United States Patent 9,782,462 (MODIFIED POLYNUCLEOTIDES FOR THE PRODUCTION OF PROTEINS ASSOCIATED WITH HUMAN DISEASE) - sequence listing, part 73

SEQ ID NO: 139374 - DNA, 1062 bp, Artificial Sequence
  Description of Artificial Sequence: Synthetic coding sequence
atgcgcgagatcgtgcacattcaggccggccaatgcggtaatcagataggcgctaagttctgggaagtaatcagtgatgaacatgggatcgacccaacaggcacatatcacggtgacagtgacctccagttaacccatagcttaggaggaggcacaggctcaggtatgggcactcttctcatttcgaagatcagggaagaatacccagatcgaataatgaacactttttcagtggtccccagtcctaaagtctcagacacagtcgtggaaccttacaatgccacactgtcagtgcaccaacttgtggaaaacacggatgaaacctactgcattgacaacgaagctctgtatgacatttgctttcgaacactgaaactgaccacgcccacctatggggaccttaatcatctggtaagcgccaccatgtccggagttacgacctgcctcaggttccccggacagttaaacgctgacttaagaaaattggccgtaaatatggtgccgtttccaaggctgcatttctttatgccaggcttcgccccattaacttcaaggggatcgcaacaatatcgggcactaacggtgcctgagcttacccagcaagtcttcgatgcaaaaaatatgatggcggcctgtgatcctcgacatggccggtacctgactgttgctgccgtctttcgtggacggatgagtatgaaagaggtggatgaacaaatgttgaacgttcagaacaaaaattccagctacttcgtcgagtggattccaaacaacgtcaagaccgccgtctgcgatattccccctcggggcttgaagatggcggtgacattcatcgggaacagcactgcaatccaggaactgtttaagagaatttccgagcagttcacagcgatgtttcgcagaaaagcattcttgcactggtatacaggtgaaggaatggacgaaatggaatttactgaagccgaatctaacatgaacgacttagtgagcgagtaccagcaatatcaggacgccacagctgaggaagaagaggacttcggggaggaggccgaggaagaggcctag

SEQ ID NO: 139375 - DNA, 1062 bp, Artificial Sequence
  Description of Artificial Sequence: Synthetic coding sequence
atgcgggaaattgtccacatccaggccggccagtgtggaaaccagataggggccaagttttgggaggtcatctcagatgaacacggtatcgaccctacaggcacttaccacggcgacagcgatctccagttgactcattctttgggaggaggtacaggctccgggatgggaactttgctgatttccaaaattagagaagaatacccagatagaatcatgaatacattctctgttgtgccctctccgaaggtaagcgacactgtcgttgagccctacaacgctaccctctctgttcatcagttggtggaaaacaccgacgaaacgtactgcatcgacaacgaggccctgtatgacatttgctttcgcacattgaagctgaccactcccacttacggggatttgaatcacttggtgtccgccacaatgagcggggtcactacctgcctaaggtttcccggacagttaaacgccgatcttagaaaactagccgttaatatggtaccatttccgagacttcacttttttatgccaggctttgctccgttaacatccaggggctcacagcagtatcgtgcgctcacagtccctgaactaacccagcaagtattcgacgcaaagaatatgatggccgcttgtgaccccagacacggccgatacctcacggtggccgctgtgtttcgtgggaggatgtctatgaaggaggtcgatgaacagatgctgaacgtccagaataagaactcttcttattttgtcgaatggatcccgaacaatgtgaagacagccgtctgcgatatcccgccccggggacttaagatggcagtcaccttcattggaaactctaccgccatacaggaactttttaagaggatctcagagcagtttactgccatgttccgccggaaggcttttctgcattggtacacgggcgagggtatggacgaaatggagttcactgaagctgagtctaacatgaatgacctggtttcggagtaccaacagtatcaggatgccactgctgaagaagaagaggatttcggcgaggaggcagaggaggaggcttag

SEQ ID NO: 139376 - DNA, 1062 bp, Artificial Sequence
  Description of Artificial Sequence: Synthetic coding sequence
atgcgcgaaatcgtacacatacaggctggccagtgcggcaatcagatcggggcaaaattctgggaggtgattagtgatgagcatggcatcgatcccactggcacgtatcacggggacagtgatctccaactcacccatagtttagggggaggcacaggttctggtatgggtactttactcattagcaaaatcagagaggagtaccctgacaggataatgaatacgttctctgtagtcccgtctccaaaggtgagtgacacagtcgtcgaaccctataacgcaactctgtctgtccatcaactcgtggagaacacagatgagacctactgcatcgataatgaagccctgtatgatatctgcttcagaacgctgaaattgaccacccctacctatggtgacctgaatcacctggttagtgctacaatgtccggcgtcacaacctgcctcaggttcccgggtcagctgaatgccgatcttagaaagctggcagtgaacatggtgcccttcccccgactgcatttctttatgcctggattcgctccgcttacgagtaggggatctcagcagtaccgcgctctcactgtgcccgagctcacacagcaggtgtttgatgccaagaatatgatggctgcttgtgaccccagacacgggagatacctgacagtagccgctgtgtttagagggcgaatgtctatgaaggaggtggacgaacagatgctgaacgtacagaataagaacagtagctactttgtggagtggattcctaataacgtgaagaccgctgtgtgcgatatcccgcctcgcggactcaagatggcggtgacctttatcgggaactcaactgcaatacaggagttgttcaaacgaattagcgagcagttcacagccatgttcaggcgcaaagcgttcctgcattggtatactggggaagggatggacgagatggagttcacagaagccgagtccaacatgaacgatctggtgagtgagtaccagcaataccaagacgccacagccgaagaggaggaagacttcggagaggaggccgaagaggaggcttag

SEQ ID NO: 139377 - DNA, 1248 bp, Artificial Sequence
  Description of Artificial Sequence: Synthetic coding sequence
atgcgtgagatcgtgcatatccaagcagggcaatgcggaaaccagatcggcgctaagttttgggaggtcatcagcgacgagcatggcattgatcctaccggtacctaccatggagatagtgaccttcaactggataggataagtgtgtactacaatgaggctaccggaggcaaatacgtccccagagcgatcctggtggacctcgaaccaggcacaatggattccgttagaagtggtccttttggccagattttcaggccggacaacttcgtcttcggtcaatctggcgctggaaataattgcttgcaggggttccaactgactcattccttgggcggaggcaccggttctggcatggggaccctcctgattagtaagatccgcgaagaatatcctgaccgcattatgaataccttttccgttgtgcctagccctaaagtctctgataccgtcgtggaaccatacaatgccacactgtctgtccaccagctcgtcgagaacacagacgagacctactgtatcgacaatgaggctctctatgatatctgcttcaggaccttgaagctgaccacccccacttatggagacctcaaccatctcgtgagcgcaacaatgtcaggagtgaccacatgtcttcggttcccgggccagctaaatgccgatctcaggaagttggctgtgaacatggtccctttccctagactacacttcttcatgccggggtttgcccctcttaccagcaggggttcccagcaataccgggccctgacagtccctgaactcacgcagcaggtgtttgatgccaagaacatgatggccgcctgtgacccgagacacgggcggtacttgaccgtcgcagccgttttccgaggaaggatgtccatgaaggaagtcgacgaacagatgttgaacgtgcaaaataaaaattcatcctatttcgtggagtggattccaaataatgtgaagaccgcagtgtgcgatatcccgccccggggcctcaagatggcggtcacctttatcggaaatagcaccgccatccaggagctgttcaaacggatttcagagcaattcacagctatgttcaggcgtaaagcctttctccactggtataccggggagggtatggatgagatggagttcacagaagccgagtcgaacatgaacgatctcgtgtctgagtaccaacagtaccaggatgctacagctgaggaagaggaagactttggtgaagaggccgaagaagaatag

SEQ ID NO: 139378 - DNA, 1248 bp, Artificial Sequence
  Description of Artificial Sequence: Synthetic coding sequence
atgcgcgaaatcgtgcatatccaggcaggtcagtgtgggaaccagatcggagcaaaattttgggaagtgattagcgacgagcacggtattgatcctacggggacctatcatggagactccgacctgcaattggaccgaatcagcgtttactacaacgaggccaccgggggtaagtacgttcccagggcaatattagtggacctggagccaggtacaatggactcagtgagatcagggcccttcggacagatctttcgtccggacaactttgtttttggacagagtggagccggcaacaattgtctgcagggctttcagttgactcattcactgggaggggggacggggagcggcatggggacgctgttaatctcaaaaataagggaggagtatcccgacaggataatgaacacattcagcgtggtgccttcaccaaaagtatccgacaccgtggtggaaccatacaatgctaccttgtctgtgcatcaacttgtggaaaatacagatgagacctactgtatcgacaatgaggccctctacgatatctgcttcagaacacttaagctcacaaccccaacatacggagacttaaaccatttggtgagcgccactatgtccggagtcacgacatgcctaaggttccccggtcagcttaatgccgatctgaggaaacttgccgttaacatggtgccatttcctagactccatttttttatgcccggattcgctcccctcacctcaagaggaagccagcagtatcgggcactcacggtgcctgagctcacccagcaggtgttcgacgctaaaaatatgatggctgcctgtgacccgagacatggccgttatctcacggtagcggctgtgtttcggggtagaatgagtatgaaggaagtggacgagcaaatgctgaatgttcaaaataagaattcgtcttattttgtcgaatggattcctaacaacgtgaaaacagccgtctgcgacattcccccccggggcctgaagatggccgtgacttttatcgggaacagtactgctatacaggagttgttcaagaggatcagcgagcagtttaccgccatgttccgccgtaaggcttttcttcactggtatacaggtgaagggatggatgagatggagttcacagaggccgaatccaacatgaatgacctggtgtcagagtatcagcagtatcaggacgctacagctgaggaagaggaggacttcggtgaggaagccgaggaagagtag

SEQ ID NO: 139379 - DNA, 1062 bp, Artificial Sequence
  Description of Artificial Sequence: Synthetic coding sequence
atgcgcgaaattgtgcatattcaggctggacaatgtggcaatcagataggcgctaagttctgggaggttataagcgatgaacatgggatcgatcccaccggtacttatcacggcgattccgacttacagctgacgcacagcctcggcggggggacaggatctggaatggggacccttcttattagcaagattcgtgaggagtatcccgaccgaatcatgaataccttttccgtcgtccctagccccaaggtgtctgataccgtcgtggagccctacaatgcaacgctttcggtgcatcaactcgttgaaaatacagacgaaacatattgcatagacaatgaggccctttatgatatttgttttcgcaccctgaaactgactacacccacatacggggatttgaatcacctggtgagtgcaaccatgtcaggtgtcacaacatgcctgcgattcccgggacagttgaatgccgatcttaggaagctcgcggtgaacatggtgcctttccccaggctgcatttctttatgcctggttttgctcctttaacttccagggggtcacagcagtatcgcgctctcacagtaccagaactgactcagcaagttttcgatgcaaaaaacatgatggcggcctgtgacccccgccatggtcggtacctgacagtagctgccgtcttccggggccggatgagtatgaaggaggtcgacgaacagatgctgaacgtgcagaataagaactcatcttactttgtggagtggatccccaacaacgttaaaaccgcggtttgtgacatcccaccacgcggtctgaaaatggccgtgacgtttattggtaattcaacagccatccaggagctgttcaagcgcatctctgagcaattcactgctatgtttcgaaggaaggctttcttgcattggtacacaggagagggtatggatgaaatggaattcactgaggcagaatccaacatgaacgatctggttagcgagtatcagcagtatcaagacgctaccgccgaggaagaggaggattttggagaggaagccgaggaagaggcctag

SEQ ID NO: 139380 - DNA, 1362 bp, Artificial Sequence
  Description of Artificial Sequence: Synthetic coding sequence
atgtccatcgttactgtccagttaggccaatgcggcaaccaaataggtttcgaggttttcgacgcactgctgagcgactctcactcatcacagggcctctgctctatgagagagaatgaggcttaccaggcctcttgcaaagagcgctttttttctgaagaagagaacggggtgccgatagccagggccgtgctggtggatatggaaccaaaagtcatcaatcagatgctttctaaggcagcacaatccggccagtggaagtatgggcagcacgcttgtttctgtcagaaacaggggtctgggaacaactgggcttacggctactccgtccacggtccaagacacgaggaatctatcatgaacataatccgcaaggaagttgagaagtgtgactcgttctccggattcttcatcatcatgagcatggcggggggtacggggagtggactgggagccttcgtaacccagaatctcgaagaccaatactccaactccttaaaaatgaatcaaattatctggccctatggtaccggcgaggtgattgtgcaaaattacaattctatcctgaccctcagccacttgtaccggtcatctgatgcattgctgctccatgagaatgatgcaatccataagatttgcgcaaaacttatgaatatcaaacaaatttctttttccgacatcaaccaggtacttgctcatcagctcggcagtgtttttcagccaacttactccgccgagtcgagctttcattatcggcgcaatcccttgggcgatctgatggagcatttggtcccccaccccgagttcaaaatgttaagtgttcgaaacatcccgcatatgagtgagaacagtctcgcgtacacaaccttcacttgggcagggctgttgaagcatctgaggcagatgcttatctcaaacgccaaaatggaggagggaatagacagacacgtctggcccccgctgagtggcctaccccccctgagcaagatgtctctaaataaggatcttcacttcaatactagtattgctaacctggtaatcttgagagggaaagacgttcagagtgccgacgtggaaggcttcaaggatcctgctctctacacctcatggctgaaaccggtgaacgccttcaacgtgtggaaaacacagcgcgccttctccaagtatgaaaagtccgcagtgcttgtatcaaactctcagtttctggtgaagcccctggacatgatcgtggggaaggcgtggaatatgttcgccagcaaagcatatatccaccaatacacaaagttcggcatcgaggaggaggatttcttggatagcttcacctcgctggagcaagtcgttgcgtcttactgtaatctgtag

SEQ ID NO: 139381 - DNA, 1197 bp, Artificial Sequence
  Description of Artificial Sequence: Synthetic coding sequence
atgagcatcgtcaccgtgcaactggggcaatgcggcaaccagatcgggtttgaagtttttgatgccttgttgtccgacagccactcttcccagggtctgtgtagcatgcgggaaaacgaggcctaccaggcaagttgcaaagagagattcttctccgaggaggagaacggcgttcctattgcccgcgcggtactggtagatatggagccgaaagtcattaaccagatgctaagtaaagccgcccaaagcgggcaatggaagtatgggcaacatgcttgtttctgccagaagcagggtagcggaaataattgggcctatggctactccgttcacgggccccgtcatgaggagtctattatgaacatcatcagaaaggaggtggagaaatgcgattccttttctgggttcttcattattatgtctatggcagggggtaccggtagtggcctgggcgcattcgtcacacaaaaccttgaggatcagtactccaacagcctgaaaatgaaccagattatctggccgtacgggaccggcgaggtgatcgttcagaattataatagcattcttaccctgtcccacttgtaccggtccagcgacgcattgctgctccacgagaacgacgctatccacaaaatttgtgctaagctgatgaacattaagcagatctcttttagtgacattaaccaagtcctcgcccaccagcttggcagcgtgttccagccaacatactcagccgagagctctttccattaccgaagaaacccccttggaatcgaccggcacgtgtggccccctctcagtggcttacccccgctgagcaagatgagcctgaataaggatttgcacttcaacacaagtattgccaacttggtgatactgcggggcaaggatgtgcagtcagcggatgtcgagggattcaaggaccctgcactctacacttcttggctgaaacccgtcaatgcattcaatgtttggaagacacagcgcgctttctccaagtacgaaaagagcgccgtgctcgtgagcaatagtcagttcctggtcaagcccctggatatgatcgtcggaaaagcatggaatatgttcgcgtctaaggcctacatccatcagtatactaaatttgggatcgaggaggaagatttcctcgatagtttcacttctctggagcaggtggtcgcaagctattgcaatctgtag

SEQ ID NO: 139382 - DNA, 600 bp, Artificial Sequence
  Description of Artificial Sequence: Synthetic coding sequence
atgtccattgtgaccgtgcagttaggccagtgcgggaaccagattggattcgaggtttttgatgccctactgagcgactcccactcatcgcaaggtctgtgttctatgagggaaaacgaagcctatcaagccagttgcaaagagagattttttagtgaggaggagaacggcgggattgatcggcacgtttggccaccactcagcgggcttccccccctctctaagatgtctctgaataaggacctgcatttcaacacgtcaatcgccaaccttgtaattttgcggggcaaggacgtgcagagtgccgatgtggaaggcttcaaagacccagcattatataccagctggctcaaacctgtaaatgctttcaacgtgtggaaaacccagcgggcctttagcaaatacgaaaagagtgcagtgttggtatccaattctcaattcctggtcaagcccctcgacatgatcgtggggaaagcttggaacatgtttgcttctaaggcatacatccatcagtataccaagtttggtattgaggaagaagattttctggatagcttcacatcgttagagcaggttgtggccagctactgcaacctgtag

SEQ ID NO: 139383 - DNA, 1056 bp, Artificial Sequence
  Description of Artificial Sequence: Synthetic coding sequence
atgtccattgtgaccgtccagcttgggcagtgtgggaatcagatcgggttcgaggtttttgacgcattgctctcagacagccattcgtcacagggcctgtgcagcatgcgagagaatgaggcataccaggcctcctgtaaggagaggtttttctctgaggaagaaaatggggtgccaatcgccagagccgttctggtagacatggaaccaaaagtcattaaccagatgttgagcaaagctgcgcagtcgggccaatggaaatatgggcagcacgcttgcttctgtcagaaacagggcagcggaaacaattgggcttacggctattcagtacatgggcctagacatgaggagtcaataatgaatatcattagaaaggaagtagaaaagtgtgactcctttagcggcttctttatcatcatgagtatggcggggggcaccggaagtggtctgggtgcgtttgtcacacagaacttggaagatcagtactccaacagcttgaagatgaatcagattatttggccttacggcacaggcgaagtgatagtacagaactataactcaatccttaccctatcccacctgtacagatcgagcgacgcactactcctacatgaaaatgacgcaatacataaaatctgcgccaagctgatgaatattaagcagatttctttcagcgatatcaaccaggtgttagcacatcagctaggctcagttttccagccgacgtactccgcagagtcctcattccactataggcgaaatcctctcgagggcttcaaggaccccgccctttatacttcttggctgaaaccggttaacgcattcaacgtgtggaaaacgcagcgcgctttctctaagtacgagaagagcgccgttttagtttccaattcccagttccttgtgaagcccctagatatgattgtaggcaaagcatggaacatgtttgcttccaaggcctatatccatcagtatactaagtttgggattgaggaggaagacttccttgacagcttcacgtccttggaacaggtcgtggccagctactgtaacctatag

SEQ ID NO: 139384 - DNA, 1191 bp, Artificial Sequence
  Description of Artificial Sequence: Synthetic coding sequence
atgagcattgttacagtccagctaggacagtgtgggaatcaaattggcttcgaggtcttcgacgccctactgagtgacagtcactcctcccaagggctctgcagcatgagggaaaacgaagcttaccaggcatcctgcaaggaacgtttcttctccgaggaagaaaacggtgtgccaatagcgcgagccgttctggtggacatggagcctaaggtgataaaccagatgttgtcaaaagccgctcagtcaggccagtggaaatacggtcagcacgcatgcttttgtcaaaagcagggctcaggcaacaactgggcctacggctatagtgtgcatgggcccaggcatgaagagtctatcatgaacattatccgcaaggaggtggaaaagtgcgatagcttcagcgggttctttatcatcatgtcaatggctggtggtaccggaagcggattaggcgccttcgtcacacagaatcttgaagatcaatactccaatagtctgaaaatgaaccagattatctggccatacggcaccggtgaagtcattgtccaaaattacaactccatcctcactctgtcacatctctaccggagctccgacgcgctgctgttgcatgagaatgacgcaatacacaaaatatgtgccaagttaatgaacattaagcaaatctccttctcagatataaatcaggtcctggcccaccagcttgggagtgtctttcaaccaacttacagtgccgagagctctttccactaccgcaggaatccgctgggagatctcatggaacatttggtgcctcacccggaattcaagatgctctcagtgaggaacataccccacatgtccgaaaattctctggcttacacaacattcacttgggccgggctgcttaaacacttacgccaaatgcttataagcaacgctaagatggaggaggggatcgataggcacgtctggcctcctctaagcggcctgccacccctgagcaagatgtccttaaacaaggatctgcacttcaatacctccatcgccaacctggtcattttacggggcaaggatgttcaatcagccgatgtgggcaaaaagttccgcgcctacatccaccagtacactaagttcggtatcgaggaggaggacttcctggactcctttacaagcctggagcaagtggtggcctcctattgtaacctttag

SEQ ID NO: 139385 - DNA, 714 bp, Artificial Sequence
  Description of Artificial Sequence: Synthetic coding sequence
atgaacatcaagcaaatctctttttctgacattaaccaggtccttgctcatcagctaggatctgtgttccagcctacctatagtgcagagagcagttttcactaccgacgcaacccacttggcgacctcatggaacaccttgtaccacacccagaatttaagatgctgtccgtgcggaacattccacatatgagcgagaattcactggcgtacacaacattcacctgggccgggttactgaagcatctgaggcagatgctcatatcaaacgcgaagatggaagagggaatagacaggcacgtctggcctcctcttagcgggttacctcctctgtccaagatgtctctgaacaaagacctgcactttaacacatccatcgctaacctcgtaattttgcggggaaaggatgtgcaaagtgctgatgttgaaggtttcaaagatcctgcactgtatacctcctggctgaagccagtgaatgccttcaatgtttggaagacccagcgcgcgttctcaaaatatgagaagtcagctgttctggtaagtaattcccagttcctggttaagccattggacatgatagtgggcaaagcctggaatatgttcgccagcaaggcctacatccaccagtacacgaaattcggcattgaagaggaggacttcttagacagtttcaccagccttgagcaggttgtggcctcatactgcaatctctag

SEQ ID NO: 139386 - DNA, 378 bp, Artificial Sequence
  Description of Artificial Sequence: Synthetic coding sequence
atgagcattgtcacagtgcagctgggacagtgtgggaatcaaataggattcgaggtgttcgacgcactgctgagcgattcccattcctcacagggcctgtgctccatgcgagaaaatgaagcctatcaagccagctgcaaagaacgcttttttagcgaagaagaaaatggggtcccaattgcgcgagccgttctggtcgacatggagcccaaggtgattaatcagatgctgagcaaagccgcgcaaagtggtcagtggaaatacggacaacacgcctgcttttgccagaagcagggaagcgggaacaactgggcttatgggcgcgacaaggactccgcctgttacccggattggagtggcaccccgggacttcaatag

SEQ ID NO: 139387 - DNA, 492 bp, Artificial Sequence
  Description of Artificial Sequence: Synthetic coding sequence
atgacgcagagtgtcgtcgtccaagtgggtcagtgtgggaaccagattggctgttgcttctgggatctcgcgttacgcgaacatgctgccgttaaccagaaaggcatatacgacgaggcaatatcttcattctttcgaaacgtcgacactagggtagtcggcgatgggggcagtatcagtaaagggaagatttgctccctcaaagctagagccgttctcatcgatatggaggaaggagttgtcaacgaaatcttacagggcccgttgagagacgtgttcgataccaaacagctcattaccgacatctctgggtccggcaataattgggctgtgggccacaaggtattcgggtcgctgtatcaggatcaaatactggagaagtttcgtaaatcagccgagcactgtgactgtctgcagtgctttttcattatccactcaatgggaggaggcaaaatctttcacagcttcgcctgtaattctgtgaaggggtag

SEQ ID NO: 139388 - DNA, 621 bp, Artificial Sequence
  Description of Artificial Sequence: Synthetic coding sequence
atggagagtgatcagaggaaggtagttggggatgggggatccatatcaaagggtaaaatctgtagtcttaaggccagggccgtattgatcgatatggaggaaggagtggtgaatgagattttgcagggtccactgagggacgttttcgacactaaacagctcattaccgatatctcgggtagtgggaacaactgggctgttggccacaaggtttttggatccttatatcaagatcagatactggaaaagtttagaaagtctgccgagcactgcgattgtctccagtgcttctttattatccatagcatgggcgggggcaccggctccgggctcggcacctttcttctgaaggtgttagaagacgaattcccagaggtctaccggtttgtcacgtccatctacccaagcggcgaagacgatgtgattacctcaccgtacaactccatcttggctatgaaagagctgaacgagcacgccgactgcgttctgcctattgacaaccagagccttttcgatataatcagcaagatcgatctaatggtgaattccggcaagctgggaactacagtaaagcctaaatcactcgtgactagttcttccggggcactcaaaaaacaatag

SEQ ID NO: 139389 - DNA, 1428 bp, Artificial Sequence
  Description of Artificial Sequence: Synthetic coding sequence
atgactcagagcgtcgtggttcaggttgggcaatgtggaaatcaaatcggttgttgtttctgggacctcgctctgcgcgagcatgctgccgttaatcagaaaggcatctatgacgaagctatatcttcattcttccggaacgtggatacccgcgttgtgggagatggcggttctatcagcaaaggcaaaatttgctccttaaaggctcgagctgtgctaatagacatggaagagggcgttgtaaacgagatcctgcagggcccactcagggatgtgtttgacacaaagcaactaatcactgatattagtggctctgggaataactgggcagtcggccacaaggtctttggatccctctaccaggatcagattctggagaaatttcggaagtccgccgagcactgcgactgtctccagtgctttttcataatccatagcatgggggggggtacaggatcagggttgggcacctttctcctaaaagtgctagaagacgagtttcctgaagtgtacaggtttgtgacatccatctatcctagtggtgaagatgacgtgatcacatcaccttataactcgattctggcaatgaaagagctgaacgagcacgccgattgcgtactgccgattgacaaccagagtcttttcgacatcatctccaagatcgatctcatggtgaactcagggaagttgggcactaccgtaaagccgaaatcgctcgtcacatccagcagtggggcactgaagaagcaacacaagaagccgtttgatgcgatgaataatatcgtggctaacttgttgctgaacttgacctccagtgctagatttgagggttccctaaacatggatctgaacgaaatctccatgaatctggtgcctttcccgcagttgcattaccttgtgtccagcctgacccccttgtataccctcacagatgttaatatccctcctcgccgtctggaccaaatgttttcggatgcattctcaaaggaccaccagcttttgcgggccgatccaaagcacagtttgtatctggcatgtgcgttgatggtgagaggcaacgttcagatctccgatctcaggcgaaatatagaacgacttaaaccttccctacagttcgtgtcttggaaccaggaaggctggaagacatccttatgttcggttccacctgtcggccattcgcactctctgctggcccttgccaataacacatgtgtgaagcctacctttatggaactgaaagagcgatttatgcgcctttacaaaaaaaaagcccatcttcaccactacctgcaggtggaaggaatggaagagtcttgttttaccgaagctgtgtcttctctctctgcactgatacaagagtacgaccaattagatgcgactaagaatatgcctgtgcaggatctgccccggctgagcatagctatgtag

SEQ ID NO: 139390 - DNA, 621 bp, Artificial Sequence
  Description of Artificial Sequence: Synthetic coding sequence
atggagtccgatcagcgaaaagttgtgggcgatgggggtagcatttctaagggtaagatttgctcacttaaggctcgagctgtgctgatcgacatggaggagggtgtcgtgaatgagatcctccagggcccccttagggacgtttttgacactaagcagctaattacagacatttctggaagtgggaataactgggcagtgggacataaggtgttcggatctctgtaccaggatcaaatcctggagaagtttcgcaaatctgcagagcattgtgattgtctgcagtgcttctttataatccattccatgggtggaggcacaggatccggcctggggaccttcctcttaaaggtattggaggacgaattccccgaggtctaccgtttcgttactagcatttatccatctggtgaagacgatgtcatcaccagcccctacaacagcatccttgcaatgaaagaacttaatgagcatgcggactgtgtgctaccaattgataaccagagtctgttcgatattatatccaagattgaccttatggtgaactcggggaagctgggtaccacagtgaaacctaagtccctagtgacatcctcttcgggcgccctgaagaagcagtag

SEQ ID NO: 139391 - DNA, 1356 bp, Artificial Sequence
  Description of Artificial Sequence: Synthetic coding sequence
atgccacgcgagatcataaccctccagctcggccagtgcggtaaccagatcggcttcgaattttggaagcagctctgtgccgagcatgggatttctcccgaggggattgtggaagagtttgcaaccgaaggaaccgaccggaaggacgttttcttctatcaggctgacgacgagcattacattccgagagcagtgctcctggacctggaacctagagtgatccacagcatcctaaatagcccctacgcaaaactttacaaccccgaaaacatctacctctctgagcacggcggcggcgccggaaataactgggcctcaggcttttcacagggtgagaagatccacgaagacatctttgacataatcgatcgggaagctgacggaagcgatagtctggaggggtttgtcctctgtcacagcatcgctggagggaccggttccgggttaggttcctatctgttggaaaggctcaatgatagatacccaaaaaagctggtccagacttatagtgtgttccccaaccaggacgaaatgtcagatgttgtggtgcaaccatacaatagcctgctcacgctgaaaagactgacacagaacgcggattgcgtggtggtgctggacaacacagcactgaaccgaatcgctacggaccggctgcacattcagaacccctcattttcacagattaaccagctggtcagtaccataatgtctgcgagtaccacaacacttcgctaccctgggtatatgaacaatgatctgattggcctcattgcgtccctcatccccaccccccgactgcacttcctcatgacaggatatactcctctgacgactgatcaatctgttgcttccgtacggaagacgactgtcttggacgtgatgcggcgcttactgcagcccaagaatgtgatggtcagtacagggagagacaggcagactaatcactgttacatcgcaatcttgaacattatccagggggaggttgaccccacgcaggtgcacaagtcacttcagcgaattagggagcggaaactggccaacttcataccctggggccctgcctcaatccaggtggccctctctcgaaagagcccctacctcccctcggctcaccgcgtatccggcctgatgatggcaaaccatacatccatctcttcactattcgagcggacttgcagacaatacgacaaattaagaaagcgtgaggcctttctcgaacagttcagaaaagaagacatgtttaaggacaactttgatgagatggacacttccagggagatcgtgcagcagctgattgatgaatatcacgcagccacccgcccagattacatatcctggggtacccaagagcagtag

SEQ ID NO: 139392 - DNA, 1356 bp, Artificial Sequence
  Description of Artificial Sequence: Synthetic coding sequence
atgcctcgtgaaattatcaccctgcagttggggcagtgcggaaatcagattgggtttgagttctggaagcagctctgtgccgaacacgggattagccccgaaggaatagtggaggaatttgctacagagggcaccgatcgtaaagacgtgttcttttaccaggcggacgatgaacattatatcccaagagctgtactgctggatttggagccgcgtgtcatccatagcatcctcaacagcccatacgctaaactgtataaccctgaaaatatctacctctctgagcatggaggtggagccggcaacaattgggcttctggcttctcacagggtgagaaaatccatgaggacatcttcgacatcatcgacagggaggctgacggaagtgatagcctcgaaggcttcgtcctctgtcacagcatagccggaggcaccggctcgggattgggctcttacctcctggaaagacttaacgatcgttatcctaagaaacttgtgcagacatactccgtctttccttaccaagacgagatgagcgacgtggtcgttcagccctacaactctttacttactctgaaacggcttacacagaacgcagactgtgtggttgttctggacaataccgccctaaatagaatcgcaaccgataggctgcacatccaaaatccctcgttctctcaaataaaccagttggtaagcaccattatgtctgccagcaccaccaccttgagatacccagggtacatgaacaatgatttgattggcttaatcgctagtcttattccaacaccacggctccattttttgatgaccggatacacacctctgaccacggaccagtcagtcgcttcggttcggaagaccacagtacttgacgtgatgcgtaggctcctgcagcccaagaatgttatggtgagcaccggcagggaccggcaaacaaaccactgttacattgccatcttgaatattatccaaggagaggtggatcctactcaagtccacaagtccttacaacggattcgagaacggaagctggccaacttcatcccctggggaccagcatcaatccaggtggcactttctagaaagtctccctatctcccctccgcacaccgagttagcggcctaatgatggccaatcacacttcaattagtagtctgttcgagtctagctgccagcaatttgataagttgcgcaaaagagacgcattcctggagcaattccggaaggaagatatgtttaaggacaactttgacgaaatggatagatctcgcgaagtagtgcaggaactcattgacgagtaccacgccgccactcaaccagactatattagttgggggacacaggagcagtag

SEQ ID NO: 139393 - DNA, 2001 bp, Artificial Sequence
  Description of Artificial Sequence: Synthetic coding sequence
atgatacacgaactgctactcgccctgtctggctatccaggatccatcttcacctggaacaaaagatctgggctgcaggtgtcacaagattttccattcctgcacccatccgagactagcgtcctgaaccgcctctgccggttgggcacggactatatccggtttaccgagttcatagagcagtatacgggacacgttcagcagcaggatcatcacccctcccagcagggtcaagggggcctccacggaatttacttgcgagccttttgtactggactggactcagtgctgcaaccctacagacaggcgctgctcgatctggaacaagagttcttaggtgatccccacctgtctatcagccacgttaattatttcctagatcagtttcaactcctgttcccctccgtaatggtagttgtcgagcagattaagagccagaagatccatggctgtcagattcttgaaacagtatataagcactcttgcggcggactgcccccagttcgtagcgctctggagaaaatcctggcagtgtgccatggcgtgatgtacaaacagctgtccgcctggatgttgcatggactcttgctagaccagcatgaagaattctttattaaacagggtccaagctcaggaaatgtgtcagcccagccagaagaagatgaggaggatcttggcatcggaggcctgactggcaagcagctcagagagctgcaggacttaaggctcattgaagaggagaacatgttagcccctagcctaaagcagttttccctaagagttgaaatcctgccatcttacatccccgtacgcgtagctgagaagatcctcttcgtcggtgagagcgtccagatgtttgagaatcagaatgtgaacttgacccggaagggatcaattctgaaaaaccaggaggatacctttgcagctgagcttcaccgtttgaagcagcagccgttgttctctcttgtggactttgaacaggttgttgataggattagaagcactgttgccgaacacctctggaaattgatggtcgaggagtccgatctcctcggtcagttgaaaatcatcaaggacttctatttgctgggccgtggagaactgttccaggcctttattgacaccgctcagcacatgctgaagacccccccaacagccgtgacagagcatgacgtgaatgtggcatttcagcaatccgcacataaggttttactggatgacgacaatctcctccccctactccacctgaccattgagtaccacgggaaggaacataaggatgcaactcaggccagagaaggccccagccgcgagacgagcccaagggaggcacccgctagcgggtgggcggcccttggtctgagctacaaagttcagtggcctcttcatatcctgttcacacctgccgttctggaaaagtacaatgtcgtcttcaagtacctcctctccgtccgcagagtgcaagctgaattgcagcactgttgggcgttgcagatgcaacggaaacacttaaagtccaaccagactgacgccatcaagtggaggcttcgtaatcacatggctttcctggttgacaacctccaatactacctgcaagtagacgtgttagagtcacagttttcccagcttctgcatcagatcaacagcaccagggactttgagtcaatccgccttgcccacgaccacttcctgtcaaacttgctggctcaaagtttcatcttactgaaacctgtgtttcactgcctgaatgagatcctcgatttgtgccacagcttctgctccctggtgagccaaaatcttgggcctctcgatgagcggggcgccgctcagctgagtatcttagtgaagggtttcagtaggcagagtagcttgttgtttaagatcctctctagcgtgagaaatcaccagattaactccgatctggctcagctcctgttacggctggattacaacaaatactatacccaggccggggggactctggggtcattcggcatgtag

SEQ ID NO: 139394 - DNA, 1029 bp, Artificial Sequence
  Description of Artificial Sequence: Synthetic coding sequence
atggttgttgtcgagcagattaagtctcagaagatccacgggtgccagatcctggagactgtctataaacactcatgcggaggcctacctcccgttcgcagtgctcttgagaaaatactggccgtctgtcacggtgttatgtacaaacagttgagcgcttggatgttgcatggactccttctagaccagcatgaggaatttttcataaagcaggggccgtcttccgggaacgtcagcgcacagccggaggaggacgaggaggatttgggcatagggggtttgacagggaagcaattgagggagctccaagatctcagactgattgaggaagagaatatgcttgcccccagccttaagcagttcagccttagagttgaaatcctgccgagttacatccctgtgagggtggctgaaaaaatccttttcgtgggagaaagcgttcagatgttcgaaaaccagaatgtgaatttgacaaggaaagggagcatactgaagaaccaggaggacacctttgcagcggaactgcaccgcctgaagcaacagcctctctttagcctggtggattttgagcaagtggtggaccgcatcagatccacggtggccgagcacctttggaagttgatggttgaagagagtgaccttcttggtcagctgaagattattaaggacttctatcttctcggccgcggggagctctttcaggcctttattgataccgctcagcacatgctgaaaacacccccaactgccgtgaccgagcacgacgtcaacgtcgcctttcaacaatctgcccataaggtgttgctggatgatgataacctgttacctcttctgcacctgacgatagagtatcacggcaaagaacacaaggccgacgccacccaagcccgggaagggccaagcagagagaccagcccaagggaagctccagcctcaggatgggccgccctgggtctgtcctacaaagtacagtggccccttcacattctctttacacctgctgtgttagagaaaaacaggcaattctag

SEQ ID NO: 139395 - DNA, 3075 bp, Artificial Sequence
  Description of Artificial Sequence: Synthetic coding sequence
atggctagacatgggccgccatggtccaggctggatgctcagcaggagagggacgttcgggagctggtgcggggagtcgcaggactgcaggatgaggctgaccccaattttcagctagcgttgaacttcgcctggtctaactttcgcttccaccgctttctcgatgtcaatagtcacaagatagagaaaacaatagagggcatatatgagaagttcgttatccactccgatttaagcaaagctgcgtcatggaagcgtctcaccgaggaatttctgaacgcgccactgccctccattaaggagataaagacagacgctcactactccattctttctttgctgttgtgtcttagtgacagcccctccaacagttcatatgtcgagacacctcgcaataaggaggtggaaaaaaaggacgattttgattgggggaaataccttatggaggatgaggagatggatattggaccatatatggatacaccaaattggagtgaggagagcgaggaagaaaatgaccaacagcccctttcccgtgaagattcaggaatccaggtggacaggacccctttggaggagcaagatcagaataggaagctggacccatgtatcagttggaaggacgagcctgatgaccgctcttggctggagcatcacgtagtgcatcagtattggacagccagaccctctcagtttccacacagtctccacctgcattctaatctggcagccgtgtgggatcagcatctgtactcaagcgatcccctttacgtgcccgacgatcgcgtattggtcaccgagacacaggtcatcagggagactctgtggctcctcagtggcgtgaaaaagttgttcatatttcagctgatcgatggcaaggtcaccgtccgtaacaatatcatcgtgacccatctaactcacagctgtcttaggagtgttctggaacagatcgctgcatacggccaggttgtgttccgcttacaagaatttatcgacgaggtcatgggtcactcaagtgagagcatgcttccgggaagcgggtcggtacccaagaagagcactgaggcgccatttcgtacgtatcaggcttttatgtgggctctgtacaagtattttatttcgtttaaagaagaactggcggagatagagaagtgcattatcaacaacgatacgacaatcaccctggcgatagtcgtggataaattagctcctcgtctgagccagctaaaggtgcttcacaaggtgtttagcacaggggtggcggaggtgccaccggacaccaggaatgtggtgcgcgcatctcacttactgaacactctctataaggcaatccttgaatacgataatgtcggagaagccagcgaacagacagtctccctcctcttcagcctctgggtggagacggttcggccatatcttcagactgtcgacgaatggatcgtacatggtcacctttgggatggagccagggaatttattatacaacgaaacaaaaacgtcccagtcaaccaccgagacttttggtacgcaacctatacactctatagcgtgagtgaaaaaacagaaaatgaagagaagatgagcgacaacgcttctgcaagcagcggttctgatcaggggcctagctccaggcaacacactatggtgagttttcttaagcccgttctgaaacagatcattatggccggaaagagcatgcagctcctgaagaatctgcaatgcgctgagtctaccacttgccaggcaggtgctagggacgccgagagaaaatctttatatacattatttctcgaaagcgtacagtcaagactaagacatggggaagatagtacacctcaggtgctgactgagcagcaggctacaaaagagaacctcatgaagatgcagagcatagctgagagtcaccttgaacttgatgacgtgcatgatccattgctggcgatcaactttgcccgtatgtacctggagcaatccgacttccacgagaagtttgctggcggcgatgtgtgtgtcgatcgctctagcgagagcgtgacatgccagaccttcgagctgaccctgcgcagctgcctgtacccacatatcgataagcagtatctcgattgctgcggaaatctgatgcagacgctgaaaaaggactataggctggtcgaatacctacaagcaatgcgcaattttttcctcatggaaggcggggataccatgtacgatttctacacctccatctttgataagattagagagaaggaaacttggcagaatgtgtctttcttaaatgtgcagctgcaggaggctgtaggccaaagatacccagaggactcttctcggttatccatcagcttcgaaaacgtagacacagccaagaaaaagttgcccgtgcacattctcgacggtttgactctctcgtacaaggtgccctggcccgtggacatcgtgattagccttgaatgtcagaaaatatataatcaggttttcctgctgcttctgcagataaaatgggctaagtactccctggatgtgctcttgttcggtgagctggtgtcaacggccgagaagcctagacttaaagaaggacttatccatgagcaggatacagtggcccagttcggccctcagaaagagccggtgaggcagcagatacatcgtatgttccttttgcgagtgaaattaatgcactttgtgaacagtcttcacaactacataatgaccagaatcctgcactcaacggggctggagttccagcatcaggttgaggaagcgaaggatcttgatcagctcatcaagatacactatcgctacctgtctacaatacatgacaggtgcctgcttcgggagaaggtgagtttcgtgaaagaagccatcatgaaagtactcaatcttgccctgatgttcgcagatggctggcaggccgggctgggaacctggcggatggaatccatcgagaagatggagagtgactttaagaactgccacatgttcctcgtcacaattttaaataaggccgtctgccggggctcttttccacatcttgaatccttggccctgtccttgatggccggtatggaacaaagctag

SEQ ID NO: 139396 - DNA, 3075 bp, Artificial Sequence
  Description of Artificial Sequence: Synthetic coding sequence
atggcacggcacgggcctccctggtcacgattagatgcccaacaggaacgagacgtgagagagctggtaaggggcgtagcaggcttacaggacgaggccgacccaaatttccaactagccctaaattttgcgtggagtaattttcggttccacaggtttctcgatgtgaactcacacaaaattgaaaagacaattgaaggcatctatgaaaagttcgtcattcactccgacttatcgaaagctgcttcttggaaacgcttgacagaggaattcctgaacgcccctctcccttcaatcaaagagatcaagaccgatgctcactattctatcttgtcactgctcctgtgcctgagcgacagcccaagtaactcttcatatgtggagaccccaaggaacaaagaagtagagaaaaaagacgactttgactgggggaagtacctcatggaagacgaagaaatggacatagggccctatatggatacccccaactggtccgaagaatctgaggaagagaacgaccagcaacccttgtcacgcgaagactccggcattcaggtggatcggaccccactcgaggagcaggaccagaatcggaaactggacccttgtatctcctggaaggacgaacccgatgaccggtcatggctcgaacaccacgtggtacatcaatattggaccgcccgaccgtcccagttcccccactcccttcacctacattcaaacctggccgcagtctgggatcagcacctttatagcagcgaccccctttacgtacctgatgatcgagtgctagtgactgagacccaagtgattcgggagacgctctggttactcagtggggttaagaagctgtttatctttcagctgattgacggtaaagttacagtgcggaacaatattattgtcacgcacctgactcactcatgtctcagaagtgtgcttgagcagatcgccgcttatgggcaagtggtgttccgcctccaagagtttatcgacgaagtcatggggcacagctccgagtctatgcttcccgggtctggcagcgttcccaagaaaagtactgaagccccgttcagaacttaccaagcattcatgtgggcgctgtataaatactttattagtttcaaggaggagctggctgagatcgaaaagtgtattatcaataatgacacgacgatcaccctcgccattgtggtggacaagctagcaccacgcctctctcaacttaaagtgctccataaggtgttcagcaccggcgtggcggaggtgccgcccgatacccgtaatgtcgtgagagcatctcacctgttgaatacactgtataaggccattcttgagtacgataatgtgggggaggcgtctgaacagactgtgtcactcctttttagtctgtgggtggagaccgtcaggccctacctgcagaccgtggacgagtggatcgtccacggtcatctatgggatggcgcgcgggaatttatcattcagagaaataaaaacgtccccgttaaccaccgcgatttctggtacgccacttatacactctatagcgtatcagaaaaaaccgagaacgaagagaaaatgtctgacaacgcctcagcttcttctgggagtgatcagggaccctcctctcggcagcatacaatggtgtcattcctgaagcctgtgctgaagcagattattatggccggaaagagcatgcaactgctgaagaatctgcagtgtgccgaatcgactacttgtcaggctggagcacgagacgcggagcgaaaatccctgtataccctgtttctcgagtctgtgcagagtcggctgcgccacggtgaggactccacgccccaggtgttgaccgaacagcaggcgacaaaagagaatttgatgaaaatgcagagcatcgccgagtcacacctggaactggacgacgttcatgaccctctgctggctatcaatttcgcccgtatgtatcttgagcaatccgattttcacgaaaagttcgctgggggcgatgtctgtgtagatcgctctagcgaaagtgtgacatgtcagacattcgagctcaccctcagatcatgcctctatcctcacattgataagcagtatctagattgctgtgggaatttgatgcagacactgaaaaaagattaccgcctcgtcgagtacctgcaggccatgcgaaacttttttctaatggaggggggagacacgatgtatgacttctataccagtatctttgataaaatccgcgagaaagagacctggcagaatgttagttttctcaatgtccagctccaggaggctgtgggccagaggtacccagaagactcttctcggttgtccattagctttgagaacgtagatactgcaaagaagaagttgccagttcacattctggacggcttaaccctcagctataaagttccatggcctgtcgatattgtcattagcctcgaatgccaaaaaatctacaatcaggtgttcctgctcttgctgcagattaaatgggccaaatactcgcttgacgtcctgttgttcggtgagctcgtatctaccgctgagaagccacggttgaaggaaggtttaatccatgagcaggacactgtggcccagttcggtccccagaaggagccggtcagacagcagattcatagaatgttcctactccgcgtgaagctcatgcacttcgttaactcgcttcataactacataatgacaagaatccttcattcgacagggctcgaatttcagcatcaagttgaggaggccaaggaccttgaccagctgatcaagattcactatagatacctgagtacaatccacgaccgctgtctgcttcgtgagaaggtcagcttcgttaaggaagctattatgaaagtactgaacttggctctgatgttcgctgatggctggcaagcgggtctcggaacctggcgcatggaatcaatagagaagatggagagcgattttaagaactgtcatatgtttctcgttacaatactcaataaagctgtgtgtcgcggctcatttccccattgcgagtatatcatgctgaaatacttctacctttgtatctcattgtag

SEQ ID NO: 139397 - DNA, 1431 bp, Artificial Sequence
  Description of Artificial Sequence: Synthetic coding sequence
atgtggaccggatacaagattctgatcttcagctatcttaccaccgagatatggatggagaagcagtacctctcacagagggaagtggacctggaagcatattttacccgcaaccacactgtgcttcagggaacccgatttaagagagctatttttcagggacaatattgccgtaattttgggtgttgcgaagaccgcgatgacgggtgcgtaacagaattctacgccgctaatgccctgtgctactgcgataagttctgcgacagagaaaattctgactgctgccccgattataagtctttctgtagggaagaaaaagaatggccaccgcacacgcagccctggtatcccgagggttgcttcaaagatggccagcattacgaggagggttccgtgattaaggaaaactgcaatagctgcacatgctccggacaacaatggaaatgtagccaacatgtctgtctggtgcggtccgagcttatcgagcaggtgaataaaggcgactatggatggaccgcacagaactatagtcaattttggggaatgactctcgaggacgggttcaaattccgactgggcactttgcccccaagccctatgttattgagtatgaacgagatgacagccagcttaccagctacaacagacctaccagaattcttcgtcgccagttacaaatggccaggatggacgcatggacctttagatcagaagaattgcgctgcctcgtgggcgttttctactgccagcgtcgctgcggatcggattgcaatccaatccaagggcagatacactgccaatctgtctccccagaatctgatctcgtgctgtgctaagaataggcatgggtgcaacagcggctccatcgacagggcctggtggtatctgaggaagaggggtctagtatcccatgcttgttaccccttgttcaaggaccaaaatgccacaaacaacggctgtgccatggcctcacgcagcgatggtaggggaaagcgccacgccaccaagccctgccctaacaatgttgaaaagagcaaccggatataccagtgtagcccaccctatcgcgtaagcagcaacgaaactgaaattatgaaagaaatcatgcagaatggaccggttcaggccatcatgcaggtgcgagaggacttctttcactataagactggtatctaccgccacgtgacctccacaaacaaggagtccgagaaatatcgaaagctccagactcacgctgtgaagctgacagggtgggggacattgagaggtgctcaaggtcagaaagagaaattttggatcgctgctaactcatgggggaagtcatggggggagaatgggtactttagaatcctgcgaggcgtaaatgaaagcgatattgagaagcttatcatagcagcatggggacagctgacatcatctgacgaaccctag

SEQ ID NO: 139398 - DNA, 1008 bp, Artificial Sequence
  Description of Artificial Sequence: Synthetic coding sequence
atgtggacagggtacaagattttgatctttagttaccttacaactgaaatttggatggaaaagcagtacttaagtcagagggaggttgatctagaggcttattttacccgcaatcacacagtgctgcaaggaacacgatttaagagagctattttccaggggcagtactgtaggaacttcggttgttgcgaagatcgggatgacgggtgtgtgacggaattctacgccgccaatgcgctttgttattgcgataaattctgtgatagggaaaattccgactgttgtcctgactacaaaagcttctgccgtgaggaaaaggagtggccaccgcacacacagccatggtatcctgagggccgatggaccgcccagaactattcccagttctggggtatgactctcgaagacgggtttaaatttcggcttgggaccctgccacccagccctatgcttttgagtatgaacgagatgactcgcctggtgagtcacgcatgttatccactgtttaaagatcagaatgcaacaaataatggatgcgcaatggcctccagatccgatgggcggggaaaacgccacgccaccaagccttgcccgaataacgtggagaaatcaaatcggatctatcagtgtagtcctccctatcgcgtgtcaagcaatgaaacagagatcatgaaggagataatgcagaacgggcccgttcaagctatcatgcaggtccgggaggatttttttcactacaagactggcatctatcggcatgtcacttccaccaacaaggagagtgaaaagtataggaaacttcagactcacgctgtgaaactcactggttggggaaccttgcggggcgctcagggacagaaggaaaagttctggattgctgccaacagctggggaaagagttggggtgaaaatggctacttcaggatcctccgcggcgtaaatgaaagcgacattgagaagctaatcattgccgcttggggacaacttacctcatccgatgaaccttag

SEQ ID NO: 139399 - DNA, 612 bp, Artificial Sequence
  Description of Artificial Sequence: Synthetic coding sequence
atggagaagcagtatctttcgcagcgggaggtcgatctggaggcctactttacacggaatcatactgtgcttcaaggcaccaggttcaaacgggcgattttccagggtcagtattgccgaaatttcgggtgctgcgaagatcgcgacgatgggtgcgtgaccgagttctacgcggccaacgccctgtgctactgcgacaaattctgtgatcgggagaacagcgactgttgcccagactacaaaagtttttgccgggaggagaaggagtggcccccccatacgcaaccctggtaccctgagggatgttttaaggacggtcaacactacgaagagggatccgtaattaaagagaactgcaactcctgtacctgtagcggccagcaatggaaatgctcccagcacgtgtgtcttgtgcgatccgagctgatagagcaggtgaacaagggggattacggatggaccgcgcagaactattctcagttctggggcatgactcttgaggacggtttcaaattccgcttgggaaccctgccaccctccccaatgcttctgtctatgaacgaaatgactgtgtcagtgccctccgactcaaggatgtgcatgtatctctag

SEQ ID NO: 139400 - DNA, 468 bp, Artificial Sequence
  Description of Artificial Sequence: Synthetic coding sequence
atggcttctaggagtgacggacgtggaaagaggcatgcaactaaaccttgccctaacaatgtggaaaagtctaatcggatttatcagtgctcgccaccttaccgagtgtcctctaacgaaaccgagatcatgaaggagatcatgcaaaacggacccgtccaggccatcatgcaggttagagaggatttttttcactacaaaaccggaatttataggcacgttacatcaactaataaggaaagcgaaaagtatcggaaactgcagacccacgccgtgaagttaaccgggtggggcaccctcagaggggcacaggggcaaaaggaaaaattctggattgccgctaactcatgggggaagagctggggcgagaatggatatttccgtatcttgcggggggttaacgagtctgatatcgaaaaactgattattgctgcatggggccaactgacctccagtgacgaaccttag

SEQ ID NO: 139401 - DNA, 618 bp, Artificial Sequence
  Description of Artificial Sequence: Synthetic coding sequence
atgagagcatggatgttcgtcagcatgcaagctgaaatctggatggaaaaacagtacctgtcccaaagagaagtggatctggaagcatatttcaccaggaaccatactgtcctacagggcacgcggtttaagcgtgccatcttccagggccagtactgcaggaacttcggctgttgtgaggatagagatgacggttgtgtaacggaattttatgcggcgaatgctctgtgttattgcgacaagttctgtgaccgggaaaatagcgattgctgtcccgattataaaagcttctgccgcgaagaaaaagaatggccccctcatacccagccgtggtatcctgagggatgttttaaagatggacaacactacgaagaaggctcagtcattaaggagaattgcaattcctgtacctgtagtgggcaacagtggaaatgttcgcagcacgtgtgtctggtgaggagtgagttgattgagcaagtcaacaaaggggactatggatggaccgcgcagaactattctcagttttggggaatgactctggaggacggttttaagtttagattgggaacgctgccccctagccccatgttgttgtcaatgaatgagatgaccgaatag

SEQ ID NO: 139402 - DNA, 3570 bp, Artificial Sequence
  Description of Artificial Sequence: Synthetic coding sequence
atgtccgttaaatctcccttcaacgttatgagtaggaataacctcgaagccccaccctgcaagatgactgagccatttaatttcgagaaaaacgagaataagctccccccccacgagagtctgcgcagccccgggaccctcccaaaccatccaaatttccgcctcaaaagctccgaaaacggaaataaaaagaataatttcctcctctgcgagcagacaaagcagtacttggcttcccaggaggacaactcagtgtccagcaatcctaacgggattaacggagaagtcgtgggcagcaaaggagataggaaaaagctacctgctggcaatagcgtgagccccccgagcgcggagagtaacagtccgcccaaagaagtgaatataaaacccggcaacaacgttagacccgccaagagcaagaagctgaacaaacttgtggagaacagcctctcaatttccaatcctggcttattcacgtctctcggaccaccactgagatcgacaacctgccatcgatgcggcctattcggcagtctgcgctgctctcagtgtaagcagacatactattgtagcacagcctgtcagcgccgtgactggtctgctcacagcatagtctgccggcccgttcagcccaattttcataagcttgagaacaagagttcaatcgagaccaaggacgttgaggttaacaacaagtctgactgtcctctgggcgtaacaaaggaaatcgcaatctgggctgagcgcattatgttctcagaccttaggtcactgcagcttaaaaaaactatggaaatcaaaggcaccgtgacggaatttaaacaccccggcgacttttatgtacagctgtatagcagcgaagtgcttgaatatatgaatcagctgtccgcctccctcaaggagacctacgcaaatgtacatgagaaggactacattcccgtgaaaggggaggtgtgcattgccaagtataccgtggatcagacctggaacagagcaatcattcagaacgtggacgtccagcagaaaaaagcacatgtgctgtacattgactacggaaatgaagagattattccactcaaccgaatctaccatcttaatcggaatattgatctgttccccccttgcgcaataaagtgctttgtagccaatgtaattcccgccgaaggaaactggtcctctgactgcatcaaggcaacaaagccattgctcatggaacagtactgctctatcaaaatcgtggatatcttggaggaggaagtggtcacttttgccgtcgaggtggaattgccaaattcaggcaagctgctagaccacgtgttgatcgagatgggttacggcttaaaaccctccggacaggattccaagaaggagaatgccgatcagagtgatcccgaagacgttggtaaaatgactacagagaacaatattgttgtggataagagcgacctgattccaaaagttttgacgttgaatgttggcgatgaattttgcggggttgtcgcacacattcagactccagaggactttttctgccagcagctccagtccggcaggaagttagccgaactgcaagcaagcctttctaagtactgtgatcagctgccgcccagatccgacttttatccagccatcggggatatctgctgtgcccagttttcagaggatgaccagtggtatagagccagtgtcctggcatatgcttcggaggagagcgtgttagtaggctatgtggattacggcaatttcgagattctgtcactgatgcggctttgccccattattcccaagctcctggaactcccaatgcaggcaatcaaatgtgtgctagctggggtgaagccatccctgggcatttggaccccagaggctatctgcctgatgaagaaactcgtacaaaacaaaatcattactgtgaaggttgtggacaaattagaaaattcatctctcgtggagttgatcgacaagagcgaaacaccacacgtgtcggtgagtaaggttctgttggatgccggttttgccgtgggggagcagtctatggtcacggataagccttcggatgtgaaggaaacttccgtcccactgggggtcgaaggaaaggtaaacccactcgagtggacatgggtcgagctgggagtggaccagaccgtggacgtggtcgtctgtgttatatacagtcctggcgagttttattgccacgtgttaaaagaggacgcattgaagaaactcaacgacctgaacaaatcactggccgaacattgtcagcagaaactgcccaacgggtttaaagctgagattgggcagccgtgttgtgctttttttgccggggacgggtcctggtatcgagccctcgtgaaagaaatacttccgaacggtcacgtgaaagtacatttcgtcgactatggaaacattgaagaagttaccgctgacgagctcagaatgatcagcagtacttttctgaatttgccatttcaggggatacgctgccaattggccgatatccagtcccggaacaaacactggagcgaggaagcaattacgagattccagatgtgtgtcgccgggataaagctccaggctcgagtggttgaagtaactgagaatggtatcggcgttgaactgactgatttatccacttgctacccccgaatcattagcgatgtccttattgacgagcacctggtcctgaaatcagcttcaccacacaaggatctgccaaacgatcgccttgtaaataagcacgaactgcaagttcatgtgcagggcctgcaggcaacctcaagcgcggaacagtggaaaaccattgagctcccagtggacaaaaccattcaggccaacgtgctggagattatttctccgaacctgttttatgccctgcccaagggtatgccagagaatcaggaaaagctatgcatgctgacggcagaattgcttgagtattgcaacgcacctaaaagccgcccaccataccgacccaggattggtgacgcttgctgtgccaaatataccagcgacgatttttggtaccgggctgttgtgctgggcacctctgacaccgatgtcgaggttttgtacgccgattatggtaacatcgaaaccctgcccctctgtcgggtgcagccaattacatccagtcacttagccctgccgttccagataatccgatgttccctggaaggcctcatggaactgaatgggagttcctcccagctaattatcatgctcctgaagaattttatgcttaaccaaaacgttatgctcagcgtgaagggcataacaaagaatgttcatacagtctccgtagagaagtgctcagagaacggcacggtggacgtcgcagataagctcgtcacttttggcctggccaaaaacatcaccccccagcgccagagcgctctcaataccgagaaaatgtaccgtatgaattgctgctgtaccgaactgcagaagcaggtggagaagcatgaacacatactgctttttcttcttaacaattccactaaccagaacaaatttattgaaatgaagaaactgctcaaaaagaccgcctccctgggtggcaaacccctgtag

SEQ ID NO: 139403 - DNA, 3315 bp, Artificial Sequence
  Description of Artificial Sequence: Synthetic coding sequence
atgagcgtcaaaagccccttcaatgtcatgtctcgaaataatttggaagctcctccgtgcaaaatgacagaaccctttaacttcgagaaaaatgaaaacaaactgccaccccatgaatctctgaggtctccagggaccctgccaaaccaccccaatttcaggctaaaatccagcgagaacggaaacaagaaaaataactttctgctttgcgaacaaacgaaacagtacctggcctcacaggaggacaactcggtctcgtcaaatccaaatggcatcaacggtgaggtcgtggggagcaagggcgataggaaaaagctgcccgccggtaatagtgttagcccaccctcagccgaatcgaatagtccacctaaagaggtgaatatcaagccaggcaacaatgtgcgcccagcaaagtccaagaagttaaacaagctggttgagaattctctctctattagcaacccgggattgttcacctcattggggcctcctctcaggagtaccacgtgtcatagatgtggcctcttcgggtctttaagatgtagccagtgcaagcagacatactactgcagtaccgcttgccagaggcgggactggagtgcccacagcattgtctgcaggcccgtccaacctaatttccacaaactcgagaataagagctctatcgagactaaggatgtggaagtcaacaataaaagcgactgccctctgggcgtcacaaaagaaattgccatttgggccgaaagaattatgttttccgacctgaggagcctgcagctgaaaaaaacaatggaaattaagggaaccgtgactgagttcaaacatccgggagacttttatgttcaattatactctagcgaggtgctggaatacatgaatcagctctccgccagcctgaaggagacgtacgccaatgtgcatgagaaagactatatcccggtgaagggagaggtctgtattgcaaaatacaccgtggaccagacttggaacagggctataattcaaaacgtggatgtgcagcagaagaaggcgcatgtcctctacatagattatggaaacgaagaaataatcccgcttaatagaatatatcatctgaatcgtaatatcgatctgttcccaccatgcgcaattaagtgctttgtcgcaaacgtgatccccgccgaaggtaattggtcatcggactgtattaaggccaccaagccactgcttatggagcagtattgctctatcaagatcgtcgatattttggaggaagaagtggtgacatttgccgtggaagttgaactgccaaacagcggaaaactgctcgatcacgtccttattgaaatggggtacgggctgaagcctagcgggcaggacagtaagaaagaaaacgccgatcagagtgatcccgaggacgtgggaaaaatgactacagaaaacaatattgtggtcgacaagtccgatttaattcctaaggtcctgactctgaatgtgggcgacgagttctgtggtgtggtcgctcatattcagacacccgaggattttttttgtcagcagcttcagagtggcagaaagcttgccgagctccaagcgtcactctccaagtattgcgaccagttgcctccacgctcagatttctaccctgctatcggagatatttgctgcgctcagttctcagaagacgatcagtggtaccgggcgtccgtgttggcctatgccagcgaggaatcagttctggtgggttatgtagattatggaaattttgaaatacttagtctcatgcggctttgccccattatcccgaaactgctggaattgcccatgcaagctataaaatgcgtgctggccggcgtaaaaccaagcttgggcatatggacaccggaagcaatctgtctgatgaagaagttggtgcagaacaagataatcactgtgaaagtagttgacaaactggagaacagctcgctcgtggagttgattgataagagcgaaaccccccatgtgtctgtttctaaagtactgctagatgcagggtttgctgttggggaacaaagtatggtgacggacaaaccatccgatgtcaaagaaacatcagtgcctctgggtgtcgaaggcaaggtgaatccactggagtggacctgggtggaattaggagttgatcagacagttgatgtcgttgtctgcgtgatctacagtccaggcgagttttattgtcatgtgttgaaagaggatgcactgaaaaagctcaatgacctgaacaagtccttggccgaacactgccagcaaaaacttccaaacggttttaaggccgagattggccagccctgttgcgcctttttcgccggggacggctcttggtaccgtgcactggtgaaagaaatcttgcccaatgggcatgtgaaggtgcactttgtagattatggtaatatcgaggaggtgaccgcagatgaactgaggatgatatcaagtaccttcctgaatctgcccttccaaggcattcggtgtcagttggcagacatccaaagtcgcaataaacactggtcagaagaggcaattacaaggtttcagatgtgtgtggccggcattaaattacaggccagggtggtggaggtgaccgaaaacgggattggcgtcgagctgacagatttgtcaacatgctatccaagaattataagcgatgtgctgattgatgagcatttggtgctcaagtccgcttcaccacacaaggatctccctaacgaccgcctggtgaataagcacgaactacaggtgcacgtgcagggcctgcaagctactagttcagccgagcagtggaagacaatcgagctgcctgtggacaagacaattcaagcaaacgtgctggaaattatttctccaaatctattttacgcactgcccaaaggaatgcccgagaaccaggaaaaactgtgtatgctcacagctgagcttctggagtactgtaatgccccaaaatctcggccgccctatagaccccgtataggagatgcgtgctgcgccaagtacacaagtgacgacttctggtacagggctgtggtgctggggacttccgatacagacgtggaggtgctgtatgctgactacgggaacatcgaaacacttccgctctgccgcgtgcagccgatcacctcctcccatctagctctgccctttcagattataaggtgctctcttgaagagaaaatgtaccgcatgaattgctgttgcacagagttgcagaagcaggtcgagaaacacgaacatatcctgttgtttctgctcaataacagcactaaccaaaataaattcatagagatgaaaaagctactgaagtcatag

SEQ ID NO: 139404 - DNA, 3228 bp, Artificial Sequence
  Description of Artificial Sequence: Synthetic coding sequence
atgtccgtgaagtcccccttcaacgtcatgagtagaaataacctcgaggccccaccttgcaagatgacggagccatttaactttgaaaagaacgaaaacaagctcccgccccacgaaagtctgcggtcgcccggtaccctgccgaaccacccaaacttccgattaaaaagctcagaaaacggcaacaaaaaaaacaactttttgttgtgcgagcagacaaagcaatacttagccagccaggaagataactcagtatcaagcaaccctaacgggatcaacggtgaggttgtgggttctaaaggagatcggaagaagctgccagcgggaaatagcgtcagcccaccttctgctgagagtaactcgccaccaaaggaggtcaatattaaaccaggtaacaatgtgcgtccagccaagtccaagaagttaaataagctggtagagaactccctgtccataagtaatccagggctgtttacttcgttgggccccccattgagaagcaccacctgccacaggtgtggcctctttggcagtcttcggtgttctcaatgcaagcagacctactattgttccacagcttgccagcggcgggactggagcgcccacagcatcgtctgccggccagtgcagcctaactttcacaagctggagaataagagcagcattgagactaaggacgtcgaggtgaacaacaagtccgattgtccgctgggcgtcaccaaggaaatcgcgatctgggccgagaggatcatgttcagcgatttaagatcacttcagctgaaaaaaaccatggagattaagggaacagtcaccgaattcaagcaccctggcgatttctacgtacaactgtatagtagtgaagtgttagagtacatgaaccagctgagcgccagtttgaaggagacatatgccaatgtgcatgagaaggactacattccagtgaagggggaggtatgtattgcgaaatacactgtggatcagacatggaacagagctatcatccagaacgtggatgtgcagcagaaaaaggcccatgtgctctacatcgactacggaaatgaggaaataataccactgaacaggatctatcatctgaaccggaacatagatctcttccccccctgcgcgatcaagtgcttcgtagccaatgttatccccgcagaaggcaactggtcttcagactgcataaaggcaactaaacctctgttaatggaacaatactgctccatcaagattgtagatatccttgaagaagaagtcgtgaccttcgccgtcgaggtggagttacccaattcagggaagcttttagaccacgtcctcatcgagatgggatatggcctcaagccatcaggacaggactctaagaaggagaatgctgatcaaagcgatccagaggatgttggcaaaatgactaccgaaaataacatcgtggtggataaaagtgatctcattccaaaggtacttactctgaatgtcggcgatgaattctgcggagtagtggcccacatccagacgcctgaggacttcttttgccagcagctccagtcaggccgcaaattggccgaactgcaggcttctctatctaaatactgtgatcagcttccccctcgctctgacttctatcccgcaatcggtgacatttgttgtgcgcagtttagtggagtcaagccctcgctagggatttggacgcccgaagctatctgcctgatgaaaaaactcgtgcagaataagatcatcactgtgaaggtggtggacaagctcgaaaactcctctttagtcgaactcattgacaaatcagaaacccctcacgtcagtgttagtaaggtgctcctcgacgccgggttcgccgtgggagagcagtctatggttacagacaagccgagcgacgtaaaggagacctcagtgccattgggagttgaggggaaagtgaaccctcttgaatggacctgggtcgagcttggggtggaccaaacagtggacgtggttgtctgtgtaatttacagcccaggagaattttactgccatgtattaaaggaagacgctctcaagaagctgaatgatctgaacaagagtctggcagaacactgtcagcagaagttacctaacgggtttaaggccgaaatcggccaaccttgttgcgcatttttcgccgacatccaatctaggaacaagcattggtctgaagaagcgattacccgatttcagatgtgtgtggccgggattaagctgcaagcgcgcgtggtggaagtgactgaaaatggcataggcgtggagctgactgatctaagcacctgctaccctcggattatctcggatgtcctgatagatgaacacctggttcttaagagtgcttctcctcataaagatctacctaatgaccgtctggtcaacaagcatgaattgcaagtccacgtccagggtttgcaggccactagctcagcggagcagtggaaaaccatcgagctccccgtagataagactatacaagcgaatgtgctcgagatcatttcgcctaatctgttttatgccctacccaaaggaatgcctgagaatcaggagaaactgtgtatgctgacagcagaactccttgagtactgcaacgcccccaaaagccggcctccatatcgaccacgcattggcgatgcctgttgtgctaagtacacttccgacgacttctggtacagagcagtggtgttaggaacttcagacacagatgttgaggttctgtatgcagactacgggaatatagagaccttacccctgtgccgggttcagccaattacttccagccacctggcattaccttttcagataattcgatgctctctggaggggttgatggaactgaacgggtcatcctctcagctgatcatcatgttattaaaaaactttatgttgaaccaaaacgttatgttgtccgttaaagggatcactaaaaatgttcacacagtgtctgtcgagaagtgcagcgagaatggaacagtggacgtcgcggataagctcgtgacttttgggttggccaaaaacattactccgcaacgtcagtccgccctaaacacagaaaagatgtaccgcatgaactgctgttgtaccgagctccagaagcaggtggaaaaacatgaacacattctcctctttttactgaacaatagcaccaatcagaacaagtttatagaaatgaaaaagctgcttaaaaagactgcaagcctgggcgggaagccactctag

SEQ ID NO: 139405 - DNA, 3342 bp, Artificial Sequence
  Description of Artificial Sequence: Synthetic coding sequence
atgtccgtgaaatcccctttcaacgtcatgagtcgcaacaacctggaggctcctccctgtaaaatgacagagcctttcaactttgagaagaacgaaaataaactccccccccatgaatccctgagaagccccggtaccctgccgaaccaccccaactttagattgaagtcatccgaaaacgggaataaaaaaaacaattttctgctatgcgaacaaaccaaacagtatctggctagccaggaagataactcagtctcttctaacccaaatgggatcaatggcgaggtcgttgggtcaaaaggcgaccgcaaaaaactcccagccggaaatagtgtttcccccccttccgctgagagcaacagtccacctaaagaagtgaatattaagcccgggaacaacgtcagaccagcaaagtccaagaaactgaacaagctagttgagaactccctgtcaatctccaatcctgggctcttcacctcccttggaccccccctaagaagcaccacatgccataggtgtggcttatttggctcactcaggtgcagccagtgtaagcagacctattactgctcaactgcatgtcagcggcgcgactggtctgcacatagtatcgtttgccgtccagttcagccaaattttcacaaactcgagaataagtcttccattgagactaaagatgtcgaggtcaacaataaaagcgattgccccttgggcgttaccaaagagattgccatttgggcggagcggattatgttctctgacttgagatcactgcagctgaagaagacaatggagattaagggaactgtgacagagttcaaacaccctggtgatttctatgtgcaactatatagcagcgaagtcctggaatacatgaatcagttaagcgctagtctgaaagagacatatgccaacgtacatgagaaagattatatcccagtgaagggcgaggtctgtatcgctaaatacaccgtggaccagacctggaaccgcgccattattcagaatgttgacgtgcagcagaaaaaggctcacgtcctatatatagattacgggaatgaagaaatcatccctctgaataggatttaccacctgaaccggaatatcgatctgttcccaccttgcgctattaaatgctttgttgcaaatgtgattcctgcagaagggaactggagttcagactgcattaaagcaacaaagccactgctgatggagcaatattgtagcattaagatcgtggacatccttgaagaagaggtggtgactttcgcggtggaggtggaacttcctaactctgggaagctcctagaccacgtccttattgagatgggatacggactgaagcctagcgggcaagatagtaaaaaggaaaacgccgatcaaagcgaccccgaggacgtcgggaagatgacaaccgagaacaacattgtggtggacaagagtgatctcattcctaaggtgcttactctgaatgtaggagacgagttttgcggcgtcgtggcgcacatccaaacaccagaggattttttctgccaacagctacagagtggacggaaattggcagagctacaggccagcctgtccaaatattgtgatcagctgcccccacggtctgacttctacccggctatcggagacatctgctgtgcccaattcagtgaggacgaccagtggtaccgggcgtctgttcttgcatatgcctctgaggagtccgtgctcgtcgggtacgtggattatgggaattttgagatactgagcctcatgcgcttgtgtcctattatccctaaactgttggagctccccatgcaggctatcaaatgcgtactggcaggagtcaagcccagcctgggtatttggacgcccgaggccatttgcctcatgaagaaactggtccaaaacaagataataacagtgaaagtagtggataaactagaaaattcttcactagtggaactcatcgataagagcgaaacaccgcacgtcagtgtttccaaagtcctgcttgatgctggcttcgcggtgggggagcagagcatggtgacagacaagccctctgatgttaaggagacctcagtcccactgggcgtcgaagggaaggtgaaccctcttgagtggacctgggtcgagctgggtgtggaccagaccgtggacgtggttgtgtgtgtcatctacagtcctggggagttttattgccatgtattaaaagaggatgccctgaaaaaacttaatgacttaaataagtccctcgccgaacactgtcagcagaaactcccaaacggctttaaggccgaaattggccagccatgttgcgcattcttcgcgggggacgggtcctggtatagggctctggtgaaagagatcctgcctaatgggcacgtgaaagtgcactttgtcgattacggtaacattgaagaggtgaccgcagacgagctgaggatgatctctagcacctttctcaacctgccttttcaagggatcaggtgtcagttggcggacatacaatctaggaataagcactggtccgaggaggccatcactagatttcagatgtgcgtagccggaattaagttgcaggcacgcgttgtggaggtgacagagaacgggatcggcgtcgaattaacggacctctctacgtgttatccccgcatcatctcggatgtgctgatcgacgagcacctggtgcttaaaagtgcttctccccataaagaccttccaaatgatcgccttgttaataagcatgagctgcaagttcacgtccaggggctacaggctacaagttctgccgaacagtggaagactattgaactcccagtggataagaccatccaggctaacgttctagagatcatcagcccaaatcttttctacgcactgcctaagggtatgccagagaatcaggagaaactttgtatgttaacagctgaacttttagaatactgcaatgccccaaaatccagaccaccgtataggcctagaataggtgacgcatgttgtgctaagtacacatctgacgatttttggtaccgggctgtcgtcctgggaacatcggacacagatgttgaggtgctctatgctgattacggtaatatcgagacacttccgctttgtcgcgtgcagcccatcacgtcaagccacttagcccttccgtttcaaataattcgctgctccttagaagaaaagatgtaccgtatgaattgctgctgtaccgagctgcagaaacaggttgaaaagcacgagcacatactactctttctgctcaacaattctactaaccagaacaagttcatcgagatgaagaaactgcttaagaaaacagcgtcccttggcggaaaacctctgtag

SEQ ID NO: 139406 - DNA, 2154 bp, Artificial Sequence
  Description of Artificial Sequence: Synthetic coding sequence
atgaaccagcttagtgcctctttgaaagaaacttatgcaaatgtgcatgaaaaagactatattccagtcaagggggaggtctgtatcgccaaatacaccgtcgatcaggccatcaagtgttttgttgcgaacgtcatccccgctgaaggaaactggtctagcgactgcatcaaagcaaccaagcccctgttaatggagcagtactgttcaatcaagatcgttgatatcctagaagaggaagttgtgacattcgcagtggaggtcgagctgcccaattccgggaagttactagaccatgtactaattgagatgggctacggactgaagccctctggtcaggacagtaaaaaagagaacgctgatcagagtgaccctgaggacgttggcaaaatgaccaccgagaacaatatcgtggtcgataagagcgaccttatccccaaagttctcactctgaacgtgggcgacgagttctgtggtgtggtagcgcacatccagactccggaagactttttctgccagcagctccagtcaggacgtaagctggccgaactgcaggcctcactgagcaagtactgtgaccagctgccccctaggagcgatttctacccagcaatcggggatatttgctgcgcccagttctctggcgtgaaaccttcccttggcatttggactccggaagcaatttgtcttatgaagaaactggtgcagaataagattatcaccgtgaaagtggtcgacaaactagaaaactccagtctggtggagctgatcgacaagtccgagactcctcacgttagcgtatctaaagtcctgctggatgctggtttcgccgtgggtgaacagagtatggtgaccgacaagccaagtgatgtaaaagaaacctctgtcccgctcggagtcgaaggcaaagtcaacccgcttgagtggacatgggttgaactcggtgttgaccagacggtggacgtggtagtttgtgtgatttactcccctggagaattttattgccatgtcctcaaggaggatgccctgaagaaattgaacgatcttaataaatccctggcagagcactgccaacagaaactccccaacggcttcaaagcagaaatcggacaaccgtgttgtgcttttttcgccggcgacggctcttggtacagagcactggtgaaggagatactgccaaatggccacgtgaaagttcacttcgtggattatggtaatatagaggaagttacagccgatgagctccgaatgatttcatcgaccttcctcaatttgccctttcaggggatcaggtgtcagctggcggacatacagagcaggaacaagcattggagtgaggaggcaattacaagattccagatgtgcgtggcgggtatcaaattgcaggccagagtggtggaggtcaccgaaaacggaataggagtcgagctgaccgatctgtcaacgtgttacccccggattatctccgatgtgctgattgacgaacatctggtgctcaagagtgcttctccacacaaagatcttcccaacgacaggctggtcaataaacatgaactgcaagtacatgttcaaggacttcaggccacaagttcagctgaacaatggaagaccatagagctgcctgtggacaaaacgattcaggccaatgttctcgaaattatatcccccaacctattttacgccttgcccaagggcatgccagagaatcaggagaaactgtgcatgctgacagccgaactactcgagtactgcaacgcacctaagtcgaggcctccttaccggcctaggatcggagatgcctgttgtgctaagtacacttccgacgacttttggtacagagccgtcgttcttggcacctctgacaccgatgttgaggtcctgtacgccgattacggaaacattgagacacttcccctatgccgggtgcaaccgatcacgagcagtcacctggcgctgcccttccagattatcagatgctccctcgaggaaaagatgtatcgcatgaactgttgttgtaccgaattacagaaacaagttgagaagcatgagcacatccttctgttcttgcttaataacagtaccaaccaaaacaagttcatcgaaatgaaaaagcttctgaaaaaaacggcaagcctcggcggtaagccgctctag

SEQ ID NO: 139407 - DNA, 1956 bp, Artificial Sequence
  Description of Artificial Sequence: Synthetic coding sequence
atgctgagacttcagatgactgacggtcacatatcttgtactgcagtcgaattcagttacatgtcaaagatatccctaaatactccccctggcaccaaggtaaaactgagcggtatcgtcgacattaagaacggcttcttgttgctgaatgatagcaataccactgtgctcggaggcgaagtagagcatttaattgagaagtgggagctgcagcgttccctatccaagcacaaccggtcgaatatcggcacggagggaggtccacctccattcgtaccttttgggcagaaatgtgtgtcccatgtccaggttgacagccgagaactcgatcgcagaaaaacattacaggtgactatgccggtgaagcctaccaacgacaacgatgagttcgaaaaacagcgtactgctgctattgctgaggtggctaagtccaaggagactaagacattcggtgggggcggcggcggagcaagaagcaatcttaatatgaacgctgccgggaatcgaaatagggaggtactgcagaaagaaaagtccaccaagagcgagggaaagcacgagggagtgtatcgtgaactcgttgacgaaaaagcactgaaacatataactgagatgggcttttctaaggaagcaagtagacaggctctgatggataacggcaataatcttgaagcggcgttgaacgtcctgctgacaagcaataaacagaaaccagtgatggggccacccctaaggggccgcggaaaaggccgggggcggatccggtcggaggatgaagaagaccttggcaacgcacgcccttcggcacccagcaccctgtttgacttcctggaaagcaagatgggcaccttgaatgtggaggagcctaagtcccaaccccagcaactgcaccaggggcagtataggagtagcaataccgaacagaacggcgtaaaagataataaccatctgcgccaccccccccgcaatgacacacggcagcccagaaacgaaaaaccccccagattccagcgtgactctcagaactcaaaatcagtactggagggatcaggcctgccacggaatagaggttcagaaagaccctccacgtctagcgtgtcagaggtttgggccgaggatagaattaagtgcgatcgcccgtattcccggtatgaccggacgaaagatacatcctacccactcggatcacaacacagtgacggcgcattcaaaaagagagataactctatgcagtcccgtagcggaaagggaccaagtttcgctgaagccaaagagaacccactgccccaggggagcgtcgactacaataatcagaagcgcggcaaaagagaatcacagacttctattccagattacttctacgatagaaagtcccagaccattaataacgaggctttctccgggatcaaaatcgaaaagcacttcaacgtgaatacagattaccaaaacccagtacggagcaacagtttcatcggcgtccccaatggagaagtggaaatgccactgaagggaagacgaatcggacccatcaagcctgctggacccgtcactgccgtaccctgcgacgataagattttttacaatagtggcccaaagcggcgaagcggcccaattaagccagaaaagattcttgagtcttcgattcctatggagtatgccaagatgtggaagcccggggacgagtgttttgccctctattgggaagataataagttttaccgggccgaggtggaggccctccactcctccggaatgaccgccgtggtgaagtttatcgattatggaaattacgaggaggtcttactgagcaatataaagcctatccagactgaagcatgggaagaggagggcacttacgaccaaaccctcgagtttcggcgtgggggggatggacagccgcgaagatccacgaggcctacgcagcagttctaccagccacctcgagctagaaattag

SEQ ID NO: 139408 - DNA, 1956 bp, Artificial Sequence
  Description of Artificial Sequence: Synthetic coding sequence
atgctgagattgcagatgactgatggccacattagttgtactgcggtcgagttttcttacatgtctaagatctcattaaacactcccccaggaaccaaggtgaagctgtcgggcatcgtggatattaagaacggtttccttctgctaaacgatagtaataccactgtactgggaggagaagtcgagcacctgatcgagaagtgggaactccagagaagcctgagtaaacataatcgtagcaacataggaacggagggcgggcctccacccttcgtgccctttggacaaaagtgtgtctctcatgtccaggtcgattcgcgcgagctggataggaggaagacacttcaggtaaccatgcccgtgaagcctaccaatgataacgacgagttcgaaaagcagcgaacagcggccattgccgaagtggccaaaagtaaagaaaccaaaacttttggtggggggggtggaggagcacgctccaacctgaacatgaacgcagctgggaatcggaaccgggaagtgctgcagaaggagaaaagcaccaaaagtgagggcaagcacgagggggtatatagagaactagttgatgagaaggcactgaaacatattaccgagatggggttcagcaaggaagcaagccggcaggcccttatggacaatggtaataacttggaggcggcactgaacgtcctgctgacatcaaataaacagaagccagtgatgggaccaccattacgcggcaggggcaagggaagaggccgtatcagatctgaagacgaggaggatttaggcaacgccagacccagtgccccgtccacactttttgactttttagaatccaaaatgggcaccttgaatgttgaggagcctaagagccaaccccagcaactgcatcaaggccagtacaggagctctaacactgaacaaaacggagtcaaggacaacaatcatcttaggcaccctccgaggaatgacacacgccaaccacgtaatgagaaaccccctcggttccaacgggatagccagaattccaagagcgtgctggaaggtagtggtcttccccgcaatcgcggatccgagaggccatcaacaagcagtgtcagcgaagtgtgggccgaggatcgtattaagtgcgacagaccttactcacgctatgaccgcaccaaagatacctcatacccactgggctcccaacactccgacggtgccttcaagaagagggataactcaatgcagtcacgctccggcaagggcccaagtttcgcagaagccaaagaaaatcctctgcctcagggctctgtggactacaataatcagaagcgcggtaaacgagaatcacagacgtcaatcccggattacttctatgacaggaaaagtcagactatcaataacgaagccttctctggcatcaaaattgaaaagcatttcaatgttaacacagattaccaaaatcccgtgcgatcaaattcttttatcggtgtgcctaacggcgaggttgagatgcccctgaagggcaggcgaattgggcctatcaagcctgccggccctgttaccgccgtgccctgcgacgataagatcttctacaattcagggccaaaacgaaggtcgggccccataaaacctgagaagattctggagtccagtataccaatggagtatgcaaagatgtggaagcctggcgatgagtgttttgctctatactgggaggataataagttctaccgcgccgaagtggaggccctgcacagttctggaatgacagctgtggtaaagttcattgactacggcaattacgaggaagtgctcctttcaaacattaagccgattcagactgaggcctgggaagaggaaggcacatatgaccagactcttgagtttcggaggggtggcgacggacagcctcgacgcagcacgcggccaacacaacagttctatcagccccctcgggctcggaactag

SEQ ID NO: 139409 - DNA, 390 bp, Artificial Sequence
  Description of Artificial Sequence: Synthetic coding sequence
atgcttcgcctgcagatgacggacggccacatttcctgcacagccgttgagttcagctacatgtctaaaatcagcctcaatacaccacccggcacaaaggtgaagctttctggaatcgtagacatcaaaaacgggtttctcttgctaaacgacagcaacaccacagtactgggtggggaggtggagcatctaatagagaagtgggagctgcaacgaagcttaagcaaacacaaccgctccaacataggaactgagggtgggccaccaccattcgtgcctttcggccagaaatgtgtgagtcacgtgcaagtcgattccagagaactggatcggcgaaaaacgttacaggtgacgatgccggtaaaaccaactaacgacaatgatgaatag

SEQ ID NO: 139410 - DNA, 1956 bp, Artificial Sequence
  Description of Artificial Sequence: Synthetic coding sequence
atgctgagactgcagatgactgacggacatatcagctgtaccgcagtggaatttagctacatgtctaagatcagcctgaatactccccccgggactaaggtcaagctgtcaggaatcgtggatatcaagaacggttttctgttacttaatgattctaataccacagtcctaggaggcgaggtagagcatctcatagagaaatgggaacttcagagatccttaagtaaacacaatcgctctaacatcggtaccgaaggcggcccacctccttttgttccttttggccagaagtgcgtgtctcatgtgcaggttgactcccgtgaactcgaccgcagaaagacgctgcaggtgacaatgccggtcaagcccaccaacgacaacgacgagttcgaaaagcagcgcaccgctgcaattgccgaagtggccaaatctaaggaaactaagacatttggcggtgggggaggcggggctcgcagcaacctcaatatgaatgcagccggcaaccgcaatcgcgaagtgctgcagaaagaaaaatctaccaagagtgagggaaagcacgaaggcgtttaccgagagctagtagacgaaaaggccctgaaacacatcactgagatggggttttctaaagaggccagccgacaagctcttatggataatggtaacaatctggaggcggcccttaacgtgctgttgacctccaacaagcagaagcccgtcatgggcccccccctgcgcggccgtggtaaagggcgaggccgaatccgcagcgaagatgaagaggacctgggaaacgcacggcccagtgcccccagcaccctgtttgactttctcgagtcgaaaatgggtaccctcaatgtggaagagccaaagtcacagccccagcaactgcatcaaggtcagtaccgatctagcaacactgagcagaatggcgttaaagacaacaatcaccttcgtcacccacccaggaatgatacccggcaacctaggaacgaaaaacctcctaggttccaacgggatagtcagaattccaagagcgtacttgaaggctccggactcccaaggaatcggggctctgaacggccgagtacgagttccgtgagcgaggtgtgggccgaagaccggatcaagtgtgaccgaccttacagccgttacgaccggacgaaggatacgtcgtatcctttaggaagtcagcattccgacggagcttttaagaaaagagacaattccatgcagagccgctcaggaaaaggcccatccttcgccgaggcaaaggagaatcccttacctcagggctccgttgattacaacaaccagaagcgcgggaaaagagagtcccagacgtctataccagattacttttacgatcgtaagtctcagacaatcaataacgaagccttcagcggcatcaagatcgagaagcatttcaatgtgaacaccgattatcaaaaccccgtgaggtctaattcttttatcggcgtgccaaacggagaagtggagatgcccctaaaaggacgcaggatcggaccaattaagccggccggccccgtgacagccgtgccctgcgacgataagattttttataatagcggacccaagaggagaagtggtcccataaaacctgaaaaaatccttgagtcctctatacctatggaatatgcaaagatgtggaaaccaggcgatgaatgtttcgccctatattgggaggacaacaaattctatcgtgccgaagtcgaagcattgcattctagcggcatgacagctgtggtgaagttcatcgactacggaaattacgaggaagtcctgctgtccaacatcaagccaatccagaccgaggcatgggaggaagaagggacttacgaccagactctcgagtttagaagaggcggtgatgggcagccgagacgctccacaagaccaacacagcagttctatcagccaccgcgagcgcggaattag

SEQ ID NO: 139411 - DNA, 2235 bp, Artificial Sequence
  Description of Artificial Sequence: Synthetic coding sequence
atggcccaggtggccggtgcagctctttcccaggccgggtggtacctatccgatgagggcatcgaggcctgtacaagcagcccagataaggtgaatgtgaatgacatcatacttatagcgctgaatacagatctgaggaccattggcaagaaatttttgccctctgacattaactctggaaaggtggagaagttagaaggaccctgtgtcctgcagattcagaagatccgcaatgtggccgccccaaaggacaacgaagaatcccaggccgcacctcgcatgttaagattgcagatgactgatggccatatatcctgcactgctgtcgagttcagttacatgagcaagatcagcctgaatacgccgccaggtaccaaagttaaactctcaggcattgtggacattaagaatgggtttctccttttaaatgatagcaatacaaccgttttaggaggtgaagtggagcatctcattgaaaaatgggagctgcaaaggtccttaagcaaacacaatcgcagcaacatcggcactgagggcgggccacctccttttgtgccgttcggacaaaaatgcgtctctcacgttcaagtcgattcccgtgaacttgatagacggaaaactctccaagtaactatgccagtgaaaccaacgaacgacaatgatgagttcgagaagcagcgaacggcagctattgccgaggtggccaaatcaaaggagactaaaacatttggagggggaggagggggcgccaggtcgaacctcaatatgaacgctgcgggaaacaggaatcgagaagtgctgcagaaagagaaatctacaaagagcgaagggaagcacgaaggagtgtacagggagctggtggatgaaaaagccctcaaacatataacagagatggggtttagcaaggaggccagcaggcaggcgctgatggataacggcaacaatttagaagccgctctcaacgtgctcttgacctcaaataagcagaagcccgtgatggggccccctctccgcgggaggggaaagggtcgcggcaggattcggtctgaagacgaggaggatctcggcaatgcaagacccagtgccccttctactctgttcgactttctggagtcgaaaatggggactttaaatgtcgaggagccaaaaagtcagccccagcagctgcatcagggccaatacagaagttctaatacagaacagaatggcgtgaaggacaataaccacctaaggcaccctcctcgaaacgacacacgccaaccgcggaacgaaaaacccccacgcttccagcgagacagccagaactccaagtctgtgctcgaaggatcaggactgcctaggaatcgtggttccgaacgcccctcaacttccagcgtctcagaggtgtgggctgaggatcgcatcaagtgcgatcgcccttatagccgttatgatcgcaccaaggacacatcatatcccctggggagccaacactcagatggagctttcaaaaaaagagacaactcaatgcagtccaggtcaggaaaaggcccatcctttgcggaggcaaaggagaatcctctaccacagggatccgtagactataataatcagaaacgcggcaaaagggaatcgcagacttccattcctgattatttttacgatcggaaaagtcaaacaatcaacaacgaggctttcagcggcatcaaaatagaaaagcactttaacgttaatacggattatcagaacccagttaggagcaattccttcattggagttcctaacggggaagtggaaatgccacttaaaggccgtcgtatcggacctatcaagccagccggccccgtgactgcagtaccttgtgatgacaaaattttctataatagcggacccaagaggcggtccggcccgatcaagcccgagaagatactggagtcaagtatccctatggagtacgcaaaaatgtggaagcctggcgatgagtgctttgcgctgtattgggaggacaacaaattctaccgcgctgaggtcgaggccctgcacagttctggtatgaccgccgttgtaaaatttatagattacggcaactacgaggaagtcctactatccaatattaagcctattcagacagaggcctgggaagaagagggcacatatgatcagactctggagttccggcggggcggtgacggtcaaccccgcaggagcactcggcccacccagcaattttaccagcctccaagagcacggaactag

SEQ ID NO: 139412 - DNA, 3297 bp, Artificial Sequence
  Description of Artificial Sequence: Synthetic coding sequence
atgctggagggcgatctggtttccaagatgctgagagccgtgcttcagagccacaaaaatggcgtagcgctgcctcgactccaaggcgagtatcggagcctgacaggggattggatcccttttaagcaactgggctttcctacactggaagcttatctgagatcagttccggccgtggtgcgcatcgagacctctcggtcaggcgaaattacatgttatgccatggcttgcacagagacggctcgaattgcacagttagttgcgcgccagagatccagcaagcgcaagaccgggagacaggtcaattgtcagatgagagtcaaaaagactatgcccttcttcttagaaggtaaacccaaagccacgttgaggcaaccgggctttgcaagtaatttctcagtgggcaaaaagcccaatcccgcccccctgcgagataaaggcaactctgtgggcgtgaagcccgacgcggagatgagcccctatatgctgcatactacccttgggaacgaagccttcaaggacatcccagtccagagacacgttactatgtcaactaataacagattcagcccaaaagccagtttgcagcctcccctgcagatgcatctgtcaaggacctccacaaaagagatgtctgacaatctcaatcagactgtagaaaaacccaatgtcaagccacccgcctcttatacgtacaaaatggacgaggtacagaacagaatcaaagaaatcctaaacaaacataacaatgggatttggatttctaagttacctcacttctataaggagctgtataaggaagatcttaaccagggcatcctacagcagttcgagcattggcctcatatctgtacagttgagaagccctgctccggggggcaagatctccttctgtaccctgcgaaacgcaagcaactcctgcgctctgagctggataccgagaaggtgccgcttagtcctctcccggggcccaagcagacccctccgctcaaggggtgtcccaccgtgatggccggggactttaaggaaaaagtagccgacttgctggttaagtatacctcaggactttgggcaagcgcactgcctaaagcattcgaggagatgtacaaggtaaaatttcctgaggatgctcttaagaaccttgcgagcctcagcgatgtttgttctatcgattacatctcggggaacccccagaaggccatactgtatgctaagttgcctctgcccactgataagatccagaaagatgccggacaggcccatggggacaatgatatcaaagccatggtagagcaggagtatctgcaagtggaggaatctattgcagagagcgccaacaccttcatggaagacattaccgtccctccactgatgattccaacagaggcatcgccctccgtgctcgtcgtggagctgagcaacaccaacgaagtcgtgattcggtatgtgggcaaggactactcagcagcacaagagttgatggaggacgagatgaaggagtactatagtaaaaaccctaaaattacaccggtacaggccgttaatgttggccaactcctggccgtgaatgccgaagaggatgcttggctacgcgcccaggttattagcaccgaagagaataaaatcaaggtgtgttatgtggactacggtttctccgagaatgtcgagaaaagtaaagcgtataagctgaatcctaaattctgctcattgagcttccaggcaacaaagtgcaaactcgccggcctagaagtactcagtgatgatccagacctggtgaaggtagtcgaatctctcacgtgcggaaaaatatttgccgttgagatcctggataaggcagacatcccactcgtcgttctgtatgatacttcaggggaggacgatattaacatcaacgccacatgtcttaaggccatatgtgacaagtcacttgaggtccatctgcaggtggatgctatgtatacaaacgttaaggtgacaaatatctgttctgatgggactctgtattgtcaggttccttgcaagggcctaaacaaactgtccgacctgttgcggaaaatcgaggactattttcactgcaagcatatgacttccgaatgttttgttagcctgcctttttgcggcaaaatctgcctgttccattgtaaggggaaatggctcagggtggaaataaccaacgtccattcctcgagggccctggatgtgcaattcctggactctggcactgtcaccagtgttaaggtgagcgaactgcgcgaaatcccgcctcgatttctccaggaaatgattgccatccccccacaggccataaagtgctgcctcgcagatctcccccagagcattggcatgtggacacctgacgccgtcctctggcttcgcgactcagtgttgaactgcagcgattgttcaattaaggtgacaaaggtcgatgaaaccagaggtatcgcacacgtgtatttgtttacaccaaaaaattttcctgatcctcaccgatcaatcaaccgccaaatcaccaacgccgacctgtggaaacaccagaaagatgtttttctcagtgccatctctagcggcgctgactcacccaattctaagaacggaaatatgcccatgtctgggaacaccggggaaaacttccggaaaaacctaactgatgtgatcaaaaaatccatggtcgatcacacttctgccttcagcaccgaggaattgcccccccctgtgcacctctccaagcccggagagcatatggatgtctacgtgcctgtcgcctgccatccggggtactttgtcatccagccctggcaagagatccataaattagaagtcctcatggaggagatgattctctattattccgtgtccgaggagagacacattgccgtggaaaaggatcaagtctatgccgcaaaagtcgagaacaagtggcacagggttcttctgaagggcatactgaccaatggtctcgtgtccgtttacgagctcgactacggaaagcatgagctggttaatatccgaaaggtccagcccctggtggacatgtttagaaagttgccatttcaggctgtgactgctcaactggcaggcgtgaagtgcaaccagtggagtgaggaagccagtatggtgttcaggaaccacgtcgagaagaagcccctcgttgcacttgtacagacagtgatcgagaacgccaatccttgggatcgtaaagtggtagtgtacctggtggatacttctctcccggacacagatacttggatccatgattttatgtctgaatacctaatcgagttgtccaaagtgaactag

SEQ ID NO: 139413 - DNA, 3075 bp, Artificial Sequence
  Description of Artificial Sequence: Synthetic coding sequence
atggcttgcacagaaacggctcggatagcacagctggtcgctcgacagcgatcaagcaaacgcaaaacaggaaggcaggtcaactgtcagatgcgggtgaaaaagactatgccattctttttagagggcaaaccaaaggcgacactgcgccagcctggatttgcttcaaacttttctgtgggcaagaagcccaatccagccccgctccgtgataaaggcaacagcgtgggggtcaaacctgatgccgagatgtccccttacatgctgcacaccacattgggcaatgaagcttttaaagatataccagtacaaagacacgtgacgatgtcaacgaataataggttttccccaaaggccagtttgcagcctcccttgcagatgcacctgagccgcacctccacaaaagaaatgtctgataacctgaatcaaaccgtcgaaaaaccaaacgtgaaacctccggcttcctatacatacaagatggatgaagtgcagaaccgcattaaggagatcctcaacaaacataataatggcatttggataagtaagcttccacacttctataaggagctgtacaaagaagacctgaaccagggaatactacagcagttcgaacactggccgcacatctgtaccgttgagaagccatgtagcggaggccaggacttgctgctttacccagcaaagcgtaagcaactcctacgaagcgaactcgacaccgagaaggtccccctgagcccactgccagggccaaagcaaactccccctctcaagggctgccctacggttatggctggggatttcaaggaaaaagtggccgatctccttgtgaaatatactagtggactgtgggcatccgcactgccaaaagcttttgaggagatgtacaaggtgaaatttccggaagacgccctgaagaacctcgcttccctaagcgacgtctgttccatcgactacataagcggcaatccacagaaggcaattctttacgccaagctgcccctgcccactgacaagattcagaaggatgccgggcaagcccatggggataatgacatcaaagccatggtcgagcaggagtacctgcaggtcgaagagagcatcgctgaaagtgccaatacatttatggaagatattacagtgccgccactcatgatcccgaccgaagcctctccgagcgtgctggtcgtagagttaagtaatactaacgaagttgtaatcaggtacgtgggcaaagattatagcgcagcacaggaactgatggaggatgagatgaaggagtattacagtaaaaacccaaagatcaccccagtacaggcagttaacgtgggccagttgcttgctgttaacgctgaagaggacgcttggctgcgggcgcaggtgattagcactgaggagaacaagatcaaggtgtgctatgtcgactatggcttcagcgagaatgtggaaaagagcaaagcctacaagttaaacccaaagttctgcagcttgagcttccaggccacaaagtgtaagctggccggcctcgaggtgttgagtgacgaccccgatctcgtaaaagtagtagagagcctcacttgcggcaaaatatttgctgtagaaatactggacaaagccgatataccattagtggttctgtacgatacttccggcgaagacgatatcaatatcaatgccacgtgtttaaaggcgatctgcgataaatctcttgaggtccacctgcaggtcgacgctatgtacacgaatgtaaaagtcactaacatctgctcggacggaacattgtactgccaagtgccatgtaagggactaaataagctttctgatctgctgaggaagattgaggattacttccactgcaagcatatgacatcagaatgtttcgtctctcttccgttctgcgggaaaatctgtctgtttcattgtaaaggcaagtggcttcgggtcgaaatcacaaatgtacactcctctcgtgcactagatgtccagttccttgatagtggcaccgtgacatcagtcaaggtatctgaattacgggagattcctccccgcttcctgcaagagatgatcgctatcccaccccaggctattaaatgctgtctggcagacctgcctcagtccatcggtatgtggactccagatgctgtgctttggctgagagactccgtgcttaattgcagcgattgttcaattaaggtgaccaaagtggacgaaaccaggggcatcgcccatgtgtacctgtttacccccaagaatttcccggaccctcaccgatccataaatcgccagattacaaatgctgacctgtggaagcatcaaaaagatgtgttcctgtccgctatcagttctggggcggactccccaaatagcaagaacggcaatatgccaatgtctggcaatacaggcgaaaacttccggaagaacctgacggacgtgattaagaaatccatggttgatcatacctccgccttctccaccgaagagctccctccacccgtgcacctttctaagcccggtgaacatatggacgtctatgtaccagttgcctgccatccgggctacttcgtgatccagccgtggcaggagatccataagctggaggttctgatggaggagatgatcctctattattccgtgtccgaagagcggcatatcgctgtggagaaagatcaggtgtacgccgccaaggtcgagaataaatggcacagagtgctgcttaaaggcatattgactaatggacttgtgagcgtctatgagctggactacggcaagcatgagctggtaaacatccgtaaggtgcaacccctggtcgacatgtttagaaaactgcccttccaggccgtcaccgcacagttggcaggagtgaaatgcaatcagtggtctgaagaggcttcaatggtgttccggaaccatgttgagaagaagcccctcgtggccttagtgcaaaccgtaatagagaatgccaatccttgggaccgcaaggttgtggtttatcttgtggatacctctctgccagatacagacacctggatccatgactttatgtctgagtatctgatcgaattgtccaaggttaattag

SEQ ID NO: 139414 - DNA, 1257 bp, Artificial Sequence
  Description of Artificial Sequence: Synthetic coding sequence
atgtatacaaacgtcaaggttactaatatttgttccgacggtactctgtactgccaggtaccttgtaagggtctgaataagctcagtgatctgctgcgtaaaatcgaggattactttcactgtaagataacaaatgtgcactccagccgtgccttggatgtgcagtttctggactctgggactgtcacatccgttaaggtaagcgaacttcgcgagatccctcctcgctttttacaggagatgattgccatacccccgcaggccataaagtgttgtctggctgacctgccgcagagtatcggcatgtggacccccgatgcagtgctgtggctgagagactccgtcctaaactgcagtgattgcagtatcaaggtcaccaaggtggacgagacccggggcattgcccacgtttacttattcacccctaaaaactttcctgatccccaccgatcaatcaataggcaaatcaccaacgctgacctgtggaagcatcagaaagatgttttcctgagcgctatttcgagtggagcagacagccctaactctaagaacggtaatatgccaatgtccggaaacaccggggaaaattttcgcaagaatctcactgatgtcattaagaaaagcatggtggaccatacaagcgccttctcgacggaggaacttcccccacccgtgcacctttcaaaacccggggaacatatggacgtctatgtgccagtggcctgccaccccggatacttcgttattcagccatggcaggagatccacaagctcgaggtcctcatggaagaaatgattctatactactccgtgtccgaggagaggcatatcgccgtggaaaaagatcaagtgtatgccgccaaagtggagaataaatggcacagagttctgctgaaaggcattcttacgaacggacttgtgtccgtttacgaacttgactatgggaaacacgaacttgtgaacatacgtaaggtgcaaccccttgtagacatgttcaggaagttgccgttccaggccgtcacagctcagctggcgggcgtcaagtgtaaccaatggagcgaagaagcatccatggtcttcagaaaccatgtcgagaaaaagcctctggtggctctcgtgcagaccgtgattgaaaacgccaacccctgggaccgcaaggtcgtggtatacctggtagatacgtccttaccggacaccgacacctggatccatgacttcatgtccgagtacctgattgagttgagtaaggtgaactag

SEQ ID NO: 139415 - DNA, 2514 bp, Artificial Sequence
  Description of Artificial Sequence: Synthetic coding sequence
atgtccctctctcacctgtatcgggacggagaaggccggattgacgacgacgatgatgagcgggagaactttgagataaccgattgggacttgcaaaacgaatttaaccccaacagacagcgacattggcagactaaggaagaggcaacctacggcgtgtgggctgagcgtgacagcgatgacgagagaccttctttcggcggtaagcgtgctcgcgattacagtgccccagtcaatttcataagtgcgggactgaaaaaaggggccgcggaggaggccgaactcgaggatagcgacgatgaggagaagccagtgaagcaggatgacttccccaaagattttgggccgcgcaagctgaagactggcgggaattttaagcccagccagaaaggcttcgctgggggcacaaaatcatttatggactttggctcatgggagcgccataccaaagggattggacagaagctcttgcagaagatggggtacgtgcctggtcgcggcctggggaaaaacgcacagggcatcatcaatccaatcgaagcaaaacagcggaagggcaaaggggccgttggcgcctacgggtccgaaagaactactcagagcatgcaagactttccagtggtcgatagcgaagaagaggccgaggaggagtttcaaaaagaactgagccaatggcgtaaggacccatctggttctaagaaaaagccaaaatactcatacaagacggtggaggaactcaaggctaaggggcggatctctaagaaacttactgcaccccagaaagagctgtcgcaggtgaaggtgatcgacatgaccggacgggagcagaaagtctattactcatatagtcagatatcccataaacacaatgtgccggacgacggacttccactgcagtcacaacaattgccacaaagtggaaaggaagctaaggccccgggctttgctctgccagagctggaacataacttgcaactgctcattgatctgacagagcaagagatcattcagaatgacagacagctgcaatacgagcgcgacatggtcgtcaacctatttcacgagcttgagaaaatgactgaggtcctagaccatgaggaacgcgtcatatcaaacctctccaaggtgctggagatggttgaggagtgtgagcgcaggatgcagcctgactgtagcaaccccctgacactcgatgaatgcgcacgaattttcgagaccttacaggacaagtattatgaggagtataggatgtctgaccgagtcgatctggctgtggctatcgtgtatccgctgatgaaagaatatttcaaggaatgggacccactgaaagattgcacctatggtaccgaaatcattagcaaatggaagagcctcctggagaacgaccagttgctgagccacggaggccaggacctgtctgcagacgcatttcaccgcttgatttgggaagtctggatgcctttcgtgcgtaatatcgtgacccagtggcagcctcgtaactgcgatccaatggtcgacttcctggactcctgggtccatataatccctgtgtggattctcgataatatactcgaccagttgatcttcccgaaattgcagaaagaagttgagaactggaacccactgacagacacagtgcccatacactcctggatccacccttggttgcctcttatgcaagcccgacttgagcccctgtactctccaatccgttcgaaactgtccagcgcgctacaaaagtggcacccttcagatagctctgcaaaactgatcctacagccatggaaggatgtgtttacacccggatcgtgggaggcctttatggtgaagaacatcgtacccaaactgggcatgtgcctgggggagctggtgattaatccacaccagcagcacatggacgccttctattgggtgatcgattgggaggggatgatctcagtttcctccctggtggggttgttagaaaagcactttttccccaagtggctgcaagtgctgtgttcttggctgagtaattctcctaactatgaagagattaccaagtggtacctgggttggaaatccatgttctccgatcaagtgttggcacaccctagcgttaaagataagtttaacgaggcactcgatatcatgaaccgggccgtctcttcaaatgtgggagcatacatgcagccgggtgcccgcgaaaacattgcctacttaacccacacggagaggaggaaggactttcagtatgaagcaatgcaggaaagaagggaggctgagaacatggcccagaggggtattggggtggccgcctcctctgtgcccatgaactttaaggatctaatagagaccaaggctgaggagcataatatcgtgtttatgcccgtaataggcaagcggcacgagggcaagcaactgtatacctttgggaggattgtcatctacattgaccgcggcgtggtatttgtacagggagaaaagacttgggtccccacttctttgcaatctcttatcgacatggctaaatag

SEQ ID NO: 139416 - DNA, 2514 bp, Artificial Sequence
  Description of Artificial Sequence: Synthetic coding sequence
atgtcactgtcccatctctatagagatggagaggggaggatcgacgatgatgatgacgaacgcgagaactttgagatcaccgactgggacctacaaaatgagttcaatccaaatagacaaaggcactggcagaccaaggaggaggcgacttacggagtttgggcggagcgcgacagtgatgacgagcggccctccttcggtggaaaaagagccagggactattctgcacccgtcaactttatttccgctggactgaaaaaaggcgctgcagaggaggcagagctcgaggactcggatgacgaagagaaaccagtgaagcaggacgatttccctaaagacttcgggcctagaaaactgaagaccgggggcaatttcaagccctcccagaagggtttcgcaggaggcaccaagtcatttatggattttgggtcatgggaacgccacacaaagggtatcggacagaaacttcttcagaaaatggggtacgtcccaggccgggggctggggaaaaacgcacaagggatcataaacccaattgaggccaaacaacgaaagggtaaaggggctgtcggagcctacggcagcgaacgcacgacccagtcgatgcaggattttcccgtggtggatagcgaagaggaggccgaggaagagttccagaaagagctgagccagtggcgtaaggacccatctggaagtaaaaagaagcctaagtatagttacaaaacagtggaggaactgaaggctaaaggtcggatttctaaaaagcttactgctcctcagaaggaactctctcaggtaaaggtcatcgatatgaccgggagggaacagaaggtgtattactcatatagtcaaattagtcacaagcataatgtgcctgatgatggactgccacttcagagccagcaactgccccagtctgggaaggaagccaaagcacctgggttcgccttaccagagctcgaacacaacctccagctgctgattgaccttacagagcaagagattatccaaaatgacaggcagcttcagtatgagagagacatggtagttaacttattccacgaattggagaaaatgacagaggtcctggaccatgaggagcgcgtcatttctaatctttccaaagtgctggagatggttgaagaatgcgagcgccgcatgcagccggactgctccaatcccctgactttagacgaatgtgcccgcatttttgagacactgcaggacaagtattacgaggagtacaggatgtccgaccgggttgacctcgctgtggcaatcgtctacccgctgatgaaggagtactttaaagagtgggacccgctgaaagactgcacttatggcacagaaatcatttcaaagtggaagtccctgctggagaacgaccagctcctctcacacggcggccaggatctgagtgcggatgcttttcacagactgatctgggaggtgtggatgccattcgtgcgaaatattgtcacacagtggcaacctcgcaactgcgatccaatggtcgattttttagatagctgggtacatatcatacccgtgtggatcttggacaacatcctggatcagctgatcttcccaaagctccagaaagaagtggaaaactggaatccactaaccgacacagtaccgatacattcttggatccatccttggctccccctgatgcaggccagactcgaacccctgtactcccctatcagaagcaagctgagttctgccctgcagaaatggcatccgagcgactcgtctgccaagttgatactacagccttggaaggacgtcttcacaccaggtagctgggaggcttttatggtgaagaacattgtccctaagctgggcatgtgtctcggtgagctcgtcatcaaccctcatcagcaacatatggatgccttttactgggtgatcgactgggaagggatgattagcgtaagttcattagtgggcctgttggagaaacactttttcccaaagtggctccaggtgctgtgttcctggctgtcaaactcccccaactacgaagagattactaagtggtacctgggatggaaatcgatgttctccgaccaagttcttgcacatccctcagtaaaagacaaattcaacgaggctcttgacattatgaacagagctgtcagttcgaatgttggagcatatatgcagccaggtgcacgtgagaacatagcctacttgacacacacggaacgtcgcaaagacttccagtacgaggctatgcaagagagacgagaggcagagaacatggcccagcggggaattggcgtggctgcgtcatccgtgcccatgaattttaaggatctgattgaaacaaaggcggaggagcataacattgtcttcatgcccgtgattggcaagaggcacgaggggaagcagctgtatactttcgggcgcattgttatctacatcgacagaggggttgtgttcgtgcaaggtgaaaaaacttgggtgccgacaagtttacaatcattgattgacatggctaagtag

SEQ ID NO: 139417 - DNA, 2514 bp, Artificial Sequence
  Description of Artificial Sequence: Synthetic coding sequence
atgtcactctcacacctgtaccgggacggagaaggcagaattgatgatgacgacgacgagcgggaaaatttcgagatcaccgattgggacctccagaacgaattcaaccctaaccgccagcggcactggcagacgaaagaagaggcaacctacggcgtctgggcagaaagggatagcgatgacgagaggcccagcttcggcgggaagagggcaagggattatagcgcgccagtgaactttatctcggctggactaaaaaaaggagcagccgaggaggccgaactagaggactctgatgacgaagaaaaacctgtaaagcaggatgatttccctaaagactttggaccacgcaagttaaaaaccggtggaaattttaaaccgtctcagaagggcttcgctggggggacgaaaagtttcatggactttggtagttgggaaaggcatactaagggcattgggcagaagctgctacaaaagatggggtacgtgcctggcaggggattgggcaagaacgcacagggaatcattaatccgatcgaagctaagcagagaaaaggtaagggcgcagtcggcgcttatggctcagaaaggaccacccagtcaatgcaggattttccagttgtggattcagaggaggaggccgaggaagaatttcaaaaggagctctcacagtggcgaaaagatcccagcggtagcaaaaaaaagcctaaatacagctacaaaactgtcgaagaactgaaggcaaaaggccgaatttcaaaaaagttgacggcaccgcagaaagaactgtcacaggtgaaagtaatcgacatgacgggaagggaacagaaggtctattactcttactctcagatcagccataagcacaacgtccctgacgacggtctgccacttcaaagccagcagctgccacagtcggggaaggaggccaaggcgcctggttttgccctccccgaattagagcacaacctacagttgcttattgaccttaccgagcaggagattatccagaatgaccgacagctgcaatatgaacgcgacatggtagtgaacctgtttcacgagttagagaagatgaccgaagtcctggatcacgaagaaagggtgatctctaatctcagcaaggtgcttgagatggtcgaagaatgcgaacggcgtatgcaacccgactgctctaatcctctgactcttgacgaatgcgcaaggattttcgagacactgcaggacaagtattacgaggagtaccgaatgtcagaccgagtggatttggccgtggccatcgtgtaccccctgatgaaagaatacttcaaagagtgggatccgctcaaggattgcacctatggaaccgagatcattagtaagtggaaatccctactggaaaatgaccagctgttgtcacatgggggtcaggacctgtctgcggatgcctttcaccggctaatttgggaggtctggatgccattcgtcaggaacatcgtaacccagtggcaacccagaaattgcgaccctatggtggacttccttgactcatgggtccacattatccccgtctggattctcgacaatatactggatcagctgatttttcctaaactacagaaggaggtggaaaattggaacccgctgaccgacacggtgcccatccactcctggatccatccttggctgccactgatgcaggctagacttgaacctctctactcacctatccgctcaaaactgtccagtgctctgcagaagtggcatcctagcgatagttccgcgaagctcatactgcagccctggaaagatgtgtttacccctggatcatgggaggcatttatggtgaagaacattgtgcccaagcttggtatgtgcctgggtgaactagtgatcaatccccaccagcagcacatggacgccttctactgggtgatcgactgggaggggatgatatccgtgtcttcattagtgggcttactggagaagcatttttttccgaagtggctgcaggtgctgtgcagttggctgtccaacagccccaattacgaggagattacaaaatggtacctggggtggaagtccatgttctctgaccaggtactcgcacatcctagcgtgaaggacaagtttaatgaggctctggacatcatgaaccgagctgtcagttcaaacgtgggcgcgtatatgcagcccggagccagggagaacattgcctacttaacacatacagagcgacgtaaagattttcagtatgaagctatgcaggagcgacgcgaggcggaaaatatggcacagaggggaattggcgtggctgcttcctcagtcccaatgaattttaaggacctgatcgagaccaaagccgaagagcacaatatcgtgtttatgcccgtcatcggcaaacgccacgaaggcaaacagctttacaccttcggcaggattgtaatctacatagatcgcggtgtcgtctttgtacaaggagaaaaaacctgggtgccaacaagtttacagagcctcatcgatatggccaagtag

SEQ ID NO: 139418 - DNA, 2514 bp, Artificial Sequence
  Description of Artificial Sequence: Synthetic coding sequence
atgtctctgtcccatctctaccgtgacggtgagggccgcattgatgatgacgacgacgagcgagagaattttgagattacagattgggacttacagaatgagttcaatcctaaccgacagaggcattggcagacaaaggaggaggccacctacggcgtgtgggcagagcgagacagcgacgacgagaggcccagctttggaggcaagcgagcccgcgattacagcgctcccgtgaattttatttctgccgggctcaagaaaggagctgccgaggaggccgagttggaggactcagatgacgaagagaagcctgtgaaacaggacgatttccctaaggacttcgggccccggaaactgaaaacaggagggaactttaaaccaagtcagaagggcttcgctggcggaaccaaaagctttatggacttcgggagttgggaacgacacacgaagggcatcggccagaagctgttacaaaagatgggttacgtcccaggcaggggtcttggcaagaacgcccaagggatcatcaaccctatcgaggccaaacagaggaagggaaagggagccgtgggcgcgtacgggtctgagcgcacgacacagtccatgcaggactttccagtggtagatagcgaggaggaggctgaggaagaattccagaaagaactgtcacagtggagaaaagatccgtccgggtccaagaaaaagccgaagtactcatacaaaacagtcgaggaactaaaggccaaggggaggatttctaagaagcttacagccccccaaaaggagctgagtcaggtaaaggtaatcgacatgacagggcgcgaacagaaggtgtactacagttacagtcagattagccacaagcacaatgtcccagatgacggcctccctttgcaatcccaacaactccctcagtccgggaaagaggcaaaggcccccggctttgctctgccggagttggagcataatttgcaactcctcatcgatttaactgagcaggaaatcatccagaatgaccggcagctgcaatacgaaagggatatggtggtgaatttgtttcatgagctggagaagatgacagaggtgctagatcacgaggaacgggtcatatctaatctgagcaaagtgctggagatggtggaagaatgtgaacgcaggatgcagcccgattgctctaatcccctaactcttgacgaatgtgcacggatcttcgaaactctgcaggacaaatattatgaggagtacaggatgagtgaccgggtcgatctcgccgttgccattgtataccctctgatgaaagaatatttcaaagagtgggaccctctgaaagattgtacctacggcaccgaaatcatttccaagtggaaaagcctcctggagaatgatcagctgttgtcacacggggggcaagatttaagtgccgacgcgttccaccgtctgatatgggaagtgtggatgccgttcgtgagaaacatagtcactcagtggcagccccgcaactgcgacccaatggtggacttcctggatagctgggtgcacattatccctgtgtggatcttggataatatcctggatcagctcattttccccaaattgcaaaaggaggtggagaactggaatccactgacagatactgtcccaatacattcttggattcatccctggctacctcttatgcaggcgcgactggaacctctttattctcccatccgtagcaaactgtcctccgccctacagaagtggcacccatcggattcctccgcgaagctcatcctacagccttggaaagacgttttcacgcccggctcatgggaggcctttatggtaaaaaatatcgttcccaagcttggtatgtgcctaggagaactggtcattaacccacatcagcaacacatggacgccttttactgggtgatagactgggagggtatgatcagtgtttcgtccctggtggggctgctggaaaagcatttttttccaaagtggttacaggtgctgtgctcatggctttctaacagtccaaactacgaggagattactaagtggtatcttgggtggaaaagtatgttcagcgaccaggttctggcccacccatcagtgaaggataagtttaatgaggcacttgacattatgaaccgagcagtgagttccaatgttggtgcctacatgcagcctggggctcgcgagaacattgcatatttgacccatacagagcgaaggaaagactttcagtatgaggctatgcaggagcgtcgagaggcagaaaacatggcacagaggggaattggcgtggccgcctcctcagttcctatgaattttaaagacttgatcgagaccaaagcggaggagcacaatattgtgttcatgcccgtgattggcaagcgccatgaggggaagcagttgtacacgttcggccggatcgtcatatacatcgatagaggggtggtcttcgtgcagggcgaaaagacatgggtccccactagtctgcagagtctgatcgatatggccaagtag

SEQ ID NO: 139419 - DNA, 267 bp, Artificial Sequence
  Description of Artificial Sequence: Synthetic coding sequence
atgtctctcagccacctgtatagagacggtgaaggtaggatagatgatgacgatgatgagcgggaaaatttcgaaattactgattgggacctgcagaacgaattcaacccaaatcgacagcggcactggcaaactaaggaggaggctacgtacggggtttgggctgagagagactccgacgacgaaagaccaagctttggagggaagagggctcgggactacagcgctccagtaaactttatttccgctgggctgaaaaaggggtag

SEQ ID NO: 139420 - DNA, 261 bp, Artificial Sequence
  Description of Artificial Sequence: Synthetic coding sequence
atgtcactcagccacctctacagagacggtgagggcagaatagacgatgacgatgatgagcgagaaaatttcgagatcacagactgggatctgcagaacgagttcaaccctaataggcagaggcactggcaaaccaaggaggaagctacttatggagtatgggccgaacgggattctgatgacgaacggccaagcttcgggggcaaacgggcaagagattacagcgccccggtcaactttatctctgctggcctgaagtag

SEQ ID NO: 139421 - DNA, 129 bp, Artificial Sequence
  Description of Artificial Sequence: Synthetic coding sequence
atgagcctgtcccatctgtatcgcgatggggaaggaaggattgatgacgacgatgacgaaagggaaaatttcgaaatcaccgactgggacctgcaaaatgagttcaatcctaaccgccagaggcattag

SEQ ID NO: 139422 - DNA, 1569 bp, Artificial Sequence
  Description of Artificial Sequence: Synthetic coding sequence
atgtctctgtcccatctttaccgtgacggggaaggcaggattgacgatgatgatgacgaaagagagaacttcgagattaccgattgggatctccaaaatgaattcaacctcttccacgagctggaaaagatgacggaagtcttggaccatgaagagagggtgatatctaacctttctaaagttctagagatggtggaagaatgtgaacggcggatgcagccagactgttccaatccactcaccctggatgaatgcgctagaatcttcgaaactctgcaggacaagtactacgaagaataccgcatgtccgacagagttgacctggctgtcgcgatagtgtaccccctgatgaaagagtattttaaagagtgggacccactgaaggattgtacttacggtacagagataatctctaaatggaagagcctcctggaaaatgatcaactgctgagtcatggcggtcaggacctatcagctgatgcattccacaggctaatttgggaggtttggatgccttttgtgaggaatatcgtgacacagtggcagcctaggaattgtgacccaatggttgactttctcgacagttgggtccacattatacctgtgtggattctcgacaacatactggaccagttgattttccccaaactgcaaaaggaggtggaaaactggaatccattgaccgacacagtgcctatccattcctggatccacccctggctgccactgatgcaggcccgcctggagccactgtactctcccatccgcagcaagctgtccagcgccctgcaaaaatggcaccctagcgactcatctgccaagctgattctgcagccatggaaagacgtgttcacccccggatcatgggaagcctttatggtcaagaacatcgtcccaaaattgggcatgtgcctaggggaactggtaattaaccctcatcaacagcatatggatgctttctactgggtcatcgattgggaaggaatgatcagtgtatcctccctggtaggccttctggagaaacactttttcccaaagtggctccaggtactttgttcctggctgtccaattccccgaactatgaggagatcacaaaatggtatctggggtggaagtctatgttctccgaccaggtgctcgcgcacccatccgtcaaggataagtttaacgaggccttagatatcatgaacagggcagtaagctctaacgtgggcgcctacatgcagccaggtgctagggagaacatcgcatatcttactcacacagagcggagaaaggattttcagtatgaggctatgcaggagcggcgggaggccgagaatatggcccaacggggaataggtgtcgctgcctccagtgtcccgatgaacttcaaggacctcatcgaaacgaaggctgaggagcacaacattgtgttcatgccagttattggtaaacgccacgagggcaaacaactgtacacttttggccggatagtcatctatattgatcgcggagtagtcttcgtacagggggaaaagacatgggtgcctaccagtcttcaaagcttgattgatatggctaagtag

SEQ ID NO: 139423 - DNA, 576 bp, Artificial Sequence
  Description of Artificial Sequence: Synthetic coding sequence
taagggcgaggtctggggaaaaatgcgcagggcattattaatcccatcgaggcaaagcagcgaaagggcaagggggctgtaggagcgtacgggagcgagcgaacaacacagagtatgcaggactttccagtggtcgacagcgaggaggaggccgaggagtggttgtttttagccgcatctgattgcatactgctggtacaagagtttcaaaaggagctgtcccaatggagaaaagatccttctggttccaagaagaaaccaaagtactcgtacaagactgtcgaggagctcaaggctaagggccgcatttcaaaaaagcttacagcgccacagaaagagttgtctcaggttaaggtcatcgacatgacaggacgcgaacagaaggtgtattattcctactctcaaatcagtcataagcacaacgtgcccgatgacgggctgccactgcaatctcagcagctgccccagtccggaaaggaagcaaaggctcccggatttgctctcccagagctcgaacacaaccttcagctcctcatcgacctgaccgaacaggagatcatccaaaacgacagatag

SEQ ID NO: 139424 - DNA, 366 bp, Artificial Sequence
  Description of Artificial Sequence: Synthetic coding sequence
atgtctctcagtcatctgtaccgggatggggaaggccgaattgacgacgatgacgacgagagggagaacttcgagatcacagactgggacctgcaaaacgaatttaaccctaacaggcagcggcattggcagacaaaagaggaggcaacatacggagtgtgggcagaacgcgactccgacgacgagcgtcctagcttcgggggtaagagggcccgcgattacagtgcccccgtgaacttcatcagcgccggactgaagaagggagccgctgaggaagctgagctggaggacagtgatgatgaagagaagccagtgaaacaggacgacttccctaaggactttgggccccgtaagctaaagacctag

SEQ ID NO: 139425 - DNA, 723 bp, Artificial Sequence
  Description of Artificial Sequence: Synthetic coding sequence
atggaagagagcgtggtgcggccctctgtcttcgtggtcgacggacagaccgacatcccctttacccggctcggacggtctcatagaagacagtcctgctcagtagcacgcgtgggcctgggtctcctcctattacttatgggggcgggtttggccgtccagggctggttccttctgcaacttcactggagactgggcgagatggtgaccagattaccggacggacccgctggatcttgggaacagttaatacaggagcgccgctcccatgaagtgaatcctgcagcccatctcaccggcgccaattcgagtctcactgggtcgggtggccctctgttatgggagacccaactggggctcgccttcctccgaggactgtcttaccatgatggggctctcgtcgtgactaaagctgggtattactatatctatagcaaggtgcagctgggtggcgtggggtgtcccttaggccttgccagcactatcactcatgggctgtataagaggacccccagatatcccgaggagctggagttgctggtgtctcagcagagcccttgcgggagagcgacgagcagttcccgcgtctggtgggacagctccttcctcgggggagtggtccatcttgaggccggtgaaaaagtcgttgtgagggtactcgatgaacggctggtccggttgcgcgacgggaccaggtcctatttcggagccttcatggtgtag

SEQ ID NO: 139426 - DNA, 954 bp, Artificial Sequence
  Description of Artificial Sequence: Synthetic coding sequence
atgaggagagcgagccgcgactacaccaagtacctccgaggcagtgaagagatgggaggcgggcctggcgctcctcacgaaggtccgttacacgcgccccctcccccagcgccacaccaaccccctgccgcctcacgctccatgttcgtagccctcttgggcttgggactcgggcaggtcgtctgctcagtggccctgtttttttatttcagagcccaaatggacccgaatcggatttctgaggacggcacacattgcatttatcggatcttacggctccacgagaatgccgactttcaggataccaccctagagagtcaagacaccaaacttattcccgactcctgtcggcggattaagcaggcttttcagggcgctgtgcagaaagagttgcagcacatagtgggctcacagcacatccgtgctgagaaggccatggtggatgggtcatggctcgatttggccaagcgcagcaaactcgaggcccagccgtttgctcacctcaccattaatgcaacagacatcccaagtgggtcccacaaggtttctctatcgtcatggtatcatgaccgcggctgggctaaaattagcaacatgaccttttcgaatggaaagctcatagtcaaccaggatgggttctattacttatacgccaatatttgtttccggcaccacgaaaccagtggagatcttgcgaccgagtatctccaactcatggtctacgtcaccaagacctccatcaagattccttcatcccacacgttaatgaaaggcggttccacgaaatattggtctggcaatagtgagtttcacttctattcaattaacgttggaggtttctttaaactcagaagcggagaagaaatctctattgaggtgagcaatccatcgctgctggaccctgatcaggacgcgacttatttcggggccttcaaagtgagagatatcgactag

SEQ ID NO: 139427 - DNA, 735 bp, Artificial Sequence
  Description of Artificial Sequence: Synthetic coding sequence
atggatcctaacagaatttcggaagacggtacccactgcatctaccggattttaaggctccacgagaacgcggacttccaggatactaccctagagtcacaggacacgaagcttatacctgactcctgtagaaggattaaacaagcgttccagggggcagtccagaaagagttacaacacattgtgggcagtcagcacatacgggctgagaaggcgatggtcgacggctcctggcttgaccttgctaaaaggtccaagctcgaggctcaaccatttgcccatctgaccatcaacgccaccgacattcctagcggcagccacaaggtgtctctcagctcttggtatcatgacaggggctgggccaaaatatctaatatgacattttctaatgggaagctcattgtgaaccaggatggtttctactacttgtacgctaacatttgctttagacatcacgagaccagcggcgacttagcgactgaatacctacagcttatggtctacgttactaagacatcgattaagatccccagctcccacactctaatgaagggaggcagcactaagtattggtccggtaacagcgagttccatttttattccattaatgtgggcggttttttcaagctaaggagtggggaagagatcagcattgaggtgtctaacccctctttgctggacccagatcaggacgccacatacttcggggcattcaaagtaagagacatcgattag

SEQ ID NO: 139428 - DNA, 735 bp, Artificial Sequence
  Description of Artificial Sequence: Synthetic coding sequence
atggaccccaaccgtatcagcgaagatgggacccattgtatctaccgaatcctcagactgcatgagaacgccgacttccaggacactacactggagagtcaagacaccaagctgatacctgactcctgccgacgaattaagcaagcctttcagggggccgtccaaaaggaactgcagcatattgtcggcagccaacacattcgagccgagaaagcaatggtcgacggcagttggcttgaccttgctaagcgttccaagttggaagctcagccgttcgctcacctcaccattaacgctacagatattccttctgggtcccacaaggttagcctctcctcatggtaccatgatagggggtgggccaagatctcaaatatgacttttagtaatggcaaattaatcgtcaatcaggacggcttctattacctttatgccaacatctgcttccggcaccacgagacttctggagatctggctacagaatacctccagctgatggtttatgtaaccaaaacctctatcaaaatcccatcatctcacaccctgatgaaaggtggctccacaaagtactggagtgggaatagcgagttccacttttatagcattaacgtggggggattctttaagctgcgatccggggaagagataagtatcgaggtgagtaatccttctcttctggacccagatcaggacgctacttactttggagccttcaaagtcagagatatcgactag

SEQ ID NO: 139429 - DNA, 735 bp, Artificial Sequence
  Description of Artificial Sequence: Synthetic coding sequence
atggacccaaacaggatcagcgaggatggcactcattgtatctatcggatactgaggttgcacgagaatgccgatttccaggatacaacccttgagagccaagacacaaagcttattccagattcatgtaggcgcatcaagcaggcatttcaaggggcagtccaaaaagagctgcagcatattgtcggaagccagcatatccgagcagaaaaggccatggtggatgggtcatggcttgatctcgccaaacgctcaaaactggaagcccagccgttcgctcatctgaccattaatgctactgacatcccgtctggctcccacaaggtatccctgtcaagttggtaccatgacagaggatgggcaaagatctcaaacatgactttcagcaatggtaaactgatcgtgaatcaagatggattttactacctttacgcaaatatctgttttagacatcacgagacctctggcgacttagcaaccgagtatttacagttgatggtttacgtcaccaaaacatctataaagatcccctctagccacaccctgatgaagggagggtctacgaaatattggagcggaaactccgagttccatttctatagcatcaacgtggggggtttcttcaagcttagatccggagaagaaatcagcatcgaggtttcaaacccatcgctgctcgaccctgaccaagatgccacatacttcggagcctttaaagtgagggacattgactag

SEQ ID NO: 139430 - DNA, 735 bp, Artificial Sequence
  Description of Artificial Sequence: Synthetic coding sequence
atggacccaaatcggatctctgaagatgggactcactgtatctaccggattttacggctccatgagaacgctgattttcaggatacgactctcgagagtcaggacacgaaactgattccagattcatgccgtagaatcaagcaggcattccaaggcgcagttcagaaagagctgcagcacatcgttggatctcagcatatccgggctgagaaagccatggttgacggaagttggctggacctcgcaaagaggtccaaactggaggcccagccatttgcccacctgactataaacgccaccgacatcccttcaggatcacacaaagtttctctcagctcttggtaccacgataggggctgggccaagatctctaacatgaccttttccaacggaaagctgatagtcaatcaggatggcttttactatctgtatgccaacatctgttttagacatcatgaaacctccggcgacctggcaaccgaatacctccagttaatggtttacgtaaccaagacctcaatcaagattccgtcgagccataccctcatgaagggaggctcaaccaaatattggtctggcaactctgagttccatttctattcaattaacgtggggggattcttcaagctgagatccggggaggaaattagtatcgaagtgtcaaacccgagtctgctcgaccctgaccaagatgccacttatttcggagcctttaaggttcgcgatatcgactag

SEQ ID NO: 139431 - DNA, 750 bp, Artificial Sequence
  Description of Artificial Sequence: Synthetic coding sequence
atggccgcgcggcggtctcagcggcggagaggccggcgtggtgagcctggtacagccctgcttgtgccactggcgctgggccttggcttggccttagcatgcttaggcctactcctcgctgttgtcagcctgggatctcgcgcatctctctcagcacaggaacccgctcaagaggagctggttgctgaagaagatcaggatccctctgaactcaaccctcagaccgaggagtctcaagatccggccccgtttctgaaccgccttgttagaccacggcgcagtgcgccaaaaggaaggaaaactagggctcgccgtgctatcgcagcacattatgaagtacatcctagacctggccaagatggagcccaggccggggtcgacggcacggtgagtggctgggaggaggcaaggataaactcttcctccccactgcggtacaatcgccagattggcgaattcatcgtgaccagagcgggcctgtattatttgtactgtcaggtccactttgacgaggggaaagccgtctacctcaaacttgacctgctcgtagatggcgtcctggcgctgaggtgtttggaggagttctccgctaccgcagcctcatctctgggtccacagctgaggttgtgtcaggtgagtgggctgctcgctttgagacctggtagcagcctgcggattcgaactcttccatgggcacacctgaaagccgctccttttctcacttatttcggactgttccaagtccactag

SEQ ID NO: 139432 - DNA, 993 bp, Artificial Sequence
  Description of Artificial Sequence: Synthetic coding sequence
atggcagcccgccggtcacagcggcggcggggcaggcggggtgaaccgggcaccgctctgctggtgccgcttgctttagggctgggactggcactggcgtgcctcggcctactgctcgccgtggtttccttaggctctcgcgcttcgctgagcgcacaggagcccgcacaagaggagctggttgctgaggaggaccaggatccctcggaattgaatcctcagactgaagagtctcaggatccggccccctttctcaatcgcctggttcgacctcgacgttcagcgcccaaaggccggaaaacaagggctcgtagagcgatcgcggcccactacgaggtgcaccctagacccggacaggacggtgcacaggcaggcgttgatgggaccgtttccgggtgggaggaggcgaggatcaactcctcgagcccactgcggtataaccgccagataggggagttcatagtaacacgggcaggcctctactacttgtattgtcaatccagcgatgcactggaggcctgggaaaatggagaacgaagtcggaaaaggcgcgctgtgctcactcagaaacagaagaagcagcattccgtactgcacttggtgcccatcaacgcaacctctaaagacgatagtgatgtgactgaggtgatgtggcagccagccctacgccggggaagaggcttgcaggctcaggggtatggagttcgaatccaggacgctggagtgtatctcctctactctcaggtgctcttccaggatgtgacatttactatgggtcaagtagtttccagagaaggacaagggcggcaagaaactctgtttagatgtataaggtctatgccctctcacccggacagggcctataattcttgttacagtgcgggcgtttttcacctgcaccagggagatatcctgtccgtcatcatacctcgcgcccgtgcaaaattgaatctgtcacctcacggaacatttctgggatttgttaaattatag

SEQ ID NO: 139433 - DNA, 723 bp, Artificial Sequence
  Description of Artificial Sequence: Synthetic coding sequence
atggaagagagcgtcgtgcggcccagtgtcttcgtggtggacggccaaaccgacattccctttacacgtctcgggcggagccacaggaggcagtcctgcagcgtcgctagggtgggtcttggactgctgctgctccttatgggtgcagggttggctgtacagggctggttcttgctccagctccattggcgtctgggggagatggttacccgccttcccgacggacctgcaggatcttgggagcagctcatccaagagcggcgctctcacgaggtgaatcctgcagctcacttaacaggagcgaacagctctctcaccggctccggcggcccccttctgtgggaaactcagttgggcctagcctttctgcggggcctgtcgtaccatgacggcgcacttgtcgttacgaaggccggctattactacatctattcgaaggttcagttaggcggtgtgggctgcccactgggtctcgcctccactatcactcatggactgtacaagcgaactccaagatatccggaagagctggagctcctcgtgagtcagcaaagcccctgtggccgcgccacctcatcaagcagggtgtggtgggacagtagcttccttgggggtgtcgtccatctggaggccggggagaaggtggtcgttcgagtgctggatgaaaggcttgtcaggttaagagacggcacaagatcctatttcggcgcctttatggtgtag

SEQ ID NO: 139434 - DNA, 615 bp, Artificial Sequence
  Description of Artificial Sequence: Synthetic coding sequence
atggaagaaagtgtggtgcgccccagtgtttttgttgtggacggccagaccgatataccattcactaggctgggccggagtcaccggagacagagctgtagcgtcgcccgtgatggccctgcaggctcatgggaacagctgatccaggagcgtcggtctcacgaagttaatccggcggcccacttgaccggggctaattcatcactgactggtagtggcggtcccctgctgtgggaaacacagctcgggctcgcatttctccgggggttaagctaccacgacggtgccttggtagtgactaaggccggatactattacatctactctaaagtacagttggggggggttggatgtcctcttgggttagcttctactataacacatggactttacaaaaggacccctcgttaccctgaggagctggagctgctggtctcccaacagagcccttgcgggcgcgccacttcctcaagccgggtatggtgggatagtagcttcctcggcggtgtggtccacttggaagccggcgagaaggtggtcgtgcgggtcctggatgaacggctcgtgagacttcgggacggcacacgaagctactttggagctttcatggtgtag

SEQ ID NO: 139435 - DNA, 525 bp, Artificial Sequence
  Description of Artificial Sequence: Synthetic coding sequence
atgaggcacttcctgtctaaagtgtactctttcccaatgcggaagcttattctttttctggttttccctgtggtgagacaaacaccgacccaacacttcaagaatcaatttccagcactccactgggagcatgagctgggtctcgcattcactaagaaccggatgaattataccaacaagttcctcctaatccctgagtcaggagactattttatctattctcaggtgacattccgcggtatgaccagcgagtgtagtgaaatccggcaggcagggcgccccaacaagcccgacagcatcaccgtagttattaccaaggttacggattcataccctgagcctacacagctcctgatgggtacgaaaagcgtctgcgaagtcggcagtaattggttccaaccaatctacctgggcgctatgttttctctacaagagggagacaagctgatggttaatgttagtgatatctcgctggttgactacaccaaggaggacaagacgttctttggagctttcctcttgtag

SEQ ID NO: 139436 - DNA, 756 bp, Artificial Sequence
  Description of Artificial Sequence: Synthetic coding sequence
atggctgaagacctgggactctctttcggggagaccgcttctgttgagatgctgccggaacatggaagctgcaggcccaaggctaggtctagcagtgctcggtgggccctgacatgttgtttggtacttctacctttcctcgccgggctgaccacctacctactggtatcgcagctgagagcccaaggggaggcatgcgtgcagtttcaggcactgaaaggccaggaattcgcgccttcacaccagcaggtgtacgcaccgctacgggcagacggggacaagccgagggcccacctcaccgttgtacggcagactccaacacaacacttcaaaaatcagttccccgctctccactgggaacatgaactggggttagccttcacgaaaaaccgaatgaactataccaacaagttcttgttgattcccgaatccggagattactttatttattcacaggtgacattccgcggaatgacttctgaatgctcggagatccggcaagcgggacggcccaacaagcctgatagcatcactgtggtgatcacaaaggttaccgattcctatcccgagcctacgcaactgctaatgggaacaaagtcagtatgcgaggtggggagtaactggttccagcccatatatctgggtgccatgttctccttacaggaaggagataaacttatggtgaacgtgagtgacatctcattagttgattacactaaagaagacaagacctttttcggagctttcttgctttag

SEQ ID NO: 139437 - DNA, 534 bp, Artificial Sequence
  Description of Artificial Sequence: Synthetic coding sequence
atgtgcctttcccatctggagaatatgcccttgagccattcccgtacacagggggctcagagatcttcatggaaactgtggttattctgtagcatagtcatgctcctctttctatgcagcttcagttggctgatttttatttttctccagttagagaccgcaaaagagccgtgcatggcaaaattcggccctctgccatcaaagtggcagatggccagcagcgaaccaccgtgcgtgaataaggtttccgactggaaattagaaatcctacagaatggactctaccttatatatggtcaggtagcgcctaacgctaattacaatgacgtcgctcctttcgaagtccgcttatataagaataaggacatgatccaaactctgacaaataaaagtaagatccagaatgtgggtggaacttacgaacttcacgtgggtgacacaatcgatctcatcttcaattctgagcaccaggtgctgaaaaataatacatattggggcatcattctgctagccaacccgcagttcataagctag

SEQ ID NO: 139438 - DNA, 600 bp, Artificial Sequence
  Description of Artificial Sequence: Synthetic coding sequence
atgactctccaccccagtccaatcacatgcgagttcctcttcagcaccgctctgataagccccaaaatgtgcttgagtcacctggagaacatgccattgtcacactcaaggacacagggagcccagcggagctcttggaagctctggttgttctgcagcatcgtcatgctgttatttctgtgtagtttcagttggttgatctttatcttcctgcagctggagacagctaaagaaccttgtatggcaaaattcggacccctccccagcaaatggcagatggcctcaagcgagcccccgtgtgtcaacaaagtcagcgactggaagcttgaaattcttcagaacggactgtatctgatttacggccaggtggctcccaacgccaattataatgacgtggcccccttcgaggtcagactgtacaagaataaggatatgattcagacactgaccaacaaatccaagattcagaacgtgggggggacctatgagctgcacgttggagacaccatagacttaatattcaactctgagcaccaggtgctgaagaacaatacttattggggaataattctcttagctaatccacaatttatttcttag

SEQ ID NO: 139439 - DNA, 552 bp, Artificial Sequence
  Description of Artificial Sequence: Synthetic coding sequence
atggagcgtgtgcagcctcttgaggagaatgtgggaaatgcagcccggcctcgattcgaacgtaataaactcctgctcgtggcctccgtgatccagggtctcggtttattgctgtgttttacctatatatgcttacactttagtgcattacaggtctcacaccggtaccctcgcattcagtctataaaagtgcagtttaccgagtataagaaggagaaaggttttatactgacttctcagaaagaggacgagatcatgaaggtgcagaataatagcgtcattatcaactgcgatggattctatctaatttccctaaaggggtacttcagccaggaggtcaatatatcactgcactatcaaaaggacgaggagcccctgtttcaactgaagaaagtgcgatcagttaactctctgatggttgcctctctgacctataaggacaaagtctacttgaacgtgacaactgacaacacctcactggatgactttcatgtgaatgggggggaactgattcttatccatcagaatccaggagaattctgtgtgctctag

SEQ ID NO: 139440 - DNA, 402 bp, Artificial Sequence
  Description of Artificial Sequence: Synthetic coding sequence
atggtttctcaccgttacccacggatccagtctatcaaggttcagtttaccgagtacaaaaaggaaaaagggttcatcctcacctctcagaaagaggacgaaatcatgaaggtgcagaataactctgtaatcattaattgcgacggtttttatctgatttcactgaagggctactttagtcaggaagttaatattagtttgcactaccaaaaggacgaggagcctctcttccaactaaaaaaggtaagatccgttaattcccttatggtggcctccttaacttataaggacaaggtgtatctgaatgtgaccacagataacacatccctggacgactttcatgtaaatggcggcgagttaattctgatacaccagaaccctggcgagttctgcgtgctgtag

SEQ ID NO: 139441 - DNA, 402 bp, Artificial Sequence
  Description of Artificial Sequence: Synthetic coding sequence
atggtgtcacaccggtaccctcggatccagtctattaaagttcaatttacggagtacaagaaagaaaaaggctttatccttacaagccaaaaggaagacgagatcatgaaagtgcaaaacaacagtgtgattataaattgtgatggcttctaccttattagtctgaagggctactttagtcaggaagtcaatattagcctacactaccagaaagacgaggagcccctctttcaactgaaaaaggtgcgctccgtgaattcgttgatggtcgcctctctgacctacaaagataaggtgtatcttaacgttactaccgacaatactagtctggacgactttcacgtcaacggaggcgaacttattctgatccaccagaaccccggcgaattctgcgtgctgtag

SEQ ID NO: 139442 - DNA, 765 bp, Artificial Sequence
  Description of Artificial Sequence: Synthetic coding sequence
atggagtatgcgagtgatgccagcctggatccggaagccccatggcctcctgctccccgggcccgcgcttgtcgcgttctcccctgggctctggtggctggattgctcttgcttttattgttggcagccgcatgtgccgtttttctcgcatgcccatgggcagtgtcaggggcgagggcttctccaggatctgctgcctccccaagactgcgggaaggacctgagctgtctcccgacgaccccgccgggcttctggacctgcgccaaggaatgtttgcccagctggtagcacagaacgtgttactcatagatggccccctttcatggtacagcgacccgggtctcgcaggggtatcgctgactggcggtctctcatataaagaggatactaaagaactggtagtggccaaagcaggagtgtattatgttttttttcagctcgaactccgacgcgtcgttgctggggagggcagcgggagtgtgagcctagccctgcacttgcagcccctgcggagcgctgccggagcggccgccctggccttaacagtggacctcccccctgcgagctcagaagcaagaaatagcgcattcggattccaggggcgactgctgcacctctccgcgggccagagacttggtgtgcacttgcacacggaggcccgcgctcgccacgcttggcagttaacccagggggctactgtcctggggctcttccgtgtgactcctgagattccagccggcctgccttcccccaggagcgaatag

SEQ ID NO: 139443 - DNA, 1851 bp, Artificial Sequence
  Description of Artificial Sequence: Synthetic coding sequence
atggcccccagggcccgcagaagaaggcctctctttgccctgctgctgctctgtgctctgttggctaggttgcaggtggcactgcaaatcgccccaccctgcactagtgagaaacactatgagcatctcggacgctgctgcaacaaatgtgagcccggcaaatacatgtcctccaagtgtactactacttccgattccgtctgccttccttgtgggccagacgaatacctggacagttggaatgaggaagacaaatgccttttgcacaaggtgtgcgacactggtaaggccctggtggctgtagtggctggaaattccaccacacccaggcggtgtgcgtgcactgcagggtaccattggtcacaggactgtgaatgttgccgccgcaacacggaatgtgcccctggattgggggcccaacaccctctgcagttaaacaaggataccgtgtgcaagccatgcctggccggatacttttccgatgctttctcctccactgataagtgccggccatggacaaattgtacattcctggggaagagagttgaacaccacggcaccgaaaaaagcgatgccgtttgttcctcttccctgcctgctcgcaaaccacccaacgagccacatgtttacctgcctggtctcatcattctcttactctttgcctccgtggccctggtggccgctattatattcggcgtttgttataggaaaaagggcaaggcactgactgccaacctctggcactggatcaacgaagcctgtggcagacttagcggcgacaaggaatcctctggagattcttgcgtgagcacccacactgccaacttcggacaacaaggcgcatgtgaaggcgtgctcctgcttaccctggaagagaaaaccttccctgaagatatgtgttaccccgatcagggtggagtgtgccagggcacatgcgtcgggggaggtccctatgctcaaggtgaggacgctaggatgcttagcctggtttccaagacagagatagaagaggactctttcagacagatgccgaccgaagatgaatacatggatcgacctagccagcccacagatcagctcctctttttaacagagcccggctccaagtccacaccaccattctcggagcccttggaagtaggagaaaacgacagcctctctcaatgctttactgggactcagtcgacggttggatccgaatcttgtaattgcaccgagcctctttgtaggactgactggactcccatgagctcagagaactacctccagaaagaagtagattctgggcactgcccacattgggccgcctcgcctagccccaactgggccgatgtgtgtacaggatgcaggaaccctcccggggaggactgtgaacccctggtgggttccccaaagagaggccccctgccacagtgcgcttacggcatggggttgcccccagaggaagaggcttctcggaccgaggccagagatcagccggaagatggagccgacggacgcctgccttcttctgccagggccggagcaggctcgggttccagccctggcggccagagtccagcttcaggtaacgttacgggtaactccaacagcacttttatttcctcaggccaggtaatgaatttcaaaggcgatattatcgtggtgtacgtttcccaaaccagccaggagggcgcagccgcagctgcagagccgatgggtagacccgtgcaggaggaaacgctggcaaggagagacagtttcgccggaaacgggcccagattccccgatccatgtggaggtcccgagggactgcgcgagccagagaaagcgtcaaggccagtgcaggaacagggaggagccaaggcctag

SEQ ID NO: 139444 - DNA, 780 bp, Artificial Sequence
  Description of Artificial Sequence: Synthetic coding sequence
atggcaagaattcctaagacgctgaagtttgtggtggtgattgtggctgtgctgctcccagtgctcgcgtattcagccaccaccgctcgacaagaggaggtgccacaacagaccgtggccccccagcaacaaagacactccttcaagggtgaggagtgccctgccggaagccacaggagcgagcacactggagcttgtaatccttgcacagagggtgtcgactacactaacgcatctaataatgagccaagctgcttcccctgtactgtttgcaaatccgatcagaagcataaaagttcatgcaccatgacaagagacactgtctgtcagtgcaaggagggcaccttcaggaatgaaaactcgcctgagatgtgtaggaagtgctcaaggtgcccctctggtgaagttcaggtgtctaactgcacgtcttgggacgacattcagtgtgtagaagaatttggcgctaacgcgactgtggaaacccccgctgccgaagagacgatgaacacctcacccggtactcctgctcccgcggccgaggaaaccatgaataccagtccgggaaccccggcccccgccgcagaggaaaccatgaccacatcgcctggcacccctgctcctgccgctgaggagactatgacaacgtctcctggaacacccgctcctgccgcggaagaaactatgattacatcaccaggcactcccgcatcttctcactatctgtcatgtaccatcgtgggtatcattgtcctgattgtgctgcttatcgtctttgtttag

SEQ ID NO: 139445 - DNA, 474 bp, Artificial Sequence
  Description of Artificial Sequence: Synthetic coding sequence
atgacaagagacacagtgtgtcaatgtaaggagggcacctttcgcaacgaaaactcccctgaaatgtgccgaaagtgctcacgttgtccctcaggtgaggtgcaggtctcgaattgtacatcttgggacgacattcagtgcgtggaggagtttggggccaatgctacagtggagacccccgcagcagaggagactatgaacacctcccctgggacccccgcaccagccgccgaggaaacaatgaacacctcccccggaacccccgctccagccgccgaggagaccatgaccactagtcctggcactcccgcacccgctgctgaggaaactatgaccacctcaccaggaacccctgcgcccgctgcggaggaaaccatgatcacctctccaggcacacccgcatctagccattacctcagctgtacgatagtcggcattattgtactaattgtccttctgatagtgttcgtgtag

SEQ ID NO: 139446 - DNA, 834 bp, Artificial Sequence
  Description of Artificial Sequence: Synthetic coding sequence
atggcccggattcccaagaccctgaaattcgtggtggttatcgtggcggtgctgttgccagtcttggcctactccgcaaccaccgcacgccaggaggaagtacctcagcagactgtggcccctcagcagcaacggcactcatttaagggggaagagtgtccggccggtagtcatcggtcagagcacaccggcgcctgtaatccatgcacagagggagtggattacaccaacgctagcaataatgagccgagttgtttcccctgtaccgtctgtaagagtgatcaaaaacacaagtcttcatgcaccatgacgagagacactgtgtgtcaatgcaaggagggaactttcagaaatgagaattctcctgaaatgtgtcggaaatgctcccgttgtcctagcggcgaggtccaagttagcaattgcacaagttgggacgatatccaatgtgtggaagaatttggcgccaacgcaactgtggagacacctgcggcagaggagaccatgaacacctcccccgggactcccgcgccagcagcagaggagaccatgaacacgtctcccgggacacctgctcccgctgctgaagaaaccatgaccacatcaccagggactccggctccagcagcggaagagactatgacgacaagccctggcacacctgcccccgcagccgaagagaccatgattacatcccccggcacacccgcttcctcacactacctgtcctgcacgattgttggaattatcgttcttatcgtcttgctgattgtcccctatttgaaaaagaaaaaaaagaaaaaactcaagaagaagcaaaagcgaaagagcaagtag

SEQ ID NO: 139447 - DNA, 1851 bp, Artificial Sequence
  Description of Artificial Sequence: Synthetic coding sequence
atggcccctcgcgcaaggagacgacgaccccttttcgcgttgctcttattatgcgcccttctggcccggctgcaggttgccctacagatcgcccccccgtgtacctcagaaaagcactatgagcacctgggtagatgttgtaacaaatgcgaaccaggaaagtacatgtcgagcaaatgtaccactacttctgatagcgtgtgtctcccctgtggccctgacgagtacctggattcctggaatgaggaagacaagtgtttactccacaaggtgtgcgataccggtaaagcgctggtggctgtcgtggccggaaactccacaacccctaggcggtgtgcctgcaccgcaggttatcattggagtcaagattgtgaatgctgccgacgcaacacagagtgcgctcccggactgggggcccaacaccctctgcagcttaacaaggacacagtgtgcaagccttgcctcgctggctatttttccgacgccttttcgtctaccgacaaatgtcgcccatggaccaactgtacctttttgggcaagcgggtcgagcaccacgggacagaaaagtctgatgcggtgtgtagcagctctcttccagcccgaaagccaccaaacgaaccacatgtgtatctgcccggcctcataatcctgctgctgtttgcaagtgtcgccctcgtggcggcaataatcttcggagtgtgttacagaaagaagggaaaggccttaactgccaatctctggcactggatcaatgaagcatgcggaaggttgtcaggcgacaaagagtcttctggtgattcatgcgtttccactcacaccgctaacttcggtcagcagggagcatgcgagggtgtgctgttgctcacactggaggagaaaacattccccgaggatatgtgctacccagatcaggggggtgtctgccagggcacctgtgtagggggcggaccatatgctcagggcgaagacgccaggatgttgagcctggtgagcaagacggagatcgaagaggattccttcagacagatgcctacagaggatgaatatatggacagaccttcccaaccgacagatcagctgttgttcctgacagagcccggatctaaatctacccctccttttagcgaacctctggaagtcggggagaacgatagtctgtcccagtgcttcacaggaacccagtccaccgtgggcagcgagtcctgtaattgtaccgaaccactctgccggactgattggacacctatgtcctccgaaaactacttgcaaaaggaggtagatagtggccattgcccccattgggctgcctctccttctccgaactgggctgatgtttgcaccggttgtaggaatcctcctggtgaggattgcgagccgctggtgggctcccctaaacgcggccctctgcctcagtgcgcatacgggatgggtttgcccccagaagaggaggcctcacggacagaagccagagatcagcccgaggatggagctgatggaaggctcccatcaagcgcccgggcgggggccggcagcgggtcctctccaggtggccaaagcccagcaagtggaaatgtgaccggtaatagcaactcgacttttatatccagtggtcaggttatgaactttaagggcgacattatcgtcgtctatgttagccaaactagtcaggagggagctgccgccgccgcggaaccaatgggtagaccagttcaggaagagacactggcccggcgagattcatttgccgggaacggtcccaggttcccggatccttgtgggggccctgaggggttgagagagcccgaaaaggcatctaggcccgttcaggagcagggaggcgccaaggcctag

SEQ ID NO: 139448 - DNA, 966 bp, Artificial Sequence
  Description of Artificial Sequence: Synthetic coding sequence
gggtcgagggcaaggtgggcaaccgaggccgcagaggcagctgcccctgctagccttagtagagccatggcaccccgggcccggaggcgaagacccctgtttgcacttttattgctttgcgcactactggcaaggctgcaggtggccctgcagattgcgccgccgtgtaccagtgaaaaacactacgaacaccttgggaggtgttgcaacaagtgcgagcccggcaaatacatgagctctaaatgcacgacaacaagtgatagcgtgtgtctgccttgtggccccgatgaatacctcgacagttggaatgaggaagacaaatgtttattacacaaagtgtgcgacacaggtaaagcgctggtcgccgtcgttgctggcaacagcacaaccccccgcagatgcgcctgcaccgccggctatcactggagtcaggattgtgagtgctgcaggagaaataccgaatgcgcacccggtctgggcgctcaacatccccttcagctgaacaaagacaccgtgtgtaagccttgcctggccgggtacttttccgacgcatttagtagtactgacaagtgcaggccatggaccaactgcacattcttggggaaacgggtggaacaccacggcacagagaaaagtgacgccgtctgcagttccagcctgcctgcgagaaagccaccaaacggtaacgtgacaggaaatagtaatagcaccttcatttcctcagggcaagtcatgaattttaaaggggatataatcgtcgtgtacgtgtctcagacttcccaggaaggagcagcagccgctgccgaacctatgggacgtcctgtacaggaagagacactagctcgccgggacagcttcgcaggtaatggaccccgcttccctgatccctgcggaggcccagagggtctgcgggaaccggagaaggcatcaaggccagtacaggaacaaggcggagcgaaagcctag

SEQ ID NO: 139449 - DNA, 1206 bp, Artificial Sequence
  Description of Artificial Sequence: Synthetic coding sequence
atgaataatctcctctgttgtgcgctggtgttcttagatatctctatcaagtggacaacccaagagacctttccacctaaatacttgcactacgatgaagagaccagccatcagcttctctgtgataagtgcccaccgggcacctaccttaaacaacattgcaccgctaagtggaagaccgtgtgtgcgccgtgccctgatcattactatactgactcctggcacacgtcagatgagtgcctgtactgctctcccgtgtgtaaggaactccagtatgtgaaacaggaatgcaataggactcataatcgagtgtgcgaatgcaaagagggaaggtacctcgagattgagttctgtctgaaacaccgaagctgtccaccaggcttcggcgtggtgcaggctggtacccctgaacgaaataccgtctgcaagcggtgtcccgacggcttcttttccaatgagaccagctcaaaagccccctgccggaagcacaccaattgtagcgtctttggccttttgctgacacagaaagggaatgccacacatgacaatatttgctccggaaacagtgagtctacgcagaaatgtggcatagatgtgactctatgcgaggaagcattttttcgcttcgctgtgcctacaaagttcactccaaactggctctctgtgctggtcgacaacttgccaggtacaaaggtgaatgccgagagcgtggagcgtatcaagagacagcactcatcccaggaacaaacctttcaacttcttaagctttggaagcatcagaataaggatcaggatattgtcaagaagattatccaagatatagatctttgtgagaactctgttcagcgccatattggccatgcaaacctgactttcgaacaacttagatcactcatggaatccttgcctgggaagaaggttggagctgaggatatcgagaagactatcaaggcctgcaagccaagcgatcagatcctgaagctgctgagcctctggcgtataaaaaacggagatcaagataccttaaagggactaatgcatgccctcaaacactccaagacatatcatttccctaaaacggtgacacagagtctaaaaaaaactataagattcttacacagcttcaccatgtacaaactctatcaaaaactttttcttgaaatgataggaaaccaggttcagtctgtgaaaatttcttgtttgtag

SEQ ID NO: 139450 - DNA, 390 bp, Artificial Sequence
  Description of Artificial Sequence: Synthetic coding sequence
atggcaaggggttccctacgtcgcttgctcagacttttggtccttgggctttggttagctctgctccgctcagtagcaggcgagcaggcccctggaacagccccatgttccaggggatcttcttggagcgccgacttagataagtgtatggactgtgcttcatgtcgggcacgcccccacagcgacttctgcctgggttgtgcagctgcaccccctgctccatttaggctcctatggcccattctgggaggcgccctgtccctcaccttcgtcctcgggcttctgagcggcttcttagtgtggcgcagatgccgacgcagggagaagtttaccactcccattgaagagactgggggtgaaggatgcccggctgtggccctcatacagtag

SEQ ID NO: 139451 - DNA, 285 bp, Artificial Sequence
  Description of Artificial Sequence: Synthetic coding sequence
atggctcgcggctctctcaggcggctacttcgactcctggtattaggcctttggctggctctgctacggtctgtggcaggtgaacaggctcctggagctgccgcccctccggcaccctttcgccttctttggcccatccttggaggagcgctaagcttgacctttgtgctcggcttactctccggcttcctcgtttggagacggtgcaggcggagggaaaagtttacaactccgatcgaagaaaccggcggagagggctgtccagctgtggctctgattcagtag

SEQ ID NO: 139452 - DNA, 882 bp, Artificial Sequence
  Description of Artificial Sequence: Synthetic coding sequence
atgagcggcttggggcgatctagacgcggggggcgcagtagagtcgatcaggaggaacggttccctcaggggctctggacaggggtggctatgaggtcttgtccggaggagcaatattgggaccctttgctgggtacatgtatgagctgcaaaacaatttgcaatcatcagtcgcagcggacctgtgcagccttttgccgatcgctgtcttgcaggaaagagcagggaaagttctatgatcatctgttacgcgattgcataagctgtgctagcatatgtggacagcatcccaaacaatgcgcatacttctgcgaaaataagcttcgcagtcctgtaaatctgccacccgagctgaggagacaacggtcaggtgaagtggagaataattcagataattcaggccgttatcaggggttagagcaccgcggaagcgaggccagcccggccctgcctggcctgaaactgtccgctgaccaagtggccctggtctactcaacactcggactgtgcctgtgtgctgtcctctgttgtttcctggttgccgtggcctgttttctcaagaagaggggggatccatgcagttgtcagcctcgctctcggcctcggcaatctcccgccaagtccagtcaggatcacgccatggaagccgggtcacctgtttctaccagccccgagcctgtggaaacgtgctctttctgtttcccagaatgtcgtgctcccacacaggaatcggcggtcacgccaggaacccctgacccgacttgtgccgggcggtggggatgccacactagaaccactgtcctccaaccatgtccacacatccctgactccggattaggcatcgtgtgtgtgccagctcaggagggaggacccggtgcgtag

SEQ ID NO: 139453 - DNA, 747 bp, Artificial Sequence
  Description of Artificial Sequence: Synthetic coding sequence
atgagcgggcttgggagaagtcgacgcgggggtaggtctcgtgttgaccaggaggagcgttggtccctgtcatgcagaaaggaacaaggtaaattctatgaccatcttttgagagactgtatatcgtgtgccagtatatgcggtcaacatccaaagcagtgcgcctatttttgcgagaataagctgagatccccggtcaacttaccccccgaattgcggagacagaggagcggcgaagtggagaacaacagtgataactcagggagataccagggtctggaacaccgcgggagcgaagcatcaccagcgctaccaggcctgaaactgagcgctgaccaggtagcactcgtctactcaactttgggtttatgtctctgcgctgttttatgctgctttctcgtggctgtcgcttgtttcttgaaaaagcgcggcgatccatgttcctgccagccccgctcaaggcctcgacaatcccccgctaaatctagccaggatcacgccatggaggccgggtcacctgtgagcaccagtccagagccagtcgagacgtgtagtttctgcttccccgaatgtagggcccccacccaagagagtgcagttactccggggactcccgacccaacctgtgctggccgcaaaaccaagcctccccccgtcctcactgcaggtaattgtggagtgcacaggcccccaccagaaacctcaaccggatccccccgcgggcagaggttgctctggacccagtag

SEQ ID NO: 139454 - DNA, 555 bp, Artificial Sequence
  Description of Artificial Sequence: Synthetic coding sequence
atgcgaaggggcccgaggtctctcagagggcgcgatgccccagcacctaccccgtgtgtccctgctgagtgtttcgatctgctcgttagacactgtgttgcatgcggtctgctacgtacccccagaccaaagcccgcaggggcttcgtcgccagcccctcggactgcacttcaacctcaggagtctgtcggtgccggcgcaggcgaagctgctctgcccctgccaggcctcctattcggcgcaccagctctgctgggcctcgccctggttctggctttggttcttgtaggcctcgtctcctggcgcagacgtcagagaagacttagaggcgcgtcctcggccgaggctcctgacggtgataaagacgcaccggagccgctggataaggtcatcatcctgagtccgggaatcagcgacgctacagctcccgcctggccaccaccaggggaggatccaggcaccacacccccgggccactctgtgcctgtcccagccaccgaactaggtagtaccgaacttgtgactaccaaaaccgccggccccgagcaacagtag

SEQ ID NO: 139455 - DNA, 852 bp, Artificial Sequence
  Description of Artificial Sequence: Synthetic coding sequence
atggaaccgcctggtgattggggacctcccccttggcgtagcacaccaaaaacggacgttctgaggctcgttctgtatctgacattccttggagcaccttgctacgccccagctctgccatcatgcaaggaggatgaataccccgtgggttccgagtgttgccccaagtgcagccctgggtacagagttaaggaagcatgtggggagttaacaggaactgtttgtgaaccatgtcccccgggaacatacattgcccacctcaacggcctctcaaaatgcctccaatgccagatgtgtgacccagctatgggacttcgagcctctcgcaactgtagcaggactgagaatgctgtgtgtggatgttctcctggtcacttttgtatcgtgcaagatggtgatcactgcgctgcttgtcgggcgtacgccacatcgagccctggccagagagttcagaagggggggacggagtcccaggatacactctgccagaattgcccaccaggcacgttctctccaaatggaactctggaagagtgccaacaccagactaaatgctcatggctcgtgactaaggccggcgcagggactagcagttcccactgggtctggtggttcctgagcggaagcctcgtcatagtcatagtctgcagcaccgtgggactaattatttgcgttaagagaagaaagccacgcggggacgttgtgaaagtaattgtttctgttcaacgcaagcgacaggaggccgagggcgaagccaccgtcattgaggcgcttcaggccccaccggatgtaacaacggttgcagttgaagaaaccattccatcattcactggcaggtcccccaatcattag

SEQ ID NO: 139456 - DNA, 522 bp, Artificial Sequence
  Description of Artificial Sequence: Synthetic coding sequence
atggagccccctggagactggggcccgcccccatggcggtccaccccaaaaaccgatgtgctgagactggtgctgtacctcacttttctgggggccccttgctatgctccagctcttccgtcctgcaaggaggatgaatatcccgtcggcagtgaatgctgccccaaatgtagccctggctatcgcgttaaagaggcatgcggagagctgaccggcacagtctgtgaaccctgcccgcctgggacatacattgcgcatttaaacggcctttcaaaatgtttacaatgtcaaatgtgtgatcccgacatcgggagtccatgcgatctgaggggcaggggccatctcgaggccggggcacacctgagccccgggagacagaagggtgaaccggacccggaagtggcctttgagtccctctcagctgagccccatgccagactttcgatggcctctgcaccatgtggccaggcaggcctacatttacgcgaccgcgcagacggaacgcctggagggagggcatag

SEQ ID NO: 139457 - DNA, 552 bp, Artificial Sequence
  Description of Artificial Sequence: Synthetic coding sequence
atggagccccccggtgactggggtccacctccttggcgatctacccccaaaaccgatgtgttgagactagtgctgtatcttaccttcctgggcgctccatgttatgctcctgccttgccaagctgcaaggaggatgaatatcctgttggatctgaatgctgccctaagtgtagcccaggataccgtgtgaaggaggcctgtggcgaactcacaggtactgtgtgtgagccatgtcctcctggcacgtatattgcacatttaaatggattgagcaagtgcttgcagtgtcagatgtgcgacccggccatgggcttaagagcatctcgaaactgctctcgcacagagaacgctgtgtgtggttgttcgcctggccatttctgcatagtacaggatggggaccactgcgccgcttgccgagcctatgctacaagcagccctggtcagcgggtccagaaaggaggaacggagtctcaggacacgctatgtcagaattgcccacctgggacattcagtccaaacggcactctcgaggagtgccagcatcagacatag

SEQ ID NO: 139458 - DNA, 696 bp, Artificial Sequence
  Description of Artificial Sequence: Synthetic coding sequence
atggaacccccaggagattggggcccacctccatggcgtagcaccccaaaaactgacgtcctccggctcgtgctgtatctcacatttttgggcgctccttgctacgcacctgctttaccctcatgcaaggaggatgaatacccagtcgggagtgaatgctgtccgaaatgtagcccaggctacagggtgaaagaagcttgcggagagctcacgggcacagtatgcgagccatgtcccccaggcacttacatcgctcacctcaatggactgagcaagtgccttcaatgtcaaatgtgtgacccagcaatgggattacgggccagccgcaactgctcgagaaccgagaatgcggtgtgcggatgttcaccggggcacttttgtatcgtgcaggatggagatcattgtgcagcttgccgcgcctatgccacctcctctccaggacagcgagtgcagaaaggaggcaccgagagccaggataccctgtgccagaactgcccaccaggaaccttctctccgaacgggactctggaggaatgtcagcatcagaccaaatgtagctggcttgtaaccaaggccggagctggcacctcctcaagccactgggtctggtggttcctgtctgggtctctggtcattgtcatcgtctgttcaacagttgggttgatcatctgtgtgaaacgaagaaaaccaagatag

SEQ ID NO: 139459 - DNA, 696 bp, Artificial Sequence
  Description of Artificial Sequence: Synthetic coding sequence
atggagccacccggcgattggggccccccgccatggcggtcgacgccgaaaaccgacgtgttgcgactggttctgtatctgacctttctgggagccccctgttatgcaccggccctgcctagttgtaaggaggacgagtatcccgtggggagtgaatgttgtcccaagtgctccccagggtacagggtgaaagaggcctgcggggaattgactggaaccgtttgcgagccgtgtccccctggaacttacattgcccacctgaacggtttgtcaaagtgcctgcagtgtcagatgtgtgatccagcgatgggtctgagggcttctagaaactgtagtcggacagagaatgccgtgtgcggctgcagtcccggacatttctgtatagtgcaggacggagaccactgcgccgcatgtagggcatacgcaacctcttccccaggtcagcgagtccaaaaaggtggcacagagtcccaggacaccctgtgccagaattgtccacccggcacctttagccctaatggaactctcgaagagtgccaacaccagaccaagtgtagctggttagttaccaaagccggagctgggacaagctcatctcactgggtgtggtggtttctcagcggctctctggtgatcgtcattgtgtgcagcaccgtgggcctcattatctgtgtcaagcgcagaaaaccacggtag

SEQ ID NO: 139460 - DNA, 696 bp, Artificial Sequence
  Description of Artificial Sequence: Synthetic coding sequence
atggaacctcctggcgattgggggcctcccccatggcgctctacccccaaaacagatgtccttcgtcttgtgttatacctgaccttcctgggtgccccatgttacgcaccagcattgccctcctgtaaagaggacgaatatccagttgggagtgaatgctgtcccaagtgcagtccagggtacagggtaaaagaggcctgcggcgaactgaccgggactgtgtgcgagccatgtcccccaggaacctacattgcccatctcaatggtctgagcaaatgtctgcaatgccagatgtgcgatcctgcaatggggcttcgcgctagccggaattgttccaggacagaaaatgcagtttgtgggtgctcaccagggcacttctgtatcgtccaagacggggatcattgtgcagcctgccgtgcctacgcaacaagcagcccgggacagagagtgcagaagggaggaaccgagtcccaggatacactgtgccagaattgtcctcccggaaccttcagcccgaacgggacccttgaggagtgtcagcaccagaccaagtgtagctggctcgtgaccaaagcaggggccgggaccagttccagccattgggtgtggtggttcctttctggctccctcgtgatagtgatcgtatgttctacagtgggactcatcatatgtgtcaaacgccggaagcctcgatag

SEQ ID NO: 139461 - DNA, 555 bp, Artificial Sequence
  Description of Artificial Sequence: Synthetic coding sequence
atgttgcagatggccggccagtgttctcagaatgagtactttgactctctgcttcatgcctgtataccttgccagctccgctgcagcagcaatactcctccactgacatgtcagagatactgcaacgcttctgtgacaaacagcgtcaaaggcacgaatgccattctgtggacctgtctgggtttgagtctcatcatatctctggctgtattcgtgttaatgttcctgctgaggaagatcaattccgaaccactcaaggacgaattcaagaacactggcagtggcctgctcggtatggccaatatcgatctcgaaaaatccagaacaggtgacgagattattttacctcgaggcctggagtacaccgtagaagaatgcacttgcgaggactgcatcaagtctaaacccaaggtggattctgaccattgcttccctctcccggccatggaggaaggggcaacgatactggtgacgaccaagactaacgattattgtaagagtctcccagccgcgctgtcggccaccgagattgagaagagcatttctgcccggtag

SEQ ID NO: 139462 - DNA, 408 bp, Artificial Sequence
  Description of Artificial Sequence: Synthetic coding sequence
atgctgcaaatggctggccagtgctcacaaaacgaatatttcgactccctgcttcacgcgtgtattccctgccagcttcgttgtagtagcaatacaccccccctgacttgccagcgctattgtaacgcccgatccggtttgctggggatggcaaatatcgacctcgagaaatctcgcacgggtgatgaaattatcctgccacgcggcctggaatatactgtcgaggagtgcacctgtgaggactgtataaagtccaagccaaaggtggactctgatcattgctttccgcttcctgccatggaagagggggccacaattttggttaccactaaaactaacgactactgcaaatccctcccagctgccctgtctgcaaccgaaattgaaaagagcattagcgcccgctag

SEQ ID NO: 139463 - DNA, 417 bp, Artificial Sequence
  Description of Artificial Sequence: Synthetic coding sequence
atggctggccaatgtagccaaaacgagtactttgattccttgctacacgcttgcatcccatgccagcttcgttgctcgagcaatacaccgccactcacctgtcagaggtattgtaacgcctctgttaccaacagtgttaagggtaccaatgccatcctgtggacatgcctgggcttgtccctgattatcagcctggccgttttcgtgttaatgttcctactgcgcaagattaatagcgagccgcttaaagatgaatttaagaacacggaaatggaaagccgaagcgtggcacaagcgggcgtccagtggagggatctcaattcccttcaacctcttcctctcggcttcaagcaattttctcatctgagcttgctgtcgaattgggactacagaattaggagcccgggacatggctag

SEQ ID NO: 139464 - DNA, 768 bp, Artificial Sequence
  Description of Artificial Sequence: Synthetic coding sequence
atggcccaacatggagcgatgggtgctttccgggcactttgtggcctggctttgctttgtgcgctctccttagggcaacggccaacagggggcccgggttgtggccccggaaggctgctcctgggaaccggtactgacgcccgatgctgcagggtgcacacaacaagatgctgtcgtgactatcccggagaagaatgctgcagcgagtgggattgcatgtgtgttcagccggagttccattgcggagacccatgttgcaccacctgcagacaccacccatgccctccggggcagggcgtgcaatctcagggcaaattttccttcggctttcagtgcatcgattgcgcaagcggcaccttctccggtggacacgagggacattgcaagccctggacagattgttgctggcgctgccgccggcgaccaaagacaccagaagcagcaagcagcccccgtaagagtggagcatccgatcggcaacgcagacggggagggtgggagacttgtggctgcgaacctggaagaccccccgggccacccaccgccgcctcccctagtccaggcgccccacaagcagctggcgccctacgcagtgcactgggccgagccctcctaccctggcaacagaaatgggtgcaggaaggtggctcagaccagcggccgggcccctgtagctctgcggccgctgccggaccatgccggagagagcgcgaaactcaatcatggccacctagcagtctggctggcccagacggggtgggctcatag

SEQ ID NO: 139465 - DNA, 705 bp, Artificial Sequence
  Description of Artificial Sequence: Synthetic coding sequence
atggcacaacacggcgccatgggcgctttcagggctctttgtggactggcactcctctgtgccctctcgctgggccagagaccgaccgggggaccaggatgtggtcccggcaggcttttgctaggcaccgggaccgacgcccgctgctgcagggtccatacaactcgttgctgtagggattacccaggagaggaatgctgcagcgaatgggactgtatgtgtgtgcagcccgagtttcattgcggtgacccttgctgcactacctgtagacatcatccctgtccgcctggacagggcgtgcagagtcaaggtaagttctctttcggattccagtgcattgattgtgcctcaggcactttcagtggcggccacgaaggacactgcaagccctggaccgattgtacccagttcggctttttgactgtttttcccggaaataaaacccataacgccgtgtgtgtgccaggaagtccccccgcagaaccccttggatggttgacagtggtgctcctggctgttgctgcttgcgtgctgctcctgacctctgcccagctgggcctacatatatggcagctgcggaaaactcagctgcttcttgaagtaccaccctccacagaagatgcgagaagttgccagttcccagaagaagagcgtggcgaacgcagcgcggaggagaaagggagactcggcgacttgtgggtatag

SEQ ID NO: 139466 - DNA, 726 bp, Artificial Sequence
  Description of Artificial Sequence: Synthetic coding sequence
atggcccagcacggcgcaatgggcgctttcagagcgctctgcggcctcgcactgctctgcgcactctctctgggtcagcggccaacaggcgggccgggttgtggacctggcagactactgctgggtaccggaacagacgcaaggtgttgcagggtgcacacgaccaggtgctgccgcgactaccctggcgaagagtgttgcagcgagtgggactgtatgtgcgtgcagccagaattccattgtggagacccctgttgtactacgtgccgccaccacccttgccctcccggtcagggggtgcagtcccagggaaagttctcctttggtttccaatgtattgactgtgcatccgggacttttagtggcgggcatgagggccactgtaagccatggacagattgcacacaattcgggtttctcaccgtcttcccagggaacaaaacccacaacgctgtgtgtgtacctggttctccacctgcagaacctcttgggtggcttaccgtggtgcttctggcggtggcagcctgtgtcctattactaactagcgctcagcttggattgcatatctggcagctgaggtctcagtgcatgtggccacgggagactcagctgctccttgaggtgcctccatcgaccgaggatgctcggtcatgccagtttcctgaagaagaacggggggaacgaagcgctgaagagaaaggtcgcctcggcgatctgtgggtttag

SEQ ID NO: 139467 - DNA, 834 bp, Artificial Sequence
  Description of Artificial Sequence: Synthetic coding sequence
atgtgcgttggcgcgcgaaggctgggtagagggccatgtgcagcacttttgctgcttgggcttgggttaagtacggtaacggggctgcactgtgtcggtgatacctatccaagcaacgacagatgctgccatgaatgcaggccagggaatggcatggtgagtagatgcagtagaagtcaaaataccgtctgcaggccttgcgggccagggttctataacgatgtggtgagttccaagccttgcaaaccctgcacctggtgtaacctgcgctccggcagcgaaagaaaacaactctgcaccgcgactcaagacacggtatgccgttgtcgggctggaactcagcccctggattcctataagcccggcgttgactgtgctccatgccctccaggtcacttttcccccggtgataatcaggcctgcaagccttggacaaattgtacattagctggcaaacatactctgcagcccgcctcaaactcctctgacgccatttgcgaggatcgcgatccacccgctactcagccccaggaaactcaggggccgccagcccggccaataacagttcagcccaccgaagcatggcccagaacctctcagggaccgagcactcgtccagtggaagtccctggcgggcgagccgtcgcagccattctgggcctgggcctggttcttggtctcctggggcctttggctattctgttagccttgtatctgctgagacgggaccagcggttgccccctgacgcccataaacctcccgggggcggctcttttagaacaccaatccaggaagaacaggccgacgctcacagcaccctcgcaaagatctag

SEQ ID NO: 139468 - DNA, 399 bp, Artificial Sequence
  Description of Artificial Sequence: Synthetic coding sequence
tagcctggcgctccccccctcccccccggagcccagaccaggcctcgcccaagaggggtcggcgagaccacattagccatgtggcccggtctcgccggactgtcgaggagtggctccgagcggaaacagctgtgtactgctacccaggataccgtttgccgctgccgcgcaggtacccagccgcttgattcgtataagccaggcgttgactgcgccccatgtcctccgggacacttctcgcccggcgacaaccaggcttgtaagccctggaccaattgtaccctagctggcaaacatacattgcagcctgccagcaattcaagtgatgcaatctgcgaagaccgcgaccccccggctacccagccccaggagacacagggacccccagccaggccatag

SEQ ID NO: 139469 - DNA, 423 bp, Artificial Sequence
  Description of Artificial Sequence: Synthetic coding sequence
atgagggccctcgaggggcccgggctgagtcttctgtgcctcgttctagccctgcctgcccttctgccggtacctgccgtgcggggcgtggctgagactccgacttatccttggagggacgctgaaaccggggagaggctggtctgcgcacagtgcccccctggtactttcgtccagcgtccctgccgcagagactcaccaaccacctgtggcccctgccctccacgccattacacacagttctggaattacctggagagatgtagatactgcaacgtcctatgcggcgagcgcgaggaggaagctagagcgtgccacgccacccataatcgcgcctgctgcgggtgctgtagacgctgtgcgtggccaggatgcccgggttggagtggggcctctgtgagtgcctcaagcctctgcacttag

SEQ ID NO: 139470 - DNA, 903 bp, Artificial Sequence
  Description of Artificial Sequence: Synthetic coding sequence
atgagggcccttgaagggcctggattgtcattactgtgtctggttctggctctgcctgccctcctgcccgtaccagctgtccggggagtggccgaaaccccgacctacccctggcgtgacgcagaaaccggggagagactggtgtgtgcccagtgccctcccggtaccttcgtgcagcggccttgccggagagacagcccaacaacgtgcgggccctgtccaccaagacattacacgcaattctggaactatttggagagatgccggtattgtaatgtgttgtgtggagaaagggaagaagaagcacgagcctgccatgccacccacaatcgcgcctgcaggtgcagaacaggttttttcgcccatgcaggattctgcttggaacatgcatcttgtcctcccggcgcaggcgtgatagcgccgggcacccccagccagaatacacagtgtcaaccttgccctcccggcacttttagtgccagcagctcctccagtgaacagtgtcagccacataggaattgcaccgcccttggcctggccctgaacgtgccgggaagcagctctcacgacacgctttgcaccagctgtacaggatttcctctctcaacgcgcgttcccggggctgaggagtgtgagcgcgccgttattgatttcgtggccttccaagacattagcatcaaacggctgcagagactcctccaggcactggaagctccagaaggttggggccctaccccacgtgccggcagagccgctctgcaactaaaactgcgcaggcgcctcaccgagctgctaggggctcaggatggcgctctactggttagattactacaggccctgcgggtggctagaatgcccgggctggaaaggagcgtcagagagcgctttctccccgtgcactag

SEQ ID NO: 139471 - DNA, 903 bp, Artificial Sequence
  Description of Artificial Sequence: Synthetic coding sequence
atgagggcccttgaggggccaggcctctcgctgctctgtctggtacttgccctccctgccctgctgccagtgccagcagttcggggcgttgcagagacccccacttatccttggcgggacgccgagactggcgaacgactcgtctgcgcacaatgccctccgggcaccttcgtgcagcggccatgtagacgcgactcaccgacaacttgcggtccctgtcctccacgccattatactcagttttggaactatctggagcggtgccgctactgcaatgttctttgtggcgagcgcgaggaggaagccagggcctgtcatgccacacacaatcgagcatgcagatgcaggaccggattctttgcgcacgccggcttttgtctcgagcacgcctcgtgtcccccaggcgctggcgtgatagctccaggcactccaagccagaacacgcagtgtcagccctgccctccaggtactttctctgcctctagctcaagcagcgaacagtgccagccacatagaaattgcaccgctttaggactggctcttaatgtcccaggtagctcatctcacgacaccctgtgcacctcatgtaccggctttcctctatcaacacgagtgccaggcgccgaggaatgcgaacgagccgtaattgattttgtggctttccaggacatctccatcaagcggttgcagcggttgctgcaggctctcgaagctcccgagggatggggccccacccccagggccgggagagctgccctgcagctgaaactgcgtcggcggctgacggagcttttgggagcacaggacggcgccctgctggttcggcttctacaagctctcagagttgcaaggatgcctgggctcgaacgatcggtgcgggaacggttcctgcctgtgcattag

SEQ ID NO: 139472 - DNA, 1788 bp, Artificial Sequence
  Description of Artificial Sequence: Synthetic coding sequence
atgcgagttttgctggccgcgttgggactgctgttcctgggagcccttcgcgcattcccccaggatagaccattcgaggacacctgtcacgggaatcccagtcattattacgacaaagccgtgaggagatgctgttacaggtgcccaatggggctcttccctacccagcagtgccctcaacgccctaccgactgtcgcaagcagtgtgaacccgattattatctcgacgaggctgaccggtgcaccgcttgcgtaacttgtagccgtgacgacttggtggagaagaccccctgtgcttggaactccagccgcgtgtgtgagtgcagacccggtatgttttgctctacctctgccgtgaacagttgtgcccggtgtttcttccactccgtttgccccgcagggatgatcgtgaaattccctggtaccgctcagaaaaatacagtgtgtgagcccgctagccccggcgtcagcccagcatgcgcatcaccggagaactgcaaggagccatcttcaggtacgatcccccaagccaaaccaacccctgtatcccccgccacatcctcggcctctaccatgcctgtacgcggagggacccgcctggctcaggaagctgccagtaaattaacccgagctccagacagtcctagttccgtcggtaggccctcctctgacccaggtctgagtccgactcagccttgtcctgagggtagcggcgactgtagaaaacagtgtgagccggactactacctcgatgaagctgggcggtgcactgcatgcgtttcatgctcaagagacgacctggtggaaaaaaccccctgcgcatggaattcctcccgtacctgcgagtgccgtcccggcatgatctgtgcgacaagcgccacaaatagtagggccagatgtgtcccatatccgatttgcgctgcagagaccgttacaaagccacaggatatggcggagaaggatacaacgtttgaagcccccccgctcggaactcagccagattgcaaccccacgccagaaaacggcgaggctccggcttccaccagccctacacagagccttttggtggattcccaggccagcaagacactaccgatacctacatccgctccagtggcactgtcttcaactgggaaacccgttttggatgcaggacctgtcttgttctgggtgattctggtcctggttgtggtcgtaggcagtagcgccttcctcctttgtcaccggagagcatgtcgtaagagaatccgacagaagctacacctctgctatccagtgcaaacctctcagcctaaacttgaacttgtcgacagccggccacggcgaagcagcactcagctccgaagcggggcctcagtgaccgagcccgtggcagaggagcggggcttaatgagccagccactgatggaaacttgtcatagtgtcggggctgcctacctggagtctttgccacttcaagacgcttcacccgctggcggtcccagctcaccgcgcgacttaccggaaccacgcgtgagcaccgagcacacgaacaataaaatcgagaagatttatattatgaaagcagacaccgtcatagtaggtacagttaaagccgaactgccagagggccggggcttagccggacctgcagagccagaactggaagaagaactagaggctgatcacaccccccattacccagagcaggaaaccgagccccctttaggctcatgttctgacgtaatgctgtctgtggaagaagagggcaaggaggaccctctgcccacagccgcctcagggaaatag

SEQ ID NO: 139473 - DNA, 399 bp, Artificial Sequence
  Description of Artificial Sequence: Synthetic coding sequence
atgagccagcctcttatggagacctgtcactcagtcggagccgcttatttggagtcactgccgttacaagatgcctccccagccggagggccatctagccctagggacctcccagagcccagggtgtccacagagcacaccaataataagatcgagaagatctatattatgaaagctgatactgtcatcgtgggcaccgtaaaagcggaacttccagaggggcgaggacttgcaggcccagccgagcccgaactggaggaggagttggaggccgaccacacacctcactaccctgagcaggaaaccgaaccccctctgggctcttgcagcgacgtgatgctctcagtggaggaggagggaaaggaggatccactgcccacagctgccagtggtaaatag

SEQ ID NO: 139474 - DNA, 1452 bp, Artificial Sequence
  Description of Artificial Sequence: Synthetic coding sequence
atgttttgctcaacaagtgccgtgaatagctgtgctcggtgtttctttcactccgtttgtccggcaggcatgatagtgaagttccccggtactgcccagaaaaacaccgtctgcgaacctgcgagtcccggtgtttctcccgcttgcgctagccccgagaactgtaaagaaccgtcctcgggaactattcctcaggccaagcccaccccagtctccccggctacatcgagcgctagcaccatgcctgtacgcgggggtactcgcctcgcccaggaggctgcgtctaaactgacacgtgcaccagacagcccatcctcagtcggccgaccttctagcgaccccgggttgtctcctactcagccttgtcctgaggggagcggagactgcagaaaacaatgcgagccagactactatctagatgaggccggtcgctgtaccgcttgcgttagctgtagcagggatgacctcgtggagaaaacaccttgtgcctggaactcttcccggacttgcgagtgtaggcctggcatgatatgcgcaacaagcgcaactaactctcgagcaagatgtgtgccctaccctatctgtgctgccgagacagtgaccaagcctcaggatatggccgagaaggacactaccttcgaggccccacctttggggacacagccagactgcaatcccactcctgagaacggtgaggcccctgcctccacttcacctacacagagcctactcgttgactcccaggcctcgaaaaccctgccgattccgacatccgcgccggtggccctgtccagcacgggcaaacccgtcttagatgccggtcctgtgttgttctgggtgattttggtcctcgtagtcgtggtgggaagctctgctttccttttgtgtcaccggagagcttgtagaaagaggattcggcaaaaactccacttgtgctacccggttcagacctcgcagccaaaacttgaactcgtagactcacgcccccggcgctcaagtactctgcgctctggcgcttccgtgactgagcctgtggcagaagagcggggactgatgtctcagcctttaatggaaacctgtcacagcgtgggggcggcctatcttgaatctcttcctttgcaagatgcctcgcctgcaggcggtccctcaagccctagggacctgcccgaacctagagtaagtaccgagcacaccaacaataagattgaaaagatttatattatgaaggcagacaccgtgatcgtcgggaccgtaaaagctgaacttcctgaaggaagaggtctggccggacccgccgaacctgaattagaggaggaactggaagcggaccatactccacactacccagagcaggaaactgagcctcccctgggttcctgtagcgatgtgatgttatcagttgaggaggaagggaaagaggaccctctacccacggccgcttccgggaagtag

SEQ ID NO: 139475 - DNA, 1437 bp, Artificial Sequence
  Description of Artificial Sequence: Synthetic coding sequence
atggccccacttagacctctcctcattctggcactcctcgcgtgggtagcgctcgccgaccaggagtcttgtaaggggcgctgcaccgagggcttcaacgtcgacaagaagtgtcaatgtgacgaactctgctcttattatcagagctgttgcactgactacactgccgagtgtaagccacaggtgaccaggggcgatgtgttcaccatgccggaagacgaatataccgtgtatgacgatggagaggagaaaaacaacgccacagtgcacgagcaggtgggcggtccgtccttaacaagtgacctgcaggcacagtcgaaaggcaacccggaacagactccggtgctgaaaccggaggaggaggcgccggcccccgaagtgggtgcgtctaaacctgaaggaatcgactcccggccggagaccttgcaccccggccggcctcagcctcccgctgaagaggagctgtgttccgggaagccctttgatgcttttaccgatctgaagaacggaagcctctttgcctttcgagggcagtactgctacgaattagatgagaaggcagttaggccaggataccctaaactgatccgagatgtgtgggggatcgaggggccaatcgatgccgccttcacacgcatcaattgtcagggcaaaacctatctctttaaggggagtcagtattggaggtttgaagatggagtcctcgaccctgattacccacggaacatttccgacggtttcgatgggatccccgataatgttgacgccgcccttgccctgcctgcgcattcatattcgggccgcgagcgcgtctactttttcaaaggcaagcagtactgggaatatcaatttcagcatcagccatctcaagaagaatgcgagggctcctccctatctgctgtgttcgaacactttgcaatgatgcagcgggatagttgggaagacattttcgagcttctgttctgggggagaacatcagctggaaccaggcagccgcaattcataagtagggactggcatggggtccctggacaggtggatgctgccatggcaggccgtatttacatctccggtatggccccaagaccatcactggccaaaaaacagaggttccgccaccgcaataggaaaggttaccgtagtcagcgaggacactcccgcggacgcaaccaaaactcccgaagaccgagtagagccacctggctaagtctcttctccagcgaggagtccaacttgggcgctaacaattacgacgactatcggatggactggttggtcccagccacctgtgagccaatacagtctgtattctttttttcaggcgacaaatattatcgcgtgaaccttcggacaagacgggtggatacagtggatcctccatatcctcggtctatcgcccaatactggctgggctgccctgctccaggacatctgtag

SEQ ID NO: 139476 - DNA, 639 bp, Artificial Sequence
  Description of Artificial Sequence: Synthetic coding sequence
atggctgaggccaagtattacctaatccaagggctggtaaacatgtgtcaatcggccctacaagacaaaaaggactcctatcagcctgtgtgcaatattcctattatcacgtcactcaaagaggaggagcgccttatcgaatctagcaccaagcctgtggtcaaactgctgtacaaccggtccaataacaaatactcctacacatccaactccgacgatcatctattgaaaaatatcgagctttttgataaactgagtttaagatttaatggccgagtactgtttatcaaggacgtcattggagacgagatttgttgttggagcttttatggacagggtcgcaagctcgccgaagtgtgctgtactagcattgtctacgccactgagaagaagcagaccaaggtcgaatttcctgaggcaaggatctacgaagagaccctgaatgtgctcctgtacgaaacacctcgagtccctgacaactccctgttggaggccacctctcgttcaagaagccaagctagcccgtccgaggacgaagagacatttgaactccgagaccgggtgcgcagaatccacgttaagagatatagcacctatgacgaccgacaactgggccaccaatccactcatcgggattag

SEQ ID NO: 139477 - DNA, 1965 bp, Artificial Sequence
  Description of Artificial Sequence: Synthetic coding sequence
atgagtgaggcttcatcagaggaccttgtccctcccctcgaggctggtgcagcaccatatcgcgaggaggaagaagcagctaagaagaagaaggagaaaaaaaaaaagagtaaggggttggcgaacgtgttctgtgtgttcaccaaaggtaaaaagaaaaaagggcagccctcgtctgcagagccagaagatgccgccggcagtcgacagggactagatgggccccctccaactgtagaagagctgaaagcagccttggagcgcgggcagctggaggccgcacgtcccctcctggctctggaacgggagctggctgctgcagccgctgccggcggagtctctgaagaagagctagtgcgccgccagtctaaagttgaggcactgtacgaactgctccgagaccaggtcctgggcgttctgaggcggcccctcgaggccccacccgaacgcttgcgacaagccctggcggtcgttgccgaacaggaacgcgaagacagacaggccgccgccgccggtcctggaacatccggtctggccgctacacggccacgccggtggcttcaactgtggcgcaggggcgtcgccgaggctgcagaagaacgcatgggccaacgtcctgccgcgggagcagaagtcccagagagtgtttttctgcatttgggtcggacaatgaaggaggacttagaagcagttgttgagcgcctgaagccactgttccctgcagagttcggcgttgttgcggcttacgccgaaagttaccaccagcattttgctgcacacctggcggccgtcgcccagtttgagctgtgcgagagggatacctacatgctgttgctgtgggtccagaatttgtatcctaacgacattattaactctccgaaacttgtcggcgagctgcagggcatgggcttgggaagcctccttccccctcgccagatccggttacttgaggccacttttctgtcctcagaggcagcaaacgtgagggagctaatggatagggcccttgagttagaggcacggagatgggcagaagacgtgccaccacagagactggatggccactgccactccgagctggccattgatattattcaaatcacttcacaggcccaagcaaaggctgagagtataacattggacctgggctctcagatcaagcgggtcctgctggtggagctgcctgcatttctgagatcgtatcagcgggccttcaacgagtttcttgaacggggtaagcagctgaccaactacagagccaacgtcattgccaatatcaataattgtctgtcgtttcggatgtccatggaacaaaattggcaagtgcctcaggacactctttccctcctcttgggcccgctcggtgagttgaaatctcacggatttgataccctgcttcagaatctgcatgaggatttgaagcctctctttaaaagatttactcacacacggtgggcagccccagtggagactctggaaaatatcattgccacggtcgacacacggctgccagagttttcagagctgcaaggatgcttccgggaggagttgatggaggctctgcatctgcacttagtgaaggaatacatcatccagctgagcaaagggcggctcgtgttaaagacggccgaacagcagcagcaacttgcgggttatattcttgccaacgccgatacaattcaacatttctgtactcagcacgggagtccagcaacgtggctgcagcccgctttaccaaccctggccgaaatcattagactgcaggaccccagcgccatcaagattgaagtggctacatacgccacctgttaccctgacttcagtaaaggacatttatctgctatccttgcaattaagggcaacctgtcaaatagcgaggtgaagaggatccggtctattctggatgtgtctatgggggctcaagaaccctcccgtccactctttagcctcatcaaagtgggatag

SEQ ID NO: 139478 - DNA, 972 bp, Artificial Sequence
  Description of Artificial Sequence: Synthetic coding sequence
atggatagggctcttgagcttgaggcgagacgctgggccgaagatgtacccccacaacgcctcgacggtcactgccactccgaattggcaattgacatcatacagataacctctcaggcccaggccaaggcagagtccattacactggatctggggtcccagatcaaaagggttctcctagtagaactgccagcctttttgaggagttaccagcgcgcttttaatgagttcctggagagagggaaacagctgacgaattacagggctaatgttattgcaaacatcaataactgtctctctttcagaatgagcatggaacaaaactggcaggttcctcaggacaccctttcgctactgctgggccccctgggtgagctcaagagccatggctttgacaccttacttcagaatttgcatgaggatctcaaacccttgttcaagagattcactcacaccaggtgggccgcgcccgtcgagaccctcgaaaacataatcgcgacggttgacactagactgccagaattctccgagcttcagggctgcttcagagaggaactcatggaagccctgcacctgcatctggtgaaagagtacattattcagctgtccaagggccggttggtcctgaagacagctgagcagcaacagcagctagcgggatatattcttgcaaacgccgataccatccaacacttttgtacgcagcacggatctccagccacatggctgcaacccgcattgccaacgttggccgagattattcggcttcaggaccctagcgccatcaagatcgaggtggccacatacgccacatgttaccctgattttagcaagggccatctgtctgctatcctggcgataaagggaaacctgagcaactctgaagttaagcgtatccggtccatcctggacgtcagtatgggcgcccaggaacctagtagaccactgttttctctgataaaggtgggctag

SEQ ID NO: 139479 - DNA, 600 bp, Artificial Sequence
  Description of Artificial Sequence: Synthetic coding sequence
atggaagcattacacttgcacttggtaaaagagtacattatccaactcagcaagggaagactggttctcaagacggcggaacagcaacagcagctggcagggtatatactggccaacgcagacactatccagcacttttgtacacagcatggttcaccggctacctggctgcaaccagctctgcccacgctggctgagatcatacgacttcaggacccctctgccatcaagatcgaggtcgccacttacgccacctgctacccagatttttcaaagggccacctcagcgctattcttgcaataaaaggaaatttatccaatagcgaggtgaagcggattcggagcatcctggacgtgtcaatgggcgcacaggaaccctctcggcccttgtttagcctgattaaaccgagagccgccgtgtcgggcattcagcagtggtggaacgggaggcagaattggaaacgcaagaaagagaagatgagtagtcgtttagccggggcttttcgggtcttgtggagagccgtcagcacggccagtatccgaagacatattcaggtggctcccaggcccctgcaggctgggcccgctatggggccctag

SEQ ID NO: 139480 - DNA, 120 bp, Artificial Sequence
  Description of Artificial Sequence: Synthetic coding sequence
atgagtgaggcgtcctccgaggacttggttcctccactggaggcgggcgccgccccgtacagggaagaagaggaggcagcaaagaagaaaaaggaaaaaaagaagaaatcaaaggggtag

SEQ ID NO: 139481 - DNA, 1965 bp, Artificial Sequence
  Description of Artificial Sequence: Synthetic coding sequence
atgagcgaggctagcagcgaagatcttgttcccccactggaagcgggcgcagccccataccgggaggaagaagaggccgctaaaaaaaagaaggagaagaagaagaaatctaagggtctcgccaatgtgttttgtgtcttcaccaaaggaaaaaagaagaaggggcagccttcatccgctgaacccgaggacgccgcgggctctaggcaggggctcgacggacccccccctacagttgaagagttaaaggccgccctggagcggggacaattagaagctgcacggcccctcctcgctctggagcgcgagctggccgccgcggcagccgccggcggggttagcgaagaagaactagtgcggcgccagagcaaagtagaagccctctatgaattactgcgagaccaagtgttgggcgtgctgaggcgcccattggaggcaccgcctgagcgtctgcgccaggctttggcggtggtagctgagcaggagagagaggaccgacaagccgccgctgccgggccgggtacttccggcctcgcggcaactagacccagacgttggcttcagctgtggcggagaggcgtcgccgaagccgctgaggagcgaatggggcagaggcccgctgcgggtgcggaggttcctgaatccgtttttctgcatctggggagaaccatgaaggaagacctggaggccgtggtggagaggctcaagcctctctttcccgctgagtttggcgtagtcgccgcttatgccgagtcgtaccatcaacatttcgccgcacaccttgctgctgtggcacagttcgaactctgcgagagagacacttatatgcttctgttgtgggtccaaaatctctaccctaacgatattatcaattcaccgaaactggtcggggagcttcaaggcatgggactgggctcacttcttcccccgcgacagattcgactgctggaggctaccttcctgagtagcgaggccgcaaacgtgagggaactcatggatagagccctggaactcgaagcaagaaggtgggcagaagatgtacccccgcaaagactggacggccactgtcactccgaactcgcaatcgatatcattcagattacatctcaggcccaagccaaagccgagagcatcacactggatttgggatcccagatcaaacgggtgctcttggttgagctccccgcattccttagaagctatcaaagggcatttaacgagtttttagagaggggcaagcaactgaccaattatagagccaacgtgatagcaaacattaataattgcctctcatttagaatgtcaatggagcagaactggcaggtcccacaggatactctctccctgctgctcggccccctcggagagctcaagtcacacggttttgatacactgcttcagaatcttcatgaagacctgaaaccgctatttaagaggtttactcacacacggtgggcagctccggtggagacgctcgaaaatatcatcgctaccgtcgacaccaggttgccggagttcagcgagctgcagggctgttttcgagaagagctgatggaggccctgcacctgcaccttgtgaaagaatacatcatccagctgagcaaaggaagattggtcctgaagacagccgagcagcagcagcaactcgctggctacatcctagccaatgctgacactatccaacacttttgcacccagcacgggtcccctgccacctggctgcagcccgccctcccaacattggctgaaataatccgcctccaggacccctccgctatcaaaatcgaagtggccacctacgccacatgttaccccgatttctcaaagggccacttgtcagccattttggccatcaagggcaacctgagcaacagcgaggttaaaagaattcgctcaattctagatgtatccatgggcgcccaagaaccctctaggcctttattctctctaattaaagtgggttag

SEQ ID NO: 139482 - DNA, 2373 bp, Artificial Sequence
  Description of Artificial Sequence: Synthetic coding sequence
atggccgagcaggtgctgccgcaggccctctatctatctaatatgcggaaagccgttaagatccgagaacgcactcctgaggatatatttaagccgacgaatggaatcatccatcactttaagacgatgcatcgttatacgctggaaatgtttcgcacatgccagttttgcccacagtttagggagataatccacaaggctttaatagatagaaatattcaggctaccttagaaagtcagaaaaaacttaactggtgtcgagaagtgaggaaactcgtagccctgaaaaccaacggcgacggcaactgtctcatgcatgccacttcccagtatatgtggggggtccaggacacagatttggtgctcagaaaagccttgttcagcactctgaaagagactgataccaggaattttaaattccggtggcaactcgagagtctgaaatcgcaggaatttgtggaaacaggactgtgttacgacacaaggaactggaacgacgagtgggataacttgattaagatggcctctactgatactcctatggcacgctctggcttacaatacaattccctggaggagatacacatatttgtcctctgcaatattctgcggaggcctattatagtcatcagcgacaagatgcttcgtagcctggaatctggtagcaacttcgcccctctgaaagttggaggcatttacctccccttgcactggcctgcacaggagtgctataggtatcccatagtcctcggctatgacagtcaccactttgttcccctggtaacactcaaggactccggcccagaaattcgcgctgtgccactggtcaatagagatagagggcggttcgaggacctgaaggtgcactttctaacggaccccgagaatgaaatgaaggagaaactcctgaaggagtatctcatggttattgagatcccggtgcagggttgggaccacggaacaacccacctcatcaatgcggccaaattagatgaagccaatctacccaaagaaataaatctagtcgacgactattttgagctagttcagcatgaatataagaagtggcaggagaattcagagcaggggagacgcgaggggcacgctcagaatcccatggaaccgtcagtcccccagctttctctcatggacgttaaatgcgagacgccgaattgcccctttttcatgtcagtcaatacccaacccttgtgccatgagtgtagtgaaaggcggcaaaagaaccaaaataagctgcctaaattgaattccaaacccggacccgagggcctcccaggcatggcactgggcgcgtctagaggcgaggcctatgagccactggcgtggaatcccgaagagagcactggggggccacacagcgcacctcccactgctccaagtccattcttgttctcagagacgacagcaatgaagtgtagatccccaggatgtccctttactctgaatgttcaacacaacggtttctgcgagagatgtcacaacgctcggcagctgcatgcctcccacgcccccgatcatacgcgtcacctcgacccaggcaagtgccaggcgtgcctgcaggatgtcacacggacctttaatggaatctgcagtacctgcttcaaacgaacgaccgcagaagcctcgtcctcgctttcaacaagcctccccccttcttgccaccaaaggtccaaatcagatccctccagactcgtacgcagcccttctccacactcctgccatcgtgccggaaatgatgcacctgcaggctgcctgtcacaagctgctcgcactccaggtgatcgaacaggcaccagcaagtgtcgcaaagcaggatgcgtatatttcggcacacccgaaaataagggattttgtacgctgtgcttcatagaatatcgggagaacaaacattttgcggctgcttcaggcaaggtctctccgacagcttcccgatttcagaatactataccttgcttaggccgcgagtgtggaaccctggggtccacgatgttcgagggttattgtcagaagtgctttatagaggctcagaaccagagatttcatgaggctaaacgcacagaagaacagttgagatccagccaacggagggatgtacctagaacaacacaatcaacaagccgccccaaatgtgctcgggccagttgtaagaatatcttggcgtgtcggtcggaggaattgtgcatggagtgccagcatccaaaccagagaatgggacctggcgctcaccgcggggagcccgcccccgaagatccacccaagcaacgctgtcgtgcccctgcttgcgaccattttggaaacgcaaagtgtaatgggtattgcaatgaatgtttccagttcaagcaaatgtacggctag

SEQ ID NO: 139483 - DNA, 489 bp, Artificial Sequence
  Description of Artificial Sequence: Synthetic coding sequence
atggccgagcaggtgctgccacaggcactttacctcagtaatatgcgaaaggccgtcaaaattagagagcgcactccggaggatatttttaaacccacgaatggcattatacatcatttcaagacgatgcatcgatacacactggagatgtttcgtacgtgtcaattttgtccccagttccgggagattatccataaggcactgattgataggaacatccaggccacgcttgagagccaaaagaagctgaactggtgtcgcgaggtgcggaaactagtagctctgaagactaatggggacggcaactgtctgatgcatgctactagccaatatatgtggggcgtgcaggatactgacctggttctgaggaaggcactgtttagtaccctgaaagaaactgatactaggaactttaagttccgatggcagctggagagtttaaaatcacaggaattcgtggaaacaggactctgttacgatacccggtag

SEQ ID NO: 139484 - DNA, 81 bp, Artificial Sequence
  Description of Artificial Sequence: Synthetic coding sequence
atggcggaacaagtcctccctcaggcgctgtacttgtctaacatgcggaaagccgtaaaaatcagagaacggactccctag

SEQ ID NO: 139485 - DNA, 297 bp, Artificial Sequence
  Description of Artificial Sequence: Synthetic coding sequence
atggctgagcaggtgctacctcaggcactgtacctctcaaacatgcgtaaggccgtcaaaattagggagcgcacacccgaagacatttttaaaccgactaatgggatcattcaccattttaagactatgcatcgctacacactggaaatgttccgcacctgtcagttctgcccacagtttagagagataattcataaggcactcattgatcggaatatccaggcaacactggaatctcagaaaaagctgaattggtgtcgggaggtcagaaaactggtggccctcaaaacgaactag

SEQ ID NO: 139486 - DNA, 813 bp, Artificial Sequence
  Description of Artificial Sequence: Synthetic coding sequence
atggccgaacaagtgctgcctcaggccctttatctgtctaacatgaggaaggctgtgaagatacgggagcggacgcccgaggatatttttaaacccaccaacggcattattcaccattttaaaactatgcatagatacaccctggaaatgttcagaacctgccaattctgtcctcaatttcgagaaattatccataaggccctcatcgatcgaaatatacaggcaacattagagtctcagaaaaaactaaattggtgcagggaagtgcggaaactggtggctctgaagactaatggcgatggtaactgcctcatgcatgctacctcccagtacatgtggggcgtgcaggatacagacttggttctgcggaaagccctgtttagcaccctgaaggagaccgacacacgtaactttaagtttaggtggcagctggagagtcttaagtctcaagagttcgtggagacaggcctatgttatgatactcgaaactggaacgatgagtgggataatttaataaagatggccagtacagatactccaatggcacgctcgggccttcagtacaactcgctggaggagattcacatctttgtactgtgtaacattctgcggcgacctattattgtgatctctgacaagatgctccgctctctcgaatccggcagtaattttgctcccctaaaagtgggtggaatttacctcccattacattggccagcacaggaatgctaccgttatcccatcgtactgggatatgactctcaccacttcgttcctttggtgactctcaaagattccgggccggatatctag

SEQ ID NO: 139487 - DNA, 2250 bp, Artificial Sequence
  Description of Artificial Sequence: Synthetic coding sequence
atggccgaacaggtgcttcctcaagccctgtatctttctaatatgcggaaggcggtgaaaattagggagagaacgcctgaggacatcttcaagcccactaacggtatcattcaccattttaagaccatgcacaggtacacgctggagatgtttagaacgtgtcagttctgcccgcagtttcgggagataatccacaaggcacttatagatcgtaatatacaggccacattggagagccaaaagaagttgaactggtgccgcgaggtccgcaaactcgtagcgctgaagaccaatggagacggaaattgcctgatgcacgcaacctcccagtacatgtggggggttcaggatactgatctggtgctaagaaaagctctctttagcactctgaaggaaactgacaccaggaactttaagtttagatggcagctcgaatcactgaagtcccaagaattcgtcgaaacgggactgtgctatgatacaagaaactggaatgacgagtgggacaacctcatcaagatggcctctaccgacacgcctatggcacgctcgggactgcagtacaattccttggaagaaatccacatttttgtgctgtgtaatatcctcagaaggcccattattgtcatctccgacaagatgttgcgcagcctggagtcaggttcaaacttcgctcctctgaaagtgggtggaatttacctgcctctacactggccagcccaagaatgctatagatatccaatcgtactagggtatgattcacaccactttgtcccactggtgacgttaaaggatagtggtcctgagatacgagccgtgccactcgttaatagagaccgaggcaggttcgaggatctaaaagtgcatttcctgacggaccctgagaatgaaatgaaagaaaaactgctgaaagagtacctgatggtgatcgaaatccctgtccagggctgggatcacggtaccacacacctgattaacgccgccaaactggacgaagccaacttgcccaaggaaatcaacttggttgatgactatttcgagcttgtccagcacgaatacaagaagtggcaggagaattccgagcagggcaggcgagagggtcatgcacagaatccaatggagccgagcgttccccagctctcgctgatggatgtaaaatgtgaaacacctaactgccccttttttatgtccgttaatacccagcccttgtgccacgaatgctcagagaggaggcaaaagaaccagaacaaattaccaaagctaaattcgaagcctggcccagagggcttgcctggaatggctctcggggctagtcgcggcgaagcttacgagccactggcttggaatcccgaagaaagcactggtggcccccattcggctccacccaccgccccttctccatttctatttagtgagacaaccgccatgaagtgtcggtctcctgggtgcccctttaccctgaacgtccaacacaacggtttctgtgagagatgccacaacgccagacagctccatgctagccatgctcccgaccatacccgccatttggaccctggcaaatgccaggcatgcctgcaagatgtgacccggactttcaacggcatctgcagtacctgttttaagcgcactaccgccgaggcttcatccagcctcagtactagcctacccccctcgtgtcatcagcggagcaagagtgatcctagccgactggtccgatccccatccccccactcctgccaccgcgcgggaaatgatgccccggccggttgcctgtcccaggcagccaggacacccggggaccgcactgggacctccaagtgccgcaaggccggatgtgtctacttcggcactcctgagaataagggattctgtacactgtgcttcattgaatatcgtgagaacaagcacttcgcagccgcctctgggaaagtgtcacctacggcaagcaggttccaaaataccatcccatgcctggggcgggagtgtgggaccctcggctctacgatgtttgagggatattgccaaaaatgttttatcgaagcccagaatcagcgattccacgaggcaaagcgcacagaggaacagctgcggagctcccagcgaagggacgtccctcgcactacccaatctacatctcggccgaagtgcgcccgggcatcatgtaagaacatactggcttgcaggagcgaagaattgtgcatggaatgccagcaccagcctgaagacgggccttggggaccccctggatag

SEQ ID NO: 139488 - DNA, 459 bp, Artificial Sequence
  Description of Artificial Sequence: Synthetic coding sequence
atggccgagcaggtgcttccacaggccctgtacctgagcaatatgagaaaggcggtcaaaatcagagaaaggacgccagaggatatcttcaaacccacaaacggaatcatccaccactttaagaccatgcatcgctataccctcgaaatgtttcgcacatgtcagttctgtccccaatttagagaaattattcacaaagcactgattgatcgcaatatccaagctacacttgagagtcagaagaaactgaattggtgtagagaggtacgcaagctcgtagcccttaaaaccaacggcgacggcaattgtttgatgcacgcgacatcacaatatatgtggggagtacaggatacggatctggtgctgagaaaagctttattctctaccctaaaagagacagacacacggaactttaaattccggtggcaactcgagtcacagatctccggcatctgctag

SEQ ID NO: 139489 - DNA, 645 bp, Artificial Sequence
  Description of Artificial Sequence: Synthetic coding sequence
atggcagagcaggttttaccacaggccctgtacctatcaaacatgaggaaggcggtcaagatccgtgagaggacacccgaagatatttttaagcctactaatggcataatccaccatttcaagaccatgcataggtatacattggagatgtttagaacttgccaattttgtccccagttccgggagattatacacaaggcccttatcgaccgcaatatccaagctaccctagagtcccagaaaaagcttaactggtgtagagaagtacggaaattggtcgcccttaagactaacggtgatggcaactgtctgatgcacgccacctcacagtacatgtggggcgtgcaggacactgacttggttctcaggaaggccttattcagcacccttaaggaaacagatacccggaactttaaatttaggtggcagctggagtcactgaagagtcaggaattcgtagagacaggcctgtgttacgatacacgaaattggaacgatgaatgggacaacctgataaagtggcttccccagacgcatccctggccggaggtagactttagtactactcactggaagaaatacacatatctatcatttgcaaccagcagtgaaggtcagtcattgagttttcagaccaaatgctag

SEQ ID NO: 139490 - DNA, 2010 bp, Artificial Sequence
  Description of Artificial Sequence: Synthetic coding sequence
atggccgaacaggtactgccacaagctctgtatttatctaatatgaggaaagcggttaaaattagggaacggacccctgaagatatctttaagcctaccaacggaattatccatcactttaagacaatgcacagatataccttggaaatgtttagaacctgtcaattttgtccccagtttcgtgaaattattcacaaggctctgattgaccgtaatatacaagccacactggaatcacagaagaaacttaactggtgtagagaagtgcggaagctggtggcgctgaaaaccaacggcgacggtaattgcttaatgcacgctactagtcagtacatgtggggggtgcaggacacggacctggtgttacgcaaggccctcttctctacactgaaagaaaccgatacaaggaatttcaaattccgatggcagctcgaatcactgaaatctcaggagtttgtcgaaactgggttatgctacgatacacgcaactggaatgatgaatgggataatttaatcaagatggcatcgacagacaccccaatggctaggagcggattgcagtacaattctcttgaggagatccacatattcgttctttgcaacattctgaggcgccccataattgtaattagtgataagatgctacgatcgttggagagtggcagcaacttcgcacctctgaaggtcggaggcatctatcttccactccactggcccgcacaagagtgttacagatatccaatcgtgctcggctatgattcccatcatttcgttcccctggtcacactcaaagactccggccccgaaatcagagcagttcctttggttaaccgagacagaggccgcttcgaggatctcaaagttcattttctaactgacccagagaatgaaatgaaggagaaattgctgaaggaatatctaatggttatagaaattcctgttcagggatgggatcatggcaccacccacctcattaacgccgctaagttggacgaggccaacctgccaaaggaaattaacttagtggacgactatttcgaactggtgcagcatgagtacaagaagtggcaggaaaattcagagcaaggaagacgggagggtcacgctcagaatccaatggagccttcggtgccacaactgtctctgatggacgtgaagtgtgaaaccccaaactgccccttcttcatgtcagtcaacactcagccgctgtgtcatgagtgcagtgaaagaaggcagaagaaccagaacaagcttcccaagctgaattccaaacctggccccgaaggtctcccaggcatggcccttggtgcaagtcggggagaagcatatgaacctctagcttggaaccctgaagagagtacaggaggacctcatagtgctccccccaccgccccaagccctttcttattcagtgaaactactgcgatgaaatgcaggagccccggctgcccctttacacttaacgtacagcataacggcttctgcgagcggtgtcataacgctagacagctgcatgccagtcacgctcctgatcataccagacacttagacccgggaaagtgtcaggcttgtttacaggatgtaacacgtacttttaacggcatttgcagcacctgttttaagcgaacaactgccgaagcctctagctccttaagcacgtccctgcctccctcttgccaccagaggtccaagagtgacccttctcgactggtccggtctccgagcccgcactcttgccaccgggctggtaatgacgcccccgccggctgcctctcacaggctgccaggacaccgggggacagaacagggacttcaaagtgtcgcaaggcaggatgtgtatattttggaactccagaaaataagggtttttgtacactctttcacagggtccagcgaaagcagaccttctgttgctgcctacgtgaatcccagtcgcattcagtgcaagtgcctgagcaccattcagttcctggtgaaggaatgagacacccttggaagcatcatgtctag

SEQ ID NO: 139491 - DNA, 834 bp, Artificial Sequence
  Description of Artificial Sequence: Synthetic coding sequence
atgattatcctgatatacctcttcctgctgctctgggaagacacccagggatggggttttaaggacggaatattccacaacagcatatggctggaaagagctgccggcgtgtatcaccgcgaagctaggtctggaaaatacaagctgacatacgccgaggcaaaagccgtctgtgaattcgaggggggtcacctggccacctacaaacagttggaggccgcacgaaagatcgggttccatgtgtgtgctgccggttggatggccaagggcagagtgggatatcctatcgtcaaaccggggcccaactgtggcttcggcaaaaccggtataatcgattacggaatcaggcttaataggagcgagcgctgggatgcatattgctacaatcctcacgcaaaggagtgcggcggggttttcaccgatcctaagcaaatctttaagagccctgggttcccaaacgagtacgaagataaccagatttgttattggcacatcaggttgaagtacggccaaagaatccacctaagcttcttggacttcgatttagaggatgatcccggatgtcttgccgactatgtggagatttacgactcatacgatgacgtccatggattcgtggggaggtattgcggggacgaattacccgatgacattatctccacaggtaacgtgatgaccctgaaattcttgtcagacgcgtccgtaaccgcgggtggctttcagatcaagtacgttgctatggatcccgtgtcgaaaagctcccaggggaagaacacctctactacttcgaccggtaataaaaactttcttgctggccgcttttcccacctttag

SEQ ID NO: 139492 - DNA, 567 bp, Artificial Sequence
  Description of Artificial Sequence: Synthetic coding sequence
atggcaactgacgtttttaatagtaagaacttagcagtgcaggcacagaaaaaaattctcgggaagatggtgtcaaagtccatcgctaccacactgatcgatgataccagttcggaggtgctggatgagctataccgcgttacgagggaatacacccaaaacaaaaaggaagccgagaaaattattaaaaaccttattaaaacggtaattaagctggccatactttaccgtaacaaccagttcaatcaggacgagctggccttgatggagaagttcaaaaagaaggtgcatcagcttgctatgactgtcgtgtcctttcaccaggttgactatactttcgaccggaacgtattgtctaggctccttaatgagtgtagggagatgttacaccagatcatacagcggcatttaaccgcaaagtcacacggcagagtgaataacgtgtttgaccactttagcgattgcgagttcctggcagccctgtacaaccccttcggtaacttcaaaccccacctgcagaagctatgcgacggcattaataagatgttggacgaagagaacatctag

SEQ ID NO: 139493 - DNA, 597 bp, Artificial Sequence
  Description of Artificial Sequence: Synthetic coding sequence
atgcactcagaagccgaggagagcaaggaagttgccaccgacgtgtttaattctaagaatctagccgtgcaagcccagaaaaaaatcctgggcaagatggtgagtaagagcatcgcaactacactgattgacgatacaagttccgaggtacttgacgaactgtacagggtgactcgggagtatacccaaaataaaaaagaggcagagaaaatcataaaaaatcttattaagaccgtgatcaagctggccatcctctacagaaataaccagtttaatcaggacgagctggctctgatggagaagttcaagaagaaggtgcatcagctcgccatgactgtcgtgagttttcaccaggtggattacacatttgataggaacgtgctgtccaggctactcaacgagtgcagggaaatgctacaccagataatccagaggcatctcaccgcaaaaagtcacggaagggttaataacgtgtttgaccattttagcgattgtgagtttttagcagcactgtacaatccctttggaaacttcaagcctcacctacagaagctgtgcgacggtataaacaagatgctagatgaagagaatatttag

SEQ ID NO: 139494 - DNA, 597 bp, Artificial Sequence
  Description of Artificial Sequence: Synthetic coding sequence
atgcactccgaagccgaggagtctaaggaagtggctaccgacgtgtttaactccaagaatctggccgtgcaggcacagaagaaaattttgggaaaaatggtgagcaagagtattgccaccaccctcattgacgacacttcttccgaggttctggatgaattgtacagagtcacacgtgagtacacacagaataaaaaagaagcggagaaaatcattaagaacctcatcaaaaccgtgatcaaactcgcaatcctataccgaaataatcagttcaatcaagatgagcttgctctgatggagaaattcaaaaagaaggtgcaccagctggctatgacagtggtgagctttcaccaggtcgattataccttcgacaggaacgtactgagccgcctgttaaatgaatgtcgggaaatgctccaccagataattcagcgccacctgactgcaaagtcccacggcagggtcaataacgtatttgaccacttttcggattgtgaatttcttgccgccttgtacaacccgttcggcaactttaaacctcatctgcagaaactgtgtgacgggattaacaagatgttggatgaggaaaacatctag

SEQ ID NO: 139495 - DNA, 555 bp, Artificial Sequence
  Description of Artificial Sequence: Synthetic coding sequence
atggaaagcttctctagcaagagcctggcattacaggccgaaaagaagttgctatctaagatggctggcaggtcagtggctcacctctttattgatgaaacttctagtgaggtacttgacgaattgtatagagtgagcaaagagtatactcactcgcgaccacaggcccagagggtgatcaaagatctcatcaaagtagccattaaggtcgcggtgcttcacaggaacggatcatttggaccatcagaactagccttagccaccagatttagacagaagttgcgtcagggggcaatgaccgccttgtcttttggtgaagttgattttacctttgaagcagcagttctggctgggctgttgactgagtgccgggatgtgctgctcgaactggtggagcatcatttgactcctaagtcacacgggcgaattcgccatgttttcgatcactttagcgaccctgggctcctgacagccctgtacgggcccgacttcacgcagcaccttggaaagatttgtgacgggcttagaaagctgcttgatgagggaaaactgtag

SEQ ID NO: 139496 - DNA, 1296 bp, Artificial Sequence
  Description of Artificial Sequence: Synthetic coding sequence
atgtaccgcaccaaagtcgggttgaaggatagacaacagttatacaagctcatcatcagccagctgctgtatgacggttatatctctatagctaatggccttatcaatgaaatcaagccacagtccgtttgcgctccgtcagaacagttactgcacctcatcaaactgggcatggaaaatgacgataccgccgtacagtacgcaatcggccgatcagacacagtcgcacccgggactgggatagacctggaatttgacgcagatgtgcagacaatgagccccgaagcttccgagtacgagacctgctatgttacatcacacaaagggccatgtcgcgtggccacatactcacgggatggccaactgattgccacagggagcgccgacgcgagtattaagattctagacacagaacgcatgctcgccaaatccgccatgcctattgaagtgatgatgaacgagaccgcacagcagaatatggaaaatcacccagttatccggactctttatgatcatgtcgacgaggtcacctgcctcgccttccaccccactgagcaaattctggcatccggcagcagagattacactctgaagctgttcgactactccaagccatcggcaaagcgggcctttaaatacatccaagaggctgaaatgctccggtccatatcattccacccatccggcgacttcattctagttggaactcagcaccccacccttcgcctgtatgatatcaataccttccagtgtttcgtgtcgtgtaatccacaagatcagcacacagacgcaatttgtagtgtcaactacaactcatcagcaaacatgtacgtgaccggttcaaaagacggttgtatcaagctctgggatggcgtgtcaaatcggtgcattactaccttcgagaaagcacatgacggagcagaggtctgttccgccattttcagcaagaactccaagtacatcctttctagcggaaaagattccgtggccaagctgtgggaaatatcaacaggcaggacgctagtgcgatataccggggctgggctcagcggccggcaggtacatagaacacaggcggtctttaatcacacagaggattatgtgctactgccagatgaacgtaccattagtttatgctgctgggactctcgaacagcggagcgaagaaacctgctgtccctcgggcataataacattgtgagatgtatagttcactcaccgacaaatcccggctttatgacctgttcagacgatttcagggctcgcttttggtacaggaggtcaaccacagactag

SEQ ID NO: 139497 - DNA, 621 bp, Artificial Sequence
  Description of Artificial Sequence: Synthetic coding sequence
atggacagtgctgggcaggacataaacctgaacagcccgaataagggcctgctgagtgactccatgaccgacgtcccagtggatacaggcgtagcagcaagaacccccgctgtggagggattgactgaagctgaggaagaggagctacgggcagaactgactaaagtggaagaggagatcgtgactctccgccaggtcctcgcagcaaaggagcgtcactgcggagagctgaagcgccgactggggctgtcaactcttggtgagctgaagcagaatctgtcacgatcctggcacgatgtgcaagtgtcctctgcttacgtgaagacgagcgagaagttgggagagtggaacgagaaagtgacgcagtccgacctgtacaagaaaacacaggagactctgagccaggcagggcagaagacatcagctgcactgtccaccgtcggttctgccattagcagaaaactaggggatatgcgcaacagtgccacttttaaaagtttcgaggacagagtcggcactatcaagtcaaaagtggtaggagaccgcgaaaacggttccgacaacttacccagctctgcggggagcggagataagccactctccgaccctgctcccttttag

SEQ ID NO: 139498 - DNA, 561 bp, Artificial Sequence
  Description of Artificial Sequence: Synthetic coding sequence
atggactccgctggtcaggacataaacctaaattcacctaataagggcctgctgtccgacagcatgacagacgtaccagtggacactggcgttgctgcacgaactccagccgtggaaggactgacagaagctgaggaggaggagctgcgagccgagcttacgaaagtggaggaagagattgtgactcttcgacaagtactggccgcaaaggagcgccactgcggagaattgaaacgcaggttagggctaagcacgctcggagaacttaaacagaacttgtcgaggtcttggcacgatgttcaggtgagtagtgcctataagaaaacccaggagacgctgtcccaggcaggacagaagacttccgccgcgttgtccaccgtggggagtgccattagtaggaagctcggagacatgcgtaacagcgcaactttcaaaagcttcgaggatagagttggcacgataaaaagtaaagttgtcggggaccgcgagaatggatctgacaacctgccaagctcagctgggtccggggataagccattatctgaccctgccccattctag

SEQ ID NO: 139499 - DNA, 630 bp, Artificial Sequence
  Description of Artificial Sequence: Synthetic coding sequence
atggattccgcaggccaggacattaacctaaactctcccaacaaggggctgctgtcagacagcatgaccgacgtcccagttgataccggcgtggccgctcgcacacccgctgtggagggactgaccgaagccgaagaggaagagttgcgggccgagctgacaaaggtggaggaggagatcgtgaccttaagacaggtcctcgcagcaaaagagcggcactgcggagagctgaagagaagactcggacttagtactctgggtgagcttaaacaaaatctgagtagatcctggcacgacgtgcaagtctcatcagcctacaagaagactcaggaaactttaagtcaggccggccagaagacttctgccgctctgtcaactgtggggtccgcaatctcaaggaagttgggggacatgcgagcccatcctttctcacattcattctcatcctacagtatcaggcattctatatcaatgccagctatgcgaaacagtgctacttttaagtcatttgaagatagggttggcaccataaagtctaaagtggtgggcgaccgcgagaacggttccgacaatctgccaagctccgccggtagtggagataagcctctcagcgaccccgccccattctag

SEQ ID NO: 139500 - DNA, 663 bp, Artificial Sequence
  Description of Artificial Sequence: Synthetic coding sequence
atggacagtgccggacaagacatcaacctcaacagcccaaataagggattactgtcggacagcatgacagacgtcccagtggacaccggggttgcggccaggacaccggcggtagaaggactgactgaagctgaggaagaagaattgagagccgaactgaccaaggttgaggaggagatagtgaccctcagacaagttctggccgcaaaggaaagacactgcggggagttgaagagacggctgggcctctctactctcggagagctgaagcagaacctatctaggtcctggcatgacgttcaagtgagctcggcgtacgtaaagacatccgagaagctgggggaatggaatgagaaagtcacgcagagtgatctttacaaaaaaacccaagaaactctcagccaagccgggcaaaaaacttctgcagctctgtccacagttggcagcgcaataagtcgcaagctgggagatatgtccagttacagcatacggcattccatttctatgccagctatgcgtaactcagccacattcaaaagttttgaagaccgggtcggaaccatcaaatccaaagtagtcggagatagggaaaacggtagcgataatctaccatcctcagccggctccggcgacaagcctctctcagacccagctcccttctag

SEQ ID NO: 139501 - DNA, 603 bp, Artificial Sequence
  Description of Artificial Sequence: Synthetic coding sequence
atggactctgccgggcaggacataaatttaaatagtcctaataaaggcttgctgtctgactccatgacagacgtccccgtggatacaggagtggcggcacgcactcccgcagtcgaggggctaactgaggcagaggaagaagaactgcgagcagagctgactaaggtcgaagaagaaattgtgacgttgcgtcaggtactagccgctaaggaacggcactgcggggaactgaaaaggagactgggtctgtcaacactgggcgagctaaagcagaacctttctcggtcctggcacgacgtccaggtatctagtgcttacaagaaaactcaggaaaccctgagtcaggcgggccaaaagacttcggccgctctgagcactgtgggctccgcaatctcacggaaacttggcgacatgtctagttactcgatacgacactctatttccatgccagcaatgagaaatagtgcaacttttaagtccttcgaagatcgggtgggaaccataaagtccaaagtggtgggcgatagggaaaatggcagcgacaacctgccttcatcagcaggctcaggagacaagcccctttcggacccagcacccttctag

SEQ ID NO: 139502 - DNA, 492 bp, Artificial Sequence
  Description of Artificial Sequence: Synthetic coding sequence
atggactcagccggacagggagtagcggcccgtacaccggccgtggaaggactgaccgaggccgaggaggaagagctgagggcagagttgactaaggtcgaagaggaaatagtgacgctgcggcaggttctggccgccaaagaacggcattgtggtgagttgaaaaggcggctgggcctgagcacattaggcgaactgaaacagaacttatctcggtcctggcacgacgtgcaggtctctagtgcctataaaaagacacaggaaaccttatcacaggccggacagaagacctccgcagctcttagtactgtgggttccgctatttcccgaaagctgggtgatatgcggaattccgccacattcaagtcctttgaggacagggttgggaccattaagagcaaagtagtgggcgatcgggagaatggatcagacaatctgcctagctccgcaggttctggggataagcctctgtccgatccggcgccattctag

SEQ ID NO: 139503 - DNA, 3405 bp, Artificial Sequence
  Description of Artificial Sequence: Synthetic coding sequence
atgcggttcggcagtaaaatgatgcctatgttcctcaccgtttatttaagtaataatgagcaacatttcactgaagtgccagtcacgcctgaaacaatttgtagagatgtcgtggacttgtgcaaagagcctggcgagtccgattgccacctcgctgaggtgtggtgtgggtccgagcgaccagtcgcagacaacgagcgaatgttcgacgttctgcaacggttcggctctcagcgaaacgaagtcagattttttctaaggcatgagcgcccacctggtagagacattgtgagcggaccgcgcagtcaggacccatctctaaaaaggaatggcgtgaaggtgccaggtgagtatcgcagaaaggagaatggtgtgaactcccctaggatggatctgacactggcggagctacaggagatggcaagtcgccagcagcagcagattgaggcgcagcagcagctgctggcaactaaagaacagagactgaagttcctgaaacagcaagaccagcgccagcaacagcaagtggcagaacaggagaaacttaagcgactcaaggagattgctgagaaccaggaggccaaactgaaaaaggtgagagctctgaaaggacacgttgaacaaaaacgcctaagcaatggaaaactagtggaagagattgagcagatgaataacctcttccagcagaaacagcgtgagctagtcctcgcagttagcaaagtcgaagaactgacccgccagctggaaatgctgaaaaatggccgcattgattcacaccacgacaaccagtctgcggtggcagagctggatcgcctttacaaagaactgcagctacggaataagctgaaccaggaacaaaatgcgaagctgcagcagcagcgtgagtgcttaaacaaaaggaattccgaagttgccgttatggataaacgtgtgaacgaactgcgcgaccggctttggaagaaaaaagctgcactgcagcagaaagaaaatctgccagtttcatctgacgggaacctcccccaacaagcagcgtccgcacctagtagagttgctgcagttgggccctacatacagtccagcaccatgccccgaatgccttcacgaccagagctcctcgtgaagcctgctctgcctgacggttctcttgttatccaagcgtccgagggacctatgaagatccagactttgcccaatatgcgcagcggagcagcttcacagactaaaggctctaagattcaccctgtgggacctgactggtctccctcgaatgcagacctattcccgagccaagggtccgcttctgtgccgcagtccaccggcaacgccctggaccaggtggatgacggggaggtgcccctccgtgagaaggaaaagaaggtacgcccgttttcaatgtttgacgcggtggaccagtccaatgctccaccctcattcggcaccctgagaaaaaaccaaagttctgaggatatacttagggatgcccaggttgcgaacaaaaacgtagcaaaggtgcctcctcccgtgcctacaaaacctaagcagatcaaccttccttacttcggccagacaaatcaaccgccttctgacattaagcctgatgggagttcacagcaattgagcaccgttgtgccatcaatgggaaccaagcctaaacctgcagggcaacaaccacgcgtgctcctgagtccttcaataccctctgtgggccaggatcaaacactgtcaccgggttctaagcaagaatcacctccagcagcagccgtccgccctttcacgccccagcccagtaaggatactctcctgcccccgttccgaaagcctcagacggtagccgcctcctctatctatagcatgtacacccagcaacaggctcccggcaagaacttccagcaggctgtccagtccgccctgaccaagactcacactcggggccctcatttctcctcggtttacgggaagcccgtgatcgctgctgcccaaaaccagcagcagcatcctgagaatatttactccaattcgcagggaaaaccggggagtcccgaacccgaaaccgagcctgtttcttctgtgcaggaaaatcacgaaaatgagaggatacctcgaccgctctccccaaccaagttactacccttcctaagtaacccttatcggaatcagtcggacgctgatcttgaagccctgcgtaagaagctgagtaacgcacccaggccccttaagaagcgatctagcattactgagcctgagggacccaacggccctaacattcagaagctcctgtatcagcgaactacaatcgctgctatggagacaattagcgttccttcctacccaagcaagagcgcatcagtgactgcctctagtgagtcacctgtggagatccagaacccatatttacacgtcgagcctgagaaagaagtggtatctctagtgcctgaatccctcagccccgaggatgtcgggaacgcatcaactgagaacagtgacatgcccgcaccaagcccagggttagattatgagcccgagggtgtgcccgataatagcccaaatctgcagaataatcctgaagaacccaatccagaagcaccgcacgtcctggacgtgtatctcgaggagtatccaccttaccctcctcccccctatccctctggggaacccgagggccccggtgaagacagtgtgtctatgaggccgcccgagatcacaggccaggtttccctgccacctggcaaacgaacaaacctgaggaagaccggcagcgagcgtatcgcacatgggatgcgcgtgaaatttaatcctctagctctcttactggatagcagtttggagggcgagtttgacttggtacaacgaatcatctatgaggtagatgatcctagcctgcccaatgacgaggggattacggccctgcacaacgcagtatgcgctggccacacggagatagttaagtttcttgtgcagtttggcgttaacgtgaacgctgcagactctgacgggtggacacctttacattgtgccgcaagttgcaataacgtgcaggtttgtaagttcctagtggagtctggagcagccgtgtttgcgatgacgtattcagacatgcagacagccgcagacaaatgcgaggagatggaagagggctatactcagtgttctcagtttctttatggagtgcaagagaagatggggattatgaacaaaggggtgatttacgccttgtgggactatgagcctcagaacgacgacgagctgccaatgaaagagggggactgcatgaccatcatccatagggaagatgaagacgagatagagtggtggtgggctagacttaatgataaggagggctatgtgcctagaaacctcctgggcctgtaccctagaatcaaaccccgccagagatcacttgcctag

SEQ ID NO: 139504 - DNA, 3018 bp, Artificial Sequence
  Description of Artificial Sequence: Synthetic coding sequence
atggacttgacgctggccgagctgcaggagatggcaagcagacagcagcaacagatagaagcccagcagcagctgctggccactaaggagcaacgtttgaaatttttaaaacagcaggatcaacggcagcagcagcaggttgcagagcaagaaaagctcaaacgcctaaaggagatcgccgagaatcaggaggccaaacttaaaaaggtgcgtgcactgaagggacatgtggagcagaagagactaagcaatggcaagctcgtcgaagaaattgagcagatgaacaacttattccagcagaagcaaagggagctggtactcgcggtgagcaaagttgaggagctaacacgccagctcgaaatgcttaaaaatggtcggatcgactcccaccatgacaatcaatctgctgtggctgagctggaccggctgtataaggagctccaactgaggaataaacttaaccaggagcagaatgcaaaactgcagcagcaacgggaatgcctgaacaaacggaacagcgaggtcgccgtgatggacaaacgggtgaacgagctcagggatcgcctgtggaaaaagaaagctgctctgcagcaaaaagaaaacctcccggtgagttcggacggcaacctgccacagcaagccgcaagcgctcccagtcgggtggcagccgtcggaccctatatacagtctagcaccatgccacgcatgccatcccgcccagagctgctggtcaagcctgctcttccggatggctctttggtgattcaggcatctgagggtccaatgaagatacagaccttaccaaatatgaggtccggagctgcttcgcaaaccaagggttctaagatccaccccgtaggtccagactggtccccctctaacgccgatctctttccaagccaaggatcagcgtccgtgccccaaagcaccggaaacgccctggaccaggtggacgatggggaggttcccctcagagaaaaggagaaaaaagtgcggcctttcagcatgtttgacgccgtggaccaaagcaatgcccccccatcctttgggactcttcgcaaaaaccagtcaagtgaggatattctacgcgatgcacaggtagctaacaagaacgtggccaaggtcccaccaccagtcccgactaagcccaaacagattaacctgccctattttggccagacaaaccagcccccatccgatatcaagcccgacggctcctcacagcaactcagcacagtcgtgccttccatgggaactaaacccaagccggccggacagcaaccccgtgtgctgctatcgccttcaattccaagcgtggggcaggatcagaccctatcaccgggctccaagcaggagagtccaccggcagcggcggttcgtccgttcaccccacaaccctccaaagacacactcctgcccccttttcggaaaccccagacggtcgctgccagcagcatttattcaatgtatacacagcaacaagccccaggcaagaactttcaacaggccgtccagtccgcccttacaaaaacgcatacaagaggcccccactttagctccgtgtatgggaaacctgttattgctgctgcccagaaccagcaacagcatcccgaaaatatttattcgaattcacagggaaagcccggatccccggagccggagacagaacctgtgtcctctgtgcaggaaaatcatgagaacgagaggataccccgaccactctctccaaccaagttactgccctttctttctaacccatacagaaatcagtcggatgcagacctggaagctcttagaaaaaaactgtcgaatgccccacgccccttgaagaagaggtccagtattacagaacccgaagggccgaatggaccgaacattcagaaactgttatatcagaggacaactattgcagccatggagacaatctctgtgccctcatacccttccaagtctgctagcgttacagcaagctccgaatctccggtggagatccagaacccctacctccacgtcgagcctgagaaggaagtggtcagcctggtgcccgagagcctgagtcccgaggacgtaggtaatgcaagcacagagaattccgatatgcctgcacctagccccggcctggactacgagcctgagggggtccccgacaattctcccaatctccagaacaatccagaggaacctaaccctgaggcaccacacgtcctcgacgtgtacctggaagaatacccaccctacccacctcccccctatccctccggcgagcccgagggccccggggaggatagtgtcagcatgcgccctcctgagataaccggtcaggttagtctgccaccgggcaaacggacaaatctgcgcaagacagggagcgaacgcatagcccatggaatgcgggtgaagttcaaccccttggcactcctactcgattccagcctggaaggcgaatttgacctagtccagagaataatctatgaagtggacgaccccagtctcccaaacgatgaggggattacagctttacacaacgctgtatgcgctggacataccgagatcgtgaagtttttagtccaattcggggtgaatgtgaacgcggccgacagcgatggatggactcccctgcactgcgcggcctcttgtaacaacgtccaggtgtgcaaatttttggtcgagagcggcgccgccgtctttgcaatgacttactcagatatgcagacggcagccgacaaatgtgaagagatggaagaggggtacacacaatgctcacagttcctttatggcgtgcaagagaaaatggggattatgaataagggggtgatctatgccctgtgggactacgaacctcagaatgacgacgagctcccaatgaaggaaggcgattgtatgaccatcatacatcgtgaggacgaagacgaaatcgaatggtggtgggccaggctgaacgataaggagggatacgtgccacgcaatctcctggggctttaccctaggataaaaccgagacagcgtagtttagcctag

SEQ ID NO: 139505 - DNA, 1104 bp, Artificial Sequence
  Description of Artificial Sequence: Synthetic coding sequence
atggagaccatttcagttcctagctatccctccaaaagtgcttctgttacagcttccagcgagagccccgtggaaattcagaatccatatctccatgtcgagcccgagaaggaggttgttagcttggtgcccgagtccttatcaccggaggatgtgggcaatgctagtactgagaactcagacatgcccgctccttccccaggcctcgactacgagcccgaaggcgttcctgataattcacctaatctgcaaaacaatcctgaggagcctaacccagaggctcctcatgtattggatgtgtatctagaggaatatcccccataccccccaccaccctatccttccggtgagcctgaaggccccggagaggactcggtgagcatgcggcctccggaaatcacgggtcaggtctcactgccgcccgggaaacggactaaccttcgcaaaacagggagcgagcggattgcgcatggaatgagggtaaagttcaaccccttggctttattgctggacagtagtctagaaggagagttcgacctggtccagcggatcatatatgaggtagatgatccatctctgcccaatgacgaaggcattacagcgctacataatgcggtatgcgccgggcacactgaaattgtgaaattcctggtgcagtttggcgtgaatgtgaacgcggcagactccgatggctggaccccactacactgtgccgcttcttgtaataacgtgcaagtgtgcaagtttctagtcgaatcgggcgctgctgtgtttgctatgacgtatagcgacatgcagactgccgctgataagtgcgaagaaatggaggaaggttacacacagtgctcacagtttctttatggtgtccaagagaaaatgggaattatgaacaaaggcgtgatttacgctctctgggactatgagcctcaaaatgatgatgagctacctatgaaggagggggactgcatgactatcatccatagagaagacgaggatgagatcgaatggtggtgggcacgtctcaacgataaggaggggtacgtgccaagaaacctcctgggtttgtaccccagaattaagcctcggcagcggagcttggcttag

SEQ ID NO: 139506 - DNA, 2043 bp, Artificial Sequence
  Description of Artificial Sequence: Synthetic coding sequence
atgaatttcgaaacatctcggtgtgcaactctgcagtattgtcctgatccttacattcagcgctttgtggagacccctgcacacttttcctggaaggagtcatactataggagcaccatgagccaatccacccaaacaaatgagtttctttcccctgaagttttccagcacatttgggactttcttgagcagccgatatgttcagtgcagccaatcgatctcaacttcgtggatgagcccagcgaggacggggctaccaataagatcgaaatatctatggattgtatacgtatgcaggattccgacttgagcgaccctatgtggccccagtatacaaacctcggcctgctgaattcaatggatcagcagatccaaaacggcagcagttccacgagtccctataacaccgatcacgcccagaattcggtgaccgctccatccccatacgcacagccttcctccacctttgatgcactgtcacctagccccgccattcctagtaatacagattaccctgggcctcatagctttgacgtgtccttccagcagtcatctacggcaaagagcgcgacctggacctactcaacagagctgaagaaactctattgccaaatcgctaagacttgtcctattcagatcaaagtaatgacacccccaccacagggcgcagttatcagggctatgccagtttataaaaaggccgaacacgtcaccgaggtggttaaacgctgcccaaatcacgaactcagtagagagttcaacgagggacagattgctccaccctcccacctgattcgtgtggaaggaaacagccatgcccagtatgtggaagacccaatcaccggccgccagtctgtgcttgtgccttatgaacccccccaagtaggcactgaattcacaaccgtcctgtacaatttcatgtgtaatagcagttgcgtgggggggatgaacagaaggccaatattgataattgtcacactggaaactcgcgacgggcaggtactaggtcgaaggtgttttgaggctaggatctgcgcctgccccggcagagacagaaaggcggatgaagactctatccggaaacagcaggtcagtgactccaccaaaaatggggacgggaccaagcggcccttcagacagaacacacacgggattcagatgacatctataaagaagcgaaggtcaccggacgacgagttgctgtatcttccggtgcgcggccgcgagacttacgaaatgttactcaaaataaaggagagcctggaattgatgcagtacctcccccagcacaccatagagacctatagacagcagcagcagcagcaacaccagcatctgctccagaagcagaccagtattcagagcccatcgtcctacggcaattccagcccgcccctgaacaaaatgaatagcatgaataagctaccatccgtcagtcagttaattaacccgcaacagcggaacgcattgacgccgacaaccatcccggacgggatgggcgccaacatccctatgatggggacacacatgcctatggcaggggacatgaacggcctgtccccaactcaggcgcttcccccacctctgagcatgccatccacctctcactgcacacctccacccccttacccaacagactgttctatcgtctcattcttggccagattaggctgtagctcctgcctagactactttaccacacagggactcaccaccatataccagattgagcattattctatggatgatttagcctccctgaagatccccgaacagttccggcatgctatttggaagggcattcttgaccataggcaactccacgagttctcctcaccatcccatctattgcgaactccttcttccgcttctaccgtgagcgtaggatcatcggagactagaggggagcgcgtcatagacgctgtacggttcactttgagacagacgatcagcttccctccacgtgatgaatggaacgatttcaatttcgacatggatgccaggcgcaataagcagcagcggatcaaggaagagggcgaatag

SEQ ID NO: 139507 - DNA, 1533 bp, Artificial Sequence
  Description of Artificial Sequence: Synthetic coding sequence
atgaacttcgagactagccgatgtgccacactgcaatactgccccgatccctacatacaacggttcgtggaaacccctgcgcatttctcctggaaagaatcatattacaggtcgacaatgtcacaaagcacccagactaacgaattccttagcccggaggtctttcagcacatttgggactttttagagcagccaatctgttcagtacagcccattgacctgaatttcgttgacgaaccatctgaagacggggcgacaaataagatcgagattagtatggactgtatacgaatgcaggacagtgatctgtccgatcccatgtggccgcagtataccaatctcggccttctgaacagtatggaccaacagatccaaaacggatcttcgtcaaccagcccatataacaccgatcatgcacagaatagtgtgacagcaccgagcccctacgctcagccgagctcaaccttcgacgcactgtctccatctccagcaatcccttccaacaccgactatccgggaccgcacagtttcgatgtctcgtttcagcagagctccactgcaaaatcggctacctggacttatagtacagaactgaaaaaactatattgccagatcgccaagacatgtccgattcagataaaagtcatgacacctcctccccagggagccgtcattcgggctatgcctgtgtacaagaaagccgaacacgtgactgaagttgtcaagagatgtcccaaccacgagttgtctcgggagttcaatgagggccagatcgcccctccctcccatctaataagagttgaggggaatagccatgcccagtatgtcgaggaccccatcacaggcaggcagtccgtgcttgtgccatacgagccaccccaggttggcaccgagttcacaactgtcctgtacaatttcatgtgtaattcgtcctgtgtgggcgggatgaaccggcggccaatcctgattatcgtcaccctcgagactagagacggacaagtcctcggcaggaggtgcttcgaagctcggatttgcgcctgccccggacgagaccggaaggcagatgaagattccattaggaaacaacaggtgagtgactctacaaagaatggtgatgggacgaaacgaccatttcggcagaacacccatggcatccagatgacctccattaaaaagcggcgatcaccggatgacgaactcttgtatctaccggttcgaggccgagagacctatgaaatgctgctcaaaatcaaagagagcctcgaactcatgcagtaccttccccagcacacgatcgagacctataggcagcaacaacagcagcaacatcaacacctgttacagaagcaaactagcatccagagccctagcagctacggaaatagcagtcctccattgaataaaatgaactcaatgaataaactgccctctgtcagccagctaatcaatccgcaacagcgcaacgcccttacacccaccactattccagacgggatgggcgctaataggtcaggaaagtccgaaaatccctag

SEQ ID NO: 139508 - DNA, 1761 bp, Artificial Sequence
  Description of Artificial Sequence: Synthetic coding sequence
atgctgtatctggagaacaacgcacagactcaattttctgagccgcagtacaccaacctgggcctgctgaatagcatggaccaacaaatccagaatggaagctcgtctactagcccgtacaatactgaccatgctcaaaactctgttactgcaccaagtccttacgcccagccgtcgtctaccttcgatgccctttcacccagccccgctataccttccaacactgactatcctggcccacactctttcgacgtatcattccagcagagcagcactgcaaagagcgccacctggacgtactctaccgagctgaagaaattgtactgccagatagcgaaaacatgccctatccagatcaaggttatgactcctcctcctcagggcgcagtgattagggccatgcccgtgtacaagaaggccgaacacgttactgaggtcgttaaaaggtgccctaatcatgagctgtcccgcgagtttaacgagggccagatcgcgccaccgagccacctgatccgggttgagggaaactctcatgcccaatacgtggaggatccaatcacagggcgacagtcagtgctcgttccatatgaacctccccaagtgggcaccgagtttacaactgtgctgtacaactttatgtgcaactcttcatgtgtggggggcatgaaccgaaggccaatcctgatcatcgtgactctggagacccgagatggacaggtcctaggtcgaaggtgcttcgaagccaggatctgcgcttgtccaggccgagataggaaagcagacgaggattctatccgtaagcaacaagtgtctgattcaaccaagaatggagatggaactaagaggccctttaggcagaacacccacggaatccagatgacctctattaagaagcgtcggtctccggacgacgaacttttgtatctgcctgtgcgcggtcgcgaaacttatgaaatgttgctcaagattaaggaatccctggagctgatgcagtacctcccacagcatactattgaaacttatcgtcagcaacaacagcagcagcatcaacatttgttgcagaaacagacctccatccagtcacccagttcttatggcaactctagcccacctttgaataagatgaattctatgaataaactaccctccgtttctcagctcattaacccccagcagcgaaatgccctaacaccaacaactatcccggacgggatgggggcgaatatcccgatgatgggaacccacatgcctatggccggagacatgaacgggttgtcccctacccaggcgctgccacctccactttctatgccttctaccagtcactgcacgccccctcccccatatcccaccgactgtagtatcgtgtcattcttagctagactggggtgctcgtcatgtctggattatttcacaacccaggggctgacaacgatttaccagatagaacactattcaatggacgacctggcttcactgaaaattcctgaacaattccggcacgcgatctggaaagggattctggatcaccgccagctgcatgaattctccagtcctagccatctcctcagaacacccagctcagcaagcacagtatcagtgggttctagtgagactcgcggagaacgggttatcgatgccgtccgcttcaccctgcggcaaaccatttcttttcctccacgcgacgagtggaacgactttaacttcgacatggatgccagaaggaacaaacaacagcgtattaaggaggagggcgaatag

SEQ ID NO: 139509 - DNA, 1788 bp, Artificial Sequence
  Description of Artificial Sequence: Synthetic coding sequence
atgaactttgagacatcaagatgtgctacactccagtactgcccggacccctatatccaaaggttcgtggagaccccagcgcacttcagttggaaggagagttattacagatccacgatgagccagtctactcaaacgaatgagttcctgagcccagaggtctttcagcatatttgggattttctagaacagcccatctgtagcgtgcagcctatcgacctgaatttcgtggacgagccaagtgaagatggcgccactaataaaattgagattagcatggactgtattcgcatgcaggacagcgaccttagcgatccaatgtggtacagtacagaactgaagaagctatattgtcagatcgcgaaaacatgtcctattcagattaaagttatgactccaccgccgcagggagctgtgatccgggcaatgcctgtttacaagaaagcagagcacgtaacagaagtggttaagcgatgtcccaaccacgagttgtcacgcgaatttaatgagggccagatcgccccaccaagtcatctgattcgcgtggagggcaactcgcacgcacaatatgtggaggaccctattaccggacggcaatccgtgttagtcccttacgagccgccacaagtgggaactgagtttaccacagtgctttataactttatgtgtaattcttcctgtgttggtggaatgaaccgcaggcccatcctgataattgtcacccttgaaacacgtgatggacaggtactggggagaaggtgtttcgaggcacggatctgcgcttgtcctggacgagaccgcaaagccgatgaagactccataagaaagcagcaggtctcggacagcactaaaaatggagatggtacgaaacggccctttcgtcagaatacacacggcatacagatgaccagcattaagaagcgtagatcccctgacgatgagctgctgtacctgccagtgagaggccgggagacctatgaaatgcttttgaaaattaaggagagccttgaattgatgcagtacctgcctcaacacactatagaaacttacagacagcagcagcagcagcaacatcagcacctcctgcagaagcagacaagcatccagtcaccctccagttacggtaattcttctccccccctgaataaaatgaatagcatgaacaagctgccatctgtcagtcagctgattaatccccagcagcgcaatgcactaactccaacaactatacccgacggtatgggagcaaacatacccatgatggggacacatatgccaatggccggtgacatgaatgggctgtcaccaacacaagctctcccccctcctctgtcgatgcctagtacatctcattgtacccctcctcctccttacccaacggactgcagcatcgtcagctttctggcccggctggggtgctcctcatgtctggattactttacaacgcagggcttgacgacgatttatcaaatcgaacattactccatggatgacctggcctctttgaaaatccccgaacagttccgccatgctatttggaagggcatcctcgatcaccgacaactccatgaattcagttctccctctcatctcttaaggactccttcctccgcgagcactgtatctgttggtagttcagaaactcgcggcgagcgggtcatcgacgccgtgcgctttactctgaggcagactatttcctttccccctagggatgagtggaacgacttcaattttgacatggatgctcggagaaacaaacagcagagaattaaagaggagggggagtag

SEQ ID NO: 139510 - DNA, 1668 bp, Artificial Sequence
  Description of Artificial Sequence: Synthetic coding sequence
atgaatttcgaaacatctcgatgtgccaccctccaatactgccctgacccgtatatccaaaggttcgtagaaacacctgcacatttcagttggaaagaaagttattatcgcagtactatgtcccaatctacacagacaaacgaatttctgagccccgaggtttttcaacacatctgggactttttagagcaacccatctgttcagtccagcctatcgatctgaatttcgtggatgagcccagtgaggacggagcaaccaataaaattgaaatcagcatggactgcatccgtatgcaggactctgacctgtctgaccctatgtggccccagtacaccaatctgggattacttaactccatggaccaacagatccagaatggctcaagcagcacatccccttacaatactgatcatgctcagaatagcgtgacagcccccagcccatacgctcagccgagctccactttcgatgccctgagcccctcaccagccattccatctaatacagattatccgggacctcacagctttgacgtgtcttttcagcagtcatctactgccaagtccgctacttggacatacagcaccgagctgaagaagctgtactgtcagatcgctaaaacgtgtccgatccaaataaaggtaatgacaccgccgccacagggagccgttataagggccatgcctgtttataagaaggccgagcatgtaactgaggtggttaagcgctgccccaatcacgagctctcacgggagtttaatgagggccaaatcgcccctccctcacacctcatacgcgttgaaggaaactcccatgcccagtatgtagaggaccctatcacgggcagacaatcagtgctcgtaccttatgaaccaccacaggtaggtactgaatttacgacagtgctgtataatttcatgtgtaatagctcatgcgttggcggcatgaatcgtcgcccaatcctgattatcgtgacacttgagacgagggacggacaggtgcttgggcgccggtgtttcgaggctcgcatctgcgcctgccctggtcgagacagaaaggcggacgaggactcaatccgaaaacagcaggtaagtgatagcacgaaaaatggcgatggcacaaagcggccttttaggcaaaacacacacggcatacagatgacgagcatcaagaagcggcggagcccagatgatgaactcctgtatctgccagtgcggggcagggaaacctatgaaatgctgttgaaaataaaggagtcgctggagttgatgcagtatctgccccagcataccatcgagacctacagacagcaacagcaacagcagcatcagcatttgctgcagaaacaaacctctatccagtccccttccagctacggaaatagttctccaccactgaacaaaatgaatagtatgaacaaactgccttctgtctcccagctaatcaacccacaacagagaaatgcgctgacccccaccactattccggacggaatgggcgccaacattccgatgatgggaactcacatgcctatggcgggagacatgaatgggctgtcaccaacccaggccctgccgcccccactgagcatgccaagcaccagtcattgtacgcctccgcccccctatccaacggattgtagcatcgtgcgaatttggcaagtgtag

SEQ ID NO: 139511 - DNA, 1251 bp, Artificial Sequence
  Description of Artificial Sequence: Synthetic coding sequence
atgttatacctggaaaataacgcccagacccagttctccgagccacaatacacaaacttagggctgctcaatagcatggaccagcagattcagaatgggtcctcatcaaccagcccctataacacagatcatgcccaaaactcagtaacggccccttctccctatgcgcagccatcctccacatttgatgccctgtcacccagccctgctattccttccaataccgactacccaggtccccattcttttgatgtcagctttcagcagtcctctacagcaaaatccgctacctggacttactcgactgaactgaaaaagctttactgccagatcgccaagacctgtcccatccagattaaggtcatgactcccccaccccaaggagcggtgataagggccatgcccgtgtacaaaaaggcggaacacgtaaccgaggtcgtgaaaagatgtcccaatcatgagctatcacgggaattcaacgagggccagattgcgcccccatcccacctgatacgggtggaggggaattctcacgctcagtacgttgaggacccgatcaccggacgacagtctgtgttggtcccttacgaacctcctcaggttggcacagagtttacaacagtcttgtataactttatgtgtaactccagctgtgtcggcgggatgaatagaaggcccatcctgataatagtgactttggagacaagagatggccaggtgctcggccgtcgctgtttcgaagcccgaatctgtgcctgcccaggcagggacaggaaggccgacgaagattccatacggaagcaacaagtcagcgactctactaagaacggcgatggtactaagcggccttttagacaaaacactcacggaattcagatgacctctatcaagaagaggaggtcccccgacgacgagctgctgtatttacccgttcgggggagagagacttacgaaatgctgttaaaaatcaaggaaagcttggagctcatgcaataccttccacagcatacaatcgagacataccgacagcaacagcaacaacagcaccaacacctgctgcagaagcagactagtatccaatccccctcttcatacggaaactcctcccctccccttaataagatgaatagcatgaataaacttccttccgttagtcaactcatcaacccccagcagcgaaacgccctcaccccaactacaatccctgacgggatgggagcgaaccgctctggaaaaagcgagaatccttag

SEQ ID NO: 139512 - DNA, 1386 bp, Artificial Sequence
  Description of Artificial Sequence: Synthetic coding sequence
atgttgtatctcgagaataatgcccagacccagttctcagaaccacaatataccaatctgggactattgaattccatggaccagcagattcaaaacggctcttcctcaacgagcccatataatacagaccatgcacagaatagtgtgactgcaccctccccttatgcacagccttccagcactttcgacgcgctatctccatctcccgccatcccctcaaacacagactatcccggccctcacagtttcgacgtcagctttcagcaaagctccaccgctaagtccgctacctggacctactccaccgagctgaagaaactgtactgtcagatcgctaaaacttgtcctatccagattaaggtgatgaccccccctccacaaggagcagtgatacgggcaatgcccgtatacaagaaggccgagcacgtgactgaagtggtgaaaagatgccccaaccatgaactgtccagagaattcaacgaggggcagatcgccccacccagccacctgatcagggtggaggggaattcgcatgcacagtacgtggaagaccctatcaccggcagacagagtgttctggtcccttacgagcctccacaagtgggcacagagtttaccacagtgctgtacaactttatgtgcaacagcagctgtgtgggcggcatgaatcggcgcccaatcctgattattgttactctggaaacccgcgatggacaggtcctgggaaggagatgttttgaggcccggatctgcgcctgccccgggcgggatcgcaaggccgacgaggatagcattcgcaaacagcaagtttccgatagcaccaaaaatggagatgggacaaagcgcccatttcgacagaacacccacggaatccaaatgacctccatcaaaaagaggaggagccctgatgacgagttactctacctgccagtgagggggagggaaacatacgagatgttgctaaaaatcaaagagtcattggagctcatgcagtacctgccacagcatacgattgaaacttatagacagcagcaacaacagcaacaccagcacctccttcagaagcagacctccatacagtccccaagttcctacggaaattcctcaccacccctgaataagatgaacagcatgaacaaactcccctcagtgagccagctgatcaacccacaacagaggaatgctctgactcccacaacaatacccgatggcatgggggcgaatatccccatgatgggaactcacatgccaatggcaggggatatgaacggattgtctcccacccaggctttgccccctcctctttctatgccttcgaccagccactgcacacccccccctccatacccaaccgactgctccatcgttaggatttggcaggtgtag

SEQ ID NO: 139513 - DNA, 1464 bp, Artificial Sequence
  Description of Artificial Sequence: Synthetic coding sequence
atgaattttgagaccagtagatgcgctaccctccaatattgtcccgatccttacatccagagatttgttgagacacccgctcacttttcttggaaggaatcctactataggtctactatgtctcagagcacccagacaaatgaattcttgtctcccgaggtctttcagcatatatgggatttcttggagcagcctatttgttcagtgcagcccattgaccttaatttcgtagacgagccgagtgaggacggagcgactaacaagatcgaaatcagtatggactgcattagaatgcaggacagcgacttgagcgatccgatgtggccacaatatacaaaccttggcttgctgaactcaatggaccaacaaatccagaatggttcctccagcaccagtccttacaacacggaccacgcacaaaattctgtgaccgctccttccccatacgcacaaccatctagtaccttcgacgcactgtctccgtccccggctatcccctccaacaccgattacccagggccacacagcttcgatgtcagctttcagcaatcctccaccgccaagtctgcgacatggacttattctactgaacttaaaaaactgtattgccagatagccaagacgtgcccaattcagatcaaagtgatgacaccaccacctcagggtgccgtcataagagccatgcccgtgtacaagaaagcggagcacgtcacagaggtagttaaaagatgtcctaaccacgagctcagtcgagaattcaatgagggccaaattgccccaccttcccatcttattcgcgttgaaggcaattcacacgcacagtacgtggaagatcctataacaggcagacagagtgtactggtaccctacgagccaccacaagtgggaacagagttcaccactgttttatataactttatgtgtaacagtagctgtgtcggaggaatgaacagacgccctatcctcattatcgtcacgttagaaacacgagacgggcaggttctggggcgccgctgctttgaagcccgtatatgcgcatgtccaggccgagataggaaggccgacgaagattcaatcagaaagcaacaggtgagcgattcaacgaaaaatggcgatggcacaaagcggccgttcagacagaacacccatggaattcagatgaccagcattaagaagcggaggtcacctgacgatgaactgctttacctccctgtgcgaggccgggaaacttatgaaatgctgctaaagataaaagaaagtctggagctgatgcagtacttacctcagcatacgatcgagacctataggcagcagcagcagcagcagcatcaacatctccttcagaaacacttattgagcgcgtgctttagaaacgaactggtggaacccaggagggaaactcctaaacagtctgacgtgttcttccgccactccaaaccaccaaacagaagcgtctacccctag

SEQ ID NO: 139514 - DNA, 1182 bp, Artificial Sequence
  Description of Artificial Sequence: Synthetic coding sequence
atgctgtatctcgaaaacaatgctcagacgcagtttagcgagccacagtacactaaccttggcctcctaaattctatggaccagcagatccaaaatggttcatcctctacatctccttacaacacagaccacgcgcaaaacagcgtgaccgcacccagtccatacgcccaacctagcagcacgtttgacgcgctgtctccgagccccgccatcccaagcaacaccgattacccaggccctcactcattcgatgtaagctttcaacagtcctccactgctaagtcagcaacgtggacgtacagcaccgaactgaaaaagttatattgtcagattgctaaaacttgccccatccagattaaagtcatgacacctcctccacagggagccgtaattcgcgctatgccagtttataagaaggcagagcacgtaacagaagtcgtcaaaaggtgccccaatcacgagttatcccgggaattcaatgaggggcagatagcaccccctagccacctcattagggtcgaaggaaatagtcacgcgcaatacgtcgaggatccgattactggccgccaaagcgtcttggtgccctatgaaccaccccaagtggggacagagttcaccacggtgctgtacaactttatgtgtaattcgtcatgcgtgggcggcatgaatcgtaggccaatcttgatcattgtgacgcttgagacccgagatggccaggtgctgggccgaagatgttttgaggcgaggatctgcgcctgccccgggagagaccgtaaggcagacgaggattctatacggaaacagcaggtgtccgattcaacaaagaacggggacggtactaaacgaccgttccgccagaacactcacggcatacagatgaccagcatcaaaaaacggagatcaccagatgacgagctactataccttccagtgagagggcgggagacctacgagatgctgctaaagatcaaagagtctctcgagttgatgcagtatctgcctcagcacactattgagacatatcgccagcaacagcaacagcagcaccagcacttgttgcaaaagcatctgttgagcgcttgttttaggaacgagctggttgaaccacgacgggaaacaccaaaacaatcagacgtgttctttcggcactctaaaccccccaaccggtcagtgtacccttag

SEQ ID NO: 139515 - DNA, 2031 bp, Artificial Sequence
  Description of Artificial Sequence: Synthetic coding sequence
atgaactttgagacaagccgatgcgcgaccctgcagtattgccccgatccttacatccagagatttgtggagacacccgcacacttttcttggaaggagagctattatcggtctactatgagccaatccacacagaccaacgaatttctttcgcctgaggtctttcagcacatttgggatttccttgagcagcctatctgtagtgtgcagccgatcgacttgaattttgttgacgagccttctgaggacggggctacaaataagatagagattagcatggactgcattcgcatgcaggactctgatctgagcgaccccatgtggcctcaatacacaaatcttggccttcttaatagtatggaccagcagatccaaaacggaagtagttctacatccccatataataccgaccatgctcagaactcagtcactgctcccagcccctatgcgcagcctagtagcacttttgatgctctgtcacccagtcctgctatcccatccaatacggattacccaggcccacacagcttcgacgtgagcttccaacagagttccaccgctaaaagtgcaacatggacctattctacggagctgaaaaagctctattgtcagattgcaaaaacctgccctattcagattaaggtgatgacacctccgccacaaggcgcagtgattcgagccatgccagtgtataaaaaggccgagcacgtcactgaggtggtaaagcggtgtcctaaccatgagctgtcacgcgaattcaatgagggccaaatcgcaccgccgagtcacctcatccgagtggagggcaattcacatgcccaatacgtcgaggatccaatcactggacgtcaatctgtgttagtgccttacgaacccccccaggtgggtaccgagttcaccaccgtcctgtacaatttcatgtgcaacagttcttgcgtcggcgggatgaacagaaggcccatccttattattgtgaccttagaaactagggacggccaggtcctcggcagaaggtgctttgaggcccgcatttgcgcatgtccaggacgggatagaaaggccgatgaggatagcattcggaagcagcaggtcagtgactccactaagaatggcgacgcattccgacagaacactcacgggatacagatgaccagtattaagaagcgacgctctccagatgacgagctcctgtatctccctgttcgtggccgggagacatatgagatgcttctgaagatcaaggaatcacttgagcttatgcagtatctacctcaacacacaatcgagacctacagacagcagcaacagcagcagcaccaacacttgctccagaagcagacctcgatccagtccccatctagctacggaaattccagtccccccctgaacaaaatgaattctatgaacaaattgccaagcgtcagccaacttatcaaccctcagcagaggaatgcacttactcctaccacaatccctgacggcatgggtgcaaacatccccatgatgggtacccacatgcccatggccggagatatgaacgggctgtcacctactcaggcactgcctccgccactcagcatgccgagcaccagtcattgtactccaccacctccttatccaaccgattgttcgatcgtgagctttttggcgagattgggttgctcctcctgtctggattactttaccacccagggactaacaaccatctaccagattgagcattactccatggacgacctggcatcgttaaagatcccggaacagtttagacatgcaatctggaaagggattctcgatcacaggcagctacatgagttcagctccccgtcccacttgctgcgcacccccagcagcgccagcaccgtttcagtggggtcgagcgagaccagaggcgagcgtgtaattgacgctgtacgttttactctcaggcagacgataagcttccctccgcgtgacgagtggaacgactttaacttcgatatggacgctcgacggaacaagcagcagcgaattaaggaggaaggggagtag

SEQ ID NO: 139516 - DNA, 1506 bp, Artificial Sequence
  Description of Artificial Sequence: Synthetic coding sequence
atgctgtacctggaaaacaatgctcaaacgcagtttagcgaatactccactgagctgaaaaagctgtactgccaaattgcaaagacctgccctatccagataaaggtgatgacccctccgccgcaaggagcagtgatccgagcgatgcccgtgtataagaaggcagaacacgtgacggaggtcgtcaaaagatgtccgaaccatgagctctcacgcgagtttaacgaagggcagatcgccccgccctctcatctgatacgtgtagaaggaaacagccatgcccagtacgtagaggatccgattaccggcaggcagtcggtcctggttccctacgagccacctcaggttgggactgaattcacgaccgtcttgtataactttatgtgcaacagtagctgtgtgggaggcatgaatcgtcggcctatccttataatcgttaccctggagacccgggacgggcaggtgctgggccgtaggtgtttcgaggcacgcatctgcgcctgtcctggtcgcgataggaaagctgatgaggattctattcggaaacagcaggtgtccgacagcaccaagaatggggacggcacgaagcgcccttttcgtcagaacacccacggaattcagatgactagtatcaaaaaacggaggtcccctgatgacgagctgctgtatctccctgttagaggtcgtgagacctatgaaatgctccttaaaatcaaagagtcacttgaactgatgcagtacctcccacagcatactatcgagacctataggcagcagcagcagcagcagcaccaacatctcctgcagaagcagacttcaattcagtctccgtccagttacggcaactcaagtcccccattaaataaaatgaatagtatgaataagcttccttcagtctcacagctgatcaatccacagcagcggaacgctcttacaccaaccaccattccggacggcatgggcgccaatatcccaatgatgggtacccatatgcctatggctggcgatatgaacggcctctcaccaacacaggcattgccccctcccctgtccatgccaagtacatcccactgcaccccaccgccaccctatccaacagattgtagcattgtgtccttcctagcccggctgggatgttcatcctgcctggactactttacaactcagggcctgactacaatctatcagattgagcattatagtatggatgacctggcaagcttgaaaatcccagaacagtttcggcacgctatttggaaaggaatccttgaccatcgacagttacacgagttttcctctcccagtcatttgctgagaactccgagcagtgcttccacagtctctgtcggaagctctgaaacacgaggcgagagggtcattgacgccgtgcgttttacactgaggcaaaccatctctttcccaccacgggatgagtggaacgattttaattttgatatggatgcaaggcgtaacaagcagcaacggatcaaagaagagggggagtag

SEQ ID NO: 139517 - DNA, 1749 bp, Artificial Sequence
  Description of Artificial Sequence: Synthetic coding sequence
atgctgtacctggagaataacgcccagactcagttttctgagccacagtacactaatttggggctgctgaactctatggaccagcaaatccagaatggcagttcgagtacgtctccatataacacagaccacgcacagaactcagttacagcgccatcaccctatgcacagccctcttctacgttcgacgccttgtcaccgtctcctgctatcccatccaataccgattatcctggaccacacagctttgatgtgagttttcagcagagctcaaccgcaaagagcgctacttggacgtatagcactgagctaaaaaagctgtactgccaaatagctaagacttgtccgatccaaattaaggtcatgaccccccctcctcagggcgcggtgatcagggctatgcccgtgtataaaaaggccgagcacgtcacagaggtcgtcaagcggtgccctaatcacgagctgtcacgagaattcaacgagggtcaaatcgcccccccctcccacttaatcagagtagaaggaaactctcacgctcagtatgtggaggaccctatcactggccggcaatccgtgctcgtgccgtacgaaccccctcaggtgggcaccgaattcacaaccgtactgtacaatttcatgtgcaactcatcatgtgtgggaggtatgaatcgccgcccaatacttatcattgtcaccctggagactcgggacgggcaggttctgggtcgtcgctgttttgaggcaaggatttgtgcatgcccgggacgcgatagaaaggccgatgaggacagcatacgtaaacagcaggtgtcggattctacgaagaacggcgacgcatttcgacagaacacccatggcattcagatgacgtccattaagaagcgcaggtctcctgacgatgagctgctgtatctgccagtcagaggcagagaaacttatgagatgttactaaagataaaagaatctctagagctcatgcaatacctcccacagcacacaattgaaacctatcggcaacagcagcagcaacaacatcagcatcttctgcagaaacagacgagcatccagagcccttcctcctacggtaactccagtccccctctgaacaaaatgaacagtatgaataaactgccatccgttagccagttaataaatccacaacagaggaacgcccttactcccaccaccatccccgacggcatgggtgccaacattcccatgatgggtacgcacatgcctatggcaggagacatgaatggactgagcccgacccaagcacttccccccccattgtccatgcctagcacctcccactgtacgccccccccaccttatcccactgattgcagtatcgtatcctttttggcccgcctgggctgcagcagctgtctggattatttcactacccagggcttaaccactatctatcaaatcgaacactactccatggatgatcttgcaagccttaaaatcccagagcagttccgtcacgccatttggaagggtattctggatcaccgccagctccacgaattttcttcaccttcccacttgttgaggactcccagctctgcctcgaccgtttccgtgggatcgtccgagaccaggggagagagagtaatcgacgctgtccgatttacactgaggcagaccatatcctttccgccaagggacgaatggaacgactttaactttgacatggatgccaggagaaacaagcagcaacgtataaaggaagaaggagaatag

SEQ ID NO: 139518 - DNA, 567 bp, Artificial Sequence
  Description of Artificial Sequence: Synthetic coding sequence
atgatcatttatagggatcttatctcccatgatgagatgttttccgacatttataaaatccgcgagatcgctgatggactctgtctcgaggtagaaggaaaaatggttagtcgcaccgagggcaatattgatgattcgctgatcggaggcaatgcatctgcagagggcccagagggagagggcacagaatcgacagtgataaccggagtggatatcgtgatgaaccaccatttgcaggaaacatcgtttacgaaagaagcttacaagaaatacataaaggactatatgaaaagcatcaaaggcaaactggaagagcaaaggcctgagcgggtcaaaccgtttatgaccggcgccgccgagcagatcaaacacattctggctaacttcaaaaattatcaattctttatcggtgaaaacatgaaccccgatgggatggtggccttgcttgactaccgcgaagacggcgttactccgtacatgattttctttaaagacggactggagatggaaaaatgcgtgagcacccgcaaatgggtcaagattaacaacgtgaagaaaacattttag

SEQ ID NO: 139519 - DNA, 417 bp, Artificial Sequence
  Description of Artificial Sequence: Synthetic coding sequence
atggtttctagaacagagggcaatatcgatgattctctgatcgggggaaacgcatcagctgaaggaccagaaggcgagggtaccgagagcacagtaatcaccggagtggatatagtgatgaatcaccacctgcaggagacttcattcaccaaggaagcatataagaaatatattaaggattacatgaagtccataaaaggaaagctggaggagcagagacctgagcgggtcaagccgttcatgacaggcgctgcagagcagatcaaacacatcctggctaactttaagaactatcagttcttcattggggagaatatgaatcccgatggcatggtcgcccttctggactaccgggaagatggcgtcaccccctatatgatctttttcaaggacggtttagaaatggagaaatgttag

SEQ ID NO: 139520 - DNA, 417 bp, Artificial Sequence
  Description of Artificial Sequence: Synthetic coding sequence
atggtgtccagaacagaaggcaatatcgacgacagtttgattggcggcaacgctagcgccgaaggccccgagggagagggtaccgaatccaccgtgatcactggcgttgacatcgtgatgaaccaccatctccaagagactagttttacgaaggaggcctacaaaaagtacattaaagattacatgaagtctattaaggggaaactggaagaacagcggcccgagcgagtcaagccgttcatgacaggtgccgccgaacagatcaagcatatcctggctaacttcaaaaattatcagttcttcatcggcgaaaacatgaacccggacggcatggttgcattgctcgactatcgcgaggacggagtgaccccgtacatgatctttttcaaggatggactcgaaatggagaaatgttag

SEQ ID NO: 139521 - DNA, 483 bp, Artificial Sequence
  Description of Artificial Sequence: Synthetic coding sequence
atgttctcggacatttacaagatccgtgaaatagctgacgggctgtgtctcgaagtggaggggaaaatggtgagtagaacagaggggaatatcgacgactctttgatcggaggtaatgccagcgcagaaggcccagagggagaagggaccgagagcaccgtgattaccggggtggacatcgtgatgaaccaccacttacaagaaactagttttactaaggaagcatacaagaaatacatcaaagactacatgaaaagtattaagggcaagttggaggagcagcggcccgaacgggtaaagccgtttatgactggtgcggccgagcaaatcaaacatatcctggcgaacttcaagaattaccagttcttcatcggtgaaaacatgaatcctgatgggatggtggccctgctggattatcgggaggacggcgtgaccccttacatgatatttttcaaagatggcctcgagatggagaaatgttag

SEQ ID NO: 139522 - DNA, 519 bp, Artificial Sequence
  Description of Artificial Sequence: Synthetic coding sequence
atgatcatctatcgcgacttaatatcccatgatgagatgttttccgatatttataagatccgtgaaatcgccgacggcctatgcctcgaggtggagggcaaaatggtcagtcgcaccgaaggcaacatcgacgacagcctgatcggcggcaacgccagcgccgaaggtcctgagggggaaggcactgaatccacagtgataaccggggtcgatatcgtgatgaatcaccatctccaggagacctcctttacaaaggaggcctacaaaaaatatatcaaggactatatgaaaagtatcaagggaaagctcgaggagcaacgacctgagagggtgaaaccgttcatgaccggtgccgctgagcagattaagcatattttggcaaactttaaaaactaccaattctttatcggggaaaatatgaatccggatggaatggtggccctgcttgattacagggaagatggggtgacgccttacatgatcttctttaaggacggactcgaaatggagaagtgctag

SEQ ID NO: 139523 - DNA, 1164 bp, Artificial Sequence
  Description of Artificial Sequence: Synthetic coding sequence
atggaagatgatgcccctgttatttatggcctggaatttcaggcacgggcactgactcctcaaacggcagaaacagacgcaattaggtttctggtaggtacacagagcctgaagtatgataaccagatccatatcatcgacttcgatgatgaaaataatatcattaacaagaacgtcctgctgcatcaggccggcgaaatctggcatatcagtgcgtcgccggccgaccgaggggttctcactacatgctacaatcgaactagtgattccaaagtgctgacctgtgccgctgtatggcgcatgcctaaagaattggagtcaggatctcatgagtcgccagatgatagttctagtaccgctcaaacgctggagctgctgtgccacctggacaatactgcacacggtaatatggcatgtgtggtctgggaacctatgggagacggaaaaaagataatttctctagccgataaccacatcctgctctgggatctgcaggagtccagttcccaagccgttctggcatctagtgccagtctcgaaggcaaagggcagctcaagttcacaagtggaagatggagcccccatcataattgcacccaagtggcgaccgctaatgacacaacactgcgcggctgggacacccggtccatgtcccagatatattgtattgagaatgcccatggccagctggtgcgagacctggattttaaccctaataaacagtactacctcgcaagctgtggcgacgactgtaaagtgaaattctgggacacacgcaatgttaccgagccagtgaaaactctggaggagcactcacattgggtgtggaacgtacgttacaaccactctcatgatcagcttgtactgacaggaagcagcgactcccgcgtgattcttagcaatatggttagcatcagctccgagcctttcggacacctcgtggacgacgacgacatctctgaccaggaggatcatcggagtgaagagaagtccaaagagccactgcaagataacgtgatcgcaacatacgaagaacatgaggacagtgtctacgctgtggactggagctccgccgatccatggctcttcgcgtctctgagttatgacggtcggttggtgattaaccgcgttccgagggcattgaagtaccacatactgctgtag

SEQ ID NO: 139524 - DNA, 990 bp, Artificial Sequence
  Description of Artificial Sequence: Synthetic coding sequence
atggctgaagctggtacgggggagccctccccttcggttgagggtgagcatggcaccgagtatgacaccctgccatctgacaccgttagcctgtctgattccgactccgatttatccttacccggcggagcagaggtggaagctctgtcccctatgggactaccaggcgaagaggattctgggcctgacgaaccccctagccctccatctggcctactcccggcaactgtgcaaccttttcacctgcggggtatgtccagcactttttctcagcgcagcagagatatttttgactgtctcgagggggccgctcgtcgcgccccatccagcgtagcacacacgagtatgtctgacaacggggggttcaaaagacctctggcaccaagtggccgtagccccgttgaagggctcggtagagcccaccggagtccggcatccccccgagtgccccccgtccccgactacgttgcccaccctgagcgatggacgaagtacagtctggaagacgtgaccgaggtgtccgagcagtctaatcaggctactgccctggcgttcttgggctcccagagtcttgccgcaccaactgattgtgtgtcgtctttcaaccaggacccaagttcttgcggtgaaggaagggtgattttcacaaagcccgttcggggcgtggaagcccgtcacgaacgtaagagggtgctgggaaaagttggcgaaccaggcagagggggacttggtaaccctgccactgatcgcggtgaagggccagtggagttagcccatcttgccggcccaggtagcccggaggctgaggaatggggatcacaccatggggggctgcaggaggtagaagcactcagtggttcggttcattccggttcagtcccaggccttcctccagtagagacagtaggatttcatgggtcgaggaagagatccagagaccacttccgcaataaatcatcctcacctgaggaccccggagctgaggtgtag

SEQ ID NO: 139525 - DNA, 798 bp, Artificial Sequence
  Description of Artificial Sequence: Synthetic coding sequence
atggccgaggctggtacgggcctactgcctgccaccgttcagcccttccatctgcgtggtatgagctccaccttttcccagcgatctcgggatattttcgactgtctggaaggcgcggcaagacgcgccccttcaagcgtcgcacacacctcaatgtccgacaacggcgggttcaaacggccgctggcaccctccggccgcagccctgttgaggggctgggccgagcacatcgttctcccgcatcccccagagtgcccccggttccagactacgtggcccaccccgaacgctggaccaagtattccctggaggatgtgaccgaggtgtccgaacagagcaatcaggcgactgcacttgcatttcttggaagccagtccctggccgccccaacggattgcgtcagctcattcaaccaggaccccagctcctgcggtgaggggagggtgatctttacaaaaccagttagaggcgtggaggcacgccatgaacggaaacgggtactgggcaaggtgggcgaacctggcagaggcggtctgggcaatcccgccacagatcgcggggaaggccctgtggagctcgcgcatctggccgggcccggatctcctgaggcagaggaatggggcagtcatcatggaggcctccaggaagttgaagctctgtccggaagcgttcactctggatctgtgcccggactgcccccagttgaaactgtaggatttcacggctccaggaagcgcagtcgggaccactttagaaacaagtcttcaagcccagaagatcccggagccgaggtgtag

SEQ ID NO: 139526 - DNA, 339 bp, Artificial Sequence
  Description of Artificial Sequence: Synthetic coding sequence
atggcagaggccgggaccggcgagccctccccttctgtcgagggtgagcatggcactgagtatgacactcttccctctgacaccgtatccctgagcgattctgatagtgatttatccctgccgggcggggcggaggttgaggcactaagcccgatgggattaccaggcgaggaggatagtgggcctgacgaaccaccatcacctcctagtggactcctgccagccacagtccaacccttccatctacgtggcatgtcttccactttttcccagcgcagccgcgacattttcgattgtttagagggcgcagcccgcagggccccttctagcgtggcatag

SEQ ID NO: 139527 - DNA, 612 bp, Artificial Sequence
  Description of Artificial Sequence: Synthetic coding sequence
atggccgaggctggtaccggagagccctctccatcagtcgaaggtgagcacggcactgaatacgatactctgccatctgatactgtatcactatctgatagtgatagcgatttgtcccttccaggcggagccgaggtagaagctctctctcccatgggtctccccggggaggaggatagtggccccgacgaacctccttcccccccatctggcttgctgcccgcaacagtacaaccttttcatcttcgaggtatgtcctccaccttcagccagagatctagggacatttttgattgcctcgaaggggccgccagacgcgccccctcatcagttgcccatacctcaatgtctgataacggggggttcaagagacctctcgcgccgtccgggagaagcccagtagaggggttgggaagggcccaccggtcccccgctagcccccgcgtcccaccagtgccggactacgtggcacacccagagcgatggacaaaatattctctcgaggacgtgaccgaagtgagtgaacagagcaaccaggccaccgcccttgcctttctaggcagccaatccctggccgctcctaccgactgcgtctctagcttcaaccagtag

SEQ ID NO: 139528 - DNA, 627 bp, Artificial Sequence
  Description of Artificial Sequence: Synthetic coding sequence
atggctgaagcggggaccggcttgctccccgccactgtacagccatttcacttgcgcgggatgagctctacgttctcccagcgatccagggacatcttcgattgtctggaaggcgcagctcgcagggcaccctcatccgtggcccacacctccatgtccgataacggggggtttaaacggcccctcgctcctagcgggcgcagccccgtggagggcctgggacgcgctcacagaagccctgcctccccacgggtgccgccagtgccggactatgtggctcatcctgagcgctggaccaaatacagtctggaggatgttacagaagtcagcgagcaatcaaatcaagcaaccgccttagctttcctgggatctcagtccctggctgcccccacagattgtgtatctagcttcaaccaggacccctcttcctgcggcgagggtagggtgatctttaccaaacccgtccgtggggtggaggcacgacacgaaagaaaacgtgtcctgggtaaagtgggagaaccaggtcggggggggctgggcaaccctgccacagatcgcggtgaaggaccagtggaactggcccacttagccggtcctgggagcccggaagctgaggagtggggttag

SEQ ID NO: 139529 - DNA, 990 bp, Artificial Sequence
  Description of Artificial Sequence: Synthetic coding sequence
atggctgaggctgggactggagaaccctcccccagcgtggagggtgaacacggtacagagtatgacacactgccatcagacaccgtgagtttgtcggactccgactccgacctcagccttcctggaggtgctgaggtggaggcattgagtcccatgggacttcccggggaggaggactccggccccgatgagccaccatccccaccatctggcttattacctgcaacagttcagccttttcatctcagagggatgtccagtaccttttcccagaggagtcgcgacattttcgactgcctggagggggccgctcgcagagccccatcctccgttgcgcacaccagcatgtcggacaacgggggtttcaagcgccccctggcacccagcggtcgatctcctgtggagggccttggcagagctcacagaagtcccgcaagtccgcgggtgccgccggtgcccgactacgtagctcaccccgagcggtggactaagtactccctggaggatgtcaccgaggtgagtgaacagtctaaccaggcaacggcgctggccttcctcgggagtcagtccctggcagcgccgactgactgcgtttccagcttcaatcaagatcccagttcctgtggcgagggtcgcgtaatcttcaccaagcctgtaaggggggtagaggccaggcacgaacgtaagcgggtattaggtaaggtgggtgagcctggccgaggtggactcggaaaccccgctaccgacaggggggagggcccagttgaattagcccatttggccggtcctggctccccggaagccgaagaatggggatctcatcatgggggcctccaggaggttgaagcactctccggaagtgtccactctggttctgtacccgggcttccacctgtggagacagttgggttccacgggtctcggaagagatcccgagatcactttagaaacaagtccagcagcccagaggaccccggcgccgaggtgtag

SEQ ID NO: 139530 - DNA, 333 bp, Artificial Sequence
  Description of Artificial Sequence: Synthetic coding sequence
atggccgaggccgggacaggggaaccttcacccagtgtggaaggtgagcatggcacagagtatgacaccctcccgtccgacacagtgtccttgtcagatagcgatagtgatctgtctttgcctgggggagctgaagttgaggccctgagcccgatgggcctgccgggcgaagaggattcaggccctgacgaaccgccatcacctcccagcgggttgctgcccgctaccgtgcagccatttcacctgaggggtatgagctccactttctcccagaggtcacgggacatcttcgattgcctggagggtgctgcccggagggcaccatcaagttag

SEQ ID NO: 139531 - DNA, 576 bp, Artificial Sequence
  Description of Artificial Sequence: Synthetic coding sequence
atggccgaggcaggaaccggggagccctcccctagtgtcgaaggtgagcatggaaccgagtatgacacactaccctctgacaccgtgagccttagcgacagcgacagtgacctcagtctcccgggaggagcggaggtggaggcgctgtcgcccatggggttgcccggcgaggaagattcaggccccgatgagcccccttccccacctagtgggctgctaccagcgacagtgcagcccttccacctgaggggtatgtcctccacttttagccagcgctccagggatatattcgactgcctggagggggctgctcgccgcgccccgtcatcagtcgcccatacttccatgagtgacaatggtgggttcaagagacctttggctccttctgggaggagcccagtggagggcctgggcagagctcacagatcaccagcctccccgagggtcccacctgtgcctgattacgtggcccaccccgagagatggactaagtattcgctcgaggacgtcaccgaggtctccgaacagtccaatcaggcaacagcgctagcattcctggggagccaatccttatag

SEQ ID NO: 139532 - DNA, 639 bp, Artificial Sequence
  Description of Artificial Sequence: Synthetic coding sequence
atgggcccgatgtggagaatgcgtggcggagcgacgaggcggggatcctgttgtggaggagacggagccgctgacggcagagggccaggacggtccggacgggccagggggggtggttcaccttctggaggcggcggaggggtcgggtggcgggggcgagccgatggagccagacagcaacttgaggaacgcttcgccgacctggcagcctctcacttggaagccatcagagcgagggacgagtgggatcggcagaacgccaggctacgccaagaaaatgctagactccggttagagaatcgcagacttaaacgcgagaacaggtctctgtttagacaggcacttcggctccctggagagggtggcaatggtactcccgccgaagcccggcgggtgcctgaggaagcatctaccaatcgccgggcccgcgatagtggccgggaggacgaaccggggtccccccgtgcactgcgcgctagactcgaaaagcttgaggccatgtatcgtcgagccctgctacagctgcacctggaacaacgcggaccacgccctagcggagacaaagaggaacagcctctgcaggaaccggactctggcctgcggtcccgcgattccgagccaagcgggccttggctctag

SEQ ID NO: 139533 - DNA, 1047 bp, Artificial Sequence
  Description of Artificial Sequence: Synthetic coding sequence
atgggcgctagaggcgctcccagcagacgaagacaggccggacgccggctgcgctacctgcctaccgggagtttcccgtttcttctcttgctgcttctactgtgtatccagcttggaggcggtcagaagaagaaggagaatcttctcgctgagaaggtggagcaactgatggagtggtcaagccgcagatcgatctttcgcatgaatggagacaagttccgaaagttcataaaggctccgcccagaaactatagcatgattgttatgttcaccgccttgcagccccagcgccagtgcagtgtctgtcggcaggccaacgaagagtaccagatcctggccaattcttggagatacagttctgcattttgcaacaagctattcttctctatggtcgactatgatgaggggacggatgtgtttcagcagctgaacatgaacagcgcacccaccttcatgcactttcccccaaagggccgccctaagagagccgacaccttcgacctgcaaagaattggcttcgccgccgagcagttggcaaaatggatcgccgaccgtacagacgtgcacatcagagtgtttaggccacccaactatagtgggaccatagcattggctcttctggtatctctagtgggaggcctgctgtacctcaggcgcaacaacctagagttcatttacaacaagaccggctgggcaatggtctccctatgcattgttttcgccatgacttcagggcagatgtggaaccatatccgcggccccccgtacgcccacaaaaatccacacaacggtcaggtgagttatatccatgggtctagtcaagcacaattcgttgctgaatcccatatcattttagttctgaatgctgctattaccatgggtatggtgctgctgaacgaagcagcaacgagtaagggggacgtgggcaaacggagaatcatctgtttggtcgggttgggacttgtggtgttcttcttttcctttttactttccatatttaggtccaaatatcacggttatccgtactcagatctcgacttcgaatag

SEQ ID NO: 139534 - DNA, 1044 bp, Artificial Sequence
  Description of Artificial Sequence: Synthetic coding sequence
atgggcgcaaggggcgcaccttcgcggagacggcaagctggccggagactaagatacctgcctactggttctttcccatttctcctcctgcttttgctcctctgcatccaactgggtggtggacaaaagaaaaaggaaaatctgctggccgagaaggtcgagcaactgatggagtggtcttcgaggaggagtattttcaggatgaacggcgataaatttagaaagtttataaaagctcccccgcgcaactactcgatgatcgttatgttcaccgcactacagccccagagacagtgcagtgtctgcaggcaggccaacgaggaataccaaatcttggccaattcatggcgttatagcagtgctttctgcaacaagctcttttttagcatggtggactacgacgaaggcacggacgtgttccagcaactgaacatgaacagcgctccaactttcatgcacttccctccaaagggacgccccaagcgcgcagatacctttgatttgcagagaatcggctttgctgccgagcagcttgcaaaatggatcgctgatagaacagacgtgcatatcagagttttcaggccgcctaactacagcggtacaattgcactggccttactggttagtttggtgggagggctcctgtatctgcggaggaataatctggaattcatatataataagacgggttgggccatggtgtcgctgtgcattgtgttcgcgatgacatcagggcagatgtggaatcacattagaggtcctccctacgcccataaaaatccacataacggccaggtctcctatatacacggatccagtcaggcccaattcgtagccgaaagccatattattcttgtgctgaatgctgcaatcacaatgggtatggtcttgctcaacgaggccgctactagcaagggggacgtaggaaagcgccgaatcatctgcctcgtggggctaggactcgtggtcttcttctttagcttcctgctttctatatttaggagtaaataccatggatatccatactcatttctgataaaatag

SEQ ID NO: 139535 - DNA, 1047 bp, Artificial Sequence
  Description of Artificial Sequence: Synthetic coding sequence
atgggagcacggggagcaccctctagacgtagacaggcaggcaggaggctgcgatacctgcccacgggatcttttccttttctgctgttgctactgctcctttgcatccagctgggaggtggtcagaagaaaaaggagaacctcctggccgagaaggtcgagcagcttatggaatggagcagcaggcggtctatttttaggatgaacggcgacaaattccggaagtttattaaggcgccaccacggaattattctatgatcgtgatgtttactgcactccagcctcagcgtcagtgctctgtgtgccgccaggccaatgaagagtaccaaatcctagccaactcttggaggtatagttcagcgttctgcaataagctgtttttcagcatggtcgattacgacgaaggcaccgacgttttccaacaactaaacatgaacagcgcccccactttcatgcacttcccgcctaagggacgtcctaaaagggccgatacattcgatctacagagaattggttttgcggccgagcagttggcaaaatggattgcagataggaccgatgttcatatacgggttttccggcctcctaattacagcggaactatcgcattggccctgctggtgtcgctggttggcgggctgctgtatctgaggcggaacaatctggaattcatttataacaagacaggatgggccatggtcagtttgtgcatagttttcgcaatgacatcgggtcagatgtggaaccacatccgcgggcccccctacgcgcacaaaaacccccataacggtcaagtgagctacatacatgggtcctcccaagcccagtttgtcgcagagtcacacattatcctcgttctgaacgcggcaatcaccatggggatggtgctattaaacgaagcagcgaccagcaaaggagatgtcggaaagaggcggatcatttgcctcgtcgggctgggcctggtcgttttctttttcagttttctgttgagcatatttcgctcaaaataccacggctacccttattccgatctggatttcgaatag

SEQ ID NO: 139536 - DNA, 1047 bp, Artificial Sequence
  Description of Artificial Sequence: Synthetic coding sequence
atgggagccaggggcgccccctcgcggaggagacaggctggaagacgcctgcgctacctgcccactggctccttccccttcctgcttcttctactgctgctgtgtatccagttgggcggcggacagaagaaaaaggagaatctgctggcggagaaggtggagcaattgatggagtggtccagccgcagatctatatttcggatgaatggggacaaattcagaaagtttataaaagcgcctccccggaattacagcatgatcgtgatgttcactgctctgcagccacagagacaatgttctgtgtgccgccaagctaacgaggaatatcaaattttggcaaattcctggagatattcgagcgccttttgcaacaagctgttcttttctatggttgactacgatgagggtaccgacgtgtttcagcagctaaatatgaatagtgcacctactttcatgcatttccctcccaaggggcggcctaaacgcgcagatactttcgatctccaaaggattggatttgctgcagagcaattagcaaagtggatagctgaccggacagatgtccacattcgcgtttttagaccccctaactactcggggaccatcgccctggcactgttagttagtcttgtcggcggcttactgtatctcagacggaacaacctggaatttatctacaataagaccggctgggcaatggtgtctctgtgcatcgtgtttgcaatgacgtccggccagatgtggaaccacatcagaggaccgccatacgcacacaaaaatccacataacggccaggtgtcctatatccacggctcctctcaggcccagttcgtagctgaatcacacatcatcctggtgctgaatgcagccataaccatgggcatggtcttactaaacgaggctgccacttctaaaggcgatgtgggcaagaggcggatcatctgcctggtggggctcggactggtggtcttctttttctcctttctgctgagtatctttcgctctaaatatcatggctatccctactcagatcttgattttgaatag

SEQ ID NO: 139537 - DNA, 534 bp, Artificial Sequence
  Description of Artificial Sequence: Synthetic coding sequence
atggctcaccctgtccagagcgaattccctagcgcccaggaaccgggctcagctgccttcctcgaccttccggaaatggagatccttttaaccaaggcagagaacaaagatgacaagactctgaacctctcgaaaacgctgagcggacctctggacctcgagcagaactcccagggcttacccttcaaagctattagcgaaggccatttggaggctcctctgcccaggagtccaagtcgcgccagcagccgccgtgcatcttccattgcaaccacatcttatgcacaggatcaggaagcccccagggattacctgatccttgcagtcgtggcatgcttctgccctgtctggcccttgaatttgataccccttattatcagtatcatgtcaaggtcttcaatgcagcagggcaatgtggacggcgccaggagacttggaagactggcacgcctgctcagtatcactctgatcattatgggtatcgttatcatcatggtagccgtcacggtgaattttaccgtgcagaagaaatag

SEQ ID NO: 139538 - DNA, 1173 bp, Artificial Sequence
  Description of Artificial Sequence: Synthetic coding sequence
atggctgtgtctgagtcacaattaaaaaaaatggtttctaaatacaagtaccgagatctgacagtaagagagacagtgaacgttattaccctctacaaggatttgaaaccggtccttgattcttatgtatttaacgacggatcatcacgcgagctgatgaatctgaccgggaccattcccgtgccttacagaggaaacacttacaacatccccatctgcttgtggttactggacacctatccttacaacccccctatctgcttcgtcaaacctacgtcatccatgacgatcaaaaccggcaaacacgtcgacgctaacgggaaaatctatctgccatatctccatgagtggaaacacccccagtcagacttgctgggcctgatccaggtgatgattgtggtcttcggtgatgagccacccgttttttctcggcccataagcgctagttatcctccctatcaggcgaccggacctcctaataccagttacatgccaggcatgcctggaggtatcagtccctatcctagtgggtatccccccaatccctcaggatatccaggctgcccatatcccccaggcggcccatatcccgctactacgtcgagccagtatccatctcaaccccccgtgacaacagtgggtccttcacgcgacggaaccatctccgaagacacaatacgtgcctctctgatttccgctgtgagtgacaaattgagatggcggatgaaagaggagatggatcgagcccaggctgagctgaacgcgctcaaaagaaccgaggaagacctcaagaaaggccaccagaaactggaggagatggttacaagactcgaccaggaggtggcggaggtggataagaatatcgagttgcttaaaaaaaaggatgaggaactgagctctgcattggagaaaatggagaatcagtccgagaataatgatatagatgaggtgataatacccaccgcccctctttataaacagattctcaatctgtacgccgaagagaatgcaattgaagacaccatattttacctaggggaagcactccgcagaggagtcatcgatctagatgtgtttctgaaacacgttcgcctgctgtctcgcaaacagttccagcttcgggctctcatgcagaaggccagaaagactgccggcctgtccgatctgtattag

SEQ ID NO: 139539 - DNA, 858 bp, Artificial Sequence
  Description of Artificial Sequence: Synthetic coding sequence
atggcagtgtcagagtcacagttgaagaagatggtgagcaagccccagtcagacttgctaggccttattcaggtaatgatagtggtcttcggggatgagccgcccgtctttagtcgccccatcagtgctagctatcctccatatcaggcgacgggtcctcctaatacttcatacatgcccggaatgccaggtggaatctccccatacccaagcggctatccacccaaccccagtgggtatcccggctgcccttacccacccggtggaccctatccagccacaacctcctcccaatatccatcacagccacctgtgaccactgtggggcctagcagagacggtaccatctctgaagacacaatccgagcctcacttatatctgctgtgtctgataagcttagatggcgaatgaaggaggaaatggaccgggcacaagctgaattgaacgcactgaaaaggacagaggaagatttgaaaaagggtcatcagaagttagaagagatggttactaggctggatcaggaagtggccgaagtagataaaaatatcgagcttctgaaaaaaaaggatgaggagctctccagcgcgctggagaaaatggaaaaccagtccgagaataatgatatcgatgaagttattatccccaccgctcccctctacaaacagatcttgaatctgtatgccgaagagaacgctatcgaggataccatcttctatttgggagaggcactgagaagaggtgttatagatctagatgtctttctgaagcatgttagactgctctccagaaagcagtttcagctcagagccctcatgcagaaggctagaaagaccgctggtctcagcgatctgtactag

SEQ ID NO: 139540 - DNA, 972 bp, Artificial Sequence
  Description of Artificial Sequence: Synthetic coding sequence
atggcacgtggacccggcctcgctcctccgccgcttaggctgcctctgctgctgttggtgttagctgctgtcacaggccacacagcagcacaggataattgtacctgtcccaccaacaagatgacagtctgctccccagacggtcctggcgggcgatgccagtgtagagccctgggatcggggatggcggtcgattgtagtaccctaaccagcaaatgcctcttgctaaaagcgcggatgagcgcgcctaagaacgcgcgaacactggtccgcccttccgagcacgccctcgtcgacaatgatggcctctacgacccggactgcgatcccgagggccgattcaaggctagacagtgcaaccagacctctgtgtgttggtgtgtaaacagcgtcggtgtgcggcgaaccgacaaaggggatctctctctgcgctgtgacgaactggttcggacacaccacatcttgattgacctgaggcaccgtcccacagctggagctttcaaccactccgacctcgatgcagaactgcgcaggctgtttcgcgagcggtataggctgcaccctaagtttgtggctgccgtgcattatgagcaacccaccatccagattgagttgcgacaaaatacttctcagaaggctgctggtgatgttgacattggtgacgccgcgtactattttgagagagatatcaaaggggaaagcctattccagggcaggggcggtctggatctgagagtgagaggggaaccactgcaagtggagcggacactgatttattatctggacgaaataccccccaaatttagtatgaagcgactgaccgctggccttatcgccgtcatcgtagttgtcgtggttgctctcgtagccggcatggccgtgctcgtcattaccaacagaaggaagtccggaaaatataaaaaagtggagataaaagaactgggtgaacttcggaaagaacccagcttgtag

SEQ ID NO: 139541 - DNA, 1353 bp, Artificial Sequence
  Description of Artificial Sequence: Synthetic coding sequence
atgggcgcccccccaggttatagaccttctgcttgggtacacctactacatcagctgcctcgcgctgattttcagttgcggcctgtgccctcggtgtttgcaccacaggaacaggaataccagcaggccctactgctggttgcagccctggcagggctaggcctgggcctgagcctcatcttcattgcagtatacctgattcgtttttgttgctgcagaccccccgagccaccaggaagcaaaataccgagccctggcggtggttgcgtcacttggtcttgtattgttgcactccttgccggctgtaccggcatagggattgggttctacggcaatagcgaaacctccgatggcgtgtcccagctttcatctgcactactgcacgcaaaccacacgctttcaactatcgatcatctggttctggaaactgttgagcgcttgggagaagcagtgaggacagagctgaccacactcgaggaggtcctcgaaccccgaacagaactcgtggccgctgcccgcggggcccgacgccaggcagaagccgcagcccagcagttacaagggcttgcattttggcagggggtccctctgtcacctctgcaggtggccgagaatgtgagttttgtggaagagtaccgctggttagcttacgtgctgttgctcctgctggaactgctggtgtgcctgttcactcttctggggttagcgaagcaaagcaaatggctcgtgatcgtaatgaccgttatgtccttgttggtcctcgtgctgtcatggggatctatgggactggaggccgctactgcagtggggctgtccgatttctgcagcaaccccgacccctacgtgttgaacctgacacaagaagagacaggcctatcctccgatattctgtcttactatctcctgtgcaacagagctgtgtccaacccgtttcagcagaggctgacactctcccagagggccctcgcaaacattcacagtcagctgttaggactggagcgtgaagccgtgccacagtttccatctgcccaaaagcctctcctctcacttgaagagaccctgaatgttactgaagggaattttcaccagttagtggctttactccattgcagaagcctgcacaaggactacggcgccgccttaagggggctgtgcgaggatgcattagagggtttgctgtttttgctactgtttagcttgctgagtgccggggcgctggccacagccctgtgttctttaccaagagcgtgggccctgtttcccccttcagatgactatgacgatacagacgatgacgatccatttaatccacaggaatcaaaacgttttgttcagtggcaaagcagcatttag

SEQ ID NO: 139542 - DNA, 1383 bp, Artificial Sequence
  Description of Artificial Sequence: Synthetic coding sequence
atgggcgccccccctgggtaccgcccatccgcgtgggtgcacttgctccaccagctcccgcgggccgactttcagctgcggccagtaccttccgtgtttgcacctcaggaacaggagtatcagcaagctcttctcctggtggccgcactagctggtctcggccttggtttatctctcattttcatcgcagtttacctcatccgtttctgctgttgcaggccccctgagccgccaggtagtaaaattccctctcctggcggcgggtgtgtcacctggagctgcattgtggccttgctagccgggtgcaccggaattgggattggattttatggcaacagcgaaacttctgatggagtctctcaactgtcttctgctctcctgcacgcaaaccatacattaagcacaatcgaccacctcgtactggagacagtggagagacttggggaagctgtccgtacggaactcacgaccctcgaggaagtcctagagccccgcaccgagttagtggcggccgcccgcggagccagacgccaggctgaagcagccgcacagcagctgcaggggctcgctttctggcagggcgtgcccctgtctccactccaagtggccgaaaacgtatctttcgtggaggagtataggtggcttgcatacgtgctcctacttcttcttgaactcctggtgtgtctgtttacattactggggcttgctaagcagtccaaatggctcgtgatcgtaatgaccgttatgagtctccttgtgctagtcctcagctggggaagcatgggactggaggctgcaaccgccgtcggactgagcgacttttgtagtaaccccgacccctatgtgctaaacctcacacaggaagagaccggcctgagctccgacattttgtcttattatcttctgtgtaatagggccgtgtccaatccattccagcagcgcctcacactctcgcaacgcgccttggctaatatccattcccaactcctggggctcgagagagaggccgtcccccagttcccttctgcccagaaacctcttctctccctagaggaaactcttaatgtcactgagggcaatttccaccagctggtagcgctgttacactgccggtcactgcacaaagattacggagccgcactgcgcgggctgtgtgaagatgcccttgaaggtctgctgttccttttgctcttctctctgttgagcgcaggcgccttagccacagctctttgctccttgccccgcgcatgggcactgtttccacctaggaaccccagtgctctgtgcagtggttcgcgcctgtctgagcccctgttgccagctgggcttgaaccagggtcacccttgagaagctttcccgggtgcagaagaaggccccactag

SEQ ID NO: 139543 - DNA, 1362 bp, Artificial Sequence
  Description of Artificial Sequence: Synthetic coding sequence
atgggtgctccgcccggctatcgaccatcggcatgggtgcatctgcttcaccagctgccaagggccgatttccagcttagacccgtcccttctgtctttgccccccaggaacaagaataccaacaagaccagagcagcttagctgtcactcaacgacccccccctacgacccctttacataggctgaggccgcggccacggttaacccccgcactagcccggcggccccccgaggctgctagaggcgatcctagaccgcagagcccacctgaggcattactactggtggcggcgctcgcggggctgggactgggactctctctcattttcattgcagtgtatctaatccgcttttgctgttgcaggccccctgaacctcccggctcaaaaatccccagtcctggcgggggatgcgtaacttggtcttgtatcgtggcccttctggctggctgtactggtataggcattggcttttacggaaattccgaaactagcgacggcgtgtcacaacttagcagcgcgctactccacgccaaccacaccctgagcacgatcgatcaccttgttttggaaacggtggaacgacttggagaagccgtgaggaccgagctcacaacactcgaggaagtgttagaaccgaggacggagttggtggcagctgccaggggagcccgacggcaggccgaggcagcagcgcagcagctgcaaggcctcgctttctggcaaggcgttcctctttcaccactacaagtagcagagaatgtgtctttcgtcgaggagtaccgctggctagcttatgtcctgctgctgctgctagagctgctcgtgtgcctatttaccctgctggggttagccaaacagtctaaatggctggtcattgtgatgacagtcatgagccttttggtgctcgtgcttagctggggatctatggggctggaagctgccaccgccgtcggtctgagtgacttctgttcgaatccagatccttacgtcttaaatttaacccaggaggaaacaggcctgtccagcgaagccgattccgtgcctgcgtcaagtgggcagcacccacttccagccgccgggccgggggctagatcttgtgcatctgtccctttctctgcggaggcctcagcagtgctcggaggtgactctgaatgtgatagacgcaagtttccacccgtagggggcaccgccaccttaccgcagccagcccaaggcctctggtgttcacctgcagggcctgtgcgcagaagacctggtcgcccagcactccctgctacactcttgccagctgtctgccggagtgccggacattgccccttgcaacctgcgccctcccttggaccacttcccacacagtag

SEQ ID NO: 139544 - DNA, 1356 bp, Artificial Sequence
  Description of Artificial Sequence: Synthetic coding sequence
atgggggctccacccggatatagacccagtgcttgggtgcaccttctacatcagctgcccagggccgactttcaactccgcccggtccctagcgtgttcgccccccaggagcaggagtaccaacaggcactactgttggttgctgctctggctggcctgggcttggggctctctcttattttcattgctgtttacctgataaggttttgttgttgtcggcctcccgaacctcccggtagcaaaatcccctcccccggtggggggtgtgtgacatggtcatgcattgtcgccctgcttgccggctgtacaggcatcggtatcggcttctacggtaactctgagacaagcgatggtgtatcccagctgagctccgcactgctgcatgcaaaccacaccctgtctacaattgaccatctcgtactcgagacagtcgaacggctgggcgaggcagttcggactgagctgactacactggaggaagtgctcgaacccaggacagagctcgttgccgccgctcgaggcgcccgcagacaggcagaggcagcagcgcagcaattgcaggggctggcgttttggcagggcgtcccactgtccccactccaagtggccgagaatgtgagcttcgtcgaagagtataggtggttggcatatgtgctcctcttgctccttgagctgttggtgtgtctgtttacactattaggattggccaagcagtccaaatggttggtgatcgttatgactgttatgagcctcctcgtcttagtgctcagttggggctcaatgggcttggaagccgcaaccgctgtgggactatctgacttctgttctaatcccgatccatacgttctcaacctcactcaagaggagaccggactatcttctgatattctttcgtattatctattatgtaatcgggctgttagcaaccccttccaacagcgattgaccctatctcaacgggctctggccaatatccactcccagctactgggtcttgagcgggaagctgtgccacagttccctagtgctcagaagccattattgagccttgaggagacgctgaatgtcacggaggggaacttccaccaactggtggcactcctccactgccgtagtctccataaggattacggcgctgcgttgcgcggcctgtgtgaggatgcgttagaagggttgctgttcctgctgttgttcagtctcttaagtgctggcgctctcgcaaccgcactgtgctctttaccgagggcctgggccctattccccccatctgacgattatgacgatactgatgatgacgaccccttcaatcctcagcaggagtcaaaaaggttcgtccagtggcagtcaagcatatag

SEQ ID NO: 139545 - DNA, 1155 bp, Artificial Sequence
  Description of Artificial Sequence: Synthetic coding sequence
atgacccgacgcgggcgccggaggtcttcacattttctgggtccgccagccggcgctgctggctgcacccagcggcggagtcgcgagcttgccgctgcagctatgagccaccagactgggatccaggcgtctgaagacgttaaggagatttttgcacgagctcgtaatggaaagtaccggctgctgaagatctccattgagaacgagcaactcgttatcggctcatacagccagcctagcgatagctgggacaaggattatgatagcttcgtgcttccacttttagaggataaacagccgtgctatatcctatttcgcttggatagtcagaacgcacagggttacgagtggatttttatcgcctggtccccggaccatagtcatgtgcggcaaaagatgctctatgccgctacccgagccacattgaagaaggagttcggtggtggccacatcaaagatgaagtgttcggtactgttaaagaagacgtcagtctacatggctacaagaaatacctacttagtcagtcttctcctgcgccacttaccgccgcagaagaggaactgcggcagattaaaatcaacgaagtgcagaccgacgtcggagtagataccaagcatcagactctgcaaggggtggctttccctatctcccgggaagcctttcaggcactggaaaaacttaacaatcgccagctcaattacgttcagctggagatcgatattaagaacgagatcattattctggccaacaccacaaacactgagttaaaagatttgccaaagcggattcccaaagacagtgcacgctaccacttctttctgtacaaacactctcatgagggagactatctggaatctatcgttttcatatattccatgcccggctatacttgttcgatcagggagcggatgctgtatagtagttgcaaatctagattgctggagattgttgagagacagcttcagatggacgttatcaggaaaattgaaatcgataatggtgatgaacttacagctgacttcctctacgaagaagttcaccccaagcaacacgcccacaagcaatccttcgctaaacccaaggggccagcgggcaagagaggaattcgaaggttgattcgtggtcccgccgaaacagaggccactaccgactag

SEQ ID NO: 139546 - DNA, 1053 bp, Artificial Sequence
  Description of Artificial Sequence: Synthetic coding sequence
atgtctcaccagacagggattcaggcatccgaggacgtgaaggagatctttgcccgagcacgtaacgggaaataccgtttgctgaagatttccatcgaaaacgagcagttggtaatcggatcttactcccaacctagcgacagttgggacaaagattacgactctttcgtgctgcctctgttagaggacaagcagccctgctatatcctcttccggctcgatagccagaatgcccagggttatgaatggatcttcatcgcctggtctcctgaccacagccacgttagacagaaaatgctgtacgccgctacccgcgccacccttaaaaaagaattcggcggcggacacatcaaggatgaggtcttcgggacagtcaaagaggacgtgtcgctgcatgggtacaagaagtacctgttgtcacaatccagtcccgctcccctgactgccgcggaggaggagctgagacaaatcaaaatcaacgaggttcagacggacgtcggggtcgacaccaagcaccagacattgcagggcgtggcttttcccattagtagggaagcctttcaggcactggagaaactgaataatcgccagctgaattatgtccaactcgaaatcgacattaagaatgaaataatcattctggcaaataccaccaacactgaattgaaggacctgccaaaaagaatcccaaaagactctgctagatatcatttcttcctgtacaagcactcgcacgaaggcgactacctggaatccattgtcttcatatattccatgcctgggtatacttgttccatcagggagcgaatgttgtattcaagttgcaaatcccggcttctcgaaattgtggagaggcagctgcagatggacgtaatccggaaaattgagatagataatggcgacgagctcacagctgattttctctatgaggaggtccaccccaaacagcacgcccataagcagagtttcgccaagccgaaaggtccggctgggaaacgaggaatccgacggctcattcgtggacccgccgaaaccgaggcaacgacggattag

SEQ ID NO: 139547 - DNA, 1074 bp, Artificial Sequence
  Description of Artificial Sequence: Synthetic coding sequence
atgtcccatcagacaggcatacaggcttccgaagacgtaaaagagatctttgctcgggccagaaatggcaagtaccgcctgctgaagatctcgattgagaacgaacagcttgtgatcggctcatattcacagcccagcgacagctgggataaagactacgacagttttgtgttgcctctactggaggataaacaaccctgctacattttatttcgcttggacagtcaaaatgcccaaggctacgaatggatttttatcgcgtggtcccccgaccattcccacgtcaggcagaaaatgctgtacgctgcaacacgggccaccctgaagaaggagttcggaggaggccacatcaaggatgaggtgtttgggacagttaaggaagacgtttccctgcatggctataagaagtacttattgtcgcagtcctctccagctccactaactgctgcggaagaggaactcaggcagataaagattaacgaatcaccagaggatcacatcggcgttcagacggacgtgggagtggataccaagcaccaaactctgcagggggtggcgttcccaatcagtcgagaagccttccaggccttggagaagctgaataacagacagctgaactatgtgcaacttgaaattgatataaaaaatgaaattattatcctcgcaaatactacaaatacagagcttaaggacctgccaaagagaatcccgaaggactcagcccgatatcacttctttctgtacaagcactctcacgagggggactatctggagtcaattgtgtttatttacagcatgccgggttacacatgttctatccgcgagagaatgctctactcttcctgcaagtcaagactcctcgaaatagtggagcgacagctacagatggacgtaatacgtaaaatcgaaatcgacaatggagacgagcttaccgctgacttcctgtacgaagaagtacatccaaagcagcacgcacataaacagagtttcgccaaacctaaaggcccagctggcaagcggggtatcagaagattaattcgaggccccgctgaaaccgaggcaactacagactag

SEQ ID NO: 139548 - DNA, 1050 bp, Artificial Sequence
  Description of Artificial Sequence: Synthetic coding sequence
atggcccaccaaactggcatacatgccaccgaggagctcaaggagttttttgcaaaagcgcgcgcaggctccgtgcggctgatcaaggtggtgatcgaggacgagcagttggtcctgggggcttcacaagaacccgtaggcagatgggaccaagactacgacagagccgtcctgcccctgttggatgcacagcagccctgctacctgctgtaccggttagactctcaaaacgcgcagggctttgaatggctctttctggcctggagccctgataacagcccagtccgtctgaaaatgctctacgcagcgacaagagccactgttaaaaaggaattcggtggcgggcatatcaaggatgagctcttcggtactgtgaaagacgatttgagctttgctggttatcagaaacacctgtcctcatgcgctgctccagcccctctcacttccgcggaacgagaactgcagcagattcgcatcaacgaagttaaaaccgagatttcggtggagtctaagcaccagaccttgcaaggtttggcatttccattacagcctgaagcccagcgggctctgcaacaactgaagcagaaaatggtcaattacatccaaatgaagctcgatctcgaaagagaaacaattgaacttgttcacacagagcccaccgacgtagcccagctaccaagtcgcgtgccaagggatgcagcacggtaccactttttcctctataagcatacccacgagggggacccgttagagtctgtggtgtttatttactctatgcccgggtacaagtgttcaattaaggagaggatgctctacagtagctgcaagtctcgactcctcgattctgtggagcaggacttccatttggaaatcgcgaagaaaattgagatcggagatggcgcagaactaaccgccgaatttctgtatgatgaggttcacccgaagcagcacgctttcaagcaggcttttgcaaagcccaaaggtcccggcggtaagcgaggacacaagagattaatcagaggacctggcgaaaatggagatgattcgtag

SEQ ID NO: 139549 - DNA, 483 bp, Artificial Sequence
  Description of Artificial Sequence: Synthetic coding sequence
atggaggagggatcaagttcccctgtgagccccgttgactctcttggcacgagtgaagaggagttggaaagacagcctaagaggtttggacgcaagaggcgatacagcaaaaagtcttcggaggacgggagcccaacccctggcaaacgcggcaagaaggggtctccatcggctcagagtttcgaggaactgcaatcacagaggatcttagcgaatgtgagagagagacaacggacccagtctctgaatgaggccttcgcagccctccgtaagatcatcccaaccttgcctagtgataaactaagcaagatccagacgttaaaactggcagccagatacatagatttcctgtatcaggtgttgcagtccgacgaaatggacaacaagatgacctcatgctcgtacgtggctcatgagcggttgagctacgctttcagcgtctggaggatggaaggagcatggtccatgtctgccagccattag

SEQ ID NO: 139550 - DNA, 1476 bp, Artificial Sequence
  Description of Artificial Sequence: Synthetic coding sequence
atgaaccccgcagctgaggctgaattcaacatcctgctcgccaccgatagctataaggtcactcattacaagcaatatccccccaacacttcgaaagtgtactcttattttgaatgccgggagaaaaaaaccgagaactcaaaattgcgcaaggtgaagtatgaggaaacagttttctacggattgcagtatatcctcaataaatacttgaaggggaaggtggtaactaaagaaaaaatccaagaggcaaaagacgtgtacaaggaacacttccaggatgatgtgtttaacgaaaagggttggaattacatccttgaaaaatacgacggtcatttgccgatcgagatcaaggccgtgcccgagggcttcgtaatcccgagagggaacgtactctttaccgtcgaaaatacagatcccgaatgctactggctgactaattggatcgaaaccatactcgtacagtcatggtaccccattactgtggccacaaattcccgggagcaaaaaaagatcctcgccaaatacctcctggagacgagcggcaacctggacggcttggaatataaactgcatgacttcgggtatcgaggggtctcgagccaggagactgcggggatcggagccagcgcacacctcgtaaacttcaagggcactgacacggtggccggtctggccttaattaaaaaatactatgggactaaggaccccgtgcctggttactcagtacccgccgcagagcatagcaccattaccgcatgggggaaagatcacgaaaaggacgcattcgaacatatcgtgacccagttctcaagcgtccctgtgtctgttgtttcagattcctatgatatatataatgcgtgcgaaaagatttggggggaggatttgcggcatctcatcgtctccagaagcacccaggcccctctcatcatcagacccgactccggcaatcctctcgatactgtgttgaaagttctggagatactcgggaaaaagtttccagttacagagaacagcaagggctataagctcctgccgccgtacctcagagtaatccagggagacggagtcgacatcaacaccctccaggagattgtcgagggtatgaagcagaagatgtggtcaatcgagaatatcgcattcggttcaggtggtggcctcctccaaaaactgacacgcgatcttcttaactgcagtttcaagtgcagttatgttgtgaccaatggacttggcatcaatgtgttcaaggatcccgtggctgacccaaataaacgaagcaaaaaaggaagactgtcgctgcatagaaccccagccggtaacttcgtaacactggaagagggtaagggggacctcgaagagtatggccaggaccttctccacacagtgtttaagaacgggaaagtcaccaaatcctatagtttcgacgaaattaggaaaaacgctcagcttaatattgaacttgaagcagcccatcactag

SEQ ID NO: 139551 - DNA, 672 bp, Artificial Sequence
  Description of Artificial Sequence: Synthetic coding sequence
atgaagctacattacgtggctgtactcacactggccatcctcatgttcctgacttggctgcccgaaagcttgtcttgtaataaagctctgtgcgcaagcgatgtgtccaagtgcctgatccaggagctgtgtcagtgcaggcctggtgagggaaattgctcttgttgcaaagagtgtatgctctgtctcggtgctctctgggatgagtgctgcgattgcgtcggcatgtgcaacccacgcaactattcagatacaccgccaactagcaaatccacggtcgaggaactgcatgaacccatcccatcattgtttagggctctaacggaaggcgatacgcagttaaattggaacatcgtctcctttcccgttgcagaagaactgtctcaccatgagaacctggtatccttcctggaaacggtaaaccagccccaccaccagaacgttagcgtcccaagtaacaatgtccatgccccttatagctccgacaaggaacatatgtgtaccgtggtatacttcgatgactgtatgtctatccatcagtgtaaaatctcttgcgaatctatgggtgcttcaaagtatcggtggttccacaatgcatgctgcgaatgcatcggacccgagtgcattgattatggcagcaagaccgtcaaatgcatgaactgcatgttctag

SEQ ID NO: 139552 - DNA, 2451 bp, Artificial Sequence
  Description of Artificial Sequence: Synthetic coding sequence
atggccgtctcactagacgacgatgtacctctgatccttactctcgacgaaggaggttctgctcctcttgcccccagtaacggactgggccaggaggaactgccctcaaagaatggagggagttatgccattcacgattcccaggccccatccctgagtagcggaggcgagagctcgccatctagccccgcacataattgggaaatgaactaccaggaagccgccatttacttgcaggaaggtgaaaataatgataaattcttcacacacccgaaggacgccaaggcactggccgcatacttattcgctcataaccatctattctacttaatggaactggccacagcgctgcttctgttacttttgtcactgtgcgaggcgcctgcagttccggctctgcgactgggaatttacgtgcatgctactttagaactttttgccctgatggtcgttgttttcgagctctgcatgaaactgagatggcttggtctacatacgtttatccgccataaaaggactatggtcaaaacttcagtgctcgtggtgcagttcgtagaggccatcgtagtattagtccgccagatgagtcacgtccgggttacgagagccctccggtgtatctttctggttgattgtagatactgtggaggcgtgagacgcaatctccgacaaattttccagtctcttccgccctttatggatattttactcctcctcctgttcttcatgataatatttgctatcctcggcttttatctgttctctccgaaccctagcgatccctatttctcaaccctggagaattccattgtttcattatttgtgctgctgacaacagccaattttcctgatgtgatgatgcccagttactcacggaacccatggtcatgtgtcttcttcatcgtctatttgtccatagagctctatttcatcatgaacctgttgctggcggttgttttcgatacttttaacgatattgaaaaacgtaaatttaagagcttattattacataaaaggactgcaattcaacatgcctaccggttgctgatttcgcaacgacgcccggcgggcatctcgtataggcagttcgagggactcatgcgcttttacaagcctcgcatgagcgcacgggagagatacctgaccttcaaggccctaaatcaaaacaacacacctctcctgagtctcaaagacttctacgatatctacgaagttgccgccctgaagtggaaggcaaagaagaaccgagagcattggttcgatgaactgccccgcaccgcgttacttatttttaaaggcatcaacattcttgtgaaaagcaaagcatttcagtattttatgtaccttgtcgtagccgtaaatggcgtttggatcctcgtggaaacctttatgctcaagggcggtaatttcttttctaagcatgtgccttggtcttatctggtgtttctcacgatttacggggtggagctcttccttaaggttgccggtctgggtcctgtagaatatctttcatccggctggaacctgtttgacttctctgtgacagtgtttgccttcctcggcctgcttgccctggctctgaatatggagccgttttacttcattgtggtgcttagaccgctgcaacttctgcggctctttaagctcaaagaaaggtacagaaatgtgctagacaccatgttcgagctacttccgcgtatggctagcctcggactcacacttttaatcttctattactccttcgctattgtggggatggaattcttttgtggtatagtttttcccaactgttgcaatacgagtaccgtggccgacgcctacaggtggcggaatcatactgtcggaaatcggactgttgtggaagagggctattactacctgaacaattttgataacattctcaatagcttcgtgacgttatttgagttaacagtcgtaaataactggtacatcatcatggagggtgtgacctcccagacctctcactggagtcggttgtatttcatgacattttatatcgtcacaatggtcgttatgaccattatagtggcatttatactggaagcatttgtgttccgaatgaactatagtcggaagaatcaggactcggaggtggatggaggcattacactcgaaaaggagatcagtaaagaggaactcgtcgctgtattggagctgtacagagaagcaaggggcgcaagctctgacgtcaccaggctgctggagaccctcagccagatggagagatatcaacagcactctatggtgttcctgggcaggcggtctcggaccaaatctgacctcagcctcaagatgtaccaggaggagattcaggaatggtacgaggaacacgccagagagcaggagcagcagcgccaactctcaagctccgccgcccctgccgcgcagcaaccacccggttcaagacagcgctctcagactgtgacatag

SEQ ID NO: 139553 - DNA, 2247 bp, Artificial Sequence
  Description of Artificial Sequence: Synthetic coding sequence
atgaactaccaggaagccgctatctatctccaggaaggtgagaacaatgacaagtttttcactcaccctaaggacgcgaaggctttggccgcctacctgtttgcacacaaccacctgttctatctgatggagctcgcaacagccctcctgttactgctgctgtcactgtgtgaagcccccgcagtaccagcgctgcgtctgggaatctatgtccacgcgacccttgagcttttcgctctgatggtagtggtgttcgaactctgtatgaagctgcggtggctgggcctccacaccttcatcaggcataaacgaactatggttaagacttcagtgctggttgtccagttcgtggaggctattgtcgtcctggttcgccaaatgagccatgtcagggtgacccgggccctgaggtgtatttttctcgtagactgcagatattgcggaggtgtgcgaagaaatctgaggcagattttccagagcctgcccccctttatggatatcctcctgctgctactcttttttatgatcatcttcgctattctcggcttttatctgttttcaccaaatccaagtgatccctacttctccaccctagagaattctattgtctctctattcgtcctgctcacgaccgccaattttccggacgtgatgatgccctcgtacagcaggaacccgtggagttgtgtgtttttcatcgtctacctttctatcgaactatactttatcatgaacctccttttggctgtcgtgttcgacacctttaacgacatagagaaaagaaagttcaagtccctgctcctgcataagcgcacggctatccagcatgcttatcggcttctcatcagccagcgcagacctgccgggatctcttatagacagttcgaaggtttaatgcgtttttacaagcctcggatgagcgcccgcgagcggtatcttacattcaaggctctgaaccaaaacaacacacctctgctgtctttgaaggacttctacgatatttacgaagtggccgcgcttaagtggaaagccaaaaaaaacagggagcactggttcgacgagctaccccggactgcactcctgatttttaaaggcatcaacatactggtgaaatccaaggccttccaatatttcatgtatctggtggtggcagttaatggtgtttggatcctggttgagacctttatgctgaaaggcggtaacttcttcagtaaacacgtgccgtggtcttatctcgtattcttaacgatttacggggtggagctattcctcaaggtcgctggactgggtccagtcgagtatctcagttcagggtggaacttgtttgatttctctgtcacggtctttgcgttcctcggactgctggctctggccctgaacatggaacccttctacttcatcgtcgtcttaagacccctccagctgctgagactgttcaagctgaaagagagatacagaaacgtcctggacacaatgtttgagctgctcccccggatggcctcactgggactaaccctgctgattttctattactcctttgcgattgtcggtatggaattcttctgtgggatcgtgtttcctaattgctgtaacacctccacagttgccgacgcctacagatggaggaatcataccgtggggaatcggaccgtagtggaggaaggatactattacctgaataacttcgacaatatactgaacagtttcgtgacattgtttgaactgactgtggtgaacaactggtatataattatggagggcgttacatcccagacatcccactggagtcgactctacttcatgaccttttacatcgtcacaatggttgtgatgacaatcatcgtggcgtttatattggaggcctttgtgttccggatgaactactcaaggaagaatcaggactctgaggtcgacggaggaattaccctcgagaaagagattagtaaagaggagctcgttgctgtgctcgagttatatcgcgaagcgcgcggggcctcttctgacgtcacacggctcctggagacactgagtcagatggaaaggtaccaacagcacagtatggtcttcctggggcggaggagcagaactaagtctgacctgagtctcaagatgtaccaggaggagattcaagagtggtatgaggaacacgcacgggaacaggaacagcagagacagctaagtagcagtgctgcacctgctgcgcagcagcccccaggatcacggcaacgttctcagacggtgacctag

SEQ ID NO: 139554 - DNA, 2667 bp, Artificial Sequence
  Description of Artificial Sequence: Synthetic coding sequence
atggagtcctgctacatcgcgcaggccggcctggagctgcttgggtcatccagcagtcccacattaactagccagagcgccgaaatcacagaggacgcatccaacggaggcgtcagcgagcagcatccatggccttcaggcttcgaaagggagcttaaacctgagacaattagttctcctggatatcatatactgcgggccaccggtgaagagaacatggctgtcagcctggatgatgatgttcctctgattctgactttagatgagggtgggtctgctccactggctccatccaatgggctaggccaggaagaattgccctctaaaaatggcggcagttacgctatccacgactcccaggctccatcactatcttcaggaggggagtctagtccgagttcccctgcacacaattgggaaatgaactatcaagaagcggccatttatcttcaagagggcgagaataacgacaagttctttacccaccccaaagatgctaaagctctggccgcctacctgttcgcgcacaaccatctgttctaccttatggaactcgctaccgcactgctgttgttgttgctcagcctctgtgaggcacccgcagttcccgccctcagactgggtatatacgtgcacgcgacactagagctgtttgctcttatggttgtcgtgtttgagctctgcatgaaactgagatggctgggactgcacacgtttattcgtcacaagcggacaatggttaagacctctgtcctggttgtgcagttcgtcgaggccatcgttgtgctggttagacaaatgagtcacgtccgggtgactagagccctccgatgcattttcttggtcgattgccggtattgcggcggtgttaggagaaatctgcgtcagatctttcagtccttgccaccgttcatggacattttactcctcctcctcttctttatgataatctttgccatactaggcttctacttgttcagccctaatccctccgacccatatttctctactttagaaaattcaatcgtcagcctgtttgtgttactcaccaccgcaaacttcccagacgttatgatgccttcctactctagaaacccctggtcatgtgtctttttcattgtatacctgtctatagagctgtattttattatgaacctgctgctggctgtggtgttcgacacattcaacgatattgagaaacgcaagtttaaatccctcctccttcacaaacgaaccgccattcaacatgcttatcggctactcataagccagaggaggcctgcaggtataagttatcgccaattcgagggcctaatgcgcttctacaaaccacgcatgtccgcaagggaaagatacttgaccttcaaggccctcaatcagaataacaccccattactctccctgaaggatttctacgatatttacgaggtcgcagccctcaagtggaaggcaaagaagaaccgggagcactggttcgacgagcttcctcggacagccttgctgatatttaaagggatcaacatactggtgaagtctaaggccttccagtacttcatgtacttagtggttgctgtgaatggggtctggatccttgtcgagacctttatgctcaaaggcggaaatttcttttccaagcacgtgccttggtcctacctggttttcctaacaatttacggagttgaattatttttaaaagtggcaggtctgggccctgtcgaatatttgtccagtgggtggaatttatttgatttctcagtcaccgtttttgccttcttgggactgttggccctggctctgaatatggagccgttttatttcatcgtggtcctgcgtcctctgcagttactgcgcctgttcaaacttaaggagaggtacaggaacgtgctggatactatgttcgagctcctgcccagaatggcaagcctgggcctcactctgttaattttctactactcctttgcaatcgtcggtatggagttcttttgtggcattgtttttccgaactgttgcaatacaagtaccgtggctgacgcttacagatggcggaaccacaccgtgggaaatcgcacagtcgtggaggaaggatattactacctaaataatttcgataatattctgaacagtttcgtgacactgttcgagctgactgtggtcaacaactggtacatcatcatggagggggtgacatcccagacgagccactggtcgcggttgtattttatgaccttttacattgtgacgatggtggtgatgactatcatcgtagcttttatccttgaggcatttgtgttccgcatgaattatagcagaaaaaaccaggactctgaagttgatggcggtataactctggagaaagaaatttcaaaggaggagcttgtggccgttctggagctctatcgtgaggctagaggtgcctccagcgatgtgactaggctgctggagactctatctcaaatggagagatatcagcagcactcaatggtgtttctggggcgacgctcccgcaccaagagcgacctgagcctcaaaatgtaccaggaggagatacaggaatggtatgaagaacatgcgagggagcaggagcagcaaagacagttgtcctcaagcgccgctccagcagctcaacagcctcccgggtcacgccagcgtagccagacagtaacctag

SEQ ID NO: 139555 - DNA, 2667 bp, Artificial Sequence
  Description of Artificial Sequence: Synthetic coding sequence
atggagtcttgctatattgctcaagctggactggaactcctgggatctagctcaagtcctacattgacctcccagtcagcagaaataaccgaggacgcctccaacggaggagtgtctgaacaacacccatggccgtccgggttcgagcgagaattgaagccagagactatcagcagcccggggtaccacatcctgagggccactggagaggagaatatggccgtttctctagacgatgatgtcccactgatcctgacactcgacgaagggggttctgcccctctggccccatctaatggcctaggccaagaggagctacccagcaagaacggcggctcctacgcgattcacgatagccaggcaccaagtttatcttcgggtggcgaaagttctccttcatcacctgcgcacaattgggaaatgaattatcaagaagccgctatatacctgcaggagggggagaataacgacaagtttttcacacatcctaaagacgccaaagcgcttgccgcgtatctgtttgcgcataatcatctattttacctgatggagctcgcaaccgctctgctgctgctcctgttaagtctctgcgaagcgcctgctgttccagcgctgcgcctcggcatatatgttcatgccactctcgaactcttcgccttgatggtggtggtcttcgagctctgcatgaaacttaggtggctcggactccataccttcatccgccacaagagaaccatggtgaagacgtcagttctcgtggtgcagttcgtggaagcaattgttgtgctggtgcgtcaaatgtcacatgtgagagtgacccgggcactgcgttgcatcttcctggtggactgcaggtattgcggcggagtcaggagaaatctgcggcaaatcttccagtcactgcctccattcatggacatccttctgctccttctcttcttcatgataatctttgccatactagggttttatctattttctcctaacccttccgatccatacttttctactctggagaactcaatcgtgagcttattcgtgcttctgacaaccgcaaacttccccgacgtcatgatgcccagctacagtaggaacccttggtcttgcgtattctttatcgtgtatctcagtatcgagttatattttatcatgaacttgctgctcgctgtggtctttgataccttcaacgacattgaaaagcggaagtttaaatcactgttgcttcataagagaactgccatccagcacgcctaccggcttttgataagccaacggcgccctgccggaatctcctatcgtcagtttgagggacttatgagattctacaagccacggatgtctgccagggagcgctatcttactttcaaggctctgaatcagaacaacaccccccttctctccttaaaagacttctacgatatttatgaggtcgcagcactgaagtggaaggccaagaaaaacagggaacattggttcgatgagctgcccagaaccgctttgcttatcttcaaagggataaatatcttagtcaagtccaaagccttccagtattttatgtatctggttgtcgccgtcaatggggtatggatcttagttgagacatttatgttgaagggaggcaactttttcagcaaacatgttccttggtcttacctcgtcttcctcaccatctacggggttgagctgtttctgaaagtcgcgggcctgggcccagtcgaatacttaagcagcgggtggaatctgttcgatttctctgtgaccgtgttcgccttcctggggctgcttgcactcgcattaaatatggagccattttacttcatcgtggtactccgcccactccaactgcttaggctgtttaagctgaaagagaggtataggaacgtcttggacacgatgtttgagttactgccacggatggctagtctaggcctaacgcttttgatcttttactactctttcgccatcgttggcatggagtttttctgtggaatagtatttcctaattgctgcaacacaagcaccgtggccgatgcttatcgatggagaaaccatacggtcggcaatcgtaccgtcgtggaggaggggtattattatttaaataactttgataacatcctgaactcatttgtgaccttattcgaactcacagtggtgaacaactggtatatcataatggaaggcgtgaccagccagacgagccattggtcccggctgtactttatgaccttttacatcgtgacgatggtggtgatgaccataatcgtcgctttcatactggaagccttcgtgtttaggatgaattactcgcgcaagaaccaggattccgaggtggatggaggcatcaccctcgaaaaggaaatctcaaaagaagagctggtggcggttctggagttgtaccgggaagcccgcggagcctcaagcgatgtaacacgtctgctggagacactgtctcagatggaacgctaccagcaacactctatggtcttcctgggacgtcggtcccgcacaaaatcggacctgagtctgaagatgtatcaggaggaaatccaggaatggtatgaagaacacgctagggagcaggagcagcagcgtcaattgtcaagttccgcggcaccggccgcacagcagcctcccgggagcagacagaggtcccaaaccgtcacttag

SEQ ID NO: 139556 - DNA, 258 bp, Artificial Sequence
  Description of Artificial Sequence: Synthetic coding sequence
atggctgtctccttggacgatgatgtcccactgattctgacactcgatgagggggggtccgccccgttggccccttctaatggattgggccaagaggaactcccatcaaaaaacggggggtcctacgcaatccatgattcacaggccccaagtctgtcaagcggcggggagtccagcccctctagccccgcccataactgggagatgaactaccaggaagctgctatttaccttcaggagggtgaaaataatgattag

SEQ ID NO: 139557 - DNA, 303 bp, Artificial Sequence
  Description of Artificial Sequence: Synthetic coding sequence
atggccgtgagcctcgatgacgatgtgccactgatacttactcttgacgaagggggaagtgcgcccttggccccctcaaatggcctgggccaggaagagctgccatctaaaaggcggtgctgtatgctgtgttctagcaaacagaaaccatggatcccgtgtagagtgatctctgatgtcgcatgtaaggccgcttcgtgttttgaaggagctagcggaccctgcgacatttccatgtgggagtgttacagggtctgcaagcaaatggctgctgcgatgcccagcaccacaccaaggccatag

SEQ ID NO: 139558 - DNA, 2259 bp, Artificial Sequence
  Description of Artificial Sequence: Synthetic coding sequence
atggctgaaccccaggctgaatctgaaccactgctcggcggcgccagggggggcgggggagactggccagccggtctaacaacttatcgatcaatacaggtgggtccaggcgctgcagcacgctgggatctgtgcatagatcaggccgtagtcttcatcgaggatgccattcaatataggtctattaatcacagagtggacgcgtcgtctatgtggttgtacagaaggtactacagtaatgtctgccagagaacactgtccttcactattttcttgatcttgtttttggctttcattgagacaccatcatccctgacaagtaccgcagatgttaggtaccgggccgctccttgggaacctccctgtggcctaactgaatctgtggaagtcttgtgtctactcgtctttgcagccgacttgagcgtcaaagggtatctgttcgggtgggcccattttcagaagaatctgtggctcctgggatacctcgtcgtgcttgtggtgagcctggtggactggaccgtttccctttctcttgtttgtcatgagcccctgcgcatccggcggttactgcgccctttctttctcttacagaactccagcatgatgaaaaagacactgaagtgcatacgatggtccctccccgaaatggcctccgtcggtctgttgctggctatacatctgtgtctgtttaccatgttcggcatgctcctgttcgccgggggaaaacaggacgacggacaggaccgcgagcggcttacctactttcaaaatcttcccgaatctttaacaagcctgctcgtactcctcaccaccgccaataatcccgatgtgatgatcccagcttactccaaaaaccgcgcttacgctattttctttatcgtgttcacagtgataggaagtctgttcctaatgaaccttttgacagccatcatttactctcagtttcgtgggtatctcatgaagtcccttcagacaagtcttttccgcaggaggctaggtactcgggctgcgttcgaagtattgtcatccatggtcggggagggcggtgccttcccccaggccgtgggggtgaaaccacagaaccttctgcaagtcctgcagaaagtgcagcttgattcttctcataagcaagccatgatggaaaaagtgcgctcttatggttctgtcctgctgtctgctgaggagttccagaagctgttcaatgagctggaccggtccgtcgttaaggaacatccgcctcgcccagagtatcaaagcccgtttctccaatcagcccagtttttattcgggcattactactttgactatctcgggaatttgattgccctggctaacctcgtctctatctgtgtgttcctggttctcgatgccgatgttcttcctgctgaaagggatgatttcatcctcggaatcctaaactgtgtgtttattgtctattatctgctggagatgcttctgaaagtctttgcattaggtctcaggggatatcttagttacccctctaatgtcttcgacggacttttgactgttgtgctgctcgtgctcgaaattagcacattggccgtttatcgcctaccacaccctgggtggagacctgagatggtcggattgttgtccctctgggacatgacccggatgttgaacatgctgatcgttttccgcttccttaggattatcccctccatgaagctgatggcagtggtagcttccaccgtgcttggattagtgcagaacatgcgcgccttcggtggaatactcgtggtggtgtactacgtcttcgccatcatcggaatcaacctgttccggggcgtgatcgtggctctcccaggtaatagctcactcgcgcccgccaacggatcggctccgtgcggctcgttcgagcagctggagtactgggccaacaactttgacgattttgcggcagctctggtgacactgtggaacctcatggtcgtcaacaactggcaggtgttcctggatgcgtacaggcggtactcgggcccttggtccaaaatatactttgtgctgtggtggttagtcagttcggtcatatgggttaacctgtttctggcactcattctggagaactttctccataagtgggatccaaggtcacacttgcagcctctggcagggactcctgaggccacctatcagatgacagtcgaattgctttttcgggatatcctggaagaaccgggcgaggacgaactcacagaaagactgtcacaacatccccacctgtggctgtgtcgctag

SEQ ID NO: 139559 - DNA, 1407 bp, Artificial Sequence
  Description of Artificial Sequence: Synthetic coding sequence
atgtggctctacaggagatactacagtaacgtgtgccaacgcaccttgtcgttcaccatcttcctcatcctatttctagctttcatcgagacccccagcagtttaacgagtacagccgatgtgcgatatagagccgcaccctgggaaccaccctgcggcttgacagagagcgtggaagtgctttgtctgctggtgtttgccgccgatttgagtgtgaaaggttacctctttggatgggcccatttccaaaagaatctatggctcctcggttatctggtggttttggtggtttccctggtcgactggacagtctcactgagcctcgtgtgccacgagcccttgcgaatcagacgcttgcttagaccatttttcttgctacagaatagctctatgatgaagaagacattaaaatgcatacgctggtccctaccagaaatggcatccgtcggtctcctcctcgctatccatctgtgtttgttcacaatgtttggaatgctacttttcgcaggtggcaagcaagacgatgggcaggatagggaacgactgacatactttcagaacctgcctgagagcctcacaagcctccttgttctactcacaaccgctaataaccctgacgtgatgatcccagcctacagcaaaaatagggcctacgcaattttcttcatcgtcttcacggttataggctctctcttcctgatgaacctcctgacggccataatctatagccaatttcgtggttatctgatgaagtcactacaaaccagtctgttccgccgtcgactgggcactcgggccgcgttcgaggttctcagcagcatggtgggcgaagggggcgctttccctcaggccacacgcagaggaccgagtacctctctgagattctgtagggctcccagttcctctagtgcgaccaccacactgacgacgtggggaacaagctccccttggcaaacttggtgtccgtttgcctgttcatggtgttggatgcagatgtgttgcctgctctccgtgatgacatcttcctggggattctccaccgccagctcattgtgtaccacgtgctggcgttgctgctctcggtccctgccatgggcatgcgaaggaacatgccccactccggccacctgcctgacaggttccagccccttgagttgctggagaccagagatggtgggattgctctctctctgggacatgacacggatgctgaacatgctgatcgtttttcggttccttcgcatcattcctagcatgaaactcatggccgttgtcgcttctacagtgttgggcctcgtgcaaaacatgcgggcctttgggggcatcctcgtgcctggcccgtgtcagtggttaggggctctatgggaactgagagctgcaggcgtgctgggccaacagcttcggtag

SEQ ID NO: 139560 - DNA, 1584 bp, Artificial Sequence
  Description of Artificial Sequence: Synthetic coding sequence
atgattctttccagctacaataccatacaaagcgtcttctgctgttgctgctgctgctctgtgcaaaagaggcaaatgaggactcagatatctttaagcacagacgaggaattgcctgagaagtatacgcagcgccgacggccatggctttctcagctttcaaacaaaaagcaaagcaatactgggagggtgcagccctccaaacggaagcctctcccaccgctacctcccagtgaagtcgcagaggaaaagattcaggtgaaggccttgtatgattttttgccacgtgagccgtgtaacctcgcccttcggagagcggaagagtacttgatactggagaaatacaatcctcactggtggaaagctagggatcggctcggtaacgagggtctcataccctctaattacgtgactgagaacaagattacaaatctggagatctacgaatggtaccaccgaaatatcaccagaaatcaagccgagcaccttctgcggcaagagagtaaggagggagctttcattgtgcgggattctcggcatctcgggtcctacaccatcagcgtctttatgggggccaggcgctcgactgaagccgctattaaacattatcagattaaaaagaatgatagcgggcagtggtatgtggccgagcgtcatgcctttcaatcgatccctgagctgatctggtaccaccaacacaatgccgctgggctgatgaccaggttgcgctatcctgtgggactgatgggaagctgcttacccgccaccgccggcttttcgtacgaaaagtgggagatcgaccccagcgagctggctttcatcaaggaaattgggagtggccaatttggagttgtgcacctaggcgagtggagaagccatattcaggtagccattaaagcaattaatgaaggctccatgagcgaggaagatttcatcgaagaggcaaaggtaatgatgaagttgtctcactcgaagcttgtgcagctgtacggcgtctgcattcaacggaaacctctgtacattgtcactgagtttatggaaaacggatgcctgcttaattacctgcgggagaacaaaggaaagctcagaaaggagatgctgctctctgtgtgccaggacatttgcgagggaatggagtacttagagaggaacggctatatccacagggacctcgcggctaggaactgcctcgtcagctcaacatgtatcgtgaaaatcagcgacttcgggatgaccaggtatgtgttagacgacgagtacgtgtcatcgttcggggcaaaattccctatcaagtggtctcccccagaagtcttcctgttcaataagtacagctctaaaagtgacgtgtggagctttggggtgttgatgtgggaagtcttcaccgagggaaaaatgccttttgagaataaatctaatttgcaagttgtcgaggctatttctgaaggctttcgtctatacaggcctcacctggcacccatgtccatttacgaagtgatgtacagttgctggcatgagaagccagaggggcgccccacttttgccgagctactgagggccgtgacggaaatcgcagaaacatggtag

SEQ ID NO: 139561 - DNA, 342 bp, Artificial Sequence
  Description of Artificial Sequence: Synthetic coding sequence
atgggcggactggagccctgttcgagactgttgttgctccccctacttctggctgtttccggcttgcggcccgtccaagcccaggcccagtcagactgcagctgttctaccgttagccctggagtgctggctggaatcgtgatgggtgacctggtcctcaccgtgctaattgccctggccgtttactttttgggcaggctagtgccgcggggcagaggcgccgcggaggccgctaccagaaaacagcggatcaccgagactgaaagtccgtatcaggagctacagggccaaagatcagacgtctattcagatctgaatacccaacgtccttattataagtag

SEQ ID NO: 139562 - DNA, 339 bp, Artificial Sequence
  Description of Artificial Sequence: Synthetic coding sequence
atgggcggtttagagccatgttcccggttactcctgttaccccttctcctggccgtatcagggctgaggcccgtgcaggcccaggcccagtctgattgctcctgtagcacagttagcccgggagtactcgccggcatcgtgatgggcgacctagtactcacagtgctcatcgcattagccgtgtactttctgggccgcctggtacctagaggcagaggtgcagccgaagcaacaagaaagcagaggatcacggagacggaaagcccttaccaagagctacaagggcaacggagtgacgtctactctgacttgaatacccagagaccgtactataagtag

SEQ ID NO: 139563 - DNA, 309 bp, Artificial Sequence
  Description of Artificial Sequence: Synthetic coding sequence
atgggcgggctggaaccttgtagtcggttgctgttactaccactgcttctggctgtgagcgattgctcctgtagcacagtctcgcctggcgttctcgccggcatagtcatgggggacctggttctgacagttcttatagccctggccgtatatttcctgggtcgacttgtgccaagaggccggggtgcagccgaggccgcgacgcggaagcagcggatcaccgagacagagagtccatatcaggagctccaaggtcagcgatcagacgtttatagcgacctcaatactcagcggccatactataaatag

SEQ ID NO: 139564 - DNA, 339 bp, Artificial Sequence
  Description of Artificial Sequence: Synthetic coding sequence
atgggcggactggagccctgttcccggctcctcttgcttccattgctcttggcagtatccggtctgcggccagtccaagcccaggctcagtcagactgttcctgctctacagtttcccctggcgtccttgctggcattgtgatgggggatctggtgctgaccgtattgatcgccctggctgtctactttttgggcaggctcgtaccacgggggcgtggagctgctgaggctacccgcaaacaacgcataacagaaactgagagtccttatcaggaattacagggccagcgctccgatgtgtactctgatctgaacacccagagaccatattacaagtag

SEQ ID NO: 139565 - DNA, 2673 bp, Artificial Sequence
  Description of Artificial Sequence: Synthetic coding sequence
atggccctgaggcgctccatgggccgccccggactgccccctttacccctgcctccgccacctcgcctgggactcctcctcgccgcactcgcaagcttattgcttcctgagtcagctgccgcgggcctcaagttgatgggagctcccgttaagctgactgtgagtcagggacagcctgtgaagctgaattgtagcgttgagggtatggaagagcctgacatacaatgggtgaaggatggagcagtcgtgcaaaatctggaccaactgtatatcccagtctctgaacagcactggatcggtttcctgtcccttaaatccgtggaaaggtccgacgccggccggtattggtgccaggtcgaggacggcggggaaactgaaatatcacagccagtatggctgaccgtggaaggcgtgcccttcttcacggtagagcctaaagatctagcagtgcctcccaatgcccctttccagctgagctgcgaggcggttggcccaccagaaccggtgacaatcgtttggtggcgtggcactaccaagatcggcggccccgccccctcgcctagtgtcctcaacgtcaccggcgtaacacaaagcactatgtttagctgtgaagctcataacctgaagggtctggcaagttcccgcactgccaccgtgcatctccaggccctccccgccgcacctttcaacattaccgtcaccaagttatcctcctcaaacgcgtcagtggcctggatgcctggagccgacgggagggccctacttcaatcatgcaccgtccaagtaacccaggcccctggggggtgggaggtccttgccgtggtagtaccagtgcctccctttacctgcctgttgagggatctggtgccagccacgaattactcactccgtgtgcgttgtgctaacgccctgggacccagcccttacgccgactgggtgcccttccagactaagggactagctccggccagtgcccctcagaatcttcatgcaattcggactgattctggtctcattctggaatgggaggaggtcattccagaggcgccactcgagggcccgttaggtccttataagctatcctgggtgcaggataatgggacgcaggacgaattaaccgtggagggaactcgcgctaacctgaccggatgggatccacagaaagatctaatagtcagagtatgcgtatccaacgctgttggctgcgggccttggagtcagcctctggtggtctcgtctcacgatcgtgcaggtcagcagggccccccgcattcaagaacctcctgggtacctgttgtgctcggggtcctgaccgccctggtgactgctgctgccctggccctgatccttcttagaaagaggaggaaggagacacgcttcgggcaggccttcgactctgtcatggcgcgtggagagcccgctgtacacttcagggctgcaagaagtttcaacagggaaagacctgagcgcatcgaggccacacttgattctctggggattagcgacgaactgaaggaaaagttggaggacgtgctcatcccagagcaacagttcaccctagggagaatgctggggaaaggcgagttcggctctgtgagggaggcccagctgaaacaggaggacgggagcttcgtgaaggtcgccgtgaagatgcttaaggctgatatcatcgcttctagcgacatcgaagaattcctgagagaagctgcatgtatgaaggagtttgatcatccccatgtggctaaattggtcggcgtgagtttgcgctctcgcgccaaaggaaggttaccaattccaatggtgatcctacccttcatgaaacacggagacctgcatgccttcctgctcgcttctagaatcggtgagaatccatttaatctcccgctgcagaccctcattcgcttcatggttgatatagcatgtggcatggagtatctatcaagccggaactttatccatagggacctggcagcaagaaattgcatgctggcagaagacatgactgtctgcgtcgctgactttggcctttctcggaaaatttattccggagattattacagacagggctgtgcctccaagctcccagtgaaatggcttgctcttgagtccttggccgataatctgtatacagtgcagagtgacgtctgggcgttcggtgtgactatgtgggagattatgacgagaggacaaaccccctacgctggcatcgagaacgcagagatctacaactatctgatcggcggcaaccgcctgaagcagccacccgaatgcatggaggacgtgtacgacctcatgtaccaatgctggtccgctgaccccaagcaacgtccatcattcacctgtctgcggatggagctggaaaacatcctgggtcagctttctgtgttaagcgcatcccaagatccactgtacatcaatattgaacgagctgaggaacctactgccgggggctccttggagttacctggccgggaccaaccatactccggggccggggacggctccggcatgggcgctgttggcggaactccctccgattgtcgctatattctaactccaggaggactggctgaacagcccggtcaggcagagcatcagccagagtcccctctcaacgaaacacaacggttactcttgcttcagcagggactcctgccacactcttcttgttag

SEQ ID NO: 139566 - DNA, 2529 bp, Artificial Sequence
  Description of Artificial Sequence: Synthetic coding sequence
atggaagagcctgatattcaatgggttaaggacggcgcggtagtacagaatttagatcagctgtatattcctgtgagcgaacagcattggatcggtttcctgagtctaaaatccgtggaaagatctgatgctggacggtactggtgtcaggtggaggacggcggagagaccgaaatttctcaaccagtgtggctgaccgttgaaggcgtacctttttttacagtcgagcccaaggacttggctgtacctcctaatgcaccctttcagctgtcttgcgaagcggtaggccccccggagcccgtgaccatcgtgtggtggcgcggaactacaaaaatcggggggcctgccccatccccgtccgtactgaacgtcaccggtgtaactcagtcaacaatgttcagttgcgaggcccataatcttaagggcctggcctcatcacgaacagcaaccgtccacctgcaagccctgcctgcggctcccttcaacatcacagttacaaagctcagttccagtaacgcatctgtcgcatggatgcccggggcggacggaagggcactgttgcagagttgcaccgttcaggtaacacaggcacctggaggatgggaggtcctggccgttgtcgtccctgtgcctccattcacctgtttgctccgggacctcgttccagccacaaattattcgctgcgagtgagatgtgctaatgccctaggccccagcccatatgcggactgggtgccctttcaaacaaagggcctggctcccgctagcgctccccagaatctgcacgccatcaggacagatagcggcctgatcctagagtgggaggaggtgatacccgaagctccactcgagggtcccctgggcccgtacaaattgtcttgggtccaggataacggaacccaggacgaattaactgtagagggcactcgagcaaacttgactgggtgggatccccagaaagatctgattgtccgcgtctgcgtctctaatgccgtaggctgcggaccttggtctcaacccctggtcgtctcttcccacgacagggcaggccaacaagggccaccccactcacgtacatcttgggtcccggtggtgctgggcgtgctgacagccctggtgaccgccgccgcgctcgccctcattctgttacgcaaaagacgaaaagaaacgagattcggtcaagcctttgactccgttatggcacgcggggaacccgctgtgcattttagagcagccaggtcatttaacagagaacgacctgagagaatcgaggcaacgctggattctctggggatcagcgacgaactgaaggaaaaactggaggacgtcttgatccctgaacagcagtttacacttgggcgcatgctggggaaaggcgagtttggctctgtcagggaagcacagctgaaacaggaggacggcagcttcgtgaaagtggcagttaaaatgttaaaggccgatattatcgcctcatctgatatcgaggagttcctgcgggaggctgcgtgtatgaaagagttcgaccatccccatgtcgccaagctggtgggcgttagtctccgctcccgcgctaaagggcgacttccaattccaatggttattctcccttttatgaagcatggtgatctgcacgccttcttacttgcctctagaataggggagaacccatttaatctgcccctccaaacacttatccgctttatggtggacattgcttgcggcatggagtacctgagttctcgcaacttcattcacagggatctggctgcacgcaattgtatgttggccgaggacatgacagtttgcgtcgctgatttcggcctgtcccgtaagatttactcaggcgactattaccgtcagggctgtgcctctaaactgcctgtcaagtggctggccctcgaatccctggctgacaacctctacacggtgcaatccgatgtctgggcctttggtgtaacgatgtgggagataatgacgcggggccagacaccgtacgccggcatcgaaaatgcagagatttataattacctgatcggcgggaacagattgaaacagccaccagagtgcatggaggacgtctatgatctgatgtatcaatgttggtcagccgatcctaaacagcgtccatcttttacctgtctgcgtatggagctggaaaacatattgggccaattgagcgtcctgagtgcttctcaggacccgctctatatcaatatagaaagggccgaagaacccacagctggcgggagtttagaactgcccggcagggaccaaccctacagtggggctggcgatggcagtggtatgggcgcggtcggtggaaccccaagcgactgcaggtacatactgactcctgggggcttagcagagcaacctggtcaagccgagcatcagcctgaatccccacttaacgagacccagaggttgctgctgctgcagcagggccttcatactgtggctgtgtctccccaggctgagggaataggcgctatatggcctgccttggttgccacggagctggcagactag

SEQ ID NO: 139567 - DNA, 741 bp, Artificial Sequence
  Description of Artificial Sequence: Synthetic coding sequence
atgaccatggacaagagtgaactggttcaaaaggctaagttggctgagcaggccgaaagatacgacgatatggccgctgccatgaaagccgtaaccgagcagggtcacgaacttagcaatgaggagaggaacctgctctcagtggcctacaaaaacgtggttggggcaaggaggagctcatggcgggttatatcaagcattgagcaaaagactgaacggaacgagaaaaagcaacagatgggcaaggaataccgggaaaaaatcgaggccgagttgcaggacatatgtaatgacgtgctagagttgctcgacaagtacttgattcctaacgcaacgcagccagagagcaaggttttctatctaaaaatgaaaggtgattatttccggtatcttagtgaagtggcttcaggcgataataaacaaactacagttagtaattctcagcaggcctaccaggaagccttcgagatttcaaagaaggaaatgcagcccactcacccaattagattaggcttagcactcaacttttctgtcttctattacgagatcctgaactcgcccgagaaagcctgctcattggccaagaccgctttcgatgaagctatcgcggagctggacaccttgaacgaagagagttataaggactctacgcttataatgcagttgctgcgagacaacctgacgctctggacctcagagaatcagggtgacgagggtgacgcgggggagggcgaaaattag

SEQ ID NO: 139568 - DNA, 741 bp, Artificial Sequence
  Description of Artificial Sequence: Synthetic coding sequence
atgacaatggacaaatcagaattggtgcagaaagctaaactagctgaacaggcagaacgctatgacgatatggcagcggccatgaaggctgtcaccgagcagggacacgaattgagtaacgaagagcgaaatcttttgtctgtcgcttacaaaaacgttgtcggagcaaggcggagcagttggagagtcatctcttcgatagaacagaagaccgagaggaacgagaagaaacaacaaatggggaaagaatacagagagaagatcgaagcagagcttcaggatatttgcaacgatgtgctggaactcttggataaatatctgatcccaaacgccacccagcccgagtccaaggttttctatcttaaaatgaagggtgattactttagatatctgtccgaagtggcctcaggggacaacaagcagaccaccgtgtctaatagccagcaagcttatcaggaagcctttgaaatatccaaaaaggaaatgcagcccactcatcccatcagattaggtctggcactcaacttttcagtgttttattatgagattctgaactccccagaaaaggcttgttccttggccaaaaccgcttttgatgaagcgatcgccgagcttgacacactcaatgaggagagctacaaggattctacactcattatgcagctccttcgcgacaatctgaccctctggacctccgagaaccaaggtgatgagggcgacgcgggggaaggggaaaactag

SEQ ID NO: 139569 - DNA, 303 bp, Artificial Sequence
  Description of Artificial Sequence: Synthetic coding sequence
atgacaatggacaagtcagaattagttcagaaggccaagttggctgaacaggccgagcggtatgatgatatggccgctgctatgaaggccgttactgagcaggggcatgagttatctaatgaggaaagaaacttgttgtcagtggcctacaaaaatgtcgtgggtgcccggagatctagctggagggtaatttctagcattgaacagaagacagagcgcaatgaaaagaaacaacaaatgggaaaggaataccgtgaaaagatagaagccgagctgcaagacatttgtaatgacgtgttatag

SEQ ID NO: 139570 - DNA, 225 bp, Artificial Sequence
  Description of Artificial Sequence: Synthetic coding sequence
atgacaatggataaatctgagctggtgcagaaagccaaactcgccgagcaggccgagcgctatgatgacatggcagcagctatgaaagcagtgactgagcagggacacgagctgtcaaatgaagaacgtaatctactttcagttgcatataagaatgttgtgggagctagacggtccagctggagagtgataagctccattgagcagaaaaccgagcggaattag

SEQ ID NO: 139571 - DNA, 768 bp, Artificial Sequence
  Description of Artificial Sequence: Synthetic coding sequence
atggacgacagggaggaccttgtgtatcaggccaagcttgcagaacaggctgaacgctacgatgagatggtggaatcaatgaagaaggtcgccggtatggacgtggagctgactgttgaggagagaaatctgctgagtgtggcttataaaaatgtgatcggggcacgcagggccagctggcggattatttcctctattgaacagaaagaagagaacaaaggcggcgaagacaaactgaaaatgatccgagaatatcgacaaatggtagagacggagttgaaactgatttgctgtgacatcctagatgtcttggataagcacctcatcccagctgcgaacaccggtgaatcaaaagtcttctactataaaatgaagggagactatcatcgctatctagctgaattcgcaactggcaacgaccgcaaggaagcagccgagaacagcctcgtcgcctacaaagcagctagcgacatagccatgacggaactgccccctacccatcccataaggcttggcctggctttgaacttctcagttttctactatgaaatcctgaacagcccggacagggcctgccgcctggctaaagccgcatttgacgacgcaatagctgagctcgacactctctccgaggaaagctacaaagacagtactttaattatgcagctgttgcgcgataacttaactctatggaccagcgacatgcagggtgatggtgaggaacagaacaaggaagcccttcaagatgtggaggatgagaatcagtag

SEQ ID NO: 139572 - DNA, 702 bp, Artificial Sequence
  Description of Artificial Sequence: Synthetic coding sequence
atggtggaatctatgaaaaaggtagccggcatggatgttgaactaaccgtggaagagagaaacttgctaagcgtagcttataagaatgtgataggtgctcgccgggcatcatggcgaatcatcagcagtatagagcagaaagaggagaacaaggggggagaggataaactaaaaatgataagggaatatcggcagatggtcgaaaccgagctgaaactgatatgttgtgacattttagacgtgcttgataaacatctgattcccgcagctaatacaggagagtcaaaggttttctactataagatgaaaggcgactaccacaggtacttagccgagttcgccacagggaacgacagaaaggaagccgcagagaattcgctcgttgcatacaaagcagcctctgacatcgccatgaccgagctaccccccacacaccctatcagactgggcctggccctaaacttctctgtgttctactacgagattcttaattctcccgatcgcgcttgcaggctagccaaggctgccttcgatgacgcaatagcagagctcgatacattgagcgaagagtcatacaaggactccacgctaatcatgcagcttttgagagacaaccttacgctatggacaagcgatatgcagggtgatggggaggagcagaataaagaagcgctgcaagatgttgaagacgagaaccagtag

SEQ ID NO: 139573 - DNA, 744 bp, Artificial Sequence
  Description of Artificial Sequence: Synthetic coding sequence
atggtcgaccgcgaacagctcgtgcagaaggccaggctagccgagcaagctgaaagatatgatgatatggccgccgctatgaaaaatgttacggagctgaatgaacctctgagtaacgaggaaagaaatctgctctccgtggcatacaagaatgttgttggtgcaagaagatcatcctggcgggtaatctctagcatcgaacaaaaaacctctgccgacggaaatgagaaaaaaattgagatggtcagggcctatagggagaaaatagagaaggagctggaagctgtgtgtcaggacgtcctcagtctgctcgataactacttaatcaaaaactgctccgagacgcagtatgagagcaaggtcttctacctcaagatgaaaggggactattaccgctatctggcagaggtagcaaccggcgagaagcgcgctacagtggtggaatccagtgagaaggcctatagcgaggcccacgagatctccaaagaacacatgcagccaacccatcctataagattggggctcgccctgaactacagcgtattctactacgaaatccaaaacgcccccgagcaggcttgccaccttgccaagacggcattcgacgatgcaatagccgagttggatactttaaacgaggacagttataaggactccaccctgatcatgcagttgttaagggacaatctaacgctgtggaccagcgatcagcaggacgacgatgggggagaagggaacaattag

SEQ ID NO: 139574 - DNA, 624 bp, Artificial Sequence
  Description of Artificial Sequence: Synthetic coding sequence
atggtggatcgcgagcagctggtgcagaaagcaaggcttgccgagcaggccgaacgatacgatgacatggccgctgctatgaagaatgttactgagctgaatgaacccctgtccaacgaagaacgtaacctcttaagtgtcgcctataagaatgtggttggagcccgccgaagttcttggagggtgattagctcaattgagcagaagacatctgctgacggcaatgagaaaaagattgagatggtgcgcgcgtacagagagaaaattgaaaaggagctcgaggctgaggtagccaccggcgaaaagagagctacggttgtggagagttcagaaaaggcgtatagcgaagctcacgagatcagcaaggagcacatgcagccaacccacccaattagactgggactcgccctcaattactcagtgttctactacgaaatccagaatgcgcccgaacaagcctgtcacctcgctaaaactgcgttcgacgacgcgatcgcagagttggataccctgaatgaggactcctataaagactctactctgattatgcagctcttgagagataatctgacgctgtggacgtccgaccagcaggatgacgatggcggagagggaaataactag

SEQ ID NO: 139575 - DNA, 678 bp, Artificial Sequence
  Description of Artificial Sequence: Synthetic coding sequence
atggcggccgctatgaaaaacgtaaccgaacttaatgaacctctgtctaatgaggaacggaatcttctgagcgtcgcttataagaacgtggtgggcgcaaggaggagcagctggagagtcatcagctctattgagcagaaaacctccgctgacgggaacgaaaaaaagatcgagatggtgcgagcctatagagagaaaatcgagaaggaactagaggccgtctgccaggacgtgctgtcgctgctcgataactacttgataaagaattgtagcgaaacccagtacgaatctaaagtgttctacctgaagatgaagggagattactacaggtacttggccgaggtggccacgggggaaaagagggccactgtcgtggagtcttccgagaaagcctattccgaagctcatgagattagtaaggaacatatgcagcctacgcatcccatccgcctggggctggctctcaactactccgtgttctactatgagatacagaatgcccctgagcaggcatgtcacctggcaaaaacagcttttgatgatgctattgctgagctcgatactttgaatgaagacagctataaagacagcaccctcatcatgcagctgttgcgcgacaatctcacattgtggacaagtgaccaacaggatgatgatggcggggaggggaacaattag

SEQ ID NO: 139576 - DNA, 738 bp, Artificial Sequence
  Description of Artificial Sequence: Synthetic coding sequence
atggataagaatgaacttgtccagaaggcaaaacttgctgaacaagcagaacgctacgacgatatggcagcttgcatgaagtctgtgaccgagcagggtgcagagttaagcaatgaagagaggaaccttctttctgtggcctacaaaaatgtcgtgggcgcaaggcggagttcatggcgagtagtgagctcgatcgagcagaagacagaaggggcagaaaaaaagcagcagatggcgcgtgagtacagagagaagatagaaactgaattgcgagatatctgtaatgacgtcctgagcctgctagagaagtttctaatacctaacgcctcacaagcagaaagcaaggtattttatctaaagatgaagggggattattacaggtacctggccgaagtggctgctggggacgacaagaagggtattgtggaccagagtcagcaggcttaccaggaggcattcgagatttctaaaaaggagatgcagcccacccacccgattcggctaggactcgccctgaatttctccgtattctattatgaaatccttaacagcccagagaaagcatgttcattggccaagacggcttttgatgaggccattgccgagctcgatacgcttagtgaagaatcttacaaggactcaaccctgataatgcaacttctgcgggacaatcttaccttatggacatccgatacacagggggacgaggctgaggccggagaaggtggcgaaaactag

SEQ ID NO: 139577 - DNA, 507 bp, Artificial Sequence
  Description of Artificial Sequence: Synthetic coding sequence
atggcccgggagtatcgggagaaaattgagacagagctccgggacatttgcaacgatgttttatcgctccttgaaaagtttttaatccctaatgcatcccaggcagagtctaaggtgttctatctgaaaatgaagggcgactattaccgctatctagccgaggtggcagctggcgacgataaaaaggggatcgtggaccaatcccagcaggcttatcaggaagctttcgaaatcagtaaaaaggagatgcaaccgacacatcctatccgcctggggcttgctctgaatttcagcgtgttctattatgaaatactcaatagtccagagaaagcctgttctctggctaagacggcatttgatgaagctattgcagaactggataccctcagcgaagagtcatataaggactccacactgattatgcagctcctgcgtgacaatttgaccctttggacatctgacacccagggcgatgaagccgaggcaggcgaaggaggagagaactag

SEQ ID NO: 139578 - DNA, 738 bp, Artificial Sequence
  Description of Artificial Sequence: Synthetic coding sequence
atggacaagaatgaactggtccaaaaggcgaaactcgcggagcaggccgaacggtacgacgacatggccgcctgtatgaagtcagtgacagaacagggagccgagttgtcaaacgaggagcgtaacctcttatctgtcgcttacaaaaacgtggtgggagccaggagatcaagttggcgcgtggtgagcagcatcgagcaaaagaccgaaggagctgaaaaaaagcagcaaatggcaagggagtatagagagaagattgaaacggagctgcgcgatatttgcaacgacgtgttaagtctcctcgaaaagtttcttatccctaatgccagccaagccgaatctaaggttttttaccttaagatgaagggcgactactatcggtacttggcagaagtggccgctggagatgacaagaaggggatagtggaccagtcacagcaggcataccaagaggcgttcgaaatctctaagaaagagatgcaacccacccaccccattaggttaggactggctctgaatttcagcgtgttctattacgaaatcctgaacagccctgagaaagcctgttccttggctaaaactgcctttgatgaagcgatcgcagagctcgacacactgagcgaggagagttataaggattccaccctgatcatgcagcttctcagagataacctgactctctggacctccgatacacaaggagacgaggccgaagcaggtgaaggaggcgagaactag

SEQ ID NO: 139579 - DNA, 738 bp, Artificial Sequence
  Description of Artificial Sequence: Synthetic coding sequence
atggataagaatgaattggttcagaaagccaagctggcagagcaagcagagcgctatgacgacatggccgcttgcatgaagtccgtcactgaacagggtgccgagctgtctaatgaggagaggaacttgctgagcgttgcatacaagaacgtagtgggcgcaaggcgcagcagctggcgtgtggtatcctctatcgaacaaaagaccgagggggccgagaaaaagcagcaaatggccagagaataccgggagaaaatcgagacggaactgagggatatatgcaacgacgtgctgtccctgctggaaaagttcctgatccctaacgcatctcaggcagaaagcaaagtcttttatctgaagatgaaaggggactattacagatacctggccgaggtagctgccggcgacgacaagaaggggatcgtcgatcagtcacagcaggcataccaagaagcatttgagataagcaaaaaagaaatgcagccaacccaccccatccgcctgggactcgccctgaatttctccgtgttttactatgagatattaaattcaccagaaaaggcgtgttctttagctaaaactgcttttgacgaggcgatcgccgagctggacacgctgtctgaagagtcgtacaaggatagcaccctcatcatgcagttactccgcgacaacctgactctgtggacatcagacactcagggagacgaggcagaggccggcgaaggaggagagaactag

SEQ ID NO: 139580 - DNA, 738 bp, Artificial Sequence
  Description of Artificial Sequence: Synthetic coding sequence
atggacaaaaatgagcttgtacaaaaggcgaaactggctgagcaggctgagcgctatgacgatatggccgcatgtatgaagagtgtcacagagcaaggcgcggaactgagcaacgaggagcggaacttgctaagtgtcgcttacaaaaatgtggtgggcgcacggagatcatcctggagagttgtcagcagtatcgagcagaagacggaaggggcggagaagaagcagcaaatggcccgggagtatagggaaaaaatcgaaacagaactgagagacatctgcaacgacgtcctgagtttacttgaaaaattcctcattcccaacgcttcccaggccgaaagcaaagtattctatctcaaaatgaaaggcgactattatcggtacctcgctgaggtagctgccggggacgataagaagggcattgtcgaccagtcacaacaggcctaccaggaagcctttgagatcagcaaaaaagagatgcagcccacccaccccatccgcttgggattggctctcaacttcagtgtgttctactacgagatcctgaactcacctgagaaggcttgcagcttagccaaaaccgcttttgacgaggctattgccgagttggacacacttagcgaagagagttacaaggatagtacccttatcatgcagctgttgcgcgacaacctgacgctgtggacttctgatacacagggcgacgaggccgaagcaggggaaggtggcgagaattag

SEQ ID NO: 139581 - DNA, 738 bp, Artificial Sequence
  Description of Artificial Sequence: Synthetic coding sequence
atggacaagaatgagcttgtgcagaaggctaaactggccgagcaggccgagcggtacgatgatatggctgcgtgtatgaagtccgtgacagagcagggagctgagcttagtaacgaagagcgaaacctgctctcagtcgcctataagaacgtggtcggtgcccgcaggagcagctggcgggtggttagcagcattgagcaaaaaactgagggagccgagaagaaacaacaaatggctagagagtatcgggaaaaaatcgaaactgaactgcgtgatatctgcaatgacgtgctttcacttctggagaagttcttgatcccaaacgcaagtcaggctgaatctaaagtcttctaccttaaaatgaaaggagactactaccggtatcttgctgaagtggctgcaggtgatgacaagaaaggaatcgtggaccagtcacaacaagcgtaccaagaggcttttgaaatctcaaaaaaggagatgcaacctactcaccccatccgcttagggttggccctgaatttttccgtcttttattacgagattctgaactcacctgaaaaggcctgctcgcttgcgaagacagccttcgacgaagccatcgccgaactggacaccctgtcggaggagtcttataaggactccactttgatcatgcagctgctgcgggataacctcacactttggacatcggatacacaaggagacgaagctgaagcaggggaaggcggggaaaattag

SEQ ID NO: 139582 - DNA, 738 bp, Artificial Sequence
  Description of Artificial Sequence: Synthetic coding sequence
atggataagaatgagttggttcagaaggccaagttagcagagcaggccgagcgctacgatgacatggcagcatgcatgaagtccgtgacagaacaaggcgcagagttaagcaacgaggagcggaacctcctgtctgtggcctataagaatgttgttggagcacggcgctcctcatggagggttgtgtccagtatagagcagaagacagaaggagccgaaaaaaagcagcaaatggctagggagtatagagagaaaattgaaaccgaactgcgagacatctgcaatgacgtgctatccctgctcgagaaattcctcattcctaatgccagccaggcagagtcaaaagtgttttatctaaaaatgaaaggtgactactaccgttacttggctgaggtagcggcaggggatgataaaaagggcatagtcgatcaaagccagcaagcttaccaggaagcctttgaaatttcaaagaaggagatgcagccaactcacccaattcgtctgggactcgcgctgaattttagcgttttttactatgagatcctcaacagtcctgaaaaggcatgttctctggcaaaaaccgcctttgatgaggcaattgccgaactagacactttgagcgaggaaagctacaaggattccactcttatcatgcaattacttcgagacaacctgacgttgtggacctctgatacgcagggcgacgaagctgaggcaggcgaaggaggagaaaactag

SEQ ID NO: 139583 - DNA, 297 bp, Artificial Sequence
  Description of Artificial Sequence: Synthetic coding sequence
atggataaaaatgagctcgtgcaaaaggcaaaacttgccgaacaggcagagcggtacgatgatatggcggcctgtatgaaaagcgtcaccgagcaaggggccgagctcagtaatgaggagaggaatctgctctctgtggcatataagaacgtggtaggcgctaggcgctcgagttggcgcgtggtgtcctccatcgagcaaaagacagaaggggctgaaaagaaacaacagatggcccgcgaatacagagagaagattgagacggagttgcgcgatatttgcaatgatgtgttgtag

SEQ ID NO: 139584 - DNA, 738 bp, Artificial Sequence
  Description of Artificial Sequence: Synthetic coding sequence
atggacaagaacgaattagtccagaaagcaaaactggccgaacaggcagaaagatacgacgacatggcagcctgtatgaaatcagtcaccgaacagggcgctgaactcagcaacgaggaaagaaacctgctctccgtggcttacaagaatgtagtgggagctcggcgctccagttggcgggtggtttcgagtatcgaacagaagaccgagggggccgaaaagaagcagcagatggcacgcgagtatcgggaaaagattgagaccgaactgcgggacatctgtaacgacgtcctcagtctgctcgagaaatttttgatcccaaatgctagccaggctgagtccaaagtcttctatctcaagatgaagggcgattattaccggtacttggccgaagtcgcagccggagatgacaaaaagggaatcgtcgatcagtctcaacaggcctaccaggaggccttcgaaatatccaaaaaagagatgcagcctacacatccgattaggctgggactggcccttaattttagtgttttttactacgagattctcaactcccctgaaaaggcttgttctctcgcaaaaaccgcatttgatgaggcaatcgccgagctcgacacactctcggaagaaagctataaagactccactctgatcatgcaactgttgagggataatctcactctgtggactagtgatacccagggcgacgaggccgaagctggagaaggcggggagaattag

SEQ ID NO: 139585 - DNA, 279 bp, Artificial Sequence
  Description of Artificial Sequence: Synthetic coding sequence
atggataagaatgaactggtgcagaaggcaaaactggccgaacaggctgaaagatacgatgatatggcggcctgcatgaagagcgtgaccgagcagggggccgagcttagcaacgaagagagaaatttattaagcgtggcatacaagaatgtggttggcgcacgtaggagtagctggcgggttgtgtccagcattgagcaaaaaactgagggggctgagaaaaagcagcagatggcccgggagtacagagaaaaaatcgagacagaactgcgtgactag

SEQ ID NO: 139586 - DNA, 738 bp, Artificial Sequence
  Description of Artificial Sequence: Synthetic coding sequence
atggacaagaacgagctggtgcaaaaggctaaattagccgagcaggcagagagatatgatgacatggcggcctgtatgaagtccgtgaccgaacaaggggctgaactgagcaatgaagaacgaaatttgctgtcagtggcctacaagaacgttgtaggcgcgcgacgctcttcttggcgggtggtcagctcaattgagcaaaaaaccgagggggccgaaaagaaacagcagatggcgcgagagtaccgcgaaaagatagaaactgagctgcgcgatatttgcaacgacgtcctgagtctcctagaaaagttcctcattcccaatgcttcgcaggcagagagtaaggttttttatctcaaaatgaaaggcgactactaccggtaccttgctgaggtggctgcaggggacgacaagaagggcatcgttgatcagagtcagcaagcctaccaagaagcctttgagatcagtaagaaagagatgcaacccacgcaccccatccgcctaggcctggctctcaacttcagcgtgttttattacgagatactaaacagccccgaaaaggcctgttctttagctaaaacagcttttgacgaagctattgccgaactggatacattgtccgaagaatcgtacaaggattccaccctaattatgcagctgttgagagataacctgactctgtggaccagtgatactcagggcgatgaggcggaggccggcgagggcggtgaaaactag

SEQ ID NO: 139587 - DNA, 507 bp, Artificial Sequence
  Description of Artificial Sequence: Synthetic coding sequence
atggcccgcgagtatcgggagaagatagagaccgaattgcgggacatttgtaatgatgtcctgtccttgctcgagaagtttctcatcccgaatgcgtctcaggccgagagtaaggtgttctatcttaagatgaagggcgattattatcgctacctggccgaggtggccgccggcgacgacaagaaaggtattgtcgaccagtctcaacaggcatatcaggaagcattcgagatcagcaaaaaggagatgcaaccaacacatccgatcaggctggggctggctctgaacttcagcgtgttttattacgagattcttaactcacctgaaaaggcatgctccttggccaaaacagcgtttgacgaagcaatcgctgaactcgacactctctccgaagaatcttataaggactctacccttattatgcagcttctaagggacaatctaaccctgtggacgagtgatactcagggtgacgaagcggaggccggcgagggcggggagaactag

SEQ ID NO: 139588 - DNA, 378 bp, Artificial Sequence
  Description of Artificial Sequence: Synthetic coding sequence
atgaaaggagactactaccgctacctggcagaagtcgccgcgggcgacgacaaaaaaggcattgtggatcagtctcagcaggcataccaagaggccttcgaaatctccaagaaagaaatgcagcctacacaccccattcggctgggactagctctaaacttctccgtgttctattacgagatcctgaatagtccagaaaaggcgtgctcactcgcaaagacagctttcgatgaggccatcgctgagctcgatactctgtctgaggaatcctataaggacagtacgttgatcatgcaactgctgcgcgataatttgacactctggactagcgacacacagggggatgaagccgaggctggggaaggcggagagaattag

SEQ ID NO: 139589 - DNA, 414 bp, Artificial Sequence
  Description of Artificial Sequence: Synthetic coding sequence
atggacaaaaacgagctcgttcaaaaggctaagttggccgagcaggcggaacgctacgacgacatggctgcgtgtatgaagtccgtcaccgaacagggggcagagttgtcgaatgaggagcggaacctgttgtccgtcgcctataagaatgtggtgggggctaggaggtccagttggagggtggtcagcagtatcgagcaaaagactgaaggcgctgagaaaaagcagcagatggctagggagtatcgtgaaaagatcgagacggaactgagagatatttgtaacgatgttctgtccctgctcgagaaattcctgatccctaacgcgtcccaggccgaaagtaaggtgttttacctgaagatgaagggagactactatcgatacttggccgaggttgccgctggcgatgattag

SEQ ID NO: 139590 - DNA, 741 bp, Artificial Sequence
  Description of Artificial Sequence: Synthetic coding sequence
atggacaagaatgagctcgtacagaaagcgaagctagccgaacaggcggagcggtacgatgatatggctgcctgcatgaagtccgtgactgaacagggggctgagctgtctaatgaagaacgaaacctcctttccgtggcttataagaatgtggtgggtgcccggaggagttcctggcgtgtcgtgtcctccattgaacagaaaaccgagggcgcggagaagaaacagcagatggctagggagtacagggagaagattgagacagaactcagagatatatgcaacgacgttctgtctttactagagaagtttcttattcctaacgcttctcaagcagaatcaaaagttttctatctgaaaatgaagggtgactattaccgatatctcgccgaagtggcggctggtgatgacaagaaagtgcgttttggtgtatcctacccgggcattgtcgaccagtcacagcaggcctaccaagaagccttcgaaataagcaagaaagaaatgcagcccacccatccgattcggctgggcttagcactgaactttagcgtgttttattacgagatactgaattcacctgaaaaggcttgttcccttgctaagactgcatttgacgaagcaattgctgaactggacactctgtcggaggagtcatataaggactcaaccctgatcatgcagctgctccgcgacaatctcacgctgtggacatccgacacccaaggggatgaggcagaatag

SEQ ID NO: 139591 - DNA, 513 bp, Artificial Sequence
  Description of Artificial Sequence: Synthetic coding sequence
atgagtcaaccatgtagaaaactgtggaggcacaactacgaaaccagtagttgtatagagtttctgaagtcgctgctcgagaaatttctcattccgaacgccagccaggctgagtcaaaagtgttttatctgaagatgaagggcgactattatcgctacttggcggaggtcgctgccggggacgacaaaaagggaatcgtcgaccagtcccaacaggcctaccaggaggccttcgaaattagcaagaaggaaatgcagccaacgcaccccattagactgggtcttgctcttaatttttccgtgttttactacgagattctgaacagcccggaaaaagcgtgctccctcgccaagactgcatttgacgaagcaattgctgaactcgatactctgagcgaggaatcgtacaaggacagtacgctgatcatgcagctgctcagagacaatcttactctgtggacatccgacactcaaggggacgaggcggaggctggggaagggggtgagaattag

SEQ ID NO: 139592 - DNA, 378 bp, Artificial Sequence
  Description of Artificial Sequence: Synthetic coding sequence
atgaagggggattattatcgatatttagccgaggttgcagctggagacgacaagaaaggaattgtggaccagtctcagcaggcctatcaggaggcctttgagattagcaaaaaggagatgcagcccacgcatccaatacggctgggcctcgctctcaacttttcggtcttctactacgagatcttgaattctcccgagaaggcctgttcgcttgccaagactgccttcgacgaggccatcgcggagttagacacccttagcgaggagagctataaggactcaacactgataatgcagctgttacgcgataatctgaccctttggacatccgacacacagggcgatgaagccgaggccggagagggtggtgagaactag

SEQ ID NO: 139593 - DNA, 228 bp, Artificial Sequence
  Description of Artificial Sequence: Synthetic coding sequence
atggataaaaacgaactggttcaaaaggctaagcttgccgaacaagcagagcgatacgacgatatggcagcctgtatgaagagtgtgactgagcagggagccgaactgagcaacgaggaacggaatctacttagcgttgcatataaaaatgtcgtcggagccaggcgctcctcctggcgggtggttagttcgattgaacagaagacagagggagctgagaagaagtag

SEQ ID NO: 139594 - DNA, 393 bp, Artificial Sequence
  Description of Artificial Sequence: Synthetic coding sequence
gtcttttaccttaagatgaagggagactattacagatatcttgcagaagtggccgctggagacgacaagaaaggaatcgttgaccaatctcagcaggcttaccaggaggccttcgaaatcagcaaaaaggagatgcaacctacccaccctataaggttagggctagccttgaatttttccgtgttctactacgaaatcctgaattcccccgaaaaggcgtgtagccttgccaagacagcattcgacgaggctatcgcggagctggatacgttgagcgaggagtcgtataaggacagcacactgataatgcagctgttgcgcgacaacctcactctctggactagtgatactcagggagacgaggctgaggctggagaggggggagagaattag

SEQ ID NO: 139595 - DNA, 159 bp, Artificial Sequence
  Description of Artificial Sequence: Synthetic coding sequence
atggacaaaaatgaattggtccaaaaggccaagctagcagaacaggccgaacggtacgacgacatggccgcttgcatgaaaagcgtaaccgagcagggcgctgaactctctaatgaggagagaaaccttctcagcgtggcctacaaaaatgtggtgtag

SEQ ID NO: 139596 - DNA, 1224 bp, Artificial Sequence
  Description of Artificial Sequence: Synthetic coding sequence
atgccaacgcccgacgccactacccctcaagccaaaggatttagacgcgcggtgagcgagctggacgctaaacaggcagaagccatcatggttcggggccagagcccgagattcattgggcgaaggcagtcgctgatcgaagatgcccgcaaagagagggaggccgccgtggccgccgctgccgccgccgtgccctctgagcccggcgacccgttggaagccgttgcctttgaggagaaagaagggaaggccgttctgaatcttctctttagccctcgcgccaccaagcccagtgccctctcacgagctgtcaaggtgtttgagacatttgaggccaagatccatcacctggagacacgccctgcccagcggccgagagctggtggtccacacctcgaatactttgtgcgcctggaagtgcggcggggcgatctggccgccctcctcagtggcgtccgccaggtgtcagaggacgtgaggagcccagcggggcctaaagtgccatggttccctcgtaaggtatcagaactcgacaagtgccaccatctcgtgactaaatttgatcccgacctcgatctcgaccatcctggatttagtgatcaggtctacaggcaacggaggaagctcatcgctgagattgcgttccagtataggcacggtgatcccattcctagggtcgaatacacggcagaagaaatagctacgtgggattgctgccacgagctcctgggccatgtgcctatgttagctgaccgcacctttgcccagttctcacaagatattggacttgcatccttaggggcttcagacgaagaaatagagaaactcagcaccctgtactggttcacagttgagttcgggctatgcaagcagaacggtgaggtaaaagcatacggggcaggactgctcagtagctacggcgaacttcttcattgcctgtcagaggagcccgagatccgtgcttttgaccccgaagctgccgccgtgcagccataccaggaccagacctaccagtccgtctacttcgttagtgagagtttctccgatgccaaagacaaactgcggagttatgctagtcgtatccagaggccattctcagtgaaattcgatccctatactctggctatcgatgtcctggatagccctcaggcagtgaggagaagtctggagggagtgcaagacgagctcgatacactggctcatgccctcagtgcaatcggctag

SEQ ID NO: 139597 - DNA, 1494 bp, Artificial Sequence
  Description of Artificial Sequence: Synthetic coding sequence
atgccgacacccgacgcaaccacaccccaggctaaggggttccggagagccgtttcggagctcgatgccaaacaggcagaagccatcatgtcaccgagatttattgggcggaggcagtccctgattgaagatgccagaaaagagagggaagctgcagtcgctgcagctgccgcagccgttccttcggaacccggagatcctttagaggctgtggcctttgaggagaaagagggtaaagccgtcctcaaccttctgttttccccaagggcaacaaagccctccgctctttctagagcagtgaaagtgttcgagacatttgaggctaagattcatcacctggaaacacggcctgcacagagaccacgagctggcgggccacatctggaatacttcgttcgcttagaggtgaggaggggtgatctggccgccctcttgtccggggtaagacaagtctccgaggacgtaagaagcccagccggtccaaaggtgccatggttccccagaaaggtgtcagagctcgataagtgccaccacttagtgaccaaattcgatcccgacctagaccttgatcatcccggcttcagtgatcaagtctaccgacagagaagaaaactgatcgccgagatagccttccagtaccggcatggggatcccatccctagagtggagtatactgccgaagaaatcgcaacatggaaagaagtgtacaccacgctgaagggcctttatgccacgcacgcatgcggtgagcacttggaggccttcgctctgctagaaagattttctggctatagggaagacaacatccctcagctcgaagatgtgagtcgctttctcaaagaaagaacaggatttcagctgagacctgtggccgggttgttaagcgcccgagatttcctcgcctctctggcttttcgagtattccagtgcacccagtatattaggcacgctagcagtcctatgcatagtccagaacccgactgctgccacgaactgcttggccacgtgcccatgctggcagaccgcacgttcgcacaattttctcaggatattggattggcttccctcggcgcttccgacgaggagatcgaaaagctctccacactgtattggttcactgtggagttcggcttatgtaaacaaaatggggaggtaaaggcctatggagccggactcctgtccagctacggagagcttctgcattgcttgtcggaagagcctgagatccgggcttttgacccagaagctgccgccgtacagccataccaggatcagacgtatcaaagcgtatatttcgtctccgaatcgttcagtgatgcgaaggacaagctccgctcctatgccagtcgcatccagaggccattttccgtgaagttcgatccctataccctggcaattgacgtcctcgatagcccccaggcggtcagacgatcccttgagggcgtgcaggatgagttggatacgctggcccacgctctaagcgcaattggctag

SEQ ID NO: 139598 - DNA, 1575 bp, Artificial Sequence
  Description of Artificial Sequence: Synthetic coding sequence
atgcccactcccgatgcaacgacacctcaggccaagggctttaggagagcagtgagcgagctggacgcaaagcaggctgaggctattatgggtgccccgggtccttctctgaccggcagcccctggcctgggaccgctgccccagctgcttcatacacaccaacaccacgcagtccccgctttatcggcaggcgtcagtccctcatagaagacgcaagaaaagagcgtgaggcagccgtcgccgcggccgccgccgccgttccgagcgagcccggcgaccctttggaagcagtcgcattcgaggagaaggaagggaaggcagtgttgaacctgctattctcccctagggctacaaaaccgtcagcgctgtcacgcgcggtgaaggtgtttgaaacattcgaagctaaaattcatcacctggaaacccggccggcccaaagaccacgggctggagggccacacctggaatacttcgttcgacttgaagtccgccggggcgacctcgctgctcttcttagcggggtccgccaggtgagtgaagatgtccggtccccagcaggacctaaagtgccctggttccccaggaaggtgtcagaactggacaagtgtcaccatctggtgactaaattcgaccccgatttagacctggatcatcccggatttagtgaccaagtgtataggcagaggcggaagcttatagctgagatcgcattccagtaccgacacggggaccctatcccacgcgttgaatacaccgccgaagagattgctacatggaaagaggtttatacaactctgaagggcctttacgctacacatgcctgcggtgaacacctggaagcttttgccctcctagaaaggttttccggatacagagaggataacatacctcagcttgaggatgttagtcgtttcctcaaggagagaacggggttccaactgcggcccgtggccgggctcctgagcgcgcgtgactttctggccagcctcgcttttcgagtgttccagtgcactcagtacattaggcacgcctccagtcctatgcattccccagagcccgattgctgccatgagctgcttggacatgtgcctatgctggccgacagaacctttgctcagtttagccaggacatcggactcgccagtctcggcgcctccgatgaagagatcgaaaagttatctacattgtactggtttaccgtagagtttggactctgcaagcaaaatggcgaagtcaaggcatatggagcaggactacttagttcctacggagagctacttcattgccttagcgaggagccggagatcagagcattcgaccccgaagctgcagccgtgcagccctaccaggatcagacctatcaatccgtctactttgtgagtgaaagcttttccgacgccaaagacaagctccgaagctatgctagtagaattcaacggcccttcagcgttaagtttgacccatatactttggctattgacgttttagactcccctcaggccgttaggcgctcactagagggtgtgcaggacgaactcgacactttagctcacgcactgagcgccatcggatag

SEQ ID NO: 139599 - DNA, 1587 bp, Artificial Sequence
  Description of Artificial Sequence: Synthetic coding sequence
atgcccacccccgatgctactacccctcaggctaaggggttccgtagggcggtctctgaactcgatgcgaaacaagctgaggcaataatggtgcgtggacagggggcgcccggcccctctctgaccggatcgccctggcctggaaccgcagcccccgcagcaagttatacaccaacacctcgttcgcccaggttcataggacgaagacagtctttaatagaggacgccaggaaggagcgagaagctgcagtcgcagccgctgctgccgcggttccctcagaacccggggatcctctcgaagctgtggcatttgaggaaaaggagggcaaggccgtgctgaacctgctgttctcacctagggctacaaaaccttccgccctttcacgagcagttaaagtcttcgagaccttcgaggctaagattcaccacctggaaactcgcccagcccagagaccccgggccggcggaccgcacctggaatactttgtcaggctggaagtaaggaggggtgatctggccgctttgttgtctggggtgcgccaagtctctgaggatgtccgcagtcccgccggtccaaaggtgccttggttccctaggaaagtgagtgagctggacaaatgccaccatttagtgactaaatttgatcccgatctcgacttagatcaccctggcttctctgaccaggtctatcggcaaagaagaaaactgattgccgaaatcgcattccagtataggcatggagatccaatcccccgcgtcgaatacactgccgaggaaattgccacgtggaaggaagtctatacgaccctgaaaggcctgtatgccacgcacgcttgtggcgagcatttggaggctttcgcacttctggagcggttcagcggctaccgggaagacaacattcctcagcttgaggacgtgtcacggtttttgaaggaaagaacaggctttcagctacgccccgtcgctgggttgttgagcgctcgggactttttggcctccttggcatttagggttttccaatgtacacagtacattagacacgcctcaagccccatgcatagccccgagccggactgctgccacgaactgcttggccacgtgcccatgttggccgacagaacattcgcccagttttcccaggacattgggcttgcttcacttggtgccagcgacgaggaaatcgaaaagctctccacattgtactggtttacagtagagttcggactttgcaagcaaaacggcgaggtcaaagcttacggggccgggctgttatcaagctacggcgagttacttcactgcctatctgaggagcctgagatacgcgcatttgatccagaggctgctgctgtccaaccatatcaggaccagacctaccagtctgtgtactttgtgagcgaaagcttctccgatgccaaagataaattacggagttacgcctcaaggatacagcggccatttagtgtaaaatttgacccctacaccctagccatcgatgtgctggactcaccccaggccgtgagaaggtccttagagggtgtacaggatgagctcgatacattggcccatgcattgtccgctattggatag

SEQ ID NO: 139600 - DNA, 3564 bp, Artificial Sequence
  Description of Artificial Sequence: Synthetic coding sequence
atgcctctaaggcattggggaatggctagagggagcaagccggtgggagacggcgcccaacccatggctgccatggggggtctgaaggtgctgctgcattgggcgggccctgggggcggggagccctgggtcacgttctccgagagttcgttaacggcagaggaagtttgtattcacattgctcacaaggtcgggataacacccccttgttttaatctctttgcactctttgatgcccaagctcaggtgtggctgccacccaaccatatcttggaaattcctagagacgcctcactgatgttgtacttcaggatcaggttttactttcgcaactggcacgggatgaatcctagggagcctgctgtttacaggtgtggcccgcctgggacagaagcttcctcagatcagacagcgcagggcatgcaactgctggatcccgcttcatttgaatacttattcgagcagggtaaacacgagtttgtgaatgatgttgctagcctgtgggaactcagcacggaagaagaaatccatcacttcaagaatgaaagtctcggcatggcattcctccacctgtgccacttggccttacggcatgggattccattggaagaagtcgccaagaaaacctcttttaaagactgcatccccagaagtttccgaaggcacattagacagcacagtgccttgaccaggctgcggttaaggaatgttttcaggcggtttctcagggatttccagcctggccgtctgtctcagcagatggtgatggtgaagtatctggcgactcttgaacgacttgctccgcgcttcggtaccgagagggttccagtgtgccatttgcgcctcctagcccaggctgagggtgagccatgttacatcagggattcaggggtagctccaacagaccctgggccggagagtgctgcagggccccccacacacgaggtgctagttacagggacaggggggatccaatggtggcctgtcgaagaagaggttaataaggaagagggatccagtggctctagtggtcggaacccccaggccagcttgtttggaaagaaagccaaggctcataaagcggttggtcagcctgctgaccggccacgcgagccactatgggcttatttctgcgacttcagagacatcacccacgtggtgctcaaggagcattgtgtgtctatacataggcaggataacaaatgcttagagctatcattaccttccagagccgccgctctgagcttcgttagcctggtggacgggtactttagacttaccgctgacagctcacattatctctgccatgaagtggccccacccaggctcgtgatgtcaataagagatggcatccacggcccgctcctcgaaccatttgtgcaggcaaagctcagacccgaggatggtttgtacctgattcactggtcgactagtcatccgtaccgcttgattttaaccgtggcccaacggtcacaggccccagacggaatgcaaagtcttagactccgaaagtttcccattgaacagcaggacggagcgttcgtcctggaaggatggggccgcagctttccttctgtgcgtgagctcggcgccgccttacagggctgcctgctgcgggccggcgacgattgcttttcactgaggcgctgttgtttgccacagccaggagaaacatccaatctgatcataatgcgtggggctcgggcgtcccctcgaaccctgaatttgagtcagctttcatttcatcgcgttgaccagaaggaaataacccagctcagtcatctgggacagggcacccggaccaacgtgtatgagggacggctcagggtcgaaggctctggtgacccagaggagggtaaaatggacgatgaggatccattggtcccaggacgcgacaggggccaggagctgagggtggtgctcaaggtgcttgacccctctcatcacgatatcgccttagccttttacgagaccgctagcctgatgagtcaagtcagccacacccaccttgcttttgtgcacggcgtctgtgtgagaggccctgagaacattatggtcacagaatatgtggagcacggtccgctagacgtgtggctccgcagagagaggggccacgtgcctatggcatggaaaatggtggttgcacagcagctggccagcgcactgtcatatttggaaaataaaaatttagtgcatggaaatgtttgcgggcgcaacatcctgcttgcacggcttggtctggccgaggggacctcacctttcattaaactgtctgaccccggagtggggctgggagctctgtcccgggaggaacgcgtcgagcgaattccatggctggctccagagtgcctccctgggggcgccaactcactaagcactgctatggataagtggggatttggcgctacgctcctggagatctgtttcgatggcgaagcccccctgcagagccgcagtccgtctgaaaaagagcacttttaccaaaggcagcataggctgcctgagccctcctgccctcagctcgccactctcacatcgcagtgcctaacgtacgaacctactcaacggccttcattcagaaccatccttagagacctgactaggctgcagccgcacaatcttgccgacgtactcacagtgaatccagattctcccgcctccgatcctaccgtgtttcacaagcgctacttaaaaaagattcgtgacctaggggagggtcactttgggaaggttagcctgtactgttacgatccaacaaatgacggtacgggagagatggtggcggttaaggccctgaaagcagattgtggcccacagcaccgctcaggatggaaacaggagattgatatcctgcggaccctctaccatgaacatattatcaagtataagggatgttgtgaggatcaaggggagaagagtctgcaactggtcatggaatacgttcctctaggctctctccgagactatcttcctcggcactcaatcggactcgcccagttgctcctgtttgctcaacagatctgcgagggcatggcctatctgcacgctcaacactatatccaccgagatctagctgccaggaatgtactgttagacaatgaccgccttgtgaagatcggggatttcggccttgctaaagctgtgcctgagggccatgaatactatagggttcgcgaagacggcgactctccagtgttctggtatgccccagaatgcttgaaggagtacaaattctactacgcctctgatgtctggtcattcggcgttacactttacgagctgcttacccattgtgattcttcacagtccccaccaaccaaattccttgaactcattggcattgcacaaggccagatgactgttttacgccttacagaactgctggagcggggggagagacttccacgccccgataaatgtccctgtgaagtttaccatttaatgaagaactgttgggaaaccgaagcctcttttagacctactttcgagaacctaataccaattctgaaaacagtgcacgaaaaataccaaggacaagccccttcggtcttctctgtgtgctag

SEQ ID NO: 139601 - DNA, 3564 bp, Artificial Sequence
  Description of Artificial Sequence: Synthetic coding sequence
atgcctctgagacactgggggatggcgcggggcagcaaacccgtgggggatggggcccagcccatggcagctatgggaggccttaaggtgcttctgcattgggctggccccggggggggagagccatgggtcactttcagtgaaagttcgctgacagccgaagaggtgtgcattcatatagcccacaaggtggggataacaccaccctgcttcaatctttttgctttatttgacgctcaagcgcaggtttggctgccccccaaccatatccttgaaattccgagggacgcctcacttatgctctatttccggatcaggttctattttaggaactggcacggtatgaatcctcgtgaacccgcggtttatcggtgcggaccccccggcacggaggcatcttcagaccaaactgctcagggcatgcagttgctagatccagcctcatttgaatacctgttcgaacagggcaagcacgaattcgttaatgacgtggcgagtctttgggaactgagtacagaagaggaaatccaccacttcaaaaacgagtcactgggaatggcattcctgcacttgtgtcatctggctttgcggcatggtattcctttggaagaggtagctaaaaagactagctttaaagactgcattcccaggtcgtttagacggcacatacgccagcatagcgcactcacacgtctgcgactgaggaatgtgtttcgcaggtttctgagagactttcaacctggtaggctgtcccaacagatggttatggtaaaatacttggcaaccctggagcgactggccccgagattcgggacggaaagagtgccggtgtgtcatctgaggctgctcgcgcaggccgaaggcgaaccctgttacatcagggactccggcgttgcgcccaccgacccgggccctgagagtgcagccggcccgcctacacatgaagtgcttgttaccggaacaggtggtattcaatggtggcctgtggaagaggaggttaataaagaagagggcagttctggctcaagcggccggaacccgcaagcaagtctgttcggtaagaaggcaaaagcccataaagccgttgggcaaccagcggatcggccacgcgaaccactttgggcatacttttgcgacttccgggacatcacacacgtggtactgaaagagcattgcgtcagtatccatcgccaggataataagtgtctggagctgagcctgccgagtagagcagctgctttgtcattcgtgtccctggtggatggctactttcgcctaactgctgatagctctcattacctgtgccacgaagtggctccccccagactggtgatgtccattcgagacggcatacatggacctctgcttgagccattcgttcaggccaagcttcgacctgaagatggactgtacctgatccactggtcaacatcgcacccctaccggctgatcttaacagtcgcccagaggtcccaggcccccgacggaatgcagagcctccgtctgcgcaagttcccaatcgaacaacaggacggcgcatttgtgctggagggttggggccgatcattcccgagtgtcagagagctcggcgcggccctgcagggctgtttacttagggccggcgacgattgtttctctcttcgcagatgttgcttaccgcagccgggcgagacatctaacctgataataatgcggggtgcccgcgcttcccctcgcacgctgaacctatctcagctctcgtttcacagggtggatcaaaaggagatcacccaactgtcacatcttggtcaggggacaaggaccaacgtgtacgaaggccggctgcgggtagaaggctcaggtgacccagaggagggaaaaatggacgatgaggaccccctggtgcctggccgcgacaggggccaagaactgcgggtggtgttaaaagtgctggatccttcccaccacgatatcgcactggctttctacgaaactgcaagtcttatgtctcaggtatcccatacacatctggcattcgttcacggtgtatgtgtacgcggaccagagaatattatggtgacagaatatgtggagcacggccctctcgacgtgtggctccggagagagaggggacacgttcccatggcctggaagatggttgtcgcccagcagctggcctcagctctgtcctacttagagaataagaatttggtgcacggcaacgtgtgtggccgcaatatactcttggcacggctgggtctggccgagggtacttctccctttattaaactgagtgaccccggggtgggtctgggtgccctgtcccgcgaggagcgggtggaaaggataccctggctggctcctgaatgcctgcccggcggggccaacagtctcagtaccgcaatggataaatggggtttcggagcgacattgctcgagatatgctttgacggcgaggcacctttacagagcaggagcccaagcgaaaaggaacatttctatcagcgccagcataggttaccagagccttcctgtcctcagctagctacactcacctcccagtgtttgacatatgagcccacccagcgtccctcatttcgaactatcctgagggacttaactagactccagccccacaatctggccgatgtgctcacagtgaatcccgactcccctgccagtgaccctactgtgttccataagcgctacctcaaaaaaatacgtgatttaggcgaagggcatttcgggaaagtgagtctgtactgttatgaccccacaaatgatggaactggggagatggttgccgtaaaagccctcaaggcagattgcggccctcagcataggagtggctggaaacaggagatcgacattctgaggaccctgtaccacgaacacattatcaagtataagggatgctgtgaagaccagggcgaaaaatcccttcagctggtgatggaatatgtcccgctgggttccttacgggattacctgcctagacattcaatcggcctagcccagctcctgttgttcgcgcagcagatttgtgagggaatggcatacttgcacgcacagcattatattcatagggatctcgcagctcgcaatgtactcctggacaacgacagattggtcaagattggagacttcggactcgccaaggccgtccccgagggccatgagtactatagggttcgcgaggacggcgactcgcctgtgttctggtacgctcctgaatgtctaaaggagtataaattctattatgccagcgatgtgtggagctttggggtgactctctacgagctcctgactcattgcgattcttcgcagagcccaccaactaagttcctggagctgatcggcatagcccagggacagatgacggtcctcagacttacagagttgctcgaacgtggggaacgacttccgaggcctgataagtgcccttgcgaagtgtaccacctgatgaaaaactgttgggagaccgaggcatcttttcgtcctactttcgagaacctgatccctatccttaagaccgtacacgagaaataccagggacaagcaccatccgtgtttagtgtatgctag

SEQ ID NO: 139602 - DNA, 357 bp, Artificial Sequence
  Description of Artificial Sequence: Synthetic coding sequence
atgccccttagacactggggcatggcgagaggcagtaagccagtcggtgatggcgcgcaacccatggccgctatgggcggacttaaagtgttgctgcactgggctggccccgggggaggcgaaccctgggttacattcagcgagtccagcctaaccgcagaggaggtgtgcattcatattgctcacaaggtggggattacaccgccctgcttcaatttgtttgccttatttgacgcccaggcacaggtgtggctgccccctaaccacattctggaaattcctcgcgatgccagcctgatgctgtactttcggatacggttctacttcaggaactggcacggaatgaatccgaggtag

SEQ ID NO: 139603 - DNA, 2805 bp, Artificial Sequence
  Description of Artificial Sequence: Synthetic coding sequence
atggttatggtgaaatacctcgccacccttgagcgactcgccccaagatttggcaccgagcgagtgcctgtctgccacctccggctgctcgcccaggcagagggcgagccctgctatatacgagattctggcgtggccccaaccgaccccggcccagaaagcgcagctggtccgcccactcatgaagtgctggtaacgggcacaggcgggatacaatggtggcccgtcgaagaggaagtaaacaaggaggagggctcttccggctcatccggtaggaacccccaggcctcccttttcgggaagaaagcgaaggcacataaggcggtgggccagcctgcagaccggcctagagagcccctttgggcttatttttgcgattttcgggatattacccacgttgtattaaaggagcactgtgtttctatccatcgccaagataacaagtgcttagagctcagtctaccatctcgggctgctgcgctttcatttgtgtccctggtggatggctacttcagattgaccgcagacagtagtcattatctctgccatgaagtggctccaccaaggctggtcatgtctatccgggacggaattcatggtcctttactagagccattcgtgcaagctaagcttagacccgaggatggcctgtacctgattcattggtcaacctcacatccctatagattgattcttaccgtggcccaacggtcccaggccccagatggcatgcaatcactccgcctccgtaaattccccattgagcagcaagatggcgccttcgtgctagaggggtggggaagaagcttcccctctgtaagagagttaggagccgcactccaaggatgtcttcttagagccggcgatgattgcttcagcttgcgacgttgctgcctgccccaacccggagagacgagtaaccttataatcatgcgaggagcgcgagccagccctagaacgttaaacctgagccagctgagctttcaccgcgtagatcagaaggagatcacacagctgtcccacctcggtcagggaaccaggacaaatgtgtatgaaggacggcttcgtgtggaggggtcgggcgatccggaagagggaaaaatggatgacgaagaccccctcgtaccaggcagagatcgcgggcaggagctgagggtggtccttaaagtactggatccaagccatcacgatatcgccctggctttctatgaaacagctagcttaatgagccaggtgagtcatacccacctggcattcgtccacggcgtgtgcgtcagagggcctgaaaatatcatggtgaccgagtacgtggagcacggacccttggacgtgtggctgcgcagggagaggggccacgtccctatggcctggaagatggtcgtggcccagcagctggcctcggccctctcataccttgaaaacaaaaacctggtgcatggaaacgtgtgtggtaggaatattttgctagccagattaggcctcgccgaaggaacatccccgtttattaaactgtccgatcccggtgtgggactgggggctcttagtcgtgaggagcgagttgagcgcataccctggttagcaccagagtgcctccctggtggcgcaaactccctatcaacggcaatggataagtggggctttggggctaccctcctggaaatctgttttgacggagaggctcccttgcagtcccgatccccctcagaaaaggagcacttttatcagaggcaacacaggctgcctgagccgagctgcccgcagctcgcgaccctcaccagccagtgtctgacttatgaacctactcagagaccaagctttagaacaatactaagggacctaaccagactccagcctcacaatcttgctgacgtgcttaccgtcaatcccgattcacctgcgtcggaccctaccgtgttccacaagagatacttgaaaaaaatccgcgatctgggtgagggccactttggcaaagtttccctgtattgttatgacccaaccaacgacggaaccggcgaaatggttgctgttaaagctctcaaggcagactgcggcccccagcatcgatcgggttggaaacaggagatcgacatactacggaccctgtatcacgaacacataatcaagtacaaaggttgctgcgaagaccagggggaaaaatcactccagctggttatggaatatgtcccgcttggatcccttcgggactacctccccagacatagcattggtctggctcagctcctgctcttcgctcagcagatctgtgaaggtatggcatatctgcatgcccagcactacatacaccgtgatttagctgccaggaacgtactgctcgataacgaccggctcgtgaagattggggactttggactagctaaggccgtgccggaggggcacgagtactaccgggtacgcgaagatggggactctcccgtgttttggtacgcgcctgagtgcctgaaggagtacaaattttattacgcttccgacgtctggtcattcggcgtaacactctacgaactgctcactcattgtgacagttcccaatcccctcctacaaagttcctcgagctcatcggcatagcccaagggcaaatgaccgtcttaagacttactgagcttctcgaaagaggagagcggctgccccgacctgacaagtgcccctgcgaggtgtatcacctgatgaagaactgctgggaaacagaggcaagctttcgccctaccttcgaaaacctgattcctatcctcaaaacagtacacgaaaagtaccagggacaggccccgtccgttttttctgtgtgttag

SEQ ID NO: 139604 - DNA, 1986 bp, Artificial Sequence
  Description of Artificial Sequence: Synthetic coding sequence
atgttacccgaggctggatctctatggctgctgaagctcctgagagacatacagctggctcagttctactggcccattcttgaagaactgaatgtgacacgccctgagcactttgactttgtcaagcctgaagatctggacgggattggaatgggaaggcccgctcagaggaggttgagcgaagccctgaagcgcttgagaagtggtcccaagtcgaaaaactgggtgtataagatactagggggttttgcaccagaacacaaggaaccaacactgcccagcgacagccccaggcacctgcctgagccagagggcggattgaagtgtttaatcccagagggagctgtctgcaggggcgaacttctcggctctggttgtttcggggtggtccaccgtggtctttggactctcccctcaggcaagagtgtccctgtggcagtaaagagtcttagggtcggacctgaaggtcccatgggaactgagctaggcgacttcctgcgagaggtgagcgtgatgatgaatctggaacatccccatgtgctccgtttgcatggcctggtgcttggccaaccactgcaaatggtcatggaactggccccactgggtagcctccacgcgagactcacagcccctgccccaacaccgccactcctggtggccctgctctgtttatttctgcgccagctcgctggagctatggcatacctgggggcccgcggtcttgtccacagggacctggccactaggaatttactgctagcgtctccaagaacaatcaaagtcgctgacttcggtctggtacggcctctaggtggggcacgtggcaggtacgtcatgggcggcccgagacccattccttacgcgtggtgtgcaccagagtctctacgacacggcgctttctcctccgcatccgacgtgtggatgtttggtgtcacactctgggagatgttctctggcggggaggagccctgggctggtgtaccaccatacctgattctacaaagactcgaggaccgagcccgcctaccccgccctcctctctgcagccgagcgctgtacagccttgcccttcgctgctgggccccacaccccgctgatcgtccatccttttcccacctggaggggctgctgcaagaggccggcccttctgaggcttgctgtgttagggatgttaccgagcctggcgctctccggatggagacgggcgatcccatcacggtaatcgagggatccccagattcaaccatctggaaaggccagaatggccggactttcaaagtaggctcttttccagccagcgctgtgaccctggccgatgccggcggacttcccgctacccgacctgtccaccgcggcactcccgccaggggggatcagcatcccggcagtatcgacggagaccgaaagaaagccaacttatgggacgctccgcctgcacgcggtcaaagaagaaacatgccccttgagagaatgaaagggatatcccgcagcctagaatcggtcctctctctcggaccccgtccaacaggcgggggctcttcccccccagagatcagacaagccagggccgtcccccagggccccccaggactgccccccagacccccgttatcctcctccagccctcagccaagtcagccgagtcgcgaaagactcccatggcccaaacgcaagccacctcataaccacccaatgggaatgccgggcgcacgcaaagccgccgctttgtccggcggactactgtccgaccccgagctgcagagaaagatcatggaggtggagctcagcgtccacggggtgacccatcaggagtgccaaacagccctcggtgcgaccggaggagatgtcgtgagtgcaattagaaatctgaaggtggaccagctgtttcacctctctagccgtagtcgcgctgactgctggcggattttggagcattaccagtgggatttgtccgctgcaagcagatatgtgcttgctaggccatag

SEQ ID NO: 139605 - DNA, 1986 bp, Artificial Sequence
  Description of Artificial Sequence: Synthetic coding sequence
atgctgccagaggccggatctttatggcttctgaaactgctccgggacatccagctggcacaattttattggcccatcctggaagagctcaatgtgacaaggcctgaacattttgattttgtaaagccagaggacctggacggcatcggaatgggccgaccagcccagagacgcttatctgaagcactcaagaggcttcgaagcggacctaaatcaaagaactgggtttacaagattctggggggttttgccccagagcacaaggaaccaaccctgccctccgactccccacgccatctgccagagccagagggagggttgaagtgtctgatccccgagggcgcagtgtgccgtggcgaactccttggaagcggctgctttggagtggttcaccggggcttgtggactctgccttccggaaagagcgtccccgttgccgtgaagagcttgcgagtgggccctgagggacccatgggcacggaactgggggacttcctacgggaggtgtctgtgatgatgaaccttgagcacccccacgtccttcgtctgcacggtttggttctgggtcagccactgcagatggtcatggagctcgctcccctcggtagcctccacgccaggctgacagcgcctgcccccacgccgccattgctggttgcactcctttgcttgtttctacgccaacttgcaggggcgatggcatatcttggggccaggggtctggtgcatagggacctggccacacggaaccttttgctcgccagtccgcggacaatcaaagtggccgatttcggactagtcaggcctttgggtggggcccggggcaggtacgtaatgggaggtcctcgccccatcccatacgcttggtgtgcaccagaatccctgcgacatggagcctttagcagtgcttctgatgtatggatgttcggggtgacgctatgggaaatgtttagtggtggggaggagccctgggccggagtgcccccatatctgattctgcaacgcctggaggaccgcgctcgattaccccgtcctcctctgtgttccagggcgctgtattcgctcgcgctccgttgttgggctccccatcccgctgaccgaccttcatttagtcacctggaaggactcctgcaggaggcgggcccatccgaagcctgttgcgtccgtgacgtgaccgagcctggtgctcttagaatggagaccggtgacccaattactgtgatcgagggtagcccagactccactatctggaagggccaaaatgggagaacttttaaagtggggtccttccccgctagcgccgtgacactggccgatgctggtgggctgccagccaccaggccagttcaccggggaacaccagccaggggcgatcagcaccccggtagtatcgatggggatcggaaaaaagccaacctttgggacgctccgcctgcacggggacagcgtcggaatatgccactggagcgcatgaagggcatcagcaggagcctggagagcgttctgagtctcggacctcgacctactggcggagggtcgagtccacccgaaatcagacaggcgcgggcagtacctcagggcccacccggactgcctccgagaccacccttgtcatccagtagtccccagccgtcgcagccatcgcgagaacgcctaccgtggccaaagcgtaaacccccccataatcatccaatgggaatgcccggtgcacgaaaagccgctgcactgagcggtggattactttctgaccccgagttgcagcgaaagataatggaagtagagctttccgttcacggagtcacgcatcaggagtgtcagaccgccttaggcgccacgggtggagacgtggtgagcgccattaggaatctaaaggttgaccagctgtttcacttgagtagcagatcacgggctgattgttggcgcatcctggagcattatcagtgggatttatccgccgcttcccggtacgtgttagcaagaccctag

SEQ ID NO: 139606 - DNA, 1587 bp, Artificial Sequence
  Description of Artificial Sequence: Synthetic coding sequence
atgcagcctgaggaaggcaccggatggcttctggagctcctgtccgaggtgcaacttcagcagtacttcctccggctcagggacgaccttaacgttacaagactatctcacttcgagtacgtgaagaacgaagatctcgagaaaattggcatgggtcgaccgggacagaggcggctttgggaagccgtaaaacgtcgtaaggccctgtgcaagaggaagagttggatgtctaaggtgttcagcggcaaacgccttgaggcggaattccctccacatcacagtcagagtacatttcggaagactagccccgccccaggtggcccagctggagagggacccttgcagagtctaacctgcctgatcggggagaaggacttaagactattggaaaaactgggcgatggctctttcggtgttgtgaggcggggggaatgggatgccccctcaggaaagacagtgagcgtggccgtcaaatgtcttaagcctgacgtactttctcagcctgaagcgatggatgactttattcgggaggttaatgcgatgcatagtctggatcacaggaacttgatccgcctttacggagtggtgctgacaccccctatgaagatggttactgagctggctccccttggctccctgttagatcgtttgcgcaaacatcagggacacttcctgctcggtaccctctcaaggtatgcagtgcaggtcgcagaggggatggggtacctcgagagcaagcgatttattcaccgggacctcgcagcccgaaacctgcttctggctactcgcgatctggtaaagattggtgatttcggcctcatgcgggccttaccacagaacgacgatcattatgtcatgcaggaacatcgcaaggtgccgtttgcctggtgcgctcccgagagcttaaagactcgcaccttcagccatgcatctgacacatggatgtttggtgtcaccctgtgggagatgttcacctacggacaggaaccttggataggtctgaatggctcccagatccttcacaagatcgacaaggagggtgagaggcttccgagaccagaagattgtcctcaagatatttataacgtgatggtccagtgctgggcacataaacccgaagatcgccctaccttcgtggccttgcgggattttctcctggaagcacagcctacggacatgcgcgcactccaggactttgaggaacctgataagctgcacatccagatgaacgatgttattaccgttattgaaggcagggcagaaaactactggtggcgcggacagaatacgaggactctttgtgtgggacccttccctcggaacgtggtcacttctgtggcgggcctatctgcccaggatatatctcagccgctgcaaaacagcttcatccacacaggccacggagacagcgacccaaggcattgttggggctttccagaccgtatcgatgaatgccccttcagcgcctttagtcccggacatcccccggccgagacgtgcgggcaggtcctctggacaggccggcgggaggcatgtgcatctgatccacggttacaccctgtgtcaagccgcacaaaagggctctag

SEQ ID NO: 139607 - DNA, 3117 bp, Artificial Sequence
  Description of Artificial Sequence: Synthetic coding sequence
atgcaacccgaggaggggacagggtggctgttagagctcctcagcgaagtgcaattacagcagtatttcctccggctgcgagacgatttaaacgtcactcgcctgtcgcattttgaatatgtgaagaacgaggatctggagaagattgggatgggacggcctggccagcgtcgcctgtgggaggctgtcaagcggcgtaaggccctgtgtaagaggaagagttggatgtcaaaggtgtttagcggcaaacgactggaggcggaattccctccacaccacagccagagcacctttcggaaaacctccccggctccgggcgggcctgcaggggaggggccactgcagagtctgacctgccttatcggagagaaggatcttcgattgttagaaaagctgggagacggcagctttggcgtcgttagacgtggggagtgggatgccccctctggcaagacagtgtccgtggccgtcaaatgtctgaaacccgatgtactctctcagccagaggccatggatgacttcattcgggaggtgaatgcaatgcacagtctggatcatcgcaacctgatccggctctatggagtcgtcctgactcctccaatgaagatggtgactgagctggcacctttgggcagtcttctagacagactccggaagcatcagggccacttcttgctcgggactctatctaggtacgccgtgcaggtcgccgaggggatgggttacctggaatccaagagatttatccaccgcgatctggcagcccggaacctgctgctggctacacgcgatttggtgaagatcggtgatttcggtctgatgagggccctaccacagaatgacgaccactacgtcatgcaggaacatcgaaaggtcccgtttgcctggtgcgcccccgaatcactgaagactcgaacattcagtcacgcatccgatacctggatgttcggcgttacgctgtgggagatgtttacatacggtcaagagccatggatcggcttgaatggctcccagattctgcacaagattgacaaggagggcgagcgtctgccgcgacccgaagactgtcctcaggacatttacaacgtgatggtgcagtgctgggctcataaaccggaggatcgacctaccttcgtcgctcttagagactttctcctggaagcccaacctaccgatatgcgtgcactccaagatttcgaagagccggataagctacacatacagatgaatgatgtgataactgtcatagagggcagagcggagaactactggtggcgaggccaaaacaccagaacactgtgtgtgggcccatttccaagaaacgtggtaaccagtgtagccggcctatcagcccaggatataagtcagccactgcagaactccttcatacacaccggtcatggagacagcgaccctcgtcattgctggggattcccagatcgcattgacgaactgtatctgggaaaccccatggatccacctgatttgttgagcgtggagctttcaacttctcgccccccacaacacctggggggtgtgaagaagccaacatacgatccagtcagtgaagatcaagatcctctgagcagtgactttaaacggctcggcctcaggaagccgggattaccccggggcttatggctggctaagccaagcgctagggtgccaggaacgaaggcatcccgcggatcaggcgccgaagtgacactgattgacttcggagaagagccagtggtaccggcactgcggccctgcgccccatctctcgcacaactggctatggatgcctgttctctgctggatgagactccgccccagagtcccacaagggccctacctcgcccactgcatcccaccccagtggtagattgggatgccagacccctgcctcccccgcctgcttacgatgacgtggcacaagacgaagatgatttcgaaatctgtagcatcaatagcactctcgtaggtgcaggcgttccagccggtccaagccagggacagaccaactatgcttttgtccccgagcaggcacgtcctccgccccctctggaagacaatctgttcctgccaccgcaagggggcgggaaacccccgagttcagctcagacggccgagatattccaggctctgcagcaggagtgtatgcgacagttgcaagctccggccgggtctccagcgccaagcccaagtccaggaggggacgacaaaccccaagttcctcctcgagtccccattccacctagacctactcggccacatgttcagctgagccccgctccgccaggcgaagaagaaacatcccagtggcctgggcctgcaagcccaccaagagtgccacctagggagccactttctcctcaaggatctaggaccccctcgcctctggtccctcccggctcctcaccactgccccccagactgagtagtagtcccggaaagactatgccaacaacacagtctttcgcctcagaccctaaatatgccacgccacaagttattcaggcgcctggccctcgggctggcccctgtatactgccaattgtgagagacggcaagaaggtgtcctcaacccattactacctcctgcctgagaggcctagctatctagagagatatcagagatttttaagagaggctcagagtcctgaggagccaacaccactgcctgtccctctgcttctgcctccgccctctacccccgcccccgcagctccaacggcaaccgtgcgccctatgcctcaggctgcactggatcctaaggccaacttctccaccaacaatagcaaccccggcgcacggccgccccctcccagagcgaccgccaggttaccacagaggggctgtcctggggacggcccagaggcgggaagacccgcagataagattcaaatggcaatggtccacggtgtgaccacggaggagtgccaagctgcactacagtgtcacgggtggtcagtgcagcgggctgctcagtacctaaaagttgagcagctgttcgggctgggactcagaccacggggcgagtgtcataaagtgttggagatgtttgactggaatctggagcaggccggatgtcacttattgggaagctggggtcctgcacaccacaagcgatag

SEQ ID NO: 139608 - DNA, 3261 bp, Artificial Sequence
  Description of Artificial Sequence: Synthetic coding sequence
atgctggaggcccggccaccgcgcacccagggatcagatgctgccggcgcggctgcagggcgaggccttcgcgcattactgttaagcctgaccgcggcagcaggcatatggggatctatgggcgagagaagcgcttaccaacggctggctggcggagaggaagggccccagcgcctcggcggcgggaggatgcagcccgaggagggcactgggtggttgctggaactcttatcagaggtgcagctgcagcagtatttcctcaggcttagagacgacctcaatgttacacggttgtcacatttcgagtatgtaaagaatgaagaccttgagaaaatcggcatgggtaggccgggccagagacggctgtgggaggccgtcaagagacgaaaggccctgtgcaagagaaaaagttggatgtccaaagttttttccgggaaaagactcgaggcagagtttccgccgcatcactcacagtctacctttaggaaaacaagcccagcgccaggcggtccagcgggcgaagggcctctacagtccctaacctgcctcattggggagaaggacttacgccttctcgagaaactcggagacggaagctttggcgttgttaggcgcggtgagtgggatgcaccaagcggcaaaactgtctcggttgcagttaagtgcctcaagcctgatgtgctctcccagccggaggctatggacgattttattcgcgaggtcaacgctatgcacagtctggaccacagaaatcttattcgtctatacggggtggtcttgaccccacccatgaaaatggtgacagagttagctcctttgggaagtctcctggaccgattaagaaagcaccaagggcactttctgcttgggacactttccagatatgccgttcaggtggctgagggcatgggctatctcgagtctaagcggttcatccatagggacctggcggcaagaaacctgctgctggctacacgggacctcgtcaagattggcgacttcggtctgatgcgagcactaccccagaacgatgaccattatgtgatgcaggagcatcgaaaggtgccatttgcctggtgtgctcccgaaagcttgaaaacaaggacgttttcacacgcatctgacacctggatgtttggagttacactttgggaaatgttcacatacggccaggagccctggattggcttgaatggctctcagattctccataaaatcgacaaggagggcgagaggctgccaagacccgaggattgcccccaggatatctacaatgtgatggttcagtgctgggcgcataaacctgaggatcgacccaccttcgttgctctgcgagacttcctcctggaagcacaaccaactgatatgagagccctccaggatttcgaagagcccgataagttgcacatccagatgaatgatgtcatcaccgtaattgagggtagagctgaaaactattggtggcggggacagaacactcggacactatgcgtagggccatttccgcggaatgtcgtcacatcagtagcggggctttcagcacaagacatatcgcagccgctgcagaactctttcatccacactgggcatggcgattccgatccacgccactgttggggattcccagacaggattgatgagctctacctcgggaacccgatggatccacccgacttattatctgtagagctcagcacttccaggccaccgcaacacttagggggcgtgaagagggaaccgcccccacggcctccccagcccgccttcttcacgcaaaagccaacctacgacccggtgtccgaagaccaagacccactgagctctgactttaaaaggctggggctgcgcaagccagggctgccgaggggattatggttggccaagcctagtgccagagtgcctggaaccaaggctagccggggttccggcgcggaggtgacactgattgacttcggtgaagagcccgtggtacctgcactgcggccatgcgccccgagtctggcccagctggctatggatgcctgttcgctgctggacgaaacaccaccacaaagccctacacgggcccttcccagacccctgcaccccacgccagtagtcgattgggacgcccgccccctgcccccccctcccgcttacgacgatgtcgcgcaagatgaagatgactttgagatctgttccatcaactctaccctggttggagcaggagtccccgccggacccagccaggggcaaactaactatgcattcgtacctgaacaggcccgtcccccaccccccctggaagataatctatttctgccaccccagggcggtgggaaacccccctcatcggcccagacggccgagattttccaagctctgcagcaggaatgcatgaggcagctgcaggcacctgccgggtcaccggcaccgtccccaagcccggggggcgacgataaaccacaggtgccgccccgggtgcccattccccctagaccaaccagaccacatgtgcagttgtccccggctccgccaggggaggaggagacatcgcagtggcccggccccgccagccctccccgagtgccccctagagaaccattgtccccccaggggagtagaaccccatccccactggtcccacccggatcgtctccactgccgcctcggctctccagcagtcctgggaaaaccatgcccacgacccagtcctttgccagcgatcctaagtacgccacccctcaggttatacaagccccaggcccccgtgctggaccctgcattctgcctattgtgcgggacggtaagaaggttagcagcactcattactacctactgcctgagagaccctcctacctagagcgctaccaacgcttccttagagaagctcagagtcctgaggaacccactcctctccctgttccactgctcttaccgccacccagcacgccagcaccagccgcaccgacagccaccgtgcggccaatgcctcaggctgcgttggaccctaaagctaacttttctaccaacaattcaaaccccggggcccgcccaccacccccacgtgctactgcccgcctgccccaaagaggttgccctggcgatgggcctgaagccggaaggcctgccgataagatccagatggtggagcagctgttcggcctgggtctccggcctaggggcgagtgtcacaaagtcctggagatgtttgactggaacctcgaacaggcaggatgccatctgttgggctcctgggggcccgcccaccataagcgatag

SEQ ID NO: 139609 - DNA, 3117 bp, Artificial Sequence
  Description of Artificial Sequence: Synthetic coding sequence
atgcaacccgaggagggaactggctggctcctagagctcctgagcgaagtgcagctgcagcaatacttcctcaggctaagagacgaccttaatgtgacccggttgagtcactttgagtatgtgaagaatgaggatcttgaaaagatcgggatgggtagacccgggcaaagacggctttgggaggcggtgaaacgccggaaggccctttgtaagcggaaatcttggatgtccaaagtcttttcaggtaaacggttggaagccgagtttcctccccatcatagccaaagtacttttagaaagacctctcctgcgcccggcggccctgcaggggagggtcctttacagtctctgacctgcctaatcggtgagaaggacctgcgcctgctggaaaagctgggcgatgggtctttcggcgttgtcagacgcggcgagtgggatgccccatctggaaagacagtttctgtggccgtcaagtgtttgaagcccgatgttctgtcccagcctgaggccatggatgactttattcgggaggtgaatgccatgcatagcctggatcatcgtaacctcattagactgtacggcgtcgtattgacaccccccatgaaaatggtaactgaattggctccactaggttcactcttagatcgtttgaggaagcatcagggacacttcctgctcgggaccctcagccggtacgctgtccaggtggctgagggaatgggataccttgagagcaagaggttcatccatagagacctcgccgctcgcaatctgctcctggcaactcgtgacctggttaagattggcgacttcgggctcatgcgggctctgcctcagaatgatgatcactatgttatgcaggagcacaggaaggttccatttgcgtggtgcgcccccgaatccctgaaaacgagaacctttagtcatgccagcgacacctggatgtttggcgtcacactgtgggaaatgttcacatatggacaggaaccatggatcggccttaatggatcccagattctgcataagattgataaagagggcgagcggcttcccaggcccgaggactgcccacaggacatctacaatgtcatggtgcagtgttgggctcataaaccagaggaccgccccacattcgttgctctcagagatttcttactggaggctcagccaaccgatatgcgcgccctccaagactttgaagaacccgataagctccacatccaaatgaacgacgtaatcaccgttattgagggacgtgctgagaattattggtggcggggccagaacacccgaacactctgcgtgggcccatttccccgcaacgtcgtgacctccgtggccggactatctgcacaggatattagtcagcccctccagaattcctttatccacacggggcacggtgattcagatccaagacactgctggggctttccagatcggatcgacgagctatacctaggtaacccgatggacccccctgacctactctcggtagagctgtctacatctcgccccccacaacatctgggcggagtgaagaagcctacttatgatcccgtctctgaagaccaagatcccctgagtagcgatttcaaacgattaggcctgagaaagcccggcctaccacgcggcctgtggctcgctaagccatctgccagagtgcctggaacaaaagcgtctcgggggagtggagcagaggtcacactgatcgacttcggcgaggaacccgttgtccctgccctgaggccttgtgccccatccctggctcagctcgctatggacgcttgcagcctcctggacgagacccccccacagtcaccaacccgcgcactgccgcgtccgcttcatccaacacccgtggtggattgggacgcccggcccctcccacctccacctgcctacgacgacgttgcacaggacgaagacgacttcgagatttgttctatcaactcgactctcgttggagcgggcgtcccagctggccccagtcagggccagaccaactatgcatttgtcccggagcaggccagaccccctcccccactggaagacaatctcttcctgccgccccagggggggggaaagcccccatcaagtgcccagacggcggaaatcttccaggccctgcagcaggaatgcatgaggcagttgcaagctccggcagggagccccgccccctccccaagccccggtggagatgataaaccccaagtcccaccacgagttcccatccctcctaggccaacaaggcctcacgtgcaactgtcccctgccccccccggtgaagaagagacaagtcagtggccagggcccgcaagcccccctagagtcccccctcgcgaacccctgtccccccagggaagccgaacaccctcccctttagtccctcctggtagtagccctctgcctcccagattatctagcagtcctggaaagactatgcccacaacccagtcttttgcaagcgaccctaaatatgcaacgccacaggttatccaagctcctggccccagggctgggccctgcattctgcccatcgtgagggacggtaaaaaagtctcgtccacgcactactacctgctgcccgagcgcccaagctacctggaacgctaccagaggtttcttagagaggcgcagtcacctgaagaacctacaccactgccagtcccgctcttgttgcccccgccttccactcctgcccctgccgctcccaccgccactgtacgacctatgcctcaagccgcccttgatcctaaggccaatttctcaacaaacaactctaatcctggggctaggccaccccccccgcgggccactgccaggttaccacagcgggggtgtcctggggatggccccgaagcaggccggccggccgataagattcagatggccatggtgcatggggtaacaacagaggagtgccaagcagccttacagtgtcacgggtggagtgtgcagagagccgcccagtacctaaaggttgagcagttgtttggcctgggcctacgaccaaggggagagtgccacaaggtgctcgagatgttcgactggaatttagaacaggcaggctgccatctgctcggctcttgggggccagcacatcataagcgatag

SEQ ID NO: 139610 - DNA, 294 bp, Artificial Sequence
  Description of Artificial Sequence: Synthetic coding sequence
atgcaacctgaggaggggacaggatggctcctggagctgctgtctgaggtccagttacagcagtatttcctgaggttgagagatgacttaaacgtaacgcgactgtcacatttcgagtacgttaagaatgaagacctcgagaagataggaatgggcagacctgggcagcggcgcttatgggaggccgtcaagagaagaaaggccctgtgcaagaggaaatcttggatgagcaaggtgttttcgggcaaaaggctggaagcagagttccccccgcatcactcacagagtacttag

SEQ ID NO: 139611 - DNA, 1827 bp, Artificial Sequence
  Description of Artificial Sequence: Synthetic coding sequence
atgtcacaggaaggagactatggacgctggacaatttcctcttccgacgagagcgaagaggaaaagccgaagcctgacaaaccctccaccagctcgctgctgtgcgcgcgccaaggcgccgccaacgagccgagatatacatgtagcgaggcccaaaaagccgcccacaaacgtaagatatctccagttaagttttcaaacacggactctgtgctgcctcctaaaagacaaaaaagcgggagtcaggaagacttgggctggtgcctttcttcctcggatgatgaactccagcctgaaatgcctcagaagcaagctgagaaggtcgtcatcaaaaaggaaaaagacattagcgcgcccaatgatggtaccgcccagcgtacagaaaatcatggcgccccggcatgtcacaggcttaaagaagaggaggatgaatacgaaacttccggtgagggacaggatatatgggacatgctggataaaggcaatccattccaattttacctcactcgggtatctggagtgaagcctaagtacaattctggagccctccatattaaggacatcctgagtccactttttgggacattggtgtcaagcgcccaatttaactactgctttgacgtggattggctggtcaagcagtaccccccggagtttaggaagaaacctattctgctggtgcacggcgataaacgggaagcgaaggctcacctccatgcccaggccaagccttatgagaatatcagcctttgtcaagccaaactggacattgcctttgggactcatcacacaaagatgatgctactactgtacgaggagggactccgcgtagtgatccataccagtaatctcattcacgcggattggcaccagaaaacccaggggatctggctcagtccattataccccagaatcgcagacggcacgcataagtctggtgagagcccaactcattttaaagctgacttaatatcctacctcatggcctacaacgccccaagccttaaggaatggatagacgtgatccacaaacatgacctgagcgaaaccaatgtttatctgattggcagtactccaggccggttccagggcagccagaaagacaattggggacactttcgcctcaagaagctattaaaggaccacgcttcaagcatgcccaacgccgagtcttggccagtggtgggtcagttctccagcgtggggagccttggggccgatgagtccaaatggttatgttccgagtttaaggagagtatgctgacacttggtaaggaatctaagacccctggaaagtcctcagtcccactgtatttgatctaccctagcgttgaaaatgtaagaacgagtctggaaggctaccctgccggtggatctctcccatattccatccaaacagcggaaaaacagaactggctgcattcgtattttcacaagtggtcagctgagacttcagggcggagcaacgcaatgccccacattaagacctatatgaggcccagcccagacttctccaagatcgcatggttcttagtgaccagcgcgaatctgtcaaaggctgcatggggagcgctggagaaaaatggaacgcaattgatgattaggagttatgaactgggagttctcttcttgccctcagcttttggacttgactccttcaaagtaaagcagaagtttttcgctggttctcaggaacctatggcaacctttccagtcccctatgatctccccccagagctttacggatcaaaagataggccgtggatctggaacattccatatgtgaaagctcccgacacccacggaaacatgtgggtgccctcatag

SEQ ID NO: 139612 - DNA, 1110 bp, Artificial Sequence
  Description of Artificial Sequence: Synthetic coding sequence
atggtgatcagcgagagactgcgcttgactagtatgccgcggccttctctgacaagaactagcctcagcgccagaaagatgatgctcctcctttacgaggaaggtctcagggtggtcattcacacttctaacctgattcacgccgactggcaccagaagacccagggcatctggttgagcccactctaccccagaatcgcagacgggacccacaagagtggtgaatcaccaacacacttcaaggcggatctgatttcctatctgatggcctacaacgccccttctctgaaagagtggattgacgtgatacataagcatgacctgtctgagacaaacgtgtacctgatcgggtccacacctgggcggtttcagggtagccagaaggataactggggtcacttccgcctgaaaaaactgctgaaggatcacgccagcagcatgcccaacgctgaatcttggcccgttgtcggtcagttcagctctgtcggcagtctaggggcagacgaaagcaagtggctgtgctctgagttcaaagaatcaatgttaaccctggggaaagagagtaaaacacccgggaaaagcagcgtcccattgtatctgatatatcccagcgtggaaaacgtccggacttctctggaggggtatccagctggggggagccttccatacagtattcagactgccgaaaagcagaattggctgcacagttatttccataagtggtcggccgaaaccagtggaaggtccaacgctatgcctcacatcaaaacctacatgcggcccagcccagacttctctaagatcgcctggtttttggttacttcagcgaacctttctaaggccgcctggggcgccctcgagaagaacgggacacagctgatgatcagaagctacgagctgggggtcctctttttacccagtgcattcggtctcgacagtttcaaggtcaaacagaaatttttcgcaggcagccaggagccgatggctacctttccagtgccttacgatctccctccagaattatatgggagtaaagaccggccgtggatctggaacatcccctatgtcaaagctcctgatacgcacggtaacatgtgggtgcccagctag

SEQ ID NO: 139613 - DNA, 1827 bp, Artificial Sequence
  Description of Artificial Sequence: Synthetic coding sequence
atgtcccaggagggtgattacggccgctggacaatttcctcaagcgatgagagcgaagaggaaaagcctaaaccggacaaacctagtaccagttcactattgtgcgcaaggcaaggcgctgccaatgagccaagatacacgtgtagtgaggcccaaaaggccgcccataagagaaagatttcacccgtaaagtttagcaacacagactcggtattgcctcccaaacggcaaaagagcggcagtcaggaggacctgggctggtgtctgtccagttcagatgatgagctgcagcctgagatgcctcagaagcaggccgagaaagtcgtcatcaaaaaagagaaggatattagtgcccccaacgacggaactgcccagagaaccgagaaccacggcgcacctgcctgccatcgcttaaaagaggaggaggatgaatatgagacgtctggtgagggacaggatatttgggatatgctcgataaaggaaatccattccagttctacctgaccagggtgtctggagtgaaaccgaagtacaatagcggcgcccttcatattaaggatatcctgagtcctctattcggcaccctggtcagtagtgctcaattcaactactgtttcgacgtggactggctggtgaagcagtacccccccgaattccgtaaaaagccaatcctgctggtccatggcgataaacgtgaggccaaagctcacctgcatgcgcaggcaaagccctacgagaatatctccttgtgtcaggccaagcttgacattgcctttggaacacaccacaccaaaatgatgcttcttttgtatgaggagggactgagggtcgtcattcacacatccaaccttatccacgcagactggcaccaaaagacacaaggaatctggctttcccctctgtaccccaggatcgccgatgggacccataaaagtggcgagtcccccacacactttaaagcggacctgattagctacctaatggcctacaatgctccttctctcaaagaatggatcgacgtcatccacaaacacgatctgtccgaaacgaacgtgtacctgatagggtctactcccggtcggtttcaaggctcccaaaaggacaactggggccattttcgcctgaagaagttactgaaggaccacgcatctagtatgccaaacgcagaatcctggcccgtggtgggtcagttttcttcggtaggatcattgggggccgacgagtctaaatggctgtgtagcgagtttaaagagtcaatgctcaccctgggaaaggaaagcaaaacaccagggaaatcttcagtaccgctgtacctgatatatccctcagttgagaacgtgaggacctctttagagggttaccccgctggtgggtcactaccgtacagcatccagacagccgagaagcaaaattggctccactcatacttccataaatggtccgcggaaaccagtggcagatcaaacgccatgccacacattaagacctacatgcgtccctcaccagatttttctaagattgcatggttccttgtgacatctgctaacctctcaaaggcggcctggggcgcactggagaaaaatggcacgcagctgatgattcgtagttatgaacttggggtgttgtttttgcctagcgcctttggcctagatagcttcaaagttaaacagaagttttttgcaggatcacaagagccaatggccacctttcctgttccctatgaccttccacctgagctttatgggagcaaagatcgcccgtggatatggaacatcccttatgtgaaagcacccgacacccacggtaacatgtgggtgccttcctag

SEQ ID NO: 139614 - DNA, 897 bp, Artificial Sequence
  Description of Artificial Sequence: Synthetic coding sequence
atgtcccaggaaggagattacggaagatggactattagttcttcagacgaaagtgaggaagagaaacctaagcccgacaaacccagcaccagcagtctcctgtgcgcacgccaaggagccgctaacgagccaagatacacatgttcggaagctcaaaaggcagcacataagcggaagatcagcccagtaaaattttccaacaccgactctgttttgcctccaaaacgtcagaaatcaggatctcaggaagacctcggttggtgcctctcaagttcggacgatgagctacagcctgagatgccccaaaagcaggcagagaaagtggttatcaaaaaagagaaggacatcagcgctccgaatgacggcaccgcccagcgcaccgagaaccacggtgcaccggcttgtcatcgactcaaagaggaggaagatgagtatgagacatcaggagaaggccaggatatctgggacatgctggacaaaggcaacccgtttcaattttacttgacacgcgtgtccggagttaaacctaagtacaacagcggggccttacacatcaaggatatcctctcccccttatttggtacgctggttagcagtgcacagttcaactactgctttgacgtcgattggctggtgaaacagtacccccccgaattccggaaaaaacctatcctcttggtgcatggggacaagagagaggccaaggctcatttgcatgcgcaggccaaaccttatgagaacatttccctgtgtcaagccaaattggacatcgctttcgggacacaccatacaaaaatgatgctgctgctctacgaagaagggctgcgagtggtgatccacacctccaacctaattcacgcagactggcatcagaaaacgcagggaacgcacctatag

SEQ ID NO: 139615 - DNA, 441 bp, Artificial Sequence
  Description of Artificial Sequence: Synthetic coding sequence
atgtcacaagaaggggactacggacggtggacaatcagctccagtgacgagagcgaggaggagaaacccaagccagacaaaccatctacgtctagtctgctttgcgcccgccagggtgctgcgaacgaacctcgctacacttgcagcgaagcccaaaaggcagctcacaagcgaaagatatctcccgtcaaattcagtaatacagactccgtactcccaccgaagagacagaaatctgggtctcaggaagacctggggtggtgtttgtcatcgtccgacgacgaactccagcccgagatgccgcagaaacaggctgaaaaagtggtcattaagaaagagaaggacattagtgcacccaatgacggaacagctcaaaggaccgagaaccatggagccccggcttgccatagactgaaagaagaagaggatgagtacgaatag

SEQ ID NO: 139616 - DNA, 447 bp, Artificial Sequence
  Description of Artificial Sequence: Synthetic coding sequence
atgtcccaggaaggcgactatgggcggtggacaatttccagctcagacgagtctgaggaggaaaagcccaagccagataagccatctaccagttctcttctctgcgctagacagggtgcagcaaacgagcctcgttatacatgttccgaagcgcaaaaagctgcacacaaacggaaaatctctcctgtgaagttcagcaacactgatagcgtgctaccccctaaacggcagaagtccggctcccaggaagacctgggctggtgcctgagctcctctgatgacgagttgcagccagaaatgccgcagaagcaggcagagaaggtggttatcaagaaggagaaggatatctccgctccaaacgatggtactgcacagagaaccgagaatcacggggcccctgcttgccacaggctgaaggaagaggaggacgagtacgaaacctcttag

SEQ ID NO: 139617 - DNA, 840 bp, Artificial Sequence
  Description of Artificial Sequence: Synthetic coding sequence
atgtcccaagaaggcgactacgggagatggacaattagctctagtgacgagagcgaggaagagaagcctaagcccgacaagccgtcaacatcttcattgctgtgcgccaggcagggagctgccaatgagcccaggtatacctgctctgaagcccagaaggctgcccataagcgaaagatctccccggtcaagttttcaaatacagacagtgtccttccacctaaacggcagaagagtggcagtcaagaggatctcggatggtgtctgtcctcttcagatgatgagcttcaacctgagatgccccaaaaacaggccgagaaagttgtaatcaagaaggagaaagacatctctgccccaaatgatggcactgctcagcgcacggaaaaccacggcgcacccgcatgccatcggcttaaggaagaggaggatgagtacgaaacctctggtgagggtcaggacatatgggacatgctggataaagggaacccgttccagttctacttaactcgggttagtggggtcaagccaaagtacaatagcggcgccctccatatcaaggacattctgtcgccactcttcggcacacttgtctcctccgctcaattcaattattgcttcgacgtcgactggttagttaaacagtatcccccagagtttaggaagaaaccaatcctgctcgtgcacggagataaaagagaagccaaggcccatctgcatgctcaggccaaaccctacgagaacatcagcctgtgtcaggcgaagctagatatcgccttcggtactcatcataccaagatgatgcttttactttacgaggagggcctcagggtggtgatttag

SEQ ID NO: 139618 - DNA, 486 bp, Artificial Sequence
  Description of Artificial Sequence: Synthetic coding sequence
atgtcgcaagaaggagattatgggcgttggacgatctcaagtagcgatgagtctgaagaagagaaaccaaagcctgataagccctctacctcatccttgctgtgcgctaggcagggtgcagctaatgagccaaggtatacatgctccgaggcccagaaagccgctcacaaacgaaagatctcaccagtgaaattttctaatactgattctgtgctaccaccaaagcggcagaaaagtggcagtcaggaagatttaggctggtgtctcagctccagcgacgatgaactgcagcccgagatgccccaaaaacaagctgagaaggtggtgataaagaaagagaaggatataagtgctcccaacgacggcactgcgcagcgcacagaaaatcacggcgctccagcttgtcacaggctcaaagaagaagaggacgaatacgagaccagcggtgaaggacaggacatctgggatatgcttgacaaggggtag

SEQ ID NO: 139619 - DNA, 456 bp, Artificial Sequence
  Description of Artificial Sequence: Synthetic coding sequence
atgtcccaggagggcgactatggccgctggaccatcagctctagcgacgagtccgaagaagagaagccaaagccagacaaacctagcacatcatcactactgtgtgcacggcagggtgccgcaaatgaaccgagatacacttgttccgaggctcaaaaagccgctcacaagcgtaagattagccccgtaaaattctcgaacaccgactcagtgttgccccccaagaggcagaaatccggttcccaggaggaccttggatggtgtctgagctcttccgatgatgaactgcagccagagatgccacaaaaacaggctgaaaaggtggtgatcaagaaggagaaggacatttccgcccctaatgatggcaccgcgcagaggaccgaaaatcatggagctcccgcatgccacagattaaaagaggaagaggacgaatatgaaacatccggggaagggtag

SEQ ID NO: 139620 - DNA, 1113 bp, Artificial Sequence
  Description of Artificial Sequence: Synthetic coding sequence
atggtcggcaagctcaagcagaacctactcctggcttgtctagttatatcgagcgtgacagtattttacctgggtcagcatgcaatggaatgccaccaccggatcgaagaaaggtcacaacccgtgaagcttgagtccacccgaactacagtgcggacaggcctcgatctaaaagccaataagacatttgcttatcacaaggacatgcccttgatcttcatcggcggagtccccagaagcgggaccacattgatgcgtgcgatgctggacgcacacccagatattaggtgcggagaggaaacacgggtgatcccacggattctggccctgaaacagatgtggagtaggtcgtccaaggaaaaaattagactagacgaagcgggcgtaacagacgaggtgctggattctgccatgcaagctttcctgttggagatcattgtgaagcacggagagccagcaccttatttgtgcaacaaggatccctttgccttgaagtcattaacctacctgagtaggcttttccccaatgcaaagtttctactgatggtccgggacggtagagcctccgttcattccatgatttctagaaaagtaactatagccggattcgaccttaacagctatcgggattgtctcaccaagtggaacagggccatagaaacaatgtacaaccagtgcatggaagtcgggtacaagaaatgtatgctggttcactacgagcagctagttctgcacccagaacgctggatgcgaacccttctgaaattcctacaaattccttggaatcactccgtgctccaccacgaagaaatgattggtaaggccggtggcgtgagcttatccaaggtggagcggagtacagaccaggtgattaagcctgtgaacgtcggagcactttcaaaatgggtgggaaagattcctcccgacgtgctccaagatatggccgtaatcgcgccgatgctcgctaagcttgggtatgacccctatgctaacccacccaattacgggaaacccgaccctaagattatcgaaaataccagacgtgtctacaaaggggagttccaattacccgacttcctcaaagagaagcctcaaactgagcaagtcgagtag

SEQ ID NO: 139621 - DNA, 129 bp, Artificial Sequence
  Description of Artificial Sequence: Synthetic coding sequence
atggtgggcaagctcaagcaaaatctgttgcttgcatgtttagtaattagctcggtgactgtgttttacctggggcaacatgccatggagtgccatcatcgcatcgaagaacggtcacaaccggtttag

SEQ ID NO: 139622 - DNA, 423 bp, Artificial Sequence
  Description of Artificial Sequence: Synthetic coding sequence
atggttggcaaactgaagcaaaacctactgctggcatgcttggtcatatcttccgtgacggtgttctacctggggcaacacgcaatggagtgtcaccacaggatcgaggagaggagtcaacctgtgaaactggagtccaccagaacaaccgtacggacaggcctggatctcaaggctaacaagacctttgcttatcataaagatatgcctctcatctttattgggggcgtgccccgctctggcacaactctcatgcgtgcgatgctggatgcacacccagatatccggtgtggggaagagactcgcgtcatcccccgcatcttggctctgaagcagatgtggagccggtccagcaaggaaaagattcggctcgatgaggccggcgtcactgatgaggtgctggacagtgcaatgcaggcatag

SEQ ID NO: 139623 - DNA, 1083 bp, Artificial Sequence
  Description of Artificial Sequence: Synthetic coding sequence
atggtcggcaagctgaaacagaatcttctgcttgcctgcctcgtgatttcctccgtaacagtcttttacctcggccagcacgctatggagtgccaccatcggatcgaggagcgctcccaaccagtgaagctggagagtactcgaaccaccgtccgaactggcctggatctcaaagcaaacaagaccttcgcgtatcacaaggacatgcccttgattttcatcgggggcgtcccacggtctgggactacactgatgagggcaatgttggatgctcatccagatatacgttgtggggaggagacaagggtgattccacggattctggcgctgaaacagatgtggagccgctccagtaaggagaaaatcagactggatgaggctggcgtaactgacgaggtgttagatagtgcaatgcaggcatttctcctggaaattatcgtgaagcatggagagcccgctccctacctgtgcaacaaggatccctttgccttaaagtctttgacatacctgagtagactcttccctaacgctaaatttctgctaatggtgcgcgacggcagggcctcagtgcatagcatgatttcccgcaaagttactattgccggcttcgatctgaattcgtaccgggattgtttgaccaaatggaaccgggccatagagacaatgtacaaccagtgcatggaggttggctataaaaaatgcatgctcgtccattacgagcagctagtgcttcacccagaaagatggatgaggactttgctgaaattcttgcaaattccctggaatcactctgtgctacaccacgaagaaatgatcggaaaggccgggggagtctctttgagcaaggttgagcgctccactgatcaggtcattaagcccgtgaacgtaggagctctgtctaaatgggttggaaagatccctcccgacgtgctgcaagacatggcggtgattgctccaatgctcgctaagcttggctatgatccttacgccaaccctccaaactacggcaaacccgacccgaaaatcattgagaacacccgccgagagcgcttgctgccatttcagcagaaaggcaattcatag

SEQ ID NO: 139624 - DNA, 1134 bp, Artificial Sequence
  Description of Artificial Sequence: Synthetic coding sequence
atgcggctcagcgtcagaagggttctcctggcagccgggtgtgcactggtcctggttctggctgtgcagttgggacagcaggtccttgagtgtagagccgtgctggctggcctgcgctccccccgcggtgctatgcggcccgaacaggaggagttggtgatggtcggcacaaatcacgtagaatataggtacggcaaagccatgcctctgatatttgttgggggcgtgccacgcagcgggacaacacttatgcgtgcgatgctagacgcccacccagaggttagatgtggcgaagagacccggattatcccacgggtacttgcaatgcgacaggcctggtcaaaatctggtcgcgaaaagctacgactagacgaggcgggtgtcaccgatgaggtgttagatgctgccatgcaggcattcatccttgaggttattgccaagcatggggagccagcaagagtcctctgcaacaaggacccctttactctcaagtcttctgtttatttatccaggctgttccccaattctaagtttctcctgatggttagagacggcagggcgtctgtgcactcaatgatcacccggaaagtgacgatcgcaggttttgacctgtcatcctatcgtgactgtctgacaaaatggaataaggccattgaggtgatgtatgcacagtgcatggaagtggggaaggaaaaatgcctgcccgtatattacgagcagctggtgctgcaccctcggcgctccctgaaactcatcctcgattttctgggaattgcctggagtgatgcagtcctgcatcacgaggacttgattgggaagcctggtggagtttccctctcaaaaattgagcggtccacagatcaagtgattaagcctgtaaatctggaggccctgagcaagtggaccggacacattcctggagatgtggttagagacatggcccaaatagccccaatgctagcgcaactgggctacgatccctatgctaatcccccgaattacggtaatccagatcctttcgtgattaacaatactcagagggttctgaagggagactataaaacccctgccaatctgaagggttactttcaggttaaccagaattctaccagtagtcacctcggtagcagctag

SEQ ID NO: 139625 - DNA, 1134 bp, Artificial Sequence
  Description of Artificial Sequence: Synthetic coding sequence
atgagacttagcgttaggagagtcttgctggcggctgggtgcgcactcgtcctcgtgctggcggtgcagctggggcaacaggttctggagtgtcgggcggtactggcagggctgagatcaccaagaggagccatgcggcctgagcaagaagagcttgtgatggtcgggacaaaccacgttgaatacagatacgggaaagcaatgcctctgatctttgtgggaggcgttccacggtcaggaaccacccttatgcgcgcaatgctagacgcccaccccgaggtgcgatgcggcgaagaaactaggattataccacgggtgctcgccatgcggcaggcctggagtaaatctggtcgggagaagcttagactcgacgaggcaggcgtgaccgatgaagtattggatgcagccatgcaagcatttatcttagaggtcattgcgaagcacggagaacctgcccgcgtgctgtgtaataaggatccctttaccttaaagagcagtgtgtatctgtctagactgttccccaactccaaatttctgctgatggtgagggatggacgagcctctgtacactccatgatcactcggaaagtgactatcgccggattcgacctttccagctatcgtgactgccttaccaagtggaacaaagcgatcgaagtaatgtacgcgcaatgtatggaggtcgggaaagaaaaatgtttaccggtttattatgaacagctggtgctccatccacgacgcagcctgaaactgattctagatttcctcggaattgcctggtctgacgccgtgctgcaccatgaagacttaattggcaagcctggcggcgtctctttaagcaaaatcgaaaggtccacagaccaagtaattaagccggtaaatttggaggctctgagtaagtggaccggacatatacctggcgacgtggtgcgggatatggcacagatagcccctatgctggcccaactgggctatgacccatacgccaacccccccaattatggtaatcccgacccattcgtcatcaacaatacccagcgagtgctgaaaggggactacaagactcccgccaatttgaaaggctattttcaggtgaaccaaaactccacctcctcccacttaggctcctcctag

SEQ ID NO: 139626 - DNA, 1134 bp, Artificial Sequence
  Description of Artificial Sequence: Synthetic coding sequence
atgcgcctcagcgtgaggcgggtgctgctggctgctggatgcgcgttggtcctcgtgctcgctgtccaactggggcagcaggtgttagagtgcagggccgtcttagcagggctgcgctcacctcgcggggcaatgcggcccgagcaagaagagctcgtaatggtcggcaccaatcacgtggaataccgatatgggaaagccatgccgctcattttcgtcggtggagtcccacggtccgggactactctcatgagggcaatgctcgatgctcatcctgaggttcggtgtggtgaggagacgcgaattatcccccgagtacttgctatgcggcaggcctggagcaagagcgggcgtgaaaaactgcgcctcgacgaagcaggggtcactgacgaggtcctggatgccgccatgcaggcatttatactggaggtaatcgctaaacatggagaacctgcaagggtcttgtgtaacaaagatccgtttaccctgaaatctagcgtgtaccttagccggcttttccccaattctaaattcctgctgatggtcagagacggaagagcatcagtgcactcaatgataacccgaaaggtgaccattgccggctttgatctttcttcttaccgtgactgcttgacgaagtggaacaaagctatagaggtgatgtatgcccagtgtatggaagtgggtaaagagaaatgcctgccagtgtactatgaacagctggtgcttcaccccagacgctcgcttaaattgattctggactttctgggcattgcctggtccgatgccgtgttgcaccacgaagatcttatcggaaagccaggcggagtttccctatccaaaattgaacggagtaccgaccaagtgataaagcccgttaacctcgaagccctgtccaagtggaccgggcatattcctggcgacgtcgtgagggacatggcgcagatagcccctatgttggcccagctgggctacgatccatatgccaatccgccgaactatggaaacccagatcctttcgttatcaataacacacagcgagttttgaaaggtgattacaagacccccgcaaacctgaaaggctactttcaggttaaccagaatagcactagctcacacctgggtagtagctag

SEQ ID NO: 139627 - DNA, 195 bp, Artificial Sequence
  Description of Artificial Sequence: Synthetic coding sequence
atgcggctgagcgtgcgcagggttttgttggccgccggctgtgccttggtgctggtcctagctgtccaactcgggcagcaagttctggaatgtcgggccgttctagccggacttaggtccccaagaggagctatgcggccagagcaggaggaactggtgatggtcggcaccaatcatgtggaatacagatactag

SEQ ID NO: 139628 - DNA, 429 bp, Artificial Sequence
  Description of Artificial Sequence: Synthetic coding sequence
atgaggctgtcagtgcgccgagtcctgcttgcggccgggtgcgcgctggtgctggtcttggcagtgcagctcgggcaacaagtgctggagtgtagggccgttctggccggactccgttctccccgaggcgctatgaggcccgaacaggaagagcttgttatggtaggaacgaaccatgttgaatatcggtacggcaaggccatgccactgatatttgtgggcggagtgcccaggtctggcacaaccctcatgagagctatgctggatgcccatcctgaagtgcggtgtggagaagaaacgagaattataccgcgcgttctggcaatgagacaggcctggagtaagtcagggagagagaaactgagattggacgaggccggggttactgatgaagtcctcgacgccgctatgcaggcctttattttgtag

SEQ ID NO: 139629 - DNA, 144 bp, Artificial Sequence
  Description of Artificial Sequence: Synthetic coding sequence
atgcggctgtctgtccgacgagtgttgctggcagctggatgtgcccttgtgttagtgctggcagtccagctgggccagcaggtcctggaatgcagagccgtgctggccgggctccgctccccccggggtgctatgagaccctag

SEQ ID NO: 139630 - DNA, 147 bp, Artificial Sequence
  Description of Artificial Sequence: Synthetic coding sequence
atgagactttcagttcgtcgagtccttctggcagccggctgcgctctcgtcctagtgctggccgtgcagctggggcagcaggtcctggagtgtcgtgctgttctcgctgggttacgtagccctagaggagccatgagaccagagtag

SEQ ID NO: 139631 - DNA, 363 bp, Artificial Sequence
  Description of Artificial Sequence: Synthetic coding sequence
atgcgcctgagcgtgaggcgggtacttcttgcagcgggctgtgcgctagtgctcgttcttgccgtgcaattgggccagcaagtgctggagtgccgagccgtgctggctggacttagatccccacggggagccatgagaccagaacaagaggaactcgtgatggtgggcacgaaccacgttgaatatcggtacggcaaggcaatgcctctgatcttcgtggggggcgtgcccagatccgggactaccttgatgcgggcaatgctcgatgcccaccctgaggtgcgatgcggcgaagagactaggattatcccacgcgtcctggccatgcgccaagcatggtcaaagtctggcagagagaaatag

SEQ ID NO: 139632 - DNA, 933 bp, Artificial Sequence
  Description of Artificial Sequence: Synthetic coding sequence
atgccattaatttttgtaggcggggtgcctcgctcaggaacaacccttatgagagcaatgctggatgcccaccccgaagtgagatgtggggaggagactcgtatcatccctagggtcctggcaatgaggcaggcgtggtctaagtccggccgcgagaaactgcgcctggatgaggccggcgtgactgacgaagtgctcgacgctgctatgcaggcatttattctcgaagtcattgcaaagcatggagaacccgcccgggtattgtgcaacaaggatccgtttaccttaaagtcaagtgtgtaccttagtcgattgttccctaacagcaagttcctcttgatggtaagagacggaagggcttccgtacattctatgatcacacggaaagtgactatcgctggctttgatttgagcagctaccgcgattgcctaacaaagtggaataaggccattgaggtgatgtacgcccaatgcatggaggtggggaaagagaagtgtctgccggtatattacgaacaactggttctccatccacgcaggtccttgaagctgatcctggacttccttggtattgcatggagcgacgcagtcttgcaccacgaagatcttatcgggaagcctgggggggtgagccttagcaaaatagaaaggagcaccgaccaagtgattaaacccgtgaatttggaagcactgagcaaatggaccggacatatacccggggatgttgtgcgagacatggcccagatcgctcccatgctagcccagctcggttacgatccttacgccaatcctccgaattacggtaatccggatccgttcgtcataaacaatacccagcgggtattgaagggggattataagactcctgcgaacctgaaagggtatttccaggtgaatcagaattctacatcaagccacctaggctcatcctag

SEQ ID NO: 139633 - DNA, 1587 bp, Artificial Sequence
  Description of Artificial Sequence: Synthetic coding sequence
atgggcgacgcacccagcccagaggaaaagttacacctcattacgcgcaacctccaagaggtgcttggggaagagaaactgaaagagattttgaaggagcgcgagctgaaaatctactggggaaccgcaaccacaggcaaaccgcatgtggcctactttgttccaatgagcaagatcgccgactttctgaaagcgggctgcgaggttacaatactcttcgctgatctgcatgcttacttggacaatatgaaggctccatgggagctgctagagctgcgagtttcgtactacgaaaacgttattaaagccatgctggagagtatcggcgtgcctctcgagaaactcaagtttataaagggaacagattatcagctgagcaaagagtacactctggatgtttaccgtctgtctagtgtggtcacacaacatgactcgaagaaggccggcgccgaagttgtgaagcaagtcgagcatcctctcctgtcgggccttttgtacccaggactccaggctctcgacgaagagtatctaaaggtagacgcacagtttggcgggattgatcaacggaagattttcaccttcgctgagaagtatctgcccgcactggggtattcgaagcgtgtgcacctcatgaacccaatggtcccgggcctgaccggcagtaagatgtcatcttctgaggaggagagtaagatcgacctgctggatcgtaaagaggacgtgaagaagaaactcaagaaagcattttgcgaacccgggaatgtagaaaataacggggtgctgagctttatcaaacatgtactgttcccattgaaatctgagttcgtcatattgcgggatgagaagtggggaggcaataagacatacacggcctatgtggaccttgagaaggatttcgctgccgaggtcgtgcatcctggcgatcttaagaatagcgttgaggtggcactaaataagctcctcgacccaatcagagagaagtttaacacccccgcactgaaaaaactcgcaagtgccgcatatcccgacccttccaagcagaaacctatggcgaaaggaccagcaaagaatagcgagccggaggaggtgataccctctaggcttgatattagggtgggaaagatcatcaccgtcgaaaaacaccctgacgccgacagcctttatgtagagaagattgatgttggcgaggccgaacctcggaccgttgtttcagggctggtccagttcgttccaaaggaggagttgcaagatagactggtggttgtgctgtgcaatttgaagcctcagaagatgcgcggcgtcgaatcccagggcatgctgctttgtgcctctatcgaaggaataaaccgccaggtggagcccctggatcctcccgccggaagcgccccaggagaacatgtatttgtgaaggggtatgaaaaaggccagcctgacgaggagctaaaacccaagaagaaggtattcgaaaagctgcaggcggacttcaaaatctctgaagagtgtatcgctcagtggaagcagacgaattttatgaccaaactgggctccatttcgtgcaagtcgctaaagggaggcaatattagttag

SEQ ID NO: 139634 - DNA, 1434 bp, Artificial Sequence
  Description of Artificial Sequence: Synthetic coding sequence
atggctgctcctattctgcgtagcttttcttgggggagatggtctggaactctcaacctgagcgtgctccttccgctggggttgagaaaggctcattccggcgctcaaggcctgctggccgcacaaaaagcgagggggttgttcaaggactttttcccggaaaccggcaccaaaattgagctccctgagttgttcgacagaggtaccgctagctttcctcagacaatctattgtggcttcgacccaacggccgacagtctgcacgtcggccacctgctagccctcctggggctcttccatttgcagagagcaggacataatgtgatcgcgctcgtcggaggcgccaccgcccggctgggggatccctctgggagaactaaagaacgcgaggcgttagagaccgagagggtgagagcgaacgctagggctctgagactgggtttagaggcattagctgccaatcaccagcaactctttaccgatggacgttcctggggatcgtttaccgttctcgacaactccgcctggtaccaaaagcagcatttggtcgactttctggctgcagtgggtggccacttcagaatgggcacgctgttaagtagacagagcgtacagctgcgtctgaaatccccagaaggtatgagtcttgccgaatttttctatcaggtcctccaggcgtacgacttttactatctttttcagcgttatgggtgcagggttcaactcggcgggtccgaccagttaggcaacatcatgagtggatatgagttcataaataagctcacaggtgaagacgtgttcggcattactgtgccattgattactagcactacaggggccaagcttggcaaaagtgctgggaatgcagtatggctaaacagagataagacgtctccatttgaactgtaccaattcttcgtccgccaacccgatgatagcgtcgagaggtacctcaagctgttcacctttctcccactccccgagattgaccatatcatgcagttgcatgtcaaggagcccgagcgacgaggaccacagaagagacttgccgccgaggtcaccaagcttgtacacggccgtgagggactggactccgctaaacgatgcacgcaagctctgtaccacagtagtatcgatgctctggaggtgatgtctgatcaggagctaaaggagcttttcaaagaggcccctttctctgagtttttcttggacccagggactagcgtcctggatacctgcagaaaagccaacgctattcctgacggccctaggggataccgtatgatcaccgagggaggcgtgagcataaaccatcaacaggtcaccaatcccgagtccgttctgattgtggggcagcacatcctcaagaacggcctgtcactactcaaaattggaaagcggaacttttatatcattaagtggttgcagttgtag

SEQ ID NO: 139635 - DNA, 723 bp, Artificial Sequence
  Description of Artificial Sequence: Synthetic coding sequence
atggctgaatatctggcaagcattttcggcactgaaaaggacaaggtgaactgcagcttctatttcaagattggggcctgtcgtcatggagatcgttgttctagactgcataataaacctaccttttcacagaccattgcccttttgaacatctacaggaacccacagaactcttcgcagtccgctgatgggttgcgctgtgccgtaagcgacgtcgagatgcaggaacactacgacgaattcttcgaggaggtgttcactgaaatggaggagaagtacggcgaggtagaggagatgaatgtgtgtgacaatctcggggaccacctggtcggcaacgtctacgttaagttccgccgggaagaggacgcggagaaagccgtgatcgacctcaataatcgatggtttaacggtcagccaattcacgctgaactttctcctgtgacagactttcgcgaagcttgttgtcgacagtacgagatgggagagtgcacacggggcggtttctgcaactttatgcacctcaagccgattagtcgcgagctgcggcgggaactttatggtcgcaggcgtaaaaagcatcgcagtaggtctcgctctcgggagcggagaagccgtagcagagaccgtggcaggggcggtgggggggggggcggcggcggagggggaggaagggagcgcgaccgaagaaggtcccgcgatagggagcggtctgggagattctag

SEQ ID NO: 139636 - DNA, 723 bp, Artificial Sequence
  Description of Artificial Sequence: Synthetic coding sequence
atggccgagtaccttgcctcaatttttgggaccgaaaaagataaggtaaactgctcattttacttcaagatcggcgcctgtcgtcatggcgatagatgttctcggctgcacaataagcccacgttttctcagacaatcctaattcaaaacatctacaggaatccacagaatagcgcccaaaccgccgatgggtcccattgtgctgtgagcgatgttgaaatgcaggagcactacgacgagttcttcgaagaagttttcaccgagatggaagaaaagtacggcgaggtggaggaaatgaatgtgtgcgataaccttggggaccatttggtgggtaacgtgtacgtgaaattccggagagaggaagatgcagagaaagccgtgatcgatctgaacaatcgctggtttaatggccagccaatccatgcggagttgagtcccgttactgattttagggaggcctgctgccgccagtatgaaatgggtgaatgtactaggggaggattttgcaatttcatgcacctcaaacccatctctcgcgagcttcgcagggaactctacggacgccggcggaaaaagcaccgtagtcggagcagatcaagggaacgccgatctcgctcaagggaccggggacgggggggcgggggtggcgggggcgggggcgggggcgggcgtgagagggatcgcagacgcagccgagaccgggagcgtagtggccggttttag

SEQ ID NO: 139637 - DNA, 504 bp, Artificial Sequence
  Description of Artificial Sequence: Synthetic coding sequence
atgcaggagcactacgatgagttcttcgaggaggtcttcactgagatggaggagaagtatggcgaagttgaggaaatgaacgtatgcgacaacttaggtgaccatcttgtaggaaacgtgtatgtcaagttcaggagagaagaggacgcagagaaggcggtgattgatctgaacaacaggtggttcaatggccagcccatccacgccgagctctctcctgttaccgattttcgggaagcctgctgcagacagtacgagatgggtgaatgcaccagaggcggattctgcaactttatgcacctaaagcctatctctcgtgagttacggcgagagctgtatggacggaggagaaagaaacatcggagtaggtcgaggagcagggaaaggcgcagcagaagcagagacagagggcgcgggggcggcggtggaggcgggggaggcggaggcggaagagagcgcgatcggaggaggtcaagagatagggaacgttcaggtaggttttag

SEQ ID NO: 139638 - DNA, 504 bp, Artificial Sequence
  Description of Artificial Sequence: Synthetic coding sequence
atgcaggaacattatgacgagttttttgaggaagtcttcacagagatggaggagaaatatggagaggtcgaggagatgaacgtctgtgataatttgggggatcacctggtgggcaacgtgtacgtcaagttccgcagggaggaggatgcggaaaaggcagtgatcgacctgaataatcgctggttcaatggccagcccatccacgcggagctcagtccagtgacagatttccgcgaggcatgctgtcggcaatatgaaatgggggaatgcacacgcggcggtttctgcaactttatgcatctgaaacccatttcgcgggaactcaggcgtgagctctacgggagaaggaggaagaaacatagatcccgttcccggtccagggagcggaggtcccggtcccgtgatagaggtcgcggcggcggaggcggcgggggcggtgggggaggagggagagaacgagaccgccggcgctcccgagatcgcgaacgatctggcagattctag

SEQ ID NO: 139639 - DNA, 1218 bp, Artificial Sequence
  Description of Artificial Sequence: Synthetic coding sequence
atgtttgtacaggaggagaagatcttcgcggggaaggtacttcgcctgcatatctgtgcctctgacggcgcagagtggctggaggaggcaacagaggatacaagtgtagagaagcttaaagagcggtgtcttaaacactgcgctcatggttcgctggaagatcccaagtcaataactcaccataaacttatccacgcagcatcggaacgtgtgctgtccgacgctcgtactattctcgaagaaaatatacaggatcaagacgtgctcctgttaatcaagaaacgggccccttctccactgccaaagatggctgacgtgagcgctgaggagaagaaaaagcaggatcagaaagcgccagacaaggaagcaattctcagagctactgccaacctgccgtcatataatatggatagggctgccgtgcagacaaacatgcgggattttcaaacagaattgcgcaaaattcttgtctctctgatcgaggtagcacagaagttgctcgccttgaaccccgacgccgtggaactgttcaaaaaagccaacgcaatgctggacgaggatgaggatgagagagtggacgaggctgctcttcgtcaactgacggaaatgggctttccagagaatcgtgccactaaagcacttcagcttaaccacatgtctgtgccccaggctatggaatggttaatcgaacacgcagaagaccccactatcgacactcctctcccaggtcaggcgcctcctgaagccgagggggccacagctgccgcctcggaagcggccgcaggggcatccgccactgacgaagaggccagagacgagctaacagagatctttaagaagatcagaagaaaacgggaattccgcgctgatgctagggccgtaatctccctgatggaaatggggtttgatgagaaagaggtcatagacgccctgcgggtgaataataaccagcagaatgctgcatgcgaatggttacttggcgaccggaagccctcgcctgaggagctggataaaggcattgatcccgacagcccactgtttcaggcaatactcgacaaccccgtggtccagttgggccttaccaaccctaagaccttgctcgcctttgaggatatgctggagaatccactgaattccacacagtggatgaatgacccggagacagggccagtgatgttacagattagccgtatttttcagacgctgaacaggacttag

SEQ ID NO: 139640 - DNA, 540 bp, Artificial Sequence
  Description of Artificial Sequence: Synthetic coding sequence
atggccgcgagccaggtacttggagaaaaaatcaatatactctcaggcgaaacagtcaaagccggtgacagagacccattgggcaatgattgccctgagcaggatcgcttaccccagagatcttggagacaaaagtgcgctagctatgtgctggcattaaggccttggagtttttcagcaagtctgactcctgtggctttgggatctgcgctggcatatcgcagtcacggagtgctcgatcccagactcctggttggctgcgcagtggccgtactggccgtgcacggagcaggtaatctggtaaatacttactacgatttttctaaagggattgaccacaagaaaagcgacgacaggaccttggtggaccgaattttggaacctcaggacgtggtgagattcggtgtgtttctatacacactggggtgtgtgtgcgctgcctgcctatactatctttcgccattgaagctcgaacacttggctctgatctacttcggaggtttgtctggatccttcctatatactggagtcctgatttag

SEQ ID NO: 139641 - DNA, 1017 bp, Artificial Sequence
  Description of Artificial Sequence: Synthetic coding sequence
atggccgccagccaggtgctgggggagaagataaacattctctcaggcgagaccgtgaaggctggcgacagagatcccctcggcaacgactgtcccgagcaggaccgcctgccacaaaggtcctggcgacagaagtgtgcttcctatgttctcgctcttagaccttggagcttctctgcctcattgaccccggtagcactgggtagcgccctcgcctaccgcagccacggcgttttggacccccggctgttggttggctgcgccgtggctgtcttggctgtacatggcgctggtaatttagtcaatacgtactatgacttttcaaaaggtatcgatcataaaaagagcgacgaccgcacattggtggaccgcatcctggaaccacaggatgtggtgcgcttcggagtgttcttgtataccctcggatgtgtgtgtgctgcgtgtctttactatctttcgccacttaaattggaacacctcgctctgatatacttcggtggactctctgggagctttctttatacaggggggattggcttcaagtacgtcgccctgggcgatctgataattctgatcacattcgggccattggccgtgatgttcgcgtacgctatccaggtagggtctctggccatctttccccttgtttatgcaatcccgctcgccttgtccacggaagccatccttcacagcaataatacccgcgatatggaaagtgatcgggaagcaggcatcgtgaccctggctattttgattggacctactttttcttacatcctgtacaacactctgcttttcctgccctacctcgtgttcagcatactggctacgcactgtacaatttcgcttgctctgcccctgttaaccattccaatggccttctcactagaacgtcagtttcggtctcaggcctttaacaagttaccccaacgcactgcgaagctgaatctgttgttaggcctgttttacgtgttcgggatcatccttgcccccgccgggtctctgccgaaaatttag

SEQ ID NO: 139642 - DNA, 3405 bp, Artificial Sequence
  Description of Artificial Sequence: Synthetic coding sequence
atgtcagaaccccaccgcgttcaatttaccagcctccctgggagcctcaacccagctttcctcaagaagtcccgaaaggaggaagcgggcgccggagagcagcaccaggactgtgagcctgccgctgcagctgttaggatcaccctcactctgttcgagcccgatcataagcggtgtcccgaattcttttatccagagctggtgaagaacattagaggcaaggtcaagggactccagccaggtgataaaaagaaagatctaagcgatccttttaatgatgaagaaaaggagaggcataaagtcgaagccctggctagaaaattcgaggagaaatatggagggaagaaacgccgcaaggatcggatccaagaccttatagacatgggctatggctacgacgagtcagattctttcatcgataactccgaggcatatgatgaattagtccccgcgtcactcacaactaagtacggggggttttatattaactccggtacgctgcagtttagacaggcttcagagtcggaggacgatttcattaaggaaaagaagaagaagtcccctaaaaagcgcaaactaaaggaaggaggtgaaaaaatcaagaagaaaaaaaaagatgatacttatgataaagagaagaaatcaaagaaaagcaaattcagtaaggcgggttttacagctttgaacgcctcaaaagaaaaaaagaagaagaagtatagcggagccttgtcggttaaagaaatgctgaagaagttccaaaaagagaaagaggcacaaaaaaaacgggaagaagagcataaacctgtcgcggtcccatctgcagaggctcagggattgcgagagctggagggagcaagcgacccgctgctgagcctgtttggctctacgtccgacaatgacctcttgcaggcggccactgccatggatagcctgacggatttagatctagagcacctcctctctgaatcgcccgagggctccccgttccgggacatggatgacggttccgactctttgggcgtcggcctggaccaggaatttcgccagcccagtagtctccccgagggactgcccgcccccctggaaaaacgggtgaaggagctggcacaggctgcccgggcagccgaaggagaatctaggcagaaattcttcacacaggatatcaacggcatccttctggatattgaagcccagactagagagttgtccagccaggttcgctccggcgtgtacgcttacttggctagctttctaccttgctcgaaggacgccctgctcaagcgagccagaaagttgcacctttacgaacagggcgggcgactcaaggagcctctccaaaagcttaaagaagctatcggccgcgcaatgccagaacagatggctaaatatcaagatgaatgtcaggcgcacacacaggctaaggtggctaagatgttagaggaggagaaggacaaagagcagagggatcgcatatgttccgacgaagaagaagacgaagaaaagggagggagaaggatcatggggcctaggaagaagttccagtggaatgacgaaattagagaattgctgtgtcaggtcgtcaaaatcaagctggaatcccaggaccttgagagaaataacaaagcacaggcctgggaagactgcgtgaagggattcctggacgctgaagttaaaccactctggccgaagggatggatgcaggcacggacattgtttaaggagagccgccggggacatggacacctgacatccatcctggccaagaagaaagtcatggccccaagtaagattaaagtgaaggagtcttccacaaagcccgacaagaaagtaagcgtgcccagcgggcagattggtggacccatagctcttcctagtgatcaccagacaggcgggctttctattggagcttccagtcgggagctcccctcacaggctagcggcggcctggctaacccccctcccgtgaacctggaggattccctcgacgaggaccttatacgaaaccctgcttctagtgtggaagctgtaagcaaagagctcgctgccctgaattcacgagccgcaggaaacagcgagttcacgctgcctgcaccatcaaaggctcccgccgaaaaagtgggaggtgtcttgtgcacggaagagaagcggaacttcgctaagccctccccctctgcacctccaccagccagcagcctgcaatcccctctcaactttctcgccgagcaagcgctggcgctcggacaatccagtcaagagaagaagcccgagagctccggctacaaggagctgtcgtgccaggccccactcaataaaggcctccccgaagtacaccagagcaaggccaaacaccactcgctgccgcgcacctctcacggtccacaggttgccgtgccagtgcctggcccgcaggtgaaggtttttcacgctggtacacagcagcagaagaatttcacccccccttctccattcgcaaataagctgcaagggccgaaggccagtccaactcaatgccaccgatccttactgcaactggtcaaaacagccgctaagggccagggtttccacccgtccgccccagcgacatccggaggcttatccgcttcctcatcctcaagccacaaaacccctgcgagctccagcagcgccctcagtcaccccgcaaaaccccacagtgtttcgtccgccggtagttcatacaagaacaatcctttcgcatcttccatctctaagcatggggtcagtagcggtagttccagttctgggggtacacctgtgcagagctcagtgtcaggctcactggtccctggtatccagccaccttctgttggccaagccaccagcaggccagtcccaagttccgctgggaaaaaaatgcccgtgtctcagaagctgacacttgttgcccccccaggaggtcccaatggagacagctccggtggaactcagggagtagctaaactcttgacttcccctagcctgaagcccagcgcagtttcatctgtgacctcttccacctctctcagcaaaggagcctccggtactgtgctcttggccggttctagtttgatggcctcaccttataagtcctcctcaccgaaactgagcggggcaatgtcctccaacagtttgggaattatcaccccagtgcccattcctgtgcatgtgctgtctttttctgcagactcgagtgccaaagcgggagtttctaaggatgcaattgtaacaggtccagccccaggcagtttccaccatggactgggacacagcctgctcgctggtctgcattcttcacctccacacgctgcccctctgccccacgcggccgtccctactcatattcctcaatccctacctggtgccagtcagctgcatggtaagggacccgccgtacctcggaagctctag

SEQ ID NO: 139643 - DNA, 3405 bp, Artificial Sequence
  Description of Artificial Sequence: Synthetic coding sequence
atgtccgagccacaccgcgtacagttcacaagtttgcccggaagtctgaatccagcgtttctaaagaaatctaggaaggaagaggctggggccggcgaacagcatcaagactgcgagcccgctgcggccgcagtccgcatcaccctgacattgtttgagccagaccataagcggtgccctgaatttttctacccagaactagtcaaaaacatcaggggtaaggtaaaaggacttcagcctggcgacaagaagaaagatttgtccgacccattcaatgacgaggagaaagagcggcataaggtggaggccttggccagaaagttcgaagaaaaatatggcgggaagaagaggcgtaaagacaggatccaggacttaatagatatgggctacggctacgacgagtctgactccttcattgacaactctgaagcctacgatgaattggtgcccgctagccttacaactaagtacggtggtttctacataaatagcggcacgctccaatttcgccaggcatccgagagtgaagacgattttattaaggagaagaaaaaaaagtcgcctaaaaagcgaaagttgaaggaaggcggcgaaaaaataaaaaaaaagaaaaaggatgatacgtacgacaaagagaagaagtcaaagaaaagcaaatttagcaaagctggattcacagccttaaacgcctccaaagagaagaagaaaaagaaatattcaggggccttgtcagtcaaggagatgcttaagaaattccagaaggaaaaggaagctcagaaaaaacgtgaggaggaacataagccggtcgccgtgccaagcgccgaggcccagggccttcgtgagctcgaaggcgcatcagaccctctcctttccctttttggaagtacatccgataacgacctactccaggctgcaaccgccatggactctctgacggatctcgatttggagcacctgctcagtgaaagcccagagggatcaccttttcgtgacatggatgatggatccgattcactgggcgtcgggctggatcaggagttccgccagccatcctcactgcccgaagggctgcctgctccgctcgagaaacgagtgaaggagcttgcgcaggctgcccgcgccgccgagggagagtctcgccagaaatttttcacgcaggacattaacggaatcctgttagatattgaggctcagaccagagaactcagttcccaggttcggagtggcgtgtacgcctacttagctagctttctgccctgttccaaggatgcattactgaagagggcgcgtaagctgcacctgtacgagcagggcgggagactgaaggagccactgcaaaagttaaaggaagcgatcggacgcgccatgcctgaacagatggctaaatatcaggatgagtgccaggcgcatacacaagccaaagtggccaagatgttagaagaagagaaagacaaggagcaacgcgataggatctgctctgacgaggaggaggacgaggagaagggggggaggagaatcatgggtccaagaaagaagtttcaatggaacgacgagattagggagctgctatgtcaggtcgtgaaaattaaactcgaatcacaggacctcgagcgcaataataaagcacaggcctgggaggactgtgttaaaggctttcttgacgctgaagtaaagccactgtggcctaaggggtggatgcaggcgcgaacactttttaaggagagtaggcgcggccatggccatctgacatccatcttggcaaagaagaaagtgatggcccctagcaagattaaagttaaagaatcttctacgaagccagacaagaaggtctcagtgccctcagggcagataggaggtcctatcgccctgcctagtgatcaccagaccggcggcctgtccattggtgcgtcatcacgtgaactgcctagccaggcctccggcggtctcgcgaacccccctccagtgaacttagaggattccctggacgaggacctgatcaggaaccctgcctcttcggtcgaggccgtcagcaaggagcttgctgccctgaattccagagcagccgggaatagtgagtttacactgcctgcgccttctaaggctcccgccgagaaagtggggggagtactgtgtacagaggaaaagaggaactttgcaaagccatctccaagcgcgcccccacccgccagcagcctccagtcacctctcaattttctcgcagagcaggccctggctttgggtcagtcatcgcaggagaagaaacctgaatcctcaggctataaagagctgagttgccaggctcctctgaacaagggtctccctgaggttcatcagtccaaagctaagcaccatagcctaccacgcaccagtcatggacctcaagtagctgttcctgtgcccggaccgcaggtcaaggtgtttcatgccgggactcagcagcagaaaaactttactcctccttctccatttgccaacaagctgcaaggtcctaaggcaagtccaacacagtgccatcggagtttgctccagttagtgaaaaccgctgcaaaagggcaggggttccacccatcagctccagctactagtggaggactctccgcttcatcttcaagcagccacaaaacccccgcctcctcctcttccgccctctctcatcctgctaagcctcactctgttagctccgcaggatcttcatacaaaaacaatccttttgcatcaagcatatctaagcacggcgtatcttccggatcctccagcagtggcgggacaccagttcaaagcagtgttagcggctctctcgtacccggcatccagccgccttcagtcgggcaggccacttcccgacccgtacccagttccgctgggaagaagatgccggtcagccagaaacttactctggtcgctccccctggcggacctaatggcgacagcagcggtggaacacagggagtggccaagttgctcacttctccttcactgaagcccagcgcagtgagctctgtgacaagctccacttcgttatcaaagggcgcatccggcaccgtgcttctcgccggaagcagccttatggcctcaccgtacaagtcctccagccccaagctgagcggggcaatgtcgagcaactctctgggcatcattactcccgtgcctattcctgtgcacgtattatccttcagtgcagattcttccgcaaaagcaggtgttagtaaggacgcaatcgtgacaggacctgcgccagggtcatttcaccatggcctaggtcatagcttgctggctggcctacatagctccccaccccatgcagcacccctgcctcatgcagcagttccgacccacatccctcagtcacttcctggtgccagtcagcttcacggcaagggccctgcagtgccgagaaagctatag

SEQ ID NO: 139644 - DNA, 3315 bp, Artificial Sequence
  Description of Artificial Sequence: Synthetic coding sequence
atgtctgaaccccaccgggtgcaatttacatcccttccgggtagcctcaacccagcctttctgaagaagagtcggaaagaggaggccggggctggcgagcagcaccaggattgtgaacccgctgccgcggccgttcggatcactctcaccctgtttgagcccgaccataagaggtgcccggagtttttctatcccgagctggttaagaatattcgtgggaaggttaagggactccagcccggtgacaaaaagaaggatctttctgatcctttcaacgatgaggagaaggagcgacataaggttgaagcactggccagaaaattcgaggaaaagtatggtggtaagaagcgccggaaggacaggatccaggacctcattgatatggggtacgggtatgacgaaagcgactccttcatcgataactcagaagcttacgatgagctcgtgcccgcgtcactcaccaccaagtacggagggttctatattaattcaggcacactgcagttcaggcaagcaagcgagagcgaggatgactttataaaggagaagaaaaaaaagtcccccaaaaagcgcaagctgaaggaaggaggtgaaaaaattaagaaaaagaaaaaggacgatacttacgacaaggagaagaaatccaaaaagtccaagttctctaaggcgggctttactgccctgaatgcgtctaaggagaagaagaagaagaagtattcaggtgctctctctgtaaaagagatgttaaagaagtttcagaaagaaaaagaagcacagaagaagcgcgaggaggagcataaacctgtcgccgtgccttccgctgaggcccagggcctgcgggagctggagggcgcaagtgatcccctgctgtccctgttcgggtcaacaagcgacaacgacctactccaggctgcgactgctatggactctctcactgacctagacctcgaacacctgctgagcgagtctcctgaggggtctccattcagagatatggacgacggcagcgattccctcggagtggggctagatcaggagttcagacagccctcgtcgttgcccgaagggctcccagccccgctggaaaagagggtcaaagaacttgcgcaggctgcccgggccgcagaaggcgagtctcggcagaagttttttacccaagatattaacggcattctgcttgatattgaggcacagaccagagaattgtcttcccaggtcaggtctggtgtctacgcctacctggcgagctttctgccttgctcgaaggacgctctgctcaaacgggcacggaagctgcacttatacgagcagggcgggcgactgaaagagcccctgcaaaaattgaaggaggccatcgggcgcgctatgcccgagcagatggccaaatatcaagacgagtgccaggcccatactcaggccaaggtggcaaagatgctggaggaggaaaaggacaaagaacaaagggatcggatctgttcagatgaagaggaagacgaagaaaaaggaggccgccggataatgggaccgcggaagaagtttcagtggaacgatgaaatcagggaactgctgtgccaggtggttaagatcaagctggagtctcaggacctagagcggaacaacaaggcacaggcttgggaagactgcgtgaaggggttcttagatgccgaggtgaaacctctctggccgaaagggtggatgcaagcacgtacactgttcaaagagagccgcaggggccatggccatttaacctctattctagccaaaaaaaaggtgatggcaccctcaaaaataaaggtgaaggagtcaagcacaaagcctgataaaaaggtgtcagtacccagcgggcagatcggcggccctatcgccttaccctctgaccaccagaccggcggattatcaatcggcgccagctctagggagttaccatctcaagcttccggaggcctggccaaccctccccccgttaacttagaggacagtttggatgaggacctcattcgcaaccccgcctccagtgtggaagccgtgagtaaagagctggctgctctgaattctagggccgctggaaactctgagttcacccttccagctcctagtaaagctccagccgagaaagtcggcggtgtgctatgcacggaggagaagcgcaacttcgctaagccttccccttctgctccaccccctgccagttctctccaaagtccgcttaactttttagcagagcaagctttggcgctggggcagagctcccaggagaaaaaacctgagtcgtcaggctacaaggaacttagctgtcaggctccgttgaataaagggctgccggaagttcatcagtctaaggctaagcatcatagccttcctcgcacatcccatggaccgcaggtggccgtccccgtgccaggcccccaagtcaaggtgtttcacgccggcactcagcagcagaagaattttacaccaccgtctccctttgccaataaactgcagggccctaaggcgtccccaacccagtgtcacaggtcactgcttcagcttgtcaaaactgctgcgaaaggccaggggttccacccaagcgcaccggccacatccggcgggctctccgcctcatcttccagttcacacaagacgccagcttcctcaagtagtgcactctcacatcccgccaagcctcactcagtgtcttcagctgggtccagctacaagaataacccatttgcctcaagcatctcgaaacatggggtcagctctggatcatctagtagtggcggtacaccggtccagtcctccgtgagtggaagcctagtaccaggtatccagccgccaagcgtgggccaggctacctcccgacccgtgccttcaagtgccggtaagaaaatgcccgtatcccagaagcttacacttgtagctcccccaggtggcccaaatggggacagttccgggggcactcagggtgtggccaagttactaacttccccatcgctgaagcccagtgccgtgtcttcggtaactagttcaactagtctatctaagggcgcgagtggcaccgttctcttagcaggcagttctctgatggcatccccgtataagagcagctctccgaagctcagcggtgccatgtcgtctaactctctgggcatcatcacacctgtccccattcctgtgcatgtcttatctttcagcgccgattcaagcgcaaaggccggagtctcgaaggatgctattgttaccggtccagcccctggaagtttccaccacggcctgggacattcagctagccaattacatggaaaaggtcctgccgtgccccggaaactgtag

SEQ ID NO: 139645 - DNA, 3795 bp, Artificial Sequence
  Description of Artificial Sequence: Synthetic coding sequence
atgtctctccagcgtgagccgcccaggccggagcccccacccccattccctccgctgcctctgcagccgccccccccgcgcgagtccgcatcacgcgcggagcagcctccacgacctccaagagagactgttcgtttggagcttgtgctgaaggacccaacagatgaaagctgcgtggagtttagttatcctgagcttcttttgtgcggagagcagcgtaaaaagctgattcacaccgaagacccctttaacgacgagcatcaggaacgtcaagaggttgagatgctagcaaaaaagtttgagatgaagtacggtggaaagccccgaaagcatcggaaagaccgactgcaggaccttatcgacatcggctttggatatgatgagacagatccatttattgacaattctgaggcttacgatgagctcgtgccagcttctctaacaaccaagtatgggggcttctacattaacactggcaccctccagtttcgtcaggcatcagatacagaagaggatgatatcaccgacaaccagaagcataagccaccgaaagtacctaagatcaaggaggacgatatcgagatgaaaaagcgcaagaggaaggaagaaggagagaaagagaagaagcctaggaagaaggtcccaaaacagttaggggtcgtggccctgaatagccacaaaagcgaaaaaaagaagaaaagatacaaggacagcctcagcctggccgccatgatacgtaaattccagaaagaaaaggatgcactcaaaaaagaaagcaaccccaaggtgcccgtcacattgtctaccccaagccttaataagcccccatgtgccgcagccgccctggggaacgatgttccagacctcaacctgagctccggggacccagaccttccaatattcgtgtctactaatgagcatgaacttttccaggaagcagaaaatgctctcgaaatgctggatgattttgatttcgaccgcttgctagatgcagcatctgatgggtcccctctgagcgaatctggtggagaaaacgggaccacaacacaacctacttatacctcccaagtgatgccaaaagtggtgccgacgctgccagaaggcctgccagttcttctcgagaaacggatcgaagacctacgtgtggctgcgaagttgtttgacgaggaagggagaaaaaaatttttcacccaggatatgaacaatatccttctcgatatcgaactccagctgcaggagctgggcccagttattcgatctggagtctacagccacctggaagcctttgtcccttgtaacaaggaaactctcgttaaaaggcttaaaaagcttcatcttaatgtgcaggatgatcggttgagagagcccctccaaaagctgaaactggccgtgagcaatgtgatgcctgagcagctgttcaagtaccaagaggactgtcaggcccgtagccaggctaagtgcgccaaacttcagactgatgaagagagagaaaagaatgggtctgaggaagatgacgacgagaagcctgggaaacgggtcatcgggccacggaaaaaatttcactgggacgatacaattaggactctgctttgcaacctggtagaaatcaagttaggatgttacgaattagagcccaacaagtcacagtctgccgaagattatttgaaatctttcatggagacggaagtcaaacctctctggcccaaagggtggatgcaagccaggatgctttttaaagagagccggtctgtccacaatcacctgacttcagcccctgccaagaaaaaggttattcccgcccccaagcctaaagtgaaggaggtgatggtcaagacgcttcccctccacagcttccccactatgcttaaggagtgctcccccaagaaagaccagaagacccctacctccttggtagcttccgtgtctggaccacctaccagttcatcaacagccgctatagctgctgcgagttcctcttccgcccctgcccaggagacaatctgtctggatgacagtctagacgaggacctgtcattccactcccctagccttgacctagtctccgaggcccttgccgtcataaataacgggaacaaaggaccaccagtggggtcccggatctccatgcccaccaccaagcctcgacctggactgcgcgaggagaagctggcctctatcatgtccaagctgccattggcaactcccaagaaactggattccacacagaccacgcactcatcttctttgatagcaggccacacaggaccagtccctaagaagccacaggacctggcccatactggcattagctccgggcttattgccgggtcttctattcagaacccaaaggtttctttggagccactgcccgccagacttttgcagcagggcttgcagagaagtagccagattcacactagttcaagctcccagacacacgtgtccagctcgtcacaggcacagattgccgcctcatcccacgccctgggaacttccgaagcgcaggatgccagctcccttactcaggtgaccaaggtccatcagcattcagctgtgcagcagaactacgtgtcccccctccaggccacgatttccaaatcgcaaacaaatcccgtggtgaagcttagcaataatccacaactgagctgcagctctagcctgattaagacctcggataagccgttaatgtatcgattgccactgagtacgccctctcccgggaatggctctcaggggagccatccccttgtgagccggactgtcccttccaccacaacatcctcaaactatctggcaaaagctatggtgtcacagattagcacccagggcttcaaatcccccttctcgatggctgcatcacccaaattggcggcaagtcctaagccagcgacatccccaaagccgctccctagccccaagcccagcgcttccccaaaacctagcctgtctgctaagcctagcgtctcaactaaattaatcagcaagagcaatcccactccaaaacccaccgtgtcccctagcagctcatcaccgaatgcattggtcgcccagggatcacactccagtacaaactccccagtgcataagcaaccttcgggtatgaatatctcacggcagagcccgaccctcaacctcttgccttcttctagaacgagcggcctccctcccactaagaacctgcaggctcccagtaagctgaccaactctagctctaccggaactgtcgggaaaaactccctgagcggtatcgccatgaacgtgcctgccagccgcggcagtaatctgaatagcagcggagcaaacaggacatctttatcggggggcaccgggtctggaacacagggcgctacaaagcctctgtccaccccacacagaccttccacggcctcagggtcttctgtggtcaccgcctcagtccagagtactgctggcgcttctcttctggctaacgcttctccactgactctgatgacgagtcctctctctgttaccaatcagaacgtgacgcctttcggcatgctgggaggactagtccccgtgactatgccgtttcagttccctctggaaatctttggattcgggaccgacaccgccggggtcactaccacttcaggctcgacaagcgccgccttccaccactcattgactcagaatttgcttaagggcctacagcccggcggggcccagcacgccgctaccctgtctcatagcccacttcccgcacacctgcaacaagcattccatgatggtggccagtcgaagggcgacactaaattacccagaaaaagccaatag

SEQ ID NO: 139646 - DNA, 4044 bp, Artificial Sequence
  Description of Artificial Sequence: Synthetic coding sequence
atggctgagcccaggagagtggcgttcatctcactgagccccgtgagaagaagggaggctgaatatcctggacccgaacgtgagcccgaatatccccgcgagccacctagactggaacctcagccctatcgggagccagccagggctgagccccccgcacctagggaacccgctccccgaagtgatgcccaaccgcccagtcgcgagaagcctcttccacagcgtgaagttagtcgagcagaaccccctatgtcccttcagagagagccaccccgtcccgaaccccccccccccttccctcccttaccactgcagccaccgccaccacgcgagtctgcctctcgggcagagcaaccgccacggccccctcgcgagacggtgcgccttgagcttgtgttgaaagaccccactgatgaaagttgtgtcgagttttcctatcctgagctactgctttgtggcgagcaaaggaaaaagctgattcacacagaagaccctttcaacgatgagcatcaagaaaggcaggaggtggagatgttagccaagaagtttgaaatgaagtatgggggaaaacctcgtaagcacagaaaagaccggttgcaagacctgatcgatatcggcttcggctacgacgaaactgacccgttcatagacaacagcgaagcttacgatgaactggtccccgcctctttaactaccaagtacgggggcttctacatcaacactgggaccctgcagttcagacaggccagtgacaccgaagaggatgatatcactgataaccaaaagcacaagcctccgaaagtgcctaagataaaagaagatgacatcgagatgaagaaacgaaaacggaaggaggaaggcgagaaggagaaaaagccgcgaaagaaagttccaaagcaacttggagttgtggccctgaattcacataagagtgagaagaagaagaaacgctacaaggacagtctgagcctcgctgcgatgatccgcaagttccagaaggagaaagatgctttgaagaaggaatccaaccctaaagtccctgtcaccctttccactccctctctcaacaaacctccatgcgctgccgccgcactcggtaacgatgtgcctgatctaaatctctccagtggagacccagacctccccatttttgtgtcaacaaacgagcacgaactctttcaggaagcagaaaatgcattggagatgttggacgacttcgactttgacaggctcttggatgcagcgtcggatggctccccgctcagtgaatctggaggagaaaacggtaccaccacacaacccacatataccagtcaggtgatgcctaaagtggtccccaccctgccagaagggttgcctgttctgctggagaaaaggatcgaagatttgcgggtcgccgccaagctatttgatgaggaaggcagaaaaaaattctttacacaggacatgaacaacattctgttagacattgagctgcagctgcaggagcttggtccggttatcaggtcaggtgtctatagccatcttgaggccttcgtgccgtgcaataaagagacactagttaagcgcctcaagaagttgcacctcaatgtccaggatgaccggttaagagagcctctgcagaagcttaagctcgctgtgtccaatgtcatgcctgaacagcttttcaagtatcaggaagattgccaggcacgctctcaagctaagtgcgccaaacttcagacagatgaagaacgggagaaaaacggcagcgaagaagatgatgatgaaaaacccggtaagcgcgtgattggaccgagaaaaaaattccactgggatgatacgatccgtactctgctgtgcaatcttgtcgagatcaaacttggctgctacgaactggagcctaacaagagtcagtcagcagaggattatttgaaatccttcatggagacagaagtaaagccactgtggcctaagggatggatgcaggctcgcatgctgttcaaagagagcagatcggtgcacaaccacctgactagcgcacccgcgaagaagaaagtcatacctgcacctaagcctaaggtcaaagaagtcatggtcaagacacttccactgcactcgtttcctactatgttaaaagagtgttctcctaaaaaggatcagaaaactcccacgtccctggtggccagtgtgagcggtccccctacttcatcgtccacagcagccatcgccgccgcaagttcctcttctgctcccgcccaggagacaatctgtctggacgactctctggatgaagacctcagcttccattctccttctctggacctggtcagcgaagcactggccgttattaataatggcaataaaggcccgccagtgggctcacgcatcagtatgccaactactaagcctcggccaggacttcgcgaagagaagctggcatcgataatgtccaagctacctctggccacgcccaaaaagctggactctacacagacaacccattctagcagtcttattgcgggccatactgggcccgtgcccaagaagccacaggatctggcccatacaggcatcagttccggcctgattgcaggcagctctatccaaaatccgaaggtgtcacttgaaccactcccagccagactcttgcagcagggcctgcaaagatcgtcccagattcacacctcctcgtcatctcagacacacgtatccagttcatctcaggctcagattgccgcctcgagccacgctttaggaaccagcgaagcacaggatgcttcatctttgacccaagtgactaaggttcatcagcattcagctgtgcagcagaattacgtgtcccctcttcaagctactatttcaaaaagtcagactaatccagtagtgaagctgtcaaacaatccccagctttcctgttctagtagcctgattaagacatcagacaaacccctcatgtaccgcctcccactgtccaccccctcccccggcaacggaagccaggggagtcatcccttagttagccgcactgttcctagtacaaccacttcctcaaactacctggctaaggccatggtgtcccagatttctactcaaggatttaaaagtcccttctccatggctgcctcacctaagttggccgccagtcctaagccagcaacaagccctaaaccactgcctagccctaaaccatcagcatcacctaagccatccctgtctgcaaagccttcagtgagtaccaagctgatcagtaagtctaacccaacacccaagcctactgtgtctccttcatcatctagccccaacgccttggtggcacaaggatctcacagcagtaccaactctccagtgcacaagcaacccagtggtatgaacatatctaggcagagccctaccctcaaccttctgcctagctcaaggacctcagggctgccaccaacaaaaaatctgcaagctccaagcaagctcactaacagtagttccaccggcaccgtcggcaaaaattcactgtctggaatagcaatgaatgtgcctgccagcaggggctcaaacttaaactcgtctggagccaatcgtaccagcctgtctggtgggactgggagtggaactcagggagctaccaagccactgtcgaccccccaccgcccctcgacagctagtggctcttcagtcgttactgcttccgttcagagtactgctggcgcgtcattgctagctaatgcttctcctctaactttgatgacaagtcctttatctgtgacaaaccagaacgttaccccattcggaatgttgggtggcctggtccccgtgactatgccattccaatttcccctggagatttttgggtttggcactgataccgcaggggtgaccacaacttcaggctccactagcgctgcattccaccacagtctcacccagaacctgctgaaaggcttacagcccggtggggcccagcacgcagctactctgtcccatagccccctgccggcccatctgcagcaggcatttcacgatggcggacagagcaaaggggacaccaaactccctcggaaaagtcagtag

SEQ ID NO: 139647 - DNA, 1686 bp, Artificial Sequence
  Description of Artificial Sequence: Synthetic coding sequence
atggccgagtctggagagagcggaggtccaccaggaagtcaggacagcgcggccggcgccgagggtgccggagcacctgctgccgctgcctccgcagaaccaaagatcatgaaggtaaccgtaaaaacaccaaaagagaaagaggaattcgccgtaccagaaaactcctccgtgcagcagttcaaagaggaaataagcaagcgttttaaatcccacacagaccagctggtgttgattttcgctgggaaaattctgaaggaccaggataccttgtcccagcacggaatacatgacggactcacagttcacctggtgatcaagactcagaataggccacaggatcactccgctcaacaaaccaacacagcagggtccaatgtgactaccagctcaactcccaatagcaactccaccagcgggtctgcgacctccaatcccttcggactggggggtttaggcggacttgccggtctatccagcctgggcttaaacacgactaatttcagcgagctgcagagccagatgcagagacaattactttctaatccggagatgatggtccagattatggaaaatccttttgttcagagcatgctgagcaacccagacctcatgagacagctcattatggcaaaccctcagatgcagcagctgatacagagaaatcccgagatctcccacatgcttaacaatcctgacattatgagacagacattagagctggctcgaaatcctgctatgatgcaggaaatgatgcggaatcaagatcgagccttgtcgaacctcgaatcaatccctgggggatacaacgctctgcgtagaatgtacaccgacatccaggagccaatgctgtctgccgcacaagagcagtttggaggaaaccctttcgccagtctggtcagcaatacaagttcaggagaaggcagccagccctcaagaacggaaaatagggacccgttgcctaatccttgggctccgcaaaccagccaatcaagttccgcgtcaagcgggaccgcgtccaccgtaggggggactaccggttctacagctagtggtacatctggccagagcaccactgctcccaacttggttcccggagtgggtgcaagcatgttcaatacccctggaatgcagagtctcctccagcaaattaccgagaacccccaactgatgcagaacatgctctccgccccctatatgaggagcatgatgcagagtttaagccagaatccggatctcgcagcccagatgcagaaccccgacaccctctccgccatgtccaatccacgggctatgcaggccttacttcagatccaacagggcctccagaccctcgccacagaggccccaggtctaatcccaggatttactcctgggctcggcgctctgggatctacaggcggcagttctggtactaacggaagcaacgcaacaccttctgaaaatacctcccccacagcgggaacgactgagcccggtcatcagcaattcatccagcagatgttgcaggctctcgctggcgtgaacccacagctgcagaatccagaagtaaggtttcagcagcagctcgaacaactatcggccatggggtttctgaatagagaggcaaacctccaggccttgatcgccactggtggcgacatcaacgctgctattgaacgtctgcttggttcccagcctagttag

SEQ ID NO: 139648 - DNA, 1770 bp, Artificial Sequence
  Description of Artificial Sequence: Synthetic coding sequence
atggctgagtcgggagaatccgggggccctcccggctcacaagacagcgcggccggggccgagggcgctggggcacccgcagcagcagcatcggccgagccaaagattatgaaagtcacagtgaagacccccaaggaaaaggaagaattcgccgtgcccgaaaattctagcgtgcagcagttcaaagaggaaattagcaaacggttcaaatcacatacagaccagctggtcctgatcttcgctggaaagattctgaaagatcaggacacgctatcccaacacggcatacatgacggcctgacggtgcatctggtcatcaagacccagaatcgccctcaggaccactccgcgcaacaaactaataccgctggttccaatgtgacaacatccagcactcccaactcaaacagcacctcaggctcggcaaccagcaatcctttcggtttgggcgggcttggcggcctggccggactctctagtcttgggctcaatacgacgaatttttctgaactgcaaagccagatgcagaggcagctgctctcaaatcctgagatgatggtgcagattatggagaacccattcgtgcagtccatgttgtccaaccctgatttgatgcggcagctgattatggcgaacccccagatgcaacagctcatacagagaaatcccgagatcagccacatgctgaataacccagacattatgcgtcaaacactggagcttgcgcggaaccccgctatgatgcaggagatgatgagaaatcaggaccgagccctgtcaaacctcgagtcaattcccggcggctataacgccctgcgaaggatgtacaccgatatccaggagccgatgcttagcgcagcccaggagcagtttgggggcaatccttttgccagcttagtctctaacacctcctccggcgaaggatcgcagcctagtaggacagaaaacagggatccactgccgaacccttgggccccacagacgagccagtcatcttctgccagtagcgggactgcatccacggtcggaggcactacaggcagcacagccagcggcacatctggccagtctaccacagcacctaacctcgtgcccggggtcggggcatccatgttcaacacccccgggatgcagtccctcctacagcagatcactgagaatcctcaactaatgcagaacatgctttccgctccatatatgaggtccatgatgcagtcactctcacaaaaccctgatctggctgcgcagatgatgctaaacaatccactgtttgccggaaacccacagctgcaagaacagatgcgtcagcagcttcctactttcctgcagcagatgcagaaccccgataccctcagcgctatgtctaatccaagagctatgcaggccctgcttcagatccagcagggcttgcagacactggctaccgaggcccccggactgatccccgggtttacccccggtctgggcgcactgggctcaaccggaggtagttccgggactaacggcagcaacgccactccttctgagaacaccagccctactgctgggaccaccgagccaggacaccaacagttcatccagcagatgctccaagcccttgccggagtcaacccacaattacagaacccagaggtgcgctttcagcagcagttggagcagctctcggcaatgggcttcctcaacagggaagccaatctccaagcgttgatagccactggaggcgatattaatgctgcgatcgagcgccttttgggctcgcagccttcttag

SEQ ID NO: 139649 - DNA, 1875 bp, Artificial Sequence
  Description of Artificial Sequence: Synthetic coding sequence
atggccgagaacggtgagagttcaggacctccgaggccatcccggggccccgccgcagcccagggctcagccgccgcccctgccgagcccaaaattattaaagtaacggtcaaaacacccaaggagaaggaagagtttgcggtgccggaaaacagctccgttcaacagtttaaggaggcaatatcaaaacgattcaaatcccagacagatcagctggtgctgatatttgctggcaagatactcaaggaccaggacactttgatccaacacggcatccacgatggactgacggtccatctggtcattaagtctcagaacaggccacagggacaatccacccagccatccaacgcagccgggaccaatacaacaagtgccagcaccccacgctccaacagtactcctatcagtactaacagcaacccttttgggctgggcagtctgggggggctggctggtctgtccagcctcgggctgtcttccacaaacttcagcgaattgcagtcccagatgcagcaacaactgatggctagtccggagatgatgattcagatcatggagaatcccttcgttcagagcatgctctctaatcctgatctgatgcgccagctgatcatggctaaccctcagatgcagcaattgatacagcgcaatccagaaatttctcacctgctcaacaaccctgacatcatgcgccagacattagaaatcgcgagaaatcctgccatgatgcaggaaatgatgcggaaccaagatctggccctcagcaacctggaatccattcccggggggtacaacgctttgagaagaatgtacactgatatccaggagcccatgctgaatgcagcccaggaacaatttggaggaaatcccttcgcttcagtcggatcctcaagcagcagcggggagggaactcaaccatctaggaccgaaaatcgcgatcccctccctaatccctgggcccccccccctgccactcagtcctccgctaccaccagcaccaccaccagtacgggcagtgggtctgggaatagtagcagtaatgcgacagggaatacagtggccgctgcaaactatgtggctagcatcttctctacccctggtatgcagagtttgctccaacagattacggaaaatccacagcttatccaaaacatgctgtcggcaccatatatgcgcagtatgatgcagtctctttcacaaaacccggacctggcggcacaaatgatgttgaatagccccctgtttacggccaatcctcaactgcaggagcagatgaggcctcaactgcctgcctttctgcagcaaatgcagaacccggacacgctgagtgctatgagtaacccacgggccatgcaagcgctgatgcagattcagcaaggattgcagaccctagctactgaggcccccggcctgattccatctttcactcccggagtcggggtaggggttctgggcacagccatagggcccgtcggccccgtgaccccgattggcccgataggaccgatcgttcccttcacgccaataggccccattggccccatcgggccgaccggccctgccgccccccctggatcaacaggcagcggcggccctacgggtccaaccgtgagcagtgccgcacccagtgagacaacatcacccaccagtgagagcgggccaaatcaacagttcattcagcagatggtgcaggctcttgcgggcgccaacgcccctcaactgcccaatccggaggtgagattccagcagcagctggagcagctgaatgccatgggctttcttaatagagaagcgaacttacaagcgctcattgccaccggcggagatatcaacgcagctatagaacggttactgggttctcagccttcctag

SEQ ID NO: 139650 - DNA, 1467 bp, Artificial Sequence
  Description of Artificial Sequence: Synthetic coding sequence
atggccgagaatggcgagtcctctgggcctccacggccctctcgcggtcctgctgccgcccaggggtccgccgcagcccctgctgagcctaagatcattaaggttaccgtaaaaacgcccaaggaaaaagaggaattcgcagtgcctgagaactcctctgtccaacagtttaaagaagcgatttcaaagcgctttaaaagtcagacagaccagctagtccttatttttgccggtaaaatactgaaggaccaggataccctgatccagcatgggatccatgatggattaacggtgcatctggtgattaaaagccaaaaccgcccgcagggccaaagcacccagcccagcaacgccgcaggaacgaacacaacttcggcgagcacccctagatcaaattctaccccaatttccaccaatagcaaccccttcggcttagggtcactggggggactggcggggctgagctccctggggctctcgtcaactaattttagcgagttgcaaagtcaaatgcagcagcagttgatggcttctccagaaatgatgattcaaatcatggagaacccattcgtgcaatcgatgctgtcgaacccggacctgatgaggcagctgatcatggccaacccccagatgcagcagctgatccagcgaaatccagaaatcagtcatcttctaaacaatccggacatcatgcggcagacactggagatcgctcggaatcctgcaatgatgcaggagatgatgagaaaccaggacctagccctatccaatttagaatcaattcctggcggatacaatgccctgcggcgaatgtacactgacatccaagagcccatgctaaatgcggcccaggaacaattcggaggcaatccattcgcctctgtaggcagcagttcctcatccggggaaggtactcagccctcacgcacagagaatcgcgatcctctgccaaacccgtgggcccctccccctgccacgcaatcttctgccacaacctccactacaacttccactggcagtggcagtggaaattcatcttctaatgccaccggcaatactgtggcagcggctaattatgttgcaagcatcttttctacccccggcatgcagagtttgctgcagcagattactgaaaacccacaactcatacaaaacatgctgtccgcaccctacatgagatctatgatgcagtctttgtctcagaatccagatctagccgcacagatgatgctgaactcccccctcttcaccgctaacccgcagctccaagaacaaatgaggccacagctgccagcctttctccaacaaatgcagaatccagacactctgagcgcgatgagtaatcccacgtcttccagcttctctaaatggtgcagaccttggttagagcaaatgctgcatagctgccgcattcaaaaaagtgatttcagcaataattggaatagttccacccaatgggggagttag

SEQ ID NO: 139651 - DNA, 1968 bp, Artificial Sequence
  Description of Artificial Sequence: Synthetic coding sequence
atggccaaggggggagaagccctgccccagggctcaccagccccagtgcaggatccccatcttatcaaagtgacagtgaagaccccgaaggataaagaagattttagcgttacagacacttgcacaatccagcagctgaaggaggagattagtcagagattcaaggcacacccagaccaactggtgttgattttcgcaggcaaaattcttaaggatcccgatagcctggcccagtgcggtgtgcgagatggcctgacagtgcatctggtaatcaaacgccagcacagagcaatgggcaatgaatgtcctgcggcctccgttccaacacagggaccgtctccagggtccctgccgcagccctccagtatctaccccgctgacggccccccagcgttctcgctgggccttttgacaggcctgtcccggctggggctcgcttaccggggatttccagaccaaccgtctagcttaatgcggcagcacgtatcagtgccggagtttgtcactcagcttatcgatgatccattcattcctggccttttgagtaatacaggactggtcaggcagcttgttttagacaacccccacatgcagcagctgatacagcataacccggaaataggacatatactcaataacccagagattatgcggcaaacccttgaatttttaagaaatcctgccatgatgcaagaaatgattcgcagccaggaccgcgtgctctccaacttagagtcaattccagggggatataacgttttatgcaccatgtacacagatattatggacccgatgctcaatgcagtccaggagcaatttggcgggaaccctttcgccacggcaacaacagacaatgccacaaccactacctcgcagcccagtcggatggaaaattgtgacccactgcctaatccctggacttctacccacggaggctctgggtctcgacaaggaaggcaggacggggaccaggatgcccctgacatccgaaaccgctttcctaactttctgggaatcataaggctttacgattacctacagcagctccacgagaatccacaaagcttaggcacttacttgcaggggacggctagcgctctaagccaaagccaggagccgcccccctcggtgaaccgcgtccccccttccagcccctcatcccaagagccggggagcggccagccgctacctgaagaaagcgtggcgattaagggtaggagctcatgtcctgcctttctgcgctatcctaccgagaactccactggccaggggggggatcaggatggagcagggaaatcttccacaggccattccaccaatctgcctgacctcgtctccggcctcggagattctgccaatagggtccccttcgcccctttaagcttttctcctacagccgctattccagggatccccgaaccaccctggctaccttccccggcttaccctcggagtctccgtcccgacggtatgaacccggctccacaactacaagatgaaattcaaccccagctccctctactgatgcatctgcaggctgctatggccaatccccgcgcgctgcaagctttaagacaaattgaacaggggctgcaggttctggcaaccgaagctcccaggctgttgctgtggttcatgccttgcctggcaggtacaggctctgttgctggggggattgagtcccgggaagaccccctcatgagcgaagatcctttgccaaatccaccaccagaagttttcccagccttggactccgctgaactgggttttctttcgccaccctttttacacatgctacaggatctggtctccactaacccccagcagctccaaccggaggcacatttccaggtgcaactggagcaactacgttctatgggatttctaaatagggaagccaatctgcaggccttgatcgcaacaggcggagatgtggacgccgccgtggagaaactgaggcaatcgtag

SEQ ID NO: 139652 - DNA, 666 bp, Artificial Sequence
  Description of Artificial Sequence: Synthetic coding sequence
atggcaaagggcggggaggcattgcctcagggatcccccgctcccgtgcaggacccacacctcataaaggtcaccgttaagaccccaaaggataaagaggacttttccgtgacagatacgtgcacaatccagcagctgaaagaggaaatttcgcagcggtttaaggcccatccggaccagttggttctcatttttgcaggcaaaatactcaaggaccctgattcgcttgctcagtgtggcgtcagggacggactcacagtgcatctggtgatcaaaaggcagcatcgggccatggggaacgagtgccctgccgcgtctgtccccacccagggaccctcacctgggagcctcccccaaccttcctctatctatccggcggatggtcctcccgcctttagcctgggattgctgaccggtttgtcacggcttgggctggcttacaggggtttccctgatcagccatcctcacttatgcggcaacatgtatccgtgcccgaattcgtgactcagcttatcgacgatccattcattccaggtctcctctctaatactggcctggtgcgtcagcttgtactggataacccccacatgcaacaattaatccagcacaatcccgaaatcggacatatccttaataacccagaaatcatgaggcagaccctgtag

SEQ ID NO: 139653 - DNA, 681 bp, Artificial Sequence
  Description of Artificial Sequence: Synthetic coding sequence
atggccgaaccctcaggagctgagactcgaccaccaattagagttaccgttaaaaccccaaaggataaggaggaaattgtcatttgcgacagagcttctgtcaaagagtttaaggaggagatttcacgccgtttcaaagcacagcaggatcagctggtgttgatttttgcaggcaaaatactgaaggatggggatacattaaatcagcatgggataaaggatggcctgacggttcatctcgtaatcaagacgccccagaaggcccaggatcccgcgccacccgccgccccctccctcccagcagctgacgccgagccgcgggtcactttgcacccgtaccaatccccctcacacgcgggtatcgccgctgatcctgcagggacaaccgacttggctgatagggggccctgggctggaacacagccgtggttgctatgggacattcctgacccttcaaccttgtcgcggcagcagcgacgagtctacgctcgggggccacactttcttacgagccacgcgtcgcacatattctctaatcgggggttccagcgacctgctgctacccacgccgccgacgaccccgccttcggctggaagtggaagctaactggtgccgacgcgcgtagtgagatctccgccgccgccggtgcggcacagctgcacgggctgcatcagtcatag

SEQ ID NO: 139654 - DNA, 1806 bp, Artificial Sequence
  Description of Artificial Sequence: Synthetic coding sequence
atggccgagccttcaggcgccgagacccggccccctataagggtcactgtaaaaacacccaaggacaaggaggagatcgtaatctgcgacagagcatctgtgaaagagtttaaggaggagatatctaggcgcttcaaagctcagcaggaccagcttgtgctcattttcgccgggaaaatactgaaagatggagacactctgaaccagcatggaataaaggatggacttaccgtccatctggtgataaaaactcctcagaaagcccaagacccagctgcagccacagcctccagccctagcacaccagatcccgccagcgctcccagtaccactccggcgtcacccgctactcctgctcagccttcaacctccggctcagcatcctcagacgccggatctggctcccgtaggagctcagggggcgggcctagtccaggcgccggagaagggagtccttccgcgacagcaagcattctgtccggttttgggggcatcttgggacttggctccctaggcttaggttcagccaattttatggagctacaacagcaaatgcagaggcagctcatgagtaaccctgaaatgctgagtcagatcatggagaatccgcttgtccaggatatgatgagtaaccctgacctcatgcggcacatgattatggccaaccctcagatgcagcagcttatggagaggaatccggagataagccatatgctaaacaaccctgaactgatgcggcagactatggaactggctagaaatcccgcaatgatgcaggaaatgatgaggaaccaggaccgcgcactttccaaccttgagagtatccccgggggctataacgcgctgaggcgaatgtacaccgacattcaggagccaatgttttccgctgctcgcgagcaattcggcaacaatcctttttcatccctggccggaaactccgattcaagtagtagtcagccactgcgcaccgaaaacagagagccacttcccaacccatggtccccttctccccctacctctcaggctcccggctcaggcggagaaggcaccggggggagcgggacctctcaggtgcatccaaccgtttcgaatcctttcggtatcaatgccgcatcgctcggctcaggcatgttcaattcacctgagatgcaggcccttcttcagcagataagtgaaaacccccagctgatgcagaatgtaatttccgccccttatatgagatccatgatgcaaactctcgcccagaatccagactttgctgcccagatgatggttaacgttccgttgttcgcggggaacccgcagctgcaggagcagttacggttgcagctgcccgtcttcctccagcaaatgcaaaatcccgaatctctgtctatcctcactaatccgcgtgctatgcaggcactgcttcagattcagcaaggactccagactctccagaccgaggctcctggattggtcccctcgctagggtcatttggcattagcagaactcccgcccctagcgcaggaagcaatgccggaagtacgcctgaagccccgaccagttcacccgctactcccgccacaagcagcccgactggagccagttccgcccagcagcaacttatgcagcagatgattcagctgctagccggaagtggcaactcgcaggttcaaacaccagaggtgcgattccagcagcagctggaacagctgaattcaatggggtttattaatcgggaggcaaatctgcaggcccttatcgccacagggggcgacatcaacgcagccatcgagaggctgttaggcagccaattgtcctag

SEQ ID NO: 139655 - DNA, 336 bp, Artificial Sequence
  Description of Artificial Sequence: Synthetic coding sequence
atggcgggcaagcaagccgtctcagccagcggaaaatggcttgatggcatacgcaagtggtactacaatgctgctgggttcaacaaactgggtctgatgcgcgacgacacaatctacgaagatgaggatgtcaaggaggcaatcagaagactgccagaaaacctgtacaatgatcgaatgttccggataaaaagggctctggacctgaacttgaaacatcaaatcctgcccaaggaacagtggacaaaatatgaagaagaaaacttctatctggagccttacttaaaagaggtgattcgggagcgtaaagagcgggaagagtgggccaagaaatag

SEQ ID NO: 139656 - DNA, 1443 bp, Artificial Sequence
  Description of Artificial Sequence: Synthetic coding sequence
atggccgctagcgtggtatgccgcgcagccaccgcgggggcccaggtgcttctgagggcccgccgctcccctgcacttctgagaacacccgctctgcgctctactgctactttcgctcaggctctacagtttgtccccgaaacccaggtgtcattgctggataatggcctgcgggtggcttctgagcagagtagtcagcccacctgcacagtgggggtatggatcgacgtggggagcagattcgagaccgaaaaaaacaacggtgccggctacttcctcgagcacctggcattcaaggggacaaaaaataggcctggaagcgccttagagaaggaggtggagagcatgggagcccatctgaacgcttattctacaagggagcataccgcctattacatcaaggcgttgagcaaagatctgccaaaagcagtcgagctgcttggtgacatcgtccaaaactgtagcctcgaggactctcagatcgaaaaagagcgggacgttatcctgcgggaaatgcaggaaaacgacgcctccatgagggacgtggtgttcaactacctacatgccactgctttccagggtacccccctggctcaagctgtggagggccctagcgaaaatgtgagaaagctgtccagagccgatctgaccgaatatctctcaactcactacaaggcaccccggatggtactagcggcggcgggcggcgtagaacaccaacagctgctggatcttgcccagaaacacctgggggggatcccatggacttacgcagaagatgcagtgccgacattaacaccatgccggtttaccgggagcgagattagacacagggacgacgccctaccattcgctcatgtcgccattgctgtggaggggcccggctgggcctctccagataatgtggcccttcaggttgcaaacgcaatcatcggacactatgactgcacgtacggcggcggagtccatctgtcatcacccttagcttccggggctgtcgccaacaagctatgccagtcctttcagaccttcagcatctgttatgctgagacaggcctcctgggagcgcatttcgtctgcgacagaatgaagattgacgacatgatgttcgtgctgcagggccaatggatgcgactgtgcacgagcgccaccgagtcggaggtggcccggggcaaaaacatcctgcgcaatgcactggtgtctcacctggatggaacgactcctgtctgtgaagatatcggacgttctctgttgacatatggtaggcgcatccccctggccgagtgggagtcccggatcgcagaggtggatgcatcggtagtgcgcgagatttgctctaaatacatatatgaccaatgcccagctgtcgcgggctacggaccgattgagcagctccccgattacaatcggattcgttccggcatgttctggctgcgattctag

SEQ ID NO: 139657 - DNA, 1362 bp, Artificial Sequence
  Description of Artificial Sequence: Synthetic coding sequence
atgaagcttttaaccagggccggctcctttagcagattttattcactaaaagtggcaccaaaggttaaggccaccgccgccccagctggcgcaccaccacagccccaggacttggagttcaccaaactcccaaatggtctggtcatcgctagcctcgaaaactactctcccgtgtcccgcattggacttttcatcaaagctggaagtcggtacgaagatttttctaacttaggcactacgcatctgctcagactaacttccagtctgactacgaaaggcgcctctagttttaagatcacgcgaggtatcgaggccgtcggcggtaaactttccgtaactgctactcgtgagaacatggcttacaccgtggagtgcctacgaggggatgtcgatatcctgatggaatttctgctcaatgtaaccacagcgccggagttccggcgatgggaggtcgccgacctgcaaccacaattgaaaattgataaggctgtcgccttccagaatccacagacccatgtgattgagaacctgcacgctgctgcttaccggaacgccctggccaaccccctctattgccctgactacagaataggaaaagtcactagcgaggagttgcactattttgtgcagaaccacttcacctcagcaaggatggccctcatcgggctaggcgtgtctcatcctgtgctgaaacaggttgcagaacaatttctgaacatgaggggcggcctggggctgtccggggccaaagcaaattacagggggggggagatcagagagcagaatggagactccctagtacacgctgcatttgtggccgaaagtgcggttgctgggagcgccgaggctaacgcctttagtgtgcttcagcacgttctcggagcgggccctcacgtgaagcgaggctccaataccacaagccacctgcatcaggccgtggcaaaggctacacagcagcctttcgacgtctccgcatttaacgcttcctactcagacagtggtcttttcggaatatacacaatcagccaggcaacagccgctggcgacgtaatcaaggccgcttataaccaggtgaagaccatcgcacaggggaatctgtccaacactgacgtccaggccgccaagaataagcttaaggccggttatctcatgtctgtggagtccagcgagtgcttccttgaggaggtgggcagccaggcactcgtggccggctcttacatgccgccttccaccgtcctgcagcaaatagactcggtcgccaacgctgacatcattaatgccgcaaagaagtttgtgtctggccaaaagtcaatggccgctagtgggaacctaggccacaccccattcgttgatgagctgtag

SEQ ID NO: 139658 - DNA, 276 bp, Artificial Sequence
  Description of Artificial Sequence: Synthetic coding sequence
atggggctggaggatgaacagaaaatgctgacagagagcggcgatcctgaggaggaagaagaggaggaagaggaacttgtcgaccctctcacaacggtgcgggaacaatgcgaacagctggagaaatgcgtgaaggcccgggaacgcttagagttgtgtgatgagagggtaagtagccgtagccataccgaagaggattgcaccgaggagctgtttgactttctacacgctcgggaccactgtgtagcccataaactgtttaataaccttaagtag

SEQ ID NO: 139659 - DNA, 249 bp, Artificial Sequence
  Description of Artificial Sequence: Synthetic coding sequence
atgggtagggagtttggaaatttgacaagaatgcgacatgtgataagttactcactcagccctttcgaacagcgtgcatacccacacgtgtttacaaaggggatcccgaacgttctgaggcgaataagagagtccttcttccgcgttgtgccacaattcgtcgtattctaccttatctacacatggggcacagaggaatttgaacgatctaagcgcaagaatcccgccgcatatgaaaacgataaatag

SEQ ID NO: 139660 - DNA, 249 bp, Artificial Sequence
  Description of Artificial Sequence: Synthetic coding sequence
atggggagggagtttggcaacctgacccggatgaggcacgtgatctcatacagtctttcacctttcgagcagcgtgcttatccgcatgtttttaccaagggcatcccgaatgttctgcgccgcatccgggagtctttctttcgggtagtgccacagtttgtggtgttctacctgatttacacgtggggcacagaagagtttgaacggtctaaaaggaaaaatccagccgcctatgagaatgacaagtag

SEQ ID NO: 139661 - DNA, 249 bp, Artificial Sequence
  Description of Artificial Sequence: Synthetic coding sequence
atgggaagggagtttggcaacttgacccggatgcgccacgtgatatcgtactccctgtccccttttgagcagcgggcttatccccacgtcttcactaagggcatccccaatgtcctgcgaaggattcgggaatcctttttccgggtggtcccccagttcgtggtgttctatctcatctacacctggggaactgaggaatttgagcgttccaagcgaaagaatccagcggcgtatgagaatgacaagtag

SEQ ID NO: 139662 - DNA, 387 bp, Artificial Sequence
  Description of Artificial Sequence: Synthetic coding sequence
atgcagattttcgtgaaaacccttacagggaagacgatcacactggaagtggagccctccgatacaatcgaaaacgtgaaggccaaaatacaagacaaagagggcataccaccagaccagcagcgcttgatctttgcagggaagcagctcgaggatggacgaaccctgagtgattataacatacagaaggaaagcacgctccacctagtgttgcggctgagaggaggtataattgagcctagcttgcgacagttggcgcaaaagtacaactgtgacaagatgatttgtcgtaaatgctatgcacgcctccatcctcgggctgttaactgtaggaaaaagaagtgtggccacacaaacaacttgaggcctaagaaaaaggtgaagtag

SEQ ID NO: 139663 - DNA, 387 bp, Artificial Sequence
  Description of Artificial Sequence: Synthetic coding sequence
atgcaaatatttgtgaagactctaactggcaaaacaatcacgctggaagtcgaacccagtgatactatcgaaaatgtgaaggctaagattcaagacaaagaaggaattcccccggaccagcagaggcttatctttgcaggcaagcagctcgaggacgggcgaaccctgagcgactataacatccagaaggaaagcactcttcacctcgtgctgagactgaggggcggtataattgagccaagtctgcgacagctagcgcagaagtacaactgtgataaaatgatttgccggaaatgttatgcgcggctccacccccgagccgtcaattgtcgaaagaaaaagtgcggtcacacaaataatctgcgccccaaaaagaaggttaagtag

SEQ ID NO: 139664 - DNA, 1872 bp, Artificial Sequence
  Description of Artificial Sequence: Synthetic coding sequence
atggccgcaggggagacacagctgtacgctaaggtgtctaataaactcaaatcccgctcatcaccatccttgctggagcctctacttgcaatgggcttcccggtacacacagccctcaaggcacttgctgccacaggccgtaagaccgccgaggaggcattggcttggctgcatgaccactgcaacgatcccagcctcgatgacccaatcccccaggaatatgctttatttctctgtcccaccggcccccttctggagaaactgcaggaattttggcgcgaatcgaagcggcagtgcgccaagaaccgggctcatgaagttttccctcatgtgaccctatgtgacttttttacctgtgaggatcaaaaagttgagtgtctctacgaggcactgaaacgtgccggggataggttgcttggctccttccccacggccgttcccttggcgctgcattctagtatctcatacctgggatttttcgtgtctggttcccctgctgacgtgatcagggagttcgctatgacgtttgccaccgaggcttccctgctggccgactgctcagtcaaaccatgtacgaagcagctgcatctgacactagctcacaaattctatcctcatcaccagagaacactcgagcagctggcaagagcaatacccctagggcacagttgtcagtggacagcggccttatactcaagagatatgcgatttgtgcattaccaaactctgagagccctgtttcagtacaagccccaaaacgtcgatgagctcaccctgtccccaggagactatatatttgtggaccccacccaacaggacgaagcaagtgagggctgggtgattggcattagccagcgtaccggctgtcgaggtttcctgcccgagaattatacagaccgcgcgtctgagagcgatacatgggtcaagcatcgaatgtacactttctccctcgctaccgatttgaatagccgcaaggacggcgaagctagcagccgctgctctggcgaatttttaccacagactgcccgcagcttgagtagcttgcaggcattgcaggctaccgtagcccgtaagtccgtactggttgtgagacacggtgagcgtgtggatcaaatctttggaaaggcttggctgcagcagtgcagcactccagatgggaagtactaccggcctgatctgaacttcccttgttctcttcctcgacggagtaggggcattaaggactttgagaacgatcccccactctcgtcctgtgggatcttccagagtagaatcgctggagacgccctgctggatagtggcatacggataagctctgtatttgcatctcccgcgttgcggtgtgttcagacagcaaaactgattctggaggaactcaaactcgagaagaagattaaaattcgggtggagccgggaatcttcgagtggaccaagtgggaagcaggtaaaactaccccgaccctcatgtccttagaagagctgaaagaagccaacttcaatatagacaccgactaccgccccgccttccccctgtcggcacttatgcctgcggagtcctaccaggaatacatggataggtgtacagctagtatggtacaaatcgtcaatacatgccctcaggacacgggtgtcattctgatcgtgtcccatggctctaccctggacagctgtacgcgcccgctgctgggactcccgccgcgggaatgcggagacttcgcgcagctcgtgcgcaaaatcccatctctgggtatgtgtttctgtgaggagaataaggaggagggcaagtgggaactcgtgaatcccccagtgaagacactgacacacggcgctaacgccgccttcaattggcggaactggatctccgggaactag

SEQ ID NO: 139665 - DNA, 1986 bp, Artificial Sequence
  Description of Artificial Sequence: Synthetic coding sequence
atggctgccggggagacccagctctatgctaaagtgagtaacaaactcaaatcgcgctcgagcccaagcctgcttgagcctttgctggcgatgggcttccccgtgcacacagctctgaaggccctagccgccacaggccgcaagaccgccgaggaggctctggcatggttgcacgaccattgcaatgacccttctctggacgatcccatcccgcaagagtacgcccttttcctctgccccaccggaccccttttggagaaacttcaagaattttggagagaaagcaagcgacagtgtgccaaaaaccgcgcgcacgaggtcttcccgcacgttacactctgcgacttctttacatgtgaagatcaaaaagtagagtgtttgtatgaagccttgaaacgagccggtgataggcttttagggtccttcccgacagccgtgcccctggccctccattcctccatttcctacctgggctttttcgtgtctggatctcctgccgatgtgatccgggagtttgccatgacgtttgccacagaggcttccctcctggccggaacttctgtctcacgtttctggatcttctcacaggtgccggggcatggaccaaatctccgcctaagcaatctgacaagggcttccttcgtctcccactacatcctccagaaatattgttcggtgaagccctgtactaagcagcttcatctaaccctggctcataagttctaccctcaccatcagcgaactctggaacaacttgctcgtgctatcccactggggcacagctgccaatggactgctgccctttatagccgagacatgcgttttgttcattatcagaccctcagagctttgtttcagtacaagcctcagaacgtcgatgagttgactttgagcccaggtgattacatcttcgttgaccctacccagcaggatgaagcgtctgaggggtgggtcatcgggatctctcaacgaaccggctgtcgtggattccttccagagaactacactgaccgtgcttcggaatctgacacatgggtgaagcatagaatgtacaccttcagcctcgctacagatcttaacagccggaaggacggggaagcctccagtagatgctctggagagtttctgccccagactgccagatctctttctagcctgcaagctctgcaggccacggttgccagaaaatccgtgcttgttgtaaggcacggggagcgcgtggatcagatattcggcaaggcctggctacagcagtgctccacgcctgacggcaaatattaccggccagatctaaactttccttgttcactcccccgacgctcgcgcggcattaaggattttgagaacgaccccccactttccagctgtgggatcttccagtcccgtatcgcaggagacgcactccttgattcaggcatccgcattagttctgtgtttgcatctcccgccttacgatgtgtacaaacagctaaactgatcctggaagagttgaagctcgaaaagaaaattaaaatccgcgtcgaacccggcatatttgagtggactaagtgggaagcaggtaaaactacccccaccctgatgagccttgaggagctgaaggaggccaactttaacattgacaccgactaccgccccgccttcccactgagcgcccttatgccggccgagtcctaccaggaatacatggatcggtgcacagctagcatggtgcagattgttaacacatgcccccaagacactggcgtgatcctgattgtttcgcatgggtccactcttgattcatgcacccgccctcttctgggtttgcctcccagagagtgtggcgatttcgctcagctggtgcggaaaatacccagcctgggaatgtgcttttgcgaagagaacaaagaggaaggcaagtgggagctcgtgaatccccctgtgaagaccctgacacacggagcgaacgcagcattcaattggaggaattggatctcgggtaattag

SEQ ID NO: 139666 - DNA, 369 bp, Artificial Sequence
  Description of Artificial Sequence: Synthetic coding sequence
atggctgctggcgagactcagctttacgcgaaggtctctaacaagctgaaatcccggagttccccaagtctgctcgagcctctcctagccatgggattccccgttcatactgctttgaaagccctggcagccacaggacgcaagactgccgaggaggcactcgcctggctgcatgatcactgtaatgacccaagtttagacgaccccattcctcaagagtatgcactctttctgtgcccaactggacctcttttggagaaactgcaggaattctggcgagagtccaaaagacagtgtgccaaaaatcgggcacacgaggtatttcctcacgtgacactgtgtgacttcttcacaggccccgccgtgtag

SEQ ID NO: 139667 - DNA, 1581 bp, Artificial Sequence
  Description of Artificial Sequence: Synthetic coding sequence
atggcggcaggtgagacccagctctatgctaaagtgtcaaacaaattaaagagcaggagtagcccctcactcttagaacccctactggccatgggcttcccagttcacacagccctgaaagcgctagccgctaccgggaggaaaacggccgaggaggctctggcttggcttcatgaccattgcaacgatccgagtctggatgatccgatcccccaggaatatgcactgttcctgtgcccaactggacccctgctcgaaaagctgcaggagttctggagggaatcgaagcgccaatgcgccaaaaaccgtgcccacgaggtcttcccacacgtgactttgtgtgacttcttcacctgcgaagaccaaaaagtggagtgcctgtacgaggcactcaagcgagctggcgacagattgcttgggtcatttcccactgctgtccctctcgccctgcattcttcaataagttatcttggcttcttcgtgtccggttcccccgctgatgtcatccgcgagttcgcaatgacattcgcaaccgaggcatccctgctcgccgactgttccgtcaagccttgtaccaaacagctccacttaacccttgcccacaagttctatcctcatcatcaaaggactttggaacaacttgcacgcgctatccccctgggccactcctgccaatggaccgccgctctgtacagcagggatatgcggtttgtgcattaccaaaccctgcgagctctcttccagtacaagccacagaacgtcgatgaattgaccctatctcctggagattacatttttgttgacccaacccagcaggacgaagcatcagaaggatgggtaatcggcatttcccagaggaccgggtgtaggggtttccttcctgagaactatacagatagggccagtgaaagtgacacatgggtcaaacaccggatgtacacattcagtctcgcgacagaccttaatagccgcaaggacggagaagccagttcccgctgctctggcgagtttctgccccagaccgcaagaagcctaagttctttacaggccctgcaggccacagtggctaggaaaagtgtgctggtggtgcgacatggcgaaagggtagatcagatatttggtaaggcatggctgcagcaatgcagcacacccgatggtaagtactaccgaccagaccttaatttcccttgtagtctgccgcgacgatctcggggcattaaggatttcgaaaatgatccccccttgtccagctgtggtatcttccaatcaagaatcgccggcgatgccctcttagatagcggcatcagaatcagtagcgtattcgctagccctgctctcaggtgcgtgcaaaccgccaagctgatattagaggaacttaagttggagaagaagatcaaaatccgggtggagcccgggatctttgagtggactaagtgggaggccgggaaaactacgccaacccttatgtccttggaagagctgaaagaggccaatttcaacattgacaccgattatcggtcccttccttgggcttgcgctagcgtcaagaagatcaaaaggaaagaaaatggatcgtggtag

SEQ ID NO: 139668 - DNA, 1950 bp, Artificial Sequence
  Description of Artificial Sequence: Synthetic coding sequence
atggcccagtatgggcaccctagtccccttggcatggcggcacgcgaagagctgtactctaaagtcactccccgcagaaataggcaacagcggccagggacaattaagcacggtagcgcactcgatgtgctgctttctatgggcttccccagggccagagcccagaaagctttggcctccacgggaggccgaagtgttcaggccgcatgtgattggttgtttagccatgtcggcgatcctttcctcgacgaccctctgccccgtgaatatgttttatacctcagacccacggggcccctggcccagaagctgagtgatttctggcagcaatccaagcagatttgtggcaagaacaaagcgcacaacatcttcccacacatcactctctgccagttcttcatgtgcgaagatagcaaagtcgacgctctcggcgaagctctgcagactacagtgagtagatggaagtgcaagttctctgcgcccttgccattggaactgtacacatcaagcaactttatcgggcttttcgtcaaggaggactccgccgaagtcttgaagaagtttgcagccgatttcgcagctgaggctgccagtaagacagaagtacacgtagagcctcacaagaagcagttgcatgttaccttagcttaccatttccaggcctctcatcttcctaccctggagaaactggcgcagaacatcgatgtgaaacttgggtgcgattgggtggcaaccattttttctcgtgatattagatttgccaaccacgaaactctgcaagtaatatacccttatactccgcaaaatgacgatgagctggaactcgttccgggagacttcatttttatgtcacccatggaacagacctccacctcggaaggctggatctatggtacatctttgacaaccgggtgttccggtcttctgccagagaactacattaccaaagccgacgagtgttccacatggattttccacggcagctattcaatccttaatacttcctccagtaactctcttactttcggagatggagtactggaacgccgaccttacgaggaccagggcctcggagaaaccaccccactcacaatcatttgtcagcctatgcaacccctgcgcgtcaatagccagcctgggcctcagaagcgttgcctatttgtatgccggcacggggagaggatggatgtggtgttcggtaagtattggttgagtcagtgcttcgacgccaaggggagatatatcagaacaaatttgaacatgcctcattcactgccacaacggtctgggggctttagggactatgaaaaggatgcgcccattacagtctttggctgcatgcaagctcgtctggtgggcgaagcccttcttgagtccaacactatcatagatcacgtgtactgtagccctagcctgcgctgcgtgcagaccgcccacaatattctgaaaggcctgcagcaggagaatcacctgaaaattagagtggaaccaggcttgttcgagtggactaagtgggttgcggggagtactctccccgcctggattcctcctagcgagctagccgccgctaacctctccgtggatacgacctaccggccgcatattcccatttcaaaattagtcgtcagcgagtcctacgacacttacatctctcgctcatttcaggtgacaaaagaaatcatttcagagtgcaaatccaaaggcaacaacatcctcatagtagcccacgcctcaagcttggaagcctgtacttgtcagctgcaggggctgtctccccagaactcaaaggattttgtacagatggtcaggaaaatcccttatctgggattctgttcttgcgaggaactaggcgaaaccggtatttggcagcttaccgaccccccgatcctgcctctaacccatggtccaaccggggggttcaactggagggagaccttgcttcaggaatag

SEQ ID NO: 139669 - DNA, 1509 bp, Artificial Sequence
  Description of Artificial Sequence: Synthetic coding sequence
atggcaagtaagaaactaggcgcggacttccacggaacgttcagctacctggacgatgtcccctttaagactggcgataaattcaaaacaccagcaaaggtcggcctgccaatcggattcagcctgccagactgtctgcaggtggttagggaggtgcaatacgacttcagcctcgaaaagaaaactatcgaatgggctgaggagatcaagaagatcgaagaagctgaaagagaagccgagtgcaaaattgccgaagctgaggcaaaagtgaactcaaagtctggcccggagggagacagcaagatgtctttctcgaaaacccatagcacagctacgatgcctcctccgatcaacccaattctggcaagcttgcagcataactctatcctcacccccacccgtgttagcagcagtgccaccaaacagaaggtgcttagccctccccatataaaggctgatttcaacttagccgacttcgagtgtgaagaggatcctttcgacaatcttgagctgaagaccattgatgagaaagaggagctgaggaatatcttggttggaactaccggtcccatcatggctcagctcctcgataataatcttccccggggcggatctgggtccgtgctgcaggacgaagaggtcctcgccagtttagagagggccacactcgactttaagcccctgcataaacctaacgggttcatcacgctaccgcagcttggaaactgtgaaaaaatgtccttgagttccaaagtttctctgcctcccatccccgctgtcagcaatatcaaatccctgagttttccaaagcttgacagcgatgactctaatcagaagactgccaagcttgccagtacattccattccacctcatgcctgcggaatggaacattccagaactcactgaagccctctacacaaagttcagcctctgagttgaacggacaccacactttgggcctgtcagccctgaacctcgactctggcactgaaatgccagcactcacttcatcccagatgccttcgctgtccgtgctgtcagtttgcaccgaagagtcaagccccccaaacacaggtcctacagtcaccccccccaacttttccgtctcacaggtacctaatatgcctagctgcccacaggcgtattccgaactgcagatgctgtcgccttctgaacgccaatgtgttgagaccgtcgtgaacatgggttattcctatgaatgcgtgctcagagctatgaagaaaaagggggaaaacatagaacaaatcctggactacttgtttgcccacggccaattatgtgagaaggggttcgaccccctgctggtggaagaagctttggaaatgcaccagtgctccgaagagaagatgatggagttcctgcagctgatgtccaagttcaaggaaatgggcttcgaacttaaggatatcaaggaggtgctgctgctgcataacaatgatcaagataacgccttggaagacctgatggcgcgcgccggtgcatcatag

SEQ ID NO: 139670 - DNA, 1509 bp, Artificial Sequence
  Description of Artificial Sequence: Synthetic coding sequence
atggcaagcaagaagcttggtgctgactttcacggcaccttcagctatctcgacgatgtgccctttaagacaggtgataagttcaagactccagcaaaagtcgggcttcctattggattctcactacctgattgtctgcaagttgtaagagaggtgcagtacgatttttcactcgagaagaagactatcgagtgggcggaggagattaaaaaaattgaagaggcagagcgcgaagctgaatgcaaaatcgccgaggctgaagccaaagtcaactcaaagagcggcccagagggagattccaagatgagcttcagcaagacacactcaaccgcaacgatgcccccaccaattaatcctatacttgctagcctgcagcataactccattctgacccccactagggtgtcctcatccgcaaccaagcagaaggtgctgtcccctccccacattaaggcagactttaatttggcggactttgaatgtgaggaggacccctttgataatcttgaactgaagactattgacgagaaggaggagttacggaacatcctggtgggtacaacaggtcccatcatggcccagttgcttgacaacaacctcccacgaggcgggagcggaagcgttctgcaggatgaggaagtcctggcatcattagagagagctacgttggattttaagccgctgcataagcctaacggcttcatcaccctgcctcagctcggtaactgtgaaaagatgtcactttctagcaaagtcagtttgcctccgattccggcggtgagtaatatcaaaagcctctccttcccaaagctggacagcgatgactcgaaccagaagaccgcaaaactggcctcaacttttcactccacttcctgtctccgtaatgggactttccagaacagcctgaagccatcaacgcagtcttcagctagcgagctcaatgggcaccatactctggggctgagcgcactaaaccttgacagtggaaccgagatgcccgctctcacatcttcacaaatgccttccctttccgtgttgtctgtctgcaccgaggagagctcgccccccaacactggaccgactgtaactccacctaatttctcggtatctcaggtgcctaacatgccttcctgtccccaagcctattcagagcttcagatgctctctccctccgaaaggcagtgtgtcgagacagtggtcaatatgggctacagttacgagtgcgtgttgcgagcaatgaaaaaaaaaggcgagaacatcgaacagattctcgactacctgttcgcccacggacaactgtgcgaaaagggttttgacccacttctggtggaggaggcactcgagatgcaccagtgttctgaagagaagatgatggagttcctgcagctgatgtccaagttcaaggaaatggggtttgagcttaaagacattaaagaagtcctactcctgcataacaacgatcaagacaatgccctggaagacctgatggccagggccggcgcaagctag

SEQ ID NO: 139671 - DNA, 1326 bp, Artificial Sequence
  Description of Artificial Sequence: Synthetic coding sequence
atggcttccaaaaaattgggagcggacttccacggcacgttttcatacctggatgacgtgccgtttaaaacaggagacaaatttaagactccggctaaagtgggcttacccattggattttccttgccggactgcctccaagtagtgcgggaggtgcaatatgattttagcctggagaagaagaccattgagtgggctgaggagataaaaaaaatcgaggaggccgaacgtgaagcggaatgcaagatcgccgaggctgaggccaaagtgaactctaagtcaggaccggaaggcgacagcaaaatgtcatttagcaaaacacactccaccgcaaccatgccgcctcctattaatccaatcctggcctccttgcagcataatagtatattgacccccacacgggtgagctctagtgccaccaaacagaaagtcctctctcctcctcatattaaagccgacttcaatcttgccgacttcgagtgtgaagaagacccattcgataatctcgagcttaaaacgattgatgagaaggaagaattgaggaatatcctggttggcacaaccggtcccattatggcccagttacttgacaataacctgccacgggggggatctggctcagtgcttcaggacgaagaagttttggctagtctagagcgcgctacgttggacttcaaacctttacataagcctaacggtttcatcacgctccctcaacttggcaattgtgaaaaaatgagcctgtcatctaaggtctccctgcctcccatacccgcagtgagcaacataaagtccctgtcattccccaaattggacagcgacgactccaatcagaaaaccgctaagctggcaagcacgtttcactctaccagttgtcttaggaacgggacatttcagaattccctgaagcctagcacgcagtcatcagcctccgaactgaatggacaccacactctgggcctgagcgccctaaacctggattctggaaccgagatgcccgccttgacctcctcacaaatgccatccctgtctgtactttccgtatgtactgaggaaagttcccctcctaacacaggccccaccattctcgattatctgttcgctcacggccagctgtgcgagaaaggctttgaccccctgttggttgaagaggcactggagatgcaccagtgttctgaggagaagatgatggagtttttgcagctgatgtccaaatttaaagagatgggtttcgaattgaaagacattaaagaagtcctcctgctgcacaacaatgaccaggataatgccctggaggacctgatggctcgggcgggagcttcctag

SEQ ID NO: 139672 - DNA, 1509 bp, Artificial Sequence
  Description of Artificial Sequence: Synthetic coding sequence
atggcatctaagaaattaggagccgactttcatggcaccttttcttacttagatgacgtgcctttcaagacaggggacaaatttaagacccccgccaaagtcggtctgccaatcggattttctctgcctgattgtctgcaggtcgtgagagaggtgcaatatgatttctcgctggagaagaagacaattgaatgggcggaggaaattaagaagatcgaagaagccgagcgggaagccgaatgtaagatcgcggaggctgaagctaaagtcaattccaagagtggcccagagggtgacagtaaaatgagtttttcaaagactcacagtacagctacaatgcctcctcccataaaccccatcctcgcttccttgcagcacaacagcattctgacccctactcgcgtgagtagttctgctaccaaacagaaggtgctgtcaccgccgcacataaaggccgacttcaacctggcggatttcgaatgtgaagaagacccgttcgacaatttggagctcaaaactatcgacgagaaagaggagctacggaacattttggtagggaccaccggccctataatggcccagctcctggacaacaatttaccgcgggggggatccgggagtgtgctccaggacgaggaagtgctagcctcactagaacgcgccactttagactttaaaccgcttcataagccaaacggtttcattaccctgccccagctcgggaattgtgagaagatgtccctctcttccaaggtgtctttaccgcccatccctgcagtgtccaacatcaaaagtctgtctttccctaagcttgactctgatgactcaaaccagaagaccgcgaaactggccagcactttccatagcacctcctgccttagaaacggcactttccagaacagcctgaagccatccacgcagagctcagcctcagaactcaatggtcaccacacacttggactctccgcccttaacctagattcaggtaccgagatgcctgctctgacaagtagccaaatgccttcactatcggtattgagcgtctgcactgaggaaagcagccctcctaacacgggccctaccgtaacaccaccgaatttttccgttagccaagtgcccaatatgccatcgtgccctcaagcctactctgaactacagatgctctccccaagtgaaagacagtgcgttgagacggtcgtaaatatgggctacagttacgagtgcgtgttaagagccatgaagaagaagggagagaacatagaacagattctggactatctcttcgcgcacgggcagctctgtgaaaaaggatttgatcccctgttagtggaggaagccctggagatgcatcaatgctccgaagaaaaaatgatggagttcctgcagctcatgagtaaatttaaggagatgggtttcgaactcaaagatatcaaagaggtgctgctgttacacaataatgaccaggataacgccttggaggacttgatggctagagcgggggccagctag

SEQ ID NO: 139673 - DNA, 1509 bp, Artificial Sequence
  Description of Artificial Sequence: Synthetic coding sequence
atggcctccaaaaagctgggggctgactttcatggcacattcagctacctggatgatgtgccattcaagacaggggataaatttaaaacccccgccaaggtagggctcccaattgggttttccctgcctgattgtttacaggtggtccgggaagtccaatacgacttcagtctcgaaaagaaaacaattgaatgggcggaggagatcaagaaaattgaagaagccgagcgggaggcagagtgtaagattgcggaggccgaggccaaggtcaactctaagtcaggtcctgaaggcgatagcaagatgtccttttccaagacccatagcaccgccaccatgccacctcccatcaatccaatacttgcttcactgcagcacaattccattctgactcctactcgggtgtccagctcagccacaaaacagaaggtcctctcgcctccacatattaaggccgacttcaatctggctgatttcgagtgtgaagaagaccctttcgacaaccttgagctgaagacaatcgatgagaaggaagaattacggaatattttggtaggcacaacaggacctatcatggcccagttgttagacaataacctgccccgcggcggatccggatcagttttgcaggacgaagaagtgctcgcctctctcgaaagagcaaccctggactttaaacctctccacaaaccgaatggcttcattaccctaccgcagctgggcaattgtgagaagatgtctctgtcatcgaaggtgtccttgcccccaatcccagcagtctccaatattaaatccctctcctttccaaaactcgactccgatgatagtaaccagaagaccgctaagcttgcatccactttccatagcactagctgtctgcgcaatggaacatttcaaaattcacttaagccctccactcagtcttctgctagcgagctgaacggtcaccataccctgggcctgagcgctctgaatctcgacagtggaacagagatgccagcactgaccagtagtcagatgccttccttaagtgtgctcagcgtgtgcaccgaggagtcgagcccacccaatactggccctacagttacgcctcccaattttagcgtgagtcaggtgcccaacatgccctcgtgcccacaggcttactccgagctccagatgttgtcgccctctgagagacaatgcgttgagaccgtggttaatatgggctactcttatgaatgcgtgctgagggcaatgaagaagaaaggtgaaaatattgagcagattctggactatctgttcgctcacgggcagttatgcgaaaaagggttcgatcccttgctagtggaggaggctcttgaaatgcaccagtgttctgaggagaagatgatggagttcctccagctgatgtctaagttcaaggaaatgggttttgagctcaaggacattaaggaggttttgttgctacacaacaatgaccaggacaatgccctggaagatttgatggcccgggccggcgccagttag

SEQ ID NO: 139674 - DNA, 1617 bp, Artificial Sequence
  Description of Artificial Sequence: Synthetic coding sequence
atgtcgggagccgtgcggggccggcgtcgagaggtgggcctccaacatgggggttgtggaaccggtggagggtatggagatgggttagcacggagtggacagtcctggcggtggtggcggtctttgtccctcggtgcagtaggctcctcagctggcaccgaacctgggagaccagccggagcttccaccttccggctgctcaggcgacggcagcaaagacactctggaagcaagtggctcctccgctcttgggtgcagatcttcatgtatgacttttcattagagaagaagactattgagtgggctgaggagatcaagaagattgaagaggcagaacgtgaagccgaatgtaaaatcgccgaagccgaggctaaggtcaacagcaagtcgggccctgagggagactctaagatgagctttagtaaaacacattccacggccactatgcctccacctataaatcctatacttgccagcttgcagcataatagcattctgactccaactagagtctcgagctcagcaactaaacagaaagtgctctctcctcctcatataaaagcggatttcaaccttgccgatttcgaatgcgaagaagaccctttcgacaacttagagttgaaaacaattgatgagaaggaagaactacggaatattttggtcggaactaccggacccattatggcccagctcctggataataacctccctcgggggggctctggatccgtgctgcaggacgaagaagtgttggcctcactggagcgggccaccctggatttcaagcccctccacaaacccaacggatttatcacattgccacaactaggcaactgcgaaaagatgagcctgtcgagcaaggtgtctttgccacctattccagctgttagtaacatcaaaagcctcagctttcccaagcttgattcagatgacagcaatcagaaaactgccaagctggcttcgacgtttcactcgacctcctgcttgcggaatgggacattccagaacagcctgaagccaagcacccaatcgagcgcttccgagctcaacggccaccacacattaggactgtccgctctaaacctcgactcaggaactgagatgcctgcactcacctcaagccaaatgcccagcttgagcgtgctttcagtgtgcacagaggagtcaagtcctcccaacacaggtcctacagttacaccacccaatttctccgtttctcaggtgcccaacatgccttcctgcccacaggcttacagcgaactgcaaatgctgtcgccttctgagcgccagtgtgtagagactgttgtgaacatgggctacagttacgaatgtgtgctgagagctatgaagaagaagggcgagaacattgaacagatcttggattacctgttcgcacatggacaattgtgtgaaaagggattcgatcctctgctggtcgaggaggcactcgagatgcatcaatgtagcgaagagaaaatgatggagtttctccagctcatgagtaaatttaaggaaatgggctttgagctcaaggacatcaaggaggttttacttctgcacaacaatgatcaggataatgcacttgaggacttgatggctcgcgcaggagcttcttag

SEQ ID NO: 139675 - DNA, 1701 bp, Artificial Sequence
  Description of Artificial Sequence: Synthetic coding sequence
atgtccggagccgtacggggacgccgaagagaagtcggattacagcatggcgggtgcggaacgggaggtggctacggagatggactcgcacgaagtggccagtcctggcggtggtggaggtcactaagcctaggcgcggtgggatcctcagcaggtaccgagcccgggaggccagcaggcgcttctaccttccgcctgttgagacgaaggcaacagagacactcaggaacctttagctatttggacgacgtcccatttaagaccggggacaagtttaagacccccgccaaggtgggcctccccattggcttctccctgcctgactgcctgcaggtcgtgcgcgaggtccaatacgacttttcactcgaaaaaaaaacgatcgaatgggcggaggaaattaagaagatcgaggaagcggagagggaggctgaatgcaagatagccgaggcagaagctaaggtcaactccaagtctggcccggaaggtgactctaaaatgagtttctccaagacccattctaccgcaactatgcccccacctatcaatccgatcctggcatcactgcagcacaatagtatcctcacacctactcgcgtgtctagcagcgccacgaagcaaaaggtgctgagcccccctcacatcaaggcagattttaacctcgccgatttcgagtgtgaggaggatccattcgataacctcgaattgaagactatcgacgaaaaggaggagctccgcaatattttggtcggcaccacaggacctattatggctcagctcctggacaataaccttccacgcggaggctctgggtcagtgttgcaagatgaggaagttcttgcctccctggaacgagccacactcgacttcaaacctctccacaaacccaacgggttcattacactgccccaactcggcaactgcgaaaaaatgtccctaagctccaaggtgagcctacccccaattccggctgtgtccaatatcaaatctttgagcttccctaaactagactcagatgacagcaatcagaagacggcaaagctggctagtactttccacagtacttcctgccttcgcaatgggaccttccaaaacagcctcaagccaagcacccagtcgagtgcgtccgagttgaatgggcaccacacactcggcctgtccgcactgaaccttgattccggaacagagatgcccgcactgactagttctcagatgcccagtctatctgtgctctctgtgtgcactgaagagtcctcgccacccaatacaggtcccacagtgactcccccaaactttagcgtctctcaggtccctaacatgcctagttgcccgcaagcttatagtgaacttcagatgctatctccttcggagcgtcagtgcgtcgagaccgtggtcaacatggggtactcttacgagtgtgtgcttcgcgccatgaaaaagaaaggcgagaacatagaacaaattctggattacttgtttgcccacggacagttgtgcgagaagggctttgatcctcttctcgttgaagaggcactggaaatgcaccagtgcagtgaggagaagatgatggagttccttcagctgatgagcaagtttaaagaaatggggttcgaactgaaggatataaaggaggtcctgctccttcacaataatgaccaagacaacgcgttggaagacctgatggcgagggctggagcttcctag

SEQ ID NO: 139676 - DNA, 690 bp, Artificial Sequence
  Description of Artificial Sequence: Synthetic coding sequence
atgcaaattttcgtgaagaccctgaccgggaagaccatcactctggaggtcgagccttcagacacaatcgagaacgtaaaagccaagattcaggacaaagaggggatcccaccagatcaacaacgattaatcttcgccggtaaacaactcgaggatggcaggactctttcagattataatattcagaaagaaagcacactccacctggttttaaggttgcggggcggtatgcagatctttgtgaaaaccctcaccggcaaaacaattaccctcgaggtggagccctcagacacaatcgaaaacgttaaggccaagatacaggataaggaaggaattcctccagatcagcagcgtctaatatttgcaggcaaacagctcgaagacggacgcaccctgtctgattataatatccagaaggagtccaccctccacttggttctgagactgcgcgggggaatgcaaattttcgtgaaaacattaacggggaaaactatcactctcgaggtggaaccgtccgacacaatcgagaacgtgaaagccaaaatacaggacaaagagggaattcctcccgatcagcagaggctgattttcgccggcaagcagctagaggacgggcggaccctgtccgattataatattcagaaggaatccaccctgcatttagttctccgtttacggggggggtgttag

SEQ ID NO: 139677 - DNA, 690 bp, Artificial Sequence
  Description of Artificial Sequence: Synthetic coding sequence
atgcagatttttgtaaagacactgacaggaaaaaccataacgctggaggtcgaacctagtgataccatcgagaacgttaaggcgaaaatccaggataaggaagggattcctcctgatcagcagagactgatttttgctggcaagcagctggaggatggccggacattaagcgattacaatatacaaaaggagagcacacttcaccttgttctgcgattgaggggcggtatgcaaattttcgtgaagactcttactggaaagacaatcacactggaagtggaaccaagcgatactatagagaatgtgaaagctaaaattcaggataaggaaggcatcccccccgaccagcagagactcatttttgcaggaaagcagcttgaggacgggagaacattgtcagattacaacatccaaaaagagtccacgttgcaccttgttttgcggctcagaggtggcatgcagatctttgttaagacgctgactggtaaaacaatcacactggaagttgagccaagcgataccatcgagaacgttaaagctaagattcaggacaaggaagggatccccccagatcaacagagactgattttcgcaggcaaacagctggaagatggtcggactctgagtgactacaatattcagaaggaaagtactctccatttggtgctcaggctgagaggagggtgctag

SEQ ID NO: 139678 - DNA, 690 bp, Artificial Sequence
  Description of Artificial Sequence: Synthetic coding sequence
atgcagatctttgttaaaaccctgacaggtaaaacaataaccctcgaagtcgagccatcggacaccatcgaaaacgttaaggctaagattcaggataaagagggcataccaccagaccaacagcgccttatcttcgctgggaagcaattggaggacggccgcaccctttctgattataacatccagaaagaatccacgcttcaccttgtgctgaggctgcgaggaggcatgcagatctttgtgaagacactcaccggaaagacaattaccttggaggtggaaccttctgacaccattgaaaatgtgaaggcaaaaatccaagacaaagagggcattcctcctgatcagcagcggcttatcttcgccggcaagcagctggaagatggtaggactctgtctgattacaacattcagaaagagtcaactctgcatctggtgttgagactgaggggagggatgcagatttttgtcaaaacactcacaggcaaaactatcacgttagaagttgaaccgtcggacaccattgagaatgtgaaggcaaaaattcaagacaaagagggaattcctccagaccagcagagactcatcttcgcaggtaaacagttagaggatggcagaacgttgtctgactataatattcaaaaagaatcgactctccaccttgtcctccgtctacgcggcggctgttag

SEQ ID NO: 139679 - DNA, 462 bp, Artificial Sequence
  Description of Artificial Sequence: Synthetic coding sequence
atgcagatatttgtgaagacccttaccggtaagaccataacactcgaagtagagccttcagatactatcgaaaacgtcaaggcaaagatccaggacaaagaaggcatcccacccgatcagcaacgcctcatcttcgccggaaagcagctcgaggatgggcggaccctcagtgactacaacattcagaaggaatccacgctccacctcgtgttgcgactgagggggggcatgcagatttttgtaaagactctgactggaaagaccatcaccctcgaagttgagccttccgataccattgagaacgtgaaggccaaaattcaagacaaggaggggattcctcccgatcagcagaggctgatttttgcgggaaaacagctcgaagacggccggactctgtctgattataatatccaaaaggagtcaacacttcacttagtccttaggctgagaggaggatgttag

SEQ ID NO: 139680 - DNA, 2058 bp, Artificial Sequence
  Description of Artificial Sequence: Synthetic coding sequence
atgcaaatcttcgtcaagacactgaccggcaagactattactctggaggtagagccctccgatactatcgagaatgttaaggcaaagatccaagataaggaggggattccccccgaccagcagcgtctgatttttgccggcaaacagctggaggacggacggaccctctcagactataatattcagaaagagagtaccctccacctcgtgctgcggttgcgaggaggtatgcagatctttgtcaagactctgaccggaaaaaccatcactctggaagtggagccatctgacaccatcgagaacgttaaagcaaaaatacaggacaaggagggcattcccccagatcagcagagactgatatttgctggaaaacagctcgaggacgggaggaccttatccgattataacattcagaaggagtctacactccacctcgtacttagactgagaggcgggatgcagatcttcgttaaaacactgaccggcaagaccatcactctggaggtggaaccttccgacaccattgaaaacgttaaggctaagatccaggacaaagagggaattcctagcgaccagcagcgacttatcttcgccggaaagcagctagaggacggccggacgttgtccgactataacattcagaaagagagcacgctgcatctcgtgctccgtctccgggggggaatgcagatttttgtgaagaccctaaccggaaagaccatcaccctggaggtggaaccatcagacaccattgaaaacgtcaaggccaagatccaagacaaagagggaataccccccgaccaacaacgactgatctttgccggaaagcaactggaagacggaaggactctgtcagactacaatatccaaaaggagtccacgctgcaccttgttctgcgcctcaggggcggcatgcagatattcgtcaaaaccctgactggaaagacaataaccttggaggttgaaccttccgacaccattgaaaatgttaaagccaaaatccaagataaagaagggataccccccgatcagcagaggcttatcttcgccggaaagcagctggaagacggccgcactctcagcgactacaacattcaaaaggagtctaccttgcatctcgttctgagactccgcggcggcatgcagattttcgtcaagaccctgacagggaagaccattactcttgaagtggagcccagtgatacaattgaaaacgttaaggccaagatccaggacaaggaggggattcctcccgaccaacagcggctcatcttcgccgggaaacaacttgaagatggaagaactctgagtgattacaacatccaaaaggagtccactctgcatctggtactaaggctgcgggggggaatgcagatcttcgttaaaacattaacaggcaaaaccattacactggaagtagagccttccgacactatcgagaatgttaaagcaaagatccaggacaaagaagggatccccccggaccaacagcgactgattttcgctggcaagcagctcgaggacggcagaacactgagcgattataacatacagaaggaaagtactcttcatctcgtcctgaggctgcggggtgggatgcaaatattcgtgaagactctgaccggcaaaactatcacattagaagttgagccatccgacaccatagaaaacgtaaaggcaaaaattcaggataaagaaggtataccacccgaccagcagcgcctgatcttcgcagggaagcagcttgaggacggcaggacactgagtgattacaatattcagaaggaatcaactttgcatctggtattaagattgcggggaggaatgcagatcttcgtcaagactttaacagggaagacgataacgctcgaggtcgaaccatctgataccatcgagaatgtgaaagccaaaatccaggacaaggaagggatccccccggaccaacagaggctgatttttgcaggcaagcagttggaagatggcaggacgctgtctgattacaatattcaaaaagagagcactctgcacctcgtccttagattgagaggtggggtgtag

SEQ ID NO: 139681 - DNA, 450 bp, Artificial Sequence
  Description of Artificial Sequence: Synthetic coding sequence
atgcagatctttgtcaaaactctcacaggaaagacgataacactcgaagttgagcctagcgatacgatcgagaacgtaaaggccaagattcaggataaagaggggattcccccagaccaacaacggttaatcttcgcgggcaagcagctggaggatggccggactctatctgactataatatccaaaaggaaagtaccctccacttggtactgcgattgcgtggaggaatgcagatttttgtaaaaaccttgacaggaaaaacgattacgctcgaggttgagccgtccgataccattgaaaacgtcaaggccaaaatccaggataaggaaggtatcccgccagaccagcagagattgatcttcgccggcaagcagctagaggacgggcggactcttagcgactacaacatccagaaagaaagtaccctgcacctggtcctgagactttag

SEQ ID NO: 139682 - DNA, 372 bp, Artificial Sequence
  Description of Artificial Sequence: Synthetic coding sequence
atgcagatcttcgtaaagactttgaccggcaagacaatcactctcgaagtcgaaccttctgataccattgaaaatgtcaaagctaagattcaggataaagagggaatccctcctgatcagcaaaggttgatcttcgctgggaagcagctcgaagatggacggaccctgtcagactataatattcagaaagaaagcacactccatctcgtgttgagactgcgggggggcatgcagatctttgtgaagacactgaccggtaagaccatcacacttgaagtggagccctctgacacaatcgagaacgtcaaagccaaaattcaggacaaggaaggaatccctccagaccagcagagactgatctttgcaggttag

SEQ ID NO: 139683 - DNA, 2058 bp, Artificial Sequence
  Description of Artificial Sequence: Synthetic coding sequence
atgcaaatttttgtgaagactcttacgggcaagacgatcacgcttgaagtggagccctctgataccatcgaaaacgtcaaagcgaagattcaggataaagaaggaatccccccagatcagcagcgcctgatcttcgctggtaaacagctagaggacggtaggacactcagcgattacaatattcaaaaggagagcacactccacctggtgcttcggttgcgcggcggcatgcagattttcgtcaaaacgctcacaggaaagaccattactcttgaagtcgagccctctgacactatcgagaacgtgaaggctaagatccaggataaggagggaattccccctgaccagcagagactgatcttcgctggaaaacagttggaggacggccgaacacttagcgactacaacatccagaaggagtccacactccacttggtattgagacttagggggggaatgcaaatctttgtcaaaactctcactggaaaaaccataactttagaggtcgagcccagcgataccatcgaaaatgtcaaggcaaaaattcaggacaaagaaggtatcccatcagatcaacaacgactgatatttgccgggaaacagctggaagacgggcgaacattgtctgattataatatccaaaaggagagcactctgcacctggtgttgagactccggggcggcatgcagatcttcgtgaagacccttactgggaaaacaataacactggaagttgagccctccgataccattgagaacgtcaaggccaaaatccaggataaggaaggcattcctccggatcaacagcggctcatctttgctggtaagcagctcgaagacggaagaactctgtcagattacaacattcagaaagaatcaacactgcacttggtgctgaggctccgcgggggcatgcaaatctttgttaagactctcactgggaagactattactctcgaagttgagccaagcgacacaatagagaacgtgaaggcgaaaatccaggataaagaggggattccacccgaccagcagcgactcattttcgctggaaaacagctcgaagatggtcgaacattatcagactacaatattcagaaggaaagtacattgcatcttgtgctccgcctcagagggggtatgcagatctttgtgaagacgctgaccggcaaaactatcactctggaggtggaaccctcggacaccatcgaaaatgtcaaagcaaaaatccaggacaaggaggggatccctccagaccagcaacgtctgatattcgctggaaaacaactcgaagacggccgaacactctctgactataacatacagaaggagagcaccctgcacctggtcctgagacttcggggtggcatgcagatctttgtgaagacactgaccggaaagaccatcactctcgaggtggagccctctgacactattgagaacgtcaaagcaaagatccaagacaaggaggggatccctcccgatcagcagcgcttgatcttcgctgggaagcagctggaggacggcaggactctctcagactataacattcaaaaggagagtaccttgcacctggtgctgcggcttcgcggagggatgcaaattttcgtgaagacattaacaggaaaaacaattacgcttgaagtggaaccaagtgacacgatcgaaaatgtgaaagccaaaatccaggataaggaaggcattccacccgaccagcagagacttatctttgctggaaaacaactggaagacggccgcacccttagcgattataacattcagaaagagtccaccctccatctggtgctaaggcttcgtgggggtatgcaaatcttcgtgaagacactgacaggtaaaaccattacattagaggtcgagccaagcgacaccatcgagaatgtcaaagccaaaatccaggataaagaggggatccctcccgatcaacagagactcatatttgctggaaaacagctggaggacggccggactctaagcgactacaacattcagaaagagtctacactgcatctggtgctccggctgcgtggcggggtatag

SEQ ID NO: 139684 - DNA, 486 bp, Artificial Sequence
  Description of Artificial Sequence: Synthetic coding sequence
atgcagattttcgtgaagactctgacaggaaagaccataacactggaggtcgagcccagtgacacgattgagaacgtgaaagctaagatccaggataaggaagggatccctcccgaccagcaacggttaatctttgctggtaaacagctggaggacggaaggacactgtcagattacaacattcagaaggagagtacactgcacctcgtactgaggctccggggaggaatgcagatcttcgttaagacactgaccgggaagacaattaccctcgaagtggaaccgtccgacaccatcgaaaacgtcaaagctaagattcaggacaaggaggggattccgcctgatcagcaacggttgattttcgcaggtaaacagcttgaagatggccgtacgctgtcagattataatattcagaaggaaagtaccttgcaccttgttttgcgcctgcggggcggtatgcaaatctttgtcaaaacactgacctag

SEQ ID NO: 139685 - DNA, 405 bp, Artificial Sequence
  Description of Artificial Sequence: Synthetic coding sequence
atgcagatttttgtgaagacactgactggaaagacaattactcttgaagttgaaccctcagataccatcgagaatgtgaaggctaaaatacaggataaagaagggatcccaccagaccagcagcgcttgatattcgcgggcaaacagctcgaggatgggcgcacactgtccgactataacattcagaaagagagcaccctacacctggttctgagactccgtggggggatgcagattttcgtgaaaaccctcacaggaaagactattaccctagaagtggagccctccgacaccatcgagaacgtcaaagccaagatccaggacaaggagggtattccacccgaccagcagaggttgatctttgccggcaagcagttagaggacgggcgcacactgtctgactag

SEQ ID NO: 139686 - DNA, 510 bp, Artificial Sequence
  Description of Artificial Sequence: Synthetic coding sequence
atgcaaatttttgtaaagaccctgacgggcaagaccatcacacttgaagtcgagccttccgatactatcgagaacgttaaagcgaaaatacaggacaaggaaggaatccctcctgaccagcaacggttaattttcgcgggcaagcagttagaggacggacggactctgtcagattataacattcaaaaagagtcaaccctgcatctggtgctccgacttcggggcgggatgcagatctttgttaagaccctgactggcaagaccattactttggaagttgagccgagcgacacaatcgagaacgtaaaggcaaaaatccaggacaaagaaggtatcccgtccgatcagcagagactgattttcgcagggaagcagctggaagacggccgcactctcagcgattataatatccagaaggagagtaccctccacctggtgctgaggctgcgcggagggatgcagatttttgtgaagaccttgactggcaaaaccatcacactggaggtctag

SEQ ID NO: 139687 - DNA, 468 bp, Artificial Sequence
  Description of Artificial Sequence: Synthetic coding sequence
atgcaaatcttcgtaaagaccctcacaggtaagactattactctggaagtcgagccgtcggacacaattgagaatgtaaaagcaaaaatacaggataaggaagggatccctccggatcagcagagattaatcttcgccgggaaacagctggaggatggaaggactctgtccgactacaacatacaaaaggagtcaactttacatctcgtgcttaggcttaggggaggaatgcagattttcgtcaagaccctgaccggcaagaccattaccctcgaagtcgaaccttctgatactattgaaaacgtgaaagctaaaattcaggacaaggaaggaatcccacccgatcaacagcggttgatatttgccggcaaacagttagaggacggacgaaccctgagtgattacaatatacagaaagagtccactctgcatttggtcctgcggctgagagggggcatgcagatctag

SEQ ID NO: 139688 - DNA, 186 bp, Artificial Sequence
  Description of Artificial Sequence: Synthetic coding sequence
atgcaaatctttgtgaagaccctgaccggcaaaactatcactcttgaggtggaacccagtgacaccatagagaacgtcaaggccaagattcaggataaggagggaataccacccgatcaacagaggctgattttcgctggaaagcagctggaggacggccgaaccttatcagattataacatttag

SEQ ID NO: 139689 - DNA, 1830 bp, Artificial Sequence
  Description of Artificial Sequence: Synthetic coding sequence
atgcaaatctttgtgaaaactctgaccgggaaaaccataaccttggaggtcgagccgtccgatacaatagaaaacgtgaaagcaaagattcaggataaagaaggtattccccccgaccagcagcgacttatctttgcaggtaaacagctggaggacggcagaaccttaagcgactacaatattcaaaaggagtcaactctgcaccttgtactccgcttgagaggcggaatgcagatcttcgttaagacactgacaggtaaaactataactttggaggtcgaaccatccgacaccatagaaaacgtgaaagctaaaatccaggacaaagaaggcatcccttccgaccagcaacgcctgattttcgcagggaagcaactggaggacgggagaacgttgagcgactataatattcagaaggaaagcaccctccacctggtactccgtttgcggggcggcatgcaaatcttcgtgaaaacactcaccggcaaaaccattacgctggaggtcgagccgtccgacacaatcgagaacgtcaaggctaaaatacaggacaaggaaggcatccctcccgaccagcagaggttgatatttgctgggaaacagctcgaggatggaagaacattgagcgactacaacatccagaaggaatccacattacacctggtgcttcggctgagggggggaatgcagatttttgtgaaaaccctgaccgggaagacgatcacacttgaggtggagccctcagatacaatagaaaacgtaaaggcaaagatccaggacaaagaggggattccacctgatcagcagcggctgatttttgcagggaagcaattggaggatgggcgtacattgtctgactataacatccagaaagaaagtacactccatctggttctccggctgcgcggtgggatgcagatcttcgtcaagactcttacaggaaagactatcacactcgaggtcgagccgtctgacacaatcgaaaatgtcaaagcaaaaattcaagacaaagaaggaattccacctgatcaacagcggctgatctttgccggcaaacagctcgaggatggaagaaccttatccgactacaatatacagaaagagtctactctgcatctggttctgcgtcttaggggcgggatgcagatattcgtaaaaacattaactggtaaaactatcacattggaggttgaaccttctgatactatcgaaaacgtgaaggctaagattcaggacaaagagggcatcccaccagaccagcagcgcctgatatttgctgggaagcagcttgaagacggacgcactctgtcagattataacatacagaaggagagtacgctacatttagttcttcggcttcgcggcgggatgcagatcttcgtgaaaacgttgaccggtaagacaattacattggaggttgaaccttccgacactatcgaaaacgtaaaagcgaaaatacaggacaaagagggcataccacccgatcagcaaaggctcattttcgctggtaagcagttggaggacggtagaacgctgagtgactataacattcagaaggaatctacattacacctggtgctgcgcctccgcggaggcatgcagattttcgtgaagacattgacaggaaaaactatcactctggaagtggaaccatctgacaccatcgagaacgtcaaagcgaaaatccaggacaaggagggtattcccccagatcagcagcgcctaattttcgctggaaagcagctcgaggacggacgcactctatccgattataacatccaaaaggagagtaccttacatctggtactgagactcagaggcggcgtctag

SEQ ID NO: 139690 - DNA, 411 bp, Artificial Sequence
  Description of Artificial Sequence: Synthetic coding sequence
atgcagatctttgtcaagacacttacagggaagactattaccctggaagtggaaccaagcgacaccattgagaatgtgaaggctaaaatacaagataaggaaggcattccgcccgaccagcagaggcttatatttgctggcaagcagctagaagatggcagaacactaagcgactacaacatacagaaggagagcaccttgcaccttgtgctacggctgcgggggggcatgcagatcttcgtcaaaacgctcacaggtaagaccattacgctagaagtcgaacctagcgacactatcgaaaatgtgaaagccaagattcaagacaaggagggcattccacccgaccagcagaggctgattttcgccgggaaacagctggaggacgggcgcacgttgtcggactataactag

SEQ ID NO: 139691 - DNA, 672 bp, Artificial Sequence
  Description of Artificial Sequence: Synthetic coding sequence
atgcagttaaaacccatggagatcaacccggagatgctgaataaggttctgagccgcttaggcgtcgccgggcagtggaggtttgttgatgtgctgggtctggaggaggagtcgctgggctcagtcccagcccctgcttgtgccttgcttcttttgtttcccctgactgcccagcatgaaaactttagaaagaagcagatagaagaactgaagggacaagaggtgtcccctaaggtatattttatgaagcaaaccatcgggaacagctgtgggactattggtctgattcacgctgttgcaaataaccaggacaagctggggttcgaggacggctcggttctgaagcagtttctctccgaaacagagaagatgtctccggaagatcgcgccaagtgctttgagaaaaacgaagcgattcaggctgcacacgatgctgtagctcaagaaggacagtgccgcgtcgatgataaagtcaattttcactttatcctttttaataacgtggatggccacctgtatgaacttgatggtagaatgccattcccagttaatcacggggcttcttccgaagacacgctcttgaaggatgccgccaaggtctgtagagagttcaccgagagagagcagggggaggtgcgcttcagcgccgtcgccctatgtaaggcagcctag

SEQ ID NO: 139692 - DNA, 642 bp, Artificial Sequence
  Description of Artificial Sequence: Synthetic coding sequence
atgcagctgaagcctatggaaatcaacccagaaatgctcaataaggtattgtctcgtttaggtgtggctggtcagtggagatttgtggacgtgctggggctagaagaggaaagtctgggctcggttcctgctccagcttgcgcactactcctgttgttcccactgacggctcaacatgagaacttccgcaagaagcagatcgaggagttaaagggccaggaggtgagccccaaggtatattttatgaagcaaacaatagggaactcttgtggaactattggactaatacatgccgtggccaacaatcaggacaagcttgggtttgaggacgggagcgtcctgaaacagtttctcagtgagactgaaaagatgagccccgaagacagagcaaagtgtttcgaaaagaatgaggctattcaggccgctcacgatgccgtagcccaggaggggcagtgtagagtcgacgataaggtcaattttcacttcatcctgtttaataacgtggatgggcatttgtatgaactggacgggcgcatgccattccccgtcaaccacggggcctctagcgaggacactctcctgaaagacgccgctaaagtatgtcgcgagttcacagaacgggagcagggcgaggttcggtag

SEQ ID NO: 139693 - DNA, 177 bp, Artificial Sequence
  Description of Artificial Sequence: Synthetic coding sequence
atgcagctgaagccgatggaaataaacccagaaatgcttaataaggtgctctcaagactaggggtagcaggtcagtggcgttttgtggacgtgctcggtctcgaggaagaatctctgggcagcgttcctgccccagcttgcgcccttctgctgctcttcccgctcactgctcaatag

SEQ ID NO: 139694 - DNA, 756 bp, Artificial Sequence
  Description of Artificial Sequence: Synthetic coding sequence
atggtgccaaggccagtatgcgctgtgctcctgctctttccgattaccgaaaagtatgaagtgtttcgtacagaggaggaagaaaaaataaaatcacaaggacaggacgtgacttcctctgtgtattttatgaagcaaactatctctaatgcctgcggtacaatcgggttgattcacgccattgccaacaacaaggacaaaatgcacttcgagtccggttcgacgctgaagaagtttcttgaggagtcagtgagtatgtctcccgaggagcgggccaggtaccttgagaattacgacgcgatccgggtcacgcacgagacttctgcccatgaggggcagacggaaagttcctccccatcctcttcacaaccccatagctctcattgtcggacaaaggcttcatccttgtgccaccacgcttccctgccatgggtgaaacgcaaccacgtggggccggccaaggctacctcgccatctctgcgcctgcgccgttggaggccattccttcgattacctagcctcggattgcattccgtggctccctctattgacgagaaggtggatctccatttcatcgcactggtgcacgtcgatggccacctctatgagctggacggcagaaagcccttccccattaaccacggagaaacgtcggatgagacactcctggaggatgcgatcgaggtatgcaagaaatttatggaacgggatccagacgagctcagatttaacgccattgcattgtccgccgcctag

SEQ ID NO: 139695 - DNA, 693 bp, Artificial Sequence
  Description of Artificial Sequence: Synthetic coding sequence
atggaggggcagcggtggctgccgctggaggctaacccagaagtcacaaaccaattcctaaagcagctgggcttacacccaaactggcaatttgtggatgtctacggaatggaccccgaactgttgagcatggtgcctcgtcctgtgtgcgctgtccttctgcttttcccaatcactgaaaagtacgaagtgtttagaacggaggaggaggagaaaattaaatcccagggacaggatgtgacctcttccgtgtactttatgaaacagactatctcaaatgcttgcggcactatcggcttgatccatgctatcgcaaataataaggataagatgcactttgaatccggaagcacactgaagaaatttctggaggagtctgtgtcgatgtcgcctgaggagcgggcgcggtacctcgaaaattatgacgcaattcgggtcacccatgagacctctgctcacgaagggcagactgaggcccccagtatcgacgagaaagtcgatttgcacttcattgcgctagtgcatgtggatggacacctatacgagctggacggaaggaaaccctttcccattaatcacggggaaactagcgacgaaactttattagaggacgctatcgaagtctgtaagaaattcatggagcgcgaccctgacgaactacgcttcaacgcgatcgccctgtcagcagcttag

SEQ ID NO: 139696 - DNA, 687 bp, Artificial Sequence
  Description of Artificial Sequence: Synthetic coding sequence
accgaagaagaagaaaaaattaaatcacagggtcaggatgtcacatcatccgtttatttcatgaaacagaccatctcaaatgcatgtggcaccatcgggctgatccacgcaattgcaaacaataaagacaaaatgcacttcgaaagtgggagtaccttaaagaaatttctcgaggaaagtgtttcaatgagccccgaggagagggcacggtaccttgagaactatgatgcaatacgcgtgacacacgaaacaagcgctcacgaaggacaaaccgagagcagcagtccttcatcatctcaaccccactccagccactgcagaaccaaggcatcctctctctgtcatcacgcctctctgccctgggttaagagaaatcacgtgggccccgctaaagctacaagcccttccttgcgacttaggaggtggcgcccatttctaaggttaccatccttgggtctgcactccgttgcccccagcattgacgagaaagtggacttgcatttcatagccttagtccacgtcgatggacatctgtacgagttggacgggcgtaagccttttcctattaaccacggggaaacgagcgatgaaaccctgctcgaggacgctattgaggtgtgcaaaaagtttatggagcgcgaccccgatgagttgagatttaatgccattgccctttcagctgcctag

SEQ ID NO: 139697 - DNA, 981 bp, Artificial Sequence
  Description of Artificial Sequence: Synthetic coding sequence
atgaccgggaatgctggtgagtggtgcttaatggagtctgatcctggagtctttacagagctgataaagggttttggttgtaggggggcccaggtcgaagagatctggtctctcgagcccgaaaactttgagaaattgaaacccgtgcacggcttaatcttcctatttaaatggcagcctggcgaggagcccgctggctcagtcgtccaagactcacgtttagatactatcttttttgcaaagcaggtgatcaataacgcctgcgctactcaggcaatcgtctctgtgctgttgaactgcactcatcaggacgtacatcttggtgagacactaagtgaatttaaggaattctctcaatcgtttgacgccgccatgaaggggcttgctcttagcaatagtgatgtaattcgtcaggtccataactcatttgctcgccaacaaatgttcgagttcgacaccaagaccagcgccaaagaggaagacgccttccatttcgtgagttacgtccccgtgaacggaagactctatgagttggacgggctgcgcgaggggcccattgacctgggagcatgtaaccaggatgattggatttcagccgtgcgtccagttatcgagaaacgcatccagaagtacagcgagggggaaatccggtttaacttaatggccattgtgagtgaccggaagatgatatacgaacagaaaatcgccgagctgcagagacagttggctgaggagcccatggacacagatcaggggaacagcatgctatccgccatccagtctgaggtggccaagaatcagatgcttattgaggaggaagtgcaaaagctgaagaggtataagattgagaacattagacggaagcacaactatctcccattcattatggagcttttgaagactttggccgagcaccaacaactaatcccgctggtggagaagttcgagaagcactttgaaaaaaccctcctgggcaagtag

SEQ ID NO: 139698 - DNA, 951 bp, Artificial Sequence
  Description of Artificial Sequence: Synthetic coding sequence
atgaccggaaatgctggtgaatggtgcttaatggagagtgatcccggcgtcttcacagaattaatcaagggatttgggtgtagaggagcccaggttgaggagatttggagcttggagcctgagaatttcgagaagcttaagccggtacacggtctcatcttcctgtttaagtggcaaccaggcgaagaaccagccggcagcgtcgtgcaagacagccgcctcgacaccatttttttcgcaaagcaggtgatcaacaatgcttgtgccacccaagccattgtgtctgtgttactcaactgcacacaccaggacgtgcatctgggagagacgctcagcgaattcaaagaattttcccaatccttcgacgccgccatgaaaggactggccctctccaactctgacgtgatccgacaagtgcacaattcctttgccagacagcagatgtttgaattcgataccaagacaagcgctaaggaggaggacgcattccactttgtctcttatgtgcctgtcaacggacgactgtacgaactcgacggcctgagggaaggccccattgatcttggggcttgcaatcaggatgattggatcagcgctgttcggcccgtaatcgagaagagaatccagaaatacagcgagggagagatcaggtttaatctaatggccatcgtttcagatcgcaaaatgatctacgagcagaagatcgccgagttgcaaagacagctggcggaggagcctatggacacggatcagggtaatagcatgctttctgccatacagtccgaggttgcaaagaaccaaatgctcatcgaagaagaagtccagaaactgaaaaggtacaaaatcgaaaacatccggagaaagcacaactatttgccttttattatggagcttttgaaaactcttgctgagcaccagcagctcatacccctggtggagaagggaaagtag

SEQ ID NO: 139699 - DNA, 1107 bp, Artificial Sequence
  Description of Artificial Sequence: Synthetic coding sequence
gccagaggcggttctgggagatgcgtcgcccgcgcaatgactggaaacgctggcgagtggtgcctgatggagagcgaccccggggttttcacagaattgattaaaggatttggctgcaggggcgcgcaggtggaagagatctggtctctggaacccgagaacttcgaaaagctaaaacccgtgcacgggctgatctttctttttaagtggcagcctggagaagagccagctgggagcgtggtccaagactctagacttgataccatttttttcgctaaacaagtcattaataacgcgtgtgcgactcaggctatcgtcagcgtgctccttaattgcactcatcaggacgtgcacctaggcgagactctctctgagttcaaagagttttcccagtccttcgatgccgcaatgaaaggactcgctctctctaatagcgacgtcatcaggcaggtacataacagcttcgcccgccagcagatgttcgagttcgacacaaagacgagcgcgaaagaagaagacgccttccattttgtgtcctatgtccccgtgaacggccgcttgtatgagttagacggtttgagggagggaccaatcgacctgggtgcctgtaaccaagatgactggattagtgccgtgagacccgtgatcgagaaaaggatccagaaggatgggttctctccatgttgtcccggttggtcccagacccctgagctgaagccaagcgcatgtctggatttgcccaaatggtatagcgagggcgagattaggtttaatttaatggcaatcgtgtcagaccggaaaatgatatatgaacagaaaattgctgagcttcagaggcagctggcagaagaggagcctatggacactgaccagggaaattctatgctttctgccatccagagtgaggtagctaagaatcaaatgctcattgaagaggaagtgcaaaagcttaaaagatacaagattgaaaacatccggcgtaagcacaactatctgcccttcatcatggaactccttaagaccctggctgagcaccagcagctgattcccctggtggagaaggccaaggaaaaacagaatgccaagaaggcccaggaaacaaaatag

SEQ ID NO: 139700 - DNA, 1068 bp, Artificial Sequence
  Description of Artificial Sequence: Synthetic coding sequence
atgacaggaaatgccggagagtggtgtttgatggaaagtgatcccggagtgttcaccgaattaattaaaggttttggctgtcgcggcgcccaagttgaagagatctggtccctggagccagagaattttgagaagttgaaaccggtgcacggtcttatatttctgtttaagtggcagccaggagaagagcctgccggctcagtcgtgcaggacagccgcttggatacaattttctttgcaaagcaagtcatcaataacgcctgcgctacacaggccattgtatcagttctgctgaattgcacccatcaggatgtccacttaggagaaacactgtcggagtttaaggagttcagtcagtcgttcgacgctgcgatgaaaggcctggccctatctaattcagacgttatccgacaggtacacaattcgtttgcccgtcaacaaatgttcgagtttgataccaagacgtctgcaaaggaggaggacgcttttcactttgtgagttacgtgcccgtcaacggcagactgtacgagttggatggcctacgcgaaggacccatcgacctgggggcttgcaaccaggatgactggatttctgctgtgcgaccagtgattgaaaaacgaatccaaaaggatggattctcaccttgttgtccaggatggagtcagacacccgaactgaaaccaagcgcgtgcctcgacttacctaaatggtacagtgaaggcgagattcgatttaacctaatggccatagtgagcgataggaaaatgatatacgagcagaagatcgctgagctccaaaggcagctcgctgaagaaccaatggacactgaccagggcaattctatgctgtccgcgattcaatccgaggtcgcgaagaaccagatgcttattgaggaagaggtgcagaagctgaagcgttataagattgagaatatccgaagaaaacacaattacctgccgttcatcatggagctcctaaagactctggcggagcatcagcagctcattcccctggtcgagaaagcaaaagagaagcagaatgcgaagaaggctcaggagaccaaatag

SEQ ID NO: 139701 - DNA, 579 bp, Artificial Sequence
  Description of Artificial Sequence: Synthetic coding sequence
atgaaaggcctcgctctgagtaattctgacgtgattaggcaggtccataactcctttgcaaggcaacaaatgttcgagtttgatacaaaaacctctgcaaaagaagaagacgcattccatttcgtgagctacgtccccgtaaatgggaggttgtacgagctggacgggcttcgagagggcccaattgatctcggcgcatgtaaccaggatgattggatcagcgctgtccgccctgtcattgagaaacgtattcaaaaatacagcgaaggcgagatcagatttaacctgatggctatcgtgtccgacagaaaaatgatctacgaacagaaaatcgcagaactgcagcggcagcttgccgaggaaccaatggatactgatcaggggaactcaatgctgagcgcaatccagagcgaggtggccaaaaaccaaatgcttattgaagaggaagtgcagaagctgaaaagatataaaatcgagaacattcgcaggaagcacaattatctgccctttatcatggagcttttgaaaaccttggccgaacaccagcagctgatcccactggtagaaaaaattttttag

SEQ ID NO: 139702 - DNA, 987 bp, Artificial Sequence
  Description of Artificial Sequence: Synthetic coding sequence
atgacaggcaacgccggggaatggtgcctgatggaaagtgaccccggtgttttcacggaactgatcaaaggatttggctgtagaggcgctcaggtcgaagaaatttggtccttggagcccgaaaactttgaaaagctgaagcccgtgcatggattgatttttctgttcaaatggcagcctggcgaagagccagccgggagtgtggtgcaggacagtcggctggatacgatcttctttgctaaacaggttattaataacgcctgcgccactcaggcaatcgtatcggtcttactgaattgcacacaccaggacgtgcaccttggagaaactctctccgagtttaaagagttttctcagtccttcgatgccgcgatgaagggcctggcgctaagcaactctgatgtcataaggcaggttcacaatagctttgcacggcagcagatgtttgagttcgataccaagacgtccgccaaggaagaagatgccttccatttcgtaagctatgtccccgtgaatgggcgcctctacgagttagatggactcagagaggggccaattgatctgggagcgtgtaatcaagacgattggatcagtgcagttcgtccagtcatcgaaaagcggatccagaaatactctgaaggagagatacgtttcaacttgatggccatcgtatccgaccggaagatgatctatgagcagaaaattgcagagcttcagaggcagctcgcggaggagcccatggatactgaccaaggtaatagcatgctctcagcaattcagtcagaagtggctaaaaaccaaatgctcatcgaagaagaggtgcagaaactgaagcgatacaagatcgagaacattcgccggaaacacaattatctccctttcataatggagttgttgaaaacactagctgagcaccagcaattaatacccctggtcgaaaaagccaaggagaaacagaatgccaaaaaagcccaggaaacaaaatag

SEQ ID NO: 139703 - DNA, 990 bp, Artificial Sequence
  Description of Artificial Sequence: Synthetic coding sequence
atgactggaaacgcaggtgagtggtgtctcatggagtcagaccccggggtctttaccgagctcattaaggggttcgggtgtaggggagctcaggtcgaggagatttggtctcttgaacctgagaattttgagaaattgaagcctgtccacggactgatttttctcttcaaatggcagcctggagaggagccggccggtagcgtcgtccaggatagtagattagacaccatattctttgccaaacaggtaataaataatgcttgtgccacacaggccatcgtttcagtcctgctcaattgtacccaccaggacgtgcatctcggggagactcttagtgaatttaaagaattcagccaaagctttgatgccgcgatgaagggccttgctctgagcaattctgacgtgatccggcaggtacacaattctttcgccaggcagcaaatgttcgagtttgacaccaagacttcagccaaagaggaggatgccttccactttgtgtcttacgtgccagtcaacgggagactgtacgaactggatggccttcgcgaaggcccaatcgatttgggcgcttgtaaccaggacgactggatctctgcggtacgacccgtaattgaaaaacggatccagaagtacagtgaaggggaaataagattcaacctcatggccatagtgagcgaccggaagatgatctatgagcagaagatcgcagaactccagaggcagttggctgaagaagagccgatggatacagatcagggcaattccatgctgtctgccattcagtcggaagtcgcaaaaaaccagatgctgattgaggaagaggtgcaaaaactgaagcgctacaagattgagaatattcgccgaaagcacaattatctgccctttattatggaactgttaaaaacccttgcagagcaccagcaactgatccccctcgtcgaaaaggcaaaggagaaacagaacgcgaaaaaggcccaggaaaccaaatag

SEQ ID NO: 139704 - DNA, 954 bp, Artificial Sequence
  Description of Artificial Sequence: Synthetic coding sequence
atggaaagcgatccgggcgtttttaccgagctgatcaagggcttcggctgcagaggcgctcaggttgaagaaatttggtctctagagcctgagaattttgagaaactcaagcccgtccacggtctgatcttcttgttcaagtggcaacctggagaagaaccggccggctcggtagtgcaagattccaggctggatacaattttcttcgctaagcaggtgattaacaatgcttgcgccacacaagcaattgtttccgtgctgctaaactgcacccaccaggacgtgcatctcggggaaacgctgtcagaattcaaggagttcagccaaagtttcgatgctgcaatgaaagggctcgcactgagcaatagtgacgtcattcggcaggtgcataatagttttgcccgtcagcaaatgttcgagtttgatactaagaccagcgctaaagaagaggatgcattccactttgtgagctatgtccctgtcaacggaagactatacgaattggacggtctccgggaaggacccattgacctgggagcttgcaaccaggatgactggatttccgctgtgcgcccggtaatagagaaacgcattcagaaatatagcgaaggggagatccgttttaatcttatggctattgtgtccgaccgtaagatgatctatgagcagaaaatagctgaattacagaggcaactcgccgaagaggaacccatggacaccgaccaggggaactccatgctgtctgccatccaatctgaggtcgcaaaaaatcaaatgctgatcgaagaggaggttcagaagttaaaaagatataagatagaaaatataaggcgcaagcacaactacctgcctttcataatggagctgctgaagaccctggcagaacaccagcagctgatcccgctggtagaaaagttcgagaaacatttcgaaaagacactgctaggcaaatag

SEQ ID NO: 139705 - DNA, 300 bp, Artificial Sequence
  Description of Artificial Sequence: Synthetic coding sequence
tgaaacctgatggctatcgtgtctgacaggaagatgatctatgagcagaagatcgcggagctccagagacagctggccgaagagcctatggatactgaccagggaaactccatgctgagcgcgatccaaagcgaagtcgcaaagaaccagatgctgattgaagaagaggtacagaagttaaaacgctacaagattgaaaacatccggaggaagcataattaccttccctttataatggaactcttgaagaccctagcagaacatcagcaactcatcccactggtagagaagattttctag

SEQ ID NO: 139706 - DNA, 498 bp, Artificial Sequence
  Description of Artificial Sequence: Synthetic coding sequence
atggtgcgcccaggcctagccagaatgtctctgccacgttgctggtttcgctatcccggctggaccggagctgaagctggtcgcgggagagccatcgtgtcaaggcggctgccctcccttaatccttgggacgcaggcgagcgccatgggggccttgtgcgtatctgtgcatcccttgggccgcataaacgcctgccagcaggtctgcctcagtgtccccatctgtatttagcagcagatcctctcgacccacagagacgtcaggagaagtcttgcgctgctcttgggaacgacaaacgccggcagcccgacgggcaacgtcagccccagcagcagcagcagccacactgccgacgaggctttcaggctcccgcactccctaaccctctgagagtgttgcaaggcctgggccgggtatcgatgtctctggggtggttggaaaggcctcccgccctcagccgcgcggcggggtgcagaggcgcacaggttgaagaatag

SEQ ID NO: 139707 - DNA, 657 bp, Artificial Sequence
  Description of Artificial Sequence: Synthetic coding sequence
tagctttctgaattcaaagagttttcccagtctttcgatgccgcaatgaaagggcttgccctgagtaattcagacgtgatcagacaggttcataacagcttcgcccgtcagcagatgttcgagttcgatacaaagaccagtgcaaaggaagaggatgcatttcattttgtgtcatacgtccccgttaatggtagactatacgagctcgatgggcttagggaggggcctatcgatcttggcgcatgcaaccaggatgactggatttccgcggtgcgacctgtgatcgagaagagaattcagaagtattcggagggtgagatccgctttaatctgatggctatcgtatcagaccgtaagatgatctacgaacaaaagattgctgagcttcaaaggcaactagctgaggaggagcccatggatacagaccaaggaaattctatgcttagcgccattcagtcagaggtcgcaaaaaatcaaatgctgatagaggaggaggtgcagaaactcaagaggtataagatcgagaatattcgtcgcaaacacaactacttgcccttcattatggagctgctcaagactctcgcagaacaccagcaactgatccctctggtggaaaaatttgaaaaacatttcgagaaaacccttctggggaagtag

SEQ ID NO: 139708 - DNA, 777 bp, Artificial Sequence
  Description of Artificial Sequence: Synthetic coding sequence
atgtcacttgggtggctggaacgaccccctgctctcagtcgcgctgccggctgtcgcggcgcgcaggtggaagagatttggagtctcgaacctgagaattttgaaaagctgaagcccgtgcatgggttaatattcctattcaagtggcaacccggcgaggaacccgccggctcagtggtgcaggacagtagactggacacaatcttcttcgctaagcaggtgatcaataatgcttgcgctacacaggctatcgtgtccgtgcttctgaactgtacacatcaggatgttcacctgggtgagacattgtctgaattcaaagagttttctcaaagtttcgatgcagccatgaaagggttagccctcagtaattccgacgtgataagacaggtgcataattcgtttgcaagacaacagatgttcgagttcgacactaagacgtccgcaaaagaggaagatgcatttcacttcgtgtcttatgttcccgtcaatggcagactctacgaactagatggtcttcgcgaggggccaattgatctgggcgcctgtaatcaagatgactggatatctgccgtgagacccgtgatcgagaagcgaatccagaaatatagcgagggcgaaatcagatttaatcttatggccatagtgagcgacaggaagatgatttatgaacagaaaatcgccgagttgcaaaggcagctcgctgaagaacccatggataccgaccagggcaattccatgctgtctgctatccaaagcgaggtggccaagaatcaatag

SEQ ID NO: 139709 - DNA, 552 bp, Artificial Sequence
  Description of Artificial Sequence: Synthetic coding sequence
tgacagcagatgttcgagttcgatacgaaaacatcagctaaggaagaggatgcattccattttgtgagctatgtcccagtgaatggcagactctacgagttagacgggctgcgagagggtccaatcgatttgggggcatgcaatcaggacgattggatttctgccgtacggcctgtaattgaaaaacgtattcagaaatactcggagggtgaaatcagattcaacctgatggctatcgtctccgaccggaaaatgatttacgagcagaaaattgctgaattgcagcgccagctggccgaagaggagcctatggatactgaccaaggcaattccatgctatctgccatacaatccgaggtcgctaaaaatcagatgctgatcgaggaggaagtgcagaagttgaagcggtacaagatcgagaacattagacgaaagcataactacctgccctttatcatggagctgctgaagacgctggcagagcatcagcaacttatccctctggttgagaaattcgagaaacattttgagaaaacactcctgggcaagtag

SEQ ID NO: 139710 - DNA, 348 bp, Artificial Sequence
  Description of Artificial Sequence: Synthetic coding sequence
taggagggtgagatacgatttaacctgatggctatcgtgagtgatcgcaaaatgatatacgagcagaaaatcgccgagctccagcgacagctcgccgaggaaccgatggatactgaccagggtaatagcatgctgagcgcaattcagtccgaggtggccaaaaaccaaatgctgattgaagaggaggtgcagaaacttaagaggtacaaaatcgaaaatatccggagaaaacataactatcttccttttatcatggaactgcttaaaactctcgccgagcatcaacagctcatccctctcgtggagaaattcgagaaacacttcgaaaagaccctgcttggaaagtag

SEQ ID NO: 139711 - DNA, 582 bp, Artificial Sequence
  Description of Artificial Sequence: Synthetic coding sequence
atgaaaggcttagcactcagtaatagcgacgtcatcaggcaggtccataatagtttcgcccggcagcagatgttcgagtttgacacaaaaacgtctgcaaaggaggaagacgctttccatttcgtgtcatacgtgcctgtaaacggacgactctatgaactcgacgggctgcgggaggggccgattgacctcggggcctgcaatcaggatgattggattagtgccgtccggcctgtcatagaaaagcgcattcaaaaatacagtgagggcgaaatacgcttcaatcttatggcgattgtgagcgatagaaagatgatatacgaacagaaaatcgcagagttgcagagacagctggcagaggaggaaccaatggacacagatcagggtaattctatgctgtcagctatccaaagcgaggttgcaaaaaatcagatgctgattgaggaagaggtgcagaagcttaagcgctacaaaatcgagaatattaggagaaagcacaattatctgccgttcataatggaactccttaagactttggctgagcaccagcaactcatcccattggttgaaaaaattttctag

SEQ ID NO: 139712 - DNA, 498 bp, Artificial Sequence
  Description of Artificial Sequence: Synthetic coding sequence
atggcacccaatgctagttgcctctgtgtgcatgtgaggtcagaagaatgggaccttatgacctttgacgcaaatccctatgattcggtgaagaagatcaaggaacacgttagatctaaaaccaaagtgccagtccaggaccaggtgctgctacttggcagcaagatccttaaacctagacggagcctctcaagttacggaatcgacaaagagaagaccattcatttgacccttaaagttgtcaagccatccgatgaagagttaccattatttctggtggaatccggggacgaggccaaaagacacctcttgcaggtccgcaggtcatctagcgtagcgcaagtgaaagctatgatcgaaacgaagacaggaatcatacccgagacacaaattgtgacttgtaacgggaagcgactagaggacgggaagatgatggctgattacggaatccggaaaggcaatctgctgtttctggcctgctattgcattggcggatag

SEQ ID NO: 139713 - DNA, 498 bp, Artificial Sequence
  Description of Artificial Sequence: Synthetic coding sequence
atggcgccaaatgcaagttgcctgtgtgtccacgtgcgatccgaggagtgggacctgatgacttttgacgccaacccatacgactccgtgaaaaagattaaagagcatgtcaggagcaagaccaaggtgccagtgcaggaccaggtgttactgctggggtccaagatattaaagccccggagaagcctaagctcctatggtatagacaaggagaaaacaatccacttgactttaaaggtcgtcaaaccctctgatgaggagctccccctttttctggtggagtccggcgacgaagccaagcggcacctgctacaggtaaggaggtccagctccgtggctcaggtaaaagccatgattgagaccaagaccggtattatcccagagacacaaatcgtgacctgtaatgggaagcgacttgaggatggaaagatgatggccgactacggtatcaggaaggggaatctgctcttccttgccagctattgcattgggggctag

SEQ ID NO: 139714 - DNA, 498 bp, Artificial Sequence
  Description of Artificial Sequence: Synthetic coding sequence
atggcaccgaatgcgtcttgcttgtgcgttcatgtgaggtccgaagaatgggacttgatgacgttcgacgccaacccatacgatagcgtgaaaaagatcaaagaacacgtccgctctaaaactaaggtgccagtccaggaccaagtgctcctgctggggagcaagatactcaagcctagacggtccctgagctcttatggcaccgataaggagaaaacaattcacctgaccctgaaagtcgtgaaaccgtctgacgaggaattgcctctgtttctggtcgaaagcggcgatgaagcgaaacggcaccttttgcaagtgcggcgatctagttcagtggcgcaagtaaaagctatgattgaaactaagacaggcattattcccgaaacacagattgtcacttgtaacggaaagcgcctggaggacgggaaaatgatggccgactacggcattcggaagggaaatctgttatttctcgcctcctattgcattggaggatag

SEQ ID NO: 139715 - DNA, 498 bp, Artificial Sequence
  Description of Artificial Sequence: Synthetic coding sequence
atggctcccaacgcctcctgcctgtgtgtccacgtcagatctgaggagtgggacctcatgacttttgacgcaaacccttacgattcagtgaagaagatcaaggagcacgtccggtcaaaaacaaaggtgccggtccaagatcaggtgctattactgggaagtaagattctgaaaccacggagatccctgagttcatacggtacagacaaggagaagaccattcaccttacactcaaggtggtcaagccctcagacgaagagctgcctctcttcctggtcgaatcaggagatgaagccaagcggcacctgttacaggtcagacgcagttctagcgtcgctcaggtgaaagccatgatagagaccaaaactggtatcattccagagacccagattgtgacatgtaacggcaagagacttgaagacgggaagatgatggctgactacggcatccggaagggtaacctgttattcttagcctcctattgcattgggggctag

SEQ ID NO: 139716 - DNA, 498 bp, Artificial Sequence
  Description of Artificial Sequence: Synthetic coding sequence
atggcgcctaacgcttcatgtttgtgtgtgcatgtcagatctgaggagtgggatcttatgaccttcgacgccaacccatacgatagtgtgaagaagatcaaggagcatgtccgatcaaagacgaaagtccccgtgcaagaccaggtgttgctcctgggatcaaagattctcaagcctagaagatccctctcctcttatgggattgacaaagagaagacaatccacctgactctgaaggtggttaagccgtctgacgaagagctgccgctttttctggtcgaatcaggagatgaggccaaacgacacctgcttcaggtgcggagaagttcatcagtcgctcaggtgaaggcaatgattgaaaccaaaactgggatcatcccagagacacagattgtcacctgcaacgggaagagattggaagatgggaaaatgatggctgattatgggatccggaaagggaatctgctcttcctggcatgttactgcattggcggctag

SEQ ID NO: 139717 - DNA, 498 bp, Artificial Sequence
  Description of Artificial Sequence: Synthetic coding sequence
atggcacctaatgcatcatgtttgtgtgtgcacgtcaggtcagaggaatgggacctcatgactttcgacgcaaacccatatgattcggtcaagaaaattaaggagcacgttaggtcaaaaacgaaggtcccagttcaggatcaggtgctgctgttggggtcgaaaatcctgaaaccaaggcgatcattgtcatcttacggaactgacaaagagaaaaccatccatttgacccttaaagtggtaaagccaagtgatgaggagctccccctctttctggtggaaagcggcgatgaagctaaacgtcaccttctacaagtacggagatcttctagtgttgcacaggtcaaggctatgattgaaactaagaccgggataatcccggagacccagattgtgacttgcaacgggaagaggttggaggatggcaagatgatggccgattacggcatccggaagggaaaccttctctttctggcatcatactgcatagggggctag

SEQ ID NO: 139718 - DNA, 498 bp, Artificial Sequence
  Description of Artificial Sequence: Synthetic coding sequence
atggccccaaacgcttcctgtctgtgcgtacatgtgaggagtgaggagtgggacctgatgacattcgacgccaatccatacgacagcgttaagaagatcaaggaacacgtgcggtcaaagactaaagtcccagttcaggatcaggtgttactgctgggatccaagatactaaagccaagacgttctttgtcctcctacggaatcgataaggaaaagaccattcatcttaccctcaaggtggtcaaaccaagtgacgaagaactgccactgttccttgtggagtccggagacgaagctaagcgtcacctgctgcaggttaggagaagctccagcgtcgcccaagtgaaggcgatgatcgaaacaaaaacggggataattcccgagacccagatagtaacatgcaatggcaagagactggaagacggtaaaatgatggccgactacggcatccgcaaaggcaatttattgtttctggccagttactgtatcggcgggtag

SEQ ID NO: 139719 - DNA, 705 bp, Artificial Sequence
  Description of Artificial Sequence: Synthetic coding sequence
atggggggatgcgttggagctcagcacgattcctccggttcattgaacgagaattcagaaggcactggggtcgccctcgggaggaatcagccactgaagaaagagaaacctaaatggaaaagcgattaccctatgaccgatgggcaactgcggtcaaaaagggacgagttctgggacacagcaccggccttcgaggggcgaaaagagatctgggatgccctgaaagctgctgcacacgcgttcgagagcaacgaccatgagctcgcccaggcaataattgacggagcaaacattacactgccgcacggcgctctcaccgaatgctacgatgaattggggaatcgataccagctgcctgtgtattgcctcgctcccccaataaatatgatagaagagaaatctgatatcgagaccttggacatcccagaaccgccaccaaattctggctatgagtgccagttgcggctgcgactgtccactggaaaagacctgaaactggtggtgagatcaacagatactgtgtttcatatgaaacgaagactccacgccgccgagggcgtagagcctggcagccaaaggtggttcttctcgggccggccactcaccgacaagatgaagttcgaagagctgaagatacccaaagattatgtagtccaggtcatcgtgagtcaaccggttcagaatccaacccccgtggagaattag

SEQ ID NO: 139720 - DNA, 924 bp, Artificial Sequence
  Description of Artificial Sequence: Synthetic coding sequence
atgtttagctttaacatgttcgatcaccccatcccacgggtcttccagaatcgcttcagcacgcagtacagatgttttagcgtgtcaatgctcgcaggtcccaatgacagaagcgacgtggaaaagggtggtaagataataatgcccccgtcggccttggatcagttaagccgcttgaacatcacatatcccatgctgttcaaactcacgaacaagaattctgacagaatgactcactgtggcgtacttgaatttgttgctgacgagggtatctgctatcttccacactggatgatgcagaacttgttgctggaggaaggtgggctggtgcaagtagaatctgttaatctgcaggttgcaacgtattccaagttccagccacagagcccagactttctcgacatcactaacccaaaggcggtgctcgaaaacgccttgcgaaatttcgcctgcctcaccaccggcgacgtaatagctatcaattataatgagaagatctatgagctcagagttatggagactaagcccgataaggcggtatccatcattgaatgcgatatgaatgtagattttgatgcaccattaggctataaagagcctgagaggcaggtgcagcatgaggagagcacagaaggcgaggctgatcattccggatacgcgggagagctaggatttagggctttcagcggaagcggcaacaggctggacgggaagaaaaagggagtagagccatcgccgagccccattaagccaggggacattaaacgtgggatccccaattacgaatttaagctagggaagatcacatttattaggaattcgcgaccattagtgaagaaagtcgaagaagatgaggctggcggccgtttcgtagctttctcaggcgagggccagtctttgcgaaaaaaggggcgcaagccttag

SEQ ID NO: 139721 - DNA, 891 bp, Artificial Sequence
  Description of Artificial Sequence: Synthetic coding sequence
atgttctcgtttaatatgttcgaccacccgatcccgagggtgtttcagaaccgtttctctacacagtatcgctgcttctctgtgagcatgctggccggccctaatgatagatcagatgtggagaaaggtggcaaatctcgcctgaatataacatatccgatgttattcaaactaaccaataaaaactcggaccgtatgacacattgcggtgttttggagttcgtagctgatgaaggaatttgctacctcccccattggatgatgcagaacctgcttctcgaagaaggggggctggtccaagtggagtctgtcaacctgcaagtggctacatactctaagtttcagcctcagagccccgatttccttgatatcacgaaccctaaggctgtccttgagaatgcccttaggaatttcgcttgcctaacaaccggggatgtcatcgcaataaactacaatgagaaaatctacgaacttcgggtcatggaaacaaaaccagacaaagctgtctcaattatcgagtgcgacatgaacgtagactttgatgcgccactcggctacaaagaaccagagagacaggtgcaacacgaggaatcaaccgagggtgaagcggaccattccgggtacgccggcgaattggggttccgggcgttctccgggtcaggcaaccggcttgacgggaagaagaagggtgtcgaaccttcaccttctcccatcaaacctggcgatattaaacgcgggatcccgaattacgagtttaagctggggaaaatcaccttcatccgtaatagtcgccccctggtgaagaaggtggaggaagacgaggccggcggcaggttcgtcgctttttctggtgaaggtcagagcctcagaaaaaagggccgcaaaccctag

SEQ ID NO: 139722 - DNA, 1032 bp, Artificial Sequence
  Description of Artificial Sequence: Synthetic coding sequence
atgttctctttcaacatgttcgaccacccaatccctagggtgtttcagaatagattctcgacacaatatcgctgcttttctgtgtccatgttggccggacctaacgaccggtccgacgtggagaaaggcgggaaaatcattatgcctccatccgcccttgaccagctttctcggctgaatattacataccctatgctgtttaagttaacaaataagaattcagaccgtatgacacattgcggggtcttagaatttgtggctgacgagggcatatgctatctccctcactgggttgtgtataggctaagcctggagagggacgggctgaaatctctggaggtcgccgaggtctctgggagtgactacttccccagcccattttgcgggctggaggtgtggatgatgcaaaacctgctgctcgaagaaggtggcctggttcaagtcgaatccgtgaacctccaggtcgctacctacagtaaatttcaacctcagtccccagatttcctcgatatcacaaatcccaaagccgtgctggagaatgccctacgcaactttgcatgcttgacaactggcgacgtgatagcgatcaattataatgaaaagatatacgaactcagggtgatggagactaagcctgataaggctgtgtccatcatagagtgcgacatgaacgttgattttgatgctcccctcggctataaggagcccgagcgtcaggtgcagcacgaggaaagtaccgagggcgaggccgatcacagtggatacgcgggggaattaggattcagagcattctcgggtagcggcaatcgattagatggcaaaaaaaaaggcgtggaaccctcacccagtcctattaagcctggagatatcaagagaggcattcctaattacgagtttaagttagggaagattacatttattaggaatagtcgccctctggtcaaaaaggtggaggaagatgaggccgggggccgctttgtggccttttctggggaagggcagtcactgcggaagaagggtagaaagccctag

SEQ ID NO: 139723 - DNA, 801 bp, Artificial Sequence
  Description of Artificial Sequence: Synthetic coding sequence
atgttctcatttaatatgttcgaccacccaattccaagagtcttccagaatcgattcagcacgcagtatcgctgctttagcgtctcaatgttggcgggacctaatgacaggtccgacgttgagaagggcgggaagattatcatgccccctagcgcactggatcaactgagtcgactgaatataacctatccaatgctgtttaagctgaccaacaagaacagtgatcggatgacccactgtggtgttctggagttcgtggcagatgaaggtatatgctatttgcctcattggatgatgcagaaccttctgttagaggagggtgggctcgtacaggtggaatctgtgaacctgcaggtggccacctacagtaagttccagccccaaagccctgacttcctagacatcacgaatcctaaggcggtgctcgagaatgccctacgcaacttcgcatgcctaacgacaggtgacgtgatcgctataaattataacgagaagatctatgaactgagagtgatggaaaccaaacctgataaggccgtgtctattattgaatgcgacatgaacgtcgacttcgacgcccccctgggatataaggagcccgagaggcaggtgcaacacgaggaatccactgagggagaagcagatcacagcgggtatgccggcgagcttggattcagagcattcagtggcagcggaaacaggcttgacggcaaaaaaaagggggttgagccttccccctccccaattaagcccggagatattaaacgcggtattcctaactatgaattcaaactgggatag

SEQ ID NO: 139724 - DNA, 1053 bp, Artificial Sequence
  Description of Artificial Sequence: Synthetic coding sequence
atgctgcctttgcctgacctggacttatggcccctggataggctgcctagccctatcaagcggaagcctcagacacttggttcgttgaagagctcgcagggaatcgttgaggagacatccgaggaggggaatagcgtcccagccagccagagtgtggctgccctcaccagtaaacggagccttgtgcttatgcccgagtcgtccgccgaagaaatcaccgtctgccctgagacccagctttcttcatccgaaacgttcgacttagagagggaggtgtcaccgggtagtcgggatatcttggatggcgtgcgcattattatggctgacaaggaggttggcaataaggaagatgcagaaaaagaggtggcaatctcaacattttctagttctaatcaagtcagctgccccctatgtgatcaatgctttcctccaactaagatcgagagacatgccatgtattgcaatggtctgatggaagaagataccgaggtcctgacgaggagacagaaggaggccaaaactaaaagcgatagcggtactgccgcacagactagcttagatattgacaagaatgagaaatgctacctgtgtaagtctctggtccccttccgggaataccagtgccacgtagattcctgtctgcagctcgccaaagcggatcagggagatggacctgaaggtagcggcagggcatgttctaccgttgagggtaagtggcaacaacgactgaagaacccaaaagaaaagggacactccgaagggagacttctgagcttcctcgaacagagtgagcataaaaccagcgatgcagacatcaaaagttccgagactggtgctttcagagtgccttcgcccggaatggaagaggcgggttgctctcgagaaatgcagagttccttcactaggcgagatctaaacgagtccccagtgaagtccttcgtgtccatcagcgaggccacagattgcctggttgattttaagaagcaagtgacagtgcaacccggaagcaggactcgcactaaagctggaagggggcggcgccgcaaattctag

SEQ ID NO: 139725 - DNA, 2163 bp, Artificial Sequence
  Description of Artificial Sequence: Synthetic coding sequence
atgccacgccggaagaagaaggtgaaggaggtcagtgagtcaaggaacctagaaaagaaggacgtggagacaacatctagcgtgagtgtgaagaggaaaaggaggctagaagatgcctttattgtcatttcggatagtgatggtgaggagcccaaagaagagaacggtctgcagaagacaaaaaccaaacaaagcaaccgcgctaagtgtttagctaagaggaaaatcgcacagatgaccgaggaggagcagttcgctctcgcactcaagatgtcagaacaggaggcccgagaggtgaattcacaggaagaagaagaggaggagctgctgcggaaagccattgctgagagcctcaactcgtgcaggccctccgacgcgagcgccacacgctctcgccccctggctaccggtccttcgtcacagtcccatcaagaaaagacaaccgacagtggactgactgaaggaatttggcagcttgtcccccccagtctgtttaaagggtcacacattagtcagggtaacgaagctgaggagcgggaagagccctgggaccacaccgagaagaccgaggaagagcctgtctctggctcatctggctcatgggatcagtcatcgcagcctgtgttcgaaaatgttaatgttaaaagcttcgatcgctgcacaggtcacagcgccgaacacacacagtgtggcaaaccacaggagtctacagggcgaggctctgccttcttgaaggcagtccagggtagcggcgataccagcagacactgtctgcccaccctcgctgacgccaaaggccttcaggatactggcggcactgtcaattacttctgggggatccccttttgcccggatggtgtagaccctaaccagtatacaaaggttatcctctgccagctggaagtgtaccaaaaatctctgaagatggcccagcgtcaattactcaacaaaaagggcttcggtgagccggtcttaccaagaccgcctagcctcattcagaatgagtgcgggcagggggagcaagcgtccgagaaaaacgaatgcatctcagaggacatgggcgatgaggacaaagaagagcgccaggagtcaagagcgtctgattggcactcaaagaccaaggattttcaagaatctagcattaaaagtctgaaggagaagctcctattggaggaagagcccacaacctcacacgggcaatcgtcccaggggatcgtggaagaaacaagtgaggaggggaattccgtcccagcgagccagtcggtggccgctctgacttccaaacgaagcctggtactcatgcccgagtcatcagcagaagagatcaccgtttgcccggaaacccagctctctagcagcgagacattcgaccttgagcgtgaggtaagcccaggttcaagggatatcctggacggagtcagaatcatcatggccgataaggaagtcggcaacaaagaagacgccgaaaaggaggtagcaataagcactttcagtagctcgaatcaggtgtcctgtcctttatgcgaccagtgcttcccccccacaaaaattgaacgccatgctatgtattgcaatggcctgatggaggaggacacagaggtcttaacacgacgacagaaggaggctaaaaccaaatctgactcaggcactgccgcacagacttccctagacatcgacaaaaatgagaagtgctatctctgtaagagcctcgtgccgtttcgtgaataccaatgtcatgtggattcctgtttacagctcgccaaggcagatcagggtgacggacccgaaggatctggccgagcctgctcgacagtagaaggtaagtggcagcaacgcctgaagaacccaaaagaaaaagggcacagcgaggggagacttctctccttcctggaacaatctgaacataaaaccagcgatgctgacattaaatcatctgaaactggcgccttccgcgtccctagcccgggtatggaagaagcaggatgtagccgggagatgcagtcctctttcaccaggcgggatcttaacgaatcaccagtgaaaagctttgtcagcatcagcgaggccacagattgcctggtggattttaagaaacaggtgaccgtacagcctgggtctcgtacccggacgaaggccgggcgcggcaggaggcgtaaattctag

SEQ ID NO: 139726 - DNA, 1929 bp, Artificial Sequence
  Description of Artificial Sequence: Synthetic coding sequence
atgactgaggaagaacaatttgccctcgccctcaaaatgtcggagcaggaggcccgggaggtgaatagccaggaagaagaggaggaggagttgcttagaaaagccatcgcagagtcgctcaacagttgcaggccctctgacgcaagcgcgactaggtcccgcccactcgccaccgggccatcttctcagagtcatcaggaaaagacgacagattcagggctgaccgaaggcatttggcagctggtgccaccatctcttttcaaaggatcccacatttcccaaggaaacgaggccgaggaaagagaggagccttgggatcatacagagaagacagaggaggagcctgtgtcaggttccagcgggtcatgggatcagtcatcgcaacctgtgtttgagaacgttaatgtcaagagcttcgaccgctgcaccggacattcagctgagcatactcaatgcgggaagcctcaagagtccaccggtagaggctcggcctttttgaaagctgtccagggatccggcgatacatcccggcactgcctgcccactctggcagatgcgaagggactgcaagacacaggaggaacagttaactatttctggggcatccctttttgtccagacggggtggaccccaaccagtacacaaaggtaatcctttgccagcttgaggtgtatcagaagtccctgaagatggcccagcgtcagctgttgaataagaaaggctttggggaacctgtgttacccaggcccccttcacttatacaaaatgaatgtggacagggcgaacaagcaagtgaaaagaacgaatgcatctccgaagacatgggggacgaggacaaggaggaacggcaggagagcagggcgagtgactggcactctaaaactaaggatttccaggagagctctatcaaaagtctcaaagaaaaactcctgctagaagaggagcctaccacaagccacggtcagtcctcacagggcattgtggaagagacttcagaagagggcaacagcgtgcccgcaagccagtccgtagctgctctgactagtaagcgctcactagtcctgatgcccgaatcaagtgcggaagagattacagtgtgtccagaaacccaattgtcctcaagcgaaacttttgatctggagcgcgaggttagcccaggatctcgagacatactcgatggggtgaggataatcatggccgataaggaggtcggaaataaggaagacgcagaaaaggaggtggctatcagtaccttcagctcctccaatcaggtgagttgtcctctgtgcgaccagtgctttcccccaactaaaattgagaggcatgccatgtactgcaacggccttatggaggaagatacagaagtacttacgcggaggcagaaggaggctaaaacgaaatccgactccgggacagcggctcagacgtctctcgatatagacaaaaacgagaaatgttacttgtgtaaaagcttggttccattccgtgagtatcagtgccacgttgactcctgtctgcagttagcaaaagccgatcagggagacggtcccgagggatctggcagggcatgtagtaccgtcgaggggaaatggcaacagcgactgaagaatccgaaagaaaaaggtcacagtgaaggccgacttctcagctttctcgagcaaagcgagcacaaaacgtcggatgctgatatcaaatcaagtgagacaggcgctttccgagtgccttccccaggaatggaagaggcaggttgtagccgcgagatgcagtcttcttttacgaggcgcgacctaaatgaaagccccgtcaagtcttttgtctctatcagcgaggccacagattgcctggtggactttaagaaacaggtgaccgtgcagcctgggtctcgtactcggaccaaggctgggagaggcaggagaagaaagttttag

SEQ ID NO: 139727 - DNA, 2160 bp, Artificial Sequence
  Description of Artificial Sequence: Synthetic coding sequence
atgccgcgaaggaagaagaaagtgaaggaggtaagcgagagccgcaacctcgaaaagaaggatgttgagacaaccagcagtgtgagtgtcaaaagaaaaagacgcttagaggacgcatttattgtcatctcggactctgacggagaagaaccaaaggaggagaacggccttcagaagacaaaaacgaagcaaagtaatagagcaaagtgcctggctaagcgtaagatcgcccagatgactgaagaggagcagtttgctcttgcgttgaagatgtccgagcaggaagccagagaagtcaatagccaagaagaggaggaggaagagcttctccgtaaggccatagccgaatctctcaactcatgtaggccgtccgacgcatccgccacaaggtcgcgacctcttgctacaggaccctcttcacagagtcatcaagaaaagacaactgactccggactgacagaggggatatggcaattagttcccccctctctgtttaagggatcccatatcagccagggcaacgaggcagaggagagagaggaaccatgggaccacacggagaagaccgaagaggagcctgtgtccggatcttcgggcagctgggatcaatcatcccagcctgtatttgagaatgtcaatgtgaagtccttcgatagatgcactggtcattccgctgagcatactcagtgtggtaaaccgcaagagtcaactggccgaggtagcgcttttctgaaggcagtgcagggaagcggcgatacttcacggcactgcctccccacgctcgcagatgctaaaggcctgcaagatactggaggcaccgtaaactacttctggggtattcctttctgtcccgacggtgtggaccctaatcagtacactaaggtgattttgtgccaactcgaggtgtatcagaaatctctgaaaatggcccaaaggcagttgctcaataagaagggttttggcgagcctgtactccctaggcctccatcactcatacagaacgaatgcggccagggagaacaggcttctgaaaagaacgaatgcataagtgaggatatgggggacgaagacaaggaagaacggcaggagagtagggccagcgattggcactcaaaaaccaaggacttccaagagagtagcattaaaagtcttaaggagaagttgcttctggaggaagaaccaaccactagtcacggccagtcttcacagggcattgtggaggaaaccagtgaagaagggaactccgtgcccgcctcccagtcagtggccgcactcacgtccaagcgctccctggtgctcatgccagagagctccgcggaagagatcactgtgtgtccagaaacccaactgagttcttcagagacattcgatctggagcgcgaggtttcacccggaagccgtgatatcctcgatggcgtccgcattatcatggccgacaaagaagtcggcaataaggaggacgcagaaaaggaagttgccatttctacattttcatcttcaaaccaggtgtcttgtccactttgcgatcagtgtttccctccaacgaagatcgagcgccacgctatgtactgcaacggactcatggaggaggatacagtgctcaccagacggcagaaagaagctaagactaagagtgacagcggcaccgctgctcagacatctttagacatagataaaaacgaaaagtgctatttgtgcaagtcattggtgccctttagggaataccaatgccacgtcgactcttgtctacagctggcgaaagcagaccaaggggatggcccagaggggagtggacgtgcgtgttcaacagtggaaggtaaatggcagcagcgactgaaaaatccgaaagagaagggccactctgaaggacgactcctgagctttctggagcagtccgaacacaagacaagtgacgccgatattaagtcctccgagaccggagcattcagagtgccttctcccgggatggaggaggctggctgttcgcgggagatgcagtcgtcttttactcgtcgtgacttaaatgaatcacccgtcaagtcgttcgtgagtatcagcgaagccacagattgtcttgtggactttaagaaacaggtcacagttcagccagggtccaggacacgtaccaaggcaggccgtggcagacggcggaagttctag

SEQ ID NO: 139728 - DNA, 96 bp, Artificial Sequence
  Description of Artificial Sequence: Synthetic coding sequence
atgccaaggcggaaaaaaaaagtgaaggaagtctcggagtctagaaatttggagaaaaaagatgtggaaacaacttcttctgtgagcgtgaaatag

SEQ ID NO: 139729 - DNA, 270 bp, Artificial Sequence
  Description of Artificial Sequence: Synthetic coding sequence
atgccgagacgaaagaagaaagttaaggaggtgagcgagagccggaatctagagaagaaggacgtggagactacctctagcgtctcagttaaaagaaaacgtcgactggaagatgcattcatcgtgataagcgatagcgacggcgaggaaccaaaggaagaaaacggattgcagaaaacaaaaacgaagcagagcaaccgtgccaagtgtttggccaaaagaaagatagcccaaatgacagaagaagaacagttcgcactggccctgtag

SEQ ID NO: 139730 - DNA, 474 bp, Artificial Sequence
  Description of Artificial Sequence: Synthetic coding sequence
atgcctcgtaggaaaaagaaggtcaaagaggtgagtgaatccaggaacctggagaagaaggacgtcgagactacttcttcagtgtcagtgaagcgtaagcgccgactggaagacgcttttatcgtgattagcgacagcgacggagaggaacctaaagaggaaaatggattacagaagacgaagaccaagcaaagcaatcgggctaaatgcctggccaaacgtaagattgcacagatgaccgaggaagaacagttcgccctcgcactgaagatgtcagaacaggaagcacgcgaagtgaacagccaggaagaggaggaggaagaacttctgagaaaagcgatagccgaatccctgaactcttgtcgtcctagcgatgcttccgccacgcggagccgccctctggcgactggtccctcatctcagagtcatcaggaaaagaccacagacagtggactcactgagggaatctggtag

SEQ ID NO: 139731 - DNA, 2160 bp, Artificial Sequence
  Description of Artificial Sequence: Synthetic coding sequence
atgcccaggagaaagaagaaagtgaaggaggtgagcgagtcgcggaacctggaaaaaaaggatgtagagaccacctcatccgtgtctgtgaagaggaagcgccgccttgaggatgcctttattgtcataagcgattcagacggtgaagagccaaaggaggagaacggtctgcagaagacgaaaacaaaacagtctaatagagccaaatgtctcgccaagcgtaaaatcgcacagatgactgaagaagaacagtttgcgctggcgctgaagatgagtgaacaggaagcaagagaggttaatagccaagaggaggaagaagaagaactgctcagaaaggccatcgcagaaagcctcaatagctgccgcccaagtgacgcgtcagcaacaagatctcggccactcgccaccggtccttcctctcaatcgcaccaggagaagacgacagactcaggtcttaccgaggggatctggcagctggttcctccctcgctctttaaaggctctcatatcagtcagggcaatgaggcagaagagagagaggaaccatgggatcacaccgagaaaaccgaagaggagcccgtttctggaagctctgggtcctgggatcaaagctctcaacctgtgttcgagaatgtgaacgtaaaatcattcgacagatgtaccgggcactccgctgagcacacccagtgtggcaagccacaggagtcgaccggcaggggctcagctttcctgaaagctgtccaagggagtggggatacatcacgccactgtctacctaccctggcagacgccaagggtctccaagacacaggcggaacggtcaactatttctggggaattcctttttgtcccgacggagtagatcccaaccagtacacaaaagtgatactgtgccagttggaggtctatcaaaaatcgctcaagatggcccagcgacaattactcaataagaagggctttggcgagccagtactaccgagacccccttcgctcatccagaatgaatgtgggcagggcgaacaggcctctgagaaaaacgagtgcattagcgaggatatgggggatgaagacaaggaggagagacaggagagcagagcgagcgattggcactctaagacgaaagatttccaagagtcttctatcaaatcactgaaagagaaactgctcttggaggaggagccgactacttcgcatggccagtctagtcagggaatagtggaagagacatcagaagagggtaacagcgtgcccgcaagtcagagcgtagccgctctgaccagcaagagatccctggtgttgatgcccgaaagctccgcagaggagattaccgtgtgcccagagacccagcttagcagtagcgaaacattcgatctggagagggaggtatcaccgggcagtagagacattcttgacggagtgcggattattatggcagacaaagaagtgggaaataaggaagatgctgagaaagaagtggctatcagtacgttttctagttcgaatcaggtctcttgcccattatgcgaccagtgtttcccccctaccaagatcgaacgacacgccatgtattgcaacgggctgatggaagaggacactgtgttaacacggagacagaaagaggcgaagactaagtcggacagtgggacagccgcccagacatccctggacattgataagaatgagaaatgctatctttgcaaatctctcgtcccgttccgcgaataccagtgccatgtggatagttgtctgcagctcgccaaggctgaccaaggcgacgggccggaaggctcaggccgggcctgtagcaccgtcgagggcaaatggcaacagagattgaagaatccaaaggagaaaggtcactctgagggacgattactgagttttctggaacagtcagaacacaaaacctctgacgcagacattaaaagctccgaaaccggtgcgtttcgggtccctagccctggcatggaagaggcagggtgtagcagagagatgcagtctagctttacgagacgggacctgaatgaatcacctgtaaagtcttttgttagtatcagcgaagcgacagactgtctcgtcgattttaaaaaacaggttacagtgcagccaggctctcgcacccgcactaaagccggccgtgggcgacgcagaaaattctag

SEQ ID NO: 139732 - DNA, 5250 bp, Artificial Sequence
  Description of Artificial Sequence: Synthetic coding sequence
atggctgatgaagaagcgggcggcaccgaacgcatggagatctctgccgaattgccacaaaccccacagaggctggccagttggtgggaccagcaggttgacttctacacagcctttttgcatcatctagcccagttagtgcccgagatctatttcgccgaaatggaccctgacctcgaaaaacaggaagagagtgttcaaatgagcatatttacgcctctcgaatggtatttgtttggagaggatcccgatatctgcctcgagaagcttaaacactccggggctttccagttgtgtggtagagtcttcaaaagcggggagacaacttatagttgcagagactgcgctatagacccaacatgcgttttgtgcatggactgtttccaggactcagttcataagaaccataggtataagatgcatacctctacaggcgggggattttgtgactgcggggacaccgaagcctggaaaaccggcccattttgtgtcaatcatgaacccggccgtgctggcacaatcaaggagaattcaagatgccccctgaatgaggaagtgatcgtgcaggcgaggaaaatctttccttcggtgattaagtacgtcgtcgagatgacgatttgggaggaggagaaagagctgcctccagagctccagattcgcgagaaaaatgaaaggtactattgcgttttatttaatgatgagcaccatagctatgatcacgtgatttatagcctccagcgagccctggactgtgaattggccgaggctcagcttcacacgacagcaatcgacaaggagggtcggcgtgcagtgaaggctggggcctacgccgcctgtcaggaggccaaggaagatatcaagagccactccgagaacgtgtctcagcaccccctgcacgttgaggtgctgcatagcgaaatcatggcacatcagaaattcgctctgagattaggaagttggatgaacaaaatcatgtcttactccagcgatttccgccagatcttttgtcaggcctgccttagagaggaacctgatagtgagaacccatgcctgatttcccgccttatgctgtgggacgctaaactgtacaagggagcacgaaaaatactgcatgagttaattttctcctcgttcttcatggaaatggagtacaaaaaactatttgccatggaatttgtgaagtattacaagcagctgcaaaaagagtacatctctgatgatcacgatagatccatctcgatcaccgcactgagtgtgcagatgtttacggtaccgacactagccaggcacttgatagaagaacagaacgtgatcagtgtgatcacagagaccttactggaagttctccccgaatatctggacaggaataataaattcaatttccagggctattcacaggacaaactgggtcgcgtgtacgcagtgatctgtgacctgaaatacatcctcatctccaagccaacgatttggaccgaaaggttacgcatgcagttccttgaggggttccgtagctttctgaagattctgacatgcatgcaaggcatggaagaaattagacgacaagtcggccagcatatagaagtggatcctgattgggaagctgcgatcgcaatccagatgcaactgaaaaacattctactgatgtttcaggaatggtgcgcttgtgacgaggaactactcttagttgcatataaagagtgtcacaaagctgtgatgaggtgctccacctcttttatttcttcgtcaaagaccgtggtgcagtcctgcggacacagccttgaaacaaaaagctatcgtgtgtcggaagatctggtctccatccatttgccgctaagccgcacactggccggtctgcatgtccgcctgtctcgactgggcgctgttagccggctgcatgagttcgtctcatttgaggattttcaggtggaagtgctggtcgaataccctcttcgctgcctggtacttgtcgcacaggtggtagctgagatgtggagacgtaatggactctctctgatttctcaggtgttttattatcaggacgtcaagtgtcgcgaagaaatgtatgacaaagatataatcatgttacaaatcggggcttccttgatggaccccaacaaattcctgctgttggtactgcaacggtacgaattagccgaggctttcaataagacgatatccacaaaagaccaggatcttatcaagcaatacaacacacttatcgaagaaatgcttcaggtactaatttacatagtaggcgagcggtacgtccctggggtggggaacgtcaccaaagaagaggtcaccatgcgcgaaatcatccatctgctctgcattgaacctatgcctcacagtgctattgccaaaaatcttccagaaaatgagaataatgaaactggtcttgaaaacgtcataaataaagtcgcgacatttaagaagcccggcgtctctggtcacggggtgtacgagctgaaagatgagtccctgaaagattttaatatgtacttctatcattactccaaaacacagcatagcaaagcggagcacatgcagaagaaacgtagaaagcaagaaaacaaggatgaagcgctgccccctccccccccccctgagttttgccccgccttttccaaggtgatcaatttgctgaactgcgatatcatgatgtatatcctgaggactgtgtttgagcgggctatcgacactgatagcaacctttggacagagggaatgctccaaatggcttttcacattctggccctaggcttgctggaagaaaagcagcaactacagaaagccccagaagaggaagtgacatttgatttctaccacaaggcttcacggctgggctcaagtgccatgaatatccaaatgctccttgagaagctgaaggggatccctcagttagagggacagaaagacatgatcacctggatactccagatgtttgacacagtgaagaggctccgggagaagagttgcctgatcgttgcgaccaccagcggctcggagtctatcaagaatgacgagatcactcatgacaaggagaaggcagagagaaagcgtaaggctgaagctgctcggctccataggcagaagatcatggctcaaatgagtgccctccagaagaacttcatcgagacccacaagttaatgtacgataatacatctgaaatgcccgggaaggaagattctataatggaagaagagtctactcctgcggtgtcagactactccaggattgccctcgggcccaagcgcggcccttctgtgaccgagaaggaagttctaacgtgcattctttgtcaggaggagcaggaggtcaagatcgagaacaatgcaatggtcctgagcgcctgcgtgcagaaatccacagccctgacgcagcatagaggtaagcctattgagctgagcggcgaagcactcgacccattatttatggaccccgacctggcatatgggacatacacaggctcctgcgggcatgtgatgcacgcggtatgctggcagaaatacttcgaagccgtgcagctttcctctcagcagcgaatccacgtggatctgttcgatctcgaatccggggagtatctgtgccctctgtgcaagtcactctgtaacacggttatccccattatccctttgcagccgcagaagataaacagcgaaaatgccgatgccctagctcagctgcttactctcgcccgttggatccagaccgtgctcgccaggatcagcggttataatatccggcatgccaagggtgagaaccccatcccgattttctttaaccaggggatgggtgattccaccctggagttccactccatacttagctttggcgttgaaagctcgattaaatattctaactctatcaaggagatggtgattcttttcgcaaccacgatctaccggatcgggctgaaggtgccacccgacgagcgcgaccctcgcgtgcctatgcttacttggtcaacctgtgccttcaccatccaggccattgagaacctgctcggggacgaaggtaaacctctcttcggcgctttacagaaccgccagcataacggcctgaaagctctcatgcagtttgccgtggcgcagcggattacttgtccacaagttctgatccagaagcacctcgttagactgctgagcgtggttctgcccaatattaagtcggaagacaccccatgcctgctgtcaatagaccttttccacgtgctggttggagccgtgctggcattcccttccctgtattgggatgaccctgtggatctccagccttctagcgtgtcatcatcttataaccacctgtatttatttcatctcatcaccatggctcacatgctccagatcttgttgacagtggacactgggttgccattggcccaagtccaggaggactctgaggaggcccattccgcttcttcattttttgccgagatatcacaatacaccagcggcagcattggctgcgacattcctgggtggtatttgtgggtgtccttaaaaaacggcataactccctatctgagatgcgcggcacttttcttccactatttactgggcgtcactccaccggaagagctgcacactaactcagctgagggagagtattcagctctgtgctcctacctaagtctgccaactaatctgtttctcctcttccaggagtactgggacacggtgaggccccttctccagagatggtgtgcagaccctgcattattgaactgcctgaagcagaagaataccgtggtgaggtatccccgcaaaaggaatagtctgatcgagctgcctgatgactattcatgtctcttgaatcaggcctcgcacttccgttgtcctcggagcgcagacgatgaacggaagcatcccgtgctttgtctgttttgtggggcgattctatgctctcaaaatatctgctgtcaagagattgtgaatggcgaggaagtgggagcgtgtatttttcatgcgttacactgtggagcaggggtttgcatcttcctgaagattagggagtgccgtgtcgttctggtggaaggcaaagctcggggttgcgcctatcccgctccctacctggacgagtatggagagaccgatcctggtttgaagcgcggcaaccctctgcatttatctagggagagatacaggaagctgcatctggtgtggcagcagcattgtataatcgaggagatcgcccgctcacaagagaccaatcagatgctgttcggttttaattggcagcttctgtag

SEQ ID NO: 139733 - DNA, 2412 bp, Artificial Sequence
  Description of Artificial Sequence: Synthetic coding sequence
atggccgatgaggaagcagggggtacagaacgcatggagatctccgccgaattgccacagaccccacagcgcctggcgagctggtgggatcaacaagtcgatttctacacagccttcctacatcatctcgcccagctggtacctgaaatatatttcgcagagatggatcccgatcttgagaaacaggaagaaagtgttcagatgagcatttttacacctctagagtggtaccttttcggagaagatccagacatatgtctagagaagctcaaacactccggtgcattccagttgtgtggtcgagtcttcaagtctggtgagaccacctactcatgtagggattgtgcgatcgaccctacttgtgtactgtgcatggactgcttccaggactctgttcacaagaaccaccggtacaagatgcatacttctacaggaggagggttttgtgactgcggtgatacggaagcatggaaaacaggacccttttgtgtgaaccatgagcctggacgggccgggaccattaaagaaaactcgcgctgcccgctgaacgaagaagtgatcgtccaggcaaggaaaatctttccctccgtgatcaaatacgtggtagagatgaccatttgggaggaggagaaagagttgccacccgaactgcagattagagagaaaaacgaaagatactactgtgtgctgtttaacgatgaacatcactcctacgatcatgtcatctactcactccaacgagctttagattgtgaactggcagaagcgcagttacataccactgcaatcgataaggaaggtcgtagagctgtgaaggctggcgcttacgccgcatgccaagaggcaaaagaagacatcaagagccactctgaaaatgtctcccagcatcccctccacgttgaggtcttgcactctgagataatggcacaccaaaaattcgctttacggctaggaagctggatgaacaagattatgagctatagttccgactttcgccagatcttttgccaggcctgcctgagagaggagccagattctgagaatccttgcctgatttccagattgatgctttgggacgccaagctgtacaagggcgcaagaaagatactgcatgagctgatctttagctcattcttcatggaaatggagtacaagaaattattcgccatggaatttgttaagtactacaagcagttgcagaaagagtatatttcagacgatcacgatagatccatctctattaccgctctgagtgtgcagatgtttactgttcccacactcgctcgccacctcatcgaggaacagaacgtgatttctgttattaccgaaactctgttggaagtcttacctgaatatctggaccgtaataataaatttaatttccaggggtactctcaggataaactcgggcgggtttatgctgttatctgcgacttgaagtatattcttatttcaaagccaactatctggaccgagcgcctgagaatgcaatttctggaggggtttaggtcttttttgaagattctgacctgcatgcagggcatggaagagatacgaaggcaggtgggccagcatattgaggtcgaccctgactgggaggcggcaattgctatacagatgcagctcaaaaatattttgctgatgttccaggaatggtgtgcatgcgacgaagaactcttattggtggcatacaaggagtgtcacaaagccgttatgcgctgtagtacttctttcatttcttcatctaagaccgtggtgcaaagctgcggccatagtctggagacgaaaagctaccgcgtatctgaggatttggtgagcattcacttacccttgtcgcgcaccttagccggcttacatgttaggcttagtcgcttgggcgccgttagccgactgcatgagttcgtttctttcgaggatttccaagtggaagtgctggtagagtacccgctgcgatgcttagtgttggttgcccaagtcgtggccgaaatgtggagacgcaacggactgtctttgatctcccaggtcttctattaccaggatgttaaatgtcgcgaggaaatgtatgataaggatattatcatgcttcagatcggcgcatctctcatggacccgaacaagttcctgcttcttgtactccagcgctatgagttggcagaagcattcaacaaaacgatttcaaccaaagaccaggatctgataaagcagtataatacactgatagaggagatgctgcaggtattaatctacattgtcggagaaagatacgtcccgggggtggggaatgtgaccaaggaggaggtgactatgagagagattatacacctgctctgtatcgaacctatgccgcactcggctattgcaaagaacctgcctgagaacgagaccaggtgcatcaggccctggagcctctag

SEQ ID NO: 139734 - DNA, 3042 bp, Artificial Sequence
  Description of Artificial Sequence: Synthetic coding sequence
atggctgatgaggaggctggtggcactgagagaatggaaatcagcgctgagctgccccagacaccgcagcgcttggcctcctggtgggaccaacaggtggacttttacaccgccttccttcatcatttggcccagcttgtgccagagatttactttgcagagatggacccagatctcgagaaacaggaggagagcgttcagatgtcaatctttacccctctcgagtggtacctgtttggggaggatcccgacatctgtttggagaaattgaagcacagtggagcctttcagctgtgcggacgagtgttcaaatcaggggagactacctattcttgcagggattgtgccattgaccccacctgcgtgctgtgtatggactgctttcaggattccgtgcacaaaaaccatcggtataagatgcatacatcaaccggtggaggtttctgcgattgcggcgacactgaggcctggaaaacaggccccttctgtgtgaatcacgagccaggcagggcagggactatcaaagagaacagccggtgtccccttaatgaagaggttatcgtgcaggctcggaagatcttcccaagtgtcattaaatatgtggtcgagatgacaatttgggaagaggaaaaggaactgccccccgagttgcagattcgcgagaaaaacgagagatactattgcgtactgtttaacgatgagcatcactcttatgatcacgtcatatacagtttacagcgggcacttgattgtgaattagccgaagcacagttgcatacgaccgctatcgacaaagagggccgtcgggctgtcaaagccggtgcttatgctgcatgccaggaggccaaggaggacatcaaaagccactctgaaaacgtctcccaacatcctttacacgtggaggtcttacattccgaaataatggcacatcagaagttcgctctgagactcggcagctggatgaacaaaattatgtcatatagctccgactttcgacagattttctgtcaggcctgtttacgggaggagccggattctgagaatccttgtttaatttcccggctaatgttatgggacgcgaaattgtacaaaggtgcacggaaaattctgcatgagctgatattttctagcttcttcatggaaatggaatacaaaaaactgttcgcaatggaattcgtaaaatactacaagcagttacagaaagagtacatctctgatgatcacgacagatcaatttccatcacagccctgtcagtccagatgtttacggtcccaaccctggccagacacctcatcgaggaacaaaacgtgattagcgtgatcaccgagaccctgctggaagtgttgcccgagtacctggacaggaacaataagtttaacttccagggttattctcaagataaactcgggcgggtgtatgctgtgatttgtgatttgaagtatattctcatatctaagccaaccatctggaccgaacgtcttcgtatgcaatttcttgagggttttagatcctttctgaagattctcacatgcatgcaggggatggaggagatccgccggcaagttggtcagcatatcgaagtggaccccgattgggaggctgccatcgcaatacagatgcagttgaagaatattttgctgatgttccaagaatggtgcgcctgtgatgaggagctactgcttgtcgcctacaaagagtgccacaaggctgtcatgcggtgttcaacgagcttcatatctagctctaaaacggtagtccaatcgtgcggtcacagccttgagactaagagttaccgggtctccgaggatctggtctccatacatctgccccttagtcgcactctggcaggactgcatgtcaggctgtccaggctgggagctgtgtcaaggctccatgagttcgtgagctttgaagacttccaggtagaggtactggtagaatacccattgcggtgcctcgtgctcgtggcccaggtggtggctgaaatgtggcggcggaatggcttgtctctgatctcgcaggtgttctattatcaagacgtgaaatgccgcgaggaaatgtatgataaagacattataatgctccagattggagctagcctaatggacccaaacaaatttctgctgttggttcttcagcgctatgagctggccgaggcattcaataagacgatctccactaaagatcaagatctcattaagcagtataacactcttattgaggaaatgctccaggtcctgatttacattgttggcgagagatatgttcctggggtgggcaacgtgaccaaggaagaagtgaccatgagagagatcatacacctgctgtgtattgagccaatgccccacagcgcaatagcaaagaacctccccgagaacgaaaacaacgagaccggcctggaaaatgtgattaacaaggtggccacatttaagaaaccaggagtgtctggccatggggtatacgagctgaaggacgagagcctgaaggacttcaacatgtacttctatcattacagcaagactcagcactccaaggcagaacacatgcagaagaaacggcgaaagcaggaaaataaagatgaggcgcttcctccaccgccccctcctgagttctgtccagctttctccaaggtgatcaatctgttaaactgcgacattatgatgtatatcctgcgcaccgtgttcgagcgggccattgatacggactccaatctgtggaccgagggcatgttacagatggcattccacattttggcactggggctgttggaggaaaagcagcagctgcaaaaagcgcccgaggaagaagttactttcgacttctaccataaggcaagcagattaggcagtagcgctatgaatatacagatgctgctggagaaattgaagggtataccccaactcgaagggcagaaagacatgatcacttggattctccaaatgttcgataccgtcaagcgtctcagggagaagtcctgcctcatcgtcgctacaacgtccggttcagagtctattaagaacgacgagatcctccatcattag

SEQ ID NO: 139735 - DNA, 1728 bp, Artificial Sequence
  Description of Artificial Sequence: Synthetic coding sequence
atgtatgcgggaaatattcctatctataaaactgagtcaaggtccaggaatgagcagggaatggacccaattactcgtcaggtggggcagcatatagaaatggagccagaatgggaggcagcctttacccttcagatgaaactgactcacgtgatatccatgatgcaggattggtgcgcgagcgatgagaaagtgctcattgaggcatataagaaatgcctggcagtattaatgcagtgccacggaggctacacggacggggaacaaccaattactctctcaatctgcggacactccgtagaaacaatcaggtattgtgtgagtcaggaaaaggtgtcgatccatctccctgtgtcaagactgcttgccggactgcatgtcttactgtcgaagtcagaggtggcctacaagtttccagagcttctccctttaagtgagttaagtccccccatgctgattgagcacccacttcggtgcctcgttctctgcgcgcaagtgcatgccgggatgtggcgtaggaacgggtttagcctcgtgaaccaaatatattattatcataacgtcaagtgtagaagagagatgttcgacaaggatgtagttatgctgcagacgggcgtgtccatgatggatcccaatcacttcttgatgatcatgttgagccgcttcgaactctaccagatatttagcacccccgattatggcaagcgattcagctctgagattactcataaggacgtcgtacagcagaacaataccctgatcgaagaaatgttatacctgatcataatgcttgtcggtgagcgcttctcgcccggcgtgggccaggttaacgccactgatgagatcaaacgggagataatccaccagctgtccattaagcccatggctcactccgagttggttaaaagcctgcctgaagacgaaaataaagagaccggaatggagagtgtgatcgaggcagtcgcacattttaagaagcctggtctgacgggaaggggcatgtacgaattgaagcctgaatgcgcaaaagaattcaacttgtatttctaccattttagcagggctgagcagagtaaagctgaagaggcacagcgaaagctgaagaggcagaaccgcgaggacaccgccctgcccccgcccgtccttccaccattttgcccactgttcgccagcttggtgaatatactgcagagcgacgtcatgttatgcatcatggggactattctgcagtgggctgttgagcataacggctatgcttggtccgaaagcatgctgcagcgtgtgctccatcttatcggtatggccctgcaggaggagaaacagcatctggaaaacgtcactgaagagcacgtggtcactttcacgtttacccagaaaatctcaaagcccggcgaggctcctaaaaactctccttccatcttagctatgctggagacgctgcagaatgccccgtatcttgaggtgcacaaggatatgatacgatggattttaaagacttttaacgcggtcaagaagatgcgagaatcgtctccaacaagccctgttgcggagaccgagggcacgataatggaggaacataatttccgagtgcaaggcacaaagaccaaactgcgaggacgcgagaaacagcgcctacccgattgtgctgaaaagagaagctggttacggtgcctcaagtgcagtggtattctgctaatgaagactaagaactctttctccagacattag

SEQ ID NO: 139736 - DNA, 5268 bp, Artificial Sequence
  Description of Artificial Sequence: Synthetic coding sequence
atggcctcagagctggagcccgaagtacaagcaattgaccgttctctgctggaatgctccgcagaggaaatcgccggcaagtggttgcaggcaaccgatttaacccgagaagtgtaccaacacctcgcgcattatgtgcctaagatctattgtcgagggcccaaccctttccctcagaaagaggacatgctagcccagcacgtgctcctgggaccgatggaatggtacctatgtggcgaagaccctgcatttggctttcctaagctggagcaggctaataagccttcgcacctgtgcggaagggtgttcaaagtaggtgaacccacttactcatgtcgggactgcgccgttgacccgacctgtgtgctctgcatggaatgtttcttaggctctattcacagagatcacagataccggatgacgactagcggcggcggcggcttctgtgattgcggcgatactgaagcctggaaggagggcccatattgccaaaagcatgaattaaacacgtctgaaatcgaggaggaggaagatcctctggtgcacttgagcgaagatgtcatcgcacgaacctataatatcttcgcgatcactttcagatatgctgtcgagattctcacttgggagaaggaaagcgaactgcccgccgacctggagatggtggaaaagtcggacacttattattgcatgctgttcaacgatgaggtccacacttacgagcaagtaatctacacgctgcagaaagctgtgaactgtactcaaaaggaggccattggcttcgccacaacggtcgaccgagatggcaggaggagcgtgagatatggcgatttccagtattgcgagcaagcgaaatcagtcattgtcagaaacacgtcacgacagactaaacctttaaaagtccaggtgatgcattcatcgatcgtggcacatcagaatttcggactcaaactcctgtcatggttggggtccattattggatactctgacggacttcgccgtatcctctgtcaagtaggcctgcaggaggggcccgatggcgagaacagttctctggtagaccgcctgatgctgtctgactctaagctgtggaaaggagccagaagcgtgtaccatcagctcttcatgtcatccttgctgatggatctgaaatacaaaaagctctttgctgtgagattcgccaaaaactaccagcagttacagcgggatttcatggaggacgaccacgagcgggccgtgtccgtcacagctttgtccgtccagttctttaccgctcccacacttgcgagaatgcttatcactgaggaaaacctgatgagtatcattattaagacgttcatggaccacctccggcatcgggacgcccagggaaggttccagttcgagcgatatacagcccttcaagcgttcaagtttcgcagagtgcagtctctcattctggatcttaagtacgttttgatttccaaacctactgagtggtccgatgaactgaggcaaaagtttctcgagggcttcgacgctttcctggaactgttaaagtgcatgcagggaatggatcctattacgaggcaggtcggccagcacatagagatggaaccagagtgggaggccgcatttacccttcagatgaagctgactcacgtgatatccatgatgcaggactggtgtgcgtcagacgaaaaggtgctaattgaagcatacaagaagtgtctagctgttctgatgcagtgtcacggcggctacactgacggagagcagccaattaccctttcaatctgcggccattctgtggagaccatcaggtactgtgtgtctcaggaaaaggtgtcaatccatcttcctgtttcgcgcctccttgctggccttcatgtcctgttgtccaagtccgaagtcgcgtacaagttcccggagttgttgccactcagtgagctgagcccacccatgctaattgagcatcccttgagatgtcttgtgctctgtgcccaagtccatgctggcatgtggaggcggaacggattcagcctcgtgaatcagatctactactaccacaacgtgaaatgccggcgtgagatgttcgataaagatgtggtcatgctgcagaccggggtatccatgatggatcctaaccactttctgatgataatgctgagcagattcgagctgtatcaaatattctcaacacccgattacggcaaacgctttagctccgaaatcacacataaagacgttgtgcagcagaataatactctaatagaagaaatgctctacctcattataatgctggtgggcgaacgtttctcccctggagtcggacaggtgaacgccaccgacgaaatcaagcgggaaatcatccaccagttgagtattaaaccaatggcccattctgagctggtaaaaagcctgccagaagacgagaataaggagacaggcatggaaagcgtgatagaggcggtcgcacactttaagaagcctggacttacaggacgcggcatgtacgagctaaagcctgagtgtgcaaaggagttcaacctatacttttatcatttctcccgcgctgagcaatctaaggccgaggaagcccaaaggaaactcaagcgccagaatagggaggatacggccctgcctcctccggtgctccccccattctgcccccttttcgccagcctggttaatatcctgcagtccgatgtgatgttatgcattatgggcaccattctccaatgggcagtggagcacaacggatacgcgtggagcgaaagcatgctgcagcgcgtgttgcatctgattggaatggctttgcaagaggaaaaacagcacttagaaaacgtgactgaggaacatgtagtgacattcaccttcacccagaaaattagtaagccaggagaagcccctaaaaatagtcccagcatcctcgccatgctcgagacccttcaaaatgctccttacctggaggtccacaaagacatgatccgctggatcctaaagactttcaatgctgtaaagaagatgcgtgagtcgagtcctacaagtcctgtcgccgaaactgagggaactattatggaagaatcgtcaagggacaaagacaaagctgagagaaagagaaaagctgaaatagcacggcttaggcgagagaaaattatggcccagatgtcagagatgcagcgccatttcatcgatgagaacaaagagttatttcagcagacattagagcttgacgcctctacctcagctgtgcttgatcactccccggttgcctccgatatgactctgaccgccctagggccagcccagacccaagttcctgaacagcgccagttcgtaacctgtattctctgtcaggaagagcaggaagtcaaagtcgaatccagggccatggtgctagctgcgttcgtgcagcggtcaactgtgctgagcaagaataggagcaagttcattcaagatcccgagaagtatgaccctctgtttatgcatccagatttaagctgcggaacacatacctcaagctgcggccacattatgcatgcacactgttggcagaggtattttgatagcgtacaggctaaggagcaacggcgtcagcagcgcctccgattgcatacctcgtatgacgtggagaatggcgagttcctctgtccactctgcgaatgccttagtaataccgtgatccctctgctcctgccccccaggaatatcttcaacaaccggcttaacttctcagatcagccgaacttgacccagtggattcgcactataagtcagcaaataaaggccctacagtttctccggaaagaggaaagcacacctaacaatgcttccactaaaaactcagaaaacgtggacgaactgcagcttccagagggctttaggcctgacttccgccctaaaattccatattctgaaagcataaaggaaatgttgaccaccttcggaacggctacttataaggtgggccttaaagtgcaccctaatgaggaggacccacgggtgcctattatgtgttggggttcttgtgcatacaccatccagtcaatcgagcgtattctatcagacgaggataagccactgttcggccccttgccatgcagattggatgactgcctgcggagccttacaagatttgctgcagcgcattggacagtcgcttcggtatcagtagtgcaggggcatttctgtaagctctttgcaagcctggtacctaatgactcccatgaggagctgccctgcattctggacatcgatatgttccacctcctggtaggattagtgcttgccttccctgccttgcagtgtcaggacttctcaggaattagtctcgggacgggcgacctgcacatttttcatctggtaactatggcccacattatacagatccttttaacatcttgcaccgaggaaaatgggatggatcaggagaaccccccatgcgaggaggagtctgccgtgctcgccctatacaagaccctgcaccagtacactggctctgccctgaaggaaattcctagtggatggcacctctggaggagtgtaagggccggaataatgccctttctgaaatgttctgctttattcttccattatctcaatggcgtgccgtccccaccggatatacaggttcccggcacatctcacttcgaacatttgtgtagctacttatccctgcctaacaacctgatttgcttgttccaggagaattctgaaatcatgaactcactcattgagtcctggtgtaggaactcggaggtcaaacggtatctggaaggggaacgagatgcgattcggtatccccgagagagcaacaaactcattaatctcccagaggactattcatccctgatcaaccaagccagcaattttagctgtccaaaatctgggggcgataaatccagggcccccacactatgcctggtgtgtggctctctgctttgttcgcaatcatattgctgtcagactgagctggaaggggaggatgtcggcgcatgcaccgcacatacctactcctgcggctccggagtaggaattttcctgcgagtgagggagtgccaggtattatttctggctgggaagaccaagggatgcttttatagtccgccttatctagatgattatggggaaactgaccaaggcctccggagaggcaatccacttcacttatgtaaagagcgcttcaaaaagatccagaagctttggcaccagcatagtgtaacagaggagattggacacgctcaggaagccaatcagaccctggtcggtatcgattggcagcatctctag

SEQ ID NO: 139737 - DNA, 5268 bp, Artificial Sequence
  Description of Artificial Sequence: Synthetic coding sequence
atggcctccgagttagagcccgaggtgcaggcgatcgaccgcagtctgcttgagtgcagcgccgaggaaattgccgggaaatggttgcaagccacagacctgacacgcgaggtgtaccagcatttagcacactatgtgccaaagatatattgtcgggggccgaaccctttcccgcagaaggaggacatgttggcccagcacgtcctcctcgggccaatggaatggtacttgtgtggagaggaccccgcattcggttttcccaagcttgagcaggccaataaacccagccatctctgtggtcgtgtgtttaaggtgggagagcctacttatagctgcagagactgcgcagtggatcccacctgcgtactgtgcatggaatgctttctgggctccatacacagagaccacagatatagaatgacaaccagcggcggcggggggttctgtgactgcggtgacaccgaggcctggaaagagggaccttactgtcagaagcacgaacttaacacaagtgagatcgaggaggaagaggatcctctcgttcacctgagcgaagatgtcatagcaagaacttacaatattttcgcaatcacatttagatatgctgtagagattctgacatgggaaaaggaaagtgaactgcctgcagatctggagatggtggagaagtccgatacatattactgtatgttgttcaacgacgaagtccatacatatgagcaggtcatttacacactgcagaaggccgtgaattgtacacagaaagaagcaataggctttgccaccacagttgatcgggacggcagaagatctgtgcggtacggagactttcaatactgcgagcaagcgaaatccgttatagtccgcaacaccagtcgccaaacaaaacccctgaaagtgcaggtcatgcacagctccatcgtggctcaccagaacttcggactgaaactgcttagctggctgggctccataattggttacagcgatggcctgcggcgaattttatgccaggttggactccaggagggccctgacggtgagaacagtagtcttgttgatcggctaatgttatccgacagtaagttatggaaaggtgcccgctcggtgtaccaccagctctttatgtcaagccttctgatggatctcaaatataaaaaattgttcgccgtgagatttgctaagaattatgaaagactgcagagtgactacgtaacggacgaccatgaccgggagtttagtgttgctgacctgtctgtccagatttttacagttccctctctcgccaggatgctaattacagaggaaaacctgatgtctatcatcatcaaaacttttatggatcacctgcggcaccgtgatgcccaggggagattccagtttgaaagatacacagctttgcaggcgttcaagttccggcgagtgcaatccctgattctggatctgaagtacgtcttgatctccaagccaaccgagtggtctgatgaactacgtcaaaaattcttggagggcttcgacgcttttttggagttgctgaaatgcatgcagggcatggatcctattacccggcaggtcggacaacatatcgagatggagcctgagtgggaagctgcgtttacgctgcagatgaagctgacccacgtgatcagcatgatgcaggactggtgtgccagtgacgagaaggtgttgatcgaagcttacaagaagtgcctggcggttctgatgcagtgccatgggggctataccgacggtgagcagcctatcacgcttagcatttgcggacatagcgtcgagactattaggtattgcgtcagccaggagaaagtcagtattcaccttcccgtgagtcggctgcttgccgggctgcacgtactcttatctaagtccgaagttgcatataagtttcccgagctgctgccactctctgaactctcccccccaatgctgattgagcatcccctgcggtgtttggttctgtgtgcgcaagtgcatgccggtatgtggcggcggaacggatttagcctggtaaatcagatctattattatcacaacgtgaagtgtaggcgtgagatgtttgacaaagacgtcgtcatgctccagaccggggtatctatgatggatcctaaccattttttaatgattatgctgagtagatttgaactgtaccagatcttttccactcctgactacggcaagagattttcatcagaaattacccataaggatgttgttcaacagaataatacacttatagaggaaatgctgtacctgattatcatgttggtgggcgaacggttttctcctggcgtgggacaagttaatgctacagacgagataaaaagggagattatccaccagctcagcatcaagcctatggctcactcagagttagttaagtcattgcctgaggatgaaaataaggagaccggcatggagtccgtaatagaggctgtggcacatttcaagaagcctgggctgacaggccgcggcatgtacgagcttaaaccagagtgcgctaaagagttcaatctctacttctaccactttagtcgggcagagcagtcgaaggcagaggaggcccagcggaagctcaagcgccagaatagggaggacaccgctttgcccccaccagtcctgccacccttctgcccccttttcgcaagcctggtcaatatcctccagtccgacgtgatgctgtgcattatgggcactattctgcagtgggccgtggagcacaacggatacgcatggtccgagtccatgctccagagggtgttgcatctgatcgggatggccttgcaggaggagaagcagcatctggagaacgtgactgaagagcacgttgtcacttttacatttacacaaaagatctccaagcccggcgaggcccctaagaattccccatcgatccttgccatgttagagaccttacagaacgctccctatcttgaggtccacaaagatatgattagatggatcctaaaaaccttcaacgccgtgaaaaaaatgagggaaagttctccaaccagccctgtggctgagacagaggggactattatggaagagtcgtcgagggataaggataaggccgagaggaaaagaaaggcagaaattgctagactgaggcgcgaaaaaatcatggcccaaatgagtgagatgcaacgccatttcatagacgagaacaaggagctctttcagcagactctggaacttgacgcctccacctctgctgtgctggatcattctcctgttgcctccgatatgacattaacagcgctaggtcctgctcaaacccaggtgccagaacagcggcagttcgtcacctgcattctttgtcaggaggaacaggaggtgaaggtggaatcacgagctatggtactggccgccttcgtgcagcggtccacggtcctgagtaaaaaccgcagtaaattcatccaggatcccgagaagtatgatccattgttcatgcatcctgatctgtcatgtggaacccataccagttcatgcggacatatcatgcatgctcattgctggcaaaggtacttcgatagtgtgcaggccaaggaacaacggaggcaacagcgactacggcttcatacttcctacgatgtggagaatggagagttcctttgtcctctgtgtgaatgcttatctaacaccgtcatcccgttgcttctgcctccacggaatatcttcaacaacaggctgaacttctccgaccagccaaaccttactcaatggataagaaccatttcccagcagattaaagcactacagtttctccgaaaggaggagtctacacccaacaacgcctcaacaaagaacagtgaaaacgttgatgaactccaactgcctgaggggttccgacctgatttcaggcctaaaatcccctattctgagagcataaaggaaatgctcaccacttttgggaccgcaacatacaaggtgggcctgaaggtacatcccaacgaagaggacccccgcgtccccatcatgtgttggggcagttgtgcctacacgatccagtcaatcgagagaattctgtctgacgaggataaaccactgttcggtccgcttccctgcaggcttgacgattgtctgaggtcgttaacacgcttcgccgctgctcactggactgttgcctccgtgagcgtggtccaggggcatttctgtaaattgttcgcaagcttggttcctaatgactcacacgaggagctgccctgtattttagatatcgacatgttccatctcctggtcggcctggtgctggcttttccggctctccaatgtcaagatttcagtggaatttctctaggaacaggtgatttgcacatctttcacttggtgaccatggcgcatataatacagatccttctcacctcctgtaccgaagagaatggaatggatcaggaaaatccaccctgcgaagaggagagcgccgtgctcgctttgtacaagacattgcatcagtatactgggagcgctcttaaggagatacccagcgggtggcatctttggcgaagcgttcgggccggtattatgccattcctgaagtgcagcgcgctttttttccattatttaaacggtgtccccagcccacccgatatccaggtgcccggcacgagccacttcgaacacctgtgttcctacctgagcctgcccaataatctgatttgcctcttccaggaaaactccgagatcatgaactctctgatagaaagttggtgtcgcaacagcgaggtgaagcgctaccttgaaggtgaaagagacgccatccggtaccctcgagaatctaataaactgatcaatcttccagaggattactcttcgctaatcaatcaggcctctaatttttcctgccctaagagcggaggcgataaatctcgggcccccactctctgcctggtttgtggcagtctgctgtgcagccaatcctactgttgccagactgagttggaaggggaagacgtcggtgcctgcaccgctcatacatacagttgcggcagcggcgtaggaatcttcctgagagtgcgggagtgtcaggtgctgtttctggcggggaagaccaaaggatgcttttactccccgccctacctcgacgattatggtgaaaccgaccaggggctccggaggggcaatccactacatctatgtaaggagcggttcaaaaaaattcaaaagttatggcatcagcatagcgtgacagaggagatcggacacgcccaagaggctaatcaaactctggtgggcatcgactggcagcatctgtag

SEQ ID NO: 139738 - DNA, 1320 bp, Artificial Sequence
  Description of Artificial Sequence: Synthetic coding sequence
atggcctccgaattggagcccgaggtccaggcaatagaccggagcttgctagagtgctctgccgaggaaatcgccgggaaatggctgcaagccaccgaccttactcgggaagtttaccagcacctagcacattatgtgccaaaaatatattgtcggggccccaacccctttccgcagaaagaggatatgctggctcagcacgtacttctgggacccatggaatggtacctgtgtggagaggacccagccttcgggttcccaaagctagagcaggccaacaagcccagccacctgtgtggccgcgtgttcaaggttggcgaaccaacctattcctgtcgggattgcgcagtggaccccacatgtgtactgtgcatggaatgttttcttgggtctatccacagggaccacaggtacagaatgacaacctcaggcgggggtggtttttgtgactgtggtgatactgaggcatggaaggagggcccttactgtcagaaacatgagctgaacacctccgaaattgaggaggaggaggaccccctagttcatctcagtgaggacgtgatcgcgcgcacttacaatatattcgctatcactttcagatacgccgttgaaatcctaacctgggaaaaggagtccgaattaccagcagacctggaaatggtggagaaatccgacacctactattgtatgctcttcaatgatgaggtccacacctacgagcaagtcatttacaccttgcagaaggctgtgaattgcacacagaaagaggccataggatttgcaacaactgtggaccgggacgggaggcgctccgtacgatacggcgattttcagtactgcgaacaggctaaaagtgtgatcgtgcgaaacacatctaggcagaccaagcccttgaaggtgcaggtcatgcactcaagcattgtggcccatcagaacttcggcctgaagctgctgagctggctgggatctattattggttactcagacggacttcgcagaattctgtgtcaggtcggcctccaggaggggccagatggcgaaaattcctctctcgtggaccggcttatgctgtcagattctaaactttggaaaggcgcaagaagcgtgtatcatcaactgtttatgtcaagcctgcttatggacctcaagtataaaaagttattcgctgtgcgcttcgctaagaattatgagcgtctccagtctgattatgtaacagacgaccatgaccgtgagtttagcgtggcggacctgtctgtgcagatttttaccgtgcccagcctcttcagcatatccgccggtagaagcggcagtcctctctag

SEQ ID NO: 139739 - DNA, 5667 bp, Artificial Sequence
  Description of Artificial Sequence: Synthetic coding sequence
atggccgcggctgctgcagcagccgtgggcggccagcagccatcacagcctgagcttcctgcccccgggcttgcactggacaaagcagctacggctgctcatctcaaggcggctcttagccgccccgacaatcgggcaggggcagaagagctgcaggcgctccttgagagggtcctcagtgcagaacggccattggctgccgcagcaggtggcgaggacgctgctgctgccggagggggcggggggcccggcgctgcggaggaagaggctctggagtggtgcaaatgcctgctggcaggtggcggcggatacgatgaattttgtgccgccgtcagggcttacgatccagcagccctgtgcggactggtctggaccgcaaacttcgtggcataccgctgtcggacatgcggaatttccccttgtatgagtctgtgcgcagaatgctttcatcagggagaccacacgggacacgacttcaatatgttcagaagccaagcgggaggagcctgtgactgcggtgacagcaacgtaatgagggaatccggattttgtaagcgccatcagataaaatcttcctccaatatcccttgcgtgcctaaagacctgctgatgatgtcggagttcgtattgccaagatttatcttctgtcttatccaatacctgcgcgagggttataatgagcctgctgccgatgggcccagcgaaaaagatcttaataaggtgctgcaactcttggagcctcagatctcgtttctggaagatttgaccaagatgggtggcgccatgcggtccgtcctgacgcaggttctgacgaatcagcagaactacaaagacctgactagtggcctgggtgagaacgcatgtgtgaagaagtctcatgagaagtacctgatagccctcaaatccagcggtctgacttaccctgaggataaacttgtttatggtgtgcaggaaccctccgcgggaacatcttccctggccgtgcagggcttcataggagccacgggcacactggggcaggtggatagttctgatgaggatgatcaggacggaagtcagggcctaggcaaaagaaaaagagttaagctttcatctggaaccaaagatcagagtataatggacgtgctcaagcacaagagttttctcgaggaactgctcttctggacaattaaatacgagtttccccagaagatggtcactttcctgctgaatatgctcccagatcaggagtacaaggtcgcatttaccaaaacgttcgtccagcactatgccttcattatgaagaccctgaagaaatctcatgaatcagacacaatgagcaaccgcattgttcacatcagtgtgcagttgttctcaaatgaagagttggctagacaagttaccgaagaatgccagttgctggatatcatggtcaccgtgctgctctacatgatggagtcctgcttaataaagtcagaattgcaagacgaggagaattctcttcatgtggtagtgaattgcggcgaggcactgctgaagaataacacctactggcccctggtgtccgacttcattaacatcctttcccaccaatctgtcgctaaaaggttccttgaggatcacggtctgctcgtaacatggatgaactttgtgtcattctttcaggggatgaatctgaacaagagggaactgaacgagcacgtggaatttgaaagccagacttactatgccgcatttgcagctgagctggaagcttgcgcccagccgatgtggggcctgctatcacactgcaaagtgcgggaaactcaggaatatacacgcaatgtcgtacgatactgcttagaagctctgcaggattggtttgacgccatcaactttgtggacgaacctgcgcccaatcaggtgacgttccaccttcccctgcacagatactatgccatgttcctgtccaaggccgtcaagtgccaggagctcgatctagactctgtgctaccagaccaggagatgctgatgaagcttatgatccatcccctacagattcaagcctcccttgcagagattcattcgaacatgtgggtccgcaatggactgcaaattaaagggcaagctatgacttacgtgcagtcccatttttgcaactccatgatcgatcccgatatctatctactccaggtgtgcgcttcgcgattagatccagactattttataagctccgtgttcgaaaggtttaaggtagttgatctgctgaccatggcctcccaacatcagaataccgttctggacgccgaacacgagagaagcatgctggaaggtgccctgaccttccttgtgattttgttatcgctgaggctgcacttaggaatgtccgacgacgaaattttgagggctgaaatggtcgctcagttatgtatgaatgatagaactcattcgtctctgctcgatttgatccctgagaatccaaatccaaagtccgggatcatcccgggctcttattcctttgagagcgtgctgtccgcggttgcggactttaaagcaccagtgttcgagcccggtggctccatgcagcaggggatgtacactcctaaagcagaggtgtgggatcaggagtttgatccagttatggtaattttgaggactgtctaccgacgagacgtgcagtcagccatggaccgttacactgcctttctcaagcaatctggaaagtttcccggcaatccatggcctccatacaaaaaacggacctcattacatccaagttataagggcctcatgcgcctcctgcactgtaaaacgctacatatcgtgctcttcaccctattgtacaaaattctgatggaccaccagaacttgtcagagcatgtgctgtgcatggtgctgtacctgatcgaattagggctggagaattcggccgaagaagagagtgacgaggaggccagtgtgggtggacccgaacgctgccacgattcgtggtttcccggcagtaacctggtgagtaatatgcggcactttataaactatgtgcgggttagagtaccagaaaccgctccggaagtgaagagggatagtcctgcatctacttcttctgacaacctgggctccctccagaattccggcaccgcccaagtttttagcctggttgccgaaagacggaaaaagttccaggaaatcattaatcgttctagcagcgaagccaatcaggttgtgagacccaaaacctcatcaaaatggtccgctcccgggagcgccccccaactaactaccgcgattcttgagatcaaggagtctatcttgtctttgctgatcaaactgcaccataaactgagcggaaaacaaaactcttactatccgccctggctggatgacatcgagattcttatccaacccgagatccctaaatattctcacggcgatggcatcaccgcagtcgagcggatcctcctcaaggcggccagccagagtagaatgaacaagcgtattatagaggaaatttgccgaaaggttaccccaccagtcccaccaaaaaaagtcacagcagccgagaagaaaaccctcgataaagaagaaaggcgtcagaaggcccgcgaacgtcagcagaagttgcttgcggagtttgcctctaggcaaaagagcttcatggaaacagccatggacgttgacagcccggagaacgacattcccatggaaattacaacggctgagccgcaggtgtccgaggccgtatacgactgtgtgatctgtggccagtctgggccctcgtcggaagatcgcccaactggccttgtggtgctgctgcaggcctcctcggttttggggcaatgccgcgataacgttgagccaaaaaagctgcctatcagcgaagaagaacagatctacccatgggatacttgtgccgccgtgcacgacgtccggttatcccttttgcaaagatactttaaggactcttcttgcctcctcgcggtctctatcggttgggaaggtggagtctacgtgcagacttgtggtcatacccttcatatcgattgccataagtcctacatggaaagccttcgtaacgaccaggtgttgcagggatttagcgtcgataaaggggagttcacttgccctctgtgcaggcagttcgcgaacagtgtgctcccttgctatcccggatctaatgttgaaaataacccatggcagaggccatccaacaaatctatccaggacctaataaaagaagttgaagaactgcagggacgaccgggcgcattccccagcgagacaaacctgtccaaggagatggagtctgtgatgaaagacatcaaaaacacgacccaaaagaagtatcgagattactctaagaccccaggttccccggacaacgatttcctctttatgtactcagttgccaggactaacctcgagctggaacttatacataggggaggcaatctgtgttccggtggagccagcaccgccggtaaaagatcctgtttgaatcagcttttccacgtgctggctcttcacatgcgactgtatagcatcgacagcgagtataacccatggagaaagctgacgcagcttgaggaaatgaacccacagctgggctatgaggagcagcagcccgaggttcctattctttaccacgacgtgacaagtctactgctcattcagatcttgatgatgccccaacccctgcgcaaggaccacttcacttgtattgttaaagtcctttttacactcctttacacccaagccctcgcagcactttccgtgaagtgtagtgaggaagatagaagcgcctggaaacacgccggagcattgaaaaagtctacatgcgacgccgagaagagttatgaggtgctgttgagcttcgtcattagtgagctctttaaaggcaaactctaccacgaggagggtacccaggagtgtgcgatggtcaatcctattgcttggagtcccgagtccatggaaaagtgcctgcaagacttttgtctcccttttttacggatcaccagccttctgcagcatcacttgttcggtgaggacctcccctcctgtcaggaggaggaagagttctctgtactggcaagttgtctcggattgctgcccactttctaccagacagaacaccctttcatctccgcgagctgtcttgattggccggttcccgcctttgacatcatcactcagtggtgttttgaaatcaagtctttcactgagcgtcatgcagagcagggcaaggccctgctgattcaggagagcaaatggaagctaccccaccttcttcagctgccggaaaactacaatacaatattccagtattaccataggaaaacttgttccgtgtgtactaaagtccccaaggacccagcggtttgccttgtgtgcggaaccttcgtatgtcttaagggcttatgttgcaaacagcagagttattgcgagtgtgtccttcatagccaaaactgtggagcgggcaccggtatatttttactgatcaatgcttcagtcatcatcatcatcaggggccataggttttgcctgtggggctccgtctatctggatgcccacggcgaagaggaccgggatctgcgcagaggaaaaccgctttatatatgtaaggagaggtacaaggtgttggaacagcaatggatctctcatacttttgaccacataaacaagcggtgggggcctcactataacggcctctag

SEQ ID NO: 139740 - DNA, 2130 bp, Artificial Sequence
  Description of Artificial Sequence: Synthetic coding sequence
atgatcgccagtaaacagagacagtttacagaggtgtttcggatcatgtcatcgaccttctcacagtcccgattcctgtatgctgcagtggtcaccgatagccctgaaaatgatattccaatggagattacgacagcagaaccgcaggtctcggaagccgtctatgattgtgttatatgcgggcaaagcggcccgtcctctgaggacaggcctaccggacttgtagtgctgctgcaggcctccagcgtactgggccagtgcagggacaatgtggagcctaaaaagttacctatctccgaggaggagcagatctacccttgggacacttgcgctgcagtacatgacgtgcggctctcactcttgcaacgctactttaaagattcatcctgtctgctggccgtttctataggctgggaaggaggggtctatgtgcagacttgcggacatacactccatatcgattgccataagtcctacatggaaagcttacggaatgatcaggttctccagggtttttcagtggacaaaggcgaatttacctgtccattatgccggcagttcgcgaattcagtactgccctgttaccctggttcaaacgtggaaaacaatccctggcagcgcccatctaataagtctattcaggatctgataaaggaagtcgaggaactccagggacgaccaggagctttcccatccgagacgaacctgtccaaagagatggaatctgtgatgaaagacattaagaacactacccagaaaaaatatcgcgactatagcaaaacgccgggatcacccgacaacgatttcctctttatgtattccgtggcccggacaaacttggagctggaacttatccaccgagggggaaacctgtgcagtggcggcgcatcaaccgcgggaaaaagaagctgtttgaaccagttgttccacgtgctagccctgcatatgaggttatacagtattgactccgaatataatccatggcgtaaactaactcagttggaagaaatgaaccctcagctgggatatgaagagcagcagcctgaagtgccaatcctgtaccacgacgtgacatcacttctcctgatacagattctgatgatgccacagcccttaagaaaagaccattttacatgcatcgtgaaagttctgttcaccctgctatatacacaagccctggccgccttgagtgttaaatgttcagaagaagatcggagcgcctggaagcatgccggggcattgaagaaaagtacctgtgatgcggagaagtcatatgaagtcctactgtccttcgtgattagtgagttgttcaagggcaaactgtaccacgaggaagggactcaagagtgcgctatggtgaatccgattgcatggtctccggaatcaatggagaagtgcctccaagatttttgcctgcctttcctgcgaatcacaagtctgctacagcaccatctcttcggagaggacctgccatcctgtcaagaagaggaagaattctcagtcttggcctcttgcctgggactgctgcctacattctatcaaactgagcaccccttcatctccgcttcgtgcctagattggccagttccagcctttgatataatcacacaatggtgctttgaaatcaaatctttcaccgagcggcacgccgaacaaggtaaggctctcctgatacaggagtctaaatggaaactgccccatcttctccagctcccagagaactacaatacgatcttccagtattatcataggaaaacatgttcagtttgtaccaaagtcccgaaggatcctgccgtttgtttggtgtgcggcactttcgtgtgtctgaagggactttgttgcaagcaacagagttattgcgaatgcgtgctccactctcagaactgtggggccggaacaggtattttcttgctgatcaacgccagcgtgatcatcataatcagaggccatagattttgcctgtggggaagcgtctacctcgatgcgcacggcgaggaagacagagatctccgccgtgggaagcctctttatatctgcaaggaacgatataaagtcttagagcagcagtggattagccacacgtttgatcacatcaacaagcggtggggcccacactacaatggtttgtag

SEQ ID NO: 139741 - DNA, 5667 bp, Artificial Sequence
  Description of Artificial Sequence: Synthetic coding sequence
atggctgctgccgctgctgccgctgtgggcggccagcagccaagccagcccgagctcccggccccaggactggccctagacaaagccgctaccgcggctcacctcaaggcggccctgtcacgccctgataacagggccggggcggaggaactgcaagccttattggagagagtcttaagcgcggaacgtccactggctgcagcggctgggggcgaagatgcagcagcagccggaggtgggggcggccccggagctgccgaggaggaagcgctggagtggtgtaagtgcctgttggccggaggagggggatatgatgagttctgcgctgccgttcgcgcatatgatcctgctgccctgtgcggtctagtgtggaccgcaaacttcgtagcctacaggtgccgaacctgtggaatcagcccttgcatgtcactttgcgccgaatgtttccaccagggagaccacacagggcatgactttaatatgtttcgctcccaagccggtggagcttgcgactgtggtgatagcaatgttatgcgggagtctggtttttgtaagaggcaccaaatcaagtctagctctaatatcccctgcgtccctaaagacctgttgatgatgtccgagtttgtgctgccgcgcttcattttctgtctcatccagtacctgagagagggatacaatgagcctgccgcagatggcccaagtgaaaaggatttgaataaagtccttcagcttttggagcctcaaatcagctttcttgaggacctcacaaaaatgggtggtgccatgagatctgttctgactcaggtgctgaccaaccagcagaactacaaggatttgacctctggcctcggtgaaaatgcttgtgtaaagaaaagtcacgagaagtacctgatagcactgaagtccagtggactgacctatccggaagataaactcgtgtatggcgttcaggagccttccgccggtactagcagtttagcagtccagggatttatcggagcgaccgggactctagggcaggtagactcaagtgacgaagacgaccaggacgggtctcagggtttaggcaaaaggaagcgcgtgaagcttagctccggaactaaagatcagagcatcatggacgtgctcaaacataagagttttctcgaggaactgctgttctggacgatcaagtacgaattcccgcagaagatggtgacctttttgctgaacatgctgcctgatcaggaatacaaagtggcattcacaaaaaccttcgttcagcattatgcgttcattatgaaaactttaaagaaatcacacgagtctgataccatgtccaataggattgtgcatattagcgtgcagttgttctctaatgaggagctcgcaaggcaagtgaccgaggaatgtcagctcctggatatcatggtcaccgtgctactctacatgatggaaagttgcctgattaagagcgaactacaggacgaggagaattctctccacgttgtggtgaactgcggcgaggctctcctgaagaacaacacttattggcctcttgttagcgacttcattaatattctgtcccatcagagtgtcgccaagagatttttggaagatcacggtctcttggtcacttggatgaatttcgtgagcttctttcaaggaatgaatctcaacaagcgggaattgaatgaacatgtcgaattcgaatctcagacatattacgcggcgtttgcagccgagctagaagcgtgcgctcagcccatgtggggcttactctcacattgcaaggttcgcgagacacaggagtatactcgcaacgtggttcggtactgtctggaagccttacaggactggttcgatgccatcaacttcgtggatgaacctgctcccaaccaggtgacattccacttgccacttcacagatactacgccatgttcctgagcaaggccgtcaaatgtcaagaactcgacctcgactccgtgttgccggatcaggaaatgctgatgaaactgatgattcacccactccagatccaagcatctctggccgagattcacagcaatatgtgggttaggaacgggcttcaaattaaagggcaggccatgacttacgtgcagtcacacttctgcaattccatgatcgacccagatatttatctgctccaggtgtgcgcctccaggctcgaccctgattactttatcagctccgtcttcgaacgctttaaagtagttgacctgctcaccatggcctcacagcatcagaataccgtgctagacgcggagcacgaaagatccatgctggaaggtgccttgacattcctagttattctcctgagtctgcgcctgcacttaggaatgtccgacgatgaaatcttgagggccgaaatggtcgcccagctgtgtatgaacgatcgtacccattcgagtctgctggatttaatccctgaaaacccaaaccccaagagcgggattatcccgggcagctacagcttcgaatcagtgctctccgcagttgccgactttaaagctcccgtctttgagcccggaggtagcatgcagcagggcatgtacacccccaaagccgaggtgtgggaccaagagtttgacccagtaatggtcatcctgcgcacagtctacaggcgcgacgtccagtccgccatggacaggtataccgccttccttaagcagagcggtaagtttcctggaaatccctggcctccatacaagaagcggaccagcctgcatccatcttataagggactgatgcgcctgctgcattgtaagaccctgcatattgtgctcttcactctactgtacaagattctgatggaccaccagaacctgtccgaacatgtcttatgtatggtcttgtacttgatcgagctcgggctggagaattcggctgaggaggagtccgacgaagaagcttctgtgggaggtccagagaggtgccacgacagctggttccctggatcaaacctggtcagtaatatgcgacacttcattaactacgtgagggtgcgggttcctgagactgctcctgaggtcaaaagggatagtcctgcctctacaagcagtgataacctggggagtttacaaaacagcggaactgcacaggtgttcagcttggttgcagagcggcgtaagaaattccaggaaatcataaaccggtcaagctccgaagctaaccaggtggtcaggcccaaaactagcagcaagtggtctgcccccgggtctgctcctcagctgactacggccatacttgagatcaaggaatcaattttgagtctcctcatcaagttgcaccacaagttatctgggaagcagaactcttattacccaccttggctggacgacatcgagatcttaatccagcccgagattcccaagtacagccatggtgacgggattactgccgtggagcgcatcctccttaaggctgcatcgcagtcccgtatgaataagcggatcatcgaggagatttgtcggaaggtgacaccccccgttccccctaaaaaagtgacggcagctgaaaaaaagactctcgacaaggaggagaggcgccagaaagccagagagcgccagcagaagctcttagccgaattcgctagcagacagaagtcattcatggaaaccgccatggatgtcgactctccagagaacgacattcctatggagatcaccactgcagaacctcaagtttccgaggccgtttatgattgcgtgatctgtggccagagcggcccttcctccgaggatcgacctaccgggttggtggttctgctgcaggcttcatcagttttggggcagtgtagagataatgtggagcctaagaaattacccatttcagaggaagagcagatttacccttgggatacctgcgccgccgtgcatgacgtgaggctctccctcttacaaagatatttcaaagattcctcctgtctgcttgccgtgagtattggctgggaaggtggcgtctacgtccagacgtgtggacacacactgcacatcgattgccacaagtcatatatggagtccctaagaaacgatcaggttctacagggcttttcagttgacaagggcgagttcacatgccccctttgccgacagttcgctaactctgtcctgccttgttaccccggatctaacgtggaaaataatccctggcagaggccatcaaataaaagcattcaggatctcattaaggaagtggaagagctgcagggcagacctggagctttcccttccgaaacaaacctctcaaaggaaatggaatccgtgatgaaggacattaaaaataccacgcagaagaagtatagggattacagcaaaaccccaggctcacctgataatgactttctgttcatgtattcggtggcccgtacgaatctggagctagagttgatacatagggggggcaatctgtgttctggcggcgcctccactgctgggaagcggtcatgcctgaatcagctgttccatgtgctcgccctgcacatgcggttgtacagtatcgacagtgagtacaacccctggaggaaactgactcagctggaggaaatgaaccctcagctcggctacgaggaacagcaaccagaggtcccaatcctgtaccatgatgttacaagtttgctgctgatccagatcctgatgatgccacaacctctcagaaaagaccacttcacctgtattgtaaaagttttgttcaccttgctgtatactcaggccttggccgctctgtcggtgaaatgctctgaagaggatagatcagcatggaaacatgccggtgcactgaagaaaagcacctgcgatgccgaaaagtcatatgaggtgctacttagttttgtaatctccgagttgtttaagggtaagctgtaccacgaagaggggacccaggagtgcgccatggtgaatccaatcgcgtggtcgccagaaagcatggaaaaatgcctgcaggatttctgtttgccctttctgcggatcaccagtctgctccagcatcatctgtttggcgaagacctcccttcctgccaggaagaagaagagttttccgtcttagcgagttgtctcggtctgctccctaccttctaccaaactgagcacccatttattagcgcatcctgtttagattggcccgtgccggctttcgacatcattacacaatggtgctttgagattaaaagcttcaccgaaaggcacgcagaacagggcaaagccctgctcattcaggaaagcaagtggaaacttccccacctgctgcagctgcctgagaattataatacaattttccagtactaccaccggaaaacatgttcagtgtgtaccaaagtgccaaaggatcctgcagtttgcctggtttgcgggacctttgtttgcctcaaagggctctgttgcaagcagcaaagctactgcgagtgcgtcctccacagtcaaaattgcggtgccggaacaggaatcttcctgttaatcaatgccagtgttatcatcattattcgggggcaccgcttctgcctatgggggagcgtgtacctggatgctcacggtgaggaggaccgggatctgcgcagggggaaacctctgtacatatgcaaagagcgatacaaggtattggagcaacaatggatctcacacacgtttgatcatataaacaaacgctgggggcctcattataatggcttgtag

SEQ ID NO: 139742 - DNA, 5754 bp, Artificial Sequence
  Description of Artificial Sequence: Synthetic coding sequence
atggctgccgccgccgctgccgctgtgggtgggcagcaaccctcccaacctgagctgccagcacccggactcgcactcgacaaggcagcaaccgcagcccaccttaaagctgcactgagcaggccagacaaccgagctggcgcagaggagttacaagcgctcctggaacgtgtgctctcagcagagaggcctctggctgccgccgctgggggagaagacgcagcagctgcaggagggggcggcggacccggggcggcggaagaagaggcactagaatggtgcaagtgccttctggccggaggcggcggctatgatgaattttgtgccgctgtgagagcctatgatccagcggccttatgcggactcgtgtggactgcaaacttcgtcgcatacaggtgtcggacctgcgggatctctccctgcatgagcttatgtgccgaatgttttcaccaaggcgatcatacaggccatgacttcaatatgtttcggagccaggccgggggtgcgtgtgactgcggagactccaatgtcatgcgcgagtcgggcttttgcaagagacaccagataaaaagcagttcaaacataccctgtgttccgaaagacctcctaatgatgtctgaatttgttttgccacggtttatcttttgtctaatccaatacctgcgagagggatataatgaacctgctgctgatggcccctccgagaaagacctgaataaggtactgcagctcttggagcctcagatcagttttctggaggacctgacaaaaatgggcggcgccatgagatctgtgctgacgcaagtcctaacaaaccagcagaattataaggatctgacatcaggactgggtgaaaatgcctgcgtgaaaaaaagccatgagaaatatctcatagccctcaaatcctccggcctgacatacccggaggataaactggtgtacggcgtacaggaacccagtgctgggacaagcagcctcgctgtgcagggctttattggcgccaccggtacattgggccaggtcgatagtagcgatgaggatgaccaggatggttcccagggactcggtaagcgcaagcgggttaaactgtcctccggcacaaaggaccaaagtattatggacgtgctaaaacataaatcttttctggaggagcttctgttctggactattaagtacgaatttcctcagaaaatggtgaccttcctccttaacatgctccccgatcaggaatataaggtcgcctttaccaagacgtttgttcagcactatgcatttattatgaaaacattaaaaaaaagccacgagagcgacaccatgtccaatcgtatcgtacatatcagcgtccagcttttcagcaacgaggagttggctcgtcaggttacagaagagtgtcaactacttgacataatggtcacggtgctcctgtatatgatggaatcctgtctgatcaagagcgaattgcaggacgaggagaacagcctgcatgtggtagtgaactgtggcgaggcgttactgaagaacaacacatactggccgctggtttccgatttcatcaacatactgtctcaccagtctgttgcaaaaaggtttctggaggaccatgggctgttggttacttggatgaacttcgtctctttttttcagggtatgaatctgaacaagagagaactgaacgaacatgtcgaatttgaatcacagacttactatgccgccttcgctgccgagctggaagcctgtgcccagcccatgtggggactcctaagtcactgtaaggtgcgggaaactcaggagtacaccagaaatgttgtgcgctactgtctggaagctctgcaggactggtttgatgccatcaacttcgttgatgaaccagcacccaaccaggtcactttccacctgcctcttcataggtactacgccatgtttctgagtaaagcagtgaaatgccaggagttggacctcgatagtgttctgccggaccaggagatgttgatgaagttgatgatccatcccttacagattcaagcctcactggcggagatccactccaacatgtgggtaagaaatggattgcagatcaaggggcaggccatgacttatgttcagagtcacttttgtaactctatgattgatccggacatctacctcttgcaagtctgcgcatctcgcctggatccggactactttatctcttctgtctttgagcgattcaaggtggtcgatctgcttacgatggcctcccagcaccagaatacagtgttggacgctgaacacgaacgcagtatgctggaaggtgccctgacctttctcgtcattttactgtccctgaggctccatctgggcatgtctgacgatgagatattaagagccgaaatggtggcccagctgtgcatgaacgaccgcactcatagctccctactggatctaatccccgaaaaccccaaccctaagagcggcataattcccggcagctattccttcgagagcgtcctcagtgcagtcgcagattttaaggctcctgtattcgaacctggcggctcaatgcagcagggaatgtatacgcctaaggcggaggtgtgggaccaggagttcgaccctgtcatggtcatcctgcgcactgtctatcgtcgagacgtacagtccgccatggatagatacaccgcatttttaaagcagagtgggaagttccccggaaatccctggcccccatataaaaagaggacaagcttgcaccctagttacaaggggctgatgaggctgctccattgcaagactctgcacatcgtcctcttcaccctgctgtataagatcctaatggatcaccagaacctgtctgaacatgtattgtgcatggtcctctatcttattgagctcggcctcgagaattcagcagaagaggaatctgacgaggaggcaagcgtgggcgggccggagagatgtcatgacagctggtttccaggatccaatctcgtgagtaacatgcgccattttatcaactacgtcagggtgcgggttcctgagacggccccagaagttaagcgagattcccccgcgtctaccagttccgacaaccttgggtccttacagaacagcgggactgcccaggtattttcgctggtcgcggaaaggaggaaaaaatttcaggaaatcatcaatagatcttcgtctgaggctaaccaagtggtcaggcctaagacctcgagtaagtggtccgctcccggtagcgccccccaacttaccactgcaattttggagatcaaggaaagcattttgtccctgcttatcaagctgcaccacaaactgtcgggaaagcagaactcctattatcctccatggctcgatgatatcgagatccttatccagccggaaatcccaaaatatagccacggagatgggataacagccgtcgaacgcatactcctgaaagctgcttctcagtcgcgtatgaacaaaagaattatcgaggaaatctgtagaaaagtcacacccccagtgccccctaagaaggttaccgccgcagagaagaaaaccttggataaggaggaacgccgccagaaggcacgggaaaggcagcagaagcttctggccgaattcgccagtcggcagaaatctttcatggagactgctatggacgtggattccccagagaatgacataccaatggagattaccacggcggagccgcaggttagtgaggcggtgtatgactgcgtcatctgcggccagagcgggccctcgtccgaggaccggcccacgggcctcgtggtgttgctgcaagcaagcagtgttctgggccagtgtagggacaacgtcgaaccgaaaaaactgccaatttccgaggaagagcagatctacccatgggatacctgtgcggcagtccacgacgtacgcctgtccctgctccaaagatacttcaaggacagtagctgcttgttagcagtgagtattgggtgggaggggggcgtgtatgtgcagacatgtggtcacacactacacattgattgccacaagagctatatggagtcacttcgtaacgatcaggtgctccagggcttcagcgtagacaagggagaatttacttgcccactctgcaggcagtttgccaatagtgtccttccctgttatccaggcagcaatgtggaaaacaatccttggcagagaccctctaataagagtatccaggatctcatcaaggaggtcgaagagctccagggccgccccggggccttcccttccgaaaccaatttgtctaaagagatggagtcggtcatgaaggacatcaagaatacaacccaaaaaaagtatcgagactacagtaagacaccagggtcacccgacaacgacttcctgttcatgtacagcgttgcccgcacaaatctagaactggaattgatacaccggggaggaaacctctgttccggcggcgcaagcaccgctggtaagcgctcatgcttgaatttctgcttcattatctttccattcaccaaaagcgagattatcctgtgccagtaccgaaaatcccatgacaaggtgtatcccaagtaccaactcttccatgtgctggcactgcatatgcgactgtactccatagactctgagtacaacccatggagaaaactgactcagcttgaggaaatgaaccctcaactgggttacgaggaacaacaacccgaggtgcccatcttgtaccatgacgtgacgtctctcttgctgatccagattctcatgatgccacagccactgagaaaggaccattttacttgcatagtcaaagtgctgttcaccctcctgtatactcaggctttggccgctttgagtgttaagtgtagcgaggaagatcggagtgcttggaagcatgctggtgctctcaaaaaatctacctgcgatgcagagaaaagctatgaagtgctgcttagctttgttatctctgaactgttcaaaggaaagctataccacgaagagggaacccaggagtgcgctatggtcaacccaatcgcttggagtcccgaaagcatggagaaatgcttacaagatttttgcctgccgtttctcagaatcacttcactgttgcagcaccacctgtttggagaagatctcccctcctgtcaggaagaagaagagttcagcgtactcgcttcctgtctcggattactgcccactttttaccagaccgagcacccttttatcagcgcttcttgcctggactggccagtacctgccttcgatattattacccagtggtgttttgagatcaagtcatttacagagcgtcacgctgagcaaggaaaagccctgctgatccaagagtctaagtggaaactgccacacctgctgcaattgcccgaaaattataacaccatatttcagtactatcacaggaagacatgctctgtgtgtaccaaagtccctaaggatcccgctgtgtgccttgtgtgtggcactttcgtctgcttgaagggtctgtgctgcaagcagcagagctattgcgaatgcgttttgcacagtcagaattgtggcgccggaaccgggatttttcttctgatcaatgcatcggttataatcattatacggggtcaccgattttgcctgtggggcagcgtttacttggacgcgcacggggaagaggacagggatcttaggcgaggcaagcccctttatatttgcaaggagcgctataaggtgttagaacagcagtggatttcgcacaccttcgaccacatcaacaaacggtggggtcctcactataatggattgtag

SEQ ID NO: 139743 - DNA, 1278 bp, Artificial Sequence
  Description of Artificial Sequence: Synthetic coding sequence
atggcgggcgccgagggagctgcaggtcgtcagtcagagctggaacctgtcgtatcacttgtggacgtgttagaggaagacgaagagttggagaacgaagcctgcgctgttctgggcggcagcgattctgaaaagtgctcttatagccagggcagtgtgaaaagacaggctctgtatgcctgttcaacctgcacaccggagggcgaagaacctgccggcatctgcctggcctgttcatacgaatgtcatggcagccataagctattcgagttgtacactaaacgcaattttagatgcgattgcggtaatagtaagttcaagaatttagaatgcaagctgctgcctgacaaggccaaagtcaacagtggaaacaagtacaacgataacttcttcggcctgtactgcatttgtaaaaggccttatcctgaccctgaggacgaaattccagatgagatgatccagtgtgtcgtttgtgaggattggtttcacggaaggcacctgggagccatccctccggaatcaggtgactttcaggaaatggtatgccaggcttgcatgaaacgatgctcattcctgtgggcttacgctgctcagctggcagtaacaaaaatcagcacagaagacgacggcctggtgcggaatatcgacggcatcggagatcaagaggtaataaaaccagaaaacggcgagcatcaggattctacactgaaggaggatgtgccggagcagggcaaagatgatgtgcgcgaagtcaaggtggaacaaaattctgagccctgtgctggcagttcatctgaatccgacctgcaaacagtgtttaagaacgagtccctgaacgccgagagcaagtcgggatgtaaacttcaggagctgaaagctaagcagctgataaaaaaagacacggccacctactggcccttgaactggcgtagcaaactatgcacctgtcaagactgtatgaaaatgtacggggatcttgacgtgctttttctgaccgacgagtatgacacagtccttgcctatgagaataaggggaaaatcgcccaagccacagaccgctcagatcctctcatggacactctgtctagcatgaatcgcgtacagcaggtggaactgatatgcgagtacaatgacctcaagacagaacttaaggactatctgaagcgcttcgcagatgagggaacagtggttaagcgggaggacatccagcagttttttgaggagttccagtcaaaaaagcgcagaagggtagacggcatgcagtattactgcagttag

SEQ ID NO: 139744 - DNA, 1050 bp, Artificial Sequence
  Description of Artificial Sequence: Synthetic coding sequence
atgcgtcgcgctctctcatgggcggctgcaaccccacgatccgctcctacactaaggaactttcggtgcgactgtgggaacagcaaatttaagaatcttgagtgtaaactgttgcctgacaaggcaaaagtgaacagtggtaacaagtataatgataattttttcggcctgtactgtatttgcaagagaccttaccccgacccagaagacgaaattcccgatgagatgatccagtgtgtggtgtgcgaagactggttccacggccgccacttgggtgctatcccccccgagagcggtgacttccaagagatggtgtgccaagcttgtatgaaaagatgttcctttttatgggcatacgccgcgcagctggctgtgaccaagatcagcaccgaggatgacgggctggtaagaaacattgatggtattggggaccaagaggttatcaagccggagaatggggagcatcaggatagtaccctgaaggaggacgttccagaacaaggcaaagatgatgtccgagaagtgaaagtcgagcagaactccgagccatgcgccggatcttcttctgagtcagacctccagacggtgtttaagaacgaatctctgaacgcagagtcgaaaagtggctgcaaactccaggagctgaaggcaaaacagctgatcaagaaggacacagccacatactggccgcttaattggcgctccaagctgtgtacctgtcaggactgcatgaagatgtacggagacctggatgtattgtttttaaccgatgagtacgacaccgtcctcgcgtacgagaacaaaggaaaaatcgctcaggctaccgatagatccgatcctcttatggacacattatccagtatgaatcgagtgcaacaggttgagttgatctgcgagtacaacgatctgaagactgagctcaaggattatcttaagcgtttcgccgatgaaggcaccgtggtaaaacgcgaggacatccagcaattctttgaggagttccagtcaaaaaagagacgtcgagtggatggaatgcagtattattgttcctag

SEQ ID NO: 139745 - DNA, 1083 bp, Artificial Sequence
  Description of Artificial Sequence: Synthetic coding sequence
atgcggagggccctttcctgggcagccgcgaccccacggagcgcccctactctgcgaaactttcgatgcgattgcggaaattctaagttcaagaatttagagtgtaagttgctgcctgataaggcaaaggtgaattccggaaataagtacaacgacaacttctttgggctatactgcatttgtaaaaggccttacccggaccccgaagacgagattcctgacgagatgatccagtgtgtggtttgtgaagattggtttcatggtagacatctcggagctataccacccgaatcgggtgactttcaggaaatggtgtgccaggcatgcatgaaaagatgcagcttcctatgggcctatgcagcccagttagccgtgacgaaaataagtaccgaagacgacgggttggtgcgaaatatagacggcatcggagatcaggaggtgattaagcctgaaaacggagaacatcaagacagcaccctgaaggaagacgtgcccgaacagggtaaggacgatgtgagagaggtcaaggtggaacaaaactctgagccctgcgcgggatcatcttccgagtctgacctgcagaccgtgttcaaaaatgaatccctgaacgccgagtccaaaagcggttgtaaattacaagagcttaaggctaagcagctgatcaaaaaagacacagctacctactggcccctcaactggcgcagtaagctgtgtacctgtcaggactgtatgaaaatgtatggcgatttggacgttctgttccttaccgatgagtatgacacagtgctggcttacgagaataaggggaaaatcgctcaggctaccgacaggagtgatccgctaatggacaccctctctagcatgaaccgcgtccagcaggtcgaactcatctgcgagtataatgatctgaagacagagctgaaagactacctgaagcgtttcgccgacgaagggacagtcgttaaacgggaagatatacagcagttctttgaggaattccagaagaaagaaaaaaagtcgggctgggacgccgtattgctgcaattggaatggagcatgaagctcagccatagctcacagtag

SEQ ID NO: 139746 - DNA, 2121 bp, Artificial Sequence
  Description of Artificial Sequence: Synthetic coding sequence
atggcaagcccagctgacagttgcatccagttcacccgccatgctagcgacgtgttgctcaatctcaataggctgaggtctagggacattttgacggatgtcgtgatcgttgtgagccgggagcagttcagagctcataagactgtgctgatggcatgctcaggactcttttatagcatctttactgaccagctcaagtgcaatctgtccgttatcaatctggacccagagattaaccctgagggattttgcatcctgctggatttcatgtacacgtctaggctgaacctaagggaaggcaatatcatggcagtcatggccactgctatgtatctgcaaatggagcatgtagtggacacgtgtcgcaaatttatcaaggccagtgaagcagagatggtctccgctatcaagcccccacgggaggagtttttaaatagtcgaatgttaatgccgcaggacatcatggcgtaccgaggcagggaagttgtcgaaaacaatctgcctctgcgatctgctcctggctgcgaatctagggctttcgccccatccctctattctggactctcgacaccacccgctagctactctatgtatagccatctccccgtgtcttcactactcttctccgacgaagagttccgcgacgtgagaatgccagtggcgaatccattcccaaaagaaagggccctcccgtgtgattctgcccggcctgtccccggagagtattcacgccctactctggaagtgagcccaaatgtgtgtcattcaaatatatattcccccaaagaaaccattcccgaagaggctaggagcgacatgcactatagcgttgccgagggactcaaacccgccgccccatctgctcgaaatgccccttattttccgtgcgacaaagcctccaaggaagaggagagacctagctcagaggatgagatcgccctgcatttcgagcccccaaacgctcctctgaacagaaaaggcctggtgtcccctcagtcccctcagaaatctgattgtcagcccaatagtccaactgaaagctgctctagtaagaacgcttgcattctgcaagctagtggttctccccccgctaaatctcctacagacccgaaggcatgcaattggaaaaagtataaatttatcgtattaaactcattgaaccagaatgctaagcccgagggccctgagcaggctgagctcggcagactgagcccacgcgcatacacggcccctcctgcttgccaacctcctatggagccggaaaacttggatctgcagagtcccacgaaactctctgcctcaggcgaggattcaactattcctcaggctagtaggttgaataatatcgtgaacagatccatgacgggcagccctcgctcttccagcgagagtcactcaccattatacatgcatccgccgaagtgtacatcttgtgggagccaatccccacaacacgccgagatgtgtttgcacacagccggcccaacctttccagaggagatgggggagactcagtctgagtactcagactcgtcatgtgaaaacggtgcatttttctgtaacgaatgtgactgcaggttcagtgaggaggcctccctgaaacgccataccttgcagacccattctgacaagccctacaaatgcgatcgatgccaggcatccttcaggtacaaaggaaacctggcatcacacaaaactgtgcacactggagaaaagccataccggtgcaatatctgtggagctcagttcaacaggcctgcaaatctcaagacacacaccaggatccactcaggcgagaagccctacaaatgtgagacgtgcggggcacggtttgtccaggtcgcccatctccgcgcccatgtcctcatccacactggggagaaaccctacccctgtgagatctgtggaaccaggttccgccacctgcagactttgaagtctcatttgcggatccacaccggcgaaaaaccataccattgcgagaagtgcaatctccatttcaggcataaatcccagctgcggctgcacttaaggcagaagcacggcgccataactaatacgaaggtgcaatacagagtgtcggccaccgacctcccgcctgaactgcccaaagcctgttag

SEQ ID NO: 139747 - DNA, 2619 bp, Artificial Sequence
  Description of Artificial Sequence: Synthetic coding sequence
atgcgaagtgtgtgtcataggtccggggagccacaatctgacgatatagaagcctctcggatgaagagggcagctgcaaagcatctcatcgagcgttattaccatcagctgactgaggggtgcggcaacgaggcctgcacgaacgagttttgcgctagctgtccgacattcctgagaatggataacaatgctgcggccatcaaggcactggaactgtataagattaacgccaagttgtgcgacccacatcccagcaagaaaggtgccagttcagcatatctggagaattctaagggtgcaccaaacaactcctgttctgaaatcaagatgaacaagaaaggcgctagaatcgatttcaaggacgtgacttacttaactgaggaaaaggtgtatgaaattctcgagttgtgccgcgaaagagaagactattctccgcttattcgggtgatcggaagagtgttctccagcgccgaggcactggtccagtcctttcgaaaagttaaacaacacacaaaggaagaactgaagtctctccaggccaaggatgaagacaaggacgaggacgagaaagagaaggccgcctgctctgcagcggcgatggaggaagattcagaggctagcagctcccgcatcggggactcaagtcagggggacaacaacctgcaaaagctaggacccgacgacgtatctgtggatatcgatgcaattcgtcgggtctatactcgtctgttgtcaaacgaaaagattgagaccgcatttctcaatgcgcttgtgtacctttctcccaatgtcgaatgtgatttgacttatcataacgtgtattcacgtgaccccaattaccttaatctgttcattatcgttatggaaaaccgtaatcttcacagtccagaatacttagagatggccctcccgctgttttgtaaggccatgagcaaactgcctctcgcggctcagggtaagctgattaggctgtggagcaaatacaatgccgaccagatacgcagaatgatggaaacattccagcaacttatcacctacaaagttatctccaatgaattcaattccaggaatctcgtgaatgacgacgacgctatcgtggccgcatctaaatgcctgaaaatggtttattacgccaatgtggtcggcggtgaagttgacacgaatcataatgaagaggacgatgaggagccaatcccagaatcatctgagctgaccctccaggagctgcttggcgaagaacgacggaacaaaaaggggccccgcgtcgaccctttggagactgagctcggagtgaaaactctggattgtaggaagcctttgattccttttgaggagttcataaacgaacctttgaacgaagtgctggagatggacaaagattataccttctttaaggtggagactgaaaacaagttctcatttatgacgtgtccctttattttgaacgctgttaccaaaaacttgggtctatactacgataaccggatccgtatgtacagtgaaagaaggatcaccgtcctgtactcgctggtccagggacagcagcttaacccttatttaaggttaaaagtgagaagagatcatatcattgacgacgccctcgtacgcctggaaatgatcgctatggagaacccagccgatctgaagaagcagctatacgtcgagtttgaaggcgaacagggggtggatgaggggggtgtgagtaaagagttttttcaactggtcgtagaggaaatttttaacccagacataggaatgttcacatacgatgagtctaccaaacttttctggtttaacccctcctcatttgaaactgaggggcagtttactctgatcggaattgtcctaggtctggcaatatataacaattgtatcctggacgtgcactttcctatggtggtctatcgcaaactgatgggaaaaaaagggacatttcgggacttgggggacagtcacccagtactttaccaatctctgaaggaccttttggaatacgaaggaaacgttgaagatgacatgatgattacttttcaaattagtcagacagatctctttggcaaccccatgatgtatgatttgaaagagaatggggacaagatccctattacaaacgagaatcgcaaggagttcgtgaatttatattcagactacatactcaacaagagtgtggagaagcaattcaaggcatttcggagaggcttccatatggtcaccaacgagagccccctgaagtatctttttcgcccagaggagattgaactgctcatttgcgggagccgtaacctggattttcaggcgttggaggaaacaaccgagtacgacggggggtatactcgggatagtgttctgatcagagaattttgggagatcgtccattccttcaccgatgagcaaaaacgactgtttctgcagttcacgaccggaacagatcgagctcccgtggggggcctcggcaagctgaaaatgatcatcgctaagaatggtcctgataccgagcggctgccaaccagtcacacatgttttaacgtgctgttactgccagagtacagttctaaggaaaagttgaaagaaaggttgctcaaggctattacatatgcaaaaggctttggcatgctttag

SEQ ID NO: 139748 - DNA, 2628 bp, Artificial Sequence
  Description of Artificial Sequence: Synthetic coding sequence
atggagaaactgcaccagtgttactggaagagcggagagccccagtctgatgacatagaggcttctcgcatgaagcgggcagccgctaaacatctaatcgagagatactatcatcagctgaccgaaggatgtggcaacgaggcctgcacaaatgagttctgcgcatcctgtcccacattcctgaggatggataataacgccgcagcaattaaggcactagaactgtacaagataaacgccaagctgtgtgacccccacccttcaaagaagggggcatcctcggcttacttggagaactccaagggcgccccaaacaattcatgtagtgagattaagatgaacaagaaaggggctagaatagattttaaagacgtcacctatctaaccgaagagaaagtctatgaaatccttgagctctgtagggaaagagaagattacagtcctctgatccgagtgataggacgtgtcttttcctctgctgaggccttagtgcagtcgtttcggaaggttaaacagcatacaaaggaggagctcaaatcactgcaagccaaagacgaagacaaggatgaggacgagaaagaaaaggccgcctgttccgcagccgccatggaggaggattccgaggcatcctctagcagaattggcgactcctcacagggtgacaataacctacagaagctgggccctgatgacgtgtcagttgatatcgacgcaatccggcgcgtttatacgcggcttctctcgaatgaaaagattgaaacagcttttctcaatgcactagtttatctgagcccaaacgttgagtgtgacctcacctatcacaatgtatacagccgcgaccctaactatttaaatctgtttatcatcgtgatggagaacagaaacttacactcccctgaatacctcgagatggctttaccactcttctgtaaagccatgtcaaaactcccgctcgccgcacagggcaaactgatccgtctctggtctaagtacaacgcagatcaaatccgtcgcatgatggaaacattccaacagctaattacttataaagtgatctctaatgagttcaattcacgtaacctggttaatgacgatgacgccatagtggctgcctctaagtgcctgaaaatggtgtactatgcaaacgtggtcggtggagaagtcgatactaaccataacgaggaggacgacgaggaacctattcctgaaagctccgagctaaccctgcaggagctgcttggtgaggagcgcagaaataagaaaggtccacgggtcgatcccctggagactgaactgggagtgaagacactcgattgccggaagcccctgattcccttcgaggaattcataaatgagcccttgaacgaagttctggagatggacaaggactacaccttttttaaggtggagacagagaacaagttcagtttcatgacatgccctttcattttaaatgctgtcaccaagaacctcggtctttactacgacaataggattcggatgtacagcgagcggagaattaccgtcttgtactccctggtgcaaggccaacagctcaatccatatctccggcttaaagtgcgaagggatcacattattgacgacgctctcgtaaggctggagatgatcgcgatggaaaacccagcagacctgaagaagcaactctacgtagagttcgagggggaacagggggtggatgaagggggtgtctcaaaggagtttttccaactagtcgtggaagaaatctttaacccagatattgggatgtttacttatgatgagtcaaccaaactgttttggttcaacccctcaagtttcgagacggaaggccaatttacactgatcggcatcgtgctggggctggctatttacaacaactgtatccttgatgtgcacttcccaatggtggtgtacaggaaactgatgggcaaaaagggaacatttcgagatcttggggactctcaccccgtgttgtaccagtctctcaaagacctgctcgagtacgagggaaacgtcgaagacgacatgatgattacttttcagatatctcaaacagatttgttcggaaatcctatgatgtatgacctcaaagaaaacggtgacaaaatccccatcaccaatgaaaaccgaaaggagttcgtcaatctgtattccgattacatcctcaataaatccgttgaaaagcagtttaaggcattccgccgcggctttcacatggttaccaacgaatctccgctcaaataccttttcaggcccgaagaaatagagctgctgatttgcggctctcgtaacctcgatttccaggcacttgaggagacaacagagtatgacggcggatatacaagagatagtgtactcatccgcgaattttgggagattgtgcactcttttaccgatgagcagaaacgactgttcttacagttcactaccggtactgaccgagcccctgttggaggattgggcaagctgaagatgattatagccaaaaacggcccagatacagagaggctcccgacatctcacacctgtttcaatgtgcttctgctccccgaatattctagcaaggagaagctgaaggaaaggttactgaaggctattacatacgcaaaaggcttcgggatgctgtag

SEQ ID NO: 139749 - DNA, 2559 bp, Artificial Sequence
  Description of Artificial Sequence: Synthetic coding sequence
atgaagagagctgcggcaaagcatttgatcgaacgatactaccaccagctgactgaggggtgtgggaatgaagcatgtacaaatgaattttgtgctagctgcccaacatttctccggatggacaataatgccgccgcaatcaaggcgttggaactctataaaattaacgccaagctgtgtgatccacacccatctaagaaaggcgcttcatctgcttacctggaaaattccaaaggtgctcctaacaattcttgctctgaaattaaaatgaataagaagggcgctcggatcgactttaaggacgtgacatacctcactgaagaaaaagtatatgagatccttgagctttgcagagaacgggaggactatagcccactcattcgggtaatcgggagggtattctcaagcgccgaagcactggtccagagctttcggaaggtcaagcagcatacaaaggaggagctgaagtctctccaggccaaggacgaggacaaagacgaggatgagaaggagaaagctgcttgcagcgccgcagctatggaagaagacagtgaggcgagctctagcagaatcggcgacagcagtcagggggacaacaacctgcaaaagttagggcccgatgacgttagtgtggacatcgatgccattcgtagagtttatacaagactgcttagcaatgagaaaatagagacagcgttccttaatgctcttgtgtacctgtctcccaatgtcgagtgtgacctaacgtatcacaacgtttactccagggatcctaattacctgaacttattcatcatcgttatggagaacagaaacctgcactcccctgagtacctggagatggccctaccactcttttgtaaagccatgagcaaattaccgctggcagctcaaggaaaactcatccgtttgtggtccaagtacaatgccgatcagatccggcggatgatggagaccttccagcagttgatcacttataaggttatctccaacgaatttaactccaggaacttggtgaacgacgacgacgctatcgtggcagcctccaaatgtctgaaaatggtctactatgctaacgtggtgggtggcgaagtggacacaaatcacaatgaggaagacgatgaagaacccattcctgagagcagcgagctcacgttacaagagctcctgggcgaggagaggcggaataaaaagggccccagagtggaccctttggagacggaattgggagtaaaaactctcgattgtcgaaagccgctaattccctttgaggaattcattaacgagccgctgaacgaagttttagagatggataaagattatacttttttcaaggtggagacagagaacaaattcagctttatgacctgcccctttattttaaacgctgtgactaagaacctgggcttgtattacgacaaccggattcggatgtacagcgagagacgaatcacagtgctttatagccttgtacaaggccagcagctcaacccatacctgaggttgaaagtgcgccgcgaccatattatcgatgatgccttggttaggctggagatgatcgctatggagaatcctgctgatctcaaaaaacaattgtacgtcgaatttgagggcgagcagggcgttgacgaggggggcgtcagcaaggaattctttcagctcgtcgtcgaagagatctttaacccagatattggaatgtttacatacgatgagtctaccaaactgttttggtttaatcctagctcattcgagaccgaagggcagttcaccctcattggtattgtgcttggactggcaatttacaataactgcatcctcgatgtccacttcccgatggtggtgtataggaagctgatggggaaaaaagggaccttccgggacctaggggactcacaccctgtgctataccaaagcctcaaagatttgctggagtacgagggaaacgtggaagatgatatgatgatcacttttcaaatctcccagaccgacttgtttggcaaccctatgatgtatgaccttaaggagaacggagataaaattcctatcaccaacgagaatagaaaagagtttgtgaacctctatagcgattatattctgaataagtcagtagagaagcaatttaaagcttttcgtagggggtttcatatggtcacgaacgagagtccactgaagtatttattcagaccggaagaaatagagttattaatttgtgggtcccgcaatcttgacttccaagcactggaggagacgacagagtatgacggtgggtatacgcgagattcggttctcattagggaattctgggagattgtgcatagctttactgatgagcaaaagaggcttttcctacagttcacgaccggcacagatagggctcctgtgggagggctcggtaaactaaagatgatcatagctaagaatggacctgacacggagcggttacctactagccatacctgtttcaacgtgctgctgctgcctgaatatagcagcaaggaaaaacttaaggaaaggctcctaaaggcgattacctatgccaagggcttcggcatgctgtag

SEQ ID NO: 139750 - DNA, 2559 bp, Artificial Sequence
  Description of Artificial Sequence: Synthetic coding sequence
atgaaacgcgccgccgccaaacatctgattgaaagatattatcaccagctgaccgaaggttgcggaaatgaagcttgtacaaacgagttctgtgcatcatgtcccaccttcttgagaatggacaataatgctgccgctataaaagccttagaactttataagatcaacgctaagctgtgcgacccccatccctcaaagaagggggcgagctcagcctacctggaaaacagcaagggcgcccctaacaatagctgctctgagattaaaatgaataagaagggagcccgcatcgatttcaaggatgtgacatacctaactgaggagaaggtgtacgaaatattggaactgtgccgggaaagggaggattacagccccctgattagggtgataggccgtgtattctccagcgcggaggcactagtccagtcctttcggaaggttaagcagcataccaaagaagagcttaagagtctgcaagcgaaggacgaagacaaagacgaggatgagaaggaaaaggccgcttgttcagctgccgctatggaggaggattccgaggcttcttcctccaggattggcgatagctcccaaggggataacaatttgcagaagctggggccggacgatgtatctgtagatatcgatgcaatccgacgagtttatacacggcttctgtctaacgagaaaatcgagacggcctttttgaacgcgcttgtgtatctgtcaccaaacgtcgaatgcgacttgacctaccataatgtttactctagggatccaaattatctgaacctctttatcattgtgatggaaaaccggaatctccacagccccgagtaccttgagatggcgcttcccttattctgtaaggcaatgtcgaaattgccgcttgcggcccagggtaagctgattcggttatggtctaaatacaacgccgaccagattaggcgcatgatggaaacattccagcagctaatcacctacaaagtgatcagcaacgagttcaacagcagaaacttggtgaacgacgatgatgctatcgtggccgcctccaagtgtctcaaaatggtctactatgctaatgttgtggggggtgaagtggacactaaccacaacgaagaggacgacgaagagcccattcctgagtcctctgagctgacactgcaggagctgctgggtgaggagagaaggaataagaagggaccaagagtggatcccctggagactgaattaggcgttaagacactggattgcagaaagcctcttattccattcgaggagttcatcaatgagccgctcaatgaggttcttgagatggataaggactacactttctttaaggtggagacagaaaataaatttagttttatgacctgcccattcatcctgaatgccgttactaagaacttggggttgtactatgacaataggatcaggatgtactcagagcggagaatcaccgtgctttactctctggttcagggtcagcagttgaatccttatctcaggctgaaagtgaggcgggaccacatcatcgacgatgctctggtgcgacttgagatgatcgctatggagaatccagctgatctgaaaaagcagttatatgttgagtttgagggcgagcagggtgtcgatgagggcggggtgagcaaggagttctttcagcttgttgtcgaggagatattcaatcccgacataggtatgtttacctacgatgagtccacaaaactattctggttcaatccaagctcattcgagactgaggggcaatttacattgataggtatcgtgctcggattggctatctataataattgcatattggacgtacatttcccgatggtggtctacagaaagctcatgggaaaaaaagggacctttagagacctaggagacagtcatccagtactatatcagagcttaaaggacctccttgagtacgagggaaatgtggaagacgacatgatgattactttccagatctcccaaacagacctgtttgggaatccgatgatgtacgatctcaaggagaacggagacaagatccctattactaatgaaaacagaaaagagttcgttaacttatactctgactatatcctgaataagagcgtggaaaaacagtttaaagctttccgcagggggtttcatatggtaaccaacgagtcgcccctgaagtacctattccgcccggaagagattgaactgctgatttgtggctctaggaatctcgacttccaggctcttgaggaaaccaccgaatacgacggtgggtacactcgcgacagcgtgctgatcagggaattctgggagattgtccactcctttactgacgagcagaagcgcctctttctgcagttcactactgggactgaccgggcccccgtaggaggcctgggcaagctgaagatgatcatcgctaaaaatggacccgatactgagaggctcccgaccagccatacctgcttcaacgtcctgctcctccctgagtattccagcaaagagaagctgaaagagcggcttctaaaagctatcacttacgcgaaaggctttggcatgctgtag

SEQ ID NO: 139751 - DNA, 3252 bp, Artificial Sequence
  Description of Artificial Sequence: Synthetic coding sequence
atgttttcgttcgaaggcgactttaagacgaggcccaaggtgagtttgggcggcgctagtaggaaggaggagaaagcgtctctgctccatagaacccaggaagaaaggcggaagcgcgaggaagagcgcagacggctaaagaatgcgataatcatacaaagtttcatccgcggctaccgcgataggaagcagcagtacagcatccaacgcagcgctttcgacagatgcgctacattgtcccagtctgggggcgcctttccaatcgctaacgggccaaacctgaccctgctagtgagacagttgttgttcttctacaaacagaatgaagatagcaagagactgatttggctgtaccagaacctgattaaacattcaagccttttcgtcaaacagttggacggctcggaacgactgacctgcctgtttcagattaaacgtcttatgagcctgtgctgccggcttctgcagaactgtaacgacgatagtctcaatgtagccctacccatgagaatgctggaagttttcagcagcgaaaacacgtatctcccagttttgcaagacgccagctacgtagtttctgttatcgagcagatcctccattatatgatacataacggttattatcgatctctgtacctgctgatcaatagcaagctacccagttccatcgaatactctgacctgtctagggttcccattgcaaagatcctgctagaaaacgtcctcaagcctctgcactttacctacaacagttgcccggaaggagccagacagcaggtattcactgcattcacagaggagtttctagcagcccctttcacagaccagattttccattttatcatacccgcgctggcagacgcacagaccgtgttcccctatgagccgttcctaaacgcccttttacttattgaaagcagatgcagtcggaagtcagggggagccccctggctcttctattttgtgctgactgttggcgagaattacctgggggcattgagcgaagagggattgttggtgtatctgcgggtcctgcagacgttcctgagccagcttcccgtcagtcctgctagtgcctcttgtcacgacagtgcctctgattccgaggaagaatccgaagaagcggacaagcctagctcccccgaggatgggcgtttgtccgttagctacattaccgaagaatgcttgaagaaattggacacaaagcagcaaaccaacacgctcctcaatctcgtctggcgggattccgccagcgaagaggtgtttacgacaatggcctccgtgtgtcacacactcatggtgcaacataggatgatggtcccaaaggtgcgcctgctctatagccttgccttcaatgccaggttcctccgacatctttggttcctcatttcatctatgagcacaaggatgatcaccgggagtatggtccctttgttgcaggtgatttctcgaggatcccctatgtcatttgaggatagctcacgcatcatcccactgttctatttgttctcatcactcttttcccatagcctcattagtattcacgacaatgaattctttggcgaccccatcgaggtggtgggacagcgccagagcagcatgatgccttttaccctcgaagaactcatcatgctctctcgctgtctaagagacgcctgcctcgggatcatcaaactggcctaccctgagaccaagcccgaagtgagagaggagtacatcaccgcgtttcaaagcattggagtcactacctccagcgagatgcagcagtgcatccagatggagcagaagcggtggatccaattatttaaggtcattacaaatctcgtgaagatgttaaagtctcgcgacaccagaagaaacttttgccctcccaatcactggctttcagagcaagaggatatcaaggctgacaaagtaacccagctctatgtgcccgctagccggcatgtgtggagattcagacggatgggacgaatagggcccttacagtccaccctggacgtcggtctcgagtcccctcccctgtctgtcagtgaagagcgccagctggctgtgttgactgagctgccattcgtggtccctttcgaggagagggtgaaaattttccaaaggctcatttacgctgacaagcaggaagtgcagggcgatggaccgttccttgatgggataaacgtgacaattcgtcgaaactatatttacgaagacgcctacgataaactgagcccagagaacgaacccgacctgaagaaaagaatccgagtccacctgctcaacgctcatggactggatgaagcggggattgacggcggcggaatctttcgggagttcctgaacgagttattgaagagtggtttcaaccctaaccaaggtttctttaagacgaccaatgagggactgttgtatcccaatccagccgcacagatgttggtgggagatagttttgcacgtcattattactttcttgggcgcatgttagggaaggccctgtatgaaaacatgctggtcgaattgccgtttgcaggctttttcctgagcaaattgctggggacctctgccgacgttgacatacaccacttagcaagcttggacccagaagtgtataagaacttactcttcctcaaatcctatgaagacgacgttgaagagttgggcctgaatttcaccgtggtcaacaatgacctgggggaggcccaggtcgtggaactgaagttcggtggtaaggatattccggtcactagcgcaaacaggatcgcatacatccacctcgttgcagattaccgtctgaaccgccaaatacgccaacactgtcttgccttcaggcagggcctggctaatgtggtaagtctggaatggctccggatgtttgatcagcaagagattcaggtactgattagcggagcacaagtgcccatctccctggaagatcttaagagttttacaaattatagcggtggctacagcgccgatcaccccgtgataaaagtgttctggcgagtggtcgagggttttactgacgaggagaagcgaaaactcttaaaatttgtcacttcctgctccagaccacctctgctggggttcaaggagctatatcctgcgttttgcatccacaatggaggatctgatctggagagattgcccacagcaagcacatgtatgaatctgctgaaactgccagagttctatgacgaaacactattacgtagcaaactgctgtatgccatagagtgcgccgctggcttcgaactgtcctag

SEQ ID NO: 139752 - DNA, 1215 bp, Artificial Sequence
  Description of Artificial Sequence: Synthetic coding sequence
atgttctcgttcgagggagactttaagacaagaccgaaggttagcctcggcggggcttcccgaaaatattcgatacagcggagtgcctttgaccgatgcgctacgctctcccagtctggaggagcctttccaatcgctaacggccctaacttgaccttactcgttcgacagctactgttcttttataagcagaacgaggattcaaagcggctgatctggctgtatcagaacctcatcaagcatagtagcctgtttgtaaaacaattggacggcagtgagcgcctgacttgccttttccagattaaacgcctaatgagtctgtgttgccgtctactccaaaactgtaatgacgattcgttgaacgtggcgcttccaatgcgtatgctcgaggtcttttccagcgagaacacttatttgcctgtgctgcaagatgcaagttatgtggtctctgttatcgagcagatcctgcactacatgatacataacggttactaccgcagcttgtacttgctgattaattcaaagctgcccagcagcattgagtacagcgatctgtcccgcgtgcccatcgccaagattttgcttgagaatgtgttgaagccccttcacttcacatataacagttgtccagagggcgccagacaacaggttttcaccgccttcactgaggagtttttggccgccccattcaccgatcaaattttccatttcatcatcccagcgctggcagacgctcagactgtttttccttatgagcccttcctgaatgccctgctcctaatcgaatctaggtgttctaggaagtccggcggagccccctggctgttctattttgtgctgacagtgggggaaaattacctcggggcgctctcggaggaggggttattggtgtacctcagagtcctgcagacgtttttgtcccaactcccggtgtcacccgcatccgcatcttgtcacgatagcgcgagcgactcagaagaagagtcggaagaagcggacaaaccctcatccccagaggacggtcggctgagcgtcagctatataacagaagaatgcctcaagaagttggataccaagcagcaaactaacaccctcctaaacctagtgtggcgcgatagtgcctctgaggaagtgtttaccacaatggctagcgtgtgccacactctgatggtacagcacagaatgatggtgcccaaggtgagggtgtacaagtag

SEQ ID NO: 139753 - DNA, 192 bp, Artificial Sequence
  Description of Artificial Sequence: Synthetic coding sequence
atggctgctcccttaagcgtcgaagtggagttcgggagctcccctggatgcctattcctgtggagctcattcgcagaggtagtgagatccagctgcctcaccgtgctccgcaatatcgaaagcttatgcttggatagacgaaatccaggtacttcagggacatgcagctccgggtcacggcgaatctgttag

SEQ ID NO: 139754 - DNA, 192 bp, Artificial Sequence
  Description of Artificial Sequence: Synthetic coding sequence
atggcagccccgcttagcgtggaggtggagtttggtggaggagctgaattattgttcgatggcattaaaaagcaccgtgtcaccctgcccgggcaggaagaaccgtgggatataaggaacctgctgatttggatcaagaaaaacctgttgaaggaaagacctgaactgtttattcagggagacagcgtgtag

SEQ ID NO: 139755 - DNA, 306 bp, Artificial Sequence
  Description of Artificial Sequence: Synthetic coding sequence
atggctgcccccctaagcgtcgaggtggagtttggagggggggcggaattattgttcgatggtatcaagaaacaccgcgtaaccctccctgggcaagaggagccatgggacattaggaatcttcttatatggatcaagaagaacctgttgaaagagaggccggaactattcatccagggcgactctgttcggcctgggatcctcgttctcattaatgatgccgactgggaactgctgggcgagctggattaccaactacaagaccaggacagcgtcctgttcatcagtacactgcacggggggtag

SEQ ID NO: 139756 - DNA, 441 bp, Artificial Sequence
  Description of Artificial Sequence: Synthetic coding sequence
atggccgccccgctgtctgtggaggtggaattcggtggaggcgcagagctgctgttcgacggaatcaaaaaacacagagtgacattacccggtcaggaggaaccttgggacatcaggaaccttttaatctggattaagaaaaacctgctcaaagaacggccggagctcttcatccagggcgactctgtccggccaggcattctcgttctcataaatgatgccgactgggagctgctcgtgtctactctgggggacatccccccccctgcccccgctctcgcggcctcagtcggaaagaggtgggcatccccccaggcacatatagagtggctgggaaacccacctcctcacagcagcccaaccctgagattgcttgaatctcctacacccggcgaggagggaatggggagctgggggcatggctccacacctcctagctag

SEQ ID NO: 139757 - DNA, 2358 bp, Artificial Sequence
  Description of Artificial Sequence: Synthetic coding sequence
atgcccggcgtcattccttcagaatcaaacgggctgtcgcggggctctccctccaagaaaaatcgtctgtccttgaagttctttcagaaaaaggagacgaaacgggcgctcgacttcacagacagccaggaaaacgaagagaaggcaagcgaatatcgtgcaagcgagatagaccaagtcgtgccggctgctcagtcaagccctattaattgcgagaagagagaaaacctccttccctttgtaggtctcaataacctgggaaatacctgctacctgaactcaatcctgcaggttctgtacttctgcccaggctttaagtccggtgttaagcacttgtttaacatcatttctcggaagaaggaagcactgaaggatgaagccaaccagaaggacaagggaaactgcaaagaggactccttggcaagctatgagttgatttgtagccttcagagcctcataatctccgtggaacaacttcaggcaagtttcttactgaatccagagaaatacaccgatgaactcgccactcagcccagacgtctcttaaacaccctgcgggaactcaatcccatgtacgagggctatctgcagcacgacgctcaagaggtcttacagtgtatattgggtaacatccaggagacttgccagcttctgaagaaggaagaagtaaaaaacgtggccgaattgccgaccaaggttgaggaaataccgcatccaaaggaggagatgaacggaattaactctatcgaaatggactctatgcgtcacagcgaagacttcaaggagaaactcccaaagggtaacgggaaacggaaaagtgatacagagttcggtaacatgaaaaaaaaggtgaaactgtctaaggaacaccagtctctggaggagaatcagaggcagacgcgttctaagagaaaggccacctctgacactctggagtcgcctcctaagatcatcccaaagtatatctcagaaaacgagtccccgagaccctcacaaaaaaaatcaagggtgaaaataaattggttgaaatctgctacaaagcagccctccatcctgagcaagttctgcagtcttggtaagatcacaaccaaccagggagtgaaaggccagtccaaagagaatgaatgtgatcccgaagaggatctgggaaagtgtgagtctgataacaccaccaatggctgcggcctagagtctcctggaaatacagtgacgccagttaacgtgaatgaagtcaagcccatcaacaagggcgaggaacaaatcggcttcgagctggtcgagaagctctttcagggacagttagtccttcggaccagatgcctggagtgcgagtcccttaccgagcgccgcgaagattttcaagacatttctgtccctgtccaggaggatgagctgtctaaggtagaggagtccagcgaaatctctccggaacccaaaactgaaatgaaaactctgcgctgggcaatttctcagtttgcatcggtcgagaggattgtcggcgaagataaatatttttgcgagaattgccaccattacaccgaggccgaacgctctcttctctttgacaagatgccggaagtgattacaatacacctgaagtgttttgctgcatctggactggagtttgactgttatggggggggactttctaagattaatacccctctactcacacctctcaagctgtctctagaggagtggagtaccaagccaacgaatgactcatatgggttgttcgcagttgtgatgcatagtgggatcaccatttctagcggccactacacagcttctgtgaaggtgaccgatttgaattccctggagctggacaaggggaattttgtggtggaccagatgtgtgaaatcggtaagccggagcccttgaatgaggaggaggcgaggggagtagtcgagaattataatgatgaagaggtgagtattcgagtaggaggtaacacacagccatccaaggtgttgaacaagaaaaacgtagaggccataggcctgctgggtggccagaaatccaaggccgattatgagctgtacaacaaagccagcaaccccgacaaggttgcatcaacggcatttgcagagaaccgcaactccgaaaccagtgacacaacaggcacccacgaatctgaccgcaacaaggaatctagcgaccaaaccggtattaatattagcggcttcgaaaataaaatcagttacgtggtccagtccttaaaggaatatgaaggcaaatggctgctgttcgatgactcggaggtaaaagtgaccgaggagaaggattttttgaacagcctcagtccctcaacctctcccacgtcgacgccctatctgctcttctataagaaactgtag

SEQ ID NO: 139758 - DNA, 2358 bp, Artificial Sequence
  Description of Artificial Sequence: Synthetic coding sequence
atgccgggagttatcccatccgagagcaatggactgtcccgcgggagtcctagcaagaaaaaccgcctcagcctgaaattctttcagaagaaggaaactaagagggccctggactttaccgattctcaggaaaatgaggagaaggctagtgaatatcgcgcttccgagattgaccaggtggtccctgcggctcagtcaagccctataaactgtgagaagagggaaaatttgcttcccttcgtcggccttaacaacttggggaacacttgttatctgaattccattttacaggtgctgtacttttgccccggctttaagagcggagtgaaacacctgtttaatattattagccggaagaaggaagcccttaaggatgaggccaaccagaaggacaagggcaactgtaaagaagacagcctggcctcttatgaattgatttgttcactgcagtcccttatcatttccgtagagcaattgcaagcatcattcttactcaacccagagaagtacaccgacgaactggccactcaacctcgacgccttttgaacaccctgcgggaactgaacccaatgtacgaaggctacctccaacatgatgcccaggaggtcctgcagtgtatcctaggtaacatccaagagacttgccagctgcttaagaaggaagaggtcaagaatgtggccgaactgcctaccaaggttgaagagatcccccatccaaaagaggagatgaacggtatcaacagcattgagatggactcaatgcggcactccgaagattttaaggagaagctaccaaagggcaatggcaagcgtaaatcggacactgagttcggcaacatgaagaaaaaggtgaagcttagcaaagagcatcagtctctggaagagaaccaacggcagacacgctccaagcgcaaggcaacctcagatactctggagtcgcccccaaagattatcccaaagtatatcagcgagaatgagtccccccgaccctcccagaaaaaaagcagagtaaagatcaactggttgaaaagtgcgaccaaacagccttccatactatctaagttttgctccctgggaaagataacaaccaaccaaggtgtgaaggggcagagcaaagagaacgaatgcgaccctgaggaggatttggggaaatgtgagtctgataataccaccaacgggtgcggtttagagagtccaggtaacacagttactccagtcaacgtgaacgaagtgaagcccatcaacaagggtgaggaacaaatcggattcgagctcgtcgaaaagctcttccagggtcagctcgtgcttagaacaaggtgcctggagtgtgaatctctgacagagcggcgcgaagacttccaggacatcagtgtcccagtccaggaggacgaactgtcaaaggtggaagaatcctccgagatctctcctgaacctaagactgagatgaaaactctgagatgggcaataagtcaatttgcttctgtggagcgtattgtcggagaggataaatatttctgtgaaaactgtcatcactatacggaagcagagcgtagtctcctttttgataagatgccggaggtaataaccattcacctgaagtgttttgcagcctcgggccttgaattcgactgctacggcggcggactctcaaaaatcaatacgccactcctgactccactcaaactcagcctggaagagtggtcaaccaaaccaactaatgattcgtacggtctgttcgccgtcgtcatgcattcagggatcaccatctctagtggtcattacacggcaagcgtgaaagtcacagatttgaattcactcgagcttgataaggggaactttgtggtggaccagatgtgtgaaattggcaaacccgaacctctgaacgaggaagaggcccgaggtgtggttgagaactacaacgacgaggaagtgtctattagagtcggcggcaacacacaaccttctaaagtgctgaataagaagaatgttgaggctattgggctgcttggcggccagaagtcgaaggctgactacgagctctataataaggcctcaaatcctgacaaggtggcaagtactgctttcgctgagaacagaaactcagaaacctccgacacgacaggtacacatgaatccgacagaaacaaagagtcgtccgatcagacgggaattaatataagtggtttcgaaaacaaaatctcttacgtggttcagagcttgaaagagtatgaggggaaatggctcctgttcgacgacagcgaagtaaaggtcactgaggagaaagactttctcaattctttatccccttcaacgtctccaacatctactccctatttactgttttataaaaagctctag

SEQ ID NO: 139759 - DNA, 264 bp, Artificial Sequence
  Description of Artificial Sequence: Synthetic coding sequence
atgccaggagtcattcctagtgagtctaatggactctccaggggatccccctcgaagaagaatcggctgtccctgaaattcttccaaaagaaagagactaagcgtgctctcgattttactgattcccaggagaatgaagaaaaagcaagtgagtacagagcttccgaaatcgaccaggtggtgcccgccgcccagagttcccccataaattgcgagaaaagggagaatcttttacctttcgtggggttaaacaacttgggttag

SEQ ID NO: 139760 - DNA, 561 bp, Artificial Sequence
  Description of Artificial Sequence: Synthetic coding sequence
atgcctggtgttattccttcagaatcgaatgggcttagtcgcggttccccctcaaagaagaatcggctcagtctgaagttttttcagaagaaagaaacaaaaagggccctggacttcacagattctcaggaaaacgaagagaaggcaagcgagtaccgggcttcagaaattgatcaagtcgtgccagccgcccagtcctcacccatcaattgtgagaagcgggaaaacttactgccgtttgtgggtttgaataatttaggaaatacttgctaccttaattctattttacaggtactgtatttctgcccaggatttaaatccggcgtgaagcacctgtttaatattatctctcggaagaaagaggccctgaaagacgaagcaaatcagaaagataagggcaactgtaaagaagatagccttgcttcatacgaattgatctgcagcctccagagtctgattatctcggttgagcagctccaggccagtttcttgcttaatcccgaaaaatatactgacgagctggccacccagccacgacggcttttgaacacactgagatag

SEQ ID NO: 139761 - DNA, 663 bp, Artificial Sequence
  Description of Artificial Sequence: Synthetic coding sequence
atgcccctgacaggcgttggccccggctcttgtcgacgccaaattatacgcgcgctgtgcctcttgctgctgctgttgcacgctggttctgccaaaaacatctggaaaagggcgctgccagcccgtctggccgaaaaaagccgtgcagaggaggccggagccccaggcggccctcggcagccccgcgcagaccggtgtccccccccaccgagaacactgccccccggggcatgtcaggccgctaggtgtcaggcagactccgagtgtccccgccaccgaaggtgctgctataacggatgcgcctatgcatgcctcgaggctgttccaccaccccctgtgttggactggttagttcagcccaagccaaggtggctaggaggcaacgggtggctgctcgatggtcccgaagaagtactccaggctgaggcctgcagtaccactgaggacggtgccgagcctttactgtgtcccagtggatacgagtgtcacattctaagccccggagacgtggctgagggcattccaaaccggggccagtgtgtgaagcagcggcgccaggcagacgggaggatcctcagacataagttgtacaaggagtaccccgagggagacagtaaaaatgtcgcagagcccggtcgcggccagcagaaacacttccaatag

SEQ ID NO: 139762 - DNA, 687 bp, Artificial Sequence
  Description of Artificial Sequence: Synthetic coding sequence
atgtaccatttgatgaagtttatccctctctactcgaaggtgcagcgtccctgcactagcacaccaatgattgactcctttgtgagactgatgaacgagtttaccaacatgccggtcccacctaaaccacggcaggctttgggcgacaagatcgtgcgggatattcgtccaggggccgcgttcgaacccacatatatttatcgactattgacagtgaacaagtcctccctgagcgagaaagggaggcaggaagacgccgaggagtacttgggctttattcttaacggactccacgaagagatgctgaacctgaagaagctcttgtcgccctccaatgagaagcttaccatctcaaatggccccaagaatcactctgttaatgaggaggaacaggaggagcagggtgaaggcagcgaggatgaatgggagcaggtaggtccacgtaataaaacaagcgtgaccagacaagctgatttcgtgcagacccctatcaccggattttggtggacacaccaggtgtgcggactgccagcagaatttaaaagaatatgtcattttgccgctatttttcacgtagcagttgggtacccggtgcgccaggacactcactctcccgggtgcaccggagagctgggaggtaaacgtatttgccctagactgtatcacaagaatcagaccagagggtag

SEQ ID NO: 139763 - DNA, 189 bp, Artificial Sequence
  Description of Artificial Sequence: Synthetic coding sequence
atggcactgcactccccccagtacatctttggcgacttttctccggatgaatttaaccaattctttgtgactccgcggtcttctgtcgaagataaaaacattcgagaattgagcctggtgagtatgaaaagcctgaatcccgtaaccctgtgccgcgagcccccggcaactgtgtttcaggcccattag

SEQ ID NO: 139764 - DNA, 2472 bp, Artificial Sequence
  Description of Artificial Sequence: Synthetic coding sequence
atgaaacggcatagaccggtatcaagttccgactcgtccgatgagtccccaagcaccagtttcacctccgggtccatgtataggatcaaatcgaagatcccaaatgagcataaaaagccagccgaggtttttcggaaagatctcatttccgccatgaagctgccagactcacatcacattaatccagattcatactacctgttcgctgatacatggaaagaagagtgggaaaagggggttcaggttcctgcctcccccgacactgtgccacagccgagtctgcggattatcgccgagaaggtcaaagacgttttattcatccgaccccgcaagtatattcactgtagtagcccggacaccacagagcccggctatatcaatatcatggagctggctgccagcgtttgtcgatatgacctggatgacatggatatcttctggctgcaggaactgaacgaagatctggccgagatgggctgcggaccagttgacgagaacctgatggaaaaaaccgttgaggtgttggagcgccactgccatgaaaacatgaatcacgctatcgagaccgaagaaggcctggggatcgagtacgatgaagatgtaatctgtgatgtgtgcaggtcaccagacagtgaagaggggaatgacatggtcttctgtgacaaatgcaatgtatgtgtccaccaagcgtgctatggtatcctgaaggttcctgaagggtcctggctctgtcgaagctgtgtgctgggtatctacccccagtgtgtcctctgcccaaagaagggtggggccttaaagaccaccaagacgggaaccaagtgggctcatgtgtcttgcgccctatggatcccagaggtgtctatagcatgcccagaacgcatggaacccattactaagatcagtcacatccctccaagccgctgggccctggtgtgtaatctttgcaaactgaagacgggagcatgcatacagtgctctatcaaatcttgtattacggcattccacgttacctgtgcttttgaacatggattagagatgaagactatactggatgagggggacgaggtaaagttcaaaagctattgcctcaaacactcccagaaccgtcagaagctgggagaggccgaatacccgcatcatcgcgcaaaagaacagtcacaggccaaatctgagaagacttcactgcgcgctcaaaagctccgcgagttagaagaagaattttacagtctggtgcgcgtggaggacgtggcggctgagcttgggatgcccaccctcgcggtggacttcatttataactactggaaactgaaacggaaatccaatttcaataaacccctcttcccgccgaaggaagacgaagaaaacggactagtgcaaccgaaggaggaatccattcacacacgtatgcgcatgttcatgcatctgcggcaagatctggagcgcgtgcgcaacctctgctacatgatatctaggcgcgagaaactaaaactcagtcacaacaagatccaagagcagatcttcgggctgcaggtgcagcttctgaaccaggaaattgacgcaggactgcctctcaccaatgctctcgaaaattctctcttttacccaccaccaagaattactctgaagctgaagatgcccaagtcgacgcctgaggatcaccggaattcctccaccgagacagatcagcagccgcacagtcctgactctagcagttctgttcactcaattagaaacatgcaggtcccccaagaatctctggagatgcgcaccaaatcctacccccgctatcctttggaaagcaagaacaaccgtctgcttgccagcttaagccactccaggtcggaagccaaagagtcctcacctgcgtggcgaaccccttccagcgaatgttatcacgggcagtcccttgggaaacctctggtcctgcaggcagccctccacgggcagtcatctatcggaaatggtaagagccagcccaattctaagttcgccaagtcaaacggcctggaagggtcatggagtgggaatgttacccaaaaagattcaagtagcgaaatgttttgtgaccaggaacccgttttctcgccccacctggtctcccagggaagctttcgtaagagtaccgtggaacatttctctagatcctttaaagagaccaccaatagatgggtgaagaatacggaggacctgcaatgttatgtgaagcctactaagaatatgtcacccaaagaacaattctggggccgccaggtccttaggcgcagcgcaggaagagcgccctatcaggaaaatgacggctactgtcctgacctggagctcagcgacagtgaggctgagtctgacgggaacaaagaaaaagtacgggtgcgcaaggatagcagcgatcgtgagaatccaccgcacgattctcgcagggactgccacggtaagtccaaaacacaccctttaagtcattcttcaatgcagagatag

SEQ ID NO: 139765 - DNA, 2763 bp, Artificial Sequence
  Description of Artificial Sequence: Synthetic coding sequence
atggctaccgtggccgcaaaccccgctgcagccgccgcagctgtggcagcagccgctgcagtcactgaggaccgtgagccgcaacacgaggagctgcccgggctcgatagtcagtggagacaaatcgagaatggggaaagcggccgggaaaggcctttgcgtgccggagagtcatggtttcttgtcgagaagcactggtacaagcagtgggaggcctacgtgcaggggggtgaccaggactcaagcaccttccccgggtgcatcaataacgccactttattccaggacgaaatcaactggaggctgaaagagggtttggtggaaggcgaggactacgtgctgttacccgctgctgcgtggcattaccttgtgtcatggtatggactggagcacggacagcctccaatcgagcggaaggtaatcgaacttccaaatatccagaaagtggaagtgtaccccgtggagctgctactcgtccgccacaatgacctcgggaagagccatacagtccagttctcacatacagactcaatcgggctcgttctgagaacagcccgagagcgatttttggtcgagcctcaggaggatacccggctgtgggcaaaaaacagcgaagggtccctcgataggctctatgatacgcacattactgttctggacgctgcgctcgaaactggccaactgatcattatggagacaaggaagaaagatggcacttggccatctgcccagctgcatgtaatgaacaataacatgtctgaggaagacgaagactttaagggccaacccggaatttgcggcctaacaaacctggggaatacttgcttcatgaactcagccctgcagtgtctatctaatgtgccccagctgacggagtatttcctaaacaattgttacctcgaggagctgaacttcagaaaccccctgggaatgaagggagaaatagccgaagcctatgcagacctggtcaaacaggcctggtctggccaccaccgctcaatcgtgcctcacgtctttaagaataaggtcggacactttgcctctcagtttctcggctaccagcagcacgatagtcaggagttgctgtcatttcttcttgacggcttgcacgaggatttgaatagagttaaaaagaaggaatacgtggagttatgtgatgcagctggaagacctgatcaggaggtggcccaggaggcctggcagaaccataagcgacgcaacgactcggtgatagtcgacacatttcacggactgttcaagtcaaccctcgtatgtcctgattgcggaaacgtctccgtcactttcgaccccttttgctatttaagcgtccctttgccgatttctcataagcgcgttctagaagtttttttcatcccgatggacccacgcagaaagcctgagcagcatcggcttgtggtgcctaaaaaaggaaagatttcagatctgtgtgtggctttgagcaagcacacagggatcagccccgagagaatgatggtcgcagatgtgtttagtcaccggttttacaagctttaccagctggaggagccgctgtcgagcattctcgaccgggatgacatctttgtgtatgaagtgtctgggcgcatagaggctattgagggttctcgcgaagatatcgtggttcctgtctatctacgggagcgtaccccggcgcgggattataacaatagctactatggccttatgttgttcggccaccccctgctcgtgagcgtgccgagggaccgatttacctgggaaggattgtacaatgtgctgatgtaccgattgtctaggtatgtgactaagcctaactctgatgacgaggacgatggtgacgagaaagaggacgacgaagaagacaaggacgatgtgccgggcccttcaactggaggctctctgcgggatcctgaacctgaacaggctggaccaagttcaggcgtgactaaccgctgccctttcttgctggacaactgcctcggcacgtctcagtggcctcctagaagacggaggaagcagttgtttaccctacaaacagttaacagcaacggcacgtccgatcgaacgacgagtcctgaggaagtgcacgctcagccttacattgccatcgattgggagcccgagatgaagaagcgatactatgatgaggtcgaagccgagggttatgtgaaacatgactgtgtgggttacgtcatgaaaaaggccccagttaggcttcaggagtgcatcgaactctttaccacagtcgagactctggagaaggagaacccatggtactgcccctcgtgtaagcagcatcaactggctactaagaagctcgacctgtggatgctgccggagattctgatcatccatctgaagcgtttcagttataccaagttttcccgcgagaagctggatacactagtagagttccccatcagggacttagatttcagcgagtttgtcatccaacctcagaacgaaagcaatcctgagctgtataaatatgatctcatagctgtctccaaccactacgggggcatgcgggacgggcactataccaccttcgcttgcaacaaggattccgggcagtggcactacttcgacgacaactctgtgtccccggtgaacgaaaaccagatcgaaagcaaggccgcgtatgttctgttttaccagcgccaagatgttgcccggcgtctgctctcacccgcaggcagcagtggagctcctgcctcccctgcgtgttcctcccccccatcctccgagtttatggacgttaactag

SEQ ID NO: 139766 - DNA, 1113 bp, Artificial Sequence
  Description of Artificial Sequence: Synthetic coding sequence
atggagatcctcatgacagtctcaaaatttgccagcatttgtaccatgggcgctaacgcctccgcgctcgaaaaagagattggtcctgaacagtttccggttaacgagcactatttcggcctggtaaacttcggaaatacttgctactgtaatagcgtcctccaggccctttacttctgccgaccattcagagaaaaagttttagcctacaagagccagcctaggaagaaggagtctctcctcacttgtctggcggacttgtttcactctattgccacgcagaagaagaaggtcggagtcatacctccaaagaagttcatcacccgactacgaaaagagaacgaattgttcgataattacatgcagcaggacgctcacgaatttctcaattatttgctcaatactatagctgacatcctccaggaggaaagaaagcaagaaaaacagaacggacgactgccaaatggtaacatcgacaacgaaaacaacaatagcaccccagatcctacttgggtacatgaaatatttcaggggacgctgacaaatgaaacgcgatgtttaacgtgcgaaaccatctccagcaaagacgaggactttctagatctttccgttgacgttgagcaaaacacctccatcacacactgccttagggggttcagtaacaccgaaactctttgttcagagtataaatactattgcgaagagtgccgttccaaacaggaggcgcataaacggatgaaggtaaagaagctccctatgatcctcgccttacatctgaaaagatttaaatacatggaccagctccacagatacaccaagttaagctatagagtagtgttcccattagagctacggctgtttaatacctccggggacgcaacgaacccggaccgaatgtatgatcttgtcgccgtggtggtccactgtggctccggccccaataggggacactatatagccatcgtgaaatcccacgatttctggctgctgtttgacgatgatatcgtcgagaagatcgacgctcaagctattgaggagttctatggattgactagcgacatttccaagaactctgagtccggctacattctgttctatcagtctcgagattag

SEQ ID NO: 139767 - DNA, 2592 bp, Artificial Sequence
  Description of Artificial Sequence: Synthetic coding sequence
atgcagaggcgtggagcactgttcggaatgcctgggggcagcgggggccgcaaaatggcggcgggggatatcggggaacttttagtgccacacatgccaaccattcgtgtacccagatccggtgatcgggtgtataagaatgagtgcgctttttcctatgattcgcccaactctgaaggaggcctgtacgtgtgcatgaacaccttcctggcctttggacgtgagcacgtcgaaaggcacttccggaagacgggccaaagtgtctatatgcacctcaagaggcacgtacgtgaaaaggtgcggggtgcaagcgggggcgccctgccaaagcggcgaaattcgaagatcttcctggatctggatactgacgatgatcttaactccgacgactacgagtatgaggatgaggccaaactggtcatattcccagatcactacgagatcgcacttcctaacatcgaggaactgcctgcacttgttacgatcgcttgtgatgccgtactgagctctaagagtccctacaggaagcaggatcctgatacatgggaaaacgagttgccagtctccaaatacgccaataacttaacccagctggataacggagtgagaatccctcctagcggctggaagtgcgcgcgctgtgacctgcgcgagaacctctggcttaatttaactgacgggtccgtgctttgcggcaagtggttcttcgactcttccgggggaaatggacacgcactcgaacactatcgagatatggggtatcctctggctgtgaagttgggaactattacgccagacggggcggacgtgtacagtttccaggaggaagagccagtattggacccccacttggctaagcatctcgcacactttggcatcgacatgcttcacatgcacggtaccgagaatgggctccaggacaacgacatcaagttacgcgtgagtgaatgggaagtaatccaggagagcggcaccaaactgaagccaatgtacggacccggctatactgggttgaaaaacctcgggaattcctgttacctctccagtgtcatgcaagcaatattttctatccccgaattccagagagcctacgtgggcaacctacctagaatctttgactactcccccctggacccaactcaagacttcaacactcagatgactaaacttggccatggcttgctcagtggacagtattcgaaacccccagtcaaaagcgagctgattgagcaggtgatgaaagaggagcacaaacctcagcaaaatggaatcagtcctcggatgttcaaggcttttgtgtcaaaatctcatcccgaatttagttccaacagacagcaggatgcccaggaattcttcttacatctggtgaaccttgtggagaggaataggatcggaagcgagaatccaagtgacgttttcaggttcttggtggaggaacggatacaatgctgtcagacccggaaagtgcgctacacagaacgggtagactatcttatgcagttgcctgttgctatggaagctgccacgaataaggacgagttgattgcttacgagctgacgcggcgggaggccgaggctaacagacgcccactgcctgagctggttagggctaagattccatttagtgcctgtctgcaggctttcagtgaacccgaaaacgtggatgacttttggtcttccgctctccaggccaaatccgcaggcgtgaagacgagtagatttgcctctttccctgaatacctcgtcgtgcagatcaaaaaattcacattcggcctggattgggtcccgaagaagttcgatgtgagtatcgacatgcctgaccttctggacatcaaccatttgcgcgccaggggattacagccaggagaggaagaactccccgatatttctccccccattgtaatacctgatgatagtaaagaccgacttatgaaccagctcattgaccccagcgacattgacgaatcaagcgttatgcagctggccgagatgggcttccccctggaagcatgtaggaaggcagtgtactttaccgggaacatgggtgcggaggtggcatttaactggattatcgtgcatatggaggagcccgatttcgcggagcccctcacgatgcctgggtatggcggcgcggccagcgccggcgcatctgtcttcggcgcgagtggcttggataatcaaccaccagaagaaattgtggccatcattactagcatgggctttcagcggaaccaagccattcaggctctccgggccactaataataatctggaaagggccctggactggatcttctctcaccctgagtttgaagaggacagcgacttcgtgattgaaatggaaaacaatgcaaatgcaaacatcatctccgaggcaaaacctgaaggacctcgcgtaaaagatggatcagggacctatgaactctttgcatttatttctcatatgggcactagcacaatgtcaggccattacatatgccatatcaagaaagagggaaggtgggttatttacaatgaccacaaggtttgtgccagcgaaagaccccccaaggatctgggctatatgtacttctatcgcagaattccctcctag

SEQ ID NO: 139768 - DNA, 1485 bp, Artificial Sequence
  Description of Artificial Sequence: Synthetic coding sequence
atgcccctgtactctgtaacagtgaagtggggtaaagaaaagtttgagggcgtcgagttgaacacggacgaaccacctatggtgttcaaggcacaactttttgcgttaaccggggtgcagcctgctagacagaaagtgatggtgaagggtggcaccctaaaagacgatgactggggaaatatcaagatcaagaacggaatgaccctgttgatgatgggatccgccgatgccctacctgaggagccttcggctaaaacggtcttcgtagaggatatgacagaggagcagctcgcctcagcaatggagctcccttgcggcctcactaatctggggaatacttgttatatgaacgcaaccgtgcaatgtatacggagcgtgcctgagctcaaagatgctctaaaacgatacgctggcgcccttagagcctcaggggaaatggcaagcgcacagtacatcacagcagcactgagggatttgtttgattccatggacaagacatcctcttctattcccccaatcatcctcctccaatttctgcatatggcttttcctcagtttgctgagaagggcgaacagggccagtacctccagcaagacgccaacgagtgctggatacagatgatgagagtcctgcaacagaagctagaggcaatcgaggacgattccgtaaaagaaacggattccagttccgcttctgccgctacaccttctaagaaaaaaagcctgattgaccagttctttggagtggaattcgagacaaccatgaagtgtaccgagtctgaggaggaggaagttacgaaaggcaaagaaaaccagctgcagctgtcttgcttcatcaatcaggaggtgaagtacctgttcacaggtctcaagctccgcttgcaggaagagatcaccaagcaaagccctaccctgcagcggaatgctctgtatattaagtctagcaaaatctcacgacttcctgcgtatctgacaatacaaatggttcggttcttttacaaagaaaaagaaagtgtaaatgctaaggtcctgaaagacgttaaatttcccctgatgttagacatgtatgagctgtgcactcccgaactgcaggaaaagatggttagctttagatccaagtttaaagatctagaggacaagaaggtgaaccagcagccaaacacttccgataagaagtcctcaccacagaaggaggtaaaatacgagccttttagcttcgccgacgacattggctcgaacaattgcgggtattacgatctgcaagccgtgctgacacaccaaggacgctcttctagcagcggccattatgtgtcctgggtaaaacgcaagcaggacgaatggatcaaatttgatgatgacaaggtctctatcgtcacaccagaagacatactcaggctgagcggcgggggcgattggcacattgcctacgtgctgctctatggccctcggcgcgttgagattatggaagaagaaagcgagcagtag

SEQ ID NO: 139769 - DNA, 1380 bp, Artificial Sequence
  Description of Artificial Sequence: Synthetic coding sequence
atgccgttgtactcagtaaccgtgaagtggggcaaagagaagttcgaaggggtggaactcaatacagatgaaccaccaatggttttcaaggcacaactgttcgcattaacaggggtgcaacctgccaggcagaaggtgatggtaaagggaggcaccctgaaggatgacgattggggaaacattaaaataaaaaacatggaactgccatgcggtcttactaatttaggcaacacctgttacatgaatgcaacagttcagtgcattcgaagcgtgccagaactgaaggacgcgttgaaacgctacgcaggcgctctgagagcctctggcgagatggcgtccgctcagtacatcaccgccgcattacgagacctctttgactccatggacaagacatcgtcctctatcccaccaatcatcttgctccagtttctccatatggcctttccacagttcgccgaaaagggagagcagggccagtatttacagcaggatgccaatgaatgctggattcagatgatgcgcgtgttacagcagaaattggaggcaatagaggacgattcagttaaagagactgactcctccagtgcctctgctgccaccccctcaaagaaaaaatctctcattgaccaattttttggggtcgagttcgagactaccatgaaatgtacagaaagtgaagaggaagaagtcaccaaaggaaaagagaaccagctccaactctcttgctttataaaccaggaggtgaagtacctgttcaccggtctcaagcttcggctccaggaggaaattaccaagcaatccccaacacttcagcggaatgccctctatataaaatcctctaaaatcagccgactgcctgcttacctgaccattcagatggtgcgttttttctataaggaaaaagaatccgtgaacgccaaagtactcaaagacgtgaaatttcctctgatgctggatatgtatgaactgtgtacacctgaactccaggagaaaatggtctctttccgctctaagttcaaggatctggaagataaaaaagtaaaccagcagcccaacactagcgataagaaatcctctcctcaaaaggaagtaaaatatgagcctttcagcttcgcagatgacatcggatcgaacaactgcggctattacgatctccaagcagtacttacacatcaaggacgttcatcaagctccgggcactacgtctcgtgggtgaaacgcaagcaggacgagtggatcaagtttgacgatgataaggtgagcattgtcacccccgaagatatactgagactctccggcgggggagattggcatattgcttatgtcctgctctatggcccccgacgcgtggaaataatggaggaggaatctgagcagtag

SEQ ID NO: 139770 - DNA, 1452 bp, Artificial Sequence
  Description of Artificial Sequence: Synthetic coding sequence
atgcccctatactcggtgactgtgaagtggggcaaagaaaagttcgaaggagtggaattgaataccgacgagccacccatggtatttaaagcccaattgttcgcgctcacaggcgtacagcccgcccgtcagaaagttatggtgaaaggaggtactctgaaggggatgacgttgctgatgatgggctccgcagatgccctgcctgaggaacctagcgccaaaacagttttcgtggaagacatgactgaagagcagctggcctccgccatggagctcccttgcgggctgaccaaccttggcaatacctgctacatgaatgccacagtgcagtgcatcagatctgttcctgagttaaaggacgccttgaagcgctatgccggagccctgcgggcctcaggcgaaatggcatctgctcagtacattactgcagctctgagggatttattcgacagcatggataaaacgagcagtagcatcccccccattattctgttgcagtttctacatatggctttcccacaatttgccgagaaaggggaacaggggcaatacctgcaacaggatgcaaatgagtgctggattcagatgatgagggttctccaacagaagcttgaagcaattgaagacgactctgtcaaggagaccgactcctccagcgcgtccgccgcaacaccgagcaagaaaaaaagccttatcgaccagttttttggcgtggaatttgagaccaccatgaagtgcactgagtctgaggaggaggaagttacaaaaggaaaggagaaccagctacagctctcttgctttataaatcaggaggtgaagtacctcttcacaggccttaaactgcgactgcaggaggagattacaaaacagtctcctactcttcagcgcaacgcgctctacatcaagagttccaaaatttcccgtttacccgcctatctgacaatacagatggtgagatttttctataaagaaaaagaatctgtcaatgctaaggtgctgaaggacgtgaaattccctttgatgctggatatgtatgaactgtgcacaccggagctgcaagagaaaatggtctctttccgatccaagtttaaggaccttgaggataaaaaggtgaaccagcagcctaacacttctgacaagaagtcaagcccgcagaaggaagtcaagtacgaacctttctcttttgccgatgacattggctctaataattgcggctactatgatctccaagcagtgttaacacatcaaggcaggagctctagtagcggccactacgtcagctgggtgaaaaggaagcaggatgaatggattaagtttgacgacgataaagtgtcgatagttaccccagaagacatcctgaggctgtccgggggaggggattggcacattgcatacgtgctgctatacggacccagacgggtagaaattatggaggaggagtcagaacaatag

SEQ ID NO: 139771 - DNA, 1380 bp, Artificial Sequence
  Description of Artificial Sequence: Synthetic coding sequence
atgccgctttattcagtaaccgttaagtggggcaaagagaagttcgagggggtcgagctcaataccgacgagcctcccatggtctttaaggctcagctttttgcactgaccggcgtccagcccgcaaggcaaaaagtaatggtcaagggcggaaccctgaaggacgacgattggggcaatatcaagatcaagaatatggagctgccctgcggcttaaccaatttggggaatacttgctatatgaacgctacagtgcaatgtatccgctctgtaccagaactgaaggatgctctgaagagatacgctggggcattgcgggccagtggcgaaatggcttccgcccaatacattacggcagcgcttcgcgacctgttcgattctatggataagacctcttcatctattccacctataattctcctacagttcctacacatggcttttccgcagttcgccgaaaagggtgagcagggacagtacctacagcaggacgcaaatgaatgctggatccagatgatgcgggtcttgcaacaaaagctggaggctattgaagacgactccgttaaggagacagattcaagctctgcaagtgccgctacaccttccaaaaagaaaagcctgattgatcagttctttggggtggagttcgaaaccactatgaaatgcacagagagcgaggaagaagaagtgaccaaaggcaaggagaatcagctgcagctctcttgctttatcaaccaggaagttaaatatctcttcacaggattaaagctcaggctgcaagaggagatcacgaagcaaagtcccaccttgcaacggaacgctctttatattaaaagcagcaaaataagtaggctgccagcttatttaactatccagatggttcggtttttttataaggaaaaggaatccgtgaatgccaaggtacttaaggatgtgaagttccccctcatgctggacatgtacgaattatgcacgccggaactgcaggagaaaatggtgtctttccgttcaaaatttaaagatctcgaggataaaaaagtgaatcaacagcccaatacatcggacaagaaatccagcccacaaaaagaggtgaaatatgaaccctttagctttgctgacgacatagggtcaaataattgcgggtactatgatttacaggctgtgcttactcatcagggacgctcaagttcttccggacactacgtgagctgggtaaaacggaagcaggacgagtggatcaaatttgacgatgataaggtgagtatcgtgacacccgaggacattctgcggctgagtggaggaggtgactggcacatcgcctatgtcctactctacggtccccgaagggtcgagataatggaggaggagagcgagcagtag

SEQ ID NO: 139772 - DNA, 2382 bp, Artificial Sequence
  Description of Artificial Sequence: Synthetic coding sequence
atgccagccggacctgttcaagccgttccacccccacctcccgtgccgactgagcctaagcaaccaacggaggaagaggcctcaagcaaagaggatagcgccccttcaaagcctgttgttgggattatttatcctccacctgaggtgagaaacatcgtcgacaaaacagcctcgtttgttgccaggaacggaccagaattcgaggcgaggattaggcagaacgaaatcaacaaccctaaattcaatttcctgaaccctaacgacccctaccatgcatattatcgacacaaggttagtgagtttaaggagggaaaggcccaggaaccaagcgccgcaataccaaaggtcatgcagcagcagcaacagactacccaacaacaactgcctcaaaaagtgcaggcacaggtgatacaagagacaatcgtgccaaaagagcccccgccagaatttgagttcattgcagacccaccgtccatcagcgctttcgacctggacgttgttaagctaaccgcacagttcgtggctcggaacggccgacagtttctgacacagttaatgcagaaagaacagcgtaattatcagtttgacttcctgcgccctcagcactctttgtttaattactttacaaaactagtagagcagtatacaaagatattgatacccccgaaagggctcttctccaagctgaagaaggaagctgaaaatccccgcgaagttttagaccaggtctgttatcgcgtggagtgggccaaatttcaggaaagagagcgcaagaaggaggaagaggaaaaagagaaagagcgggttgcctacgcacagatcgactggcatgacttcgtagtagtcgaaactgtcgattttcaaccgaatgagcaagggaacttcccaccacctactaccccggaggagctgggggctcgaatcctcattcaggagagatacgaaaaatttggagaatctgaagaagtggagatggaagttgaatccgatgaagaggatgacaaacaggagaaagcagaggaaccgcctagccaactcgaccaggatacccaggttcaggacatggatgaaggttcagacgatgaggaggagggtcagaaagtacccccccccccagagactcccatgcccccaccacttccaccaacccctgatcaggtaatagtgagaaaggactacgaccccaaagccagtaagcccctgccacccgctccagcccctgacgagtatctcgtctcacctatcaccggtgagaagatacctgcaagcaaaatgcaggagcacatgcgtatcgggctgctcgaccctaggtggttggagcagcgggatagaagcatacgggagaagcaaagtgacgacgaagtctacgccccaggcttggatatcgagtcttccctgaaacagctagcagaacgccgcaccgacatttttggtgttgaagaaaccgctatcgggaagaaaatcggggaggaggaaattcagaaaccagaagagaaagtaacctgggacggtcacagcggatcgatggccagaacacagcaggccgcacaggccaatattactctgcaagaacaaattgaggctatccacaaggccaaaggcctcgtccccgaagatgacactaaagaaaaaatcggacctagcaagcccaacgagataccacagcagcctcctcctccttcaagcgccacaaatattccgtcctccgctccacctattacatccgtccctcgtccacctacaatgcctccaccagtaaggactacggtggtgtcagcagtgcccgtgatgcctagacctcccatggcctccgtggtgagactgccccctggttccgtaatagctccgatgccacccatcattcacgctccgaggatcaacgttgtccctatgcctccatccgcccctcccatcatggctccacggccacctcctatgattgtgccaaccgcatttgtgccagctccccccgtcgcaccggtgccggcccccgcgcccatgcctccagttcatcccccaccgccaatggaagacgagccaaccagcaagaaacttaagactgaggattctctcatgcctgaagaagagttcttgcgccgaaataagggacccgtgtctatcaaagtacaggtgcctaacatgcaagataaaactgaatggaagctaaacggtcaagtactcgtgtttacactgcctcttactgatcaggtgagcgtaatcaaagtcaaaatccacgaggctaccggaatgcccgcaggcaaacagaagttacagtatgaaggcattttcatcaaagacagtaatagtcttgcttattacaacatggcaaatggggccgtcatccatctggctctcaaggaacgcggtggccggaaaaagtag

SEQ ID NO: 139773 - DNA, 732 bp, Artificial Sequence
  Description of Artificial Sequence: Synthetic coding sequence
accatcagggtgaaggattcactgatctgcgttgattgcgcaatggagagttcacgcaattcgagcatgctgacactgcccttgagcctctttgacgtggattccaagcctctcaaaacactggaggatgccttgcattgcttcttccaaccacgagagctcagtagtaagtctaaatgtttctgtgagaactgcggtaaaaagactcggggaaagcaggtgctgaagctcactcacctgccccagactttaacgatccatttgatgaggttttccatacgaaactctcaaacgaggaagatctgccacagtctatatttccctcagagcctcgacttctcccaaatcctgcccatgaaaagagaatcctgcgatgcagaggaacagtctggagggcagtacgaactttttgcggtgatagcacatgtgggtatggctgactccggccattattgtgtgtacattaggaacgcagtcgacgggaagtggttctgctttaacgattctaatatctgtctggtgagttgggaggatatccagtgtacctacggcaaccctaattatcactggccgccttttttgtgtcacgcttgcattctgatagaggacggggaatatctgaggttgttccgccctgcaaacattcgacaattcacctctagagaggaaacctgggtcgaatgctggtgtgtcctgacactgcagtgtaaacagctgcagcaggtgtggtag

SEQ ID NO: 139774 - DNA, 1698 bp, Artificial Sequence
  Description of Artificial Sequence: Synthetic coding sequence
atgccccaagcgagtgaacacagactggggcggactcgcgagcctccagtgaacatccagcctagagtcgggagcaagctgccctttgcccctcgcgcacgcagtaaagagagaagaaaccctgcatctggccctaaccctatgctgcgtccattacctcccaggccaggtctgcctgatgaaagattaaaaaagctcgagttgggtcgaggccgtacatccggaccaagaccaagaggccctttgcgcgccgaccacggggtacctttaccggggtctcctccccccaccgttgccctgcccctgccgagccggaccaaccttgcacggagcaagtccgtgtctagcggcgacctgcgcccaatgggcatcgccctgggaggtcatcgaggcactggggagctcggcgcagccctgtctaggctggctctgcgccctgagcccccaaccctccgtaggagtacctcactgagacgacttggcggatttcccggacccccaaccctgtttagcatcaggactgagcccccagcaagccacggcagttttcatatgatttctgcacgctcatctgagcccttctactcagacgacaagatggctcaccataccctgcttctcggctccgggcacgtaggtctcaggaatctgggtaatacttgttttctaaatgcggtgctgcagtgcctgagctccaccaggcctctgcgcgatttctgtttgcgcagagactttcggcaggaagtgcccggtggcgggcgtgcccaggaactcacagaggcatttgcagatgtgataggggcactttggcaccccgactcctgtgaggccgtgaatccgactcgctttcgcgcagtcttccaaaagtacgtgccttcattcagtgggtactcgcagcaggatgcacaagaatttctcaagctgctgatggaaaggctccatctcgagatcaacaggcggggccggcgggcaccgcccattctggcaaatggccccgtaccatcacctccacgaagaggcggggctttattagaggagcctgagctcagcgacgacgatagggcgaatctcatgtggaaacgctaccttgaacgagaagattccaagatcgtggatttgtttgttggccagctgaaatcttgcttaaagtgtcaggcttgtggatacaggagcaccacgttcgaggtcttttgcgacctcagcctgcctatacccaagaagggcttcgctggggggaaggtatctctgcgagactgcttcaaccttttcaccaaggaggaagaacttgaatcagagaacgcaccggtctgcgaccgctgtcggcagaaaactaggtccactaaaaagctgacggtgcaaaggtttccgagaatccttgtcctgcacctgaacaggtttagcgcatcacgaggcagcatcaagaagagtagtgtcggggtcgattttccactacaacgcctaagcctgggcgactttgcgtcagataaagctggtagtccagtctatcaactgtacgcgttgtgcaaccactcaggatccgtccattatggacactatacggccctgtgtcgctgtcagactggctggcatgtttacaacgacagtagggttagccctgtgtccgaaaaccaggtcgcatcctctgaaggctatgtcctgttctatcagctgatgcaggagccgccaagatgcctgtag

SEQ ID NO: 139775 - DNA, 1656 bp, Artificial Sequence
  Description of Artificial Sequence: Synthetic coding sequence
atgccgcaggcaagtgagcatcgactgggtcgtacaagagagccccccgtgaatatccagcctagagtgggatccaaactcccattcgcccctagagcaagatctaaggagcgtagaaacccagctagtggaccaaatcctatgctccgccctctcccgcctagacctggactccccgatgagcggctcaagaagttggagctaggccgcggaagaacatctggcccacggccgcggggcccacttagagcagatcatggggtccccctgccgggcagcccgccccccacagtcgccttgccactcccaagtcgtaccaacctagcacggagcaagagcgtgtcgagcggagaccttcgccctatgggtattgcactggggggccaccgcggcacgggtgaactgggggccgctctgagccgcctggcgctgcgtcctgaacctccaacactacgaagaagcacgtccttgcgtaggctggggggattcccaggcccccctacactcttttcaattcgtaccgagcccccagcttctcatggctcattccacatgataagtgcccgctcgagcgagcccttctactcagacgataagatggctcatcacaccctgttgctcgggtcaggccacgtggggctacgtaatctgggcaacacttgcttcttgaatgccgtgctccagtgtttgtcttctacccggcccctgcgcgatttctgtctacggagggatttccggcaggaggtaccaggtggcggccgcgcgcaggagctcactgaggccttcgctgatgtcattggtgcactctggcacccagatagctgtgaagccgtgaaccctactcgatttcgcgcggttttccagaaatatgtgccttccttttccgggtattcccagcaagatgcgcaagagttcctgaagttgctgatggaaaggctacaccttgagataaaccgccgcggcaggagggccccccccatcctagccaacggacccgtcccatcccctccacggagagggggggctctgttggaagagccagagctttctgacgacgatcgcgccaatctcatgtggaagagatatctggagcgggaggactctaagatcgtcgacctatttgtgggacagttgaagagctgcttaaaatgccaggcctgcggctaccgatccactaccttcgaggtattctgcgacctttccctgccaatccccaaaaaaggctttgcgggagggaaagtgtcgctcagagattgctttaatctcttcaccaaagaggaagagctggagtctgaaaacgcgcctgtgtgcgacagatgtcggcagaaaaccaggagcactaaaaagctaacagtgcagcgtttcccccgcattctggtactgcacttgaatcgcttttctgcctcaagggggtcaatcaaaaagtcttccgtcggggtggactttccactccagaggttgagtctgggagacttcgccagtgataaggccggttccgtccactatggccactacacagccctgtgtagatgccaaacaggctggcatgtctacaatgactcccgcgtgtcccctgtgtcagaaaatcaggtggctagctccgagggctatgtgctcttttaccagctgatgcaggaaccgcccaggtgcctctag

SEQ ID NO: 139776 - DNA, 1698 bp, Artificial Sequence
  Description of Artificial Sequence: Synthetic coding sequence
atgccacaggcttctgagcacaggctcgggcgaacccgcgagccccctgtgaacattcaacctagggtcgggtccaagctcccattcgccccacgtgctcgctctaaagaacggcgaaacccagcctcaggccctaatcccatgcttagacctttgcctccccgtcccggcctgcctgacgagcgactcaagaagctggagcttggaagaggtcggacatccgggccaagaccacggggcccgctgagggcagaccatggagtgcctctgcctggctctccaccaccgaccgtggctctccctctgccaagtagaactaatctggctcgctcaaaatctgtatccagtggcgatttacggcctatgggcatcgcactcggcggccacagaggcactggagaactgggggccgctctgtctcggctggcactgagacctgagcctcctactcttagacggagcacctcccttcgaaggcttggcgggttcccgggccctccaaccctgttttctatccgaacggagccgcccgcttcccatgggtcctttcatatgatatctgccaggtcatctgaacctttttactctgacgataagatggctcaccacacactactgctaggtagcgggcacgtagggctgcggaatctcggaaatacctgctttctaaatgctgtcctacagtgtttaagcagtacccggcctctgcgggatttctgtcttcgaagagactttcgacaggaggtcccaggtggcggcagagcccaggaactgaccgaggcgttcgcagatgtcatcggcgccttgtggcacccagacagctgcgaagccgtgaaccccaccagatttcgagccgtttttcaaaaatatgtacccagctttagcggctatagtcaacaggacgcccaggaattcctgaaactgctgatggagcgacttcacctggaaatcaatagacgcgggcgaagggcccctcccattcttgcaaatggccccgtgcccagcccaccgagaagagggggtgctttgctggaagagcctgagctgagcgacgacgatagagctaaccttatgtggaagaggtacctggaaagagaagattctaagattgttgatttgttcgtgggtcagcttaagagttgtcttaagtgccaggcctgcggctatagatcgactacatttgaagtcttctgtgatcttagtctgcctatacccaaaaagggctttgcaggaggcaaggtgagtctcagagactgcttcaaccttttcacaaaggaggaggaactagagagtgaaaacgccccagtctgtgaccgttgtaggcagaaaacccgctctaccaaaaaactgaccgtgcaacgcttccctaggattctggtgttgcatctgaatcgcttctcagccagtaggggatccatcaagaagagtagtgtcggggttgattttcctctccagcggctgtccctgggcgactttgcctccgacaaggccggaagtcctgtctatcagttgtacgctctttgtaatcactctggatctgtccactacggacactataccgcattgtgtcgctgtcagacgggctggcacgtatataacgattctcgcgtctcgcctgtctctgagaaccaggtggcatcttctgagggatacgtcctgttttaccaactgatgcaggaacctccccgttgcctctag

SEQ ID NO: 139777 - DNA, 1578 bp, Artificial Sequence
  Description of Artificial Sequence: Synthetic coding sequence
atggtctcccggcctgaacccgaaggagaagcaatggatgcggaacttgccgtcgccccgcctggatgtagtcacctcgggtcattcaaggttgacaattggaagcagaaccttagagcaatctatcagtgcttcgtgtggagcggcaccgctgaggctcgtaagaggaaagctaaaagttgtatatgccatgtgtgtggggtgcaccttaatcgcctgcatagctgtctctattgtgtcttcttcggctgcttcacaaagaaacacattcacgagcatgccaaggcaaagcggcacaatctggcaatagacttaatgtatggcggaatctattgtttcctctgtcaagactacatttatgataaagatatggagattatcgccaaagaagaacagcgcaaggcttggaagatgcagggtgtcggagagaaattcagcacatgggagccaactaagcgcgagcttgagctccttaagcacaaccccaaacgccgaaagattaccagtaactgcaccattggcctacggggccttatcaatcttggcaatacatgtttcatgaattgtattgtgcaggcgcttacccacactccgctgctgagggattttttcctgtctgatcgccatcgctgcgagatgcagtcccccagcagctgcctggtctgtgagatgagttctctattccaggaattttactccggccatagaagcccgcatatcccctataagctcctccaccttgtatggactcatgcaagacatttggccgggtacgaacagcaggatgcccatgaattcctaattgctgctctggacgtcctgcatagacactgcaagggggacgacaatgggaaaaaggccaacaatccgaaccattgtaactgcatcattgaccagatatttaccggcggtttacagagcgacgtcacttgccaggtttgtcatggtgtaagtacaaccatcgaccctttctgggacatcagcctagacctgccaggcagttccacacccttctggccccttagcccaggcagtgagggcaatgtggtgaacggcgagtctcatgtttccggcacaaccacattaactgattgtctgaggcgcttcactcgaccagagcatttgggcagttcagccaaaataaaatgctctgggtgccacagttatcaggaaagcaccaaacagctgaccatgaaaaaactgcccatcgttgcttgcttccaccttaagagattcgagcattcagcaaaactgcgtagaaagattaccacatacgtgagctttccgctggaactcgatatgaccccttttatggcctctagcaaggaaagcaggatgaatggtcagtatcagcaaccaaccgactcgctcaataacgacaacaaatacagtttgttcgccgtggtgaaccatcaaggtaccctggagtccggacattataccagctttatccgtcagcacaaagaccagtggttcaaatgcgacgacgccattataaccaaggcttctattaaggacgtgctggatagcgagggatatttgctcttctatcataaacaatttctagagtatgagtag

SEQ ID NO: 139778 - DNA, 1782 bp, Artificial Sequence
  Description of Artificial Sequence: Synthetic coding sequence
gcagccgctgcccggggtcgatgtcttccttgctctctgccaagcgctattgctcagccgcacctgtgtcccgcatccgccctctgttccaggcggccaggcttaggccagcctggtcagcctcccagcagtcctcacgccgccctcgccagctcttcccctccctcgccaccacccccggccagaggtagggcgctgccccctatggttagtaggcccgagccggagggcgaggcaatggacgcagagctggcagtggctccccctggatgctctcacctcggtagcttcaaggtggacaattggaaacagaacctgcgagccatctaccagtgctttgtatggtccgggactgccgaggctagaaagcggaaggcaaagtcatgcatttgtcatgtatgtggcgtccacctcaatcgcttacattcttgcttatactgtgtgtttttcggctgcttcaccaaaaagcatatccacgaacacgccaaggctaagcggcacaacctcgctatcgacctgatgtatggagggatctactgctttctctgtcaggactacatctacgataaggatatggaaatcatagccaaggaagagcagcgcaaagcctggaagatgcagggagtgggagagaaattcagcacctgggaacctaccaagcgcgaactggaactgctgaaacacaatcctaagcgacggaagattacaagcaattgcacgattggtttaagaggtttaataaaccttggaaacacctgttttatgaactgcatagtgcaagccttaacacacacacctctgttacgagactttttcctctccgaccgtcaccgctgtgagatgcagagccccagctcttgtctcgtgtgcgaaatgtccagcctctttcaggagttctacagtggacatcgatccccccatatcccgtataaactcctacaccttgtctggactcatgctaggcacttggctgggtatgaacagcaggacgcacatgaattcctcattgctgcactcgatgtcttacatagacattgcaagggtgatgataacgggaaaaaagccaataacccaaatcattgcaactgcatcattgaccagatttttacagggggccttcaatctgacgtgacatgccaagtttgccacggcgtgagcacgacaattgatcccttctgggacatctccctggaccttcctggcagcagcactccgttctggccactgtctccaggctctgaaggcaacgtcgttaacggtgaaagtcacgtgtctggcaccacaactctgaccgactgtctgagaagatttacccgcccagagcacctgggctcatccgctaagataaagtgttccggctgccactcatatcaggagtcaacaaagcagctgaccatgaaaaagctccctattgtcgcgtgtttccacttgaagcgatttgaacactccgccaaacttaggcgcaagattacaacatacgtttcctttccattagaactggacatgacaccatttatggccagctcaaaggagtcaaggatgaacggccagtatcagcagcccaccgattcccttaacaacgacaacaaatactctctattcgctgtggtgaatcaccagggtacattggaatcaggacactatacaagttttatcaggcagcacaaagaccagtggttcaagtgcgacgatgctattatcacaaaggcaagcatcaaggatgtgttagactcagaaggatatctgctgttttatcacaaacagtttttggagtacgagtag

SEQ ID NO: 139779 - DNA, 1542 bp, Artificial Sequence
  Description of Artificial Sequence: Synthetic coding sequence
atggctccgggatggcctagcctgagtgctggaagccgccaggaagctccccagttggcagcgggtggaagcgcctaccaggcagtcggacgccagtttcagcctagggctactgccctgcagggaccgtcccaggccaagagctgtatctgtcacgtatgcggcgttcacctgaaccgactgcacagttgcctctactgcgtattctttggctgcttcactaaaaagcatattcatgaacacgctaaggcgaaaaggcataacctggccattgatttgatgtatggcggcatctactgcttcctctgccaagattacatttatgacaaagatatggaaatcattgccaaggaggagcagcggaaggcatggaaaatgcagggagttggggagaaattctcaacatgggagccaacgaagcgcgagctggagcttttgaaacacaaccctaaaagaagaaagatcaccagcaattgtactattggactgagaggcctgatcaacctgggcaatacctgctttatgaattgcatcgttcaggccctaacccatactcctcttctgagagattttttcctgtcagatcgacaccgctgtgagatgcagtctccaagcagttgcctcgtgtgcgagatgagctctctgtttcaggaattctattcaggacaccgatcacctcacatcccatataaactgctccatctagtgtggacccacgccaggcatctggccgggtacgaacagcaggatgcccacgagtttctcattgccgctctggacgtgttacatagacactgcaagggggacgataacggaaagaaagcgaacaacccgaaccattgtaactgtattatagatcagattttcacaggagggctgcagagcgatgtgacatgtcaggtttgccacggagtatctaccaccattgacccgttctgggatattagcctggatctccctggatccagcacaccgttctggcctctttccccaggctccgaagggaacgttgtcaacggagaatcccatgtcagcggtacaaccacattaacagattgtctgagaaggtttacacgccccgagcacctcggatcatcagcgaagattaagtgctctggctgtcatagctatcaagaaagcaccaaacagcttacaatgaagaagctacccatagtggcctgctttcacttgaaaagattcgaacacagcgcaaagctaaggagaaaaatcactacctacgtgagtttcccactcgaactggacatgaccccttttatggcttccagtaaggaatcacgaatgaatggccagtatcaacagccaacagactccctgaacaatgacaacaaatatagtctgtttgcagtcgtgaatcaccaggggacgctcgagtccgggcactacacatctttcatccgccaacataaggaccaatggtttaaatgtgacgatgctattattacaaaagccagcatcaaagatgttctggattccgagggctacctcctgttttaccacaaacagtttcttgaatatgagtag

SEQ ID NO: 139780 - DNA, 7863 bp, Artificial Sequence
  Description of Artificial Sequence: Synthetic coding sequence
atggaaagcgaggaggagcaacacatgactactttgctctgcatggggttttccgacccggccacaattaggaaggcccttagactggctaagaacgatatcaacgaggcagtggcgctcctgaccaacgagaggcccgggttggattatggaggatatgaacccatggattctggcgggggaccaagtcccgggcctgggggggggccgaggggagatgggggcggcgacggcggcgggggcgggccttcacgcggcggatccaccgggggggggggcggctttgatcctccaccagcttatcacgaagttgtagacgccgaaaagaatgacgagaacggaaattgctctggcgagggcattgaattcccaaccacgaacttgtatgagctggagagccgtgtcctgaccgaccattggagcattccttacaaaagagaggaatcgttgggaaaatgcctgctggccagcacctatctggctcgcctcggcttgtcagagtctgatgaaaattgtagacggttcatggaccgctgcatgccagaggccttcaagaagctgctcacctcatccgcagtgcataagtgggggacagagatacacgagggcatatacaatatgctgatgctgctaatcgagctcgtagcagaacggattaaacaggaccctattccaacggggctcctgggcgtcctgaccatggcctttaatcctgataacgagtatcatttcaagaacagaatgaaagtaagccaacgtaactgggctgaagtgttcggcgagggtaatatgtttgccgtcagccccgtgtctacattccagaaagaaccacatgggtgggttgtagacctagtgaacaagttcggggagcttggcggattcgctgcaattcaggcaaaactgcattccgaagatattgagctgggcgcagtcagcgccctgatccagcccctaggggtgtgcgctgagtatctcaatagcagtgtggtccagcctatgctggatcctgtcatcctgactacaattcaggatgtgagatccgtggaggaaaaagacttgaaggacaaaagactcgtatcgatccctgagttgctgagcgctgtgaagctgctctgtatgcgcttccaaccagatctggtcaccatcgttgacgaccttaggctcgacatactgctgcggatgcttaaaagcccccacttctcagccaagatgaactcccttaaggaagtgactaaactcattgaggacagtacattaagtaaatcagtcaaaaacgccatcgataccgatcggttgttagattggctagttgagaatagtgtgctgtcaatcgccctggaaggaaacatcgatcaggcacagtattgtgataggatcaagggcataattgagctattgggatccaagctgtccctggatgagttgacgaagatttggaagattcagtcagggcagagctctaccgtcattgagaacattcataccattatcgcagccgccgccgtaaagttcaactctgaccaactgaaccacctctttgtcctcatacagaaatcatgggaaactgaaagtgaccgagttaggcaaaaattattgtcactgatcggcagaattggaagggaggcccggttcgagactacctctggcaaagtcttggacgttttgtgggagctggcccacctgcctactttaccatcttctctgatccagcaagctctggaggaacacctaactatcctatcagatgcttatgcagtgaaagaggcgattaaaaggtcttacatcattaaatgtattgaagacataaagagacccggcgagtggagcggactggaaaagaataaaaaagacgggttcaagtcctcccaactgaataatcctcagtttgtctgggtcgtccccgccctgcgccagctacacgagatcactaggtctttcattaagcagacctatcagaagcaagataaatctatcattcaggacctcaagaagaacttcgagattgtgaaattagtgactgggtccctcatagcctgccacagactcgcggccgctgtcgcgggccccgggggcctttcaggttcgacccttgtggatggtcgctacacatacagagaatacctggaagcacaccttaaatttctggcctttttcctacaggaagctacattgtatcttggctggaacagggctaaagaaatttgggaatgtcttgtgacgggacaagatgtgtgtgagctggatcgcgagatgtgctttgaatggttcacaaagggacagcacgacctcgaaagcgatgtgcaacagcagttgtttaaagaaaaaatcctcaagttggaaagctacgagataacaatgaacggttttaacctttttaaaactttctttgaaaacgtcaacctgtgcgatcaccgactgaaaagacagggcgcccagctttatgttgagaaactagagctgattggaatggactttatttggaagatcgcgatggagagtcccgatgaagaaatagccaacgaagctatccaactgattatcaactacagttacatcaacctgaatccccgcctcaagaaggattccgtaagtttgcataaaaagttcatcgcagactgctatacaaggctggaggccgcttcatctgcactcggcggcccgactctgacacatgcagtcactagagctacaaaaatgcttaccgccacagctatgccgacagttgcgacaagcgttcagtcgccttaccgctctaccaaactagtgatcattgaacgtctcctgcttctcgctgaacgctatgttattaccattgaggacttttatagcgtaccccgaactatcctcccacatggcgcatccttccacggtcacttacttacactgaacgtgacgtatgaatctaccaaagacactttcaccgtggaggcccatagcaacgagacaataggctcagtgaggtggaaaattgctaaacagttgtgctcaccagtggacaatatccaaatatttaccaacgacagcctgctaaccgtcaacaaggaccagaaattgcttcaccagctgggcttcagcgatgagcagatactaactgtcaaaacttccgggagcggtacccccagcgggagttcagcagactcctccacttcatcctcctccagctcttcaggggtgttctcttccagttatgcgatggaacaggagaagtccctaccaggcgtagtgatggctctggtttgcaatgtgtttgatatgctgtaccaacttgctaatctagaggagcccaggatcaccttaagagtgcgcaagttactcttactgatccccaccgatccggctattcaagaagctttggaccagctagattcacttgggagaaagaagactttgctgtccgagtccagctcccaatcttctaagtcaccaagcctgtctagcaagcagcagcatcagccctcagccagcagcattctggaatccctgttccggagttttgcccctggcatgagcactttcagggtgttgtacaacctggaagtgctgtccagtaagttgatgccaacagccgacgacgacatggcgcgatcttgtgcaaagtcgttctgtgagaatttcctgaaggcaggaggcctgtccctagtcgtcaacgtaatgcagagagactctatccctagtgaggtcgactatgaaactcgccagggggtttattctatctgtctgcagctggctcggttcttactggtgggccagacaatgccgactctactggacgaagacctcactaaggacggaattgaagcacttagctctcgtccgtttcgcaatgttagccgtcaaaccagtcggcagatgagcctatgcggcacccccgaaaaaagcagttaccggcagctctctgtaagcgatcggagtagcatcagggtggaggaaattattcccgctgccagagtagccatccagaccatggaagtgagtgactttacgtctacagtcgcatgctttatgcgcctatcctgggcggccgctgctggacgcctggatttagttggctcaagccagccgatcaaggagtccaactctctgtgtcccgcgggtataaggaaccgcctgagctcgagcggcagtaattgctcatcaggctcggaaggcgagcccgttgcactacacgcaggaatttgcgtgcgccagcagtccgtgtcaactaaggactccctgatcgcaggagaggccctcagcttactggtgacttgtctccaactgcggagccagcagctggcttccttttacaatttaccttgcgtggcggacttcattatagacattctccttggctctccatctgccgagattaggagagtggcgtgcgaccagctctacaccctctctcagaccgacaccagtgcgcaccctgacgtccaaaaacccaatcaattcctgctaggcgtcatattgacagcccagcttcccctctggtcaccaacttcaattatgcgcggcgttaaccagaggctgctctcacagtgcatggagtacttcgaccttcgctgtcagctgctggatgacctcactacctcggaaatggaacagctgcggattagccccgcaaccatgctggaagacgagattacctggctcgataacttcgaacctaacaggacggctgagtgtgagactagcgaagctgataatattctcttggccgggcacctcagactgatcaagaccctcctgtcgctgtgtggtgccgagaaagagatgctgggtagtagcctgattaagcctctcctggacgatttcttatttcgggctagtaggattattctgaatagccactccccggcaggcagcgcagccatttcccagcaggatttccatcccaagtgcagcactgctaactcccgactcgccgcctatgaagtgttagtcatgctcgccgacagtagcccttcaaatttacagatcatcatcaaggagctgctgtctatgcaccatcagcccgatccagcgctgacaaaggagttcgactatctgcccccggtagattccagaagcagttcaggctttgtggggctacgtaatggcggcgctacctgttacatgaacgcagttttccagcagctctacatgcagcctggtttaccagaatcgctgctttccgttgatgacgacacagataatccagacgattctgttttctaccaggtccagtccttgttcggacacctgatggagtcaaagctgcagtactacgtccctgagaacttctggaaaatttttaagatgtggaacaaagaactgtacgtgcgggaacagcaggacgcgtacgagttcttcacatcgctgatagatcagatggatgaatatctaaagaaaatgggcagggaccagatcttcaaaaacacattccagggtatttactcggaccaaaaaatctgcaaggattgcccccaccgatacgaacgagaagaggcttttatggcgctcaatctgggcgtaactagctgtcagtccttagaaatctctctggaccaatttgtgcggggggaggttctggaaggctcaaatgcttactactgtgagaagtgtaaagagaagagaataacagtgaaaagaacatgtatcaaaagcctgccttctgtgctggtcatccacctcatgagatttgggtttgactgggagtctggacggtctatcaaatatgatgaacaaatcaggtttccatggatgctcaacatggaaccttacacagtgagcgggatggcaaggcaggatagctcgagtgaggtcggggagaatggccggagcgtcgatcaaggtggcggagggtcacctcggaaaaaagtagccctcacagagaactatgaattagtgggcgtcatcgtgcactccggccaggcccacgctgggcactactattcattcattaaagatagacgagggtgcggtaagggcaaatggtacaagtttaatgacacggtcatcgaggagttcgatctgaatgacgaaactctggaatacgaatgcttcggcggtgagtacagacctaaggtgtacgatcagactaacccctataccgatgtgaggcgtagatactggaacgcatacatgctgttttatcaacgcgtttcagaccagaactcacctgtgctgcccaaaaagagtcgtgtctcagtggtccgtcaggaggccgaagatctctcgctgtcagccccttccagtccagagatctctcctcagtcaagccctcgcccacatcgtcccaataacgatcgactcagtatcctgaccaagttagtgaaaaagggagagaagaagggcctgtttgttgaaaagatgccagccaggatctatcagatggtcagagatgaaaatctgaagttcatgaagaatagagacgtgtactcctccgattatttctcttttgtactaagcctggcctctttgaatgccactaaactgaagcatccctactacccctgtatggccaaggtgagtctgcaactggctatccagtttcttttccagacttacctcagaacaaagaaaaagctcagggtggatacagaagagtggattgcaacaatcgaagctttgctgtcaaagtcattcgatgcttgtcagtggcttgtcgaatatttcatcagttccgaaggaagagagctcattaagatcttcctgctcgagtgtaacgtgagggaggtaagagtcgctgtcgctaccattctggagaaaacccttgactctgctttattttaccaagataaactgaaaagcctccatcaactattggaagtgctgctcgcactgctcgataaagacgttcctgaaaattgcaaaaattgtgcccagtatttcttcctgtttaatacctttgtgcagaagcaaggaattcgtgccggtgacctacttctgaggcacagtgctctgcggcacatgatttcttttcttctgggagcaagtagacagaataaccagattaggcgttggagctcggctcaggctagggaatttggcaacttgcacaacactgttgcactgttggttcttcactctgatgtgtcctctcagcggaatgtggctcccggaatcttcaaacagcgcccccccatctccattgccccctcttctccccttctgccgctccatgaggaggttgaagcattgctcttcatgtccgaaggaaagccatatctgctggaggtcatgtttgcactccgggaattaacgggcagcttactggccttgatcgagatggtggtttactgttgtttttgcaatgagcatttctcattcaccatgctccactttatcaaaaaccagctcgagaccgctcccccacatgagctcaagaatacatttcagcttctgcacgaaatcctagtgattgaggaccctattcaggtggaacgggtgaagttcgtgttcgagactgagaatgggctgctcgccctaatgcaccattctaaccatgtggattcaagtaggtgctatcagtgtgtgaagttcctcgtcacattagcgcagaaatgtcccgccgcgaaagaatactttaaagaaaactcacatcattggtcgtgggccgtgcagtggttacagaagaagatgtcagaacactactggaccccacagtctaatgtctccaatgaaaccagcacaggcaagaccttccaacgcactataagcgcccaggatacactggcctatgccactgctcttctgaatgagaaggagcagtcaggatctagcaatgggtctgaaagctctcctgccaatgagaacggagacaggcatttgcagcaggggagtgagagccccatgatgatcggcgaactcagatcggatctggacgacgtggacccatag

SEQ ID NO: 139781 - DNA, 7383 bp, Artificial Sequence
  Description of Artificial Sequence: Synthetic coding sequence
atgaccactttattgtgtatggggtttagtgacccggcgaccatcaggaaagccttgaggttggccaaaaacgatatcaatgaagccgttgctttgctgactaacgagcgaccaggcctcgactacggaggatacgagcctatggattccggcggcttgtctgaatcggacgagaattgtcgcaggttcatggacaggtgtatgccagaggcttttaaaaaactcttgacttccagcgctgtgcataaatggggtaccgaaatccacgaaggaatttataatatgcttatgctgctcatcgagctcgtggctgaaaggattaaacaggacccaatccctactgggctgcttggtgtacttacaatggcatttaacccagacaatgagtaccacttcaagaatcggatgaaggtgagccagcgtaattgggcggaagtgtttggtgaggggaatatgtttgccgtatcaccagttagcacgttccaaaaggagccacacgggtgggtagtggacttggtgaataagtttggcgagctgggcggctttgccgcaatccaagcgaagctgcactcagaggatatagaactgggagccgtttccgcacttattcaaccactgggtgtctgcgcagagtacttaaacagttctgttgttcaacctatgttagatccagtgatcctcacaaccatacaggatgtaaggtccgtggaggagaaagacttgaaggacaagcggctggtgagcattccagaattgttgtctgcggtcaagcttttatgtatgagattccagccggatctcgtgacaattgtggatgacctgagactggacattctgctcagaatgctgaaaagccctcacttttccgccaagatgaatagcctaaaagaggtgactaagctgatcgaggactcaacattaagcaaatccgtgaagaacgctattgataccgatcgcctactcgactggctagtcgaaaatagtgtattgagcatcgccttggagggaaacattgaccaggcccagtactgcgacaggattaaagggataatagagcttctggggtccaaattgagcctggacgagcttacaaagatttggaagatccaatccggccaaagctcaacagtgattgaaaacattcatacgattatcgcggctgctgccgttaaatttaattccgaccagctgaatcatctgtttgtgctgattcaaaaggtgctggacgtactgtgggagctggcccacctacctaccctgccttcaagcctgattcagcaagccttagaagagcatctcaccattctctccgacgcttatgcagtaaaggaagccatcaagaggtcttatataatcaagtgtatcgaagacattaagagaagttcgcagctcaacaatccccaatttgtgtgggtggtgcccgccctgaggcaattacacgagatcaccagaagtttcatcaagcagacttatcagaaacaggacaagtcaatcattcaggacctgaagaaaaactttgaaatcgtcaagctcgtgacgggctccctgatcgcctgtcaccgtcttgcagcagctgtggccggccctggcgggttaagcggaagcaccctcgtagatgggcgctacacttatcgcgagtatctggaagctcatcttaagtttctcgcatttttcctgcaggaagccacgctatatctaggttggaatcgcgccaaagaaatctgggaatgcctcgtcaccggtcaggacgtttgtgagttggaccgggagatgtgcttcgagtggttcaccaaaggccagcatgacctggagtcggacgttcagcagcagctcttcaaagagaaaatccttaaactggagagttatgaaattacaatgaatggctttaacttgtttaaaaccttttttgaaaacgttaatctgtgcgatcaccggttgaaaaggcaaggcgctcaactctacgtcgagaaactcgagttgattgggatggactttatttggaaaattgccatggagtcccctgatgaggagatcgccaacgaggcaattcaactgatcattaactactcatacattaaccttaacccgcgtttgaagaaggacagtgtaagcctgcacaaaaaattcatcgccgattgctatacccgacttgaagccgcctcgagcgctcttggtggccccactttgacacacgcagtcactcgcgctacaaaaatgctgactgccactgcgatgcccaccgtggctacaagtgttcaatcaccctatcgatcaaccaaactcgtgattattgaacgactgctgctcctggctgaaagatacgtcattaccatcgaggacttctacagcgtgcccagaaccattcttccacacggggcaagtttccatggacacctgttgactctgaacgtgacttatgagagcacaaaggacacgttcactgttgaggcacatagcaatgagaccatcggtagcgtgcgctggaagatcgccaagcaactctgctcacccgtagataacattcaaatttttactaatgatagcctgctgactgtaaacaaagatcaaaaactgttacaccaacttggcttttcagatgagcagatcttgaccgtcaagactagtggttcagggacgccttccggttcctctgctgacagcagcacttcctcctcatcatcctcttcaggggtgttctcgtcaagctacgcaatggagcaggagaagtctctcccgggcgtggtgatggcactggtgtgtaatgtgttcgacatgctttatcagcttgctaatctggaagaacctcgaattaccctgcgcgtcagaaaactcctcctgctgatacccaccgatcccgccatccaggaagcactggatcaactcgattctctgggccgtaagaaaacgttactttcagagagcagcagccaatcctcgaagtccccttctctttcaagtaaacagcagcaccagccatccgctagctccatacttgaatcactgttcagatcattcgccccagggatgtcaaccttcagagtcctgtacaacctggaggttctatcttccaagcttatgccaactgccgacgatgatatggcccggagttgcgcaaaatcattttgtgaaaattttctcaaggctggagggctgtccctcgttgtgaatgttatgcagcgcgactctatcccaagcgaggtagactatgagacccgacagggtgtttatagcatctgtctccagctggcaaggttcctgttggtgggccagacaatgcctacattactggatgaggatttgacaaaggacggcatcgaagctctctcatcccgcccattcaggaatgtgagccgacagacgtcaaggcagatgtctctctgcggaacccctgagaaatcctcctatcgccagctttctgtcagtgaccgttcatcaatccgcgtggaggagattatccctgcggcacgggtagcaattcaaacaatggaggtctccgacttcacttccacagtggcctgctttatgcgacttagctgggcggctgctgccggcagactggaccttgtggggagttctcaacctatcaaagagtcaaactccctgtgccccgccggtattaggaaccggctttctagttctgggtcaaactgctcatcagggtccgaaggggaaccagtggctctccacgcgggaatatgtgtgagacagcagtccgttagcacgaaggacagcctgatagctggtgaggctctctcacttctggtaacctgtctgcagctgaggtcacagcagttagcttcgttctataatctaccctgcgtggctgattttatcatcgacatactactgggcagcccctctgccgagatccggagggtagcttgcgaccagctgtatactctttcccagactgacaccagtgctcacccagacgtccagaagccaaatcaattcctgctaggagtgatcctgactgcccagttaccactgtggtctccaacatccattatgagaggcgtcaatcaacggctgctctctcagtgcatggagtatttcgatctgcgctgtcaactcctggacgatctgaccacatcagaaatggaacagctgcgcatctccccagccaccatgctggaggacgaaatcacatggctggacaacttcgaacccaatcggactgccgaatgtgagacgtccgaagcagataatattctattagccgggcatctcaggctgattaagacacttctctcattgtgcggggcagaaaaagagatgctgggctcctcgctgatcaagcctctattggatgattttctttttagggcctctaggattattctcaacagccactcacctgcagggtcagccgctatcagtcagcaggatttccatcctaagtgcagtacagctaattcaaggttggcagcttacgaagtccttgtcatgctagcagattccagccccagcaacctgcagatcatcatcaaagaattactcagtatgcatcaccagcctgaccccgctcttacgaaggaattcgactacctcccccccgtggacagtcgcagttcttctgggtttgtaggactgcgcaatggcggcgctacctgctatatgaatgcagtctttcaacagctgtacatgcagcctggcctgcctgaaagcttgttgtccgtggacgatgatacagacaacccagatgactctgtgttctatcaggtccagagtttgttcggacatctcatggagagcaaactgcagtactacgtgccagaaaatttctggaaaatcttcaagatgtggaacaaggagctttacgtccgagagcagcaggacgcctacgaattcttcactagcctgatcgatcagatggatgaataccttaagaagatgggccgcgaccagatatttaagaatactttccaggggatttacagtgaccagaagatctgtaaggactgcccacataggtacgaacgcgaagaggcctttatggccttgaatttaggagtaacaagctgtcaaagcctggagattagcctggatcagtttgtccgcggggaggttctcgagggtagcaatgcttactactgcgaaaagtgcaaggagaagcgtatcactgtgaaacgtacttgcataaaatctctgccatcagtgctggtgatacacctgatgagattcggattcgattgggagagtggtagatccatcaaatacgacgaacagatcaggtttccgtggatgctgaacatggaaccatacaccgtgtctggaatggcacgtcaggattcttcatctgaagtgggtgagaatggccgctccgtcgatcagggagggggcggctccccacggaaaaaagtcgctctcaccgaaaattatgagctcgttggagtgatcgtgcattctggccaggcgcacgccggtcactactacagttttattaaggatcgcagagggtgcggcaagggaaagtggtacaagttcaacgacaccgttatcgaggaatttgacctgaacgacgaaaccctcgaatacgagtgtttcggaggcgagtatcgtccaaaggtgtacgaccagaccaatccatacacggacgtcagaaggcggtactggaatgcctatatgcttttttatcagagagtatctgaccagaatagcccagtgctacccaaaaaaagtcgcgtgtccgttgtaaggcaggaggccgaagatttgtctctttctgccccctcatcccccgagatcagtccccagagttccccccgaccacacagacctaataatgataggttatccatactgacaaagcttgttaagaaaggcgaaaaaaaaggcctcttcgtggagaagatgcccgcacggatttaccagatggtgagggacgagaatttgaaattcatgaaaaatcgtgatgtctatagcagcgattatttctccttcgttctgtcattggcttcactgaatgccacaaagctcaagcacccatattatccgtgcatggccaaggtgagtttacagctcgcaattcagtttctattccagacctatctaagaaccaagaagaaactgcgggtcgacacggaagagtggatcgccaccatcgaggctcttctgagcaaatcattcgatgcctgccagtggctggtggagtatttcataagctcagagggaagggagctcatcaagatctttctgcttgaatgcaacgtaagggaggtgcgggtagccgtggcaacaattctcgagaaaacactcgattccgcactcttctaccaggacaagctgaagtctcttcatcagctcctggaggtcctgctcgcccttctggataaagatgtacccgaaaactgtaagaattgcgctcaatatttcttcctgtttaacacttttgtgcagaagcaaggaattagagctggtgatttgctactccgtcattccgctctgcgtcacatgatatcctttttgctgggcgcgtcaagacagaacaaccagatcaggcggtggagctccgctcaggccagagaattcggcaatcttcacaatactgttgccctgctggtcctgcactctgatgttagctctcagcgcaatgtggctccagggatcttcaaacagaggcctccaatctccatcgccccaagcagtccactcttgcctttgcacgaggaggtggaagcattgctttttatgagtgagggaaaaccttacctgttggaagtgatgtttgccctcagagagctgaccggcagcctcttggctcttatcgagatggtcgtgtattgttgtttctgtaacgaacacttctcgtttaccatgctccacttcatcaagaatcaacttgaaacagcccctccccatgaacttaaaaacacattccagctactacacgagatactggtcatcgaagatccaatccaggtggaaagggtcaagtttgtcttcgaaactgagaacggactactggcattgatgcatcactccaaccatgtcgattcctctcggtgttaccagtgcgtgaagtttctggtaaccctggctcaaaagtgtcccgcagccaaagagtatttcaaggaaaactcacatcactggtcatgggcggttcaatggctacaaaaaaagatgtctgagcactactggacaccgcagtctaacgtgagcaacgaaacaagtacaggcaaaacatttcagcgaactataagcgcccaggacacactcgcctatgccacggccctcctgaatgagaaggagcagagcggcagttctaacgggtcagagtctagtcccgctaatgagaatggcgatcggcacctgcaacaggggtctgagagtccaatgatgatcggcgagcttcgtagcgacttggacgacgtagacccttag

SEQ ID NO: 139782 - DNA, 2742 bp, Artificial Sequence
  Description of Artificial Sequence: Synthetic coding sequence
atggcggcccttttcctcaggggattcgtccagatcggaaattgtaagaccggcatctcaaagagcaaggaagcttttatcgaagccgtggagaggaagaagaaagaccgcctggtgttgtattttaagagcggcaaatactcgaccttcaggctgtcagacaacatccagaatgtggtgctgaaaagctatcgcgggaaccagaatcatcttcaccttacacttcagaacaataacggcctgtttattgagggcctcagtagcacggacgcggagcagctcaagatctttctggatagggtgcatcagaacgaggtccagcctccagtgaggcctggaaagggcggctctgtgttctcatctacaacacagaaagagataaacaagacctccttccacaaagtggacgagaagagctctagcaagagcttcgaaattgccaaaggctcgggtaccggcgtccttcaaaggatgcccttattgacatcaaagctcacactaacctgcggcgagctctctgagaaccaacacaaaaaaagaaagcgcatgctgtcctcgtcctcagagatgaatgaggaattcctcaaggagaacaattccgttgaatataaaaaatctaaggcggactgcagccggtgcgtgtcatacaatcgggagaagcagctgaagttgaaggagctggaagagaacaaaaagcttgagtgcgaatcctcctgtatcatgaacgctactgggaacccgtatctagacgatattggcctacttcaggctctgaccgagaaaatggtgctcgtctttctactgcagcagggctattctgatggctacacaaaatgggataaactcaagttgtttttcgagctcttcccggagaaaatctgtcatgggcttcctaatctaggtaatacatgctatatgaatgccgtgctccagagtctcctgtcgatacccagcttcgccgacgacctgctgaatcagtcgttcccgtggggtaagatccccctcaacgccctgacaatgtgtctggcaaggctcctcttctttaaggatacctacaatatcgaaatcaaggaaatgctcctgttgaacttgaagaaggcaattagcgcagcagccgagatttttcacgggaatgcacaaaacgacgcacacgaatttctggcacactgtcttgaccagctcaaagataatatggagaagctgaacacaatttggaagcccaagagtgagtttggggaagataactttcccaaacaggttttcgccgacgaccctgacacgagcggattttcctgcccagtgattaccaactttgagctggagctgctccactccattgcatgcaaagcgtgtgggcaggtaattctgaaaacagaactcaacaactatctctctatcaatctccctcagaggattaaggctcacccctccagcatccagtctacctttgacttattttttggtgctgaagaacttgagtacaaatgtgctaaatgcgagcataagacaagcgtgggtgtgcattcatttagccggttgccgaggatcctcatagtgcaccttaagcgctattctctgaatgagttttgcgccttgaagaagaacgatcaggaggtaattatttctaaatatctcaaagtgtcctctcactgtaacgaaggaaccagacccccgcttcccctgagcgaggatggagaaatcaccgatttccagctgttgaaagtcatccgaaagatgacatctggcaatattagcgttagctggccggccaccaaggagtccaaagacatactcgcgccacacattgggtccgacaaggagtctgagcagaagaaaggacagaccgtcttcaagggcgcctcccggcgacagcagcagaagtacctgggtaaaaattccaagccaaacgagttggagtccgtgtactctggagatcgggcctttattgaaaaggagcctctggcccatctgatgacttacctggaggacacttctctgtgccagttccacaaggccggaggcaaacctgcgtcttccccaggcacaccactgagtaaagtggattttcaaactgtccctgaaaatccaaaaaggaagaagtacgtcaaaacgagcaagtttgtggctttcgatcggatcatcaaccccacaaaagatctgtatgaggataaaaatattagaattcctgagagatttcaaaaagtctctgagcagacccagcagtgcgacggaatgaggatttgtgagcaggctccacagcaggccctgccacaatcattccctaaacctggcacgcagggccacactaaaaatctcctacgccccacgaaactcaatctgcagaaaagcaatagaaattcactgctggcccttggttcaaacaagaatcccaggaacaaggacatccttgacaagataaagtctaaggcaaaggaaactaagagaaacgacgacaagggtgatcacacctataggctcatctctgtagtgtcccatctgggcaaaacgctgaaatccggtcactacatttgcgacgcttatgattttgaaaagcagatttggttcacctacgatgatatgagagtactggggatacaagaagcccagatgcaggaagatcgaagatgcactgggtacatttttttctacatgcacaatgagatcttcgaggagatgctcaagagggaagaaaatgctcagctcaatagtaaggaggtggaagaaacgttacaaaaggagtag

SEQ ID NO: 139783 - DNA, 2742 bp, Artificial Sequence
  Description of Artificial Sequence: Synthetic coding sequence
atggccgcgctcttcctaagaggattcgtgcagattggcaattgcaagacagggatcagcaaatctaaagaagccttcatcgaagccgtggaacgtaaaaaaaaagaccgtctcgtgctctatttcaaatccggcaaatacagtacgttcaggctttcagataatattcagaacgtggtgttgaaaagctacaggggaaatcaaaatcacctgcatttaacactgcagaacaacaacggactctttattgagggactttcttcgacggatgccgagcagctgaagatcttccttgatcgggtgcatcagaatgaggttcagcccccggttcggccaggaaaggggggctcagtgttttcgagcacaacgcagaaagaaattaataagacatcattccataaggttgatgagaaatccagctccaagagctttgagatcgccaaaggatccggcaccggtgttcttcagcggatgcctctgctaacttctaagttaaccttgacttgtggagaactgtccgagaatcagcacaaaaagaggaagcgtatgctgagctcctctagcgaaatgaacgaagaattcctgaaggagaacaactcagtcgagtacaaaaagtcgaaagccgattgcagcaggtgtgtgtcatacaaccgcgaaaagcagctgaaattaaaagagctcgaagaaaacaagaagcttgaatgtgaatcaagctgcattatgaacgcaaccgggaatccctacctcgatgacattggattactccaggccttgactgagaagatggtcctcgtgtttctactgcaacagggctactccgacggctacactaagtgggacaaactgaagctgtttttcgagctcttcccagagaaaatctgtcacggcttgccaaacctagggaacacatgttatatgaatgccgtccttcagagcctgttaagtatcccatcctttgcagatgacttgttgaaccagtctttcccttggggtaagatccctctgaacgcattaaccatgtgtctcgcccgcctgttatttttcaaggatacgtataacatagagattaaggagatgcttcttctgaatctcaagaaagcaatttctgccgccgctgagatttttcacgggaatgcacaaaacgatgcccacgaattccttgcccattgtttggaccaacttaaggataatatggaaaagcttaatactatctggaagccgaaatcagaatttggagaggataattttcctaagcaagtatttgctgacgacccagacactagtggattttcctgccctgtaatcacaaacttcgagcttgagttactccactccatagcgtgcaaggcctgcggccaagtgatcctgaagacggagctgaacaattatttgagtattaatctcccacagcggattaaggctcacccatccagcattcagtccactttcgacctgttctttggggcagaggaattggagtataaatgtgccaaatgtgaacataagacctcagttggagtccactctttctcgaggctgcctcgcattcttatcgttcatctcaaaaggtacagtctgaacgagttctgtgctctgaagaaaaatgatcaagaggttataatctctaagtacctcaaggttagcagtcattgcaacgaagggacccgcccccccctgcctttaagcgaggatggtgaaatcaccgattttcagctgctgaaagttatccgaaaaatgacctcaggaaatatcagtgtatcatggcccgcaactaaggaaagtaaggacattttagccccccatatcggctcggataaagaatccgagcagaagaaggggcagactgtgttcaaaggcgccagtagaagacagcagcagaagtatcttggtaagaattccaagcctaacgagctggagagtgtgtactccggagaccgagcttttatcgagaaggaacccttggcccacctgatgacttacctggaagacacgagtctgtgtcagttccataaggccggaggaaagccagcttcgtctcccggaacacctctgtctaaagtcgattttcagactgttccggaaaatcctaagaggaagaaatacgtgaagaccagtaagttcgtcgctttcgaccggatcatcaaccctactaaggatctctacgaagacaaaaatattcgtatcccggaacggttccagaaggtgagcgagcagacacagcagtgtgacggaatgagaatttgtgagcaggcaccccagcaggctctaccccagtccttccccaaaccaggcacccaaggccacactaaaaatctactaagaccaacaaaactaaacttgcagaagtccaacagaaactccctcctggctttgggatcgaacaagaaccctcgcaataaggatatactggacaagatcaagagtaaagcaaaagaaacaaagcggaatgatgacaagggggatcatacgtatcgtttgatcagtgtggtgtcccacctgggcaaaacacttaaaagtgggcactatatttgtgacgcttatgactttgagaagcagatttggttcacgtacgacgatatgcgcgtcctcggcattcaggaagcccagatgcaagaggaccgacggtgcaccggatacatctttttttacatgcacaatgagatcttcgaggagatgctcaagagagaggagaacgcccagctgaatagcaaggaagtagaagaaacacttcaaaaggaatag

SEQ ID NO: 139784 - DNA, 3234 bp, Artificial Sequence
  Description of Artificial Sequence: Synthetic coding sequence
atgacagcagaattacaacaagacgacgcagctggcgcagcagacggtcacgggtcgagttgccaaatgctccttaatcagttgcgggagatcacaggaattcaagatccaagtttcctccacgaggctttgaaagcctcaaatggcgacatcacccaagctgtgagtctcttgactgatgaaagggtgaaggaacctagccaagatactgtagccacagagccttcagaggttgagggctcggccgccaacaaagaggttttggccaaggtgattgacctgactcacgataataaggacgacctccaggctgcgatcgcattatcactgctagaatcccctaagatccaagctgacgggagggacctgaacagaatgcatgaagccacctcggccgagacaaaacggtccaagcgtaaacgatgtgaggtgtggggagagaaccctaatccaaacgactggcggcgtgtcgatggctggcctgtcggactaaagaacgtaggcaacacatgctggtttagcgccgtgatccagtccttatttcagctgcccgaatttcgccgactcgtgttaagttattctttaccacagaatgtgttggaaaactgcaggtcccatacggaaaaacgcaacatcatgttcatgcaggagctccagtatctatttgctctcatgatgggatccaataggaagtttgttgacccctctgcagcactcgacctcctcaagggggcatttaggagttccgaggagcaacagcaagacgtgtcagagttcacccataagcttttggactggctggaggatgcgtttcagttggcggtaaacgtcaactctccgcggaataagtcagaaaatcctatggtgcaactattttatggaaccttcctgactgagggtgtgcgggaagggaagccgttctgtaataacgaaacgttcgggcagtatcctttgcaggtgaacgggtaccgtaatctggacgagtgcctggagggcgctatggtggagggcgacgttgaactgttgccatctgatcactcagtgaaatatggtcaggagcgttggttcaccaaattgccccctgtcttgacattcgaactgtcccgatttgagtttaatcagagcctaggacagccagagaagatccacaacaaactagaatttccccagattatttatatggatagatatatgtaccgctcaaaggaactcatcagaaataaacgcgaatgcataaggaagctgaaagaggaaattaaaatcctccaacagaaactagagcggtatgttaaatacggcagcggcccagcgagattcccattgccagatatgctgaaatacgtgatagaattcgcttctacaaaacccgccagcgaatcctgcccccctgagtccgacacccatatgactctgcctttaagtagtgttcactgctctgtttcagatcagaccagtaaggaatccacaagcacagaaagctcatctcaggacgtggagtcaaccttttcttcacctgaggactctctgcctaagtcaaaacctcttaccagctctagatcatctatggagatgccctcccaacctgcaccacggaccgtgactgacgaggaaatcaacttcgtgaagacttgtctccagcgctggcgttccgagattgaacaggacatccaagatctgaaaacttgcatcgcgagtaccactcaaaccattgagcagatgtactgtgacccactacttaggcaggtcccctatcgccttcacgctgtactggtgcacgaaggacaagctaacgccggtcattactgggcctatatatataatcagcctaggcaatcctggcttaaatataacgacatctcggtaactgagagctcatgggaggaggtcgaacgggactcttatggcggcctgcgcaacgtgtctgcatactgtcttatgtacattaacgataaactgccctattttaacgccgaggcagcaccaactgagtcagaccagatgagcgaggtggaagccctctccgtggaactcaagcactacatccaggaggataactggaggtttgagcaagaagtggaagaatgggaggaagaacaatcatgcaagattccccagatggagagcagtaccaactcatcttcacaggattattcgacgtcacaagaaccttccgtggcatcctcacatggggtcagatgcctgtccagcgaacatgctgtgatcgtgaaagagcagacagcgcaagcaattgctaacaccgcccgggcgtatgagaaaagcggcgtggaggcagccctgagcgaagttatgctctccccagcaatgcaaggcgttatactggcaatagcgaaagccaggcaaacattcgatcgagacggcagcgaagctggcctcatcaaggcgttccacgaggagtacagtcggctgtaccagctcgctaaggagacaccgacatctcattcagacccacggctccaacatgtactggtatatttctttcagaacgaagccccgaagcgggtcgtggaacggacgcttttggagcagtttgctgataaaaatctgtcatacgatgaacgatctatctccattatgaaagtggcacaggcaaaactgaaggagatcggcccggatgatatgaatatggaagaatacaaaaaatggcacgaagattacagtctgtttcggaaggtttccgtctacctgctgactgggctcgagctttaccaaaaggggaagtaccaggaagctttaagctatctagtgtacgcatatcagtccaatgctgccttgttgatgaagggacctaggcgcggcgtaaaagaaagtgttatcgctctgtatcgcagaaagtgcctgcttgaactaaacgcgaaggcagctagcctttttgagaccaacgacgaccacagcgtgactgaggggatcaatgtgatgaacgagctgattattccgtgtatccacctgataataaacaatgatatttctaaggacgacttggacgcgatcgaggtgatgcggaatcactggtgttcgtatttggggcaggatattgcagagaacctccaattatgcctgggcgagtttctgccaagactgctcgatccctccgcggagataatcgttctcaaggagccacctacaattaggcctaattcaccctacgatctgtgctctaggtttgctgccgtgatggaaagcatccagggcgtatccaccgtgactgtcaagtag

SEQ ID NO: 139785 - DNA, 3138 bp, Artificial Sequence
  Description of Artificial Sequence: Synthetic coding sequence
atgaccgccgaactccagcaggacgatgcagcaggcgcggccgatggccacgggagcagctgccagatgcttctcaatcaactccgggaaatcacagggattcaggacccatctttcttacacgaggcactcaaggctagtaacggtgacatcacacaggccgttagtctgctgaccgacgaacgggtgaaggaaccatcacaggacactgtggcaacagaacctagcgaggtggaaggctctgcggcaaacaaggaggtcctggccaaagtcattgatctgacccatgacaacaaagatgatctccaggcggccattgctctgtccctactggagagtccaaagatccaggctgacggccgcgacctgaatcgtatgcacgaagctacgtctgctgagacaaagaggtccaagcggaaacgatgcgaggtctggggagagaatcccaatcccaatgactggcgcagagtggacggatggcccgtcggcctgaagaatgtgggcaatacttgctggttttctgccgtgatccaatctctgtttcagctgcccgaattccgtcgcttggtcctgagctactccctgccgcagaatgtcctggaaaactgcagatctcacactgagaagcgcaacataatgttcatgcaggaactccagtatctgtttgcactgatgatggggtccaacaggaaattcgtcgatccctctgccgccctggacctgcttaagggtgcctttcggtcatctgaggaacagcagcaagacgtcagcgagttcacgcacaaactcctggactggttggaggacgcattccagttggctgtgaacgtgaactccccgagaaataaaagtgaaaatccaatggttcagctgttttatgggacattcttgaccgagggagtgagggagggtaaaccgttttgcaacaacgagaccttcggccagtatccgctccaggtgaacggctaccgtaacctcgacgagtgtttagagggagccatggtggaaggagacgtggagctgctgccatccgaccactctgttaaatacggtcaggaacggtggtttacaaagctcccccctgtcctcacttttgagctttccagatttgaattcaatcaaagcctgggacagccagagaagatccacaataaactcgagttccctcagatcatatacatggaccggtatatgtacagatcgaaggagttgatccggaataaacgggaatgcattcgcaagctcaaagaggaaatcaagatcctgcagcagaaattggagcggtatgttaagtacgggtcaggcccagctaggtttcccctgcctgatatgttgaagtacgtcatcgagttcgccagtacaaaacccgcctccgaatcatgcccgcctgagtcggatacacatatgacgctcccactaagcagcgtccactgctccgtgtctgatcagacttccaaagagagtacctcaacagaaagcagcagccaggacgtcgaaagtacattctcgagcccagaggactcgttgcccaagtccaaaccactgactagttctcgtagttctatggaaatgccctcgcagccagccccacgcactgtgaccgacgaagaaattaatttcgtgaagacgtgcctccagcggtggcgctccgagatcgaacaagatattcaggatctcaagacatgtatcgccagcacaacacaaacgatcgagcagatgtattgcgatccactcctgaggcaagttccgtaccggctccacgccgttctcgtgcacgaaggccaggctaacgctggacactattgggcctacatctataatcagccccggcagagctggctaaagtacaatgacatcagcgtcacagagagcagttgggaagaagtggagagagatagctatggcgggctcaggaacgtgagtgcttattgtctgatgtacattaatgacaaattaccgtatttcaacgccgaagctgctcccactgagtccgaccagatgtcagaagtggaggccctcagcgtcgagctgaaacattacattcaggaggacaattggcgcttcgagcaggaagttgaagaatgggaggaagagcagagctgtaaaattccccagatggaatcctccacaaatagctcaagtcaagactactctacatcccaagaaccaagcgtcgcctcaagccacggagtgcgctgtttatccagtgagcatgccgtgatagtgaaagaacagaccgcgcaggccattgctaatacggccagagcctatgaaaaatcgggtgtagaggcagccctgtctgaagcttttcacgaggagtattccagactgtaccaactggccaaagagactcctacctcccactctgatccccggttacaacacgtgttggtgtatttcttccagaacgaggccccgaagagggtcgtggagaggaccttgctggagcagttcgctgacaagaacctatcgtacgacgaaaggtctatctcaatcatgaaggtggcccaggcaaagctaaaagagataggtccagacgacatgaatatggaagagtacaaaaaatggcacgaagactacagtctgtttcgcaaggtcagcgtttacctgttgacaggcctggagttgtaccagaaagggaagtatcaggaagccctgagctacctggtgtatgcctaccagagtaacgccgctttgcttatgaaaggaccccgaaggggtgtgaaagaatctgtcatagcgctgtaccggcgtaagtgtctgctggagctgaacgccaaggcggcatcacttttcgagaccaatgacgaccatagcgtaacggaaggtatcaacgtaatgaacgagctgattattccatgtatccacttgatcatcaacaacgatataagtaaggacgatctagacgctattgaggttatgcgaaaccactggtgttcttacctgggacaggacatcgcggagaatcttcagctatgtctgggcgagttcctgcccagattattagacccgtccgccgagattatcgtgcttaaagagccaccgactattcgccccaattcgccttacgatctgtgttctcggtttgccgctgtgatggaaagtattcagggcgtcagcaccgtaactgttaaatag

SEQ ID NO: 139786 - DNA, 1497 bp, Artificial Sequence
  Description of Artificial Sequence: Synthetic coding sequence
atgcagtcacccccccacctggctgtgtgtcgaagtaacaaatctccgtgggtttgccttacgtgcagctctgtacattgtgggagatatgtgaatggccacgcaaaaaaacactatgaggacgcacaagttcctttgaccaaccacaaaaagtccgaaaagcaggacaaggtgcagcacaccgtctgtatggattgctcttcctattctacgtactgctatcgttgtgatgacttcgtggtgaatgacactaagctcgggctggtgcagaaagttcgcgaacatctccagaatctggaaaattcagccttcacagcagatcgccacaagaagagaaaactgctggaaaactccacactaaacagcaagctgctaaaagtgaacggtagcaccacggcaatctgcgctaccggtctgagaaatctgggcaatacttgctttatgaacgcaatactgcagtctctaagcaacattgagcagttctgttgttattttaaggaactgcccgctgtggaactacggaacggcaagactgccggaaggcggacatatcacacccgcagccagggcgataataacgtctcccttgtcgaagagttccgcaaaacgctgtgtgctttgtggcaaggatcacagacggctttctctcctgagtctctgttttatgtcgtgtggaaaattatgcctaatttccgagggtatcagcagcaagatgcccacgagtttatgagatacctgctagatcacctccacctggaactgcagggcggattcaatggggtgtccaggagcgccatacttcaggagaactcgaccctctccgcctccaacaagtgctgcattaatggcgcaagcaccgtagtgaccgcgatattcggagggatcttgcagaacgaggtcaactgcctcatctgcggtactgagtccaggaaatttgacccctttctcgacttgtcccttgacattccctcacagttccgttcaaagagatctaaaaaccaggagaacggacctgtctgctccctgcgagactgcctgaggagtttcacagatttggaggagctggacgaaacagagttatacatgtgccataagtgcaagaagaagcagaagagcactaagaaattctggattcagaagttaccaaaggttctgtgccttcatttgaaacgctttcactggactgcatatctgcggaacaaggtcgacacctacgtcgagttcccccttagagggctcgacatgaaatgttatctgctggaacccgagaattctggccctgagtcatgcctgtacgacttagctgcagtggttgtgcaccacgggagcggcgtcggatcaggccattacacagcctacgctacccacgagggaagatggtttcattttaatgatagtaccgtcacgctcactgatgaggagacagttgtcaaggccaaggcatacatattgttctacgtagagcaccaggctaaggctggcagtgataaactttag

SEQ ID NO: 139787 - DNA, 1563 bp, Artificial Sequence
  Description of Artificial Sequence: Synthetic coding sequence
atggagtgtcctcacctcagtagttctgtgtgcatcgcacccgacagcgccaagtttccaaacggcagcccaagctcctggtgttgctcagtctgtcgctctaacaaatccccgtgggtgtgccttacctgtagttcagtacactgcggacgctacgttaatgggcacgccaagaagcattatgaagacgcacaggtgcccctgaccaatcacaaaaaatccgaaaagcaggacaaagtacaacacaccgtatgtatggattgttcttcctattccacatactgttacagatgtgacgacttcgtcgtgaatgatacaaagttgggccttgtccaaaaggtccgggagcaccttcagaatctggagaactctgcatttaccgccgataggcacaagaagcgtaagttgttggaaaactccacgctgaattcaaaactgctcaaggtgaatggatctaccacagcaatatgtgccaccggtctccggaatctgggcaacacatgctttatgaatgctattcttcagtccctgtccaatatagagcaattttgctgctactttaaagagctcccggccgtagaattgaggaatggcaagactgccggcagacgaacctaccacactagatcacagggtgataacaacgtgtccctggtagaggagttccggaaaaccttatgcgccctgtggcaaggcagtcaaacagccttctctcctgagtctctgttctatgtggtttggaaaataatgcccaattttcggggataccaacagcaagatgcacatgagttcatgagatatctcctcgatcatttacacctggaactccagggaggcttcaatggcgtatcccggtccgccattctgcaagagaactcaacattgtccgcttccaacaagtgttgtattaacggtgcctctaccgtagtgaccgccatctttggcggaatcctgcagaatgaggttaactgcttgatttgcggaacggagtctcgtaaatttgacccgttccttgacctctctctcgacatacccagccagtttcggagcaagcgctcgaagaaccaagaaaacggacctgtctgtagcctcagagattgtttaagaagcttcacggacctggaagaacttgacgagaccgaactgtacatgtgtcataaatgtaaaaagaaacagaagtccaccaagaagttctggatccaaaaacttccaaaagtgctctgtctccacctaaagaggtttcactggactgcttacctccggaacaaagtggacacatacgtggagttccctttgaggggtctcgacatgaagtgctacctcctggaacctgaaaactctggccccgaatcctgtctgtatgacctagcggcggtggtggttcatcatggctctggagtcgggtccggccactacaccgcctacgcaactcatgaaggaaggtggttccattttaatgatagcacagtgactcttacagacgaagagactgtagtgaaagcaaaagcttatatcctgttctatgtcgagcatcaggccaaggccggatctgataaactgtag

SEQ ID NO: 139788 - DNA, 471 bp, Artificial Sequence
  Description of Artificial Sequence: Synthetic coding sequence
atggagtgcccccacctgtcctctagtgtctgtatcgctccagatagtgcaaagtttcccaatggctctccgagcagttggtgctgttcagtttgtagaagcaataagagtccatgggtctgcttaacttgctcatctgtgcactgcgggcggtacgttaatggtcacgcaaagaagcactacgaggacgcacaagtgccactgactaaccacaagaagagcgagaaacaggataaagtgcagcatacagtctgtatggattgcagttcctattctacctactgctataggtgcgatgactttgtggtgaatgacacaaagttaggtctggttcagaaggtgagagagcatctccagaacctcgagaacagtgcattcaccgctgacaggcataaaaaacggaagctcctcgagaacagtactctcaactccaaactcttgaaagtgaatgtgtttggaagacgcgtatag

SEQ ID NO: 139789 - DNA, 1071 bp, Artificial Sequence
  Description of Artificial Sequence: Synthetic coding sequence
atggactgctctagttacagcacctattgttacaggtgtgatgactttgtcgttaatgacacaaagctgggacttgtgcaaaaagtgagggaacatctacagaatctcgaaaactccgccttcaccgcagaccgccacaagaaaaggaaattgctggaaaactctactctgaattccaagctgcttaaagtcaacggctctaccacagctatctgtgctaccggactccgaaacctgggcaacacatgctttatgaatgcaatcttgcagtcactcagcaacatcgagcagttttgttgctacttcaaggagctacctgccgttgagctccgtaatggaaaaaccgcgggcagacggacttaccacactcggtcccaaggagacaacaacgtatcacttgtggaagagttcagaaagacactgtgcgccctgtggcagggctcccagaccgcattctctcctgagtcactcttctatgtggtgtggaagattatgcctaattttcggggataccagcagcaagatgcccacgagtttatgcgatacctcctggatcatctccatttggagttacaaggtggatttaatggcgtctcccgctcagctatactgcaagagaactccacgctgagcgcctcaaacaagtgttgcatcaacggcgctagcacggttgtgaccgctatatttgggggaatcctgcagaatgaggtgaactgcctgatctgtggcactgagtcacggaaattcgatccctttctcgacttatccctggatatacccagtcagttccggtcaaaacgaagcaaaaaccaggagaacggaccagtttgctcccttcgtgactgtttacgttcctttaccgatctggaagagctggacgagaccgaactgtacatgtgccataagtgtaaaaagaagcagaaatcaacaaagaaattctggatccagaagttgccaaaagtgctgtgtctgcaccttaaacggttccattggaccgcctatcttcgcaacaaggtggatacatacgttgagtttcctctcaggggcctggacatgaagtgctattattag

SEQ ID NO: 139790 - DNA, 816 bp, Artificial Sequence
  Description of Artificial Sequence: Synthetic coding sequence
atgcccaattttaggggctaccagcagcaggacgcccatgagttcatgagatacctgttagaccatctccacctggaactgcagggaggatttaatggggtgagccgtagcgccattcttcaagagaactccacactgagtgcctcgaataagtgttgcattaatggggcttccacagttgttacagcaatttttggcggcatactgcaaaacgaggttaactgccttatttgcggaacagaaagccgtaaattcgaccccttcctggacctcagcctggacatcccttcccagtttcggtccaaacgctccaaaaatcaggaaaacggaccagtgtgcagtctgagggattgcctcagaagcttcacagacttggaggagctggacgaaacagagctctatatgtgccacaaatgtaagaagaaacagaaatccacgaagaaattctggatccagaaactgcccaaagtcttatgtctgcacctgaaaaggttccattggacagcttacctcaggaacaaggtggacacttacgtggaattccctcttcgaggccttgatatgaagtgttacctgctagaaccagagaatagcggacctgaaagttgcctttatgatttggctgccgttgtggtgcaccatggatcgggcgtgggctcaggacattacactgcctacgctacccacgagggcaggtggtttcatttcaacgacagcacggtgaccctgacagacgaagagaccgtagtaaaggccaaagcttacatactgttttacgtggagcaccaggcaaaggccgggagtgacaagctttag

SEQ ID NO: 139791 - DNA, 1431 bp, Artificial Sequence
  Description of Artificial Sequence: Synthetic coding sequence
atggaatgcccacatctcagttcaagcgtgtgtatcgcgcctgactccgccaagttccctaatggctccccctcttcatggtgctgctcagtgtgcagaagcaacaaatccccatgggtctgtctgacttgctcttcagtgcactgtggatcttacaggtgtgacgattttgtggttaacgatacgaaactggggctcgtgcagaaagtccgtgagcatctccaaaacctagagaacagcgccttcaccgccgacaggcataaaaagcggaagctgctggagaattccaccttaaacagcaagcttctgaaagtcaacgggtcgaccacagctatatgcgcaaccggactgaggaacctcggaaacacatgctttatgaacgctatattgcagtccctcagcaatatcgaacagttctgttgttatttcaaagagctcccagctgtggagcttcggaacggcaagactgctggaaggaggacttatcatacccgttcccagggagacaataacgtatcgctcgtcgaggaatttagaaaaaccctctgcgcactctggcagggaagtcagacagctttctctcccgaatcccttttctatgtggtgtggaagattatgcctaattttaggggctatcagcagcaggacgctcacgagttcatgaggtatctgttagaccacctccatttagagctgcagggcgggtttaatggtgtgagccgatctgctatcctccaggaaaattctacgctgtccgcatctaataagtgctgcatcaacggagcctctaccgtggtcactgctatctttgggggaattctgcagaatgaggtgaactgcctcatctgcggtactgagagtcgcaaatttgatccatttctggacctgagcctggatatacccagtcaatttcgatccaagcgtagtaagaaccaggaaaacggcccagtgtgcagccttcgggactgcctgcgctcttttactgatcttgaggagctcgatgaaacagaattgtatatgtgccataaatgcaagaagaaacagaaatctactaaaaaattctggattcagaaattacctaaggtgctgtgtttgcatcttaaacgttttcattggaccgcctatctgcgcaacaaggtcgacacttatgtggagtttccactgcgaggcttagatatgaagtgctacctcctagaacccgagaatagtgggcctgagagttgcctttacgacctggctgcagtagtggtgcaccacgggtcaggcgtgggtagtggccattatacggcttatgctacgcacgaagggagatggtttcatttcaatgattctacggtcactctgacagacgaagagacggtggtgaaagctaaagcatatattcttttctacgtggagcatcaggccaaagccggatctgacaaactgtag

SEQ ID NO: 139792 - DNA, 168 bp, Artificial Sequence
  Description of Artificial Sequence: Synthetic coding sequence
atggagtgcccacatctgagttcaagtgtctgcatcgcaccagacagtgccaagtttcctaacggaagcccttcaagttggtgctgctctgtgtgtagatcaaataaatcaccttgggtttgtctaacgtgctcctctgtccattgtgggaggatctggggcacctag

SEQ ID NO: 139793 - DNA, 1554 bp, Artificial Sequence
  Description of Artificial Sequence: Synthetic coding sequence
atgttaagcagccgggctgaagctgcaatgaccgccgccgacagggcaatccagcggtttctgaggacgggggccgccgtgcggtataaagttatgaagaattggggcgtaatcggtggaatcgctgcggccttggccgccgggatctatgtcatttggggacccataacagagcgcaagaaaagaagaaaggggctcgtgccaggtctagtgaacctggggaacacatgttttatgaattccctgcttcaagggctgtcagcctgtcctgcctttattcgctggctggaggaattcacaagccagtattcgagagaccaaaaagaaccaccatcccatcagtacctgtcactgaccctgctgcatctcctgaaggctctgtcatgtcaagaagtgacagatgacgaggtgctagacgcctcctgcctgctggatgtgctcagaatgtaccggtggcagatctcttccttcgaggagcaggatgcacatgagcttttccacgtgatcacatcatcacttgaagacgagcgagatcggcagccacgagtcacccacctgttcgacgtgcattcactggagcagcagagcgaaatcacccccaagcaaattacgtgtcggacacgcggtagcccccacccaacttccaaccactggaaatcacagcatccctttcacggaagactcacatcaaacatggtgtgcaagcactgtgaacaccagtcaccagtgcgcttcgacacattcgattctttgtccctatctatccctgcggcgacttggggccacccacttactctggaccactgcctgcatcattttatctctagtgagagcgtacgtgatgtcgtctgcgacaactgtacaaaaatcgaagccaaaggaacactcaacggggagaaggtggaacatcaaagaacaacttttgtgaagcagctaaagctgggcaagttgcctcaatgtttatgcatccatctgcagcgactgtcctggagctcccacggcacgccactgaaacggcatgagcacgtgcagtttaacgaattcctgatgatggacatttataagtatcacctgcttggtcataagccttctcaacataatcctaagctcaacaaaaaccccgggcccaccctggaacttcaggacggccccggagcccccacccccgtgctgaaccaacccggtgcccccaagactcagatcttcatgaatggggcctgtagtccatccttactgcccacgctgtctgcccccatgccgttcccactgccagttgtgcctgactattcatcaagcacctacctgtttaggctaatggctgtagtggtacatcacggcgacatgcattccgggcatttcgtgacgtataggcgctccccaccaagcgcgcggaaccctttatccacgtcaaaccagtggctctgggtaagtgatgacacggtgcggaaagcttctcttcaagaagttctgtcgtcatccgcatacctcctcttctacgaaagagtcctgtctaggatgcagcaccagagccaagagtgcaagtcagaggagtag

SEQ ID NO: 139794 - DNA, 4815 bp, Artificial Sequence
  Description of Artificial Sequence: Synthetic coding sequence
atgggggccaaagaatcgcggatcgggtttttatcctacgaggaggctctgcgacgggtgaccgatgtagagctgaagcgacttaaagatgcgttcaagcgaacctgtgggctgtcctactatatgggtcagcattgtttcattagagaagtcctgggagatggggtgcccccaaaggtcgccgaagtgatttattgtagctttggcggcacctcaaagggtttacactttaacaacctaatcgttggcctggttttgctcaccagaggaaaagacgaggaaaaagccaagtatatcttttccctgttctcatcagaatctgggaactacgttatccgggaggagatggagaggatgctgcatgtcgttgacggcaaggttccagatacgctacgcaagtgtttttctgagggggaaaaggtgaactacgagaaattccgaaattggttattcctcaacaaagatgctttcactttttcacgatggctactgagtggtggggtttatgtgacactcacagacgatagtgatacacccactttctaccagactctggccggcgtcacgcacctggaggagagcgacataattgatctcgagaagaggtactggttactgaaggctcagtcccgcaccgggagatttgatcttgagacgttcggaccactggtatcccctccaattaggcctagcctaagcgagggattgttcaacgcattcgatgaaaatagagacaaccatattgacttcaaggaaatctcgtgtgggctgtctgcatgctgcagaggtccgctggcggaaagacagaaattttgtttcaaggtgtttgatgttgaccgagatggggtcctgtcacgcgtggagctacgagatatggttgtagcacttctagaagtgtggaaggacaaccgcaccgacgatattccagaactgcacatggacctgtctgacatcgtcgagggtattctgaacgcacatgatacaactaagatgggtcatctgactctagaggactaccagatttggagcgtaaagaatgtgttggcaaacgagtttctcaacttgcttttccaagtttgccacatcgtgttgggtctgcgacccgcaacacctgaagaggaaggccaaatcatccgggggtggctggagcgcgaaagtcggtacggtctgcaggccggacacaactggtttatcatttcgatgcaatggtggcaacagtggaaggaatacgttaagtatgacgccaatcccgttgtaattgaacccagtagtgtgctaaacggcggaaaatacagctttggaaccgcagctcacccaatggaacaggttgaagatcgaataggctcctccctttcatacgtgaatacaactgaagaaaaattctccgataacatctctactgccagcgaggctagcgaaacagctgggtccgggtttctgtatagcgcaaccccaggcgctgacgtatgtttcgccagacagcataatacctcagataataataatcagtgcctcctcggcgccaatggtaacatactactccacctgaatccacagaaacccggagcaatcgacaaccagccgctggttactcaggaaccagtgaaagcgacttccttgactctcgaaggcggtcgccttaaaaggactcctcagcttatacatggtagggactatgaaatggtgccggaaccggtgtggagagctctttatcactggtacggcgcaaacctggccttgccaaggcccgtgataaaaaatagtaaaaccgatattcccgaactggaactcttccccaggtacctgctgtttcttagacagcagccggccaccagaacacagcagtccaacatttgggtgaacatgggtaacgtaccatctcccaacgcccctctgaaacgggttctcgcatataccggttgcttcagccggatgcagaccattaaggaaatccacgaatatctctctcaaagacttaggatcaaggaagaagatatgcggctgtggctgtataacagcgagaattacctcacacttttggacgatgaggaccacaagctggaatatctcaagatccaggacgagcagcatctggtgatcgaggtgagaaacaaggatatgtcgtggcctgaggaaatgtctttcattgccaactcttccaaaattgacaggcacaaagtccccaccgaaaagggcgctactggcctttcaaatttaggaaatacttgctttatgaacagctcaattcaatgcgtctccaacacccagcccttgacccagtactttattagcggtcgacacctgtacgaactgaatcgcacaaaccccattggcatgaagggacatatggccaaatgttatggcgaccttgtacaggaactgtggtccggtacacagaagaacgtcgcaccactgaagttaaggtggacaattgccaaatacgctccccgattcaacggatttcagcagcaagactcacaggaactgctggctttcctcctagacgggcttcatgaggatctgaatcgagttcacgagaaaccatacgtggagctcaaagactccgacggtcgacccgattgggaagtggccgcggaggcgtgggataaccacttacgcaggaatagaagtatagtggtagacctcttccacggtcagttacggtctcaagtgaagtgcaagacttgtggacatatcagtgttcgctttgatcctttcaatttcctttcactgcctctaccgatggacagttacatgcaccttgagattaccgtgatcaagttagacggcacgacgcccgtgcgttacggattacggctaaatatggacgaaaaatatactggtcttaagaagcagctatccgacctgtgcggtctgaattccgaacagatcttactggccgaagtccacgggtcaaatatcaaaaattttccccaggataatcagaaggtgcgactgtcggtgtctgggtttctgtgtgcctttgagattcctgtgcccgtgtctccaatctctgcaagcagcccaacacagacggatttcagttcctccccgtctaccaacgagatgttcacccttacaacaaacggcgatctgccgcgtccaatcttcatacccaatggtatgccaaatacagttgttccttgtgggacagaaaagaattttacaaatggtatggtcaatggtcacatgcccagcttgcctgactctccctttacaggctatataatagccgtgcataggaagatgatgaggactgagctgtattttctcagctcacagaaaaaccggccctcgctgttcgggatgcctctgattgtgccatgtactgtacacacaaggaagaaggatttgtacgatgctgtatggatccaggtctctcgcctggccagcccactcccacctcaggaagcttctaatcacgcacaagactgtgacgatagtatgggctaccagtaccccttcacgctacgtgttgtccagaaagacggaaactcctgtgcttggtgtccatggtacagattttgtcgaggctgtaagattgactgcggagaggatcgggcatttatcggcaatgcttacatcgctgtcgattgggatccaacagctctccatctgcgataccagaccagccaagaacgggtggtggacgaacacgagagcgtcgagcagagccgtagggctcaagccgagcccatcaatctggattcttgtctgagggcattcacatccgaagaggagcttggggagaacgagatgtactattgctctaagtgcaagactcattgcttggctacgaagaaactggacctctggcgcctgcctccgattctcatcatccatctgaaacgcttccagttcgtgaatggacgttggattaaaagtcagaagatcgtgaagtttccacgagaaagcttcgacccttcagcttttcttgttccgcgcgatccagccttatgccagcataagccgcttaccccccagggcgatgagctgtctgagccgaggattctggcccgcgaagtgaagaaagtggatgcgcaatcgtccgctggagaggaagatgtgttgcttagtaaatcccccagctctctgagcgctaatatcatttctagcccaaagggctctccttcctcgtctaggaaatctggtacatcatgccccagtagtaaaaacagttcccccaactcaagcccacggacgttgggacgtagcaaaggcagactgcggctcccccagattgggagtaagaacaagctttccagctcaaaggagaatttggacgccagcaaggaaaatggtgctggacagatttgtgagctggcggatgctctgagccgcggacacgtcctaggaggaagtcagccagaacttgtcaccccccaggaccacgaagtggctctggctaatggcttcttatatgagcatgaagcatgcgggaatggttatagcaatgggcagttgggtaaccactccgaagaagatagcaccgacgatcagagagaggatacccgaatcaaaccaatctacaatctatacgctatttcatgtcatagcgggattctcggcggcgggcactacgtgacatacgccaagaacccaaactgtaagtggtactgctataacgacagctcttgtaaggaactgcatccagacgagatcgacaccgactcagcctacatcctgttctatgagcagcagggcattgattatgctcagtttcttccaaaaactgacggaaagaagatggctgacactagctccatggatgaggactttgagagtgattataagaagtattgtgttctgcagtag

SEQ ID NO: 139795 - DNA, 1173 bp, Artificial Sequence
  Description of Artificial Sequence: Synthetic coding sequence
atgggcgctaaggagtctcgcattgggtttctgagctacgaggaagctctgagacgggtcaccgacgtcgaactgaaaaggttaaaggacgcattcaagcggacttgcggtctcagttactatatgggccagcattgcttcatacgagaggtgctgggcgatggcgtcccccctaaagttgcagaggttatctactgtagttttgggggcacctccaaaggcctacattttaataaccttattgtcggtctggtgctactcactaggggtaaagatgaggaaaaggccaagtacattttttcgctctttagctctgagtccgggaattacgtgatccgcgaggagatggagcgcatgctgcacgtggtggacggaaaagtgccagatacgctgaggaaatgttttagcgagggcgagaaagtcaactacgaaaagtttaggaattggcttttcctgaacaaagatgcatttacgttctctcgctggctgctgtcgggcggggtctacgtgacgctgaccgatgactcagacacacctaccttctatcagaccctcgcaggtgtgactcatttagaagagtctgatattatagacttggagaaacgctactggcttctgaaggctcagagccgcaccgggcggtttgatttagagacctttggccccttagtaagcccccctatcagaccttccctctctgagggactgttcaacgcctttgatgagaaccgggataaccatatcgactttaaggaaattagttgcggactgagtgcctgttgtagaggtccactcgcagaacggcagaaattttgcttcaaggtgttcgatgttgatcgcgacggggttctgagccgagtcgaactgcgcgacatggtggtagctctgctagaggtctggaaagataatagaacggacgacatacctgaactgcacatggatctgtcagacatcgtggaggggattctgaacgcccacgacactactaagatgggccatctcacgctagaggattatcagatctggtctgtaaaaaatgtgctagccaatgagttcctcaatcttctctttcaagtatgccatattgttcttggcctacggcccgctacccccgaagaggagggtcagatcataaggaccctcgagacagatcaaatctacacccggaactag

SEQ ID NO: 139796 - DNA, 3372 bp, Artificial Sequence
  Description of Artificial Sequence: Synthetic coding sequence
atgcccattgtggacaagctcaaagaggcactgaaacccggccgaaaggattccgcagacgacggggaacttggaaaattactagccagtagcgccaagaaggtactcctccagaagatagagttcgagccagcctctaagtctttcagctaccagttggaggccctgaaatccaaatatgtcctgctcaatccaaagacagagggagcttcccgtcataagagtggagatgatcccccagcccggcgccaaggatcagagcacacatacgagagttgcggtgatggcgtaccggcaccgcagaaggtcctgtttccaactgagaggctttcgctgagatgggagagagtgtttcgggtaggagcaggcctccacaacttggggaacacttgttttcttaatgcaaccatccagtgtttgacatacacgccccccctggccaactatttgctgtccaaagagcatgctcgatcttgtcaccagggtagcttctgcatgctgtgcgtcatgcaaaatcatattgtccaggccttcgcaaacagcggaaacgctatcaagcccgtgtcattcatacgcgatctgaagaagattgctcgccattttcggttcgggaaccaggaggatgcccacgagttcctccggtacacaattgacgccatgcaaaaagcttgtctaaatggctgtgctaagcttgatcggcagacccaagcgactactcttgtgcatcagatttttggcggatatctgagaagccgcgttaaatgctccgtctgcaaatccgtgagcgatacgtatgatccatatctggacgtggcactggagattcgccaggccgcgaatattgtccgggcccttgaactgtttgtaaaggcagatgtccttagcggtgagaacgcctacatgtgcgctaaatgtaagaagaaggtgccggcttcaaaacgtttcacaattcatcgcacgtccaatgtcttaacactctcactcaagcgtttcgcaaatttcagtgggggtaaaatcacaaaggatgtcgggtaccctgagtttttgaatatccgaccttacatgtcccagaataacggcgaccccgtgatgtacggcctgtacgctgttctagtccacagcggctatagttgtcatgccggacattactattgttacgttaaggccagcaacggccagtggtaccagatgaatgacagcttggtccattcctccaacgtgaaagtggtgttaaaccaacaggcatatgtgctgttctacctgagaattcccggcagtaaaaagtcccctgagggtctgatcagccgtaccggtagctcctctcttcctggacggcctagtgtcattccggatcactcaaagaaaaacatcggcaacggaatcattagctctccgctaaccggcaagagacaagatagcgggactatgaaaaaaccccacaccacagaggagatcggagttccgatctctcgaaacggttctactttggggctcaagagccagaatggatgtattcctccaaagttaccttctggttcgccgtcccccaagctcagccagactcctacccatatgcccactatcctggatgaccccgggaagaaggtgaagaagcctgcaccgccacaacatttcagtccaaggacagctcagggcctgcccggaaccagcaacagcaattcttcacgatcaggctcgcagagacagggttcatgggactcccgagacgttgtgctgtccacatctccaaagcttctggcaaccgcaactgcaaatggacatgggctgaaaggcaacgacgagtccgctggccttgaccgccgcggcagttcctctagctcccctgaacattcagcatcttccgactccaccaaggccccccaaacgcccaggagcggggccgctcatctgtgtgactcgcaggagaccaactgctccacagctggacacagcaaaaccccgccctccggggctgacagcaaaacagtcaagttgaagtcgccagtgctgagcaatacgactactgagccggcttcgactatgtccccaccgcccgcgaaaaagcttgccttgtcagccaagaaagcctctacgctgtggagggcgactggaaatgatctgaggcctcccccacccagcccttcatccgatctgacccatcccatgaagacctctcaccctgtagtggcctccacttggcccgtccaccgggccagggcagttagtccagcgccccagtcgtcctctcgactgcagccaccctttagcccacaccccacattgctcagcagcacaccgaagcctcctggcacctccgaacccagatcctgttcttctattagtacagccctgccgcaggtaaacgaggatctggtcagcctgcctcaccagctgccagaagcatctgaacctccccagtcaccctctgagaagcggaagaaaaccttcgtcggagaaccccagcgcctcggaagcgagacccggctgccacagcacatacgcgaagcaacggcagcaccacatggaaaaagaaaaaggaagaagaagaagcggcctgaagatactgccgcatccgctctccaagaaggacagacccagagacagcctggtagccccatgtatagacgggaggggcaggcccagcttccagcagtgagacgacaggaagatgggacccagccacaggtcaatggacaacaggtgggctgcgtgaccgatggccaccacgcaagcagtagaaagcgccggcgtaagggagctgaggggctgggagaagagggcgggctgcaccaagacccactccgacactcatgctcccctatgggtgatggggaccctgaggccatggaagagtcacctaggaagaaaaagaaaaaaaaacggaagcaagagacacagcgggcagtggaggaggacgggcacctgaagtgtccaaggtcagctaaaccccaagatgcagtggtcccagaatcatcttcgtgtgcaccttctgcaaacggctggtgtcccggcgaccgcatggggctgagccaggctccacctgtctcctggaatggcgagagagagtcagatgttgtgcaggagttgttaaagtatagtagtgacaaggcatatggtcgtaaggtactgacttgggacgggaagatgagtgcagtgagccaggacgccattgaggatagccgacaggcccggacggaaaccgtggtggatgattgggacgaggaatttgatcggggcaaggagaagaagattaagaagttcaagagagaaaaacggcggaacttcaacgcttttcagaagctgcagacaagaagaaacttctggtctgtgactcatcccgcaaaagctgcctccttgtcctacaggcggtag

SEQ ID NO: 139797 - DNA, 1647 bp, Artificial Sequence
  Description of Artificial Sequence: Synthetic coding sequence
atgccgatcgtcgacaaactgaaagaagccctaaagcccggtaggaaggatagcgccgacgatggggagctcggcaagttactcgcatctagtgctaagaaggtgctgctacaaaagatcgagttcgaacctgcctccaagtctttttcgtaccaactggaagcactgaagtctaaatacgtgctcctgaatcccaaaacagaaggggcatctcgtcacaagtctggagatgacccgccagctcgaaggcagggctctgagcacacttacgagtcttgtggcgacggcgtgccagcaccacagaaggttctcttccccacagagcggctgtcactgcgatgggagcgagtgtttagggtgggcgcaggactccataatcttgggaacacatgcttcctgaacgctacgattcagtgcctcacctacaccccgcctctggccaattacctcttgtcaaaagagcatgcaagatcctgccatcaaggcagcttttgcatgctgtgtgttatgcagaaccatatcgttcaggccttcgccaacagcgggaacgcaatcaaaccagtgtccttcattcgcgatctaaaaaaaatcgccagacattttcggttcggaaatcaggaggacgcacatgagtttcttagatacaccatcgatgcgatgcagaaggcatgtctgaatgggtgtgcgaaactggacagacagactcaggcgactacactggtccatcagatctttggaggatatctgagatccagagtgaaatgctcggtctgcaaatccgtctcagacacatatgacccatatctggacgtcgccctcgagatcaggcaggccgccaatatcgttcgcgcattggaattgttcgttaaagccgacgtgttgagcggtgaaaacgcatacatgtgcgctaagtgtaagaagaaggtgccagcctccaagcgtttcactattcaccgtacctctaacgtgctgaccctgtctcttaaacgtttcgctaacttcagtgggggcaaaattaccaaggatgtggggtacccagagttcttaaatatccgtccctatatgtcacaaaacaatggggaccccgtcatgtacggactctacgcagtgctcgtccattctggatattcctgccatgccgggcactactattgctatgtgaaagcctcaaatgggcaatggtaccagatgaacgatagccttgtccattcatccaacgtaaaggtggtccttaaccagcaagcgtacgtactattttatctcaggatcccaggaagcaagaaatcccctgagggcctcatttcacgcaccggatccagtagcctaccagggcgcccctccgtgatccccgaccacagcaagaaaaacatcggcaatggcattattagtagcccccttactggcaagcggcaggactccggaactatgaaaaagccgcacacaactgaagagattggtgtcccaatctcccgaaacggctctactctaggcctgaagtcccaaaatgggtgtatcccccccaaactgccctcaggaagccctagtcccaagttgtctcaaacacccactcacatgcccaccatcctcgacgaccccgggaaaaaagtgaagaaaccggcccctcccctgcccacaggtatgggctag

SEQ ID NO: 139798 - DNA, 2187 bp, Artificial Sequence
  Description of Artificial Sequence: Synthetic coding sequence
atgtgcgccaaatgtaaaaaaaaggttccagcctccaaacggttcaccattcatagaacctcaaacgtgctgacgttatccctgaaaagattcgccaacttctcaggagggaagatcaccaaagatgttgggtaccccgagttccttaacattagaccctacatgagccagaataacggtgatcccgtgatgtatggtctttacgccgtgttggtgcattctgggtattcttgtcatgcaggacattactattgctacgttaaggcatcgaacggccagtggtaccagatgaatgacagcctggtgcacagtagcaatgtaaaggtggtgctgaaccagcaggcttatgtgttgttctacctccggattcccggcagcaagaaatcaccagaaggactcatttcccgaacgggctcatcatccctgcccggcaggcccagcgttatccccgaccactccaagaaaaacattggcaatggcatcattagtagccctctgaccggaaaacggcaggattcagggaccatgaaaaagcctcacacaaccgaggaaataggtgtccccattagccggaacgggtccactttgggactgaagtcccagaacgggtgtatccccccaaaattgccctccggttctccttctccaaagctgagccaaacccctactcacatgccaacaatcttggacgatcccgggaagaaagtcaagaagcccgcccctccacagcatttttcccctagaacggcccaggggctgcctggaacgtccaattccaactctagtagaagcggtagtcagaggcagggtagttgggactccagagacgtggtgttgagtacatctcccaaacttctggctaccgccactgccaatggtcatggacttaaaggcaacgatgagtccgccggcctcgaccgtcgtgggagctctagctcatcccccgaacactctgcatctagcgactcgacaaaagcaccccagaccccgcgatccggcgccgcccatctttgtgactcacaggaaaccaactgtagcacagcaggtcacagtaaaacccctccctctggcgcggactccaaaacagtgaagttgaagagtccagtcttgtccaacactacaactgaacccgcgtcaactatgtctcctccacctgccaagaagcttgcactctctgctaaaaaagcgtctaccctgtggagagctactggcaacgacctcaggccccctcccccgtccccctctagtgatctcacacatcctatgaagaccagtcatcctgtggtcgcatcaacatggcctgttcatcgcgcccgcgcagtgtcccccgctccccagagcagttccagactccagccaccattctctccacatcccacagcagcgtctgcactgcaggagggccagacccagagacagccgggatcacccatgtacagacgggagggacaagcccagttgcccgccgtaagaagacaggaagatgggacacagccacaggttaacggacagcaggtgggctgtgtgactgacgggcatcacgccagctctcgcaaaaggcggagaaaaggcgcggaaggcctgggggaggaaggtggcctgcaccaggacccactgcgtcattcctgctcccccatgggtgatggcgaccccgaagccatggaggagagtcctcgcaagaagaaaaaaaaaaagaggaaacaggaaactcagagggctgtagaggaagacggccacctgaaatgcccaagatcagccaagcctcaggatgcagttgttccagaatcatcatcttgcgcgccatcagcgaatggttggtgtccgggggatcggatgggtctctcacaggcacctcctgtcagttggaacggagagcgtgaatctgatgtggtccaggaattgctgaaatattcaagcgataaagcttacgggagaaaagtacttacttgggatggtaagatgtcagcagtctcccaggatgcaattgaagattccagacaagccagaacggaaaccgtggtagacgattgggacgaggaatttgaccgaggtaaagaaaagaagataaagaaattcaagagagaaaagaggagaaattttaacgctttccagaagttacagacacggcggaatttctggtctgtgactcatcctgccaaagctgccagtctgtcttatcggcgctag

SEQ ID NO: 139799 - DNA, 3372 bp, Artificial Sequence
  Description of Artificial Sequence: Synthetic coding sequence
atgccaattgttgataagcttaaggaagctttgaagcccgggagaaaggatagtgcggacgacggcgagctgggaaaactgctcgctagtagcgctaagaaggtgttattacagaaaatcgagtttgagccagctagcaaatctttttcataccaactcgaagccctaaagtccaagtacgtccttcttaatcctaagaccgagggcgccagccggcacaagtccggggatgacccacccgctagaaggcagggtagcgaacacacctatgaatcatgtggcgacggcgtgcccgctccccagaaagttctctttcctaccgagagactcagtctgcggtgggaacgggttttccgcgtgggggcaggcctgcataatttgggcaacacctgttttctcaacgccactattcaatgcttaacatatactcctccccttgctaactatctgctgtctaaggagcacgcaagatcctgtcaccaaggctcattctgtatgttgtgtgtgatgcaaaaccacattgtgcaggcctttgctaatagcggaaacgctatcaaacctgtctcatttatcagggacttaaagaagattgcccggcattttagattcggtaatcaggaggatgcccatgaatttctacgctacaccattgatgctatgcaaaaggcttgcctgaatgggtgcgccaagctggatcgccagacacaggccacaaccctggttcatcagatttttggcggatacctgcgcagtagggtgaaatgtagcgtatgcaaatcagtttctgatacctatgacccatatctggacgttgccctggagatcaggcaggctgccaatatagtgcgggcacttgagctgttcgtgaaggccgacgtcttgagtggggaaaatgcctatatgtgtgccaaatgcaagaagaaggtgcccgcatctaaaaggtttaccatccatcgcacgtctaacgtgctgaccttaagcctaaagcggtttgctaatttctccggaggaaaaatcacgaaggacgttgggtacccggaatttctcaacattcggccatatatgagtcagaataatggcgatcctgtgatgtacggtctctacgctgtgctggtccactcaggttattcctgccatgctgggcactattactgctatgtgaaagccagcaatggccagtggtatcaaatgaatgactccttggttcattcgagtaacgttaaggtggtgctcaaccagcaggcctacgtgctgttttatctgcggattccaggatcaaagaaatctcctgaaggactgatctcacgcaccggcagctcgtccctgcccgggagacccagtgtgatcccagaccactccaaaaagaatatcggaaacggaattatcagctcccccctgaccgggaagaggcaagactccggaacgatgaaaaaaccccacacaactgaagaaattggggtgcctatctctaggaatggcagcactttgggtctcaaatcccagaatggatgcataccacccaagttgcctagcggttctccctctcccaaactgtcccagactccaacccatatgcctaccatcttggatgaccctgggaagaaagttaaaaaacccgccccaccccagcatttctcccccaggacagcgcagggcttgccaggcacaagcaatagcaacagctcaagatccggctcacaaaggcagggttcatgggattccagagacgtggttctgagcacgtcccctaaattactggcgactgccaccgctaacggccacggcctcaagggcaatgatgaatcagccggcttggataggcgcgggagctcgtcgtccagccccgagcacagcgcgagcagtgactccaccaaagctccccagactccaaggagtggcgcggcgcatctgtgcgattcccaggagactaattgttcaaccgcaggtcattctaagactcccccaagtggagccgactctaagactgtcaagctaaagtcgccggttctgagtaacactaccacagagcctgcttctacaatgtcccctcccccagcgaaaaaattggccctgtcagctaaaaaggcttcaaccctgtggcgagccacaggaaatgatctgcggcccccacccccttccccctccagcgatctcacccaccccatgaaaacgagtcacccagtggtggcgtccacctggccggtgcaccgagcacgcgcagtgagtccagccccacagagttccagcagactgcaaccccccttcagtccgcatcctactcttctcagcagcacaccgaaaccccccggcaccagcgagccaagatcttgttcatcgataagtactgctcttccacaagtgaacgaggatcttgtgagcctcccccatcagctcccagaagccagtgaaccaccccaatcacctagtgagaagcgtaaaaagacatttgtaggggagcctcagagactcggaagtgagacccgattgccccagcacatccgggaggctacggcagcgccacacgggaagcgcaaacggaaaaagaaaaaacggccagaagatactgcggcctcagctctacaggaagggcagacacaaagacagccagggtcccccatgtacagacgcgagggacaagcccaactgcccgcggttaggcgtcaggaggacggcacgcagccgcaggttaatgggcaacaagtgggttgcgtcaccgacggacaccacgcctcctctagaaagaggcggaggaagggtgcagaggggctcggtgaagagggcggcctgcaccaggaccccctgaggcactcctgcagccccatgggagacggcgatccagaggcaatggaggagagcccgcgcaaaaaaaagaaaaaaaagcgcaagcaggaaacacagagggccgtggaggaggacggccaccttaaatgccccagatctgccaagccccaggatgcggtcgttcccgaaagtagctcatgtgccccatccgctaacgggtggtgccctggggacaggatgggactgtctcaggccccccctgtgtcctggaacggagagagagaaagtgacgtcgtgcaggagctgcttaagtatagctcagacaaggcttacggtaggaaggttctgacatgggacggtaaaatgtcagcagtttctcaggatgctattgaggactctcgtcaagcaaggacagagaccgttgttgatgattgggatgaggagttcgatcgtgggaaggagaaaaagattaaaaagtttaagcgcgaaaaacgtcggaatttcaatgcctttcagaagttacagacaaggcggaatttttggagcgtgactcatccagcaaaggcggctagcctgagctatcggaggtag

SEQ ID NO: 139800 - DNA, 1698 bp, Artificial Sequence
  Description of Artificial Sequence: Synthetic coding sequence
atgagtggacgaagcaaaagggagtccagaggcagcacaaggggtaaacgcgagtcagagagccgtggcagctctggtcgggttaagcgtgagcgtgatcgagaaagagagccggaagctgctagctcaagggggtctcctgtgcgagtgaaaagggaattcgagccggcaagcgcccgcgaggctcctgcttctgtggtaccctttgtgcgggtgaagagggagagggaggtggacgaggactctgagccggaaagagaggtacgagcaaaaaacgggagagtcgattctgaggatcgaagatcccgtcactgcccctatctggacaccatcaaccgcagtgtgctggactttgattttgagaaactctgttccatcagtctgtcacatatcaatgcttatgcctgccttgtgtgtggcaaatatttccagggacgcggtttgaagagccatgcctatatacacagcgttcaattcagccaccacgtgttcctcaaccttcacacattaaaattttactgcttacctgataattacgaaatcatcgactccagcctcgaggacatcacttacgtgctgaagccaactttcacaaaacagcagatcgccaacctggacaagcaggcgaagctgtctagagcctacgacggaaccacctacttgcctgggattgtcggcctgaacaacataaaagcaaacgactacgccaatgccgtcctacaagcactgagcaatgttcctccactccgaaactatttcctggaggaggataactataagaatattaagaggccacccggagacattatgtttctgctggtgcaaaggttcggggaactgatgagaaagctgtggaatcctcgtaactttaaggcgcacgtgagcccccacgaaatgttgcaggctgtggtactttgttccaagaaaacattccagattacgaaacagggagatggagtcgactttctaagctggttcctcaatgcgctccattcagctttaggtgggaccaagaagaagaagaagaccattgtgaccgatgtttttcagggatcgatgcgcatctttacaaagaagcttccacatccagatctgccagcagaggaaaaggaacagttgctgcataatgatgagtatcaagaaaccatggtcgagtcaacttttatgtatctgactcttgacctccctacagcaccattgtataaagacgagaaagagcagcttatcatcccacaggtgccattatttaatattctcgccaagttcaacggaatcacggagaaagagtacaagacttataaggaaaactttttgaagcgctttcagctcacaaaattgccgccgtatctgattttctgcattaagcgttttacaaagaacaacttctttgttgagaaaaaccccaccatcgttaacttcccaatcaccaatgttgacctacgcgagtatctgagtgaagaagtccaggctgtccataaaaacaccacttatgatctgatcgcaaacatcgtgcatgatggaaagcctagcgagggctcctaccggatccacgtcttgcaccacgggaccggcaagtggtacgaactgcaggacctgcaggttacagatattctgccacagatgattactttaagcgaggcttacattcagatctggaagcgacgcgacaacgatgaaaccaaccaacaaggggcttag

SEQ ID NO: 139801 - DNA, 1698 bp, Artificial Sequence
  Description of Artificial Sequence: Synthetic coding sequence
atgagcggccgctctaagcgagagagccgtggtagcaccagagggaaaagggaaagcgagagtaggggatcaagtggaagagtaaagagggagcgtgaccgggagcgggaaccagaggccgcgtcgtcacgcgggtctccagtccgcgtgaagagagaattcgaacctgccagcgctagagaggccccagcctctgtagttcctttcgtgcgcgttaaacgcgaaagggaagttgacgaggattccgagcctgagagagaggtacgggccaaaaatggccgggtagactctgaagatagaaggtccaggcactgcccttatctggacaccattaatcgctcagtacttgacttcgactttgaaaagctttgcagtatatcactctctcacataaatgcctacgcctgtctggtatgcggcaagtattttcaggggcgcggactcaagtcacatgcgtatattcacagtgttcaattttctcatcacgtcttccttaatctccacaccctgaaattttactgtttaccagacaattatgagattattgacagttccctggaagatatcacttacgtcctcaagcccacttttacgaaacagcaaattgctaacctggacaagcaggccaagctctcccgggcttacgatggcacaacttacctgcccggtatagtcggcctcaacaacatcaaggctaacgactatgcgaacgctgtactccaggcactcagtaatgtgccacccttaaggaattacttcttagaggaggacaactacaaaaatattaaaaggccacctggggatatcatgttcctgttggtgcagcggttcggagaactgatgcgcaaactctggaaccctcggaacttcaaagcccacgtatcccctcatgaaatgctccaggcagtagtgctgtgttctaaaaaaacttttcagatcaccaagcagggagacggcgtggatttcttatcttggtttttaaatgcattgcacagtgcactcgggggaaccaaaaagaagaagaaaactattgtgacagatgtgttccaggggagcatgcggatattcaccaaaaagctcccacaccctgatctacctgcagaagagaaagagcagctgctccacaacgatgagtaccaggaaacaatggtagaatcaaccttcatgtacctgaccctagatctgcctacggcacccctctataaagacgagaaggaacaactcatcattccgcaggttcccctctttaatattctggctaagtttaacggtatcaccgaaaaagaatataaaacatataaggaaaactttctcaaaaggttccagctcactaagctgcctccatacctgatcttttgtattaagcggttcaccaaaaataatttctttgtggaaaagaaccctaccattgttaattttccaataacgaacgttgacctgcgcgagtacctgagcgaggaggtgcaggccgtgcataagaatacaacttacgacctcatcgccaacatcgtgcatgacggcaaaccaagcgagggttcttaccgaattcatgtgctccaccacggcaccggaaaatggtacgagttgcaggacctgcaggtgactgacatcctgccccagatgattacgctctccgaggcttacattcagatatggaagcgtagagataatgatgaaacaaatcagcaaggcgcttag

SEQ ID NO: 139802 - DNA, 1389 bp, Artificial Sequence
  Description of Artificial Sequence: Synthetic coding sequence
atgcttaccgcagtccctagccaccttttttccgcgaagaacggccgagtcgactcggaggaccggagatctcggcattgtccatatctcgataccattaatagtttttctccctttcccaccggccggggcctaaagtcccacgcatacattcatagcgtacaattctcccatcatgtgttcctcaacctccacacgttgaagttctattgtctccccgacaactacgagattatcgatagcagtctggaagacataacctacgtgctcaagcctacatttactaaacagcagatcgcgaatttggataagcaggcgaagctcagccgagcctatgatggtacaacatacctaccaggcattgtggggctgaacaatattaaagcgaatgactatgcgaacgcagtactgcaggcgcttagtaacgtcccacctcttaggaactacttccttgaggaggacaactacaagaatattaagaggccaccaggcgatattatgtttctgttagtgcaacggttcggtgaattgatgcgcaagctttggaaccccagaaacttcaaagcccacgtcagccctcatgaaatgctgcaggctgtcgtgctgtgcagcaaaaagacatttcaaataaccaaacagggcgacggtgttgacttcctgtcttggttcctgaatgctctccactcagccctcggcggaacgaagaagaaaaagaaaactatcgttactgacgtttttcagggctccatgcgaatctttacgaagaagctcccccatcccgatctccccgcagaggagaaggagcagctgctgcacaacgacgagtatcaggaaacgatggtggaatccactttcatgtacttaaccctcgatttgcccaccgcccccctgtacaaagacgagaaggagcaactgattatcccacaggtgcccctgtttaacattctggctaagtttaatggcataaccgagaaagaatataagacatacaaagaaaattttctgaaacgatttcaactgactaaactgccaccctatctgattttctgtatcaaacgctttacgaagaataatttcttcgtcgagaagaacccaactatcgttaactttcccatcacaaacgtggacctgcgtgagtatcttagcgaagaggttcaagctgtacacaagaatacaacatacgacctgatcgccaacattgtgcacgacgggaaaccatctgaggggtcctataggatccacgtgttgcatcacggaacaggcaagtggtatgagctgcaggaccttcaggtgaccgatatcctgcctcagatgattactctgtcagaagcctacattcagatttggaagcggcgggacaacgatgaaacaaaccaacagggcgcatag

SEQ ID NO: 139803 - DNA, 1467 bp, Artificial Sequence
  Description of Artificial Sequence: Synthetic coding sequence
atgtccggccgttcgaaacgggaatcacgaggttcaacacggggtaaaagagagagtgagagcagagggagctccggtagggttaagcgtgaaagagaccgtgagcgggaacctgaagctgcttcttcaagaggatcccccgtccgagtgaaacgagaatttgagcctgcatctgctcgcgaggcacccgcatcagtggtgcccttcgtgagagtgaagagagaacgagaggtggatgaagacagcgaaccagaacgcgaggttagggcgaagaacggcagagtcgacagcgaggaccggaggagtcgccactgcccttacctggatacaatcaaccgaagtgtgctggattttgatttcgagaaactctgctcaatcagcctcagtcacatcaacgcgtatgcctgcctggtttgcggcaaatacttccaagggcgggggttgaagagtcatgcctatatccatagtgtgcaattttcacatcacgtgttcctgaatctacacaccctgaaattctactgcctgcccgacaattatgaaatcatcgactcaagcctggaggacatcacctacgtgttgaagccaacgttcacaaaacagcagatcgcgaatcttgataagcaggcgaaacttagcagggcatacgacggaactacttaccttccggggatcgtggggctgaacaatatcaaggcgaatgactacgcaaacgccgtgttgcaggcgctgtccaatgtgcctcctcttcgaaactatttcttggaagaagacaactacaaaaatattaaacgcccgcccggcgacatcatgttcctccttgtacaacgctttggggagctcatgagaaagttgtggaaccccaggaactttaaggcacacgtgtccccccatgagatgttgcaagccgtggtactctgttcgaaaaagaccttccagattacaaagcagggcgacggggtcgatttcctgagctggtttctcaatgccctgcactcggccctcggcgggaccaaaaaaaaaaaaaagaccatcgtgaccgacgtcttccagggctctatgcggatttttacgaaaaagctcccccacccggacttaccggccgaggaaaaggaacagctcctccataatgatgaatatcaagagacaatggtagagtctacattcatgtaccttaccctggaccttcctaccgctccattgtataaagacgaaaaggagcagcttatcataccgcaggtcccactcttcaatattctagctaaatttaacggaataactgaaaaagaatataagacatataaagaaaatttcctcaaaagatttcagctaacaaagctcccaccatatttaattttttgcatcaaaaggttcaccaaaaataatttcttcgtcgagaagaatcctaccatcgttaactttccgattaccggccaggccaatggaatgaactataagacttctcgctag

SEQ ID NO: 139804 - DNA, 2892 bp, Artificial Sequence
  Description of Artificial Sequence: Synthetic coding sequence
atggctgaaggcgggggatgccgggaaagaccggatgctgagacacagaagtcggaactcgggcctctgatgcggacaaccctccaaaggggcgcgcaatggtacctgattgacagtcggtggttcaagcagtggaaaaagtatgtggggttcgattcttgggacatgtacaacgtgggagagcacaatttgttcccaggcccaatcgataatagcgggttgtttagtgatcctgagagccaaactctgaaagagcatctgatcgatgaattggactatgtgctggtacccacagaggcttggaataaactcttgaattggtacggatgcgtggaagggcagcagccaattgtgcggaaggtggtggaacatgggttatttgtgaagcattgtaaggtggaggtttacctgcttgaactgaagttgtgtgaaaatagcgacccgaccaatgtgctctcatgtcacttcagcaaagctgatacgatagccaccattgaaaaagagatgcgcaagctttttaatatccccgccgaaagggagacgaggctctggaacaaatacatgtccaatacatatgagcaactcagtaagctggataatacagtgcaagatgctggactgtaccaagggcaggtgctggtgattgagccgcagaatgaagacggtacatggcctagacaaacactccagtcaaagtcaagcaccgccccaagtagaaactttactaccagccctaagtcctcagcctcgccgtactcctcagtgtcggcctccttgattgccaatggggacagcacctcgacatgcggaatgcactctagcggcgtatcgagaggtggttccggcttctcggcctcttataattgccaggagccacctagtagccatattcaaccaggactctgtggccttggcaacttaggcaatacctgcttcatgaattccgccctccagtgcttatccaacacggcgcccctaacagactacttcctgaaagatgaatacgaggccgaaataaaccgggataatcctctcgggatgaaaggggaaatcgctgaggcctacgcagagctaattaaacagatgtggtcagggcgtgacgcacacgtggcccctcggatgtttaaaacgcaggtcggccgattcgcccctcagttcagtggttatcagcagcaggacagccaggagcttttggcgttcttgctcgatggtctgcacgaggacttgaaccgagtgaagaagaaaccttacctggagctcaaggacgcgaacgggcgacctgatgccgttgttgcaaaagaagcttgggagaaccacaggcttaggaatgacagcgtgattgtggatacttttcacggtcttttcaaatccacactggtgtgcccagaatgcgctaaggtcagtgtgacatttgacccattctgctacctcaccctgcctctgccactcaagaaggatagagtcatggaagttttcctggtacctgcagatccacactgcaggccaacccagtaccgcgtaacagtaccccttatgggcgcggtgtccgacctgtgtgaggccttgtctcgcctgagtggaattgctgcggagaacatggtggtggctgatgtctacaatcataggttccataaaatatttcagatggacgaaggattgaatcacattatgcccagggatgacatttttgtttacgaggtatgctccactagcgttgacgggtctgagtgtgtcactctgccagtttatttccgggagcggaaatctagacccagtagcaccagctccgccagcgctctgtacgggcaaccacttctcctttctgtccctaagcataagcttacactcgagagtttatatcaggctgtgtgcgatcggatctcccgatatgtgaaacagcctctgcctgacgagtttggctcctcaccactcgaacccggggcatgtaatgggtcaagaaacagttgcgagggagaggatgaggaagaaatggaacaccaggaggaaggcaaagagcagctgtccgagactgagggttccggggaggatgaacctgggaatgatccaagtgagacgacccagaaaaagatcaaaggtcagccttgtccgaagagactgttcacgtttagcttggtgaattcatacggtactgcagatataaattcgctagccgctgatggcaagctgcttaagctcaattcccgtagtacactcgccatggactgggactctgagacccggaggttgtactacgacgaacaagagagcgaagcttacgagaaacacgttagtatgctccaaccgcagaaaaaaaagaaaactactgtcgcgctacgagactgcatagaactctttaccacaatggaaaccttgggagagcatgatccatggtattgtcctaactgcaaaaagcaccaacaggccacaaaaaagttcgacctgtggtcccttccaaaaatcttagtcgttcacctgaaacgtttttcctacaaccgctactggagggacaaactcgatactgtcgtcgagtttccgatcaggggcctgaatatgagtgaattcgtgtgtaacttaagcgcccgaccatacgtttacgacctcatcgcggtgagtaaccactacggcgctatgggcgttggtcactatacggcgtacgcaaagaataaactgaacggcaaatggtattatttcgatgattctaacgtgagcttagcctccgaagatcagatcgtgactaaggctgcctatgttctattctatcaacgccgcgacgacgagttctataagaccccctctctcagcagcagcggctctagcgacggaggtactaggcccagctcaagtcaacagggttttggcgacgatgaagcctgtagcatggacaccaattag

SEQ ID NO: 139805 - DNA, 2751 bp, Artificial Sequence
  Description of Artificial Sequence: Synthetic coding sequence
atggcagaagggggcggctgtagagagagacccgacgcagagacgcagaaatcagaactggggcccctgatgaggacgactcttcagcggggggcccaatggtaccttatcgattcacgatggtttaagcagtggaagaagtacgtaggcttcgactcatgggatatgtataatgttggagagcacaatctctttccgggacctatcgacaattccggcctgttttccgatcccgagtcccagacacttaaggagcacctgatcgatgagctcgattatgtcctagtacctacagaggcttggaataaactcctcaattggtatgggtgcgtcgagggccagcagccaatcgtccgtaaggtcgttgagcacggccttttcgtgaaacactgtaaagtcgaggtgtaccttctcgagctgaaactgtgtgaaaactctgatccaactaacgtactttcctgccactttagcaaggctgacactatcgccaccattgagaaggagatgaggaaattattcaatataccagctgaacgggagacccggctgtggaataaatacatgtcgaatacgtacgaacagctctcaaaattggataacaccgtgcaagacgcagggctgtatcagggccaagtgctcgtaatcgagccccagaatgaagacggcacttggccccgacaaacactgcagtcgaatggctctggattctctgcctcctataactgtcaggagcccccaagttcccacattcagccagggctctgtggattaggtaatctgggcaacacctgttttatgaactctgcccttcagtgtctctccaacaccgcacccctcaccgattacttcttgaaggacgaatatgaggccgaaattaaccgcgacaatcctctgggtatgaagggcgagatcgcggaggcctacgcggagctgattaaacaaatgtggtccggccgagacgcccacgtcgcgccgagaatgttcaagacccaggtcgggagatttgctccacaattttccggctatcaacagcaggactcccaggagctgttggctttcctgctcgatggcctccatgaagacctgaaccgtgtgaaaaagaagccatatctagaactcaaggacgctaacggtcggcctgatgcagtcgtagccaaagaggcatgggagaatcaccgccttcgcaatgattccgtaatcgtcgacacctttcacgggttattcaagagcaccctcgtgtgcccagagtgtgccaaggtgagtgtgactttcgacccattctgttacctcacactgcctttgccacttaagaaggacagggtcatggaagtgttcctcgtgcctgccgatccacattgtagaccaactcaatatcgcgtgaccgtgccgttgatgggagcagtcagcgatctttgtgaagcgctgagtaggctgtcaggaattgcagccgagaatatggtggtggctgatgtctacaaccaccggttccacaagatcttccaaatggatgaaggacttaaccatatcatgccccgcgacgacatatttgtctacgaggtatgttctacttcagtggatggctcagagtgtgttaccctgcctgtgtatttccgcgaaagaaaaagtagaccaagcagcacaagctctgcctctgccctgtatgggcaaccgctcttgctcagcgtccctaaacataagctcacactggagagcctctatcaggccgtgtgcgatcgaatttccaggtatgtgaaacagcccctgcctgacgaatttgggagcagtcccctcgaacccggcgcatgtaacggctcacgtaatagctgcgagggtgaagacgaggaggagatggagcaccaggaggagggcaaggaacagctttctgaaactgaaggcagcggggaagacgagccaggcaatgatccaagcgaaacaacacagaagaagatcaagggccaaccatgtcccaaaaggctgttcacgttctcccttgtcaattcatatggaaccgccgatataaacagccttgccgctgacggcaagttgctgaagctaaactccagatcaaccctcgcgatggactgggatagtgagacgaggcgcttatattatgacgagcaggaatccgaagcttatgagaaacacgtgtcgatgcttcagccgcagaaaaagaaaaagacgacagttgctctgcgtgactgcattgagctgtttaccactatggaaactctcggggaacacgacccctggtactgccccaattgtaaaaagcaccagcaggccacaaagaaatttgatctctggtccctccccaagattctagtcgtccacctgaagcggttcagttataatcggtactggcgagacaaattagacacagtcgttgagtttccgatcagagggctgaatatgtcagagttcgtttgtaatttgtcagcccgcccctacgtctatgacctcatcgctgtgagcaaccattacggcgccatgggcgtcggccattatactgcatacgcaaaaaacaagcttaatgggaagtggtattattttgatgacagcaacgtttcactagcctctgaagaccagattgttaccaaagccgcttatgttttgttctaccaaagacgggacgatgagttttacaagacccctagtctgtcctcaagtggaagcagtgacgggggtaccaggccgagttcgtctcaacagggatttggagacgatgaagcatgcagtatggatactaactag

SEQ ID NO: 139806 - DNA, 942 bp, Artificial Sequence
  Description of Artificial Sequence: Synthetic coding sequence
atggccgagggggggggctgccgggagcgacccgacgccgagacacagaagagtgaacttggtcctctgatgagaacgacactacagcggggtgcacagtggtacctaatcgactcacgctggtttaagcagtggaagaaatatgtggggtttgatagctgggatatgtacaatgttggggaacataacctttttcccggtcctatagataattccggactttttagtgatcccgagtcccagacattaaaagaacacttaattgatgagcttgactacgtcttggtgccaacagaggcgtggaacaagctgctgaattggtacgggtgtgtggaggggcagcagcccattgtgagaaaagtagttgagcacggactgttcgtgaaacactgtaaagtggaggtctacctcctggagctgaaactatgcgagaatagcgatcctaccaatgtgctttcttgccattttagcaaggccgacaccatagccactatcgagaaggagatgcgaaagctctttaatatccccgcggaacgcgagacaagactgtggaacaaatacatgtctaacacgtacgagcagttatccaagctggacaacaccgtgcaggacgccggactgtaccaggggcaggtattggtgatcgaaccacagaatgaggatggcacctggccacgacagacacttcagagcaaagttagtttcttcctccctagattggagtgtaacggggcgatcctggcccactgcaacttctgtcttcctgggtcctcaaatagtccagcaagcgcatcaagagtggccccaagccacctcgccaatttcttcttctttgagatggagagtcattccgtgacaaagcttgagtgtggcggagcagttagcgcgtattctcgggtgcaggtcatgctactgccccagccaccggagtggctagggtag

SEQ ID NO: 139807 - DNA, 2139 bp, Artificial Sequence
  Description of Artificial Sequence: Synthetic coding sequence
atgttggcaatggacacgtgtaagcacgtggggcagcttcagctcgctcaggaccactcgtctctgaatcctcaaaagtggcattgcgtggactgcaacacaacagagagtatctgggcctgcctaagctgctcacatgtggcgtgcggccgttacatcgaagaacacgcgctgaaacatttccaggagagctctcaccccgtggcgctggaagtcaacgagatgtatgttttctgctacctgtgcgatgactatgtactcaacgataacaccactggtgacctgaagcttcttaggcggaccttaagcgccatcaagtctcagaactatcattgcactactaggagcggaaggttccttaggagcatgggaacaggagacgactcctatttcctgcatgacggagcacagagtctcctgcagagcgaagatcagctttacactgctctatggcacagacgccgcattctgatgggaaagatctttagaacatggtttgaacaatcacctatcgggcggaagaagcaggaagagccatttcaagagaaaatcgttgtaaagagggaggttaaaaaacgccggcaagagttggaataccaggttaaagccgaattggaatctatgcctcctagaaagtccctacgcctacagggcctcgcccagagcactattattgagatagtgtccgtgcaggtgcccgcacagacacccgcttctcccgcgaaagataaggtactgtcaacatcagagaacgagatctcccagaaagtatccgattcatctgtgaagcgcagacccattgtcacaccaggcgtcacggggttacgaaaccttggaaatacgtgttacatgaacagtgttcttcaagtgctgtcccacctcctgattttccgacagtgtttcctgaagctggacctgaaccagtggttggccatgactgcctcggaaaaaacgaggagttgcaagcatccgcctgtgaccgacacagtggtctaccagatgaatgagtgtcaggaaaaggacacaggttttgtttgcagtagacagtcctcattaagcagcggactgtcaggaggcgcaagtaagggccggaagatggagttaattcaacccaaagaaccaacaagtcagtacatctctctatgccacgaactgcataccctgttccaggtgatgtggagcggaaaatgggcacttgtgagtccttttgccatgttgcactccgtttggaggttaatcccagcttttcgcggctacgcccagcaggatgcccaggaatttctttgcgagcttctagataaaattcagcgggaactagagacaacgggcacctccctccccgctctcatacccacatctcagagaaagttgatcaaacaggtcctcaatgtggtgaacaatatcttccacggccagttgctcagccaggtcacgtgcctggcatgtgacaataaaagtaacaccattgagcccttttgggacctgtctcttgagtttcccgagagataccagtgcagtggcaaggacatcgcctcacagccttgcctcgttaccgaaatgctcgccaaattcacagagacagaggccttagagggtaagatctatgtatgtgatcaatgcaatagcaaacggcgccgctttagttccaagcctgttgtgttgaccgaggcccaaaaacaattaatgatctgtcacctgccacaagtgttacgtctgcacttgaagaggtttcggtggtctgggcgaaataatcgcgagaagatcggggtgcatgttggtttcgaggagatcttgaacatggaaccttactgttgtcgggaaacgcttaagagcctccggcctgagtgcttcatttatgatctaagtgccgtggtgatgcatcatgggaaaggctttggatcaggacactacacagcatactgctacaattctgaaggcggtttctgggtccactgcaatgactcaaaattgagcatgtgcaccatggatgaagtctgtaaagctcaagcttacattctgttctatacccaacgcgtgacagaaaacggacattcaaaattgctgccacccgagctgctgctaggatctcagcatccaaatgaggacgccgacacatcgagcaatgagatactaagctag

SEQ ID NO: 139808 - DNA, 2139 bp, Artificial Sequence
  Description of Artificial Sequence: Synthetic coding sequence
atgctggcaatggacacttgtaaacatgtggggcagttgcagttggcacaggatcacagttcgctcaatccccagaagtggcattgcgtcgactgtaacaccacagaatcgatctgggcatgtttgtcgtgttcccatgtcgcctgcgggaggtacatagaggagcacgccctgaaacatttccaggaaagtagccacccagtggcgttggaagtcaacgaaatgtacgtgttttgttacctgtgtgacgattacgtactgaatgacaatactacgggagatttgaaactgcttcggcgaaccctttctgcaataaaatcacagaattaccactgtacaacacgcagcggacggttcttaagatctatgggtacaggagatgacagctatttcctgcacgacggggcacagtctctgctccagagcgaagatcagctgtacactgcgctctggcatcgcagacggatcctcatgggcaaaatttttcgaacgtggttcgagcagtccccaatcggaagaaagaagcaggaggagccttttcaagaaaaaattgtggtgaagcgggaggttaagaaacgccggcaagaattggaatatcaagtgaaggctgaactggaatcgatgcccccgcgcaaatcactgcgtttacagggccttgcacagtccaccattattgaaatcgtgtctgtacaggtccccgcccagacacccgcctcccctgcaaaagacaaggtgctgagcacttctgagaatgagatctcccaaaaggtcagcgattcatccgttaagcgccggcctatcgtcaccccaggggtgactggcctgcgtaatttgggcaacacctgttatatgaacagcgtgctgcaggtgctctcccatctgctcatttttaggcaatgttttctgaagttggacttaaatcagtggctggccatgacggcatcggagaagacacgctcttgtaaacatcccccggtcacagatacagtcgtgtatcagatgaacgagtgccaagagaaagatactggcttcgtgtgtagcaggcagtcaagcctatcatctggacttagcggtggggcctccaaaggaaggaagatggaacttatccagcccaaggaaccaactagccagtatatttccctgtgtcacgagctacacaccttgtttcaagtcatgtggtccggtaaatgggccttggtaagccccttcgccatgctgcattctgtgtggcgtctcatccccgcttttcgcggttatgcacagcaagatgcgcaggagtttctctgtgagctgcttgataaaatccagagggaactggagacaacggggactagcctgcccgccctgattcccacttcccaacggaaactcattaagcaggtgttaaatgtcgtgaacaacattttccatggccagctcctctcacaggttacttgcctcgcttgtgataataagtccaacacgattgagccgttctgggacctatccctggagttccctgaacgataccagtgtagcggcaaggacattgcaagtcagccctgcctggttaccgagatgttggccaagttcaccgaaacagaagcactagagggaaagatttatgtgtgtgaccaatgcaacagtaagagacggcggttttccagcaagccagtagtcctgactgaagcccagaagcagctgatgatctgccatctccctcaggtgctaaggctgcacctgaagagatttcggtggagtggccgcaacaaccgagaaaaaattggggttcatgtcggttttgaggaaattctcaacatggagccctattgttgcagagaaaccctgaaatccctgagacccgaatgctttatctacgacctgagcgccgtggttatgcatcacggcaaggggttcgggtctgggcactacaccgcatattgctacaattcggaaggcggcttctgggtgcattgcaacgactcaaaattatctatgtgtaccatggacgaggtgtgtaaggcacaggcatacatcctgttttatacacagagagtgactgagaacgggcacagtaaactcctgccccctgagctactgctgggctcccaacatccaaacgaagatgcagataccagcagcaatgaaatactgtcgtag

SEQ ID NO: 139809 - DNA, 2139 bp, Artificial Sequence
  Description of Artificial Sequence: Synthetic coding sequence
atgctggccatggacacctgcaagcacgtcggtcagttgcagcttgcgcaggatcatagtagtctcaaccctcagaaatggcattgtgtggactgtaacacgaccgagtcaatttgggcttgtctgtcttgcagccacgtagcttgtgggaggtacatcgaagaacatgccctgaagcatttccaggaaagctcacaccctgtagccctggaggttaacgagatgtacgtgttctgctatttatgcgacgattacgttctcaacgacaatacaactggagatttaaagctcctccggagaactttgtccgcgattaagagccaaaattatcactgtactacccgtagcggcagattcctaagatccatgggcaccggggacgatagctatttcttacatgacggagcccagagtcttctccagtctgaggatcagctctacactgctttatggcataggagacgcatactgatgggtaagattttcagaacttggtttgagcagtcacctattggaaggaagaagcaggaggagccatttcaagaaaagatcgtggtcaagagggaagtcaaaaaacgacggcaagaattggagtaccaggtgaaagccgagctggagtcaatgccaccacgaaagagccttcgcctgcaggggctcgcccagtcaacgatcatcgaaatcgtgtcagtccaggtccccgcccagacacctgcatcccccgcgaaggataaagtgctttccacctctgaaaacgagatcagccaaaaagtttctgattcctccgtcaaacgaagacctatcgtcacaccgggtgttactgggctgcgcaaccttggaaatacgtgttatatgaacagtgtccttcaggttctttctcacctcctaatttttcgacagtgcttcctcaaattagacctcaaccaatggctagctatgactgctagtgagaaaactcggagctgtaagcatccccctgtaacagatactgtcgtataccagatgaacgagtgtcaggaaaaggacacgggttttgtctgttctcgccagagtagtctcagcagcgggctttctggcggagcaagcaaggggagaaaaatggaactcattcagccaaaggagcccacctcacaatacatcagcctctgtcacgagctacacaccctcttccaggtcatgtggtccggaaagtgggcgctggtcagcccctttgccatgttgcatagtgtgtggagacttataccagctttcagaggttacgcccagcaggacgcccaggagtttctgtgtgagctactcgataaaattcagagagaactcgaaaccacggggacatcacttccagcgctcatcccaacctcccagcggaagctgattaagcaagtgctcaatgtggtcaataacatcttccatgggcagctccttagccaggtgacgtgtttggcctgcgataacaaaagtaatacaatagaacccttctgggaccttagcctggaattcccagagaggtaccaatgttcagggaaggatatcgcatcacagccctgcctggtcaccgaaatgttggccaagttcaccgagacggaggctcttgaaggcaaaatttacgtctgcgaccagtgtaacagtaaacggcgtcgatttagtagcaaacccgtggtgctgaccgaggcccagaagcagctgatgatctgtcacttgcctcaagttcttcgcctccacctaaaaagattccggtggagtgggcgcaataatcgcgaaaaaataggggtgcatgtgggattcgaggagattctgaacatggagccatactgttgcagggagactctgaagtcactgaggcccgagtgcttcatctacgaccttagcgcagtggtgatgcatcatggaaaaggattcggcagtggccactacaccgcgtattgctataactctgaggggggattttgggtccactgcaatgactcaaaactctccatgtgtaccatggacgaagtctgcaaagcccaagcatacattctgttctacacacaaagggtcaccgagaatgggcatagcaagctgctgccgcctgagttattgctagggtctcagcatcctaatgaggatgccgacacatcttcaaacgagatcctcagctag

SEQ ID NO: 139810 - DNA, 336 bp, Artificial Sequence
  Description of Artificial Sequence: Synthetic coding sequence
atgctggcaatggacacgtgcaaacatgtggggcagttgcagctggcccaggatcattcttccctcaacccccaaaagtggcactgcgttgattgcaacactactgagagtatttgggcctgcctgtcctgcagtcacgtcgcttgtgggaggtacattgaagagcacgctctgaaacattttcaggaaagtagtcatccagtcgccctggaagtgaatgaaatgtacgtattttgttacttatgtgatgactacgtgctgaatgacaacaccaccggagatcttaaactgctccggcggactctgtctgcaataaagagtcagaattaccactag

SEQ ID NO: 139811 - DNA, 495 bp, Artificial Sequence
  Description of Artificial Sequence: Synthetic coding sequence
atgttggcaatggacacatgcaagcatgttgggcagcttcagctcgcacaggatcacagcagcttgaatccacagaagtggcactgtgtggactgtaacacaacggagtcaatctgggcctgcctcagctgcagccatgttgcttgcgggaggtacattgaggaacacgcgctgaagcacttccaggagagtagccaccctgtggcactggaagtgaacgaaatgtatgtcttttgctacctttgcgatgattacgtgttgaatgacaatacaaccggtgatctcaagttgctacgacgcacgctcagtgccatcaaaagtcagaactaccactgcaccaccagaagcggtcgatttttgagatctatgggtacaggcgacgattcatacttcttacatgatggcgcacagtccctcttgcagtccgaggatcaactgtataccgcactctggcacagaaggcgcattttgatgggcaagattttcaggacttag

SEQ ID NO: 139812 - DNA, 1101 bp, Artificial Sequence
  Description of Artificial Sequence: Synthetic coding sequence
atgaccgtacgcaatatcgcttcaatctgcaatatggggacaaatgctagtgccctcgagaaggacattggcccagaacaattccctatcaatgagcattatttcggtctagtgaacttcggtaacacttgctattgcaattccgtgctccaggccctatacttctgcagaccctttagagagaacgtcctggcttataaggcccagcagaaaaagaaggaaaatttattgacttgcttagccgacctgtttcactccatcgctacccagaaaaaaaaggtgggcgtaattccccccaaaaagtttattagcagattaaggaaggaaaatgacctgttcgacaactacatgcagcaggatgcacacgaatttctgaactatctgctgaacactatcgctgacatcttacaggaggaaaagaagcaggagaagcagaacggcaaactaaaaaacggcaatatgaacgagcccgcggagaacaacaagccagaactgacatgggtccatgagatctttcagggcactctgaccaacgagactaggtgcctaaactgtgagacagtgagcagtaaggatgaagacttcctcgacctgtctgtggacgtcgagcagaatacctctattacgcattgcttgcgggatttcagcaatactgaaaccctatgctcggagcagaaatattactgcgagacctgctgctccaagcaggaggcccagaagcgcatgcgcgtgaagaaactcccaatgatcctcgccctgcatttgaagcggtttaagtacatggaacagttacatcggtacaccaagctatcttacagagtagtgtttccacttgaacttcggctattcaatacctctagcgacgctgtgaatctggaccgcatgtacgacctcgtggcagtcgtcgttcactgtggtagtggccccaatagaggtcactacattacaatcgttaagtcccatggcttctggctgctgtttgacgacgacatagtggagaagatcgatgcgcaggcaattgaggagttctacggcctgacaagtgatatatccaaaaactccgaatccggatacatactcttctatcagtcacgggaatag

SEQ ID NO: 139813 - DNA, 1080 bp, Artificial Sequence
  Description of Artificial Sequence: Synthetic coding sequence
atgaactgctttcagggcaccaatgccagcgcacttgagaaagatattggtcctgagcagttccctatcaatgaacactacttcggcctggtgaattttggcaatacatgttattgtaactcggtcctgcaggctttgtatttctgcaggcctttcagggagaacgtgctggcttataaagcgcagcagaagaagaaagagaacttactgacttgtttggccgatctctttcatagcattgccacgcagaagaagaaagtcggcgtaattcctcctaagaaattcattagtagacttcggaaagagaatgacctgttcgacaactacatgcagcaagacgcacacgaattcctgaattacttattgaacacaattgccgatatactacaggaagagaaaaaacaggaaaagcagaatggaaagttgaagaacggcaatatgaatgagcccgcggagaataacaaaccagagctgacatgggtgcacgagatcttccagggtaccctgaccaatgagacaagatgcctgaactgcgagacggttagtagcaaggacgaggattttttagatctgagcgttgatgtggaacagaatacttcaataacccattgcctccgcgatttttcaaacacagagacgttgtgcagcgaacagaagtactactgtgagacatgttgtagtaaacaggaggcccagaagcgcatgcgcgtcaaaaaactgcccatgattcttgctcttcatctaaagagatttaagtacatggagcaactgcacaggtataccaaattaagttacagagttgtgttcccattggaactccgcctgttcaacaccagctccgatgccgttaatctggatcgtatgtatgatctcgttgcggtggtggtgcactgcgggtccggtcccaaccgcggccattatattacaatagttaaaagccacggcttttggcttctgttcgacgacgatatagttgaaaagattgacgcgcaggcaattgaagaattttacggactgacatccgatatcagcaagaatagcgagagcggatatatcctgttttaccagagccgggaatag

SEQ ID NO: 139814 - DNA, 4221 bp, Artificial Sequence
  Description of Artificial Sequence: Synthetic coding sequence
atggatatggtggaaaacgcagacagcttacaggcacaagagagaaaggacatactgatgaagtatgacaaggggcaccgggcaggactgcctgaggacaaagggcctgaaccagtcggcattaacagttcgatcgataggttcggcattctgcacgaaacggagttaccaccagttaccgctcgggaagccaaaaaaatcaggcgcgagatgacaaggacatctaaatggatggaaatgttgggggaatgggaaacctacaaacattcctctaaacttatagacagggtttacaagggaattccaatgaatattcgggggcctgtgtggagtgttctactcaacattcaggaaattaaactcaagaacccgggacgataccagattatgaaagaaaggggtaagcgctcatccgaacatattcaccacatagaccttgacgtgcggacgaccctgcgcaaccatgtgttcttccgcgatcggtacggagccaagcagcgcgagctgttctatatactcttggcctactccgaatacaatcctgaggtcggttactgccgcgacctaagccatatcaccgcgctcttcctcctgtacctgccagaggaggatgccttctgggcactagtgcagctcctcgcatcagaaagacattcactccctggcttccactctcccaatggcgggaccgtgcagggactccaggaccagcaggagcatgtcgtgcctaaatcccagcccaaaacaatgtggcatcaggataaagaaggattgtgcggccagtgtgcctccttggggtgcttacttagaaacctcattgatggtatctctctgggactgacgctgagattgtgggacgtttacctggtcgagggagaacaggttctgatgcctataactagtatcgccctgaaggtgcagcagaagagactgatgaagacctcacgatgtggattgtgggcacggctacgcaaccagttttttgatacctgggccatgaacgacgatactgttctgaagcacttgagggcctcgacaaagaagctcacacgtaaacagggcgacttgcctccccctgccaaacgggaacaagggtccctggctccccgacccgtgcccgcctcccggggggggaagaccctgtgcaaaggctaccgccaagccccccccggaccgccagctcagtttcagagacccatatgttcagcttccccaccctgggcttcacgtttcagtactccgtgtccaggaggcgcagtgcgtgaggatacttacccggtgggcacccagggagtcccttctctggcattggcccagggtgggccccagggttcttggaggttccttgaatggaagtctatgcctcgcctgcccaccgatttggatatcggcggcccctggtttccacactacgacttcgaatggtcgtgttgggttcgcgccatttctcaggaggaccaactcgccacttgctggcaggctgagcactgcggggaggtgcataacaaagacatgagctggcccgaagagatgagtttcaccgcaaacagcagcaaaattgataggcagaaggttcccactgaaaagggcgccaccgggctgtcgaatctagggaacacatgtttcatgaatagtagtatccagtgtgtatctaatacacaacctctgacacagtacttcataagcggccgacacttgtacgagcttaatcggacaaacccaattgggatgaaggggcacatggcaaagtgctacggggatctcgttcaggagttgtggtctggcacccaaaagtcggtggcccccctgaagctgcgcagaaccatcgccaaatacgccccgaaattcgacggttttcaacagcaggacagccaggagctgctggccttcctgctggacgggctgcatgaagaccttaatagggtccacgagaagccgtacgtagaattgaaggatagtgatggtcggcccgattgggaggtcgcggccgaggcctgggacaaccatttgcggcgtaaccggagcattattgttgatctattccacggacagctaagatctcaggtgaagtgtaaaacctgcgggcacatttccgtgcgcttcgacccatttaatttcttatccttaccactccccatggacagctacatggatctggagatcacggttattaagctggacggcactacaccggtgagatatgggcttcgcctgaacatggatgaaaagtataccggactcaagaaacagctgcgtgacctttgtggcctgaattccgagcagatcttactggctgaggtccatgatagcaatattaagaatttcccacaagataaccagaaggtacaactgtccgtgagcgggttcctttgtgccttcgaaatcccagtgcccagctcccccatctcagcttcttctccgactcagattgacttttcttctagccctagtactaacggcatgtttacgttgaccaccaacggcgacctgcccaagcccatcttcattcctaacggcatgccaaatactgtggttccttgtggcaccgaaaaaaactttactaatgggatggtaaatggacacatgcctagtctcccagacagtcccttcacaggctacatcattgccgtgcacaggaaaatgatgagaactgaattatatttcctctcgccccaagaaaaccgacccagtctattcggaatgcccctgattgtgccatgcaccgtccacaccaggaagaaagatctgtatgatgccgtttggattcaggtttcttggctggcccgcccacttccgccccaggaagcctcaattcatgcccaggaccgagataattgcatgggataccagtaccccttcactctgcgagtggtgcagaaagacggcaactcatgtgcatggtgcccgcagtatcggttctgccgaggttgcaagattgattgcggggaagatagagccttcataggaaacgcctacatcgcggtggattggcatccaaccgctctccacctccggtatcagacatcccaggaacgggtcgtggacaaacatgaaagcgtggagcagtcgcgcagggctcaagctgaaccaatcaatctagactcgtgtctgcgggctttcacatcagaagaggaactgggtgaatccgaaatgtactactgcagcaaatgtaagactcactgcctcgcaactaaaaagctggacttgtggcgattacccccatttttaatcatccatctcaaaagattccagttcgtaaatgaccagtggattaaaagtcagaaaattgtcaggttcctgagggagagcttcgacccttccgcctttctggtgccaagggaccccgccctctgccagcacaagcccttaactccacagggggacgagctgtccaagccaaggatattagctcgggaagtgaaaaaggttgatgcgcaatcatccgcaggaaaggaggatatgctgttgagcaagtctccatcatcattaagcgctaatatctcaagtagccctaaggggagcccctctagctctcgaaaatcggggacctcatgcccatcctccaaaaattcctcccctaattcttcaccccggacgttaggccggtctaagggtaggctgcgactgcctcagatcgggtccaaaaacaaaccgtctagcagcaaaaaaaacttagatgccagcaaagagaatggtgcggggcagatctgcgagctagccgatgccttaagccgcgggcacatgcgaggagggtcacagcccgagttggttacacctcaagaccatgaagtcgctcttgccaacggttttctgtatgagcatgaggcatgcgggaatggctgtggtgacggttactccaatggtcaactcggaaaccactcagaggaggattctactgatgaccaacgcgaggatacgcacatcaaacctatttataatctgtacgcaataagctgtcactctggcattctgagcggcggccattatataacttatgccaagaaccccaactgcaaatggtattgctataacgacagcagttgcgaagagctacatcccgacgaaatcgataccgattccgcctacattttgttctacgagcagcagggcatcgactacgcccagtttctcccaaagatcgatggtaagaaaatggcagacacatcctcgaccgacgaggacagtgaaagtgactacgagaaatactcaatgttgcagtag

SEQ ID NO: 139815 - DNA, 3270 bp, Artificial Sequence
  Description of Artificial Sequence: Synthetic coding sequence
atgcctcagagactgcctcacgcacgccaacacactcccttgcccttgggaagcgctgactataggcgggttgtatccgtccgcccccaaggaccacaccgcgatcctaaggactctagggatgccgctaaacgcgagcaggggagcctcgccccccggccggtgcctgcttcacgtggggggaagacactgtgtaaaggatatcgccaagctccccctggcccaccagcacaattccaacgcccaatttgctctgccagtcccccctgggcttctcgcttctctaccccctgccctggaggagctgtgagggaagacacctatccagtgggtacacagggcgtgccgtcgctggctctggcccaaggtggaccccagggctcctggcgtttcttggaatggaaatccatgcccagactgccaacagaccttgatataggggggccgtggtttcctcattatgacttcgagtggtcctgttgggtgcgagctatcagccaggaagaccaactcgctacttgctggcaagccgagcactgcggggaagttcacaacaaagacatgtcttggcccgaggagatgagcttcaccgccaacagttccaaaattgatagacagaaggttccaaccgagaagggggcgacaggactatccaacctaggaaatacttgttttatgaactcttctatccagtgcgtgtccaatacacaacctctgacccaatactttatctccggtcgacatctttacgaattgaacaggactaaccccatagggatgaagggccatatggcgaaatgttatggggacctcgtccaggaactgtggtcaggaacacagaaaagcgttgcgcctctgaagctgagacgcaccatcgctaagtacgcccctaaatttgatgggttccaacagcaagacagccaggagctgctcgcattcctcctagatggtcttcatgaggatctgaatagagtgcacgagaaaccttacgttgagctcaaggatagtgatggtcgtccagattgggaagttgcggctgaggcctgggacaatcatctccggagaaaccggtccatcatcgtcgatctgtttcacggccagctccgctcgcaggttaagtgtaagacttgcggccacatttctgtcagattcgatcccttcaatttcctctctcttcctcttccaatggattcatacatggatctcgaaatcaccgtgattaagttggatggaaccacgccagtgcgctatgggctccggttgaacatggacgagaaatacacaggcctcaaaaagcaattgcgagatctttgcggtcttaattcagagcagatcttgctcgccgaagtgcacgatagcaacatcaagaattttccccaagataatcagaaagtccaattaagtgtgtcaggctttctttgtgccttcgagatacccgtgccttccagcccgatcagcgcaagctctccgacacaaattgattttagcagcagcccttccaccaacggtatgttcacattaaccactaatggagatctgcccaagcctatatttatcccaaacggaatgcccaatactgtcgtgccctgcggcacagagaagaattttacgaacggcatggtaaacggtcatatgccctctctgccagacagcccgtttaccgggtatataattgctgtgcaccggaagatgatgcggacagagctgtattttctgtccccccaagagaatcggccgtccctatttggaatgcccttgatcgtcccctgcacagtgcacacccggaagaaggatttatatgacgccgtgtggatccaggtatcttggctcgcgcgtccactgcctccccaggaagcaagcatccatgcccaggatagggataactgtatggggtatcagtacccttttacattgcgggtagtccaaaaagatggcaactcatgcgcatggtgtccccagtatagattctgtcgcgggtgtaagatagactgtggggaggaccgggcctttattggaaatgcgtatatcgcagtggattggcacccgacggcactgcaccttcgatatcaaacatcacaagagcgagttgtggacaaacatgaaagcgttgagcagtctcggcgagcccaggccgaacctattaacctggactcttgcctgcgtgccttcacaagcgaggaggagttaggcgaaagcgaaatgtactattgttctaagtgtaagacccattgcttggctaccaaaaaactggacttatggcgcttgcctccttttcttatcattcacctgaaaaggtttcagttcgtcaacgatcagtggatcaaatcgcagaagattgttcgcttcctgcgcgaatcctttgatccgtccgctttcctggtgcctcgagatcccgccctgtgtcagcataaaccactcaccccccagggcgatgaactaagcaagccccgtatactcgcccgcgaagtgaaaaaggtggatgcccagtcgtcagccggtaaggaagatatgctactgagcaagtcccctagtagcctatcagccaatatatcgagcagccccaagggctctcccagttcttcccgcaaatctggtacctcctgtccctcctccaaaaattcttctccgaatagctcgcccaggacccttgggcgtagcaaggggaggctgagactgccccagattggatccaagaacaaaccctctagcagcaaaaagaatttagacgcaagtaaagaaaacggagcaggacaaatttgcgaactggctgacgccctgagtagaggccacatgagaggaggcagccaacccgagctggtgacacctcaggatcacgaagttgccctcgccaatgggtttctctacgagcatgaggcctgcgggaatggctgtggggatggatactccaatggacagcttggtaaccactccgaggaagactctaccgatgaccaaagagaagatactcatattaaaccaatatataatctgtacgcgatctcgtgtcattcgggcatcctctctggcgggcactatatcacatacgccaagaaccccaattgcaagtggtactgctataacgattcgtcctgcgaggagctacacccagacgagatcgatacagattcggcgtacatcctgttctacgagcagcagggaattgattacgctcagtttcttccgaagatagatggaaaaaaaatggccgacacatcatccaccgatgaggactcggagtcggattacgagaaatatagtatgctgcagtag

SEQ ID NO: 139816 - DNA, 2361 bp, Artificial Sequence
  Description of Artificial Sequence: Synthetic coding sequence
atggatatggtcgagaacgccgatagcctgcaggctcaagagaggaaagatattcttatgaaatatgataaaggccatcgagccggactgcccgaggacaagggaccagaacccgtcgggatcaactcatctatcgatagattcggcatcttacacgaaactgagctgcccccagtcacggccagagaagctaaaaagatccgccgggagatgacccggacgtcaaagtggatggagatgctcggggagtgggaaacctacaaacactctagcaagctcatcgatagagtctacaaggggatcccaatgaacatcagaggccccgtctggagtgtattgctgaacatccaggaaataaagctgaaaaatcccggtcggtatcagattatgaaagaacggggaaaacgcagctctgagcatattcaccacattgacttggatgtccgtacaacattgagaaaccatgtcttctttagagaccggtacggagctaagcagagagaactattctacatactcctggcatattccgagtataatcccgaagtgggatattgccgcgatctttcccatattactgctttgtttcttttgtatctgccagaggaagacgcattctgggcgctcgtgcagttgctggcatccgaacgtcactctctcccaggatttcactctcctaacgggggcacagtgcagggcctgcaggatcagcaggagcacgtagtacctaaatctcaacctaagactatgtggcaccaggataaggaaggactctgcggccagtgcgcctcccttggatgccttctgcggaatcttatcgacggcattagcctgggcttgaccctcaggctttgggacgtgtacctggtggagggagaacaggttctgatgccgataaccagtattgcattgaaggtccaacagaaaagacttatgaagacctcccggtgcgggctttgggccaggctgcgcaaccagttttttgacacctgggcaatgaacgacgacacagtgctcaaacacctgagagcttcgaccaagaagctcacccgtaaacagggtgacctcccacctcctgcgaagagagagcagggctctctcgcccccaggcccgtgcctgccagtaggggtggaaagacactgtgcaaggggtacaggcaagcccccccgggccctcccgcacaattccagagacctatctgcagtgcaagcccaccgtgggcctcccgattttccacaccgtgcccaggtggtgcagttcgggaggatacataccctgtgggcacacagggggtgccttctctggccctcgcccagggcggccctcaaggtagctggcgctttctggagtggaaaagcatgcccagactgcccacagatcttgacatcggaggcccttggtttccacattacgacttcgaatggagttgctgggtacgtgccataagccaggaagaccaactcgccacatgttggcaggctgaacattgcggtgaagtgcacaacaaggacatgtcctggcctgaagaaatgagtttcaccgcgaactcctcaaagattgaccgtcagaaggtgccaaccgagaaaggagcaactggcctctccaatttaggaaacacatgctttatgaacagtagcattcaatgcgtgagtaacactcagcccctgactcaatatttcatctcagggcggcacttatatgagttgaaccgtacgaacccaatcggaatgaaaggacacatggctaagtgttatggagacctcgtccaagagctatggtcgggtactcagaaatccgtcgcaccccttaaactacgacgaacaatagcaaagtacgctcctaagtttgatgggtttcagcagcaagacagtcaggagctgttagcatttctcctggacgggctgcacgaagaccttaaccgcgttcacgagaagccatatgtagaactcaaagattccgatgggcgacccgactgggaggtggctgccgaggcatgggataatcacctccgacgaaaccggagcatcatcgtcgacctgtttcacggacagctccgcagccaggtcaaatgtaagacttgtggtcacatctcagttcgcttcgacccgttcaactttctgagcctgcctctgcctatggactcttacatggacctcgaaattaccgttataaaactggacggcactacacctgttcgctatggtctcagactgaacatggacgaaaagtacacagggctaaagaagcaattacgcgatctctgcggtctaaacagtgaacagatcctgctggcggaggtacacgattcaaatatcaagattagcccacttcaccacctgcagatggagtgttccccctag

SEQ ID NO: 139817 - DNA, 84 bp, Artificial Sequence
  Description of Artificial Sequence: Synthetic coding sequence
atggacatggttgaaaatgcagatagcctgcaagcacaggagcgcaaagatatcctgatgaaatacgataagggacatcggtag

SEQ ID NO: 139818 - DNA, 174 bp, Artificial Sequence
  Description of Artificial Sequence: Synthetic coding sequence
atggacatggtcgagaacgccgatagtctacaggcacaggagaggaaggacattctgatgaagtatgacaagggccatcgggctggactgcccgaagataaggggtcacctctggagagcaccgccgccctaatcgtgctagcattttgcatgcggcgatcctgtctcctgtag

SEQ ID NO: 139819 - DNA, 3309 bp, Artificial Sequence
  Description of Artificial Sequence: Synthetic coding sequence
atgaatcaccagcagcagcaacaacagcagaaggcgggagagcagcagttgagcgagcccgaggacatggaaatggaggctggcgacactgacgatccccctcgcataacacagaatccagtgattaatggcaacgtggctctgtcagacggccacaatactgcagaggaggacatggaggatgatacttcttggaggagcgaagccacatttcagttcactgttgaacgcttctcccgcctatccgagagcgtcctgagccctccttgttttgttaggaatttaccttggaaaattatggtcatgcccaggttctaccctgaccgcccacatcagaaatccgttggtttttttcttcaatgtaacgctgaatctgacagcactagctggtcatgccatgcccaagccgtactcaagatcattaattatagggacgatgagaagtcgttttctcgcaggataagtcacctttttttccacaaggagaacgactggggcttcagtaatttcatggcctggtctgaggtgactgatcccgagaaagggtttattgatgacgataaggtgaccttcgaagtttttgttcaggccgatgccccgcatggggtcgcatgggattctaagaagcatacaggctacgtgggactgaaaaatcaaggcgccacctgttacatgaattccctcttacagactctattttttacaaatcagcttaggaaagctgtgtacatgatgccgaccgagggagacgactcctccaaaagtgtgccattggctctgcaaagggtgttttacgagcttcagcatagcgataagccagtggggactaagaaactgaccaagagctttgggtgggagacactcgattcctttatgcaacatgacgtccaggaactttgcagagtgcttctggacaacgtcgagaataagatgaaaggtacatgtgtggaaggcacgatccctaagttgtttcgcggcaaaatggtcagctatattcagtgtaaggaggtcgactataggagtgataggcgggaagactattatgatattcagctttcgatcaagggaaaaaaaaacatttttgaatccttcgtggactacgtggccgtagagcagctggacggtgataacaaatatgacgccggggaacatggcctccaggaagctgaaaaaggggtcaaattcctaactctgccacctgttctccatctgcagctgatgaggtttatgtatgatccacagaccgatcagaatattaagattaacgatcgattcgagtttcccgaacagctgcctctggatgagttcctgcagaaaacggacccaaaagatcccgccaattatattctccatgcagtgctcgtgcattctggggacaatcatggcgggcactatgtggtctacctgaatccaaagggagatggaaagtggtgcaaatttgatgacgatgtcgtctcacgctgcacgaaagaagaagccattgagcataactacggcggtcacgacgacgatcttagcgtccggcactgcacgaatgcatatatgttggtttacatcagagagtctaagctaagcgaggtattgcaagcagtgaccgatcacgacattccccaacagcttgtggagaggttgcaggaggaaaaacgcatcgaagcccagaagcgcaaggaaaggcaagaggcccacctttatatgcaggtacaaattgtggcggaggatcagttctgcgggcatcagggtaacgatatgtacgacgaggaaaaagttaagtacacagtcttcaaggtgctgaagaattcttcacttgctgagttcgtacaatccctttcgcagaccatgggcttcccacaggatcaaatcaggttgtggccaatgcaggcccgctccaacggcacaaaacgacccgctatgttggacaacgaagctgatgggaataaaacaatgatagaacttagcgataacgaaaacccatggaccatttttttggaaaccgtcgacccagaactggccgcatctggagccactctacccaaatttgacaaagaccatgatgttatgttatttctcaaaatgtatgacccaaaaacccgctctctgaattactgcgggcacatctacactcccatctcatgtaagataagggacctcttgcctgtcatgtgcgacagagctggcttcatccaggatacatccttaattctgtacgaagaggtgaagcctaatttgaccgagcgcatccaggattacgatgtgtcattggataaggcgctagacgaactgatggatggcgatatcatcgtcttccagaaagacgacccagaaaatgacaacagtgaacttccaaccgccaaggaatactttagagacctctaccaccgggtggatgtgattttttgcgacaaaaccatccctaatgatcctggttttgtggtgacactaagcaaccggatgaattacttccaggtcgctaagacagtggcccagcggctaaacactgacccgatgctgttgcagtttttcaagagccagggatatcgcgacgggcccggcaatccactgcggcacaactatgaggggacactccgagatttgttacagtttttcaagccgcgtcagcccaagaagctctactaccagcagctcaaaatgaaaattaccgactttgagaaccgacgctcctttaagtgtatctggttgaatagtcagtttagagaagaggagattacactatatcccgataagcacgggtgcgtgcgggacctgctggaagagtgtaaaaaagctgtagagttgggagagaaagcctccggaaagctacgtctgctggagatagtatcatacaagatcatcggcgtacaccaagaggacgaactcctggagtgcttgtcgccagccacgtcgcgcacatttagaattgaggagatcccactggaccaagtggacattgacaaggagaatgagatgttagtgaccgtagcccactttcacaaggaggtgttcggcacattcggcatcccatttctgctgcgcatccaccagggcgagcatttcagagaggtgatgaaaaggattcagtctctcctcgacattcaggaaaaagagttcgagaagttcaaattcgccatagtgatgatgggcaggcatcaatacatcaacgaggacgaatacgaggtaaatctgaaagacttcgagccacagccaggaaatatgagccatcctagaccgtggttagggcttgaccacttcaataaagcccccaaaagatcacggtatacgtacctcgagaaggctattaagattcacaattag

SEQ ID NO: 139820 - DNA, 3333 bp, Artificial Sequence
  Description of Artificial Sequence: Synthetic coding sequence
tgtagccactctgacgtcggcgaacgaacttctcctatccctcagcagcggccattacagagccacgccgagatggccggcaaccatagacttggtctggaggccggcgacacagacgaccctcctaggatcacccagaaccccgtaattaacggtaacgttgctctttctgacgggcacaacaccgccgaggaggacatggaggatgatacctcatggaggtcagaggctacatttcagtttacagtggaaagattttccagattgtcggaatcagtgctttctcctccctgtttcgtgcgcaatctgccttggaagattatggtcatgcctcgtttctaccccgaccggcctcaccaaaaaagcgttggtttcttcctccagtgtaacgctgaatccgactcaacatcctggagctgtcatgcccaggccgttttgaaaatcatcaactaccgggatgatgagaaaagcttcagccggcgaattagtcatctcttcttccacaaggaaaatgactgggggtttagtaactttatggcatggtccgaggtgaccgacccggagaaaggattcattgacgatgacaaagtcaccttcgaggtgtttgtgcaagccgacgctccccatggcgtagcttgggattccaaaaaacataccggctacgtgggcttgaagaaccagggcgctacttgttacatgaactccctcctgcaaaccctcttctttactaatcagctgagaaaagctgtgtacatgatgccgacagaaggcgatgacagctccaagtcagtgcccctggcactccaaagggtgttttacgagctgcagcactccgacaagccagttgggactaagaagcttacaaagtcatttggttgggagactctagattcttttatgcagcatgatgttcaggagttatgccgggtcctgctcgacaacgttgagaacaaaatgaaaggtacatgcgtagaggggaccatacccaaactgttcagggggaagatggtcagttatatacagtgcaaggaagtcgactaccgatcagaccgcagggaggattactacgacatccagctgagcatcaagggcaaaaaaaacattttcgaatcttttgtggactatgtggccgtggagcaactagacggagataataagtatgatgcgggtgagcatggcttgcaggaggctgaaaaaggggttaagttcctgacactccccccagtgctgcacctgcagctcatgagatttatgtacgaccctcagactgaccagaacatcaaaattaacgatcgtttcgaattccccgagcagctccctctggacgaattcctccagaagaccgaccctaaagatcctgctaattatatcttacatgccgtccttgtgcattcaggtgataaccacgggggtcattacgttgtgtacctcaacccaaagggcgatggcaagtggtgtaaattcgatgatgacgtggtctcaagatgtacaaaagaggaagctatagaacacaactacggaggccatgacgacgacctgtccgtccgccattgtacaaatgcatatatgctcgtttacataagggaatccaaactatccgaggtcctgcaggccgtgaccgaccatgatataccacaacagctcgttgaaaggttgcaagaagaaaaaaggatcgaagcccaaaagcggaaagaaaggcaggaggcccatctatatatgcaggttcagattgtggcggaagatcaattctgtggccaccaaggtaatgacatgtacgacgaggagaaggtgaagtacaccgtctttaaggttttgaagaattcatcccttgcagaattcgtgcaatccctgtcgcagacaatgggttttccacaagatcaaatcagactgtggcccatgcaggcccggtccaatggcactaaacgacccgctatgctggacaacgaagccgacgggaacaagactatgatcgaactatctgataatgagaacccctggacaatttttctggagaccgtggacccggaactcgcggcaagtggggcaacactaccaaagttcgataaggaccatgatgtgatgttgtttctgaagatgtacgatcctaagacccgatcgctcaattactgcggtcatatttatactcctatatcttgtaagatcagggaccttttacccgtgatgtgtgatcgcgccggatttatacaggatacttctctcattctgtacgaggaggtcaagcctaatctcacagagcgaatacaagactacgatgtgagtctggacaaagcccttgacgagctgatggatggggacattatcgtcttccagaaggacgatccagagaatgataattccgagctgcctaccgccaaagagtattttcgggacctgtatcacagagtagatgtcatcttctgcgacaagaccatccctaatgacccaggttttgtagttaccctctccaatcgcatgaactacttccaggtcgctaagaccgtggctcagaggctcaataccgaccccatgttactccaattctttaaatcccaggggtatcgtgacgggccagggaatccccttaggcataactacgagggcaccctgagggatctgctgcagtttttcaaaccacggcagcccaagaaattgtattatcagcagctgaaaatgaaaattaccgattttgaaaatcgtaggagcttcaagtgtatctggctcaattctcaatttcgtgaggaggagatcactctgtaccctgataagcatggctgcgtgcgggatctactggaagaatgcaagaaggcggttgagctgggggaaaaagcctccggcaagttgagactccttgaaatcgtatcatacaagattatcggtgtgcaccaagaggatgagctgttggagtgcctgtcaccggcaacatctcggaccttccggatagaggaaatccctttggaccaggtcgatattgataaagagaacgaaatgttggtgactgtcgcccacttccataaggaagtctttggaaccttcggcatccctttcctgttgcggattcaccagggcgaacacttccgggaggtgatgaaaaggatacagagtttgctggatattcaggagaaggaattcgagaaattcaagttcgccattgtcatgatgggcaggcatcagtatatcaacgaagacgaatatgaggttaaccttaaggatttcgaacctcaacccggcaacatgtcccacccacgcccgtggcttggactcgatcactttaacaaggctccaaagagatctcgctacacatatctggaaaaggccatcaaaattcataactag

SEQ ID NO: 139821 - DNA, 3012 bp, Artificial Sequence
  Description of Artificial Sequence: Synthetic coding sequence
atggtgatgccaaggttttacccggataggcctcatcagaagagcgtagggtttttcctgcagtgcaacgccgagtccgacagtacctcctggagctgtcatgcccaggccgtactgaagattatcaactaccgcgacgacgagaaatctttctcccgaagaatctcgcaccttttctttcataaagagaatgactggggcttctccaatttcatggcttggtccgaggtgactgatcccgagaagggctttatcgatgacgacaaagtgacctttgaggttttcgttcaagccgacgccccccatggcgtggcttgggatagtaagaagcatactgggtatgtaggactgaagaatcagggtgcaacctgctacatgaactccctacttcagactctgtttttcacgaatcagctccgcaaagccgtatacatgatgccgacagagggcgatgacagttccaagtccgtaccgttggccctccagagggttttctacgagctgcaacacagcgataaacctgtgggaacaaagaagctcactaagagcttcgggtgggagaccctggacagcttcatgcagcacgacgtacaggagttgtgccgtgttctcctcgacaatgtggaaaacaaaatgaaggggacttgcgtcgaaggcactattcccaagctgttccgtggcaagatggttagttacatccagtgcaaagaagttgattatcggtctgatcgtagggaggactattacgatattcagctgtccattaaggggaagaagaacattttcgagagctttgtagattatgtagcagtcgagcagctggatggtgacaataagtatgatgccggcgaacatgggctacaagaggctgaaaaaggagtcaagttcctaacactgcccccggtgcttcacctccagcttatgaggttcatgtatgatcctcagactgatcaaaacattaagatcaacgacagatttgaatttccagaacagctgccattagacgaattcttgcagaagacggatccaaaagacccggcaaactatattctccatgctgtgttagtccattctggtgacaaccacgggggccactatgtagtctaccttaacccgaaaggtgatggcaaatggtgcaaattcgatgacgacgtagtgtctaggtgcacgaaagaagaggcaattgagcataactatggtgggcatgatgacgacctgtcagtgaggcactgcactaatgcctatatgctagtctacatcagggagtccaagttgagtgaggtcttgcaggctgttaccgatcacgatattcctcagcaattagtagaacgtctgcaggaggagaagaggattgaggcgcaaaagcgcaaggagcgtcaagaggctcatctgtacatgcaggttcagatcgttgctgaagaccaattttgcggacaccaaggtaacgacatgtatgacgaggagaaggtgaagtacaccgttttcaaggtgctgaaaaatagttctcttgccgaattcgtgcagagtttaagccaaacaatgggctttccccaggaccagatccgtctgtggccgatgcaggcacgatctaacggcaccaagcgtcccgcgatgctcgacaatgaggccgacggcaacaaaactatgattgagctgtctgacaacgagaatccctggacaatatttctcgagaccgtagacccagaattggcagccagtggggctacactccccaagtttgacaaggaccacgatgtgatgctcttccttaaaatgtatgacccgaaaacacggtctctgaactactgtgggcatatctacacaccaatatcgtgcaagattcgagacctccttccagtgatgtgtgacagagctggattcatacaggacacctctctgattctatacgaagaagtgaagcctaacttaacagaacgcatccaggactacgacgtctccctcgataaagccctggacgagctgatggatggcgacattatagtgtttcagaaggacgaccctgagaacgacaactctgagctgcccacagcaaaggaatattttagggacttataccatagagtagacgtcattttctgtgataaaaccattccgaatgaccctggattcgtcgtgaccctcagtaatcgcatgaactattttcaggtggccaagacagtggcacagaggctcaatactgatccgatgctgctgcagtttttcaagagtcagggctaccgcgatggccccggcaacccgttgcggcacaattacgagggcactctgcgggacctattgcaattctttaaaccaagacagcccaagaaattatactaccagcagttgaagatgaagattacggatttcgagaatcggcggtcatttaaatgcatttggttaaactctcaattcagagaggaggagataactttatatccagataagcatggctgcgtgcgagacctgttggaggaatgtaagaaagctgtcgagttgggcgaaaaagcctctggaaagcttcgcctgctcgaaattgtttcttacaagattatcggggtccatcaagaggatgagttattggaatgtctgagcccagcaacaagcagaacattccgcattgaggaaattcctttagaccaagtcgacattgataaggagaatgagatgctggttactgtggcacactttcataaggaggtgttcgggacctttggaataccctttttgctgaggatccaccaaggcgagcacttccgtgaagttatgaagcgtatccagtctttgctggacatccaggaaaaagaattcgagaaattcaagtttgctattgtaatgatgggccgacaccagtatatcaacgaagatgagtacgaagtcaatttaaaagacttcgaaccgcaaccgggcaacatgtctcatccgcggccctggttgggcctcgaccattttaataaggctcccaagagatctcggtatacttaccttgaaaaggccataaaaattcacaactag

SEQ ID NO: 139822 - DNA, 1530 bp, Artificial Sequence
  Description of Artificial Sequence: Synthetic coding sequence
atggaggacgacacttcctggaggtctgaagctacgttccagttcaccgttgaacgctttagcaggttgtcggagagcgtactatctccgccatgcttcgttagaaacctcccatggaagattatggtgatgcccaggttctatccagatagaccccaccagaagtccgtcgggttcttcttgcagtgtaacgccgaatcagattccaccagttggtcctgtcacgcccaggcagtcctcaagatcatcaactacagggatgatgaaaaaagtttttcccgccggatctctcatctgttttttcacaaggaaaacgactggggattcagcaattttatggcctggagcgaagttaccgatcctgaaaagggcttcattgacgacgacaaagttacctttgaggttttcgtgcaggccgacgccccacacggagtcgcatgggactccaagaagcatacaggctatgttgggctgaagaatcaaggagctacatgctacatgaattccctgctgcaaaccctgttttttacaaatcagttgcggaaagcagtttacatgatgcccacagagggagatgacagtagtaagtcggtccccttggctctgcaaagagtcttctatgagctacagcactctgacaagccagtgggaaccaaaaaacttacgaagtcgttcggttgggagactttagacagctttatgcaacacgatgtgcaggaattgtgccgcgtgcttctcgataatgtcgagaataagatgaaaggaacttgcgttgaaggtactatccctaagctcttcagaggaaaaatggtttcttacattcagtgcaaggaggttgactaccggagtgacagacgcgaagattattacgatatccagctgagtataaagggcaagaagaacatcttcgagtcatttgttgactacgtagcagtggagcagctggatggcgacaataagtacgatgctggcgaacatggacttcaggaggcggaaaaaggtgtgaaattcctcactctgccccctgtgctacatttgcaactcatgcggttcatgtatgacccccaaaccgatcagaatatcaaaatcaatgaccgcttcgagtttcctgagcagctccccctggatgaattcctgcagaagaccgatccaaaggatcccgccaattacatccttcacgcagtgcttgtccactcaggtgacaaccatggcgggcactatgtcgtgtacttgaaccccaaaggggatggaaagtggtgtaagtttgatgacgacgtggtgtcacgctgtactaaggaagaggcaattgagcataactacggcgggcacgacgatgacctgtccgttagacattgtaccaacgcatacatgctcgtgtacatcagggagagcaaactgaccgtcgggggggcaataacccgacgagagaaggaccgaggctctgaggccgaaggtgcggcgggatctccatccctctacgcttccgcagatagtagaaggggtccggtgctctggccaccgagggagtag

SEQ ID NO: 139823 - DNA, 7713 bp, Artificial Sequence
  Description of Artificial Sequence: Synthetic coding sequence
atgaccgctaccactagaggctctccagtcggaggcaacgataatcagggtcaggcccccgatgggcagagtcagccacctttgcagcagaaccaaacgtccagcccagactcttccaatgaaaatagtccggcgacccctcctgatgaacagggacaaggagatgccccaccacaactggaggacgaagagccagcttttccccacacagacctcgccaaactcgacgatatgattaatcggcccagatgggttgtgccagttttaccaaagggcgaactggaagtgttgttggaagcagccatcgatctctcgaagaaggggcttgacgttaagtctgaggcctgccagcggttcttcagggatgggcttacaatctcttttacgaagatcctgactgacgaagccgtgtctggctggaaatttgaaatacaccgctgtataattaataacactcaccgactcgtcgagctatgtgttgccaaattatcacaagactggttcccactcctcgaactgctggccatggcgctgaatccacattgcaaatttcacatctataacggtacacgcccatgcgagagcgtcagcagcagcgtccagctcccggaggacgaactctttgcacgcagtcccgatccacggtccccgaaaggttggttagttgacctactgaacaagttcggcactcttaatggctttcagattctgcatgatagatttataaacggaagtgcacttaacgtacagattatagccgcgttaatcaagccgttcggacagtgctatgaattcctgactctccataccgtgaaaaagtacttcctgcccataatcgagatggtgccccagttcctggagaacctgacggatgaggaactgaagaaggaggctaaaaacgaggccaaaaatgacgctctttctatgatcattaaatcgttaaagaacctcgcttctagggtgccagggcaggaggagacggttaaaaatttagagattttccggctcaaaatgattctgaggcttcttcagatcagcagcttcaacgggaagatgaatgcactgaacgaagttaataaagtgatcagtagtgttagctactatacacacagacacggaaatcccgaggaggaagagtggctgactgccgaacgcatggcagagtggattcagcaaaataatatactttccatcgtcttaagagactcactgcaccaaccacagtacgtggaaaaacttgagaaaattctgagattcgtaattaaagagaaggctcttacactgcaggacctggataacatttgggcggcccaggccggaaagcatgaagccatagttaagaatgtgcatgatctgcttgcgaaacttgcatgggatttctcacccgagcaactcgatcatttgttcgactgttttaaagcttcttggaccaacgcctcaaagaagcagagagagaagctgctcgaactcattcgtcggttggccgaggacgataaagatggtgtcatggcccacaaggtgctgaaccttctctggaacctcgcccactccgatgacgtgcccgttgatatcatggatctagccctttccgctcatatcaagatccttgactacagctgctctcaagacagagacacgcagaagattcagtggatcgatcgctttattgaagaactgcgcaccaatgacaaatgggtcataccggcactgaaacaaatcagggagatctgttctctgtttggtgaagcaccacagaacttatcccagacacagcgatctcctcacgtcttctatcgccatgacctcataaatcagctgcagcataaccacgcactggttacactggtggccgagaacctggcaacatacatggagagcatgaggctatatgcaagggatcatgaagattatgacccacagacggtccggctcggctcaagatacagccatgtccaggaagttcaggaaagactgaatttcctgaggttcctcctgaaagacggacaattatggctttgcgcgccacaggctaagcagatttggaagtgtcttgccgaaaacgccgtgtacttgtgcgaccgggaggcttgttttaaatggtatagtaagctgatgggtgacgagcccgacctggacccagatattaacaaggatttttttgagagtaacgtcctccagctggacccgagcctcttaaccgagaacggaatgaaatgctttgagcgcttcttcaaggcagttaattgcagagagggcaaactcgtggcaaagcggagggcctatatgatggatgatctcgaactgataggactggattacttatggagggtcgtcatccaaagtaatgatgacatcgctagcagggctatcgacctactaaaagaaatttatacaaacctcggtccacgcctccaggtgaatcaggtagtgattcacgaggatttcattcagagctgcttcgaccgcctcaaagcaagttatgacacgctatgtgtcttggatggtgacaaagattctgtgaactgcgccaggcaggaagcagttaggatggttcgcgtgctaacagtgctgagagagtatatcaatgagtgtgacagcgattaccacgaggagcgtaccattctccccatgtcacgagccttcaggggcaaacacctgtcttttgttgtgcgcttccccaaccagggaaggcaggtggatgacctggaggtgtggagccatactaacgacaccatcggatcagtccggagatgtatcttaaaccggattaaggctaacgtcgcccatactaagatcgagctatttgttggcggggaactgattgacccagccgatgaccgaaaactcattggccaactgaatctcaaggacaagagcctgataacagccaaattgacccagatctcctccaacatgccctcctctcccgacagcagttcggacagcagcacaggcagccctggaaaccatggcaaccactacagtgatggacccaaccctgaagttgagagttgtcttcccggcgtgattatgtcactgcatcccagatatatttcctttctttggcaagtcgccgacctgggatcttcgctgaatatgcctcccctgcgagacggagcccgcgtgctaatgaaactcatgcctcctgatagtactacaattgagaagctccgggctatctgcctcgatcatgccaaactgggcgagtcatctctatctccctctctcgatagcttgtttttcgggccgtcagcgtcacaagtactttaccttactgaggtcgtgtatgcccttctgatgccagccggagccccccttgccgacgacagttccgattttcaattccactttctgaaatctggcggcctgccactcgtgttgtctatgctgacaagaaacaattttctccctaatgccgatatggagacacggcgcggagcttatctaaatgccctgaagattgccaaactcctgctaaccgccattggttacggccacgtccgggcagtggccgaggcatgccagcctggcgtcgagggagttaatccaatgacccaaattaatcaggtgactcacgaccaggcagtggttctgcagagtgccttgcagtctatccctaatcctagtagtgagtgtatgctcagaaatgtctcagtgcgtctcgcgcagcagattagcgatgaggcctcaaggtacatgccagacatttgtgtgatcagggcaatacagaaaatcatatgggctagcggatgcggctccctccagctcgtgttctccccaaatgaggaaatcaccaaaatctatgagaaaactaatgccgggaatgaacccgacttggaagatgagcaagtgtgttgtgaggccctggaggttatgactctctgctttgctctcataccaacagcactggatgcgctgagtaaggaaaaagcatggcagacttttatcattgacctgctgctacattgtcacagcaaaactgtgagacaggtggcccaagagcagtttttccttatgtgtacgagatgttgcatgggtcaccggccattgctcttcttcattaccttactttttactgtgttgggctcgaccgcccgggagcgcgctaagcattctggggactacttcaccctgctgcggcatctgctcaactatgcgtacaactccaacattaacgtccccaacgccgaggtgttgttgaacaacgaaatcgactggctgaaaagaatcagagatgatgtgaagcgtaccggcgaaactggtatcgaagagactatcctggaaggacatctgggcgtaaccaaggaactgctcgcattccaaaccagcgaaaaaaagtttcatattggttgtgaaaaaggaggtgcgaatctgattaaggagctgattgatgacttcatctttcccgcctctaatgtgtatttacagtacatgcggaacggcgaacttcccgcagaacaagcgatccccgtgtgcggtagccctcctaccatcaatgctggttttgaacttctggttgctctggctgtggggtgtgtgcgaaacctcaaacagatcgtcgattcactcactgagatgtactatatcgggacagcaatcaccacctgtgaagccctcaccgagtgggagtatctgccaccagtgggtccgcggcctccaaaggggtttgtgggtctgaagaatgcgggggcaacatgttacatgaacagcgtcatacagcagctgtatatgatacctagcatcaggaatggcattcttgcaatcgagggaactgggtcagatgttgacgacgatatgtccggagacgaaaagcaggacaatgagagcaatgtggatccgcgagacgatgtcttcggctacccacagcagttcgaggacaaacccgccttgtccaagacagaggatagaaaggaatacaatattggggtgctgcggcacctgcaggtgatctttggccacctcgcggcctctcgcctgcagtattacgtcccccgcgggttttggaaacagttccggctttggggcgagccagtcaatctgcgggaacagcacgatgctctcgagttctttaactctctggtggacagtctggacgaggctctgaaagccttagggcaccctgctatgttgtccaaagtcctgggcgggtcatttgcagatcagaaaatatgtcaggggtgtccccatagatacgaatgcgaggagtctttcactaccctgaacgttgacattcggaatcaccagaatctcctggattccctggagcaatatgtgaaaggtgatttgctggagggagcgaatgcgtaccattgcgagaagtgtaataagaaggtcgatactgtgaaaagactgttaataaagaaactgcctccagtcctggcaatccaactgaagcgattcgactatgactgggaaagagagtgcgccatcaaattcaatgattatttcgagtttcccagggaactagatatggaaccctatacggtagcaggggtggccaagctggagggagacaatgtgaacccagaatcccagctgatacagcagagcgagcaatctgagtcagaaaccgctgggtccacaaaataccggttagtaggtgtcctggtgcacagtggacaggcatctggcggacactactatagttacattattcaaagaaacgggggtgatggggaacgcaaccggtggtacaagttcgatgacggagacgttaccgagtgcaagatggacgacgacgaagagatgaaaaatcaatgtttcgggggagaatacatgggggaagtttttgaccacatgatgaagcgcatgagttaccggcggcaaaaacggtggtggaatgcatacattttgttctacgaacggatggacacaatagatcaggatgacgaattgatacgatatatatccgaacttgcaataaccacgagacctcaccaaataatcatgccctctgctatcgagcgtagtgtgcggaagcagaacgtgcagtttatgcacaaccgcatgcaatattcaatggaatatttccagtttatgaagaaactcttgacttgtaatggcgtgtacctgaacccgcctcctggtcaggatcacctcctgcccgaagcagaggaaattacaatgatctctattcagctcgccgcccgctttctgtttaccactggctttcataccaaaaaagtggtccgtgggagtgccagtgactggtatgacgccctgtgcatactgctcaggcactccaagaacgtgcgcttctggtttgcccataatgtactgtttaacgtttccaaccgcttcagcgagtacctgttggagtgtcctagcgccgaggtcagaggagcattcgccaagctcatcgtctttattgctcacttttctctccaggacgggccatgcccatcaccattcgcaagcccgggacctagttcacaggcgtacgacaacctgtctctgtccgatcacctgcttagggcggtgctcaatctcctgcggagagaagtaagtgagcacggtcgacatttacagcagtactttaatcttttcgtcatgtacgccaatctgggagtcgccgagaaaactcaacttttaaagctgagtgtccccgccactttcatgctggtttcactggatgaaggtcccgggccccccatcaagtatcagtacgctgagcttggaaagctgtactccgtggtgtcacaattaattcgctgttgcaacgtctcctcaagaatgcagagcagcatcaacggcaaccccccattgccaaatccttttggggatccaaatttatcccagccgatcatgcccatccaacagaatgtcgccgatattctctttgtgcggaccagttatgtgaagaaaattattgaggattgtagcaattccgaggaaacggttaagctgctcagattctgttgctgggaaaacccgcagttcagctcaactgtcctgagcgagctgttgtggcaggtggcatattcctatacatacgagcttcggccctatctagatctgctgctgcagatcttgctcatcgaggattcgtggcagactcaccgtattcacaatgccctgaagggtatccccgacgaccgggatggactgttcgacaccattcagcgctcaaaaaaccattatcaaaaacgtgcataccagtgtattaaatgtatggtcgccctattcagcaattgtcctgtggcctaccagattttgcagggaaatggggaccttaaaaggaaatggacttgggccgtggaatggctcggagatgagctggaaaggcgaccttataccggtaatccgcaatacacctacaataattggtctccccctgtacagtccaacgaaacttccaacggttattttctggagcgatcacactcagcaagaatgacacttgcgaaagcctgtgagttgtgtcctgaagaagtaaagaaagccacttcagttcagcagattgagatggaggagagcaaggaacctgacgaccaggacgcacctgacgaacatgagagtccaccccccgaggacgcccccttgtacccacattcaccgggctctcagtaccaacagaataaccatgtgcacggtcaaccctatactggtccggcagctcatcacatgaacaatcctcaacgcacaggccagagggctcaggaaaattacgagggctccgaggaggtgtctcctccccagacaaaagatcagtag

SEQ ID NO: 139824 - DNA, 7665 bp, Artificial Sequence
  Description of Artificial Sequence: Synthetic coding sequence
atgacagccaccactaggggttcaccagtaggcggcaacgacaatcagggtcaagcacctgatggtcagagtcagccgccgctccagcagaaccagaccagctcacccgacagctctaatgaaaactctcccgcaacaccccccgatgagcaagggcagggtgacgccccccctcaactggaggatgaagaacctgcgttcccacacactgatctcgcaaagctggacgatatgattaatcggcccaggtgggtggtgcctgtgctgcctaagggggagctggaggtgctgttagaagctgcaatcgacttatccaagaagggcctcgatgtcaagtcagaagcctgccaacgattcttccgggacgggctcacaatcagcttcacaaaaatattgacagacgaggctgtctcaggctggaagtttgagatacacagatgtatcattaacaacactcaccgtctggtcgaactgtgcgtggccaagctttcccaggattggttcccattgctggagcttttggctatggccctgaacccccattgtaagtttcatatttacaatggcacacgaccatgcgagtctgtgagctcctctgtgcagctgccagaagacgaattgtttgcgcgatcacccgatcccaggagtccgaaaggatggctggttgatttgttgaataagtttggtactcttaatggatttcagatcctgcatgatcgattcatcaatggctcggcactcaacgttcagattatagctgccctgatcaagccattcggtcagtgctacgagtttctgaccttacataccgtaaagaaatattttctgcccatcatcgaaatggtcccacagttcttagaaaatctcacagacgaggaactcaagaaggaggcaaagaatgaagcaaaaaacgacgctctgagcatgatcataaaaagtctcaaaaacctcgcatcacgagttccagggcaagaggagacagtgaagaatctcgaaatctttaggctcaagatgatactccgattgctccagataagttctttcaatggaaagatgaatgccctcaacgaggtcaataaagtgatctcgtccgtgtcctactacacacaccggcatggcaaccccgaggaagaggagtggctgacggcagaacgtatggctgaatggatccagcagaataatatcttgtcgattgtcctgcgcgattcactgcatcagccacagtatgttgagaagctcgagaagattttacgcttcgttatcaaggaaaaagcgctgacactgcaggacctggataacatctgggctgctcaggccgggaagcacgaggcaatcgtgaagaacgtacacgatctactggctaagctggcctgggacttttctcctgaacagctagaccatctctttgactgctttaaggcaagctggaccaatgccagcaagaagcagagggagaaattactggagctgatacgccgtttagctgaagatgataaggacggcgtcatggcgcacaaagtgctgaacctcctatggaatctggcacatagtgacgatgtgccagtggacattatggaccttgctttatccgcccatatcaagatcctagactactcttgcagtcaggaccgagacacccagaaaatccagtggattgatagattcatcgaagagctgcggacaaacgacaaatgggtgatcccggccctgaagcagatcagagaaatctgtagcctctttggcgaagccccgcagaatctcagccagacacagcgatctcctcatgtattttacaggcacgacttgatcaaccagctccagcataatcacgcactggtgacgctcgtggcagagaacttagctacctacatggagagtatgaggttgtacgcccgagatcatgaggactatgatccacagacagtgaggcttggttcacgttattcccacgtgcaagaagtgcaggaaagactcaattttctccggttccttctgaaagacggacagctctggctctgtgctccccaagctaagcagatctggaaatgtctggccgagaatgccgtgtacctttgcgatcgtgaggcgtgttttaagtggtatagcaagttgatgggggatgagcccgacttggacccagatatcaataaggactttttcgagtccaacgtgctacagctcgacccatctttgctaaccgaaaatgggatgaaatgctttgaaagattttttaaggcagtgaactgcagagaggggaaactggtggctaagcgacgcgcgtacatgatggatgacctagagctgatcgggctggactatctgtggcgcgtggttatccagtctaacgacgatatcgccagcagggccatcgatctactgaaagaaatatacacaaatctgggtcccagacttcaggttaatcaggtggtgattcacgaggacttcattcagagctgtttcgacagactcaaagccagctatgacacactgtgtgtgctggacggtgataaggacagcgttaactgtgcccgccaggaggcagtccggatggtgagggtcttgaccgtgctcagggagtatatcaatgagtgtgatagcgactatcacgaggagagaacaattctccccatgagccgcgcgtttcgcggcaaacatcttagctttgtcgttcggtttccgaatcagggccgccaagtggacgacctcgaggtttggagtcataccaatgacacaatcggctccgtcagacgatgcattttaaatagaattaaggcaaacgttgcccacacaaaaattgagctatttgtgggcggcgagctgatagaccccgccgacgacaggaagctgattggtcaactcaatctgaaggataagtctcttattaccgccaagctgacacagatatcaagtaacatgccatcttctcccgacagttcttccgatagcagcacaggatctcctgggaatcatggcaaccattacagcgacggaccaaatcccgaggtggagtcatgtctgccaggggtgatcatgagcttgcaccctagatacatttccttcctttggcaagtcgccgatctgggatcgtctctcaatatgccacctttaagagatggcgcccgagtgcttatgaagttgatgccccccgattcaacaaccatcgagaaacttagggcaatctgcctggatcacgccaaattaggggagagcagccttagtccatctcttgattccttgttcttcggcccatccgcaagtcaagttctgtacctgacagaggtagtctatgccctgttaatgccagcaggagcaccacttgctgatgactcaagtgattttcagttccattttctaaagtctggcggcttgccgctcgtcctttcaatgctgactcggaataattttcttccaaacgcagatatggagactagacgaggtgcttacctgaatgctctcaaaatcgctaagctcctgctcactgcaatcggttacggacatgtgagggccgtggccgaggcctgccagcccggggtcgagggcgtgaaccccatgacgcagatcaaccaggtcacgcacgatcaggccgtggtgctacagtcagctctgcaatccatcccaaaccccagtagtgagtgcatgcttagaaatgtctccgtcagattagcccagcagatttccgacgaggccagtcggtatatgccagacatttgtgtcatccgcgctattcagaagatcatctgggccagtggctgcgggtccctgcaacttgtgttctctcctaatgaagaaattaccaaaatttacgaaaagacgaacgcaggtaacgagccagatcttgaggatgagcaggtctgctgtgaagcccttgaggtgatgactttgtgctttgctctgatcccgacagcgttagatgctctcagcaaggaaaaggcttggcagacattcattatcgatctcctgttacattgccacagtaagacagtgaggcaggtcgcgcaggaacagttttttctaatgtgcacaagatgttgcatggggcaccgacccctgcttttcttcataaccttactgttcacggtcctcgggagcacagcccgcgagagagctaaacattcaggggactattttacgctgctccgtcacctgctcaattacgcttacaactcaaatataaacgttccaaatgccgaggttctcctcaataatgaaattgactggttaaaaagaattagggatgacgtcaagcgaacgggcgagacgggcattgaagagactattcttgaaggccacttaggcgtgaccaaagagttactcgctttccaaacaagcgagaagaagtttcacattggatgcgaaaaggggggggcaaaccttatcaaagagctaatagatgactttattttccctgcatccaatgtgtatttgcagtacatgagaaacggagaactccccgcagaacaggccatcccagtgtgtggtagtccccctactatcaacgcaggatttgaacttctcgtagccctggcagttggatgtgtcagaaatctgaagcagattgtcgatagtcttaccgagatgtactatatcggtactgccattacgacttgtgaggctctcacagaatgggaatacctgccaccggtgggcccccgcccaccaaaagggtttgttggcttaaagaatgccggcgccacctgttacatgaactccgtgatacaacaactttacatgattccttcgatcaggaatgggattttggctatagaagggactggctcagacgtcgacgacgacatgtctggcgatgagaagcaggacaacgagagtaatgtggatcctcgagacgacgtctttggataccctcagcaattcgaggacaaaccagctctgtctaagacagaggatcgaaaggaatataacataggggtcctacgccacctacaggttattttcggtcatttggccgcttcccgtctccagtattatgtgccccggggtttctggaaacagttcagactttggggagaaccggttaacttgagagagcagcacgacgccctagagttcttcaattccttagtcgatagcctcgacgaggccctgaaagccctaggccatcccgcaatgctgtctaaagtcctgggggggagctttgctgatcaaaagatatgccaaggatgcccacatagatacgagtgcgaggaaagcttcaccaccctcaacgtggacatccggaaccatcagaatctgttagacagcttagagcagtacgttaagggggacttgttggaaggcgccaacgcctatcactgcgagaaatgtaacaagaaagtggatacagtgaagcgccttctgatcaagaagcttcccccagtcctcgcgattcagctgaaacgctttgactatgattgggagcgggagtgcgcaatcaagttcaatgactattttgaattcccgagggaactggacatggagccatacaccgtggctggagtagctaaactcgaaggagacaacgttaatcctgagtctcagctgattcagcaaagtgagcagtctgaatccgaaacggccggatcaaccaaatatcgactggtaggcgtgctcgtgcattcgggacaggcatccgggggtcactactacagttatatcatacaaagaaacggaggcgacggcgagcgcaataggtggtacaagttcgatgatggggacgtcaccgaatgtaagatggatgacgatgaagaaatgaaaaatcagtgcttcggcggtgagtatatgggtgaggtgtttgaccacatgatgaagcgcatgtcatataggaggcagaaacgctggtggaatgcatatatacttttttacgagcgaatggatactatagaccaagatgacgaactcatccgttatatctccgagttagcaattactacacgcccccaccagattatcatgccaagcgctatagagcgaagtgtgcgcaaacagaatgtgcagttcatgcacaaccggatgcagtatagtatggaatattttcagtttatgaagaagctgctaacatgcaatggtgtgtacctgaacccccccccgggtcaggatcatttgctaccagaagccgaggagatcaccatgatatcaatacagctcgccgcaaggtttctatttacgactgggttccataccaaaaaagtggtccgcggttccgcgagcgattggtacgacgcattgtgcattctgctgcgccattcaaaaaatgtgcggttttggtttgctcataacgtcctgttcaatgtctcgaacagattctcagagtacctgctcgagtgtccttctgccgaagtgcggggcgcttttgctaagctgatagtgttcattgctcattttagccttcaggacggtccttgtccaagcccgtttgcaagcccaggccccagttctcaggcgtacgacaacttatccctctccgaccatttgttacgcgccgtgctgaacttgctgagacgggaggtctccgaacacggacgacatctgcagcagtactttaatctttttgtcatgtatgccaacctaggtgtggccgagaagacgcagctcttaaagctgagtgttccagccaccttcatgctcgttagtctcgatgaaggccccggcccccccatcaaataccagtacgccgagttggggaagctttactctgtggtgagtcagcttatccggtgctgcaacgtgtcctcccgcatgcaaagcagcatcaacgggaacccccctctacctaacccctttggtgatccgaacttgagtcagcctatcatgcctatccaacagaatgtggccgatatactattcgttaggactagctatgttaagaaaatcatcgaagactgtagcaacagcgaagagaccgtaaagctgctaaggttctgctgttgggagaacccccaattctccagtaccgtgctttccgagctactctggcaggtagcatattcctacacctatgaactccgtccttatctggacttactgcttcaaatactcctgatagaggactcctggcagactcaccgcattcataatgccctgaagggcattcctgacgatcgagacggcctgtttgatactatccagagatccaagaatcactaccagaagagggcttaccagtgtatcaaatgcatggtggcccttttctccaattgccctgtggcttaccaaattcttcaggggaatggcgaccttaagcggaaatggacttgggccgtggaatggctgggagatgaactcgagcggcggccatatacaggcaacccccaatacacatacaataattggagccctccagtgcagtccaatgagactagtaacggctacttcctggaaaggagtcactccgctcgcatgaccttagctaaggcctgtgaattgtgtcctgaggaagagccagacgaccaagacgcgcccgacgaacacgagtctcctcctcccgaggatgcgcccctgtaccctcacagcccaggatctcagtatcagcagaacaaccacgtgcatggtcagccgtataccgggcctgccgctcaccatatgaacaacccccagaggacaggccagagggcacaagagaactacgagggttccgaagaggtatctcccccccagaccaaagatcaatag

SEQ ID NO: 139825 - DNA, 7668 bp, Artificial Sequence
  Description of Artificial Sequence: Synthetic coding sequence
atgacagccatcactcatgggagccccgtagggggcaatgattcgcagggtcaggttctggatggccagagtcagcatctattccagcagaatcagacttcttcacctgattctagcaatgagaactccgtggctactccacctcccgaggagcaaggccagggagatgctccacctcagcacgaggatgaagagcccgctttcccacacacggagttggccaacctggacgatatgatcaaccgaccgagatgggtcgttccagtgctcccaaaaggcgagttggaagtcctactcgaagccgccattgatctatcagtcaagggcctcgacgtgaagagtgaggcctgtcagaggtttttcagggacggactgaccattagctttactaagatcctgatggacgaagccgtgagcgggtggaagttcgagattcataggtgcatcatcaacaatacccatagactcgtggagctgtgtgtcgcgaagttgagccaggactggttcccactgctggaacttctggccatggccctcaacccacattgcaaattccacatctataatggtacaagaccctgcgagctgatctcttccaacgcacaactgcccgaagatgaactgtttgccaggagttccgacccccgctcccctaaggggtggctggttgatttgatcaacaagtttggaacactgaatggtttccagattctgcatgacagatttttcaacgggtcagctctgaatattcagatcattgccgcacttatcaagcccttcggacaatgttatgagttcctaagccagcacaccttgaagaagtattttatccctgtcatcgaaatcgtgccacatcttctagaaaacctgactgacgaggaactgaagaaggaggccaaaaatgaagctaagaatgatgcactgagtatgatcattaaatccctgaagaacctggcctccaggataagtggccaagacgagaccattaaaaatctggaaattttccggcttaagatgattttgcggttactccagattagtagctttaatggcaagatgaatgcattgaacgagataaacaaagtgatatcgagcgtgtcttactatactcaccgtcattctaatcctgaggaggaagagtggctgaccgccgaacggatggcagagtggattcagcagaataatatcttaagtatcgtcctgcaggactctctgcatcaacctcagtatgtcgaaaagttggagaagatactgcgttttgttattaaggaaaaagctcttacgcttcaggacttagacaacatttgggctgcacaggcggggaagcacgaggcaatcgtgaaaaatgtacacgacttgctggcaaagctggcctgggatttcagccccggtcagctggaccacctcttcgattgttttaaggctagttggacaaacgcttctaagaaacaaagggagaaattacttgaactcattcgccgcttggccgaggatgacaaagatggagttatggctcataaggtattaaacctgctgtggaatctggcccaaagcgatgacgtacccgtagacatcatggacctggccttatcagctcacatcaagatcttggactattcttgttcccaggacagagacgcccaaaaaattcaatggatagaccactttatcgaggagctacggaccaacgacaagtgggtgattcccgctctgaaacaaatccgcgaaatttgttctctctttggcgaagcgtcccaaaatctgtctcagactcagagatcgccacatattttctacaggcatgatcttatcaatcagctgcaacagaatcacgcactcgttacactcgtagcagagaatctggcgacctatatgaactcgattcgactgtacgctggcgatcatgaagactatgacccacaaactgtgagattgggctccagatactctcacgtgcaggaggtgcaagaacggcttaacttccttcgatttttattgaaggacggacagctgtggctctgcgccccacaggccaagcaaatctggaagtgtctggcagaaaacgcggtttatctgtgtgatcgggaagcgtgcttcaaatggtactcaaaactcatgggtgacgaaccagacctcgacccagatatcaacaaggacttttttgagagcaatgtcctccaactggaccccagcctgttgactgagaacgggatgaaatgcttcgagcggttcttcaaagccgtaaactgcagggagaggaagcttatcgccaagcggcggagctatatgatggacgatctagaactgattgggctcgactatctctggcgagtggtgattcagagttcagatgaaatcgccaacagggccatagacttgctgaaagagatctatacaaatcttggcccaagacttaaagccaaccaggttgtcattcatgaggacttcatccagagttgttttgacaggcttaaagctagctatgataccctgtgtgtctttgatggtgataaaaacagcataaattgcgcgcgacaggaagcaatccgaatggtaagagtgctgacagtgatcaaagagtatattaacgagtgcgactctgattaccacaaagagaggatgatactgcccatgtccagagcatttagaggcaaacatctctccctgatcgttaggtttcccaaccaggggagacaggtggatgagctcgacatttggtctcacacaaatgacaccataggctctgtgcgtcggtgcattgtgaatcgaattaaggccaatgtcgcgcataagaagattgagctatttgtagggggagaactaattgactccgaggacgataggaaactgattgggcagctgaacctcaaagataaaagcttgatcactgctaaactgactcagatcaacttcaatatgccgagttcccctgattcctcctcggactctagcacagcttctccagggaatcataggaaccactacaatgatggtcccaatctcgaggtcgaaagctgtctccctggcgtcatcatgagcgtgcacccgagatatatttcatttctctggcaggtggctgacctgggctctaatctgaatatgcctcctcttcgggacggagcaagggtcttaatgaagctcatgccgccagatcggaccgccgttgaaaaactgcgagcagtgtgtctggatcacgctaaactgggggaggggaagctttcccccccacttgatagcctgttcttcgggccttctgcctcccaggtgctgtaccttacggaggtcgtgtatgccttgctgatgccagccggtgtaccactaactgatggcagctctgatttccaagtgcacttcctaaaatcgggcggcctccccctcgtcctgtccatgcttatacgtaataatttcttaccaaacaccgatatggagactaggagaggggcttatctcaacgcattgaaaatagccaaactgttgctgacggccattggctatggtcatgtccgggccgtggccgaagcctgtcaacccgtggtggacggcacagaccctataacgcagattaaccaggtgacacatgatcaagccgtggtgctacagtctgccctgcagagtatccccaacccctcatctgaatgcgttctcagaaacgagagcattctactggcccaggagatcagcaatgaggcctctcgatacatgccggatatctgtgtaattcgagcaattcagaagatcatctgggcctccgcttgcggagcccttggtctggtcttctcacctaatgaggagattaccaagatttaccaaatgacaaccaatgggtcaaacaagctggaggtggaggatgagcaggtttgctgcgaagcactagaagtcatgaccttatgcttcgcactgctgcccacggcactggacgccttgtccaaagaaaaggcgtggcaaacatttataatagatctcctgctgcattgcccttctaagaccgtgaggcagttagcacaggagcagttttttctgatgtgtaccagatgctgtatggggcaccgtcctcttctgttttttataacactgcttttcaccatccttggatccaccgctagagagaagggaaaatattcgggcgactactttactctcctgcggcacctcttaaattatgcatacaatggcaacatcaatattccaaatgcagaggtgctcctggtgtctgagatagattggcttaaacgcattagagataacgttaaaaatacaggtgagacaggcgtggaagaacctatcctagagggtcaccttggggttaccaaggagttgctcgccttccaaacctctgagaaaaagtatcacttcggttgcgagaaagggggagccaatctgatcaaggaactgatcgacgattttatcttccccgcgagcaaggtgtatctccagtaccttagaagcggggagcttcccgccgagcaggctatccctgtgtgcagcagtccagtgaccatcaacgctggcttcgagctgctcgtggccttagccatcggctgcgtgcgcaatctgaagcaaattgtcgactgcctgaccgagatgtattacatggggaccgcgatcaccacttgcgaggctctgactgaatgggagtacttacctcccgtcggtccaagaccacctaaggggtttgtgggactgaaaaacgctggtgctacctgttatatgaacagtgttatccagcaattatatatgattccctctatacggaatagtatactggcaatagaagggaccggatctgatctgcatgacgatatgtttggcgatgaaaaacaggattctgagagcaatgtggatccgagggatgacgtcttcgggtatccgcaccaatttgaagataagcccgcgctcagcaaaactgaagatagaaaggagtacaacatcggcgtacttagacatctccaggttatttttggacacctcgcggcctcccaactgcaatactacgtgccacggggcttttggaaacagttccgcttatggggcgagccagtaaacctgagggaacaacatgacgcactcgagttttttaatagcctggtagactccctggacgaggccctcaaagcattgggtcacccagcaatactatcaaaggtgcttggggggtcctttgccgatcagaaaatctgccaagggtgcccgcacagatatgaatgcgaggaatcattcactacactgaatgtcgacatccgaaatcatcagaatttactggatagcctggaacagtatataaagggtgatctcctcgaaggggctaacgcatatcactgtgaaaaatgcgataagaaagtcgataccgtcaagaggttgttgatcaagaagttgccacgcgttctggccatacaactcaagaggtttgactacgactgggagagggagtgtgccattaaatttaacgactattttgaattccctcgggaacttgatatgggcccctatactgtggcgggcgtagccaacctggagcgcgataatgtgaactccgaaaacgagctcatcgaacagaaagaacaatctgacaacgagaccgctggaggaacaaagtaccggctcgtcggcgtgctggtccattccggacaggcatcagggggccactattatagttatattatccagcggaacggcaaggatgatcagacagaccattggtataagtttgatgatggggacgtcacagaatgtaagatggacgacgacgaagagatgaaaaaccagtgttttggcggggagtacatgggcgaagtctttgatcacatgatgaagaggatgtcttaccgtaggcagaagaggtggtggaatgcctatatattgttctatgagcagatggacatgattgatgaggacgatgagatgatcaggtacatctctgaattgaccatcgcccgcccgcaccaaattataatgtcccccgctatagagcggtcagtgcgaaagcagaatgtcaaatttatgcacaacagattgcaatatagcctggagtacttccaatttgtgaagaaactgctgacgtgtaatggcgtttacctgaacccagcccctggacaggattatcttctgcccgaggccgaggaaatcacaatgatatccattcaactggcagcccgtttcctatttaccacagggttccacacgaagaaaatcgtgcgtggtcctgcctcggactggtacgacgccctatgcgtgctgttacgccattccaaaaatgtgcggttttggtttacacacaatgtgctgttcaatgtgagcaatagattctccgaatatcttctggaatgtccttccgcagaggtacgcggtgcctttgctaagctgatcgtattcattgcgcatttctcactgcaggacggatcttgcccatctccattcgcgagtcccggcccctcctcacaagcctgtgataatctttccctaagtgatcatctgctcagggccacattgaatctccttagacgggaggtatcagagcatggccatcacctccagcagtacttcaacctgttcgtcatgtatgctaatcttggggtcgctgaaaagactcagttgttaaaactcaatgtgccagccacgttcatgctggtttctcttgatgaaggtccaggccctcccatcaaataccagtatgcagagctcgggaagctgtatagtgtggtgagccagctgattcggtgctgtaatgttagcagcacaatgcagtctagcatcaatggaaacccaccattaccgaacccctttggcgacctcaacctgtcccagcctataatgcccatacagcagaatgttttggacatcctattcgtgcgcaccagctatgtaaagaagataatcgaagactgttcgaactcggaggatacgatcaagctcctccgcttctgcagctgggagaatcctcaatttagcagcacagttctgagtgagctgttatggcaagtggcttatagttacacttacgagctgagaccgtatctggatttgctatttcagattttgttgatcgaagactcttggcaaacgcataggatacacaatgccctgaagggcattccagatgatagagacgggttgtttgatacaatacagcggtctaagaatcattatcaaaagagggcgtaccaatgtatcaaatgtatggtcgccctgtttagctcttgtcccgtggcctatcaaattctgcaggggaacggagacctcaagcgaaagtggacgtgggccgtggagtggctcggtgacgagctggagaggcgcccctatactggcaatccacagtacagctataacaactggagccctccagtacagtccaacgaaacagctaatgggtattttttggagcggagtcattccgctagaatgaccttagctaaagcgtgtgaactgtgccctgaagaggagccagacgatcaagatgcacccgatgaacacgaaccctctccgtcagaggacgcccccctgtatcctcattctccggcctcacagtatcagcaaaacaaccacgtacacggacagccatacacaggacctgccgctcaccatttgaataatccacagaagacaggccagagaactcaggaaaactacgaagggaatgaagaagtgtcaagcccacaaatgaaggatcagtag

SEQ ID NO: 139826 - DNA, 714 bp, Artificial Sequence
  Description of Artificial Sequence: Synthetic coding sequence
taactgcttaaaaccgctgttactcaacgaatccctagcaactacttcgccttcgcgctggggaggatcctctcaagccacctcttgagcagtgccaacttcagcggcaggatacataatgcgctgaaaggcattcccgatgaccgggatggactgttcgacacaatccagcggtcaaagaaccactaccagaagagagcatatcagtgcatcaaatgtatggttgccctcttcagtagctgtcctgtggcctaccagattttgcaggggaatggagacctgaagcggaaatggacatgggccgtggagtggctcggtgatgaactcgaaaggaggccctatacagggaacccgcagtatagctataacaattggagtccccccgtgcagtcaaacgagaccgccaacggctatttcctcgaacgaagccactcggccaggatgacactcgccaaagcttgtgagctatgtcctgaagaggaaccagatgatcaggacgctccggacgagcacgagccctctcccagtgaggatgctccactctacccccactcaccagcttcacagtaccagcagaacaaccacgtacacggccagccctacacagggcctgctgcccatcatttgaataacccgcagaagactgggcagcggactcaggagaactatgagggaaacgaggaggtgtcttctcctcagatgaaggatcagtag

SEQ ID NO: 139827 - DNA, 3201 bp, Artificial Sequence
  Description of Artificial Sequence: Synthetic coding sequence
atgacagatcaagagaataataacaacatttcatctaacccgtttgcagcactttttggtagcctggctgacgcaaaacagtttgctgccattcaaaaggagcagttaaaacaacagtccgacgaacttcctgcaagcccggatgactcggacaatagtgtcagcgagagtctagacgagttcgactatagtgtggccgaaatcagtcggtctttccggtcgcagcaggaaatttgtgagcagctcaatatcaaccacatgatccagagaatttttctcattacgcttgataacagtgatccctcgctgaaatctggcaacggaatccctagcaggtgcgtgtacctagaagagatggcagtagagttggaagatcaggactggctggatatgtcgaacgtggaacaagccctcttcgctagactgctgttgcaagaccccggtaaccaccttatcaacatgacctcttctaccactctaaatctgagcgccgacagagacgctggggagcggcatattttctgttacctctatagctgcttccaacgggccaaagaggaaattactaaggtacccgaaaaccttctacccttcgccgtacaatgtcggaacctcaccgtgtcgaacaccagaaccgtccttctcacgcctgagatatacgtggatcagaacatccatgagcagctggtggacctaatgctcgaggcaatccaaggcgcccactttgaggatgtgaccgaatttctggaggaggtgattgaagccctgatcctggacgaggaggtccggacatttcctgaggtaatgatccccgtatttgacattctgctcgggcggatcaaggacctcgagctttgccagatcttgctttatgcatacctagatattctgctttattttacaagacaaaaggatatggccaaagtgttcgttgagtacatacagcccaaagaccccacaaatggccagatgtatcagaaaacccttctcggcgttatcttgtccatctcctgccttcttaaaacccctggagttgtagaaaaccacggatatttcctgaacccctccaggagctccccacaggaaattaaggtgcaggaggctaacatccaccagtttatggcccaatttcacgaaaagatttaccagatgttgaagaaccttctgcagctaagtcctgagaccaagcattgcatcctgtcctggctgggcaactgtctgcatgccaacgcaggacgcaccaagatttgggcaaatcagatgcccgaaatcttttttcagatgtacgcttcggacgctttctttctgaacctgggcgcagcactgctgaaactgtgtcaaccattttgcaaacctcggtcgtccaggctgctcacgtttaaccccacctactgcgcattaaaagagctgaacgatgaggaacggaagatcaaaaatgtgcatatgagaggacttgataaagaaacctgtctgatcccagcagtgcaggaaccaaagtttccacaaaattacaacctggttaccgagaacttagctttgaccgaatatactctgtatttggggtttcataggttgcatgaccagatggtcaagatcaatcagaacctgcatcggctccaggtcgcctggcgtgatgctcaacagtcaagtagccccgcagccgacaacctgagggaacagttcgagaggctcatgactatttacctcagcaccaaaacagcaatgaccgaaccacagatgctgcagaattgtttaaatcttcaagtgtccatggccgtcctgctggttcaactagcgatagggaatgagggtagccagcccatcgagctgaccttccccctgcccgacggttatagttcactcgcctatgttccggagttcttcgcagacaatctcggcgacttcctgatcttcctgaggcgattcgccgacgatattctcgagacatccgccgattctctcgaacacgtgctgcacttcatcactatattcaccggtagcattgaaagaatgaagaacccccatctgcgggcaaagctggctgaggtgctcgaggcggttatgccacacctggatcaaaccccgaatccgctggttagtagtgtgttccatcggaagcgggtgttctgcaactttcagtacgccccacagctggcagaggccctcattaaagtgttcgtagacattgaattcactggggatccacaccagttcgaacagaagtttaattacagaaggcccatgtaccccattctgcgctacatgtggggaacagacacctacagagagtcaattaaggacttagcagattatgcctctaagaatctggaggccatgaaccccccactgttcttgcgctttctcaatctgctgatgaatgacgccatatttttgctggacgaagcaatacagtatctgtccaaaatcaaaatccagcagatcgaaaaagaccggggagaatgggactctttgacgccagaggccagaagggagaaggaggccggtctccagatgtttggccaactggctcgttttcataacatcatgtctaacgaaacgataggaaccctcgccttcctcacctccgaaattaagtcactgttcgtccacccattcctcgcagagcgcataatttccatgctgaactatttcctccagcatcttgtcggaccaaagatgggggccctgaaggtcaaggattttagcgagttcgatttcaaacctcagcagttggtgtccgacatttgcaccatctacttaaacctgggagacgaagagaatttctgtgccaccgtcccgaaagatggccgatcatatagtcccaccttgtttgctcaaactgtgcgagtcctgaaaaagatcaataagccaggcaacatgattatggctttttctaacctggctgagaggataaaaagtcttgctgatctgcaacaacaagaagaggagacatacgctgatgcatgtgacgaattcctggaccccataatgtctaccctgatgtgtgacccagttgtactgccgtcctccagggtaactgtggacaggtctacaattgcccgacacctcctatcagaccagaccgatcccttcaataggtcacctttgacaatggaccagatacgcccaaacacggaattaaaagagaaaatacagagatggctggcagaacgcaagcaacagaaggaacagctggaatag

SEQ ID NO: 139828 - DNA, 3222 bp, Artificial Sequence
  Description of Artificial Sequence: Synthetic coding sequence
atgaccgatcaagagaacaataacaacatctcaagcaatccctttgctgccctcttcggcagcctggccgacgcaaagcaattcgccgcaatccagaaggagcagctgaagcagcagtcggatgaactgccggccagtcctgatgacagtgataacagcgtgtccgagtcactcgacgagttcgactactccgtggccgaaatttcacggagctttaggtcccagcaagagatatgtgaacagctaaacattaatcacatgatccagaggattttcctcatcacactggacaattctgatccatccctgaagtccggaaacggcataccctccaggtgcgtatacctggaagaaatggcagtagagctggaggaccaagactggctcgatatgtccaacgtggaacaggccttgtttgcccgcctcctgctgcaggatccaggcaatcatctgataaatatgacatcttctactacgctgaatcttagcgcagaccgggacgctggagaacgccacattttctgctatctttattcctgttttcagagagcaaaggaggagatcaccaaggttcctgaaaacctgctgcctttcgctgtccagtgtcgaaatctcacagtatcaaacactcgaactgtcctgttaaccccggagatctatgttgaccaaaatattcacgaacaacttgtggatctgatgttggaggccatacagggcgccagggagtacatgaataagatttacttcgaggacgtgacggagttcctagaggaggtgatcgaggcgttgattctggatgaagaggtccgaactttcccagaagttatgatccccgtgttcgatattctgctagggcggataaaggacctggagctttgccagatcctcctctacgcctacctggacattctgttatactttaccagacagaaggatatggcaaaagtgtttgttgagtatattcaacccaaggatccaaccaacggacagatgtatcagaagaccctgctaggcgtgatcctgagcatatcttgcctcctgaagacgcctggggtggtcgagaatcatgggtactttctcaacccgtcaaggtccagcccccaggagatcaaagtgcaggaggccaatatccatcagttcatggcgcagttccacgagaaaatctaccagatgcttaagaatctcctgcaactgagcccagaaactaagcactgcatcctgtcctggctggggaactgcctccatgctaatgctggcaggacaaaaatctgggctaaccaaatgccggagatcttcttccagatgtacgcctccgatgcattctttctcaacctcggagccgcattattgaagctctgtcaacccttttgcaagccccggtcttctcgactccttacttttaacccaacctactgcgccctcaaagagcttaatgatgaagagcggaaaatcaaaaacgtgcacatgaggggcctcgacaaagagacctgcctgattcccgccgtccaagagcccaagttcccccaaaactataacctggtgacagagaacctcgccctgacagagtatacactttatcttgggttccacagactacacgatcagatggtgaagatcaaccagaatctgcatcggctccaggtggcatggcgtgacgcccagcagagttcctcaccagccgccgataatctcagggagcagttcgagagattgatgacaatttatctctccaccaaaaccgctatgaccgaaccacagatgctacagaattgcctaaatctgcaggtttctatggcggtgctgctcgttcagcttgcaatcggcaacgagggaagccagccgatcgagctgacctttccactgccagacggctacagctctcttgcgtatgtgcctgaattcttcgccgacaacctaggcgacttcctgatatttcttagaaggttcgccgacgatatacttgagacgtccgcagattctctagagcacgttttgcactttatcacaatttttaccggatcaatcgagcgcatgaagaacccccatctccgggccaaactggccgaggtacttgaagctgtcatgccgcaccttgaccagacaccaaaccctcttgtctccagtgtcttccatagaaaacgagtgttttgtaactttcaatatgcacctcaactggcagaggctcttataaaggtcttcgtggacatagaattcactggcgacccacatcagtttgagcaaaagttcaactatcgaaggcccatgtaccctatcctccgctatatgtggggcacagatacgtacagagaatcaatcaaagatctggccgactacgctagtaaaaacttggaagcaatgaatccacccctgtttctgaggtttttaaatcttctcatgaatgacgcaatctttttactcgatgaggccattcagtatttgagcaagattaaaatccagcaaatcgagaaggaccggggggagtgggattctctgacccccgaagcccgcagggagaaagaggcgggactacaaatgtttggtcagttagcgcgctttcacaacataatgagcaatgagaccattggtaccctcgctttccttacatcggagatcaagagcctgttcgtgcatccatttctggcggagaggatcatcagtatgctgaattactttcttcagcatctggtgggccccaaaatgggggcccttaaagtgaaagacttcagcgaatttgactttaaaccccagcaacttgtcagcgacatctgcaccatctatctgaacctgggcgacgaggagaacttttgtgccactgtgcctaaggacgggcgatcctactccccgaccttgtttgcccagaccgttcgcgttcttaagaaaataaacaaacctgggaatatgattatggccttttccaatttggccgagcggattaagtccctcgctgatctgcaacagcaggaagaagaaacttacgccgacgcttgtgacgagtttctcgatccaatcatgtcaaccctgatgtgcgatcccgtggtgctgcctagttcgagagtgaccgtcgatcggagcacaattgcgaggcacctgctgtccgaccagactgaccccttcaatcgaagcccactcactatggaccagatcagacctaataccgaattaaaagagaaaattcagagatggcttgccgaacgaaaacagcagaaagagcagctggaatag

SEQ ID NO: 139829 - DNA, 1617 bp, Artificial Sequence
  Description of Artificial Sequence: Synthetic coding sequence
atggtgaaaattaaccagaatctccatagactgcaggtcgcttggagggacgcccagcaatcctcgagtccagctgcagacaatctcagagaacagtttgagcggctcatgaccatatacctgagcacaaagaccgccatgaccgagcctcagatgctgcagaattgcctgaatctccaggttagcatggccgtcctgttggttcagttggctatcggaaacgagggctcccaacccattgagctgaccttccccctcccagatgggtatagctccttggcctacgttccagaattctttgccgataatctcggagacttcctgatctttctgcgtaggttcgccgatgacattctggagaccagtgcagacagcctggagcatgtgctgcacttcattactatctttacaggctccattgagagaatgaagaacccccacctcagagctaaattggctgaggttctggaggctgttatgccgcatctggatcaaacacccaatcctctggtgagctctgtgtttcataggaagagagtcttttgtaacttccagtacgcccctcagctggccgaagctttaattaaggtgtttgttgacatcgaatttacaggtgatccgcaccagtttgagcagaaattcaattatcgacggccaatgtaccctatcttacgctatatgtggggtactgacacctacagagagtccatcaaggatctggccgactacgccagtaaaaacctcgaggcaatgaacccacctctgtttctgcggtttctaaacctcctgatgaacgacgctatcttcctgctagacgaagcgatccagtatctgtcaaaaatcaagattcagcagatcgagaaagaccgtggtgagtgggattccctgactcctgaagcaaggcgtgagaaggaagcagggctccagatgttcgggcagttggcacgctttcataatattatgagtaacgaaacaataggaacccttgccttcctcaccagcgaaatcaagagcctgttcgttcatccattcttggctgagagaatcatctccatgcttaattactttcttcagcacctcgtgggtcccaagatgggagccctgaaggtcaaagacttctcggagtttgattttaagccccagcagctggtgagcgacatttgtaccatttaccttaacctgggcgacgaggagaatttttgcgcgactgtgccaaaggatggtcggtcatactcaccaacccttttcgcacagacagtcagggtacttaaaaagatcaacaaacccggcaatatgatcatggctttctcgaacctggctgagcgaataaaaagtctcgcagatttacagcagcaggaggaggaaacctacgctgacgcttgcgatgagtttttggatccaataatgagcacactgatgtgcgatcccgttgtcttacctagtagtcgagtaaccgtcgacagaagtacaatcgctaggcacctgctttcagaccagacagatccgtttaataggtcccctctcacaatggatcagattaggcctaatactgagctcaaggaaaagatccagagatggttggccgaacggaagcaacagaaggaacaactagagtag

SEQ ID NO: 139830 - DNA, 3522 bp, Artificial Sequence
  Description of Artificial Sequence: Synthetic coding sequence
atggaagagctctccgcagacgaaatccgtaggcgccgactggctcgcttggccggcggccagacgagccagcccacaactcctttaacgtccccccaacgtgaaaatccccctggacctccaatcgccgcctcagcaccgggccccagtcagtcgctgggcctaaacgtgcataacatgacgcctgctactagtcccatcggagccagtggcgttgcacaccgctctcagtcgtctgaaggagtcagctcactgtcttcttcaccatcaaactcccttgaaacccagagccaaagcctgtcccggtcacagtctatggacatcgacggggtcagttgcgagaaatcaatgagccaggtggacgttgattcgggcatcgaaaatatggaagtggacgaaaacgataggcgggaaaagcgcagcctgtctgataaagagccttcctctggccctgaagtgtcggaagagcaggctcttcaactggtttgcaaaatatttcgagtatcttggaaggacagagatcgagacgtgatcttcctgagctcactcagcgcacagttcaagcagaacccaaaggaggtcttttctgactttaaggacctgatcgggcagatactgatggaagtgcttatgatgagcacccagactagagacgagaatccctttgccagtctgacggccaccagtcagcccatcgctgccgccgctcgctcgcctgataggaatctgctgctgaatacaggttctaaccctggcacctccccaatgttctgctccgttgctagtttcggcgcgagttctttgagtagtcttggcgcttctggcggggcctctaactgggatagctactccgaccattttaccatcgaaacgtgcaaagagaccgacatgctgaattatcttatagagtgtttcgatagagtcggcatcgaggagaaaaaggccccaaagatgtgttctcagcctgctgtctcccagctgctcagtaatattaggtcacaatgcatttctcacactgccttggtgcttcagggaagcctgacccagcctcggagcctccagcagccatcgtttcttgttccctacatgctgtgtcgtaatctgccttacggtttcatccaggaactcgtgagaaccacacaccaagatgaagaagtctttaagcagatttttatacccatcctgcagggcctggcactggctgcgaaagagtgctctcttgacagtgactattttaaatacccacttatggctctaggcgagctgtgtgagaccaaatttggcaagacccatccagtgtgcaacctggtggcttctctccgcttatggctgccaaaatcgttgtcacctggctgtggtagggagctccagcggctgtcctacctgggagcatttttcagcttctctgtgtttgccgaagatgatgtgaaggtagtggagaagtacttcagcggccctgcaatcacactcgaaaacacacgcgttgtctcccagtcattacagcactacctggagctcggcaggcaggagttatttaagattctgcacagcatcttgctgaacggcgaaaccagggaggccgcacttagttatatggccgccgtggtcaatgccaatatgaaaaaggcccagatgcagacagacgatcgattggtcagcacagatgggtttatgctgaactttctatgggtgttgcagcagctttcaaccaagatcaagttggaaacggtagaccccacatatattttccatccgagatgtcgaatcacgctccctaacgacgaaaccagagtcaacgctactatggaggacgtcaatgactggctgactgagctgtacggtgaccagcctcccttctccgagcccaaatttcctaccgaatgtttcttcctcaccctccacgcccatcacttaagcattctgccgagctgtcggaggtacattcggagactacgcgctataagggaactgaatagaaccgtagaagacttgaaaaacaacgaaagccagtggaaagattcacctctagctactagacatagagagatgctcaagagatgtaagacccagcttaagaagctggtgcggtgcaaggcctgtgctgacgcaggtctgctagatgaatcgttcctccgacgctgtctgaatttctacggcctcctgatccagttgctgttacggattcttgatcccgcatatcctgatattacactgcccctaaacagtgacgtgccaaaagtttttgctgctctgcctgaattttatgtcgaggacgtggcagagtttcttttctttatcgtgcagtactctccccaggccttgtatgaaccatgtactcaagacattgtaatgtttctggtggtgatgctctgtaatcagaactacattagaaacccttaccttgtggccaagctagtagaggtgatgtttatgaccaacccggctgttcaacccaggacccaaaagttttttgagatgatcgagaatcatcccctgtctactaagcttttagtgcccagcctgatgaaattctataccgacgtggagcacacaggcgctacaagcgagttctacgacaagttcaccatcagataccacattagcaccatattcaagagcctatggcagaacattgcgcaccatggaacatttatggaagaattcaattctgggaagcaatttgtcaggtatattaacatgctgattaacgataccacattccttctcgatgaaagtttggaatctttgaagcggatccacgaagttcaggaggaaatgaagaataaggaacaatgggatcagctcccaagagaccaacaacaggcgcggcagtctcagctggcacaggacgagagagtttctcgcagctacctcgctctagctactgaaacagtggatatgtttcacattttaacgaaacaggttcagaagccattccttaggccagagcttggtcctaggctagcagcaatgctgaattttaacctgcagcagctgtgtgggcctaagtgccgcgacttgaaagtggagaacccagagaaatacggattcgaaccaaaaaagttgttggaccagctcacagacatatacttacagctcgactgcgcacgctttgcaaaggcaattgccgacgatcagaggagctattcaaaagagctgtttgaggaggtgattagcaaaatgagaaaggctggcataaaatcaactatcgctattgagaagttcaagctactggctgaaaaggtagaggagatcgtagccaaaaacgctagggctgaaattgactactccgacgcacccgatgagttccgtgaccctcttatggacactcttatgacagaccccgtccggcttccttcgggtactattatggacaggtccatcatcctgcggcacctcctcaactcgccaaccgatccattcaatagacagaccctgactgagagcatgctcgaacctgtgcctgaactgaaggaacaaatccaggcctggatgcgagaaaaacagaattccgatcactag

SEQ ID NO: 139831 - DNA, 3909 bp, Artificial Sequence
  Description of Artificial Sequence: Synthetic coding sequence
atggaggaactctcggcagacgaaatccgccgcaggaggttggctcggctcgccggaggccagaccagccagccaaccacgcccttgactagcccacagagggagaaccctcccggtcctcccattgcggcatctgctccgggaccgtcacagtcactgggactgaacgtgcacaacatgactccagcaaccagccctatcggtgcttccggtgttgcacaccgttcacaaagcagcgaaggtgtcagttcacttagcagctctccaagtaattcactcgaaacccagtctcaaagtctgagcaggagtcaatccatggacattgatggtgttagctgtgaaaagtccatgtcacaggtggatgtggacagcggcattgagaatatggaagttgacgaaaacgaccggagggagaaacgctcactgtctgataaggagccctcatcagggccagaagtctctgaggagcaggctctgcaactcgtgtgtaagatattccgagtctcttggaaagaccgagaccgcgatgtgatatttctgagcagcctgtccgcgcagttcaagcagaaccccaaggaggtcttttcagatttcaaggacctgattggccaaatactgatggaagtcctgatgatgtcaacccaaactcgagatgagaatccttttgcatcactgaccgccaccagccagcccatcgcggcagccgcccgctcacctgaccggaacctccttctgaatactggctctaacccagggacaagtccaatgttctgctcagttgcatcctttggggcctcttccctttcgtccctttacgagtcctcaccagctccgacaccctcgttctggtcaagcgtccctgtgatgggcccaagtttggccagccctagcagagccgccagccagttggctgtaccatccacccccctgagccctcactccgccgccagcggtacggccgcgggttcacagccctcttctccgagataccgcccttacaccgtgactcacccctgggcctcctctggggtgtcaatcctgtcatcgagtcccagcccccccgcgctggcctctagccctcaggcagtacccgcctccagttccaggcaacggccgagttctacgggcccgccactcccacccgccagcccaagcgcaacctctaggcggccgtcttctctccgcatttccccttccctgggtgcttcaggaggggcctctaactgggacagctactcagaccacttcacgatagaaacatgcaaggaaacggatatgctgaactacttgatagagtgcttcgaccgcgtaggtatcgaggaaaagaaggctccaaaaatgtgttcgcaacccgccgtcagccagctgctgtccaacattaggtcacagtgtatctctcacacagcattagtgcttcaaggatccctgacgcagccgcggagtctgcaacagccatcttttctggtcccctacatgctgtgtcgcaatctcccttatggctttattcaggagcttgtacgtacaacccatcaggacgaagaggtgttcaaacagatattcatccccatccttcagggcttggccctggccgccaaagaatgttccctagattcagattacttcaaatatccactgatggctctgggtgaactttgtgaaaccaagttcggaaagacccaccccgtgtgtaacctggtggcttccctgaggctgtggctgcccaagagcctgtctccagggtgtgggcgcgagttacagaggctttcgtacttgggagcgttttttagcttttctgttttcgctgaggatgatgtaaaagttgtcgagaagtatttcagcggtccagcaattacacttgaaaataccagagtggttagccagagtcttcagcactatctggagttgggccgacaggagcttttcaagattctacactctatcctcttgaacggggagacaagagaagctgcactgtcatatatggccgctgttgtgaacgcaaatatgaaaaaggcgcagatgcagaccgatgatcgcttagtctccaccgacgggtttatgttgaacttcctgtgggtgctccaacagttgagcaccaaaatcaaactggaaaccgtcgatccaacttatatctttcatccaagatgcaggattacactgccaaacgatgagaccagggtgaacgccactatggaagatgtaaatgattggcttacagagctgtatggagatcaacctccattttccgagcccaagtttccaaccgaatgttttttcctcacactgcacgcccaccacttgagcatcctgcctagttgtcgccgctatattcgcagactgcgagctattagagagctaaatagaaccgttgaagacctgaaaaacaatgaatcccagtggaaggattcacctctggctacaagacacagggaaatgcttaaacggtgcaaaacacagcttaagaagttggtaagatgcaaggcgtgcgcggacgcaggcttgctggatgaatccttcctccgcaggtgccttaacttttatgggctcctgatccagctgctcctgaggatccttgatcctgcatatcccgatattaccctgccgctcaattccgacgttcccaaggtctttgctgccctcccggaattttatgtggaggacgtggcggagtttctcttcttcatcgtccagtattcaccgcaggcgctgtacgaaccttgcacccaggatatcgtaatgttcctggtggtgatgctgtgtaatcagaactacatacgtaatccatacttagtcgctaaattggtggaggtgatgtttatgacaaatcctgctgtgcagcctcgtactcagaagttcttcgagatgatcgagaatcaccccttgagcactaagcttctcgtgccttcattaatgaaattctacactgacgtggagcacaccggtgccacctcggagttctatgacaagttcaccattcggtatcacatcagtacaatattcaagtccctgtggcaaaacatcgctcatcacggtaccttcatggaagagttcaacagcggtaagcaatttgtgagatatattaacatgttgattaatgacaccaccttcctgctggacgagtccctggagagcctaaaaaggatccacgaagtccaggaggaaatgaaaaacaaggaacaatgggatcagttgcctagggaccagcagcaggcccgtcaaagccaacttgcgcaggacgagcgggtctccagatcatatttggcactggcaaccgaaacagtcgacatgttccatatactgactaaacaagtgcagaagccattcctgcgccccgagctgggacctagattggcggccatgctcaatttcaatctccagcagttgtgtggacccaagtgccgggatttaaaggtcgaaaatcctgagaaatatggcttcgagcctaaaaagctgctggatcaattgactgacatttacctgcaactcgattgtgctcgcttcgctaaagctatcgcagatgatcagcgctcttatagcaaagaactatttgaggaggtgatcagcaagatgaggaaggctgggatcaagtccaccatagccatcgagaagtttaaattgctcgctgaaaaggtcgaggaaatcgttgctaaaaatgctcgcgctgaaattgactactctgatgctccagacgagttcagggatcccttgatggacaccctcatgacggaccctgtccggcttccctctgggacaatcatggacagatctattatactccgccatctgctgaatagtcccactgatccctttaacagacagaccctgacggagtctatgctggagccagtgcctgagctgaaagagcagatccaggcttggatgagggaaaagcagaactcggatcactag

SEQ ID NO: 139832 - DNA, 303 bp, Artificial Sequence
  Description of Artificial Sequence: Synthetic coding sequence
atggaagaactttccgccgacgagattagaaggcggagactcgcacgcctcgcaggtgggcagacgtctcagcccactacccccctcactagcccacaacgcgagaacccaccaggcccaccaatcgccgccagcgcgcccgggcctagccaaagcctaggactaaacgtacacaatatgacgcccgctacaagtccgataggcgcctcaggactgggtatcataagtgacgacaaaatgatcaaaaccgaattcggctctgcagatttcatgaacctcgtcgatggctttaaaataaaatag

SEQ ID NO: 139833 - DNA, 3186 bp, Artificial Sequence
  Description of Artificial Sequence: Synthetic coding sequence
atgtcccaggtcgacgtggactcagggattgagaatatggaagttgatgagaacgaccggagagaaaagcggagccttagcgacaaggaacctagtagcggcccagaggtttcggaggagcaagctctgcagctggtttgcaaaatcttcagggttagctggaaggacagggatcgggacgtcattttcctgagctcactgtcagcacaatttaaacagaacccaaaagaagtgttctcagattttaaggatcttatcggccagattctaatggaggtcctgatgatgagcacccagacaagagatgagaaccctttcgctagcctcactgcaacaagtcagccgattgcagctgccgctcggtcccccgacaggaaccttctcctcaatacaggtagcaacccggggacgtcaccaatgttctgctccgtagccagttttggtgcatcaagtctttcgtccctgggggcctccggcggagcctctaattgggattcatattcggatcatttcacaatcgagacctgtaaggagactgatatgcttaattatttgattgaatgttttgatagagtgggcattgaagagaagaaagcccccaaaatgtgttcccagcccgccgtgagccagttactgagcaacattagatcccaatgtattagccacaccgctctcgttcttcagggctctcttacccaacctcgaagtctccagcaaccgagcttccttgtcccctacatgctgtgccggaatctaccttacggattcattcaggaactggtgagaacaacccaccaggacgaagaggtcttcaaacagatattcataccaattttgcaggggcttgcgctggccgccaaagagtgttccctcgactcagactatttcaagtatccattgatggctctaggagagctctgtgagactaagtttggtaaaacgcaccctgtgtgtaaccttgtggccagtcttaggctatggttaccaaaatcactgtcaccagggtgcggacgcgaacttcaacgcctcagctacctgggcgccttttttagcttctcagtgttcgcggaggacgacgttaaagtcgttgagaagtatttttccggaccggctattactctcgagaacacgagagtggtgagtcagtccttgcagcattatttggagctcggtaggcaagagttgtttaaaatcctgcactccatcctgctgaacggagagacccgagaggctgcattgtcgtatatggccgctgtggtgaacgcaaatatgaaaaaggcccaaatgcaaactgatgataggctcgtgtccactgatgggtttatgctaaactttctgtgggtactacagcagctgtccactaagatcaagctcgaaaccgttgatcccacatatatctttcatcctcgctgccgcatcaccctgccgaacgatgagacacgagtgaatgccactatggaggatgtgaatgactggctgaccgaactgtatggagaccagccgcccttctcggaaccaaagttcccgacagagtgcttttttcttactctacacgctcaccatctctccatcctaccatcttgtcgccgatacatccggcgccttcgcgccatcagagagctgaatcgcaccgtggaagaccttaagaataacgaaagccaatggaaagattcccctctggcgactcggcaccgcgagatgctgaagcgatgcaaaacacagctgaaaaagcttgtgcgatgcaaagcatgtgcagatgcaggcctgctcgatgaaagctttcttcgcagatgtctgaacttctacggcctgctgattcaacttctactgcgcatccttgatcctgcctatccagatatcaccctgcctctgaattctgacgtgcctaaggtattcgctgcgctgcccgagttttacgtggaagatgtcgcggaatttttattcttcattgtccagtattcgccccaggcgctgtacgaaccctgcactcaggacatagtaatgtttctggtggtaatgctctgcaaccagaattacatcagaaatccttatctggttgcaaaactcgtagaagtgatgttcatgacgaaccccgcggttcagcccagaacgcagaagttcttcgagatgatagagaaccatccactcagcactaagctgcttgtgccctccctgatgaagttctacaccgacgttgaacacactggggccacaagtgaattttatgataagtttactatcagataccacataagcacaatcttcaaatcactttggcagaatattgcccaccacggcacatttatggaggagttcaacagcgggaaacaattcgtgcgctacataaacatgctgatcaacgacaccacattccttctggatgaatcgttggaatcactaaagaggattcacgaggtgcaagaggagatgaaaaacaaagagcagtgggatcagctgcccagagaccaacaacaggcacggcagtctcagctggcccaggatgagcgcgtgagccgatcctacctagccctggctacagagaccgtggatatgttccacattttgaccaagcaggtgcaaaaaccttttctgaggccagagctcggacctagacttgccgctatgttgaactttaacttgcaacagctatgtgggccgaaatgccgcgacctgaaggttgagaatcctgagaaatatgggtttgaaccaaaaaaactgctggatcagctgactgacatctacctgcagctggactgcgcgagattcgccaaggctattgcggacgatcagagaagctactcgaaagaattgttcgaggaagttatttccaaaatgagaaaggcggggattaaaagtactatagctatcgagaaatttaagttacttgcagaaaaagtggaggaaatcgtggccaagaacgcaagggcggaaatcgactacagtgacgcacctgatgagttcagggggaagtggacccatccactcatggataccctaatgactgatcccgtccgattgccaagcggaaccatcatggacaggtctattatactgcgtcacttacttaattcgcctacagatccctttaacagacagacactgaccgaaagcatgctcgagccggtgccagaactgaaagagcagatccaggcctggatgagagagaagcaaaacagcgatcactag

SEQ ID NO: 139834 - DNA, 513 bp, Artificial Sequence
  Description of Artificial Sequence: Synthetic coding sequence
atgccaggcgaggtgcaggccagttatctcaagtcgcagagcaagctatccgatgaggggcgcctcgagcccaggaagtttcattgtaagggtgtgaaggtccctcggaacttcaggctgcttgaagaactcgaggaaggacaaaaaggagtaggcgacggaactgtgtcatgggggcttgaagatgacgaggatatgaccctcacgcgatggaccggtatgataatcggccctccacgtacaatctacgagaaccgaatttatagtctgaagattgagtgcggaccaaagtatcctgaggccccccctttcgtgagattcgtcacgaagataaacatgaatggcgtcaacagttctaacggcgtggtagatccacgggccatttcagtcctagctaagtggcagaattcctactccatcaaagtagtgctccaggagctacgacgcttgatgatgagcaaggaaaacatgaagctgccacagcctcctgaaggccagtgctactccaattag

SEQ ID NO: 139835 - DNA, 312 bp, Artificial Sequence
  Description of Artificial Sequence: Synthetic coding sequence
atggaaaagggccttaacactaagaactttaccgagcagactatttatgagaacagaatatatagcctgaaaatcgaatgtggacctaagtaccctgaagccccgccctttgttaggttcgtaactaagattaatatgaacggggtcaattccagcaatggggtggttgacccccgagctattagcgttctcgccaagtggcaaaactcttactctatcaaagtggtgctccaggagctcaggcgcctgatgatgtctaaggaaaacatgaagctgccgcagccaccagagggccagtgctactctaattag

SEQ ID NO: 139836 - DNA, 444 bp, Artificial Sequence
  Description of Artificial Sequence: Synthetic coding sequence
atggctgcaactaccggctctggcgtcaaagtccctagaaatttcaggctcctggaggaattggaagagggacaaaagggtgtgggggatggcaccgtgagttgggggctggaggacgacgaagatatgacactaactcgttggacaggtatgatcatcggcccgccacgaactatatacgagaaccggatatacagtctgaagattgagtgcggacccaaataccctgaagctcctcctttcgtgcggttcgtgaccaagattaacatgaatggggtaaattcgtctaacggggtcgtggatccaagggccattagtgtgctggctaagtggcagaattcttatagtatcaaggtggtcctacaagagctgaggcggctgatgatgagcaaagagaatatgaagttgccgcaaccacccgaaggacagtgttatagtaattag

SEQ ID NO: 139837 - DNA, 513 bp, Artificial Sequence
  Description of Artificial Sequence: Synthetic coding sequence
atgcctggcgaggtgcaagcatcttacctgaagtcccagtctaaactgtctgatgagggacgccttgagcccagaaaattccattgcaaaggagtgaaagttcctcgaaactttagactgctagaagaattggaggaggggcagaagggtgtcggtgacggcactgttagctgggggctcgaagatgacgaagatatgactcttactcgctggaccggcatgatcataggacctcccagaactatttatgagaataggatctacagcttgaaaattgagtgcgggcccaagtaccctgaagcccctcccttcgtgcgtttcgttacaaaaataaacatgaatggtgtgaatagctcgaatggggtagtggacccccgcgctatctccgtgctggctaagtggcagaacagttactcgattaaggttgtcctgcaggaattgagaagactgatgatgagtaaagaaaatatgaaactgccacagcctccagaaggtcagtgttatagcaattag

SEQ ID NO: 139838 - DNA, 312 bp, Artificial Sequence
  Description of Artificial Sequence: Synthetic coding sequence
atgaaagaagacctgaacctggaaaattttaccgctaagaccatctacgaaaacaggatttacagcttgaaaattgagtgtggtccaaagtatcctgaggctccaccgtttgtgcgctttgtcactaaaattaatatgaacggggttaattccagtaacggcgtggtggatcccagagctatcagtgtgttagctaagtggcagaacagctattcaatcaaagtggtgctgcaggagttacgcagactcatgatgtctaaagaaaacatgaaattgccacaacctcctgagggccagtgctacagtaattag

SEQ ID NO: 139839 - DNA, 312 bp, Artificial Sequence
  Description of Artificial Sequence: Synthetic coding sequence
atgaaggaggatttgaacctcgaaaatttcacggccaaaaccatctacgagaataggatctacagcttaaagatcgagtgtggccccaagtatccagaagcccctccattcgtgcggtttgtgaccaaaattaacatgaatggggtcaattcatctaatggcgtggtggacccgagggctatcagcgtgctggccaaatggcagaactcttatagcataaaagtagtactccaagaacttcgcagactgatgatgtcaaaagagaatatgaaactgccgcagccccctgagggtcagtgctattcgaattag

SEQ ID NO: 139840 - DNA, 318 bp, Artificial Sequence
  Description of Artificial Sequence: Synthetic coding sequence
atggccgcaacaaccggttcaggcgtgaaagttccaaggaacttccgactgctggaagaactggaagaaggacagaagggagtgggggacggtactgtctcctggggcctggaagatgacgaggacatgacacttacgaggtggaccggcatgattattgggcccccaagagtggacccacgagccatctctgtgcttgccaagtggcagaatagctactctattaaagtggtgctgcaggagctacggcgacttatgatgagcaaggagaatatgaaactacctcaaccccccgaaggccaatgctactcaaactag

SEQ ID NO: 139841 - DNA, 369 bp, Artificial Sequence
  Description of Artificial Sequence: Synthetic coding sequence
atgtcaactccagccagaagacgactaatgcgggactttaaacggctccaggaagacccgccagcaggagtatctggagcccccagcgagaataacatcatggtctggaatgcagtcatctttggacccgaggggacacccttcgaagatgtctacgccgatggatccatctgtctggacattctgcaaaatcgttggtccccgacttacgacgtctccagtatcctgacaagtatacagtcgcttttggacgagccgaatccaaatagccccgcgaactctcaggccgcacaattgtatcaagagaataaaagagagtacgaaaagagagtgagcgcgatcgtggaacaaagttggcgcgattgttag

SEQ ID NO: 139842 - DNA, 459 bp, Artificial Sequence
  Description of Artificial Sequence: Synthetic coding sequence
atgtccacgccggcacgcaggagacttatgcgtgacttcaagcggttgcaggaagatcccccagcaggcgtgtctggagctcctagtgagaataatatcatggtatggaatgcagtgattttcggccctgagggtaccccgttcgaggacggtacatttaagctgacgatagagttcacggaagagtaccccaataaacctcctacggtgaggtttgtgagtaagatgtttcaccctaacgtgtatgcggacggtagcatctgcctggacatccttcagaatcgctggagcccaacttacgatgtgagctcaatcctcactagtattcagtcactgctcgatgagcccaatccaaattcaccggccaactctcaggctgcacagctataccaagaaaataaacgagagtacgagaagcgcgtgagtgctatagtggaacagagctggagggattgttag

SEQ ID NO: 139843 - DNA, 234 bp, Artificial Sequence
  Description of Artificial Sequence: Synthetic coding sequence
atgttccatcccaatgtgtatgctgacggaagcatctgtttagacatcctgcagaataggtggtctcccacctacgatgtgtcctcgattctcaccagcatccaatctctcctggatgagccaaaccctaactccccagccaatagtcaggccgcccaactttaccaggagaataaaagggagtacgagaaaagagtgagcgcgatagtggagcagtcctggcgcgattgctag

SEQ ID NO: 139844 - DNA, 459 bp, Artificial Sequence
  Description of Artificial Sequence: Synthetic coding sequence
atgtcaacccccgcaagacggcggttgatgcgggactttaaacgtctccaggaagatcctcccgtgggagtaagcggagcaccctccgagaacaatataatgcagtggaatgcagtgatcttcgggcctgaggggacgccatttgaggacgggacattcaagctggtgattgaattctccgaggaatacccaaacaaacctcccaccgtgaggttcctatctaaaatgttccatcccaatgtttatgctgacgggtccatttgtctggatattctgcagaaccgatggtcgcctacttacgacgttagctctattctcactagcatccagagcctcctcgacgagcccaatcccaacagccctgcaaattcccaggccgcccaactttatcaggagaacaagcgcgaatatgaaaagagagtgtccgctatcgttgaacagagttggaatgacagctag

SEQ ID NO: 139845 - DNA, 153 bp, Artificial Sequence
  Description of Artificial Sequence: Synthetic coding sequence
atggctagccaaaacagggatcctgcagcaactagcgttgccgcggctcggaagggcgccgagccttcaggaggggctgctcggggcccagtgggcaagaggctgcagcaggagctgatgaccttgatgaatccaacattaatcgtcccctag

SEQ ID NO: 139846 - DNA, 486 bp, Artificial Sequence
  Description of Artificial Sequence: Synthetic coding sequence
atggcctcacagaaccgggacccggccgccacaagcgtggccgctgcaagaaagggtgctgagccatcaggaggagcagcaagaggaccggtgggcaagagactgcagcaggagctcatgacattgatgatgtcgggagacaaaggaatctccgcgtttcctgagagcgataatttattcaaatgggtgggcactatacacggcgctgctggcacagcagtgggatctatcaggactagcagcactgtgtgcctcctgagtggaccccgggagacccaggactcttctaaacctctggtgtggggcctggggtgggacatgaggctgctcctcgaactcaccctccagctgttcctgcagatgccagaacctaacatcgactcacccttaaacacccatgctgctgaattgtggaaaaatcccacagccttcaagaagtacctccaggagacctatagcaaacaagtgaccagtcaagagccatag

SEQ ID NO: 139847 - DNA, 453 bp, Artificial Sequence
  Description of Artificial Sequence: Synthetic coding sequence
atggctagtcagaacagagatccagctgcaacttcagttgctgccgccagaaagggagccgaaccatctggcggcgctgccaggggtcccgtcgggaagagactgcagcaggaattaatgactttaatggtctacgaagacttgaggtataaactaagtctggagttcccatctgggtatccatataatgcccctactgtaaagtttctcacaccatgttaccaccccaacgtggatacgcagggtaatatatgcttggatatcttgaaagaaaagtggtcggctttgtacgacgtgcgaaccatactgttatccattcagtcgctgctcggcgaacctaatatagactcacccctcaatactcacgcagcggaactatggaagaatcccacagccttcaagaaataccttcaagagacctattctaaacaggttacatcacaggagccttag

SEQ ID NO: 139848 - DNA, 540 bp, Artificial Sequence
  Description of Artificial Sequence: Synthetic coding sequence
atggcatctcagaatcgcgacccagctgcgacttctgtcgcagccgcaagaaagggggccgagccctccggtggggctgccaggggccccgtcgggaagcgactgcagcaggaactaatgaccctaatgatgtctggagacaagggcatctccgcttttcccgagtctgataacttgtttaagtgggtcggcactatacatggtgccgctggtacagtatatgaagacctgaggtacaagctgagcctagagttcccgtctgggtatccatataatgcacctacagtgaagttcttaaccccctgctatcatcccaacgtggacacccagggtaacatatgccttgatatcttaaaagaaaagtggtccgccttgtacgacgtgagaacaatattactgtcgattcagtcactgctgggcgagcctaatattgattcacctcttaatacacacgccgccgagctatggaagaaccccactgcctttaagaagtatctgcaggaaacttactcaaagcaggttacttctcaggagccttag

SEQ ID NO: 139849 - DNA, 423 bp, Artificial Sequence
  Description of Artificial Sequence: Synthetic coding sequence
atgactctgatgatgagcggcgataaaggaatttccgcctttcctgagagtgacaatctctttaagtgggttggaaccatccatggtgccgccggcacagtttatgaggatcttcgatacaagctgagcctcgaatttccatcagggtatccttataacgcccctaccgttaagttcttaacgccatgttatcaccctaacgtagacacacagggcaatatatgtctggatattctcaaagaaaaatggtcggccctctatgatgttaggactattctgctcagcatacagtccctgctcggcgagcccaatattgacagcccactgaacacacatgccgctgagctgtggaagaacccgaccgcattcaaaaagtacctgcaggaaacttactctaagcaggtcacttctcaggagccctag

SEQ ID NO: 139850 - DNA, 423 bp, Artificial Sequence
  Description of Artificial Sequence: Synthetic coding sequence
atgacgctgatgatgagcggtgacaagggaataagtgcattcccagagagcgataatctgttcaagtgggtagggacaatccacggagctgccggcactgtctacgaagatcttcggtataagctgagcctggaattcccttctggatatccatacaatgctcctactgttaaatttctcacgccctgttatcaccctaacgttgatactcaggggaatatctgtcttgacatcctgaaagaaaagtggagtgcactctatgacgtgcggactatcctcctgtcgattcagagccttttaggtgaacctaacattgactcacccctgaatacccatgcagcagaattgtggaaaaatcctacggcatttaaaaagtacctgcaggaaacttattccaagcaagtcacgtctcaggagccttag

SEQ ID NO: 139851 - DNA, 114 bp, Artificial Sequence
  Description of Artificial Sequence: Synthetic coding sequence
atggcagcctccgctgccgaaacccgcgtgtttctcgaagtccgaggtcagctgcagtccgcactcctgattctgggcgatagggtgtctccctattgcccttgttggtcgtag

SEQ ID NO: 139852 - DNA, 1170 bp, Artificial Sequence
  Description of Artificial Sequence: Synthetic coding sequence
atggccgccagtgccgcggagacaagagtattcctcgaggtccgcggccagctgcagagtgccctcctgatcctgggcgaaccaaaagagggggggatgccaatgaacatctccattatgccttctagccttcagatgaagacccccgagggatgcaccgagatacaattacctgccgaggtgcggctggtcccgagctcatgtagggggctgcagtttgtcgtgggggacgggcttcatctaaggctgcaaacacaggctaaactgggaaccaagctaatcagtatgtttaaccagagcagccagactcaagaatgttgtacattttattgccagtcttgcggggaggtcataatcaaagatcgcaaactgcttcgagtgctgccactaccgtctgaaaactggggcgctctggtgggcgagtggtgctgccacccggatccttttgcgaataagagcctacatcctcaggagaatgattgttttattggagactccttttttctggttaacctcagaacttctctatggcagcagcgcccggaactctctcccgtagagatgtgctgcgttagctcagataatcattgtaaactcgaacccaaggccaataccaaagtcatatgcaaacgttgtaaagttatgctgggggagactgtgtccagcgagactaccaaattctatatgaccgagattattatccagtcatccgagcgttccttcccaattattccacggtcttggttcgtgcagtcggtgattgcgcagtgtctcgtgcaactatcatccgctcggagtacgttccgatttaccatccaggggcaggatgataaggtctacattctattatggctccttaatagcgacagcctggtgattgaaagcctccgcaactccaagtatattaaaaaatttccactcttggagaatacatttaaggcagattcttcctctgcttggtccgcggttaaggtcctttaccagccctgcatcaagagtcgcaacgaaaaactggtgagcctgtgggaatcagatatttccgttcatccactgacactgccctctgcaacctgtttggaactgctcctgatcctgagtaaaagcaacgccaacctcccatcctctcttagacgggttaactctttccaggtggcctttcttaagatgtag

SEQ ID NO: 139853 - DNA, 444 bp, Artificial Sequence
  Description of Artificial Sequence: Synthetic coding sequence
atggcgttgaagagaatccagaaggagctttcagacctgcaacgggatccgcccgcccactgctctgcgggccctgttggcgacgacttgtttcactggcaggccacaatcatggggccgcccgatagcgcttaccaggggggagtgtttttcctgaccgtacattttcccacagattatcctttcaaacccccaaaaatagctttcaccacgaaaatataccatccgaatatcaacagcaacggaagcatatgtctggacatcctccgaagtcagtggtccccagctctgaccgtttctaaagtgctactcagtatctgctccctgctttgcgaccccaaccccgacgatcccctagttccagatatagcacagatttacaagtccgacaaggagaaatataatcgccacgcccgggagtggacacagaaatacgctatgtag

SEQ ID NO: 139854 - DNA, 606 bp, Artificial Sequence
  Description of Artificial Sequence: Synthetic coding sequence
atgtcaacagaggctcagcgcgtggatgactcgccttccactagcgggggttccagtgatggagatcagcgagaaagcgtgcagcaggaacctgaacgggagcaggtccagcctaagaaaaaggaggggaaaataagcagcaaaacagccgctaagctgagcacgagtgcaaagcggatacaaaaggaactagcggagatcaccctggatccacctccgaattgtagcgctggacccaagggcgataatatctatgaatggcgtagcaccattcttgggccgcctgggtcagtttacgaggggggtgtcttttttctggatattacctttagtcctgactacccctttaagccacctaaggtaaccttccgtactaggatctaccattgtaacatcaatagtcagggcgtcatttgccttgatatcctgaaggacaactggtcacccgcgctgacaataagcaaggtgctccttagtatctgctctctgctgactgactgtaaccctgccgatcccctcgtaggttccattgcaacccagtacatgacaaacagggccgagcatgaccggatggcccggcagtggacgaagaggtatgcaacgtag

SEQ ID NO: 139855 - DNA, 606 bp, Artificial Sequence
  Description of Artificial Sequence: Synthetic coding sequence
atgagcactgaggctcagagagtggacgacagtccaagtacctctggaggatcttcagatggtgatcaacgagaatcagttcagcaggaacccgagcgggagcaggtgcagcctaaaaaaaaagaaggcaagatctcaagtaagactgccgcgaaactgtctacttcagccaagaggatccagaaggagttggccgaaatcacgctcgaccctcccccgaactgttccgctggacccaaaggcgacaacatatacgaatggcggtcaacaatactcggaccccccggatctgtgtatgaaggtggcgtctttttcttagacattaccttcagccctgactatcccttcaaaccacctaaggttactttccgcactaggatctaccattgcaacatcaactcgcagggcgttatctgtttagatattttaaaagataactggagcccagctctaaccatctcgaaggtccttcttagcatttgtagcctcctgacagactgtaatccagccgaccccctggtaggctcgatcgcgacccagtacatgacgaaccgggccgaacacgaccgtatggcgcgccagtggacgaaacgctacgctacttag

SEQ ID NO: 139856 - DNA, 624 bp, Artificial Sequence
  Description of Artificial Sequence: Synthetic coding sequence
atgtctagcgatagacagaggtctgacgatgagagtccctccaccagcagtggatcttccgatgcagaccagcgagaccctgcagcacctgagccagaggaacaggaggaacgaaaaccctcagcaactcagcagaagaaaaacaccaaactgtcctccaaaacaacagcgaaactctccactagcgctaaacggatacagaaggagctcgctgaaattacgctggacccaccaccaaattgttccgctggccccaaaggcgataatatttacgaatggcgcagtactatactaggcccaccaggctccgtgtatgaggggggggtgttttttctggacattaccttcagtagcgactacccttttaagccaccgaaggtcacatttcgcacgcggatttatcactgcaacatcaattctcaaggggtcatctgtctggacattttgaaggataactggtcacctgcactgacaattagcaaagttctcctgagtatatgctcgctgctcactgactgtaatccggcagaccctctggtcggtagcattgccacccagtacctcactaatcgagcagaacacgataggatcgcccgtcaatggaccaagaggtacgccacctag

SEQ ID NO: 139857 - DNA, 624 bp, Artificial Sequence
  Description of Artificial Sequence: Synthetic coding sequence
atgtcgtccgatcgacagcggtctgacgacgagagtccaagcacatccagtggctcctccgatgctgatcagcgcgacccagctgccccagagcccgaagagcaggaagagcggaagccgagtgccacccaacagaagaaaaataccaagctgtcatcaaagaccactgctaagctgtctaccagcgcaaagagaattcagaaggagctggcagagatcaccctagaccccccaccaaattgcagtgccgggcccaagggcgacaatatctacgaatggcgctctactatcctcggacccccaggatctgtctacgagggaggcgtgttttttcttgacataacattttctagtgactacccgtttaaaccccctaaggttacatttaggacccggatctaccattgcaacattaattctcagggagttatctgcttggatatactgaaggataactggtcgcccgccctgactattagcaaagtcctgctttccatttgctctctgctgacagattgcaacccagcggaccctctggtcggttcaatcgccacacagtatttgaccaatcgagcagagcacgaccgaattgctcggcagtggacaaaacggtacgcaacctag

SEQ ID NO: 139858 - DNA, 624 bp, Artificial Sequence
  Description of Artificial Sequence: Synthetic coding sequence
atgtcttctgatagacagagaagtgatgacgagtccccttccacgagctcgggctccagtgacgccgatcaacgagatcccgcagctcccgagcccgaagaacaagaggagaggaaaccctccgccactcagcaaaaaaagaataccaaattgtccagcaaaactaccgccaaattatccacttctgccaagcggatccagaaagagttggccgagatcacgcttgacccaccgccaaattgttctgcgggcccaaagggggacaacatatacgagtggcgaagcaccatcctggggcctccggggtctgtctatgaagggggcgtatttttcctcgacatcacgttttcaagcgactaccctttcaagccaccaaaggtgacctttcgaacaaggatttaccactgtaacattaactcacaaggagtgatctgcctcgacatactgaaagacaactggtccccagccttaacaatcagcaaagtgctgctttcaatttgctccctgctcactgattgcaatcccgctgatccactggttgggtctatcgctacgcagtaccttaccaatagggctgagcacgaccgcatcgcccggcagtggacaaaacgatatgccacatag

SEQ ID NO: 139859 - DNA, 624 bp, Artificial Sequence
  Description of Artificial Sequence: Synthetic coding sequence
atgtcttcagatcgccagcggagcgacgacgaatccccttcaacgagctcagggagctccgacgctgaccagcgtgaccccgctgctcccgagccagaggagcaagaagaacggaagccctcagccacacagcagaaaaaaaacacgaagttaagttctaaaactactgccaaactaagcacaagtgccaagcggatacagaaagaattggctgagatcacattagaccccccacctaattgctctgcaggacccaagggcgataacatatacgagtggcgctccacaatactgggacctcctggatcagtctatgaaggcggcgtgttttttttagacatcacattttcctcggattacccattcaagccgcctaaagtgacctttcggactcgcatttaccattgcaatatcaatagccaaggagttatctgcctcgatattctgaaagacaactggtctccagctctcaccatctcaaaagtcctgttaagcatttgctcccttctgacagactgtaatcctgctgatccgctagtaggcagcattgccacacagtacctaactaacagggcagaacatgataggatcgcacgccagtggacaaagaggtatgccacctag

SEQ ID NO: 139860 - DNA, 528 bp, Artificial Sequence
  Description of Artificial Sequence: Synthetic coding sequence
atgtcctctgaccgccagcgatccgacgacgagagccccagcacctcttctggctcctcagacgctgatcagcgagatccagcagcccccgagccggaagaacaggaagaaaggaagcctagcgcaacacagcagaaaaagaacaccaaactttcaagcaaaaccaccgccaagttaagtactagcgctaagcgaattcagaaggagctggcggaaattaccctagacccgccccccaattgttctgccggccccaaaggagataacatttatgaatggagaagcaccattttgggtccacctggaagtgtttacgagggcggggtattctttctggatatcaccttcagttccgactaccctttcaagccgccaaaggtgacctttcggactcgtatatatcactgcaacattaattcgcagggggtcatctgcctggacattctgaaagacaactggtccccagccctgaccatatcaaaggtattgttatcaatctgttcactactaacggattgtaatccttag

SEQ ID NO: 139861 - DNA, 528 bp, Artificial Sequence
  Description of Artificial Sequence: Synthetic coding sequence
atgagcagcgatcgccagcggtccgacgatgaatctccatccaccagcagtggaagttcagatgccgaccaaagagacccagctgcaccggagcccgaggagcaagaagaacgcaagccctccgccacgcagcagaaaaagaacactaagctgagctccaagaccaccgcaaaactttcaacgagtgctaagaggattcagaaagaactcgccgagatcacactggaccccccacctaattgctctgcaggacccaagggagacaatatttacgaatggaggtctacgatcctcggccccccgggcagtgtgtatgaggggggcgttttcttcctcgacataacattttcaagtgactacccatttaagccacctaaggtaaccttcaggaccaggatttatcactgtaacattaattcccaaggcgtgatctgcttggatatactgaaggataactggtcccctgctctaacaatctcaaaggtccttctgtccatctgttccctgctgacagactgcaacccatag

SEQ ID NO: 139862 - DNA, 528 bp, Artificial Sequence
  Description of Artificial Sequence: Synthetic coding sequence
atgtcctcggacagacaaaggtccgacgacgagtccccctccaccagttcgggatcaagcgatgcagaccagcgcgatcctgctgcaccagagcccgaagaacaggaggagagaaaaccgtcagccacccagcagaagaagaacacgaagctgtcatctaaaaccacggcaaagctctccacaagcgccaagagaattcagaaagaattagctgagatcacccttgatcctccccccaactgtagcgcaggtcctaagggcgacaatatctatgagtggcgcagcacaatcttgggacctccgggcagcgtgtatgaagggggggtctttttcctggacattacctttagcagcgattatcctttcaagccacccaaggtcactttccggacacgtatctaccattgcaacatcaactcccaaggcgtgatatgtctggatatccttaaagataattggagccccgcactcaccattagtaaggtgctgctgtcgatctgcagtctactgacagactgtaatccttag

SEQ ID NO: 139863 - DNA, 414 bp, Artificial Sequence
  Description of Artificial Sequence: Synthetic coding sequence
atgaacgaggagaatttcttcgaatgggaggccctcattatggggcctgaggacacgtgtttcgagtttggggtcttcccagccatccttagcttcccattggattatccactgagcccacccaaaatgcgctttacctgcgaaatgtttcaccctaatatttaccctgatggcagagtatgcatttccatactgcacgccccaggcgacgaccctatggggtacgaatctagcgcagaacgctggtcgccagtgcagtcggtggaaaagatactgctgagtgtggtgtctatgctggccgagcccaatgacgaaagtggcgccaatgtcgatgcctctaaaatgtggagagatgaccgggaacagttctacaagattgcgaagcaaattgtgcagaagtctttgggcctgtag

SEQ ID NO: 139864 - DNA, 498 bp, Artificial Sequence
  Description of Artificial Sequence: Synthetic coding sequence
atggccggtaccgctctgaaacggctcatggccgaatataagcagctgacacttaacccgccagaagggattgtagccgggcctatgaatgaagaaaacttttttgagtgggaggcccttataatggggcccgaggacacttgtttcgaattcggagtttttcctgctatcctgagcttcccactggattaccctctgagccccccaaaaatgcgtttcacctgcgaaatgtttcacccgaatatctacccggacggccgggtctgcatctccattttacatgctcctggtgatgatcctatggggtatgagtcttctgctgagaggtggtctccagtgcagtcagtggaaaagatcctgctgtcagtggtgtccatgctggccgagccaaatgatgagtccggcgctaacgtcgacgctagcaagatgtggcgcgatgatcgcgagcagttttacaaaattgccaagcagatcgttcagaagagtctgggcctgtag

SEQ ID NO: 139865 - DNA, 552 bp, Artificial Sequence
  Description of Artificial Sequence: Synthetic coding sequence
atgagcagcccaagccccggaaagaggcgcatggacacagacgtggtcaagcttatagaatccaagcacgaagttaccatattgggcggactgaacgaattcgttgtcaagttctacggcccacagggaacaccctacgaaggaggagtgtggaaagtaagggttgacctgcccgacaaatacccgttcaagagtcctagcattggcttcatgaataagattttccatccgaatatcgatgaagcctctggaaccgtgtgccttgatgtcatcaatcaaacttggacagccctctacgatttgaccaatatttttgagtcctttttaccccaattactcgcatatcctaatcctatcgatccattgaatggagatgcagccgcgatgtacctccatcggcctgaagaatacaagcagaaaattaaggaatacatccaaaaatatgccaccgaagaagccttgaaggagcaggaagaggggaccggcgacagcagctctgaaagctctatgtctgacttctccgaagacgaggcccaggacatggagttatag

SEQ ID NO: 139866 - DNA, 459 bp, Artificial Sequence
  Description of Artificial Sequence: Synthetic coding sequence
atgtcctccccatcgcctggcaaaaggaggatggatacggatgttgtgaaactcatcgaaagcaagcatgaggtgactattttgggcgggctgaacgaattcgtggtcaaattctatggcccgcagggaacgccttacgagggcggagtgtggaaggtgagggtcgacctgcccgacaagtatcctttcaagagcccgtctatcgacttgactaacatctttgagtcattcctccctcagctgctggcctatcccaatcctatagaccctctcaacggggacgccgcagctatgtacctccaccgccctgaagagtacaaacagaagatcaaagagtatattcagaaatatgcgacggaagaggctctgaaagagcaggaagagggcacaggagactccagctcagagtcttcaatgtccgatttcagcgaggacgaagctcaggacatggagctctag

SEQ ID NO: 139867 - DNA, 477 bp, Artificial Sequence
  Description of Artificial Sequence: Synthetic coding sequence
atgtcggggatcgccttaagcaggctagctcaggagagaaaggcctggaggaaggaccaccctttcggtttcgtggcagttcccactaaaaaccccgatggaacaatgaatttgatgaactgggagtgtgctatacccggaaagaagggtaccccatgggaagggggactctttaaactccgaatgctcttcaaggacgactaccccagctcaccccccaagtgtaagttcgagccacccctgtttcatcctaacgtatacccctccggaaccgtctgtctcagtatattagaagaggacaaagattggcgccccgccatcaccatcaaacaaattttgctgggaatacaggagctgttgaacgagcccaacatccaggatccagctcaagccgaagcatatactatttactgtcagaatcgtgtggagtatgaaaaaagggttcgcgcccaggccaaaaaattcgctcccagctag

SEQ ID NO: 139868 - DNA, 477 bp, Artificial Sequence
  Description of Artificial Sequence: Synthetic coding sequence
atgtcaggcatcgctttgagtagactggcccaggagcgcaaagcctggaggaaagaccatccgttcgggtttgtagcagtcccgaccaaaaatcccgatggcaccatgaacctgatgaattgggagtgcgctatccctggaaaaaaaggcactccttgggaagggggactttttaagctaaggatgctgtttaaggacgattatccgtctagccctcctaagtgtaaatttgagcccccgctctttcacccaaacgtttaccctagcgggactgtttgcttgagcatactggaagaggacaaagactggcggcctgccataacaataaaacagatactactcggtattcaggagcttctgaatgagcctaatatccaagacccggctcaggctgaagcctacacaatctactgccagaaccgcgttgaatacgaaaagcgggtgcgagcccaggccaagaagttcgccccgagttag

SEQ ID NO: 139869 - DNA, 477 bp, Artificial Sequence
  Description of Artificial Sequence: Synthetic coding sequence
atgtccggtatcgcgttatccagactggctcaggaaagaaaggcatggagaaaggatcatccatttggctttgtggcggtgcccaccaagaaccccgacggaaccatgaacttgatgaactgggagtgtgccataccggggaagaaaggaacaccatgggagggcggactcttcaagctcagaatgttgtttaaagacgactacccatctagccccccgaagtgcaaattcgagcctccgctgtttcatccgaatgtgtatcctagtgggacagtatgtctttctatccttgaggaggataaggactggagacccgccatcaccatcaaacagattttactgggaattcaggagttgttgaacgaacctaatattcaggatcccgcccaggcggaggcttacaccatttattgccaaaatcgcgttgaatacgagaagagagttcgggcccaagctaaaaaatttgctccatcatag

SEQ ID NO: 139870 - DNA, 477 bp, Artificial Sequence
  Description of Artificial Sequence: Synthetic coding sequence
atgtctggcattgccttgtcaagactggcgcaggagcggaaagcttggcggaaagatcacccctttggttttgtcgccgtgccaacaaaaaatcccgatggcactatgaacctgatgaattgggagtgcgctatcccaggtaagaagggtacaccatgggaaggcgggttatttaaattaagaatgttgtttaaggatgactatccgtcctcacctcccaagtgcaaatttgagccgcctctcttccaccccaatgtctacccaagcggtaccgtttgtttgtcaatacttgaggaggacaaagactggaggcccgccatcacaataaaacagatcttacttggaatacaggagctgctcaacgagcccaatatccaggatcccgctcaagcagaggcatacacgatctattgccaaaaccgcgttgaatacgaaaagcgcgtgagagcgcaggcaaaaaaattcgccccctcttag

SEQ ID NO: 139871 - DNA, 477 bp, Artificial Sequence
  Description of Artificial Sequence: Synthetic coding sequence
atgagcggaattgccctgtcaagactggcccaggagaggaaagcatggcgtaaagatcacccttttggatttgtggccgttcctaccaagaatcccgacggcaccatgaacctgatgaattgggagtgtgcgatcccaggcaagaaggggaccccatgggagggcggccttttcaaactgcggatgctgttcaaggatgactaccccagttccccccccaaatgtaagtttgagccgcctctgtttcacccgaacgtgtatccttctggcacggtctgcctgagcatactcgaggaggacaaagattggaggcccgcaattacaatcaagcagatccttctgggcatccaagagctgctcaatgaaccaaacattcaagacccagcacaggcagaggcatataccatctactgtcagaaccgggtggagtatgagaaacgcgtcagggcccaggcgaaaaaattcgctccaagctag

SEQ ID NO: 139872 - DNA, 477 bp, Artificial Sequence
  Description of Artificial Sequence: Synthetic coding sequence
atgagcggaatagccctgagccggctggcccaggagcgcaaagcctggagaaaggaccatccatttggcttcgtcgctgtgccgactaagaacccagatggcacaatgaatctaatgaactgggaatgcgccatccccggaaagaaaggaaccccctgggagggcgggttatttaaactgcggatgttgttcaaagacgattacccgagcagccctcctaaatgcaaattcgagccacccctctttcacccaaatgtctatccgtcaggaaccgtgtgcctgagtatccttgaggaagataaggattggagaccggccatcaccatcaagcagatactcctgggcattcaggaactgctgaatgagccaaacattcaggaccctgcccaagcagaggcctatactatttattgtcagaacagagtagaatacgagaagcgggtgcgcgctcaagcaaaaaaattcgccccgtcttag

SEQ ID NO: 139873 - DNA, 465 bp, Artificial Sequence
  Description of Artificial Sequence: Synthetic coding sequence
atggctgccagccgacgcttgatgaaggagttagaggaaattagaaaatgcggcatgaagaattttcggaacatccaagtggacgaggcaaacctcctgacctggcaaggcctaatagtacctgacaatcctccatacgacaaaggggcgtttcggatagaaataaatttccccgctgaatacccttttaagccacccaagatcaccttcaaaaccaaaatctaccatccaaacatcgacgagaagggtcaggtgtgtctacccgtgataagtgctgagaactggaaaccagcaaccaagactgaccaagtcatccagtccctgatcgctctggttaatgaccctcagccagaacacccgctgagagcagacttggctgaagaatacagtaaggacaggaagaaattctgcaagaatgctgaggagttcactaagaaatatggcgaaaagcgaccagtcgactag

SEQ ID NO: 139874 - DNA, 639 bp, Artificial Sequence
  Description of Artificial Sequence: Synthetic coding sequence
atgcaagtggcagctgggacaaggggtgatactaggctgcaagaggtggccctgctgccccagctgtttgacttgttggtacttgggcaaaggagggccaggcttctgcgtcaggttccttctgcactggccggaaaggacttggcacagctacaggcgggggcaaccctcgcagggtaccgacgcgctcacggcccagaagaactcgaggaaattaggaaatgtggaatgaaaaactttcgaaatatacaggtcgacgaggctaacctgctgacttggcaaggcctcatagtgcctgacaaccccccctacgataagggagcattccggatcgagattaatttccctgccgaatatcctttcaaacctcctaagattacatttaaaaccaaaatttaccacccaaacatcgatgagaaaggtcaggtatgccttccagtcattagcgccgaaaattggaagcctgccaccaaaacagaccaagtgatacagtctttaatcgctctcgtgaacgaccctcagcctgaacacccactgagagcggacttggcagaagagtactccaaggacagaaagaagttttgtaaaaacgctgaggagttcacaaagaaatatggagagaagagacctgttgattag

SEQ ID NO: 139875 - DNA, 369 bp, Artificial Sequence
  Description of Artificial Sequence: Synthetic coding sequence
atggctgcctccaggcgcctcatgaaagataaccccccctacgataagggagcgttcaggatcgaaataaactttcctgccgaatatcctttcaaacctccaaagatcacctttaaaactaaaatctaccatccaaacattgacgagaagggacaagtctgcctgcccgtcatcagtgccgaaaactggaaacccgcgaccaaaaccgaccaggttattcagagtctgattgcccttgtaaacgacccacagcccgaacaccccctccgcgcagatcttgctgaggagtattccaaggaccggaagaaattctgcaaaaacgcagaggaattcaccaagaaatacggtgaaaagcggcccgtggactag

SEQ ID NO: 139876 - DNA, 462 bp, Artificial Sequence
  Description of Artificial Sequence: Synthetic coding sequence
atgatggcctccatgagggtcgtgaaggagcttgaggacctacagaagaaaccgcccccatacctccggaacctttcctccgatgatgctaacgtgttagtgtggcacgctctcctactcccggatcagcccccataccatttaaaggcattcaatttgcgtatcagttttccgccggagtacccatttaagcctcccatgattaagtttacgactaaaatttaccacccaaatgtggacgaaaatggacagatctgtcttccaataatctcttccgagaattggaaaccttgtacaaagacttgtcaggtgctggaggcactgaatgtgctggttaaccggccgaatatccgggaacctctgcgtatggacctcgccgatttgctgacccagaatcccgagctgttcaggaaaaacgctgaggaatttactcttagattcggggtggaccgcccgtcctag

SEQ ID NO: 139877 - DNA, 264 bp, Artificial Sequence
  Description of Artificial Sequence: Synthetic coding sequence
atgatcaaattcaccacgaaaatctaccatcccaacgtggacgagaatggacagatttgcctacccatcatttcgtcagagaactggaaaccttgcacaaaaacttgtcaagtgcttgaagcgctgaatgtgcttgttaatcggcccaatattagagagcccttacggatggacctggccgatttgctcactcagaaccccgagcttttccgtaagaatgccgaagagttcacattaaggtttggggtggatcgcccaagctag

SEQ ID NO: 139878 - DNA, 198 bp, Artificial Sequence
  Description of Artificial Sequence: Synthetic coding sequence
atgatcaagttcacaacgaaaatatatcacccaaatgtggacgagaacggccaaatttgcctgcccattattagtagtgaaaattggaagccctgcactaagacctgtcaggttctcgaggcgctgaatgtcctcgtgaatcgtcctaatatcagggaacccctgagaatggatttagcggatctgctgactcagtag

SEQ ID NO: 139879 - DNA, 1128 bp, Artificial Sequence
  Description of Artificial Sequence: Synthetic coding sequence
atgagcgtcagtgggctaaaggccgagctcaagttcttggccagcatcttcgacaagaaccatgagagattccgtattgtttcatggaagttagatgaactgcactgccagttcctggtgccccaacagggaagccctcactcgttacccccgccgctcactctgcactgtaatattacagaaagttacccctcctcctccccaatctggtttgtggattctgaggaccctaatctgaccagcgtcctcgagaggctggaagacacaaaaaacaataacttgctgagacagcagctgaaatggctgatctgcgagctgtgctccctgtataacttaccaaagcacttagacgtcgagatgcttgaccagccattgcctaccgggcaaaacgggactaccgaagaagtcacctccgaagaagaggaagaggaggaggagatggcagaagatatcgaagatctggaccactacgagatgaaggaggaagagcctattagtgggaagaaatccgaggacgagggaatcgagaaagagaacttagcgattttggagaagatccgcaagactcagcgccaagatcatcttaatggtgccgtttcaggcagcgttcaagcctccgaccgccttatgaaggagctgcgggacatataccgcagccagtcatataagactggcatctacagcgttgagctcatcaatgattcattgtacgattggcacgtgaagcttcagaaggtcgatcctgatagtccgctccatagcgacctgcaaatcctgaaagagaaggaggggattgagtacatccttctcaacttttctttcaaggacaactttcctttcgacccccccttcgtccgggtggtattacctgtactaagtggcggctatgtcttggggggaggcgccctgtgcatggagttgctgacgaagcaggggtggtcgtctgcgtattctatcgagagcgtaattatgcagattaatgcaacgctagtcaaggggaaggcgagggttcagttcggtgcaaataagaatcagtacaaccttgcaagagcccagcagtcctacaacagtatagtacagatacatgaaaaaaatgggtggtatacaccacctaaggaagacgggtag

SEQ ID NO: 139880 - DNA, 945 bp, Artificial Sequence
  Description of Artificial Sequence: Synthetic coding sequence
atgtccgtcagtggcctgaaggcggagctgaagttccttgcgtcaatattcgataagaatcacgagaggttccgcatcgttagttggaaactggacgagctccattgccagtttttagtacctcaacagggctcgccccatagcctgccacccccattgaccctacattgtaatattaccgaatcgtaccctagttctagccctatctggtttgtggacagcgaggacccgaacctaacaagcgtgctcgaacggctcgaagatacaaagaacaataacttgctgagacagcaactgaagtggctgatatgtgaattatgttcgctgtataatctgcctaagcacttagacgtcgaaatgctcgaccagcctctccccacaggtcaaaacggaaccactgaggaggtgacctctgaggaggaggaggaggaagaggaaatggccgaggacatcgaagacttggaccattacgagatgaaagaggaggaaccaatttccggaaagaagagcgaagatgagggcattgagaaggaaaatctggccatcctcgaaaaaatccggaagactcaaaggcaggaccacctcaacggagctgtaagcggcagcgtgcaggctagcgatcgcctgatgaaagagctgcgggacatctacagatcccagtcttacaagactggaatctactctgtcgaacttattaacgacagtttatacgattggcatgtaaaactgcagaaagtggaccctgacagccctctgcactcggatctgcaaattctcaaagagaaggagggcattgagtacatcctccttaacttctcttttaaggataattttcccttcgatccccccttcgtacgcgtggtgctccccgtattgagtggaggactggtgcacccatctaaaggacgctggctgaacgtactgacggttgtgtgtcttgattag

SEQ ID NO: 139881 - DNA, 1080 bp, Artificial Sequence
  Description of Artificial Sequence: Synthetic coding sequence
atgcgaatggatagcctaactgaggaaaagctggaatgccggttgtggtgttgtctctcagatccttccccgcccgggctggcagctcggtgctgcgtcttggagcgaagcattgtcccttcactcaggcaggagagctatcctagcagctcccccatctggtttgtcgattctgaagatcccaacttgacaagcgtgctggagcgtctggaagacaccaagaataacaatctcttacgccagcagctcaagtggctgatttgtgagctgtgcagcctgtacaatctacccaagcacctggacgtcgaaatgctggatcagccattaccgacagggcagaacggtaccaccgaagaggtgacatccgaggaagaagaggaagaggaggagatggctgaggacatcgaggatcttgaccattatgagatgaaggaggaggaaccgataagcgggaaaaagtctgaagacgagggcatagagaaagagaatttggccattctggaaaagatacggaaaacgcagcggcaggatcatctcaacggagccgtgtcgggctcggtgcaggccagcgatcggctgatgaaggagctgagagatatctatcgctcccaatcatataaaacaggaatttactcggtagagttaatcaacgactctctttatgactggcacgtgaagcttcagaaggttgatccagatagcccactgcattctgacctgcagatacttaaggaaaaggaaggaatcgagtacattctgcttaatttttcgttcaaggacaactttccgtttgaccctccatttgtgagagtggtgctgcctgtgttgagtggcggatacgtcctgggcggaggagccctttgcatggagctcttaacgaagcaggggtggtcttcggcctacagcatagagagcgtgatcatgcaaattaacgccaccctagttaaaggtaaggctcgcgtccagttcggcgcaaataaaaatcagtataatctggcccgcgcccagcagtcttataactctattgtccaaatccatgaaaagaatggctggtacacgccccccaaggaggacggatag

SEQ ID NO: 139882 - DNA, 1080 bp, Artificial Sequence
  Description of Artificial Sequence: Synthetic coding sequence
atgagaatggacagcctgaccgaagagaagctcgagtgcagactatggtgctgcttgtcagatccctccccccccgggctggcagcaaggtgctgcgtcctggaaaggtctatagttccctccttgcgccaggagagttatccaagctcatccccaatctggtttgtggatagtgaggatcctaatctcacctctgtgctggagcggctggaggataccaagaataacaacttgttgcggcagcaactaaaatggctgatatgcgagctgtgttctctgtataacttacccaaacacctcgacgtggagatgctggaccagcccttgcctaccggacaaaacgggactactgaggaggtcaccagtgaagaagaagaggaagaagaagagatggctgaggatatagaagaccttgaccactatgagatgaaagaggaagagcccatcagcggtaaaaaatccgaggatgaggggattgaaaaagaaaatttggcaatcttagagaaaatccgcaaaacccagaggcaggaccacctgaacggagctgtaagcggcagcgtgcaggccagtgataggctgatgaaagagctcagagacatttacaggagccagagctataagactggcatttattccgtagagctgatcaatgacagcttgtatgattggcacgtcaaattgcagaaagtcgaccccgactctccattgcacagcgacctccaaattctaaaggagaaggagggtattgagtatatcctgctgaacttctcctttaaagacaacttccccttcgacccccctttcgtgcgagtggtcctgccagtgctgtcggggggctatgtactcggcgggggcgccctgtgcatggagttgctgaccaaacagggctggagcagcgcctacagtatagagtcggtgatcatgcagattaatgctacgttggtgaagggaaaagcaagggtgcagttcggagccaataagaaccagtacaaccttgctcgggcccaacaaagttacaactccattgtgcagatccacgagaagaacggctggtacactccgcccaaagaggacggatag

SEQ ID NO: 139883 - DNA, 717 bp, Artificial Sequence
  Description of Artificial Sequence: Synthetic coding sequence
atggcacaacagcagatgacatcttcgcagaaggcactcatgctcgaactgaaatcactgcaggaagagcctgtggaaggatttcgaatcacactagtagacgagagcgacctgtataattgggaagtcgccatttttgggcctcctaataccctctatgagggaggttattttaaagcacatataaagtttcccatagactacccttacagtccccctacatttcgttttctcaccaagatgtggcaccctaatatctacgagaacggagatgtgtgtatttccatcttgcacccgccagtggacgacccgcagtccggagagttaccaagtgaaagatggaatccaacacagaacgtaaggaccattctgttgtctgtgatcagcttgctgaacgaaccaaataccttctcccctgccaacgtggatgctagcgtcatgtttaggaagtggagagattcaaaagggaaggacaaagagtacgccgagatcattagaaaacaggtgtcagccaccaaagcagaggcagagaaggacggggtgaaagttccaacaactctcgcggaatattgtataaagacgaaggtgcctagtaatgataattcgtccgatctgctgtacgacgatttatacgatgacgacatcgacgacgaggatgaggaggaagaagatgctgattgctatgacgatgacgacagcggaaatgaagagtcatag

SEQ ID NO: 139884 - DNA, 669 bp, Artificial Sequence
  Description of Artificial Sequence: Synthetic coding sequence
atgaacagcaacgtggagaacctacccccacacataattagattggtgtacaaggaggtgactacactgaccgctgatccccctgacgggatcaaagtgttccccaatgaggaagacctgaccgatctgcaggtgaccattgagggcccggaggggacaccatacgctgggggcttgtttcgtatgaaactgcttctgggaaaggatttccctgcgagcccaccaaaagggtatttcctgacaaagatctttcaccccaacgtaggcgctaatggagagatttgtgtcaatgttttgaaaagagactggaccgcagagctgggtatacggcacgtgctgttgacaatcaagtgtctgcttatacaccccaacccggagtccgctctgaacgaggaagctggtagactgctgcttgagaactatgaggaatatgctgcccgcgctagactgttgaccgaaattcacgggggagctggcgggccttccgggcgcgcagaagccggaagggccttagcttcaggaacagaagcgtcttcgaccgatcccggagcaccgggaggacctgggggtgccgaggggcctatggccaagaagcacgccggtgagcgtgacaagaagctggcagccaaaaagaaaaccgataagaagagagcacttaggcgactctag

SEQ ID NO: 139885 - DNA, 594 bp, Artificial Sequence
  Description of Artificial Sequence: Synthetic coding sequence
atgcaacgtgcctcaaggctcaagcgagaacttcacatgctcgcgaccgagccccctcccggcatcacctgctggcaggataaagatcagatggatgaccttagagcccagattttgggtggcgccaacaccccttacgaaaagggcgtatttaagctggaagtgatcatacccgagcgatacccatttgaaccgccacaaattaggttcctgacccctatctaccaccccaacatcgactctgcggggcgcatctgtcttgacgtacttaagctgccacccaagggcgcctggagaccctctctgaatatcgccaccgtactcacttccatccagctgctcatgagtgaaccaaatcccgacgatcccctgatggcagatatttcgtccgagtttaagtacaacaagcccgccttcttaaagaatgcacgccagtggaccgagaagcacgctcgtcagaaacagaaagcagacgaagaagagatgttggacaacttgccagaagccggggattccagggttcataactctacccagaagcggaaggcgtcccagctagtcggcattgagaaaaagttccaccccgatgtgtag

SEQ ID NO: 139886 - DNA, 489 bp, Artificial Sequence
  Description of Artificial Sequence: Synthetic coding sequence
atggcctccatgcagaccaccggccgtagagtggaagtgtggttccctaaaagattgcagaaagaactgttggctcttcagaacgatcctcccccaggaatgacgttgaatgagaaaagcgtccagaattccattacacaatggatcgtcgatatggaaggcgcccccggcactctctacgaaggggaaaaatttcagttactgttcaaattctccagtcgctatccatttgacagccctcaggtgatgtttaccggagaaaacatacctgtacacccacatgtctattcaaacggtcatatctgtctatccattcttaccgaggattggtcccccgcgctctctgtacagtctgtttgtttgagcattatttccatgctgtcttcctgcaaggagaagcgtcgacccccagataacagtttctacgtgaggacttgtaataaaaaccccaagaaaacaaaatggtggtaccatgacgacacctgctag

SEQ ID NO: 139887 - DNA, 480 bp, Artificial Sequence
  Description of Artificial Sequence: Synthetic coding sequence
atggcttccatgcaaaagcgtctgcagaaagaacttctggccctgcagaacgaccctcctccagggatgacactgaacgaaaagtcagtgcagaactccattactcagtggatcgtagacatggagggtgcaccagggactctatatgagggcgagaaatttcagctcttgttcaaattttcgtcaagatacccctttgactctccccaggtcatgtttaccggcgagaacattcccgtgcatccccacgtgtatagcaatggacacatctgtctgagtatactgactgaagactggtctccggcccttagtgtccagtccgtatgcctgtccataatcagtatgctgagttcctgcaaggagaagcgccgcccccccgacaacagtttctacgtgagaacctgtaataagaatccgaagaaaaccaaatggtggtaccatgaacttaaaagtgccttcatattatctatcacagattag

SEQ ID NO: 139888 - DNA, 456 bp, Artificial Sequence
  Description of Artificial Sequence: Synthetic coding sequence
atggccagcatgcagaagaggctgcagaaagaactcttggcccttcagaacgacccgcctcccggtatgactctgaatgagaagagtgtacagaacagtatcacccagtggattgtggacatggagggcgcgcctggtaccctgtacgagggggagaagtttcagctcctctttaaattttctagtaggtacccattcgacagcccgcaagtgatgtttaccggggaaaatatcccagtccaccctcacgtgtatagcaatgggcacatttgtctgtctatactcaccgaagattggtcacccgccctgagcgttcaaagtgtttgtcttagcattatcagtatgctgtcctcatgtaaggaaaagcgacgtccccccgataacagcttctacgtgcgaacatgcaacaagaaccctaagaaaacaaagtggtggtaccacgacgatacttgttag

SEQ ID NO: 139889 - DNA, 354 bp, Artificial Sequence
  Description of Artificial Sequence: Synthetic coding sequence
atgtcctcgaacgtgccagccgacatgattaacctgcgcctgatactggtcagcggcaaaactaaggaatttttgttttcaccaaacgactctgctagcgatatcgctaagcatgtgtatgacaattggccaatggactgggaggaggagcaggtgagctcccccaacattctgaggctcatctatcagggcagattcctgcatggcaatgtcaccctgggcgccctcaaactgccttttgggaaaaccacggtgatgcacttagtggcacgtgagaccttgccagaacctaactcccagggacagcggaaccgagaaaagactggcgagagcaattgctgtgttatcttgtag

SEQ ID NO: 139890 - DNA, 474 bp, Artificial Sequence
  Description of Artificial Sequence: Synthetic coding sequence
atgcagctgaccgtgaaagctctgcagggtcgggagtgtagcctccaggttccagaggacgagcttgtgtctacgcttaaacaactagtgtccgagaagcttaatgtaccagtgcggcagcagcgactgttgttcaagggaaaggcactggcagatgggaaacgcctaagcgattacagcatcgggccaaatagtaaactcaacctcgttgttaagcctctggagaaagttctactggaagagggtgaggcacaacggttagcagattctcctccaccacaggtgtggcagctgatttcaaaagtgctagcacgccacttctctgcagccgatgcttcacgcgtgttagagcagctgcagagggactacgagcgtagcttgagccgcctcactttggacgacattgagaggctggccagtcgctttctgcatcccgaggtgacagagacaatggaaaaggggttttctaagtag

SEQ ID NO: 139891 - DNA, 525 bp, Artificial Sequence
  Description of Artificial Sequence: Synthetic coding sequence
atgtttcttactgtaaagctgctcctgggacagagatgctctctaaaagtcagtgggcaggagtccgtggcaaccctaaagcggctcgtgagtaggaggttaaaggtgcccgaggagcagcagcatttgctattccggggacagctgcttgaggatgacaaacacttgtcggactactgtatcggccccaatgctagcataaatgtcatcatgcaacctctggaaaaaatggctcttaaggaagcccatcaacctcaaacccagccactgtggcaccagctgggtctggtgctggctaagcacttcgaaccgcaggacgctaaggcagtcctgcagctgctgcgccaggaacacgaagagcggctgcaaaaaatttccttggaacatctggagcagttggctcagtatctgttagccgaggaaccccatgtggagcctgctggagagcgagagcttgaagcgaaagctcgcccacaaagttcttgtgatatggaggagaaagaagaggctgccgctgaccagtag

SEQ ID NO: 139892 - DNA, 222 bp, Artificial Sequence
  Description of Artificial Sequence: Synthetic coding sequence
atgattgaggtggtttgcaatgatcgcctaggcaagaaggtaagagtcaagtgtaacacagacgacactatcggcgacctgaagaagctgatcgctgcgcagaccggcaccaggtggaataagatcgtgctcaaaaagtggtacactatttttaaggaccacgtgtcattgggggactacgaaatccacgacgggatgaacctagagctgtactaccagtag

SEQ ID NO: 139893 - DNA, 222 bp, Artificial Sequence
  Description of Artificial Sequence: Synthetic coding sequence
atgatagaggtggtgtgtaatgacagattgggtaagaaagtgagagtgaagtgcaacacagacgacaccatcggtgaccttaagaaactgatcgccgcccagactggcacacgttggaacaagatagtcctgaagaagtggtatactatttttaaagaccacgtgtccctcggtgattatgagatacacgatggaatgaatctggaattgtactatcagtag

SEQ ID NO: 139894 - DNA, 1143 bp, Artificial Sequence
  Description of Artificial Sequence: Synthetic coding sequence
atgtccctgagtgattggcacctcgctgttaagctcgcggaccaacctcttacaccgaagtctattctgcggctgccagagactgagctgggtgagtactccctgggtggatatagcattagtttcttgaagcagctcattgcagggaaattgcaagagagcgtaccagaccccgaactgatcgacctaatttactgcgggcgcaaactgaaagatgaccagacactggatttctacgggattcagccaggatctactgttcatgtgctgagaaaatcctggccagagcctgaccagaagcccgagcccgtggataaggtagccgccatgcgcgagttccgagtgttgcacactgcacttcacagcagctcctcttaccgcgaagccgtgtttaagatgctgagcaataaggagtctcttgaccagatcattgttgccacaccaggactttcgtcagatccaatagcactgggcgtcctccaagataaagatctgttctcagttttcgcagatcctaacatgctagacaccttggtgcccgcccaccctgcactggtaaacgctattgtgctcgtgcttcactccgtggccggctctgccccaatgccaggaacagattcctcatcacgaagcatgccatcttcatcctatagagacatgcccggggggttcctgttcgagggtctgtctgacgacgaagacgatttccatcctaacacgcggtctaccccctccagtagcacaccctcctccagacccgctagcttaggctattcaggagctgctggcccacgccccattacccagtctgagctggctacggcgctcgccctcgctagcactccagaatccagttcccacaccccaactcctggcacccagggacactctagcggaacctctcccatgtcctcgggagttcagtcaggaacacctatcaccaacgaccttttcagtcaggcattgcagcatgccttgcaggctagcggacaaccctccctccaatcgcagtggcaacctcagcttcagcagctcagagacatgggtattcaagatgatgagctctccctacgcgcgctgcaggcaactggcggagacatacaggctgctctggaactgattttcgcaggtggcgcaccctag

SEQ ID NO: 139895 - DNA, 1143 bp, Artificial Sequence
  Description of Artificial Sequence: Synthetic coding sequence
atgtcattatctgattggcatctggcggtcaagctggcagaccagccccttactcccaaaagtatactccggttacccgaaacagaactgggagagtattccctgggcggatacagcatcagctttctgaaacaactgatagcaggcaagcttcaagagtcagtgcctgaccctgaacttattgatctcatctattgcgggcgcaagctgaaggacgatcaaaccctggatttttatggcattcagccaggcagcacagtccacgtgctacgcaagtcctggcccgaaccagatcaaaagcccgagccagtggacaaagtggccgctatgagggaatttcgggtactccacactgctttacacagtagtagctcttatcgcgaggccgtgttcaaaatgttgagtaacaaagagtcccttgatcagattatcgtagccacgcctggcttgtcgagcgaccccattgccttaggagttctgcaggacaaggacttgttcagcgtgtttgctgatcctaacatgttagataccctggtcccagcacatcctgcacttgtgaacgcaattgtcctcgtactacattccgtggccgggtctgctcccatgccaggcacggatagctcaagccgctccatgccaagctcctcgtatcgcgacatgcctggcgggtttttattcgaggggctgtctgatgacgaggatgattttcaccccaacacacggtctacaccttctagcagtaccccctcttctaggcccgcctctctgggttacagtggagccgcaggtccccgccctataacccagtccgagctcgctacggccctggctcttgcctctacccccgaatccagttcccacactcccacacccggtacccaaggccacagttcagggacatctccaatgagtagtggtgtacagtccgggacgccaattactaatgacctgttttctcaggctctgcagcacgccctgcaggcaagcggccaacccagcctccaaagccaatggcagccacaactgcagcagctacgcgacatgggaattcaggacgatgagctgtcgttgagggcgctacaagccacaggtggagatattcaggctgcgttggagctcatcttcgccgggggtgccccttag

SEQ ID NO: 139896 - DNA, 957 bp, Artificial Sequence
  Description of Artificial Sequence: Synthetic coding sequence
atggcccttcccatcatagttaaatggggtggccaggagtactccgtgaccacgctgagcgaggatgacacagtgcttgacctcaagcaatttctgaaaaccctgaccggcgttcttcccgaacgacagaaactcctgggcctcaaggttaaaggaaaacctgccgaaaatgacgtcaaactcggtgcattgaagcttaagcctaataccaaaattatgatgatggggacccgggaagaaagcttggaagacgtgctaggccctccacctgacaacgatgatgtcgtgaacgactttgatatcgaggatgaggtggtggaagtcgagaacagggaagagaacctccttaagatttctcgcagagtgaaggaatacaaggtcgaaatcttgaatccccctcgagaaggcaaaaaactactggttctggacgtggactacacccttttcgatcatagatcctgcgctgaaacgggcgtggaattaatgcggccctatctccacgaatttcttacatccgcctacgaggactacgatatagttatctggagcgcgaccaatatgaagtggattgaggcgaaaatgaaggagttaggcgtctctaccaacgctaactataaaatcacgttcatgcttgatagtgctgcaatgatcaccgtgcataccccccgacgggggctcatcgacgtcaagccactgggagtaatctggggaaaattttctgagttttactccaaaaaaaacacaattatgttcgacgacataggaagaaatttcctaatgaatccacagaatggtcttaaaatcagaccatttatgaaggcccacctcaatcgcgacaaagataaggaacttctcaagcttactcagtatctgaaggagatcgccaaattggacgattttctagaccttaatcacaaatactgggaacgctacctgtccaaaaagcaggggcagtag

SEQ ID NO: 139897 - DNA, 1923 bp, Artificial Sequence
  Description of Artificial Sequence: Synthetic coding sequence
atggcactgagcaggggcttgcccagggaactggctgaagctgtcgctggaggtagagtgttggtggtgggcgccgggggaatcggctgtgagctactcaagaatttggttctgaccggcttcagtcacatcgaccttatcgacctcgacaccatcgatgtgagcaatttgaaccgccaattcctcttccagaaaaagcacgttggccggagcaaggcccaggtggctaaggagtcagtactgcagttttaccctaaggccaatatcgtggcataccacgactcgatcatgaaccccgattataatgtggaatttttccgtcagttcatcttagtgatgaacgcactggataaccgggccgcccgcaaccacgtgaatcggatgtgcctggctgcagacgtccccctgatcgaatcaggcaccgccggctacctggggcaagtaaccacaatcaagaagggagtgacggagtgctatgaatgtcaccctaagcccacccagcgtactttccctggttgtacaataagaaatacccctagcgagcccattcactgtatcgtctgggctaaatatctgttcaatcagctgtttggcgaagaggatgctgatcaggaggtttccccagatcgagcagatcctgaggcggcttgggagcctacagaggcagaagcccgagcaagagcctccaacgaggacggggatatcaagcgtattagcactaaagaatgggccaaaagtacaggatacgatcccgtaaagctgtttacaaagctgttcaaggatgacatccggtacctgctgaccatggacaaactgtggcggaagcgcaagccgcccgtccccctcgattgggcagaggtccagagccaaggagaagagaccaatgcaagcgaccaacagaacgaaccccaactgggcctcaaagaccagcaagtcctcgatgtgaaaagttacgcccgcttattctccaagagcatcgagactctgcgcgtgcacttagcagaaaagggggacggcgcggagctgatatgggacaaggatgatccgagcgcgatggacttcgtgacctctgcagctaatttacgtatgcatattttcagcatgaacatgaaatcaagattcgacattaagtctatggccggcaatatcatacccgccattgccacaaccaatgccgtgatagcaggactgatcgtcctggaaggattgaaaatcttgagcgggaagattgatcagtgcaggacgatatttcttaacaagcaaccgaatcctaggaaaaaactcttggtgccatgcgcactggaccctccaaacccgaattgctatgtctgtgcatccaagcccgaggttactgtccgcctgaacgtgcacaaggtgaccgtgctcacgctgcaggataagatcgtcaaagaaaagttcgccatggtcgctccagacgtgcaaatcgaggacggaaagggcactattcttatctcgtctgaggagggagaaaccgaggcaaataaccacaagaagctcagcgagtttggcattcgtaatggcagccgcctacaggctgatgattttttgcaggattacactctgctgattaatatcctgcacagcgaagacctaggcaaggatgtggagtttgaggtggtcggggatgctcctgagaaggtgggcccaaagcaggcggaagatgcagcaaaaagcatcacaaacggctctgacgacggtgctcagccgtctacaagtaccgcacaggagcaggatgatgtactgattgtggattccgacgaggaagacagctctaataatgccgacgtgtcggaagaggagagaagccgcaaacgcaagctagatgagaaggagaatctctcagcaaaacggagcaggattgagcagaaggaggaactggacgacgtgatcgcactagattag

SEQ ID NO: 139898 - DNA, 1635 bp, Artificial Sequence
  Description of Artificial Sequence: Synthetic coding sequence
atgaacccagattacaatgtggagttcttcagacagttcatcttggtcatgaacgctcttgataatagggctgcgcgaaatcatgtgaataggatgtgtctcgcagcagatgtgccactgattgaatccggaacagcaggctacttgggccaagtgactaccattaagaaaggtgtcacagagtgctacgagtgccaccccaagcccacccagcgaacctttccgggatgtaccatccggaatactcctagcgaaccgatccattgtatcgtgtgggcaaagtacctgttcaaccaattgtttggcgaggaggatgccgatcaggaagtgtcccctgaccgtgcggacccagaagcagcatgggagcctacagaggccgaagcccgagcaagggcaagcaatgaggatggcgacataaaaagaatcagcaccaaggagtgggccaaatccacagggtacgatcccgtgaaactgtttacaaaactctttaaggatgacatccgatacttgttaacgatggacaagttatggagaaaacgcaagccacctgttcccctggattgggctgaggtccaatctcagggtgaagaaactaatgcatcagaccaacaaaatgaaccacaactggggttaaaggaccagcaggtgctcgacgtcaagagctacgcacggcttttctcgaaatctatagaaactctgagggtgcaccttgctgagaaaggtgacggcgccgagctgatctgggataaggatgatccctctgcaatggattttgtgaccagtgcggctaatctccgaatgcacatctttagcatgaatatgaaatctagatttgatattaagtctatggccggaaatataatacccgctatcgccacaaccaatgcggtcattgcaggcctgattgtcctagagggactgaagattcttagcggtaagatagaccaatgtcggactatatttctgaacaaacaacccaatccacgaaagaaactgctagtgccgtgtgccctcgacccccctaacccgaattgctacgtatgcgcaagcaaacctgaggtcaccgtgcgattgaatgttcataaggtgactgtgctgacactgcaggacaagattgtgaaagaaaaatttgccatggttgctcccgacgtgcagatagaggacggtaagggaactatattaattagcagtgaagaaggcgaaacagaagcaaataaccataagaaactctccgaattcggtatcaggaatggctcccgacttcaggccgacgactttcttcaagactacacgctgctgattaacattctgcacagcgaagatctgggaaaggatgtggaattcgaagtggtcggcgatgctcctgagaaagtgggaccaaagcaggccgaggatgctgccaaaagtatcacaaatggtagcgatgatggtgctcagccatccacaagtaccgctcaggagcaggacgatgtgttgattgtggactcagacgaagaagatagctcgaacaacgccgacgtgtcggaggaggagcgctcgcggaaaaggaagctcgacgaaaaggagaacctgagtgccaagagatctagaatcgagcagaaggaggaattggacgacgtcatcgctctggactag

SEQ ID NO: 139899 - DNA, 879 bp, Artificial Sequence
  Description of Artificial Sequence: Synthetic coding sequence
atgtgtctcgcagcagatgtgccactcattgaaagtggcacagctggctacctgggtcaggttaccacaattaagaagggggttaccgagtgttacgagtgccacccaaagcctacccagagaaccttccctggatgtactataaggaacacacccagtgagccaatacattgtattgtgtgggctaaataccttttcaaccagctttttggagaggaggatgcggatcaggaagtatcacccgaccgcgctgaccccgaggcggcgtgggagccgacggaggctgaggccagagccagagcctctaacgaagatggagacattaagcgaatcagcacaaaggagtgggctaagagcactggttacgaccctgttaagctcttcacaaaactgtttaaggatgatattaggtacttacttacgatggacaagctgtggaggaagcggaagccgccagtccctctggattgggccgaagtgcaaagccagggtgaagagacaaatgccagtgatcagcagaacgagccccagctaggccttaaggaccaacaagtcttggacgttaaatcctacgctaggttattctctaagagcatcgagacgctgcgagtgcacctcgctgagaaaggggacggagccgagcttatttgggataaggatgatccctccgctatggactttgtgacaagcgccgccaacttacgaatgcacatatttagcatgaacatgaaatccaggtttgatattaaaagcatggccggaaacataatccccgctattgcgactaccaatgcagtgattgccggtctgatagtgctcgagggtctgaaaattctatccggcaaaatcgaccagtgtcgcacagatttcttcgagtag

SEQ ID NO: 139900 - DNA, 1047 bp, Artificial Sequence
  Description of Artificial Sequence: Synthetic coding sequence
atggcattaaaacgtatgggcatagtttcagactatgaaaagatccggacttttgcggtggctatcgtgggtgtagggggcgtagggagcgtgacagccgagatgctcactcgatgcggtataggcaagctcctgctttttgactacgataaggtcgaactggctaatatgaatcggttgttttttcaacctcaccaggcaggactttcaaaggtgcaggcggccgagcacacactgagaaatatcaatcctgacgtcctctttgaggtccataattacaatatcaccacagtcgaaaactttcagcattttatggaccgcatctcaaacggagggctcgaggaaggtaaaccagtggatctggtcctgagctgtgtggacaatttcgaggctcggatgacaattaacactgcatgtaatgagcttggacagacttggatggagtccggtgtgagcgaaaacgcagttagtggtcatattcagctgattatacctggcgagtctgcctgcttcgcctgcgcgccacctctggtggttgccgctaatatcgacgagaaaacactcaagcgcgagggggtttgcgctgctagtttgcccaccacgatgggcgtcgtggccggcattttagtgcagaacgtgctcaagttcctgcttaactttggcactgtctccttctacctggggtataacgccatgcaggactttttccctacaatgtccatgaagccaaatccccagtgcgatgaccgcaattgtcgaaagcagcaagaagagtataaaaaaaaagtggctgctctcccaaagcaagaagttatacaagaggaggaggagattatacatgaggataatgaatggggtatcgagttggtcagcgaagtctccgaggaggaactgaagaactttagcggtcctgttccagatctgcccgagggcattactgtagcgtataccatacctaagaaacaagaggactccgtcaccgaactgacagtagaggacagtggtgagtccctcgaggatctcatggcaaagatgaagaatatgtag

SEQ ID NO: 139901 - DNA, 1215 bp, Artificial Sequence
  Description of Artificial Sequence: Synthetic coding sequence
atggcagagtctgtcgaacgtttacagcagagagtacaggaacttgagagagagctcgctcaggaacgcagcctacaggttccacgatctggggatgggggcggaggccgcgtcaggattgaaaagatgagctcagaggttgtggattctaacccgtactccaggcttatggccctgaagaggatgggcatcgtttccgactatgaaaagatccgaacgtttgccgtcgcgatcgtcggcgttggcggagttggcagcgtaacagcggaaatgcttacaagatgcgggattggaaaactgctgttgttcgattacgacaaagtggagctggccaacatgaatagactgttcttccagccacaccaggccggactgagtaaagtgcaagccgccgagcataccttgcgaaatatcaatcccgacgtactgttcgaggtccacaattacaatatcacaacagttgagaattttcaacatttcatggacagaatctcgaatggtggtttagaagaaggcaaacccgttgacttggtcctttcctgcgttgacaacttcgaagctcgtatgaccattaacaccgcgtgtaacgagctgggccagacctggatggagtctggggtgagcgaaaatgccgtgagcggccatatacaattaattatccccggagaaagcgcctgtttcgcttgtgcgcctcctctcgtggtggcagccaacatcgatgaaaaaaccttgaagcgggagggggtctgcgccgcttccctgccaactacaatgggtgtagttgccggtattctggtgcagaatgtactcaaatttcttttgaacttcgggaccgtttcattctatctcggttataacgccatgcaggatttcttccccacaatgtccatgaagcccaacccgcagtgcgacgatcggaattgtcggaaacagcaagaggagtacaaaaagaaagtcgctgctttgcctaagcaggaggtgattcaggaagaggaagaaattatccacgaagataatgagtggggcatagagcttgtctcagaggtgagcgaggaggaactgaagaattttagcggaccagtgccagatctgccggaaggcattactgtcgcctacacaattccgaaaaagcaagaagattccgtgactgagctgactgtggaagacagtggggagagcctggaggatctgatggctaaaatgaaaaatatgtag

SEQ ID NO: 139902 - DNA, 2379 bp, Artificial Sequence
  Description of Artificial Sequence: Synthetic coding sequence
atgtggattcaggttcgaacaatggatggccgacagacacacaccgtggatagcctgtcccgcctaactaaagtggaagagcttagaaggaaaatacaggaactgtttcacgtggaacctggactccagcggttgttctatagaggaaagcaaatggaagacgggcacactcttttcgactacgaggtgcggctgaatgacacaatccagttgctggtgaggcagtctctcgtgctcccccattccaccaaggagcgcgatagcgagctatcagatacggatagcggctgctgtctcgggcagagtgagtctgacaagagtagcacccacggggaggctgctgccgaaacggactctagaccagcagacgaggacatgtgggatgagacagagctgggactatataaggtgaatgagtatgttgacgcacgtgacaccaacatgggcgcttggttcgaagcgcaagtggtgagggttacacggaaggctcccagccgcgacgagccatgcagcagcacctcacgccccgctctggaggaggacgtgatctatcacgtgaaatatgatgattatcccgaaaacggtgtggtccaaatgaactcccgggacgtgcgagcacgcgctagaacgatcatcaagtggcaggacctggaagtgggtcaggtagtgatgctgaattataaccctgacaacccaaaagagcggggcttctggtatgacgctgaaatctcccggaaacgcgagacacgaactgctagggagttgtatgcgaatgtggtcctgggggacgatagtcttaatgattgcagaatcatcttcgtggatgaggtgttcaagatcgaaaggccaggggagggatctcctatggtggataatcccatgagacggaagagtgggccatcttgtaagcactgcaaggacgacgtaaatcgactctgccgcgtgtgcgcatgccacctgtgcggaggacggcaggacccagataagcagttgatgtgcgacgagtgtgacatggctttccacatctactgtctggatccccccctgtcatccgtcccatcggaagatgaatggtactgtcccgagtgtcgcaacgacgcatctgaggtggtgcttgctggcgaaagactgcgggagagtaaaaagaaggccaaaatggcatccgctacaagttcatctcagagggactggggcaaagggatggcctgtgtgggaaggacaaaagagtgtactatagtcccatccaatcattatggacccatccccggcatccccgtgggcaccatgtggagatttagggtgcaggtatccgagtcaggcgtacacagaccccatgtcgccggcatccatggcaggtcaaatgacggagcatactccctggtgctcgccggaggatacgaggacgatgttgatcacgggaacttcttcacatacaccggctccgggggacgtgatctcagcggaaataagaggacagccgaacaatcttgtgaccaaaagctcacaaatactaatagagccctcgccctgaactgctttgccccaattaacgatcaagagggcgctgaagccaaggattggcgatcaggaaagccagttcgcgtagtgcgcaacgttaagggggggaagaactcgaaatacgctcctgctgagggaaacaggtacgatgggatctacaaggtggtgaaatactggcctgaaaaagggaaaagcgggttccttgtgtggcgctacctactgagacgcgatgacgacgaacctggaccatggacgaaggagggcaaggatagaatcaaaaaactaggactgaccatgcagtacccagagggctacttggaagccctggcaaatagggagcgggaaaaagaaaactcaaagcgcgaagaggaagagcaacaggagggcggatttgcaagccctcgcactggcaagggtaaatggaaacgcaagtcagccgggggagggccaagtcgggcgggacctaggaggacctccaaaaaaaccaaggtggaaccatactctctaacagcccagcagagcagtttgatccgggaggataagtccaatgctaaattatggaacgaagtgctcgcgagcctaaaggaccgccccgcctcaggcagtccattccagctcttcctgtcaaaggtggaagagacttttcagtgtatttgttgccaggagctggtgttcagaccaattaccactgtctgtcagcataatgtctgtaaagactgtctggatcgaagttttcgggcgcaggtgtttagttgcccggcttgtcgttacgacctaggccgctcatacgccatgcaagtgaatcagcctcttcagaccgtgctgaaccagcttttcccaggctatggaaatggaagatag

SEQ ID NO: 139903 - DNA, 1224 bp, Artificial Sequence
  Description of Artificial Sequence: Synthetic coding sequence
atggcatctgctacctccagttcccaacgtgattggggaaagggtatggcatgcgtcggtagaactaaagagtgtaccatcgtaccttcaaatcactatggaccaattccaggaatccccgtggggacgatgtggaggtttcgcgtgcaggtgagcgagagcggagtgcacaggccacacgtggctggaatacacggacggtcaaatgacggcgcctactctttagtcctcgcaggcgggtatgaagacgacgttgatcacggtaatttttttacttataccggctcaggtggaagagatttgtctggaaacaagagaaccgcagagcagtcctgcgaccagaaactgacgaataccaaccgggccctcgcgctgaactgctttgcacccataaacgaccaggagggtgctgaagccaaagattggcgcagtggcaaaccagtgcgggtagtacggaacgtgaagggtggcaaaaatagtaagtacgctcccgcagaagggaaccggtacgacgggatctataaagtcgtcaaatactggcccgagaaggggaagagcggcttcctggtgtggcgatatttgttgaggagggatgacgatgagcctggaccctggaccaaagaggggaaagaccgcatcaagaaattaggacttacgatgcagtatcccgagggctatctggaagcacttgccaatagagagcgggagaaggaaaactcaaaaagggaagaggaagaacagcaggaaggcggcttcgcgtcccccaggacgggaaagggtaaatggaaaaggaagtctgccggcggcggccctagtagagccggacctaggaggacttcaaaaaagaccaaagttgagccgtattcattgacagcccagcagtcgagcctcataagagaggacaaaagtaatgctaagctctggaatgaggtccttgcctccctaaaagacagacccgcatcagggtctcctttccagttattcttgtctaaggtagaagagaccttccagtgtatatgttgccaggagctcgtcttcaggcccattaccacggtgtgtcagcataatgtttgcaaagattgcttggatcgttcattccgcgcgcaggttttttcctgtcctgcgtgcagatatgacctaggtagaagctacgcaatgcaggtcaatcagcccctccagactgtgctgaatcagttatttcccggatacggcaacggtcgatag

SEQ ID NO: 139904 - DNA, 2418 bp, Artificial Sequence
  Description of Artificial Sequence: Synthetic coding sequence
atgggggttttcgctgtacccccgttgagtgccgacaccatgtggattcaggtgcgcaccatggacggccgacaaacacacacagtagacagcctgtcccgcctgaccaaggtcgaggaactgcgacgcaaaatccaggagctgtttcacgtcgagcccggcttgcagcgcttattctatagaggcaaacagatggaggatggtcacacattgttcgactacgaagtgcggctgaatgacacaatacagctgctggtccgacagagcctggtacttccacactcaacgaaggagagagacagcgagctgagcgacacagactccggttgctgcctggggcagtctgaatctgataagtcaagtacccacggtgaggcagcagctgagactgattcgagacctgcagacgaagatatgtgggacgagacagagttgggactgtacaaagttaatgaatacgtggatgcccgagatactaatatgggggcatggtttgaggctcaagtggtgcgtgtgacccggaaagcacccagccgggacgagccctgctcaagtacgtcaagacctgcgctagaggaggacgtcatctaccatgtgaagtatgatgattacccggagaatggcgtggttcagatgaatagtcgagacgtacgtgcccgcgccagaactataataaagtggcaggacttagaggttggacaggtcgtgatgctgaactataaccctgataacccaaaagaacgcggtttttggtacgatgctgaaatctctcgcaagcgggagacgaggactgccagagaattgtatgcaaatgtggtgttgggggatgacagcctgaatgattgtaggatcattttcgtggatgaggtcttcaagatcgaaagaccaggtgaggggtctccaatggtggacaatcctatgcgccggaagtccggtccttcttgtaagcattgcaaggacgatgtgaacagactgtgcagggtttgcgcctgccacctgtgtggcggccgtcaagaccccgacaaacagcttatgtgtgatgagtgtgacatggcatttcacatttattgccttgacccacccctcagcagcgtgccttccgaggatgagtggtactgtcctgagtgccgtaatgatgcatcagaagtggttctcgccggcgaaaggctgcgggagtctaagaaaaaagctaaaatggcatccgcgacatctagttcccagcgagattgggggaagggaatggcctgtgttgggcgtacaaaagagtgcactattgtgccttcgaatcactacggccctatcccaggcattccagttggaacgatgtggagattcagggtacaagtatctgaatccggtgtccatcggccacacgtcgctgggattcacgggcggtctaatgacggcgcgtattctctcgtgctggctggtggatacgaggacgatgtcgatcatggaaatttctttacatatacagggtccgggggcagagacctgtcaggtaataaaagaaccgccgagcaatcctgtgatcagaagttaacaaataccaatcgcgcccttgcactgaactgctttgcccctattaacgaccaagaaggcgccgaggcaaaggactggcggtcgggtaaacctgtgagagtggtgcggaacgtcaaaggcggaaaaaactccaaatacgcgcctgccgagggtaaccgctatgacgggatctacaaggtggtgaagtattggccagagaaaggaaaatcaggcttcctggtgtggcgatatttactgagacgagacgacgatgagcccgggccctggacaaaagagggaaaagataggattaagaaactgggccttaccatgcagtaccccgagggctatttggaggcccttgccaaccgcgagagggagaaagagaattctaaacgtgaagaagaggagcaacaggaaggcgggttcgctagtccaagaacaggaaaaggcaaatggaaaaggaagagtgctggcggcgggccttctcgcgccggcccccggcgaacatctaagaagactaaggtggagccctacagtctcaccgctcagcaatcctccctgatcagagaagacaagagcaatgctaagttgtggaatgaggtactggccagccttaaggaccgccccgcgtctggttcgccatttcagctcttcctctccaaggtggaagagaccttccaatgtatttgttgtcaggagctcgtgttcagacctatcactaccgtgtgtcagcacaatgtctgcaaagattgtctggacaggtccttccgggctcaagtcttctcttgtccagcctgtcgttacgaccttggccgctcatacgccatgcaggtgaaccagcctctccaaaccgttctgaaccagctcttccccggctatggcaatgggcgctag

SEQ ID NO: 139905 - DNA, 2379 bp, Artificial Sequence
  Description of Artificial Sequence: Synthetic coding sequence
atgtggatacaggtgaggaccatggacggacggcagacccacacagtagattccctcagtcggctgactaaggttgaagagctgcgccgcaaaattcaggagcttttccacgtggaaccaggccttcagaggctattctatcgtggcaagcaaatggaagatggtcacactttgttcgattacgaagtccgtttgaatgacacaattcaattgcttgtgcgtcagtccctggttcttcctcactcaaccaaggaaagagacagcgagctgtcagataccgactccggctgctgtctcggccagtctgaaagcgataagtctagcacccacggtgaagccgccgctgagactgattctcgaccagccgacgaggatatgtgggacgagactgagctggggctctacaaagtcaacgagtatgtggacgctcgagatactaacatgggtgcctggtttgaggcccaggttgtgcgagtgacccgtaaggccccatcgagagacgagccttgttcttcgactagccgtcccgctctggaagaagatgtgatctatcacgttaagtatgacgactatccagagaatggggtcgtacaaatgaactccagagacgtaagggcccgagctagaactatcattaagtggcaggacctggaggtgggtcaggtggtgatgctgaactacaacccagacaaccccaaggagcgggggttctggtacgatgctgagatctcaagaaagcgtgaaactaggacagccagagagctttacgctaacgtcgtgcttggggacgattccctgaacgactgcaggataatttttgttgacgaggttttcaagatagagaggcccggagagggaagccctatggtggacaacccgatgaggcggaagtctggccctagttgcaaacactgcaaggacgacgtaaatcggctgtgtagggtttgtgcctgccacttatgtggcggccggcaggacccggacaagcagctgatgtgcgacgagtgtgacatggcctttcacatctattgcctggatccccccctttcctccgtgccttccgaggatgagtggtactgtccagagtgcagaaatgacgcctctgaggtggtattagccggcgagaggctgagagaatcaaagaagaaagccaaaatggctagtgcgacctcctctagtcagcgcgactggggcaaggggatggcctgtgttggacggaccaaggagtgcaccatcgttccctcaaatcattatgggcccatcccagggatacccgtcgggactatgtggcgattccgagtccaggtctcagagtcgggtgtacaccgaccccacgtggctgggatccatggtaggtctaatgatggagcatatagtctcgtacttgcagggggctatgaggacgatgtggaccatggaaatttcttcacctacacaggctccggaggaagagatctgagtggtaataagcggaccgccgagcaaagctgtgatcagaagcttaccaacaccaatcgggccctggctttgaactgtttcgcacctataaatgaccaagaaggggctgaggccaaggattggagatcagggaaacccgtgcgggtggtaagaaatgtgaaagggggaaaaaactcaaaatacgcaccggcagaaggcaaccgttacgatggcatatacaaggtggtgaagtactggcccgaaaaaggcaagtccgggtttttggtgtggcgttacctgcttcgacgagacgacgacgagcctggaccatggaccaaagaagggaaggacagaattaagaagctgggactgaccatgcagtatcctgagggctacctggaagccctagctaacagggaacgtgagaaggaaaattcaaagagggaagaagaagagcagcaggaaggggggtttgcctcaccacgaactgggaaaggaaaatggaagcggaaatcagctggcggaggaccatcccgcgccgggccaagacgcacgtccaaaaagaccaaagtcgaaccatacagccttaccgcacagcagtccagcctgattcgggaagacaaaagcaatgccaagttatggaatgaggttcttgccagtcttaaggatcggccggcttcaggaagtccctttcaactgtttctatctaaagtggaagagacatttcaatgtatatgttgtcaggagctcgtgttcaggcccatcaccacggtctgccagcacaatgtttgcaaggactgtctggataggagtttcagagctcaggtatttagttgtcctgcgtgtagatacgatcttgggaggagctatgctatgcaagttaatcagcctctccagacagtgcttaaccaactctttcctggctacggcaatgggcggtag

SEQ ID NO: 139906 - DNA, 2379 bp, Artificial Sequence
  Description of Artificial Sequence: Synthetic coding sequence
atgtggatccaggtcaggacaatggacgggcggcaaacacatacggtcgattctctgagccggctcaccaaggtggaggagctgaggaggaaaatccaagagcttttccacgtagagccaggactgcagagattgttctatagaggcaaacagatggaggacgggcatacgctattcgactatgaagtgcggctgaatgataccattcaactgctcgtcagacaatcgctggtgctgcctcattccaccaaggaacgggactctgagctgagcgacaccgactcaggatgttgtctgggccagagcgagtcagacaagtcttccactcacggggaagcagcggcggagactgactcccggccagcggacgaagacatgtgggatgaaaccgagctaggcctgtataaggttaacgagtatgtagacgcgcgcgacaccaacatgggagcctggttcgaggcgcaggtggttcgagtcactaggaaggccccatcacgagacgaaccgtgttcctctacaagcaggccggctctggaggaggatgtgatttaccacgtgaagtacgatgactacccagagaacggggtagttcaaatgaacagccgtgatgtaagagcccgcgcccgaaccatcattaaatggcaggatctggaggtggggcaggtagtgatgctaaactacaaccctgataaccctaaggaaagaggcttctggtatgatgcagagattagtaggaagagagaaacaaggacagcccgtgaactgtatgctaatgtggtactgggcgatgatagcctgaatgattgtcgaattatttttgtggacgaggtgtttaagatcgagcgacctggggaaggatccccaatggtcgacaatcccatgagaaggaagtccggaccctcctgtaagcactgcaaagatgacgtgaatcgactgtgccgtgtttgcgcctgccacctgtgtgggggcaggcaagaccccgacaagcagttgatgtgcgacgagtgcgatatggcttttcatatttattgcttggacccacccctttcctcagtacctagtgaagacgagtggtattgtcccgagtgcagaaatgatgcttccgaagtggtgctggctggggagaggctgcgagagtcaaaaaagaaggccaagatggcctcagccacttcatcaagtcagagggactgggggaagggtatggcttgtgtcggacgaacgaaggagtgtacgattgtgccctctaatcactacggcccaatccccggaattcctgtcggcacaatgtggcgctttagggtccaggtgagtgagtcaggagtgcaccgcccccatgtcgctggtattcacgggagatccaacgacggcgcatactccctcgtcctggccggtggatacgaggatgacgtagaccatggaaatttctttacatatacaggctctggagggagggaccttagcggcaataagcgtaccgcagaacagtcctgcgaccaaaagctgactaatacaaatagggctctggccctcaattgctttgcccctatcaacgaccaggagggcgcagaagccaaagactggcgatccggaaagcccgtgcgcgtggtcaggaacgtgaagggggggaagaacagcaaatatgcacctgctgaagggaatcgatacgatggtatctataaagtagtcaagtactggccagagaaaggcaagagtggatttctcgtgtggagatatctactgcggcgggatgatgatgaaccggggccctggacgaaagagggaaaggatagaataaaaaagctcggactaacaatgcagtatccagagggctatctggaggctctagccaacagagaacgagagaaggagaactccaagcgagaggaggaggaacagcaagagggcggctttgcctctcctagaacaggcaagggaaaatggaaaaggaagtcagccgggggtgggccctcgcgcgctggtcctagaaggactagtaagaagactaaagttgaaccgtattccttgaccgcccagcaaagttccctcattagagaagacaaaagtaatgcgaagctgtggaatgaagttttggcctcactgaaggaccgtccagcctccggcagcccattccagttgttcctcagcaaagttgaagaaacatttcagtgcatttgctgccaggagttggtgttccggccgatcaccacagtctgtcagcataacgtctgcaaggattgccttgacaggagttttcgggcccaggttttctcttgccccgcgtgtaggtatgacctaggtcgttcttatgccatgcaggttaaccaaccattgcagaccgtgttaaatcagttattccccggatacggcaacggccgatag

SEQ ID NO: 139907 - DNA, 3240 bp, Artificial Sequence
  Description of Artificial Sequence: Synthetic coding sequence
atgaagtcttgtgcagtttccctgaccaccgccgcagtagctttcggtgatgaagccaagaagatggctgaagggaaggcctcaagggaaagtgaggaagagtctgtgtccctcacagtagaggaacgagaggccctgggggggatggactctcggcttttcggatttgtccgcctgcatgaagatggtgccaggacgaaaactttactgggcaaggcagtgaggtgttacgaatccctgatactcaaagcagagggaaaagtggagtcagattttttttgccagctgggacactttaacctgctcctcgaggattacagcaaggcacttagcgcataccagcggtactattctttacaggctgattactggaaaaacgcagcgtttttgtacggcctcggcctggtgtatttttattacaacgcgtttcattgggcaattaaggcgttccaggacgtgttgtatgttgacccgtcattctgccgtgctaaggaaatccacctgcggctcggtctgatgtttaaggtaaacacagactataaatcctccctgaagcacttccaactggcactcatcgactgcaatccgtgtactctgtccaatgctgaaatacaattccacattgctcatctctatgagacacagaggaagtatcattcagctaaggaagcctatgagcaactgctccagaccgagaacctacctgcccaggtgaaagctacagttttgcagcagcttggttggatgcaccacaacatggatctcgttggcgacaaggccacaaaagagagttatgctatccagtatctgcagaagtcattggaggctgacccgaactcagggcagagctggtatttcctgggtcggtgttatagctcaatcggcaaagtccaggacgcttttatttcctaccgccagtccattgacaaaagcgaggcatccgccgatacttggtgctctatcggggtgctctatcaacaacaaaaccaacctatggatgcactgcaggcgtacatctgcgcagtgcagttggaccacggtcacgctgcggcatggatggacctgggcaccctctatgaaagctgtaaccaacctcaggatgctattaagtgttatttaaatgccgctagatcaaaaaggtgcagcaataccagcacactagccgctagaatcaaatttctccagaacgggtcggataactggaatggtgggcagtccctgagtcaccaccctgtgcagcaggtctacagtctgtgtctgaccccgcagaagcttcagcatctggagcaattgcgcgccaacagggacaatctcaaccccgcccaaaagcatcagctggagcaattggagtcccaattcgtgttaatgcagcagatgcgccataaggaagtggcacaggtgcggactacgggaattcacaacggagccatcaccgatagctctctccctaccaacagcgtttcgaatcgccaaccccacggagccctgactcgagtgtctagcgtgtctcagccaggcgtgcggccagcctgcgttgagaagctgctgtcgtccggtgcgttcagtgcaggatgtataccatgtggaacctctaaaatccttggatccaccgataccatcctgctgggttccaattgcatagctggaagcgagagtaacggcaacgtgccgtatcttcagcagaacacccacacactgccccacaatcatactgatttgaacagttccaccgaagaaccttggaggaaacagttgtccaattccgcacaggggcttcacaagtcgcagagctcttgcctgagcggcccaaacgaggaacagccccttttctctaccggttccgctcagtatcaccaagctactagcaccggaataaagaaggcaaatgaacacctgactctgcccagcaattccgtgccacagggagacgcggacagtcaccttagctgtcacactgccacatcagggggccaacaaggtattatgtttacaaaggaatccaagcccagcaaaaacaggagtctggtgcccgagactagcaggcacaccggcgacactagcaacggctgcgccgatgtgaaaggactgagtaatcatgtacaccagctcatcgccgatgccgtgagctccccaaatcatggcgactctccaaatttgctgattgcagacaacccacagttgtctgcattgcttatcgggaaagccaacggcaatgtggggaccgggacctgtgataaggtcaataatattcaccctgcggtgcacacaaagactgaccactctgtcgcgagctccccctcttccgccatctcgaccgctaccccaagtccaaaaagcaccgagcagcgtagcataaattcagtgacaagtctcaatagtccacactcaggtctgcatacggtgaatggagagggattgggcaagtcacagtccagcacgaaggtggacctgccgctggcttcccacaggtccacctcccagatactgcccagcatgtcggtgtcaatatgcccctcaagcacagaagtgttaaaggcctgcagaaatcctggaaaaaacggcctttctaatagctgcatcctgcttgacaagtgtccccccccccgtccgcctacgagtccctacccccccctccccaaggataagctgaaccctcctacgccgtctatctatctagaaaacaaacgtgatgctttttttcctccactacatcagttctgtactaatccaaaaaaccccgtcactgttattcgtggactcgccggggccttgaaactggatctgggactattttccacaaagaccctggttgaggctaataatgaacatatggttgaggtccggactcagctcctccagcccgccgatgaaaattgggacccaaccggcaccaagaagatttggcggtgcgagagcaatcgctcacatacgaccatagcaaaatatgctcaatatcaggcttctagtttccaggagtctttgagggcaggcatgcaatggtgcgatctgagctctctacagcctcccccacctgggttcaagcggttctctcacttgtccctaccgaattcctggaattaccgtcaccttccgagctgccccacgaacttctgtatctttgttgagacaggtttccaccacgtggggcaggcttgtctggaacttttaacctccggcgggctgctggcgtccgccagccagagtgccggcataaccggtgtgtcccaccacgcaaggtag

SEQ ID NO: 139908 - DNA, 4044 bp, Artificial Sequence
  Description of Artificial Sequence: Synthetic coding sequence
atgaagtcctgtgccgtatccttgactacagcagccgtcgcttttggcgacgaagccaaaaagatggcagaggggaaagccagcagggaaagcgaggaagaatccgtctcactgacggttgaagaacgcgaagctctcggtggcatggattctcgccttttcggtttcgtccggttacatgaagacggcgcaaggaccaaaacactgctgggcaaagccgtccggtgctatgagagcctgattttgaaagccgaaggaaaggttgagtctgattttttttgtcagctgggacactttaatctccttctcgaggattatagcaaggccctgagtgcttaccagagatattacagccttcaggctgactactggaaaaatgccgcctttttatatggactggggctcgtatacttttattacaatgctttccattgggctatcaaagcatttcaagacgtgctttatgtcgatccgagcttctgccgtgcgaaagagatccatctgcgcctggggctcatgtttaaagtaaacacagattataagagcagtctcaaacacttccaacttgcattaatcgactgcaatccctgcacattgagtaacgccgaaatccagtttcacattgcccacctctatgaaacccaaagaaagtatcacagcgctaaagaggcatatgaacaactgcttcagacagagaatctgccagctcaagtgaaggccacagttctgcaacagctgggctggatgcaccacaacatggatctggtgggagacaaggctactaaggagtcttacgctatccagtatttgcagaagagcttggaggccgaccctaattcaggccagagctggtactttcttggaagatgctactccagtattggcaaggtccaggacgcttttatttcatatcggcaaagtatagacaaatctgaagcctctgccgacacttggtgctcgatcggtgttttataccagcagcagaaccagccaatggatgcactccaagcgtatatctgcgccgttcagcttgaccatggccacgcagctgcttggatggaccttggcacgctgtacgagtcctgcaaccagcctcaggatgctattaagtgttacctgaatgccgccagatccaaacgctgtagcaatacgagtactcttgctgcaagaataaaattccttcagaacgggtcagataactggaatgggggccagtccctctcccaccacccagtgcagcaagtgtattccctctgcttgactccccagaagctgcagcatctcgaacagctgcgggcaaatcgagataacctcaatcctgcgcaaaagcaccagctcgaacagctggagtcacagttcgtcctgatgcaacagatgcggcataaagaagtcgcccaggtgcgaaccaccgggatacataacggggcaataacggacagtagtttaccgactaattccgtgtcaaaccggcaacctcacggagccctcaccagggtatctagcgtctcccagcctggggtccggccagcctgcgtagaaaaactcctctcttctggtgccttcagtgccggctgcatcccctgcggcaccagcaagatcctgggctccaccgacaccatcctgctcggctctaactgcattgctggtagcgagtccaacgggaacgtgccttatctgcaacagaacacccacacactgccacataaccatactgacctgaattcatcaaccgaggagccttggagaaaacagctgtcaaattccgctcagggactgcacaaaagccagagtagctgtctgagcggaccaaatgaggagcagcctcttttctcaactgggtctgcccagtatcaccaggcaactagtactgggataaaaaaagcaaacgaacaccttactttgccttccaacagtgtgcctcagggtgacgccgattctcatctttcctgccacacagctacatcagggggacagcagggcattatgtttactaaggaatccaagccctccaaaaaccggtctctggtgcccgaaacctctcgccacaccggcgacacgtctaacggctgcgcggatgtgaaaggcctgagcaaccatgtgcatcagttgatcgctgacgccgtttcctcgcccaatcacggggattcccctaacttgctcatcgcggataacccacagctgtcagccctgctgatcggcaaggcgaatggtaatgtgggtacaggcacttgcgacaaagtcaacaatattcacccagcggtccatacaaaaacagaccattctgtcgctagctctcccagcagtgcgatcagcacagctactccatcacccaagagcactgagcagaggtcaatcaactctgtgacctccttgaactcccctcactccggcctgcacacggttaatggagaaggactcgggaaaagccagagttccacaaaggttgatcttccactggcaagccatcgctccacctcacagatacttccctcgatgagcgtgagtatttgtccctcgtccaccgaagtcctgaaggcttgcagaaatcctggaaagaacgggctgtctaatagctgcatcctgctggacaaatgtcctcccccccgcccccccactagcccatatccacctttgcccaaagataagctgaatccccccactccgtccatatacttggaaaacaaacgggacgctttcttccctcctctacatcagttttgtactaatcccaaaaatcctgtgaccgttatcagaggattggcaggggcactgaaacttgatctgggcctgttcagcacaaaaacactggtggaggccaataacgaacacatggtagaggtaaggacacagctgttgcaaccagctgatgagaattgggaccccacgggcacaaagaagatctggcggtgcgagtctaatagatctcacacaacgatcgccaaatatgcgcagtatcaggcttccagttttcaggagagccttcgcgaggagaacgaaaagcggactcaacataaggatcacagcgataatgagagcacctcatcagaaaatagcgggcgccgccggaaggggcctttcaagacaataaaattcggaaccaacattgacttaagcgataataagaaatggaaacttcagttgcatgagttgaccaagctaccggcctttgcccgtgtcgtctctgccggcaacctcctgacccacgttggccacactattctggggatgaacactgtacagttatacatgaaggtgccgggatcaagaacccctggacaccaagagaataacaatttctgttctgtgaatataaatattggcccaggagattgcgagtggttcgtcgtccccgaagactactggggtgtgctcaatgacttctgtgagaagaacaacttaaacttcctgatgagctcgtggtggcccaatctggaagatctgtacgaagcgaatgtgcccgtgtacagatttattcaaagaccaggcgaccttgtgtggatcaatgctggaaccgttcattgggtgcaggcagttggatggtgcaacaacattgcgtggaacgttggacctctcacagcctgtcaatacaaacttgccgtggagaggtacgaatggaataagctcaaaagcgtgaaatctccagtaccaatggtacacctgagttggaatatggcgcgcaatattaaggtaagtgacccgaagctcttcgagatgatcaaatactgccttctgaagatcctgaagcaataccaaacccttcgagaagccctcgtggctgccgggaaggaagtcatttggcacggaaggacaaacgacgagccggcccactattgttcaatctgcgaggttgaagtattcaacctgttatttgttactaatgagtccaatacacagaagacatacatagtgcactgccacgactgtgctcggaagaccagtaagagcctggaaaatttcgtagtgctcgaacagtataaaatggaagatctcattcaggtgtacgatcagtttacactcgcattatcactgagtagttcctcctag

SEQ ID NO: 139909 - DNA, 3723 bp, Artificial Sequence
  Description of Artificial Sequence: Synthetic coding sequence
atgaaaagttgtgctgtttctttgacgacagccgccgtggcgttcggtgacgaagcgaaaaagatggccgaaggcaaagccagtcgagagtccgaagaggagagtgtctcactgacagtcgaagagagagaggccttgggcggcatggatagcagactttttgggttcgtgcgcttgcacgaggatggagccagaacaaagaccctactggggaaggcagtcagatgctatgagtccttgatcctgaaagccgagggaaaagtcgagtctgatttcttctgccaactggggcacttcaacttattgctggaggattactctaaagccctgagcgcctaccagcgttactactcactccaggcagactattggaaaaacgcagcattcttatacggactggggctcgtgtacttctattataacgccttccattgggccataaaagcctttcaagacgtgctctacgtggacccgtctttctgccgagccaaggagattcatctgcgactaggtttaatgttcaaagtgaataccgattacaaatcctcactgaagcattttcagctggcgctgattgactgcaatccatgtaccctgtccaatgccgaaatccagtttcacatagctcacctctacgagacccagcggaagtatcactccgcgaaggaagcatatgaacaattgctgcagactgaaaatcttcctgcacaggtcaaggcaacggtcctacagcagctaggatggatgcaccacaacatggatctggtgggtgataaagccaccaaggagtcctacgctatccaatatctgcaaaagtcactggaggcggatcccaatagtggtcagtcatggtacttcctggggcgctgttatagcagcattggcaaggttcaagacgcctttatatcataccgtcagtcgatagacaagagcgaggctagcgccgacacctggtgttccatcggagtactgtaccagcagcagaaccagccaatggacgcactgcaggcatacatctgcgctgtacagctcgaccacggacatgctgccgcttggatggacctgggcactctgtacgagagttgcaaccagcctcaggatgctattaagtgttatctgaacgctgctcgatccaagaggtgcagtaacacctcaactttggcagcacggataaagttcctgcagaatggaagcgataattggaacggcgggcagagcctctctcaccatccagtgcagcaagtttattcactgtgtctgacccctcagaaacttcagcatctggagcaactgagagctaatagagacaacctcaacccagcccaaaaacatcagctggaacaactggaatctcagtttgtgttaatgcagcaaatgagacataaggaagttgctcaagtgagaacaaccggaatccataacggggccattacagacagttcacttcccactaatagcgtcagcaatcgccaacctcacggggccttgaccagagtctcgagcgtgtcacagcccggcgtccgcccggcgtgcgtagagaaactgctgtcttcgggggcctttagtgcaggatgcatcccttgcggtacatcgaaaatcctgggatcgacagacaccatcctgcttggctctaattgcatcgccggtagtgagtctaacggcaatgtcccctacctgcagcagaacacacatacgctgccgcacaaccacacagaccttaacagctcaacagaggaaccttggcgaaagcaactgtccaacagtgcccagggcttgcacaagagccaatccagctgtctgtcaggacctaatgaggaacaaccactgttctcgaccggttctgcccagtaccatcaggccacctctacagggatcaaaaaagctaacgaacacctcactctgcccagcaattccgtgccccaaggtgatgccgatagtcatctatcctgccacactgcaacatctggagggcagcagggtattatgttcaccaaagagtctaagccatccaaaaacaggagcctggtcccagagacctccagacatactggagacacttccaatgggtgcgctgatgtgaaggggcttagcaaccacgtgcaccagctaattgcggacgccgtaagctcccccaatcacggtgacagtcccaacctgctaatcgctgataatccacagctctctgcgttattgatagggaaggcgaatgggaatgtggggactggaacttgtgataaggtaaacaacatccacccggccgtgcacactaaaacggatcacagcgttgcatccagccccagctctgcaataagtactgcgactcctagcccaaaaagcaccgagcagagaagcattaactccgtgacctcattgaattctccccactcaggcctgcacactgtgaacggcgaaggccttggcaaatctcaatcctccaccaaggttgatctacctttagcctctcaccggagtactagtcagatcttgcctagtatgtcagtgagcatttgcccctctagtactgaagtcctgaaagcttgcaggaatcccgggaagaatggcctgtctaatagctgcatcttactggataagtgtcctccaccacgtcccccgacctctccatacccgcctctgcctaaggataagctcaaccctcctactcctagcatctatctggagaacaagcgcgatgcattttttcctcccctacaccaattctgcactaatccgaagaatcctgtcactgttattagaggactggccggggccttgaagctcgaccttggtttattcagtactaagacacttgtagaagccaacaacgaacacatggtggaggtgcgcacccaactgctgcagccagccgatgaaaattgggatcccaccggcacaaaaaaaatatggcgttgcgagagtaataggagccacacgactatagccaaatatgcacagtaccaggcctcctcctttcaggagtcattgcgagaagaaaacgagaagaggacacagcacaaggaccactcagacaacgaatccacatctagtgagaattccggacggcgccgaaaagggcctttcaaaacgatcaaattcgggaccaacattgacctgtcagataataaaaaatggaagctgcagctccatgaactgactaagttgccggctttcgccagggtagtgagcgccgggaacttgctgacacacgtgggacatacgatactggggatgaacacagtgcagctgtacatgaaagtgcccggttctcgtacacccggccatcaagaaaacaacaatttctgcagcgtgaacattaatatcggcccaggtgactgcgagtggtttgtagtgccggaagactactggggggtcttgaacgacttctgtgagaagaacaacctaaattttctgatgagcagttggtggcctaatctggaagacctttacgaggctaacgttccagtctatcgttttatacaacgacccggtgacctcgtatggataaatgcaggcactgtgcactgggtgcaggcagtaggatggtgtaacaacattgcctggaatgtgggcccacttacggcctgtcagtacaagctggctgtcgaacggtatgagtggaacaagcttaagtctgtcaaaagccctgtgcctatggtccacctctcctggaatatggccaggaatatcaaggttagtgatcccaaactcttcgagatgattaaatag

SEQ ID NO: 139910 - DNA, 624 bp, Artificial Sequence
  Description of Artificial Sequence: Synthetic coding sequence
atgaagtcctgcgcggtgtctttaacaacggccgcagtcgccttcggagacgaggcaaaaaagatggctgaggggaaagcttctcgagaaagtgaggaggaatcagtctccttgacagtcgaagagcgggaggcgctcggtggtatggattcacggctatttgggttcgtcagactgcatgaggatggagccaggacaaagaccctgctgggtaaggccgtgcggtgttacgagtccctgatcctgaaagctgaaggtaaggtcgagtccgatttcttttgccagttgggtcactttaatctgttgctggaggattactccaaagcgctgtccgcataccagaggtattatagcttacaagccgattattggaaaaacgcagcgtttctgtacggactggggctcgtctatttctactataacgcttttcactgggcgatcaaggcctttcaggacgtcctgtacgtggacccttctttctgccgggccaaggaaattcacctgcggctgggacttatgttcaaggtcaatacagattacaagtccagccttaaacattttcaactggcgctcatcgattgtaacccttgtacactctccaacgccgagtctaagtatttctag

SEQ ID NO: 139911 - DNA, 4179 bp, Artificial Sequence
  Description of Artificial Sequence: Synthetic coding sequence
atgaagtcctgcgccgtgtcactgactacagctgccgttgcctttggcgacgaggcaaagaagatggctgaaggcaaggcaagcagggaatctgaagaagagagtgttagtctcacggtcgaggagagggaagccctgggcggaatggattctcgcctgttcggcttcgtgaggttacacgaggatggagcccgcactaagaccctgctgggtaaggcagttagatgctacgaaagcctcatcttaaaagcagaagggaaagtggaaagcgattttttttgtcagctcgggcattttaaccttttgttagaggactactctaaggccctctccgcttaccagaggtattatagcctccaggctgattattggaaaaacgctgcttttttgtacggcttgggtcttgtctacttctactacaacgctttccattgggccatcaaagcgttccaggacgtcttgtacgtggatcctagcttttgccgcgctaaggaaatacacctgaggcttgggctgatgtttaaagtgaataccgactacaagtcctccttaaagcactttcagctggctcttattgactgcaatccatgtacactgtccaacgcagagattcagtttcacatcgctcatctatatgagacacagcgcaagtatcactccgccaaggaggcatatgaacagctcctccagacagagaacctgcccgcccaggtgaaagctaccgtactccagcagctcggctggatgcaccataacatggacctggttggggacaaagctacaaaggaaagctacgctattcaatacctgcagaaaagtctggaggcagaccccaattctggccagagttggtatttcctaggaagatgctattccagcatcggaaaagtgcaggatgcctttattagctaccgtcaatccatagataaaagtgaagccagtgccgacacatggtgttcaataggggtcctgtatcagcagcagaaccagcctatggacgctctgcaagcatatatctgcgccgtgcagctggatcatggccacgcagccgcctggatggacctgggtaccctctatgagagctgcaatcagccccaggacgctatcaagtgttatttgaatgccgcccgatcaaagaggtgtagtaatacctctaccctggctgcgagaattaagttcctacaagctcagctttgtaacctgccccagtcctccctccagaataagaccaaactcttaccatccattgaagaggcctggtcgttgcccatcccggctgaactgacctcaaggcagggggctatgaacacagcacaacagaacggatccgacaattggaatggagggcagagcttgtctcatcatccagtgcaacaggtgtattccctgtgcttaaccccccagaagcttcaacacctggaacagctcagagccaaccgggacaaccttaatccagcacagaaacatcaactggaacaacttgagtcccagtttgtgttgatgcaacaaatgagacacaaggaggtggcacaggtgcgaacaacgggaatccacaacggagccataaccgattccagcttgcctacaaattcagtgagtaatcggcaaccacacggggcgcttacacgcgtatcttccgtatcgcagccaggcgttcgccccgcctgcgtggagaagctgctgtcaagcggagctttctcagctggctgtatcccctgtggcacctccaagatcctgggctcaaccgacaccatcctgctcggtagcaattgtatcgccggcagcgaaagtaacggcaacgtcccatacctccagcaaaacacccacaccctccctcataatcacaccgacctcaatagttcaaccgaagaaccttggcgaaagcaactctccaattcagctcagggcctgcataagagccaatcatcgtgcctgtcagggccaaacgaggagcaaccactgttcagtacaggaagcgcacagtaccatcaggccacaagcaccgggattaagaaagcgaacgaacacctcacactgccatcaaatagcgtcccacagggcgatgctgacagtcacctatcctgccatactgcaacatccgggggacagcaggggatcatgtttacaaaagagtcaaaacctagcaaaaatcgctcccttgtccccgagacctcaaggcacactggagacaccagcaacggatgtgctgacgtgaagggtctgtccaaccacgtgcatcagctcatcgccgatgccgtgtccagtccgaaccacggcgatagtccaaatttgctcattgccgacaatccccaactgagtgcattgttaattggtaaagccaatggtaacgtgggcaccggcacatgcgataaagtaaacaacatccacccggccgttcatacaaaaactgaccacagcgtggcgagctccccaagctccgctatttctacagccaccccatcacccaagagcacagagcagaggtccattaacagtgtcacaagtctgaattcccctcatagcggcttacatacggtaaatggtgagggcctcggaaagtcacagtccagtactaaggtggacctccccctggcgtctcatcgaagcacatcacagatactccctagcatgagcgtgtccatctgcccctcgagcactgaagtgctgaaggcttgccgtaaccccggtaagaatggattgtccaattcatgcatcctgcttgacaagtgtcccccaccaaggccacctacttccccctacccccctctgcctaaggataagctcaaccctccaacgccttccatttatctggaaaacaagagggatgcctttttcccccccttacatcagttctgcacaaacccaaaaaatccggtgaccgtcattcgtggcctcgcaggcgctctcaaacttgacctcggcctgttttccaccaaaaccttggtggaggccaacaatgagcacatggtggaagtgcggactcagctcctgcagcccgctgacgagaactgggacccaactggcactaagaagatctggcgatgtgaaagcaacagatcgcataccaccatcgcaaaatacgctcaataccaagcctctagctttcaagaaagcctgcgggaagaaaacgagaagagaactcagcacaaggatcattccgataacgagtctacttcctccgaaaacagcggccgcagacgaaaaggacccttcaaaacgataaaattcggtactaatattgatttaagcgacaacaaaaagtggaaactgcagcttcatgagctgactaagcttcccgcgttcgcacgtgtcgtgagcgcaggcaatctgttgacacacgttggccataccatactggggatgaatacagtccagctatatatgaaagtgcccggatccaggactcctggacatcaggagaacaacaatttttgctcagtgaacattaacatcgggcccggcgactgtgagtggtttgtggtccccgaggattactggggagtacttaatgacttttgcgagaaaaataatctgaacttcctgatgtcatcatggtggccaaatctggaagacttgtatgaagcaaatgtgcccgtctacaggtttatacagcgccccggagatctggtatggataaatgcaggcacagttcactgggtccaggcagtaggctggtgtaataatattgcgtggaatgtgggccccctgaccgcatgtcagtacaaactcgcagtggagagatacgagtggaacaaactgaagagcgtgaaaagcccggttccaatggtacacctgtcttggaacatggcccggaacatcaaggtgtcggaccccaagcttttcgagatgataaagtattgcttactaaagatccttaaacagtaccagactctcagggaggcactggtagccgccggaaaagaagtgatatggcacggaaggacaaacgatgaaccagcacattattgtagcatatgtgaagttgaggtcttcaacctgttgttcgtcactaatgagtctaacacacagaagacttacattgtccattgtcacgactgtgctagaaaaacgtccaaaagcctggaaaatttcgtagtgctggagcaatacaagatggaagatctgatacaggtttatgatcagtttaccctggccctgtcccttagctcatctagttag

SEQ ID NO: 139912 - DNA, 3636 bp, Artificial Sequence
  Description of Artificial Sequence: Synthetic coding sequence
atgaaatcctgtgcggtcagcctcactacagcagctgttgcctttggggacgaggccaagaagatggcagagggcaaggcctcccgggagagcgaggaggaatccgttagtctaaccgtcgaggaaagagaagctctgggtgggatggattcgaggctgtttggctttgtcagattgcatgaagatggagccagaacgaaaactcttctgggaaaagcagtaagatgctacgagagcctgattctgaaggccgaggggaaagtggaatccgacttcttttgccagctcggtcatttcaacctactgttggaggactatagcaaggctctcagcgcataccagaggtattactcgctacaggccgactactggaaaaatgccgccttcttatatggattgggcctggtttatttctactataacgcattccactgggcaatcaaggcctttcaggacgtgctgtatgtagaccctagcttttgccgggcgaaagagatccatttgaggctgggtttaatgtttaaggtcaatactgattacaagagttccctgaaacatttccaactggccctcatcgattgcaatccatgcacccttagcaacgccgagatacagtttcatattgcccacctgtacgaaacacaacgcaaatatcactcggcgaaggaagcatacgaacaactgttacagaccgagaatctgccagcccaggtgaaggccacggtgctccaacagttaggctggatgcaccataacatggatctcgtgggggacaaggcgacaaaggaatcatatgccattcagtacctgcagaaatctctcgaggccgaccctaactcaggccagagctggtactttctggggaggtgttactctagcattgggaaagtgcaagacgcttttataagctataggcaatctatcgacaagtccgaggctagcgccgacacctggtgtagtattggggtcctgtatcagcagcagaatcaaccaatggacgccttgcaggcctatatttgtgccgtgcagctggaccacggccatgcagcagcatggatggatctgggtaccctctacgagtcttgcaatcagccacaggatgccattaagtgttacttaaacgctgccagatctaaacggtgtagcaacacctcaacgctcgccgcacggataaaatttctccaagcccaactctgtaacctgcctcagagcagcctccagaataaaaccaagctgttgccctctattgaggaggcttggtcactacccataccggctgagcttacaagtcggcagggcgccatgaacacagctcagcagaatggcagtgacaactggaacggcggacaatctttatctcatcacccggtacaacaagtgtactcactctgcctaacgccccagaaactgcagcatctcgaacaacttagagcgaatagggacaatctcaatcctgcacagaagcatcaactggaacagctcgagagccagttcgtgctcatgcagcagatgcgccacaaagaagtagcccagggtcttcataaatcccagtcttcttgtctgtccggtccaaacgaggaacagcccttattctccactggtagtgcacaataccatcaggctactagcactgggataaaaaaagccaacgagcacctcactctgccatccaactccgtccctcagggcgacgctgatagccacctatcttgtcacaccgccacctccggtggccagcaaggcatcatgttcacaaaagagtccaagccgtccaaaaaccggtcccttgtccctgagacaagccgccacaccggtgacacctctaatgggtgcgccgatgttaagggcttaagcaaccacgtgcatcagttaattgctgatgccgtgtcctcgccaaatcatggggactctcccaacctgctaattgctgataatcctcagctcagtgctctgctcatcggcaaagccaacggcaatgtgggaacagggacctgcgataaggtgaacaatatacacccggcagtgcacacgaagactgaccatagcgtcgcttcctcaccctcttccgctatttcaacggctacaccatctccaaaatccaccgaacaacggtctattaacagcgtgacctctctgaactcacctcatagcggactgcataccgtgaacggggagggccttggaaaatcacaaagttctaccaaggtcgacctccccctggctagtcacagaagtacatcacagattttacccagcatgagcgtcagtatctgtccttcaagcacagaagttctcaaagcatgtcgcaaccctgggaaaaatggcctatcaaactcgtgtatcctcctggacaaatgccctccgccccggccgcctaccagcccgtatccccctctgccaaaggataaattgaatcccccgacccccagcatatatttagagaacaaacgcgatgccttcttccctccgctacaccagttctgtacaaatcctaaaaatccggttacagtcatacggggcctcgccggagccctcaagttggatctgggtcttttttccaccaaaaccttggtcgaggccaacaatgagcatatggtggaggtgcggacccagcttctgcagcctgccgacgagaattgggatcccacaggcacaaagaaaatttggcggtgcgaatctaaccgcagccacaccaccattgccaagtacgcccagtaccaggccagttcatttcaggagtcactcagggaagagaatgagaaaagaacacagcacaaggaccatagtgataacgagagtacctctagcgagaattcaggtaggaggcgtaaaggaccatttaaaacaataaaattcggtacaaatatcgatctcagcgataacaagaagtggaagttgcaacttcacgagctgacgaagcttcccgcattcgcccgcgtggtgtccgcaggaaacctgttaactcatgtaggccatactattctcggcatgaacacagtgcaactgtatatgaaagtacccggatcaaggacaccaggccaccaggaaaacaataatttctgctcagtgaatattaacatcgggccaggagattgcgagtggttcgtcgtgcctgaagattattggggcgtgctgaacgacttctgcgaaaaaaataatctgaactttctgatgtctagttggtggcctaatctggaggacctgtatgaggcaaatgtgcccgtgtaccgcttcatccaacgccccggcgacctggtgtggatcaatgccgggacggtgcactgggtacaggcagtaggctggtgcaataatattgcatggaacgttggcccactcacagcatgtcagtataaactggcggtcgagaggtacgagtggaataagcttaagagcgtgaagtcccccgtcccgatggttcacctgtcatggaacatggcgcgcaatattaaggtgagtgatcctaagctctttgagatgatcaaatattgcctgctgaaaattctgaagcagtaccagaccttgcgcgaggcattggttgcagctggaaaagaagtcatttggcatggccggacaaatgatgagccagcccattactgctcaatttgcgaggctctgagtctgagtagcagctcttag

SEQ ID NO: 139913 - DNA, 3141 bp, Artificial Sequence
  Description of Artificial Sequence: Synthetic coding sequence
atgaaatcctgtgccgtgtccttaacgactgccgcagttgcattcggggatgaggccaaaaagatggccgaaggcaaagctagccgggaaagcgaggaagagtctgtgtctctcactgttgaggagagggaggccctggggggaatggattcacggcttttcggcttcgtccgcctccacgaggacggggcgcggacaaaaactttgttaggcaaggccgttagatgctatgagtcgctcatacttaaggccgaaggcaaagtggagtcagattttttttgtcaacttggacattttaatctgctcttggaggattatagcaaggcactctctgcatatcaacgctactactcattacaagctgactactggaaaaatgcggcctttctctacgggctgggtctcgtgtacttttactataacgccttccactgggccataaaggcttttcaggacgttctttatgttgacccctccttttgtcgtgcgaaagaaatacaccttcggctgggacttatgttcaaggtgaacactgattacaagtcgtcacttaagcacttccagcttgctctgatagattgcaatccgtgtactttgagcaatgccgagattcagtttcacatcgctcacctttacgaaacgcagaggaagtaccattctgctaaggaggcgtatgagcaattattacaaactgagaacctacccgcacaagtaaaggctacagtgctccagcagctgggttggatgcatcataatatggacctggtgggagataaagccactaaagagagctacgcaatccagtacctgcagaaaagcctggaggcagatccaaacagtggtcaatcttggtacttcctaggctcagtgctgtatcagcagcagaatcaacccatggatgccctacaggcctacatctgcgcggtgcaactggaccacggccacgcagctgcctggatggatttaggcacgctctacgaaagttgcaatcagcctcaagacgccatcaagtgctatctcaatgcagcacgctccaaaaggtgtagcaacactagcacactagctgctaggatcaagtttctccaaaacggcagcgacaactggaatggaggacaatccttatctcaccatcccgttcagcaggtttatagcctctgccttacgccgcagaagctgcagcatcttgagcaactgcgggctaatcgggacaatcttaaccctgcacagaaacatcagctggagcagttggagtcccagtttgtattaatgcaacagatgagacacaaggaggtggcacaggttcgcacaaccggtatccacaatggggcaattacagacagcagccttccgacaaactccgtctccaatagacaacctcacggcgcattaacaagggtctcaagcgtgtcacagcccggggtccggcccgcatgtgtggagaaactgctttcctccggggccttttctgcagggtgcataccttgtggaacttcaaagattttgggtagtactgataccatcctgctcggcagcaactgtattgcaggcagtgaaagtaacggtaacgtcccttatctacagcagaacacccataccctccctcataaccacaccgacctgaattcctcaacagaggagccttggcgtaagcagcttagcaactccgcgcagggactgcataaatctcagtcgagctgcctgtcaggtccaaatgaggaacaacccctgttttctaccggatcagcccagtaccaccaggctactagtaccgggattaagaaggctaacgaacaccttactctgccttcaaattccgtgccgcaaggcgacgccgatagccacctgagttgccacactgccacaagtggcgggcaacaggggattatgtttaccaaggagtccaaaccatccaaaaacaggagtttagtacctgagacatcacggcataccggcgacacatctaacgggtgcgcagatgtaaaggggctctccaatcatgtgcaccaactgattgcagacgctgtgtcttccccaaaccatggggatagccctaatttgcttatcgcagataatccccagctgtcagcgctgcttattggcaaagctaacggcaatgttggcaccggaacctgcgataaagtcaataacatccaccccgcagtacacacaaaaactgaccactcagtggccagctccccctcgtctgctatcagtacagcaaccccatcacccaagtctaccgagcagaggagtatcaatagcgttaccagcctgaacagcccacactccggactgcatacagttaatggtgaaggcctggggaaaagtcagagttctaccaaagtggacctgccactggcctctcaccgatccacaagtcagatcttgccttcaatgagcgtgagtatctgccccagctcgacagaggtcctcaaagcctgccgaaatccaggaaaaaacggactttcgaatagttgtatcctcctcgataaatgccctccacctaggccacctacatcaccctatccacctctcccgaaggataagctaaacccccctaccccatctatatacctggagaacaaacgtgatgcgttttttccgcctcttcaccaattctgtacaaatccgaaaaatcccgtgaccgtgatacgtggcctggctggggctctgaaactagacctggggctgttctcaacaaagaccctggtggaagccaataatgagcacatggtggaagttagaacccagctcttacagcccgcagacgagaattgggatcctacagggactaaaaaaatctggaggtgtgaaagcaaccgttcccacaccactattgcaaaatacgcccagtaccaggccagttcattccaggagtccctgcgcgctggtatgcagtggtgtgatctgagctccttgcagcccccaccacccggattcaagcgattctctcatctgtctttacccaactcttggaattatcgccacctgcctagctgccccactaatttctgtatttttgttgagactggctttcaccatgttggccaggcctgccttgagctactgaccagcggcggccttcttgccagcgccagccaatccgcaggcataacaggagtctcgcaccatgccaggtag

SEQ ID NO: 139914 - DNA, 3018 bp, Artificial Sequence
  Description of Artificial Sequence: Synthetic coding sequence
atgaaatcatgcgccgtgtctcttaccacagctgctgttgcctttggggacgaagctaaaaaaatggcagaaggaaaggcaagccgagagagcgaagaggaatcagtctcactcaccgtggaggaacgtgaggccctgggggggatggacagtcgtcttttcggcttcgtccggttgcacgaggatggtgctcgcaccaagactcttctgggcaaagctgtgcgctgctacgaatcactaatcctcaaagctgagggaaaggttgagtctgacttcttttgccaattgggacattttaacctgctattagaagactacagcaaggccctttcagcgtaccaacgatactattccttgcaggccgattactggaaaaatgccgcattcctctacggcctcggactggtttatttctactataatgcttttcattgggccatcaaagcgttccaggacgtactgtacgtagatcccagcttctgccgagccaaagagatccacctgaggcttggcctcatgttcaaagtgaacacagactataagtcttcccttaagcatttccagctcgccctgattgactgcaacccatgtacgctgtcaaatgcagaaatccagttccatattgcccatctgtacgaaacgcaacggaagtatcactccgctaaagaggcgtacgagcagctgctacaaacggaaaatctccctgctcaggtcaaggccaccgtgctccaacagttaggatggatgcatcataacatggacctcgtgggggataaggccactaaggagtcatacgcaatccagtatctgcagaagtccctcgaagctgacccaaactcggggcagtcctggtatttcctaggctctgtgctttatcagcagcagaatcagcccatggatgctctgcaagcttatatctgcgcagtccaactggaccacggtcacgcagcagcctggatggacctgggaacgctgtacgagagttgcaaccaaccacaggatgctataaaatgctatttgaacgctgctagatcaaagcggtgtagtaatacatccacactagccgcccgaataaagttcctgcagcagagtcttagtctacacatgattacctcaagccaggtcgagggactgtctagccccgccaagaagaagaggacgtcatcgcctactaaaaatggaagtgataattggaacgggggtcaatccttaagccaccatccagtccaacaggtgtacagcctttgtctgactccccaaaagctgcagcatcttgagcagctgagggctaaccgtgacaatcttaaccccgcacaaaagcatcagctggagcaactggaatcacaattcgtgctaatgcaacagatgcgacacaaggaagtcgctcaggtgcgcactacaggtatccacaatggtgcgatcactgactctagtttgcctaccaacagtgtatctaacagacagccccatggagcactgacccgagtgtcgtcagtgagccaaccaggcgtacggccagcctgcgtggagaagctgctcagcagcggcgcattcagtgccggttgcattccttgcggaacgtcaaaaatccttgggtccactgacaccattctgctcggtagcaattgcatcgccggatccgagagcaatgggaacgtaccttatctgcaacagaatacacacaccctcccgcacaatcataccgatcttaattccagcaccgaggaaccatggagaaaacaactgtcaaacagcgcacaaggactccacaagtctcagtctagttgcctgagcggccccaacgaggaacaaccactcttctcgacaggcagtgctcagtaccatcaggcaacatcaaccggcataaaaaaggcgaatgaacatctcactctgcctagcaatagcgtgccccaaggcgacgcagatagccatctgtcatgtcatacagcaacttctggcgggcaacaggggatcatgtttacaaaagagtctaaacccagcaagaataggtcactggtgcctgaaaccagccggcataccggagacacatccaatggttgcgccgacgtcaaaggactgtcgaaccatgtccaccagctgatcgccgatgcggttagttctcctaatcacggagattccccaaacctcctgatcgctgacaacccccaactgagcgccttgctgattgggaaggccaacggcaatgttgggacaggaacttgtgacaaggtgaataacatccacccggcagtccatacaaagaccgatcattccgttgcctcgtctccttcctctgccatcagtacggctacaccctctcctaaaagcaccgagcaacgaagcatcaattcagttacatctttgaacagtccccacagtggactccacacagtgaatggcgagggactagggaagtctcaaagctccactaaggtcgatttgcccctcgccagtcatcgctccacttcgcagatccttccaagtatgtctgtatccatatgcccatcatccactgaagttctcaaggcgtgcagaaatccaggcaagaatggactctctaattcatgcatcctccttgataaatgtccacctccgcggcccccgactagcccctatccacctctgcctaaggacaagctgaatcctcctaccccgtctatctatctcgagaataagagggatgctttttttcccccgctgcatcagttttgtaccaatccaaaaaacccagtcactgttattcgtgggctggccggggcactgaagctggatttagggctcttcagcacaaagaccctcgttgaggcaaataatgagcacatggttgaagtcagaacccagctgctccaacctgccgatgaaaattgggatcctacagggaccaagaagatctggagatgcgaatcaaataggagccacacgacaatcgccaaatatgcacagtaccaggccagttccttccaagagagtctgaggtcgttgattctgagtcatccaggctggaacgccatggtttag

SEQ ID NO: 139915 - DNA, 3213 bp, Artificial Sequence
  Description of Artificial Sequence: Synthetic coding sequence
atgaaatcttgcgctgtttcacttaccactgctgccgtggcattcggcgacgaagcaaagaagatggccgagggcaaggcgtcaagggagagtgaagaagagtcggtgagtctcacagtggaggagcgagaggccctaggaggaatggatagcaggctctttgggtttgtgcggctgcacgaggacggtgcccgcacaaaaacactgctcggcaaagccgttcgctgttacgagagtctcatcctcaaggctgaaggcaaagtggagtcagactttttctgccaactgggccattttaaccttctgttggaggattattctaaggccttatcagcatatcaacgatattactcactgcaagccgactactggaagaacgcagcatttctgtatgggctgggactggtctacttttattataatgcgttccactgggctatcaaggctttccaggacgtactgtacgtcgacccgtccttttgtcgggccaaagaaatccatcttcgtctcggactcatgttcaaagttaacacagattacaagtccagcttgaagcacttccaattggctctcatagattgtaacccctgtactctctctaacgcagagattcagttccatattgcacacctatacgaaacccaacggaaatatcactcggccaaagaagcgtacgagcagttgctacaaacggagaacttgcctgcacaggtgaaggccactgtgcttcaacaactcggctggatgcaccataatatggatctagtgggagataaagctacgaaagaatcttatgcaattcaatacctacagaaatcccttgaagccgatccgaactctggacagtcctggtacttcctgggccgttgctacagttccatcggtaaggtccaggacgcattcatctcctacaggcagtctatcgataagtctgaggcatcagcagatacctggtgcagtatcggcgtactctaccaacagcagaatcagccgatggacgccctgcaggcatacatctgcgccgtacaactggaccacggacacgccgcggcctggatggacctcggaactttatatgagagctgcaatcagcctcaagacgcaatcaaatgctacctgaatgccgcacgctccaagcgatgttctaacacttcgacgctcgcagctagaataaagttcctgcaggcccagctttgtaatctcccacaatcttcgttacagaataaaacgaagctgttgccttctatcgaggaggcctggagcctccctattccggccgagctgacttccaggcagggtgcgatgaatacagcccagcaacagtcgctatccctgcatatgatcaccagctcccaggtggaaggactatcaagcccggccaagaagaaacgcaccagctctcccaccaaaaatgggagcgataactggaatggggggcagtcactcagccatcacccagtccaacaagtgtacagtctgtgcctgacgccccagaagctccagcatctggaacaattgcgggcgaatcgtgacaacctgaacccagcgcagaagcaccagttggaacagctggaaagccaattcgtccttatgcagcagatgcggcataaggaggtcgcccaggttaggaccaccgggatccataacggggccatcaccgacagttccttgcccacaaactcagtctccaatcggcagccccatggtgcgctgacgcgcgtgagcagcgtgagccagcctggcgtccggcctgcctgcgttgagaaactcttatccagcggggctttctccgccgggtgcatcccctgcggtacgagtaagatcctgggttctacagatactattctcttgggaagcaactgtattgctggatcggaatcgaatggaaatgtcccatatcttcagcagaacacccacacgctgccccacaaccacactgaccttaattccagcacagaggaaccttggcgcaagcagctgtccaatagcgctcaaggcctccataagtcccaaagtagctgcctcagcgggcccaacgaagaacagccccttttctcaaccgggtcagcccagtaccatcaggctacaagtacaggcattaaaaaagccaatgaacacctgacattgcctagtaactccgtgcctcagggcgatgccgattcccatctgagttgccacactgcaactagtgggggacagcaggggattatgtttactaaagagtccaaaccatctaagaatcgttctcttgtgcccgaaacgtctaggcataccggggacactagtaacggctgcgctgatgtcaagggactctccaaccacgtccaccagctgatcgctgatgcggtgagcagtcctaatcacggggatagtccaaatctgcttatcgcagataatccacagctttccgcattattgatcggaaaggccaatggaaacgttggtaccggtacttgtgataaagtgaacaatattcacccagcagtccacacaaaaactgatcattccgttgcaagctccccttcatctgccattagtaccgctacgccatctcccaaaagcacagagcagcgctcaattaactctgttacatcgctaaacagcccacattctggcctgcatactgttaacggagaaggattaggcaagtctcaatcttctacgaaggtggacctccctctcgctagccacaggtccacaagccagatcttaccctctatgagcgttagcatttgtccgagcagtacagaggtacttaaagcctgcaggaatccagggaagaatggactgtcaaactcctgcattctgctggataaatgtccaccaccccgtcctccaactagcccttacccaccgctcccaaaggacaaactgaaccctccaacacccagcatttacctggagaacaaacgcgacgctttcttccctcccctccaccagttttgtaccaacccaaaaaacccagtgactgtgattcgggggctggcgggagccttgaagctagatctgggcttattctcaacgaaaacgctggtggaggcaaacaacgaacacatggttgaggtgcgcacccagttgctccagccggccgatgaaaactgggatccaacaggcacgaagaagatctggcgatgtgagtccaataggtcccacacaaccatagcaaagtacgcccaataccaggcaagcagctttcaggagagcctgcgctag

SEQ ID NO: 139916 - DNA, 798 bp, Artificial Sequence
  Description of Artificial Sequence: Synthetic coding sequence
atgcccaacatggtcttcatcggtggtatcaattgcaagaaaaggaaggatctgtcacaagaattcgaggcgtacatcaacgcttccggagagcatgggatcgtggtgttcagcctgggatccatggttagcgaaattcccgaaaaaaaagcaatggccatcgcagacgcattaggaaaaataccccagacggtgttgtggaggtacactggtacaagacccagcaatctcgctaataataccatcctggttaagtggttaccacaaaacgaccttctagggcaccccatgactcgggccttcatcacacacgccggctcccatggcgtgtacgagtccatatgcaatggcgtacctatggtgatgatgcctctgttcggcgatcagatggataacgccaagagaatggaaaccaaaggggctggagtgacccttaatgtgctcgaaatgactagcgaggacctagaaaatgccctgaaagctgttattaatgacaagtcatacaaggaaaacattatgcgtctctcctcactgcacaaggacaggccggtggagcccctggatctggcggtattttgggtcgaattcgttatgaggcataagggcgccccgcacctccggcccgccgcccacgatctaacttggtaccaataccattccttggacgtcatcggcttcctgctcgctgtagtgctcactgtcgccttcatcaccttcaagtgctgtgcttacggctacaggaaatgcttggggaagaaaggtcgggtgaaaaaggcacataaaagtaagacgcactag

SEQ ID NO: 139917 - DNA, 1605 bp, Artificial Sequence
  Description of Artificial Sequence: Synthetic coding sequence
atggcaacagggcttcaggtccctcttccgcagctcgccaccgggcttctgttgttgctttctgtacaaccctgggctgagtctgggaaagttctcgtggtgccaactgatggttcgcattggctgagcatgagggaggctcttagggacctgcatgcccgaggtcatcaggtggtagtgcttactctcgaggtcaatatgtacattaaagaagaaaatttcttcacccttactacatatgccatctcttggacacaggatgaatttgataggttgctgctcgggcatacacagagctttttcgagactgagcaccttctgatgaaattctcccggaggatggctattatgaataacatgtccctcatcatccataggtcctgcgttgagcttctgcacaacgaagccttgatcagacacctccacgccacaagttttgacgtcgtactgacagacccattccatctttgcgcggccgtattggccaagtatctgagcattcccgctgtgttcttcctcaggaatataccatgcgatttagatttcaagggcacgcagtgtccgaacccttcctcttacatcccgcgcctactaaccacaaactctgatcacatgacgtttcttcagcgagtgaagaacatgctttatcctctggccctttcatacttatgccatgctgtctcagccccctatgcctctttggcgagtgaactcttccagcgcgaggtctcagtagtagatctggtatctcacgcctctgtctggctcttcagaggagacttcgtcatggattaccccagaccaataatgccgaacatggtctttattggaggtatcaactgcgccaacgggaaacccctgtcccaggagttcgaggcttacattaacgcctctggtgagcacggtatagttgtgttcagtcttggatctatggtgtctgagattcccgagaaaaaagctatggcgattgcagatgccctaggcaagataccacaaactgtgctgtggcgatacaccggcacacggccgagtaatctcgcaaacaacaccatcctcgtgaaatggctgcctcagaacgaccttctgggccaccccatgacccgcgcattcattacacatgccggctctcacggagtgtatgaaagtatttgtaacggcgttcccatggtcatgatgcccttgttcggcgaccaaatggacaacgctaagaggatggagaccaagggcgcaggtgtgacattaaatgtactcgagatgacttcagaagatttagagaacgccctcaaggcagtcattaatgataagagctacaaagaaaatatcatgcggttgagcagtttgcacaaggaccgccccgtggagccgctggacctcgcagttttctgggttgagttcgtcatgcggcacaagggagctcctcacttgagacctgccgctcacgacctgacgtggtaccaataccatagcctggatgtgatcggctttttacttgcagtcgttctgaccgtcgcttttattactttcaagtgctgtgcatatgggtaccgaaagtgcttaggaaaaaagggccgcgtgaaaaaggcccataagtctaaaacacactag

SEQ ID NO: 139918 - DNA, 1599 bp, Artificial Sequence
  Description of Artificial Sequence: Synthetic coding sequence
atggcctgtctgttaaggtctttccagcgcatcagcgcgggggtcttctttttagctctctgggggatggtcgtcggggataagctactggtggtgccccaggacggcagtcactggctcagcatgaaagacatagtggaagtgctctcagacaggggacacgagattgttgtggtcgtgcctgaggtgaatctgctgctcaaggagtccaagtactacacacgaaaaatctaccctgtgccttacgaccaggaggaattgaaaaatcggtaccagagtttcggcaataaccatttcgcggagcggtcatttctgaccgccccacagacagaatatcgcaacaacatgatcgtaatcggcctttatttcataaattgtcagagcctgctccaagatagagacactctcaacttcttcaaggaaagcaagtttgacgccttattcactgacccggccctcccttgcggtgtaatattggccgaatacctgggactacccagcgtttatctttttcgggggtttccctgctcactggaacacacattctcccgctcgccagaccccgtctcctatatcccacgatgttacacaaagttcagtgatcacatgaccttctctcagcgagtcgctaacttcctcgtcaacttacttgaaccttacctgttttattgcctcttttccaagtatgaggaactcgcttctgccgtgctcaagcgcgacgtggatatcataacgttgtaccagaaggtgtcagtatggcttttgcggtacgattttgtcctggagtaccctcgtcccgttatgcccaacatggtctttattggtgggattaactgtaagaaaaggaaagatctaagtcaggaattcgaagcatatatcaacgctagcggcgagcacgggatcgttgtcttcagcctcggcagcatggtgtctgaaatccctgagaagaaagctatggcaattgccgacgccctgggtaagatcccacagaccgtgctatggcgctataccgggacgcgccccagcaacctggcaaataatacaatcttggtgaaatggcttcctcagaacgatctcctggggcaccctatgaccagagcgtttattacgcatgccgggagtcacggtgtctacgagtctatttgtaacggggtcccaatggttatgatgccgctgttcggagatcaaatggacaatgcaaaaaggatggagaccaagggcgccggcgtcacactcaatgtgcttgaaatgacaagcgaagatctcgagaacgcactgaaggccgtgatcaacgataagagctacaaggagaacatcatgcgccttagttccctgcataaagatagacccgttgagccactcgacttggccgtattttgggttgagttcgtaatgcggcataagggggctcctcaccttaggccagctgcccacgatttaacctggtaccaatatcactcacttgatgtcattgggttcctgctagccgttgtcctgaccgtagcatttatcactttcaagtgttgtgcttacggttacagaaagtgtctcggcaagaaaggcagagttaaaaaggcgcacaagtcaaaaacacattag

SEQ ID NO: 139919 - DNA, 570 bp, Artificial Sequence
  Description of Artificial Sequence: Synthetic coding sequence
atggcgtgcctgctgaggagttttcaaaggataagcgccggggtgttctttctggctctgtggggtatggtcgttggcgacaagctgctggtggtgccccaggacgggtcacattggctatctatgaaagacattgttgaggtcctctcggaccgtggccacgagatagtcgttgttgtgcctgaagtgaatctgttgctcaaggagagcaagtattacacaagaaaaatctacccagtcccatatgaccaggaggaactgaagaatcgctatcagagttttggcaataatcatttcgccgagcggagcttcctcacagctccacaaaccgagtaccggaacaatatgattgtgattggcttgtattttattaactgccagtccctcctgcaagacagggatacactcaatttcttcaaggagtccaaattcgatgcacttttcaccgaccccgcgctcccgtgcggtgtgatcttggcggagtaccttggcctgccctctgtgtacctgttccgcggcttcccctgtagcctggagcacaccttctcccggtcacctgaccctgtttag

SEQ ID NO: 139920 - DNA, 1593 bp, Artificial Sequence
  Description of Artificial Sequence: Synthetic coding sequence
atggcccgagccgggtggactgggctgttacctctgtacgtgtgcctgctgttgacgtgtggtttcgccaaggccggcaagctgctcgttgtgcccatggatggatcccactggttcactatgcaaagcgttgtggagaaactcatcctgcgggggcacgaagtggtggtcgtaatgcccgaagtgtcttggcaattaggccgctctctcaattgcactgtcaagacctattctacttcgtacactctggaagaccaggatagggagttcatggtgttcgcagacgcacggtggaccgcaccgctccgatcagctttctctctgcttacaagctcttccaacgggatctttgatcttttctttagtaattgtcggtcacttttcaacgatcgaaagttggtggagtatctcaaggagagctgtttcgacgcagtttttttagaccccttcgacgcgtgtggacttattgtggcaaagtattttagcctcccatcagtggtgtttgccaggggtatcttttgccactacctggaggaaggtgcacagtgtcccgctcccctgtcatacgtgcctcggctgctgctcggcttctccgacgccatgacttttaaggagcgcgtgtggaaccatattatgcatcttgaggagcatttgttctgtccctacttctttaaaaatgtgctggagatcgcctctgagattctccagactccagtcactgcatacgatctgtactcgcacactagcatctggctgctgaggactgactttgttctggagtacccgaaacccgttatgccaaacatgattttcataggcggtattaactgtcaccaagggaagcctgtgcccatggagtttgaagcatacatcaatgctagcggcgaacatggcattgtggtgtttagtctgggaagcatggtctcagagatacctgagaaaaaagccatggcaatcgctgacgctctggggaaaattcctcaaactgtcctgtggcggtacaccggcacgcgcccctcaaacctggctaacaacaccatattagtcaagtggttacctcaaaatgacctgttggggcacccgatgacaagagcgttcataactcacgccggtagccatggcgtttatgaatccatttgcaacggagtccccatggttatgatgccattgttcggagatcagatggataacgctaaaagaatggagaccaagggggcgggtgtaacattaaatgtactggagatgacctccgaagacctggaaaatgcccttaaggctgtgatcaacgacaaatcctacaaggagaatattatgaggctttctagtctccacaaggatagacccgtcgagcccttagacctcgcagtcttctgggttgagtttgtcatgcggcacaagggggcccctcatctgagacccgctgcccatgatcttacttggtaccagtaccattctctggatgtgatcgggtttcttctggctgttgtcttgaccgtcgcctttatcacgttcaaatgttgcgcttacggttatcggaaatgcctgggaaagaaaggccgcgtgaagaaggctcacaagtccaaaactcattag

SEQ ID NO: 139921 - DNA, 1593 bp, Artificial Sequence
  Description of Artificial Sequence: Synthetic coding sequence
atggctcgaaccggttggacctcccctatcccactgtgtgtgtctcttttattaacctgcgggtttgccgaggccggaaaactgctggtggtgccgatggacggatcacattggtttaccatgcagtccgttgtggaaaaactcattctgcgcggccacgaggtggtagttgttatgcccgaggtgtcttggcagttagggaaatccttgaactgcactgtgaaaacttactctactagttatacacttgaagatttagatagggaatttatggattttgcagacgcacagtggaaggcacaggtcagatccctgttcagtctctttctcagtagctcaaatgggttctttaaccttttcttcagtcactgtcgctctctgtttaacgacagaaaactagtcgagtatctgaaggagtccagctttgacgccgtattcctcgatccatttgacgcctgtggacttatcgtggccaagtatttctctctgcccagcgtggtgttcgctcgcggaatcgcttgtcactacctggaggaaggggcccagtgccccgctccactctcctacgtgccgcggattctgctgggattttctgatgctatgacatttaaggaacgagttagaaatcacattatgcatctggaggaacacctgttctgccagtacttcagtaagaatgccctggagatcgcaagtgagatcctccagacacctgtgactgcctacgacttgtactctcataccagcatttggcttctgagaacagacttcgtgctggactatcccaagccagtcatgcccaatatgatcttcattggtggcatcaattgtcaccaaggcaaaccactgcccatggagttcgaggcttacattaacgcttcaggcgagcacggtattgtcgtattttcactgggaagtatggtcagtgagataccagagaagaaggccatggccatcgcagatgcactggggaagatacctcagacggtcctttggagatacaccggcaccaggcccagtaaccttgccaataatactatcctggtgaagtggctgcctcagaacgacctcctgggccatcccatgactcgtgctttcatcacccacgccgggagccacggcgtctatgagagtatctgcaatggggtccccatggtaatgatgccactctttggagaccaaatggacaatgcaaagcggatggagacgaaaggtgctggagtaaccctgaacgtgctggagatgacctccgaagatctggagaacgccctgaaggcggtaataaacgataaaagctacaaagaaaatatcatgcgcctgagttctttgcacaaggacagacccgtggagcctctggatctcgcagttttctgggttgaattcgtaatgcgccataagggtgccccccacttaagacccgctgctcacgatctcacatggtatcagtaccacagccttgacgtgattgggtttttgctggccgtggtgctcaccgtggccttcattacttttaagtgctgcgcttatggctatcgcaagtgcctaggaaaaaaaggacgggtgaaaaaagctcataagagcaagactcactag

SEQ ID NO: 139922 - DNA, 1593 bp, Artificial Sequence
  Description of Artificial Sequence: Synthetic coding sequence
atggcctgcacaggctggacaagcccactgccactgtgcgtgtgcttactgctgacgtgcggcttcgccgaagcaggcaaactcctcgtggtccctatggatggtagccattggtttaccatgcgctcggtcgtggagaaactcatcctgaggggccatgaggttgttgtggtgatgcctgaggtgtcttggcagctggggcgtagtctgaactgcacagtgaaaacctactcaactagctacactttggaagacctggatcgcgaattcaaagcctttgctcacgcccagtggaaagcccaggtacgctctatctactctttgctgatggggtcttacaatgatatattcgatcttttcttctcaaattgtcgaagcctgtttaaggataagaaactggtggaatatctcaaggaatcatctttcgacgcggtattcctggatcccttcgacaactgtggcttgattgtagccaaatatttcagcctaccaagtgtagtgttcgcccgcggtatcctgtgccattacttggaggagggagcccagtgcccagcccccctgtcttacgtccccagaatactactgggcttctctgatgcaatgacttttaaggagcgagttagaaaccacatcatgcaccttgaagaacatcttctgtgccaccgcttttttaagaacgcactcgaaattgcttctgagattctccagacacctgtgactgagtacgacctctactcccatacctcaatatggctgctcaggacagactttgtgctggactacccaaagcccgttatgccaaatatgatcttcatcggaggaatcaactgccaccagggtaagcccctgccaatggaattcgaggcgtatataaacgcatcgggtgagcacggtatcgtcgttttctctctgggcagcatggtgagcgaaataccagaaaagaaggctatggccattgccgacgccctgggcaaaatcccccagactgtgctctggcgctatacaggcaccagaccttccaatctagcaaataacacgatccttgtgaaatggctgccccagaacgatctcttgggccatcccatgacgagagcgttcatcacccatgctggcagtcatggggtttacgagagcatttgcaacggcgtgcccatggtgatgatgcctctgttcggggaccagatggacaacgcaaagcgcatggaaacaaagggcgcaggcgtcaccctcaacgtgctggagatgactagtgaggacctcgagaatgctctgaaggcagtgatcaatgataagtcatataaggaaaacataatgcgactcagctcccttcataaagacaggcccgtcgaacctctcgatttagctgtcttttgggtggaatttgtcatgagacataaaggggcccctcatctacgaccggcagcgcacgacctgacatggtatcagtatcacagccttgatgtgatcgggtttctgctcgccgttgtcctgactgtggctttcatcacattcaaatgttgtgcctatggctatcgcaagtgcctcgggaaaaagggccgggtgaaaaaggctcacaaatctaagacacactag

SEQ ID NO: 139923 - DNA, 1584 bp, Artificial Sequence
  Description of Artificial Sequence: Synthetic coding sequence
atgttgaataatctgttactgttctccctgcagattagtctgatcgggacaaccttaggcgggaacgttctcatctggccaatggaggggtcccactggctgaacgtcaaaattattatagatgagctcattaagaaagagcacaacgtaaccgtgctcgtggctagcggtgccctgttcattacgcctacttcaaatccatcgctaacattcgagatctatcgcgtgccatttggtaaagaacgcatcgagggagttatcaaggactttgtattaacttggctggaaaatcgccccagtccatccactatctggcggttttaccaagaaatggcaaaagtgatcaaggacttccacatggtgagtcaagagatctgcgatggggtgcttaaaaatcaacagctgatggccaaactgaagaagtctaaattcgaagttctggtcagcgatccggtgtttccatgtggggacattgttgcgttgaagctagggatcccatttatgtactctctgcggttttcccctgcttcaacagtggagaagcactgtgggaaggtcccttacccaccgtcatacgtgcccgccgttctctcagagctcaccgaccagatgtcgttcactgacaggatcagaaactttatctcatatcatctccaagattatatgttcgaaacattgtggaagagctgggactcatactacagcaaggccctgggagggttattgttgtgttgtcccgggtggagcgccgttgccgacttggggtcactgcaaccccttcttcctggctttaaacggttttcccgccttagccttcactgcagctgggattatcgcctgccagcgggccgccccacaacgctctgtgaaacaatgggaaaggcagaaatctggctaatccgaacttattgggattttgaattcccaagaccttatctcccgaacttcgaattcgtgggtggcctccattgcaaacctgctaagccgctgcctaaggtactctggaggtataaagggaagaagccggctacccttggcaacaacactcagcttttcgattggattccccagaatgatctgcttggtcacccgaagactaaagccttcattacacacggaggcacgaatggtatctacgaagcaatatatcatggcgtccctatggtaggagttcccatgttcgctgaccagccagacaacatagcccatatgaaggccaaaggcgcagccgtggaagtgaacctgaataccatgacaagcgtggatctgcttagcgccctaaggaccgtgattaatgagcctagttacaaggaaaacgctatgcgattgagcaggatccaccacgaccagccagtgaaacctctcgatcgcgcagttttttggatcgagttcgtaatgcggcacaagggtgcaaagcaccttcgcgtggccgcccacgacctcacctggttccaataccacagcctggacgtcatcggtttcctccttgtttgcgttacaacggcaatctttctagtcattcagtgttgcctgttctcatgccagaagtttggaaagattggaaagaagaagaaacgtgagtag

SEQ ID NO: 139924 - DNA, 2082 bp, Artificial Sequence
  Description of Artificial Sequence: Synthetic coding sequence
atgttgaataatctactccttttttcactgcaaatctcattaatagggacaaccttggggggaaatgtcctgatctggccaatggaagggtcacactggctcaatgtgaagataattatcgacgagttgatcaagaaggagcacaacgttactgtcctggtggcctcaggagctttgttcataactcctacttccaatccctctctcacttttgagatctatcgagtccccttcggtaaagaacggattgaaggagttatcaaggactttgtcctgacttggctggaaaatcgcccctccccttccaccatttggagattctatcaggaaatggccaaggtaattaaggactttcatatggttagtcaggaaatttgtgatggcgtcctgaaaaatcagcaattgatggccaagctgaagaagtctaaattcgaagtcctggtgagcgacccagtcttcccgtgtggagacatagtggccttgaagctgggcatcccgtttatgtattctctgcgtttctcgcctgcctccaccgttgagaagcactgtggcaaagtcccttatcccccttcttacgtgccggccgtgctcagtgaacttacagaccagatgtcattcaccgatagaatccgcaatttcatttcctaccatctgcaggattatatgttcgaaacactgtggaagtcgtgggactcctactatagcaaagctttggatgggtctcattggttgaacataaagataattctggaggaactgatacaacgtaaccataacgtgacggtcctggcctcgtcggccaccctgttcatcaattccaacccagattccccggttaacttcgaggtgattcctgtcagttacaaaaaaagcaacatcgactcattgatcgagcacatgataatgttatggattgatcaccgacctacgccgctcactatatgggcattttataaggaattgggcaagctcctggacactttctttcagattaatatccagctgtgcgatggagttctgaagaatcccaagttgatggccaggttacagaagggaggttttgacgtgcttgtggctgatcccgtgaccatctgcggggatctggttgctttgaagcttggtataccgttcatgtatacactcagattctccccggccagcaccgtggaaagacactgcgggaaaattccagcccccgttagctacgtccctgcagccctcagcgagctgacagatcagatgaccttcggagagaggatcaagaatacaatctcttacagccttcaggactatattttccagtcctattggggcgagtggaacagctactatagtaaaattcttggccggcccacgacactgtgcgagacaatgggcaaggctgaaatttggctcatccgaacctactgggacttcgaattcccacgtccttatctgccgaattttgaattcgttggaggtctccattgtaaaccagccaagccactcccaaaagtcctctggagatacaaaggcaaaaaaccagccactctgggaaacaacacccaactattcgattggatccctcaaaacgatttgctgggccacccaaaaacaaaagctttcattacccacggaggcacaaatggcatctacgaggcaatctaccatggcgtgcccatggtaggcgtgccgatgttcgcggaccaaccggataacatcgcacacatgaaagcgaaaggtgccgcagtggaggttaatttgaataccatgacttcggtggatctactctcagcactgcgcaccgtgataaacgaaccatcttacaaggagaacgctatgaggttgtcacgcatacatcacgatcaacctgtcaaaccattggaccgcgccgttttttggatcgagttcgtgatgcgtcacaaaggtgctaaacacttaagagtggccgcacatgatctaacttggttccagtaccattctctggacgtcatcggctttctgctggtgtgtgtcacgaccgcaatttttctagtgatccagtgctgcctgttttcatgccaaaagttcggcaaaatagggaaaaagaaaaagagggagtag

SEQ ID NO: 139925 - DNA, 1611 bp, Artificial Sequence
  Description of Artificial Sequence: Synthetic coding sequence
atggtatcaattcgggacttcaccatgcccaagaaattcgtccaaatgctagttttcaacctgacgctcactgaggttgtgctaagtggaaatgtgttgatctggcctacagatggaagtcactggttgaatatcaagattatattggaagagctgattcagagaaatcacaacgtgactgtgctggctagttctgcaacgctttttataaattcaaacccagatagcccagtgaattttgaggtcattccagtatcttataaaaagtctaatatagattccttgatagaacacatgattatgctatggatagatcatcgtcccaccccactgactatttgggctttttacaaggagctggggaaactgcttgataccttcttccagatcaacattcaactctgtgatggcgttttaaaaaatcccaagcttatggcaaggctgcaaaaagggggctttgatgtgttagtggctgaccctgttacaatttgcggcgacctggtggctcttaagttaggtattccttttatgtatacccttaggttctctcctgcaagcaccgttgaacgccactgcggaaagattccggcccctgtctcttatgtcccagctgcactgtccgaactaacggatcagatgacatttggagaacggattaaaaacaccataagttactccctccaggactacatattccaaagctattggggagagtggaatagttattatagtaagatcctgggccgaccaaccacattgtgtgaaacgatgggtaaggccgaaatctggctgattcgtacttactgggatttcgagttcccaagaccctacctgcctaatttcgaattcgtcggaggcctgcactgtaagcccgctaaaccattgcctaaggaaatggaagaatttattcagagtagcggcaagaatggcgttgtcgtgttttcccttggctcaatggtgaagaatcttaccgaggagaaagccaaccttattgcatctgccctcgcccagattccccaaaaagtgttgtggcggtacaaaggcaagaaacccgccacattgggaaataacacacaattgttcgactggatcccccagaatgatctgctgggccaccctaaaaccaaggccttcattactcacggagggacaaacgggatctacgaagctatttatcacggggtccccatggtaggcgtccctatgtttgcagatcaacctgacaacatagctcatatgaaggcaaagggggcggcagtcgaggttaatctgaacaccatgaccagtgtcgacctgctctccgctcttagaaccgtgatcaatgaacctagttacaaggaaaatgcgatgcggctgagtaggatacatcatgatcaaccggtgaagccactggatagagcagttttctggattgaattcgtgatgaggcataagggagcaaaacatttgcgtgtggcggcccacgatttaacatggtttcagtaccatagcctggatgtaatcgggtttctcctggtgtgcgtgactaccgccatctttctggtcatacaatgctgtctatttagctgccagaagttcggcaagataggaaagaaaaaaaaaagggagtag

SEQ ID NO: 139926 - DNA, 1584 bp, Artificial Sequence
  Description of Artificial Sequence: Synthetic coding sequence
atgctgaataatctgcttcttttctctctgcagatatccttgatcggtaccaccctgggcgggaacgtactgatctggcccatggagggatcacactggctgaatgtgaaaatcattattgatgaactcattaaaaaagaacacaatgtcactgttctggttgcatctggggccctttttattactcctacgagcaaccccagtttgactttcgaaatataccgcgtacctttcggcaaggaacggatagaaggcgttattaaggatttcgtgttgacctggctggagaacagaccaagtccgtctaccatctggcgtttctaccaggagatggcaaaggtgataaaggactttcatatggttagccaggagatttgtgatggagtgctgaagaaccagcagttgatggccaagcttaaaaagagtaagttcgaggtgctggttagcgatccagtttttccttgtggtgatatcgtcgcgttgaaactggggatccccttcatgtatagccttagattctcgccagctagcactgtggagaagcactgcggcaaggtgccatatcctccttcctatgtgccagcagttttgagcgagctgaccgaccagatgtctttcaccgaccgaattaggaatttcatttcctaccatctccaggactacatgtttgagactctgtggaaatcctgggatagttattacagtaaagcattggggcgcccgacgaccctctgcgaaactatggggaaagctgagatttggctgatccgcacctattgggattttgaattcccaagaccttacctaccaaactttgaattcgtgggcggactccattgcaaaccagcgaagcctttgcccaaagagatggaagagtttatccaaagcagcgggaagaatggcgtggtagtcttttctcttggatccatggtgaagaatctgactgaagagaaagccaaccttatcgcttccgccctggctcaaatccctcaaaaggtgttatggcgctacaagggtaaaaagcctgccacactgggaaacaacacacagctgtttgactggatcccacaaaatgatttgctggggcatcctaaaaccaaagctttcatcacacacgggggcaccaatggcatttacgaagctatataccatggtgtccccatggtgggggtcccgatgtttgctgatcagcctgataatattgctcacatgaaagccaaaggagcagcagtggaagttaacctgaatactatgacgtccgtggacctgttgagcgcattgagaactgtgatcaacgagcccagctacaaggaaaacgccatgcggctgtcccgcatccaccacgaccagccggtgaaaccattagacagggccgtgttctggatcgagttcgtaatgcggcacaaaggggcgaagcacctgagagtggcagctcatgatctcacttggtttcagtatcactctctcgatgtgataggtttcttgctcgtttgcgtgactacggccatttttctagtgatccagtgttgtctcttttcttgccagaagttcgggaagattggaaagaagaagaaacgcgaatag

SEQ ID NO: 139927 - DNA, 477 bp, Artificial Sequence
  Description of Artificial Sequence: Synthetic coding sequence
atgttgaacaatctcctgctgttctccctgcagatcagcctgattggcaccacactgggtggaaacgtgctgatttggccaatggagggttcccactggctgaatgtgaaaataattatcgacgaactcatcaaaaaggagcacaatgtgaccgttctggtggcatccggcgctcttttcatcacacccacatcaaatccctcactcacattcgagatctaccgagtccctttcggtaaggagagaatagagggggttatcaaggactttgtgttgacctggctggaaaaccgcccaagtcctagtactatttggcggttctaccaagagatggcgaaggtgattaaggattttcacatggtctctcaagagatttgcgacggagtcctgaaaaaccagcaacttatggcaaaactgaagaagtctaagtttgaggttcttgtgagcgaccctgttttcccttgcggagatatttag

SEQ ID NO: 139928 - DNA, 1590 bp, Artificial Sequence
  Description of Artificial Sequence: Synthetic coding sequence
atgactcttaagtggaccagcgtattgctcctgatccacctgagttgttatttctcatcggggagctgcggaaaagtcctcgtttgggcagccgaatatagccactggatgaacatgaagacaattctcaaggaattagttcagaggggtcacgaagttacggtgctggcctcttccgctagtatcctgttcgaccccaacgatgcgtcaacgctcaagtttgaagtctacccaactagtctcactaagaccgagttcgagaatatcatcatgcagcaggtcaaacgctggagcgatatccgtaaggattctttttggctctacttctcacaggagcaagagatcctttgggagttgtacgacattttcagaaacttctgcaaagacgtggtctccaacaaaaaggtgatgaagaagctccaggagagtcgtttcgatatagtgttcgccgacgccgtgtttccctgcggggagctgctcgctgccctcctgaatattcggtttgtgtattcactacgtttcacacccggctacaccatagagcggcactcaggcgggctgatttttccgccctcatacattcctattgtgatgagtaagttatctgatcagatgacattcatggagcgggtgaagaacatgatctatgtcctctactttgatttctggttccagatgtccgatatgaagaagtgggaccagttctattcggaagttttaggacgacccacaactctttttgaaaccatgggtaaagccgacatctggctgatgcggaacagctggagtttccagttcccgcacccctttctccctaatgtagatttcgttggcggtttccattgtaagcctgctaagcctctgcctaaagaaatggaggaatttgtgcaaagctcaggagagaacggggttgtcgtgttctcactgggatcagtgatttctaacatgactgcagaaagagccaacgtcatcgcaaccgccctggctaaaatccctcagaaagttctttggcggttcgacgggaataaacccgatgcactgggcctaaatacccgcctttataagtggattcctcagaacgatctgctgggccacccaaagacccgcgcctttattacccacgggggcgctaatgggatatacgaggctatctatcatgggattccgatggttggaatacccctgttcttcgaccagccagataacatcgcccatatgaaggcaaagggagccgccgtgcggttagacttcaatacaatgtcatccacagacctgctgaacgcacttaagaccgtgatcaatgatccgctgtacaaggaaaacattatgaaactgtcaaggattcagcatgaccaacccgtaaagccactggaccgggccgtcttttggattgagtttgtgatgccccacaagggggccaaacacttgcgtgtcgcagcccacgacttaacctggttccagtaccattcgctggacgtgatcgggtttctgttagcgtgcgtcgctacagtgatatttataatcactaagttctgccttttttgcttttggaaatttgctcgtaaaggaaaaaagggcaagcgggactag

SEQ ID NO: 139929 - DNA, 1593 bp, Artificial Sequence
  Description of Artificial Sequence: Synthetic coding sequence
atgtcactgaagtggaccagtgtgtttctgcttatccagctttcctgctatttctcgtctggatcttgtggcaaagtgttggtgtggccaaccgagtactcgcactggatcaatatgaaaaccattttggaggagctggttcagcgtgggcatgaagtcacagttttaacaagctccgcctcaactttggtgaatgcctctaaatcatccgccatcaaactcgaagtgtatcctacctccctcacaaagaattacctggaggattcactgctcaagatcctcgatcggtggatctacggtgttagtaaaaataccttttggagttacttctctcagctgcaggagctgtgctgggagtattatgattacagcaacaaactgtgtaaggatgcagtgctcaacaaaaagctgatgatgaagctgcaagagtcgaagtttgacgtgatactggcagacgcccttaatccttgtggggaactgttggccgagctgtttaacatcccctttctgtattcgctccgcttttcagtgggctacacgtttgagaaaaatggtggaggattcctgttccctccgtcttacgtgcccgttgttatgagcgaactgtccgatcaaatgattttcatggagaggattaaaaatatgatacatatgctctactttgatttttggttccagatctatgacctcaaaaaatgggatcaattctatagtgaggtgctgggccgcccaacgaccctattcgagacaatgggaaaggcagaaatgtggctgatcagaacctattgggatttcgagtttccaagacctttcctccccaatgtcgactttgtcggcggcttgcattgcaagccggcaaagcccttgcctaaagagatggaagaattcgtgcagtcgtcaggggagaatggaatcgtggtattttctctgggctcgatgatttcgaacatgtccgaggagtctgcaaatatgatagcctcagcactcgcccaaataccccagaaggtgttatggcgattcgatggcaaaaagccgaacaccctcggctccaatactagactctacaaatggctgccacaaaatgacttactgggccatcccaagacaaaggccttcatcacccacggaggcaccaacggaatctatgaagccatctatcatggcattcccatggtggggatccctctctttgccgaccagcacgacaatatcgcccacatgaaagcaaaaggggctgcactcagcgtggacatccgaacaatgtcatcacgggatcttctgaacgcactgaagagtgttattaatgacccagtttataaagagaacgtgatgaaactgtcccgtatccaccatgatcagcctatgaagccacttgatagggctgtgttctggatagagtttgttatgcgccacaagggggcgaagcacttgagagtggccgcacacaacctgacctggatccagtatcactcactggatgtcatagcctttctgctcgcttgtgtggcgacagtgattttcataattactaagttctgccttttctgcttccgaaaactcgccaaaaagggcaaaaagaagaagcgagactag

SEQ ID NO: 139930 - DNA, 1593 bp, Artificial Sequence
  Description of Artificial Sequence: Synthetic coding sequence
atgtcccttaaatggatgagcgtattcctattaatgcagctctcctgttacttcagttcaggctcgtgcgggaaagtactagtgtggccaacagagtatagccactggataaacatgaagactatcttagaggaactagttcagagaggccacgaagtgatcgttttgaccagctctgcctccattttggtcaacgcttcaaaatctagcgccattaagctggaagtttatcctacaagcctaactaaaaacgacctggaggatttcttcatgaagatgttcgatcgatggacttacagcatttctaagaacactttctggtcctatttcagccagctccaggaactttgttgggaatacagcgactataacatcaaactgtgcgaagatgcagtgctgaataagaagctgatgcggaagttgcaagagtctaagtttgacgtgctgctcgcggacgctgtgaatccttgcggagagctgcttgccgagctgctgaatatccctttcctgtactctcttagattcagcgtcggatataccgtcgaaaaaaacggggggggatttctgtttcctcctagttacgtgccagtggtaatgagcgagttatctgaccagatgatttttatggagcgcatcaaaaacatgatttacatgctgtacttcgatttctggtttcaggcctacgatctaaaaaagtgggaccagttctactccgaagtgctaggtagacccacaacattgttcgaaaccatggggaaggctgaaatgtggctgattcggacctactgggattttgaattcccaaggccgttcttgcccaatgtagactttgtaggcggcctgcactgtaagcctgctaagcctctgcctaaagaaatggaagaattcgtccagtcctctggcgaaaatgggattgtggtttttagtctgggttctatgatttccaacatgtcagaagaaagtgcaaatatgatcgcctcagctctcgcccagatcccccagaaagtcctatggcgcttcgacggtaaaaaacccaacacactcggctctaacaccagactatacaaatggctgcctcaaaacgacctactcggccatcccaagaccaaggccttcatcacacatggcggaacgaacgggatctacgaagccatttatcatggtatacctatggttgggatccccctgtttgctgatcagcacgataacatcgctcatatgaaggcaaagggcgctgctctgtcagtggacattcggaccatgtcatcaagagatttgctgaacgccctgaagagcgttatcaatgatcccatttataaagaaaatatcatgaagctaagcagaatccaccacgaccagcccgtgaaaccactggaccgggctgtgttctggattgagttcgttatgagacacaagggcgccaagcacctcagggttgccgcgcacaaccttacctggattcaataccattcactggacgtgattgcctttctcctggcgtgtgtggcaacgatgatatttatgatcacaaagtgctgtctgttctgctttcggaaactcgccaaaaccgggaaaaagaagaaacgggattag

SEQ ID NO: 139931 - DNA, 1590 bp, Artificial Sequence
  Description of Artificial Sequence: Synthetic coding sequence
atggctctgaaatggacgtccgtgcttctcttaattcaccttgggtgttatttctcctccggttcatgcggaaaggtcctggtttggaccggcgaatatagccattggatgaatatgaagaccatcctgaaggaactcgtccagaggggtcacgaagtcaccgtgttagcatccagtgctagtattctgttcgatccaaatgatgcctttacccttaaactggaagtctaccctacatcgctgacaaagaccgaattcgagaacataataatgcagcaggtcaagaggtggtcagacattcagaaagactccttttggctctacttttctcaggagcaggagattctgtgggagtttcacgatatcttccggaacttctgcaaagacgttgtaagcaacaaaaaagtaatgaaaaagctgcaagagagcagatttgacatcatttttgctgacgcattctttccatgtggggaactgttagcggccttgttgaacataccctttgtctacagcttgtgcttcaccccggggtatactattgaaaggcacagtggcgggttgatttttcccccgtcctacatccccgtggtgatgagtaagcttagcgatcagatgacattcatggaaagggtgaagaacatgatttatgttctttatttcgatttctggttccagatgtgtgatatgaaaaagtgggaccagttctactctgaggtcctcggccggcccacgactcttttcgaaaccatgggaaaagccgacatctggctaatgaggaatagttggagctttcagtttccacatccgtttttgcccaatattgattttgtgggaggcctacactgcaaacctgcaaagccgctgccgaaagagatggaggaattcgttcagtcttccggcgaaaatggggtcgtagttttctccctggggtcagtcatttcaaacatgaccgccgaaagggctaacgtgattgctaccgctctcgccaagatcccacagaaagtgctgtggcgatttgacggcaataaacctgacgcactcgggctgaacactcggctgtacaaatggatcccccagaatgatctcctgggactcccgaaaactagagccttcattactcacggcggcgccaatggtatttacgaagcaatttaccatggcattcccatggtgggcattcctctgttctgggaccagcccgataacattgcccacatgaaagcgaagggggctgcagtgagactggatttccataccatgtcaagcactgatttactgaatgctttaaagactgtgattaacgacccctcatacaaagaaaacgtgatgaagctgagcattattcagcacgaccagcccgtgaaaccactgcatagagcggtgttttggatcgaatttgttatgtgtcacaagggcgcaaaacacctgagagtcgcagcaagagatctgacgtggtttcagtatcacagtttagatgtgatcgggttcctgctggcctgcgtggcgacagtgatcttcgtggtgactaaattctgcctgttttgcttttggaaatttgcccggaagggtaaaaagggcaagcgggactag

SEQ ID NO: 139932 - DNA, 1008 bp, Artificial Sequence
  Description of Artificial Sequence: Synthetic coding sequence
atggctctgaagtggactagcgtcctgctgctcattcatttggggtgttacttttccagcggctcctgcgggaaggtgctagtgtggacaggagagtactcacactggatgaacatgaagactatcctgaaagagctggtgcagcgcggtcatgaagtcacagtgctggcctcctccgcttctatactcttcgatcctaatgacgcattcacactcaaactggaggtttatcccacaagtctgaccaaaaccgagttcgaaaacatcattatgcagcaggtgaagaggtggtctgatatccagaaggattcattctggctatatttcagtcaggaacaggaaatcctttgggagttccacgatatcttcagaaacttctgtaaagatgtcgtgtctaacaagaaagtgatgaaaaagcttcaggagagcaggttcgacattattttcgctgacgctttctttccctgtggggagttactcgctgcactgctgaatattccatttgtatactctttatgcttcacccctgggtataccattgagagacattcaggggggctcatattcccacctagctacattccagtagtgatgtcaaagttgtcggaccagatgaccttcatggagcgagttaagaatatgatctacgttctctattttgacttctggttccaaatgtgcgacatgaagaaatgggatcaattctattcagaggtgctgggccggcccactaccttatttgaaactatgggcaaagcggacatctggctgatgcgcaatagttggagcttccaatttccgcaccccttcctccctaatattgattttgtcggtggcctgcactgtaaacctgctaagcctcttcctaaagagatggaggaatttgtccagtccagtggtgaaaacggggtcgtagtgttttctctgggctccgttatctccaacatgaccgctgagagggccaacgtgattgccactgctctggcgaagatcccacaaaaaatttag

SEQ ID NO: 139933 - DNA, 1587 bp, Artificial Sequence
  Description of Artificial Sequence: Synthetic coding sequence
atgtctatgaagtggacttccgccctcttactgattcagctcagctgttatttctcctcaggcagctgtggaaaggtattggtgtggcccacagagttttctcactggatgaatatcaaaacaatcctggatgaactggtgcagaggggtcacgaagttaccgtgctcgcctccagtgccagtatttcttttgatccaaacagtccaagcaccttgaaatttgaagtgtatcccgtctccttgaccaagacggaatttgaagatattattaaacagcttgtgaagcgatgggccgaactcccaaaggatactttctggtcctatttcagtcaggtgcaagaaattatgtggacattcaatgacatcttgaggaaattttgtaaagacattgtgtctaacaagaagcttatgaagaaactgcaagagtctcgcttcgacgtggtactggctgacgctgtgtttcccttcggggaacttctagccgagctattaaaaatcccttttgtctattccctcaggttttcccctggctatgcaatcgaaaagcactcagggggtctgctgttcccgccatcctacgtcccggttgttatgagcgaactcagtgatcagatgacattcattgagcgggttaagaatatgatctacgtgctgtactttgagttctggttccaaatatttgacatgaagaagtgggaccagttctacagcgaagtcttgggacgtcctacaaccttgtctgagactatggccaaagcggatatttggctgatccgaaactactgggatttccagttcccacacccgttattgcccaacgtcgaattcgtgggtggcctacactgcaaacctgctaaaccgctccccaaggaaatggaggagttcgtacagagtagcggcgaaaatggcgttgtcgtcttctctctcgggtctatggtatctaacacctcagaggagcgcgccaacgtgatcgcctccgcactagccaagatcccgcagaaggtgctgtggaggttcgacggcaacaagcccgacactctgggcttgaatacgagactgtacaagtggattccccagaatgacttattagggcatccaaaaacccgcgcgttcattacacacggaggggctaacggcatatacgaagcaatctaccatggcattcccatggttggcgtgcctctgtttgcagatcagcctgacaacatcgctcacatgaaggcaaagggcgcagccgtgagcttagattttcacaccatgagttccaccgacttactcaatgccctgaagaccgtcattaacgaccccctgtataaagagaatgctatgaagctgagtaggatacaccacgatcagccagttaaaccactcgacagggctgtcttttggatagagtttgtgatgagacacaaaggtgccaagcacttgcgggtcgcggcccatgacctgacctggttccaatatcatagcctggatgttacgggattcttactggcatgcgtcgccaccgtgatttttatcattactaagtgcctgttttgcgtgtggaagtttgtgagaacgggcaagaaaggaaaacgggactag

SEQ ID NO: 139934 - DNA, 1179 bp, Artificial Sequence
  Description of Artificial Sequence: Synthetic coding sequence
atgttcttcgcactgctgcatgtgtctagtaccaatggcctggacgcggtgttccctttcggcgaactcttggcggaactgttaaagatcccattcgtttactcactgcgcttcagccctggttatgctatcgaaaaacactcaggcggacttctattccctccgagctatgtcccggtcgttatgagtgagttgagcgatcagatgacctttatagaaagggtgaagaatatgatatatgttttgtatttcgaattttggttccagatcttcgacatgaagaagtgggaccagttctatagcgaggtgctgggaagacctactacgctatctgaaactatggccaaagcagatatttggttaatcaggaactactgggatttccaatttccgcaccctctgctgcccaacgttgagttcgtcggagggctgcattgcaagcccgctaaacctctcccaaaagagatggaggaattcgtgcaatcatcaggtgagaatggagtggtggtattttctctgggttcaatggtctcaaatacatcagaagagcgtgctaatgtgatcgcaagcgctcttgcaaaaatcccccagaaggtgctctggcggttcgatgggaacaagcctgatacactaggactgaacacccgactatacaaatggattcctcagaatgacctgctagggcacccaaagacaagagctttcattactcacggcggtgctaacgggatttacgaagccatctatcacggcatccccatggtgggtgtccctctgttcgccgatcagcccgataacatagctcatatgaaggcaaagggcgctgcagtcagccttgattttcatactatgagttcaactgacttattaaatgcactgaagaccgtgattaacgaccctttatacaaggagaacgcaatgaagttgagcagaatccatcatgatcagccagtgaagcccctcgacagagctgtgttttggatcgagttcgtcatgcggcacaaaggagctaagcaccttcgagtggccgctcatgacttgacttggtttcaatatcattccttagatgtgacagggtttctccttgcctgcgtggctaccgtgatcttcataattacaaagtgtctcttctgtgtatggaagtttgtgagaactggaaaaaagggcaagagagattag

SEQ ID NO: 139935 - DNA, 165 bp, Artificial Sequence
  Description of Artificial Sequence: Synthetic coding sequence
atgtccatgaaatggacatcagcgcttctactgatacaactgagctgctatttttccagcgggtcctgcgggaaagtgctcgtgtggcctacagagttttctcattggatgaatattaaaacaatcctggatgaattagtgcaacggggacatgaagttacctag

SEQ ID NO: 139936 - DNA, 1590 bp, Artificial Sequence
  Description of Artificial Sequence: Synthetic coding sequence
atgagtgtgaagtggaccagcgtaattcttctgattcaactgtcattttgcttcagttctgggaactgcggcaaagtacttgtctgggcagcagaatattcccattggatgaatattaaaacgatattggacgaactgatccagagagggcacgaggtgacagtactcgctagttcggcctccattctctttgacccgaacaattcatccgcactgaaaatagaaatctaccccacttctctcaccaagactgagctcgaaaatttcatcatgcagcagataaagaggtggtccgacctgccaaaagataccttttggctatacttctcgcaggtacaagaaataatgtctatctttggggatataaccagaaagttctgcaaagatgtggtatccaacaagaagttcatgaagaaggtgcaagagtcacggttcgatgttatcttcgccgacgctatattcccctgttcagaactcctggcagaattgtttaacattccatttgtgtactctttgagtttcagtccaggctacacctttgagaaacatagtggcggatttatcttccctccctcctacgttcccgtggttatgtctgagttaaccgatcagatgacgttcatggaacgggtcaagaatatgatttatgtcttgtatttcgacttttggtttgagattttcgatatgaagaagtgggatcagttttactcagaagtgctcggccgtcccacaaccctgtcagaaaccatgggcaaggccgacgtatggttgattcggaatagttggaatttccagttcccttatcctctgttgccaaatgtggatttcgtagggggcctgcattgtaaacctgcaaaaccattgccaaaggagatggaagacttcgtgcaaagctcaggggaaaacggggttgtggtgttttccttaggctctatggtgagtaatatgacggaggaaagagccaatgtgatcgcctccgcactggcacaaatcccccagaaggtgctgtggaggttcgacgggaataagccagatacgctgggacttaacaccagactttataaatggatcccacagaacgacctcctgggtcatcccaagacgcgggccttcattacgcacggtggggccaacggaatctatgaagccatctatcacggaatcccaatggtcggcataccattattcgccgatcagcccgataatattgcgcatatgaaggcgcgcggggcagctgtgcgagtggacttcaatactatgagtagcacagacctgcttaatgccctcaagagagtgatcaatgaccccagctacaaagagaatgtgatgaagctgtctcggattcagcacgaccagccagtcaaaccactggatcgcgctgtcttctggatagagtttgtgatgaggcacaaaggtgctaaacacctgagggtagctgctcacgatctgacatggtttcagtaccattctttggacgtaatcggctttctgctggtgtgtgtggctaccgtgatctttatcgtgacaaagtgttgtctgttttgcttttggaaatttgcgcggaaagctaagaagggtaagaatgactag

SEQ ID NO: 139937 - DNA, 1269 bp, Artificial Sequence
  Description of Artificial Sequence: Synthetic coding sequence
atgctccagtggcgaaggcgccactgttgctttgccaagatgacttggaatgctaagagaagcctctttcggacacatctgatcggggtcctgagtctcgtgttcttgtttgccatgttccttttttttaatcaccacgattggctccctggacgggcggggtttaaggaaaatccagtgacctacactttccggggtttccggagcactaaatccgagacgaaccattcctccttgcgcaacatatggaaggagacagtgccgcagaccctgcgccctcagacagcaaccaacagtaataacaccgatctttcgccccaaggagtgactggactcgagaacaccttgtccgccaacggaagcatctataacgaaaaaggaacgggccaccccaattcctatcactttaaatacatcattaatgagcctgagaagtgtcaggagaagtcacctttcttaatcctgcttatcgccgcagagcccggacaaattgaggcccggcgtgcaatcaggcagacctggggaaatgagtccctagctcccggaatacaaattaccagaattttccttctcggtctgtcgataaagctcaacgggtatctccagcgtgcaatactggaagagtcacgtcagtaccacgatattatccagcaggaatatcttgacacctattacaacctgacaatcaaaaccttgatggggatgaactgggttgccacttattgtccacatattccttatgtcatgaagacagacagtgatatgttcgtcaacaccgagtatttgatcaataagttgctgaagccagatttgccccccaggcataactattttacggggtacctaatgcgaggctatgcccctaatcgcaacaaggattccaaatggtacatgccaccggacttgtatccttcagaaaggtatccagttttttgtagtgggactggttacgtcttttctggtgatctagcagagaagatattcaaggtgagcctcggaattcgacgacttcacctcgaggacgtatacgtgggaatttgtctcgccaagctccgcatcgaccctgtccctccccccaatgaatttgtgttcaaccactggagggtcagttacagctcttgtaagtactctcacctgatcacgtcccaccagtttcagccctccgagctaataaagtactggaatcacctgcagcaaaacaagcacaacgcatgtgccaacgccgcaaaggaaaaggcgggtagatatagacacaggaagctgcactag

SEQ ID NO: 139938 - DNA, 1137 bp, Artificial Sequence
  Description of Artificial Sequence: Synthetic coding sequence
atgcagctgcgcttattccggcgactgctcctggcagccctattattggtgattgtctggactttattcggccccagcggcctcggcgaagaactgctgtctctgagcctggctagtctgctccccgcccctgcaagtccaggcccacccctggctctgcccaggttgctgatacccaaccaggaagcttgttcaggccccggtgcccccccgtttctgttgatcctggtatgtactgcacccgagaacctcaatcagaggaacgctattagggcgagctggggaggtttgagggaggctaggggtctgcgagtccaaaccctgttccttctcggcgagcccaatgcacaacatcctgtgtggggtagccagggttccgatttggccagtgagagtgcagcccagggcgacatccttcaagcggcctttcaagactcctaccgcaatttgaccttgaagaccctgtccggacttaactgggccgaaaagcactgtccaatggctcgctacgtgctgaagaccgacgatgacgtgtatgtgaatgtgcctgaattagtcagcgaactggtgctgagaggcggaagatggggccagtgggaaagaagcaccgagccccaacgagaggcagaacaggagggcggccaggtgctgcactcagaagaagtaccacttctgtacctagggagggtgcactggagagtaaatcctagccgcactcctggtggcagacaccgcgtgagcgaagagcagtggccacatacttggggaccttttcccccttacgcttcaggcactggttacgtgctgagtgcctccgcagttcagcttatactcaaagtcgccagccgcgccccacttcttccactcgaagatgtgttcgtaggggtaagtgcccggcgcgggggccttgcacccacacagtgcgtgaagcttgccggagccacccactatcctctggatcggtgctgttacgggaaattcttgctcacaagtcatcgcctggatccttggaagatgcaagaagcgtggaagcttgttggcgggtctgatggagaacgaaccgcacctttttgctcttggttccagggggtgctcggaatcctgcgttgccgcgctattgcatggttgcagtcctag

SEQ ID NO: 139939 - DNA, 1137 bp, Artificial Sequence
  Description of Artificial Sequence: Synthetic coding sequence
atgcagttaaggcttttcaggaggttattacttgcggcacttttactcgtgatcgtgtggactctattcggcccatctgggctgggagaagaacttctgtccctaagtctggctagcctgctcccggccccagcctctccaggcccccctttggctctgccccgacttctcatccctaatcaagaagcttgctccggccctggggcccctcctttcctcctaatcctcgtgtgcaccgccccggaaaacttaaaccaacggaacgcgatccgcgcaagctggggcgggctgagagaggcacgaggcctgcgggtgcagacactgtttctccttggggaacccaacgcccaacaccctgtctgggggtctcaaggtagcgacctcgcctcagagagtgctgctcagggagatattcttcaagcagccttccaagacagctacagaaacctcacattaaaaaccctgtcagggttaaactgggccgagaaacactgtcctatggcccgctatgtcctaaaaacggacgatgacgtttacgtcaatgtcccagagttggtcagtgagctcgtgctgcgcggaggtcggtggggacaatgggagcgcagcacagaaccccagagagaagcagagcaggagggaggacaggtcctgcatagcgaggaggtccctctcctctacctaggacgggtgcactggcgggtgaatccgtctaggactcctgggggccgtcatcgcgtcagcgaggaacagtggcctcacacctggggaccctttcctccctacgccagtggaaccgggtatgtgcttagtgccagcgccgtgcaattgattcttaaggtcgctagtcgcgccccactgctccctcttgaggacgtgttcgtaggggtgagcgctagacgcggaggcctggccccgacccagtgtgtgaaactcgccggagccactcactaccctctggacagatgctgctatggtaagttcctcttaacctcacatcgcttggacccttggaaaatgcaggaggcttggaagctggttggagggtccgatggggaacgtacagctcctttttgctcttggtttcagggcgtgctcggaattctgcgctgtcgggcaatcgcatggctgcagagttag

SEQ ID NO: 139940 - DNA, 1137 bp, Artificial Sequence
  Description of Artificial Sequence: Synthetic coding sequence
atgcagttgcggttattccgtcggctgctgctggctgcgcttcttttagtgatagtgtggactctgttcggcccttcggggctgggcgaggaactcctgagcttatcactcgctagcttacttccagctccagcaagccccgggcctccactggcactgcctcgcctgctcatacccaaccaggaggcatgtagtggccctggagcccctcccttcctcctgatactggtgtgtaccgccccggaaaacctcaaccagaggaatgctatcagggcttcatggggtgggctccgggaggctcgcgggctacgtgtgcaaaccttattcttacttggggagcctaatgcacagcatccagtatgggggagccagggttctgatctcgcttcggaatcagctgctcagggggacattttacaggccgcttttcaggatagttatcggaacctcacgttgaaaacactttctggcttaaactgggccgaaaaacactgtccaatggccaggtatgtgttgaaaacggacgacgatgtttacgtgaacgtgccagaacttgtctccgaattggtgctcaggggcggtagatggggccagtgggaacggtctactgagcctcagagagaggcagaacaagaaggcggacaggtcttgcattctgaggaggtgccactcctctacctgggcagagtgcattggcgtgtcaatccttcacggacccccggcggccgacaccgcgttagtgaagagcagtggccacacacctggggccccttcccaccatatgcatcaggcaccgggtacgtgttgtcagcctccgcagtccagctgatccttaaagtggcttcacgagcaccactgctaccactggaggatgtcttcgtgggggtgtccgctcgccgcggaggcctggcgccaacccagtgtgtgaaactggccggtgcaactcattatcctttagatcggtgttgctacgggaagttccttctgacctctcacagactcgacccctggaaaatgcaagaagcgtggaagctggtgggagggagcgacggagaacgcacggcccccttctgtagctggtttcaaggagttctggggattctacgctgcagggccatcgcttggctgcaatcttag

SEQ ID NO: 139941 - DNA, 1137 bp, Artificial Sequence
  Description of Artificial Sequence: Synthetic coding sequence
atgcagctgagactgtttagacggctgctactcgccgcccttctgctggtcattgtctggaccctcttcggccccagcggtcttggggaggaacttctaagcctcagtctcgcgtcattactgcccgccccagcatcacctgggccccccctggccctgcctcgtttgttaattccgaaccaagaggcctgtagcggccccggagccccgcctttcttacttatactggtgtgcaccgcccccgagaatctgaaccaaaggaacgccattcgcgcctcctggggaggccttagagaggcccgcggattgagggtccagacactcttcctcttgggggagccgaacgcccagcatcccgtatggggcagccaaggatcagatctggcctctgagagtgccgcccaaggcgatatcctgcaggccgcatttcaggacagctatcgtaatctgactctgaaaacactgtctggactcaattgggccgagaaacattgtcccatggcccgttacgtgctgaagactgacgatgatgtctatgtcaatgttcccgaactggtgtccgaactggtcctccgcgggggccgctggggccagtgggaacgtagtaccgagccacaacgggaggccgagcaagagggcgggcaagtgttgcactccgaagaggtccctcttctttacctcggaagagtccactggcgagttaacccaagtagaacacctggaggacgccatcgcgtaagcgaggaacagtggccgcacacctggggtccctttcccccctacgccagtggaaccggctatgttctctcagcatctgctgtgcagctgattctcaaggtggccagccgtgcgcccttgctccctttagaggacgttttcgtgggcgtttctgcgcggagaggtgggctggcaccaactcagtgcgttaagctggctggagctacccattacccactggaccgatgttgttatggaaagttcctcctcacaagtcacaggctcgatccatggaagatgcaagaggcctggaagctggtcgggggatccgatggcgagcggaccgcacccttctgcagctggtttcagggggtcctgggtatcctacgctgccgggcgatcgcctggctccagtcctag

SEQ ID NO: 139942 - DNA, 1137 bp, Artificial Sequence
  Description of Artificial Sequence: Synthetic coding sequence
atgcaactccgtctgttccggcgtctcctgttggccgctcttctgcttgtcatagtgtggacacttttcgggcccagtggtttaggtgaggagttgctgtccctgtctcttgctagcctcttgcccgctcctgcctcacctggaccgccactggccttgccaagactactgattcccaatcaagaggcgtgctccggccccggtgcccctccttttctcttgatcctcgtgtgtacagcacccgaaaatctaaaccagcggaatgccataagagcttcttgggggggactgagggaggctagaggcctaagagttcaaacactgtttctcctgggtgaaccaaatgcccagcacccagtgtggggctcccagggctcagacctcgcatcggagtctgccgctcagggagatattctccaggcagccttccaggactcttatcggaatctgacactgaaaaccctctcaggattgaattgggcagagaagcactgccccatggcgcgatacgtgctaaagactgatgatgatgtgtatgtgaacgttccggaactggtcagcgagctggtgttgcgggggggacgttgggggcagtgggagcggagcaccgagcctcaacgcgaagcggagcaggaaggcggtcaggtgctgcactcagaggaagtacctctgctatatcttggccgagtgcactggcgcgttaacccttccaggactcccggcggtaggcacagagtgagcgaagaacagtggccacatacctggggtccttttcccccatacgcatctgggaccggatatgtcttatctgcaagcgcggtccagttgattctgaaggtcgcttctagggcccctctgctgcctttagaggacgtttttgtgggggtaagcgcaaggagaggcggcctggcacccacccaatgtgtgaagctggcgggggccacacattaccccctggataggtgctgttacggaaagtttcttttgacgtcacatcggctggatccttggaagatgcaggaggcatggaaattagtcggggggagtgatggcgagcgcacggcccccttctgcagttggttccagggtgtgctgggcattctccggtgtagggctatcgcatggctccagtcctag

SEQ ID NO: 139943 - DNA, 933 bp, Artificial Sequence
  Description of Artificial Sequence: Synthetic coding sequence
atggctttcccaaaaatgcggctgatgtacatctgtctgctcgtgttgggagctttgtgcctctacttttcgatgtacagtctgaatcctttcaaagaacaatcctttgtatataaaaaggacggaaatttcctgaaactgcccgacaccgactgtagacagacacctccatttttagtcctgctggtgactagctcacacaagcagctggccgaaagaatggctataaggcagacttggggcaaagagcggatggtgaaaggcaaacagctgaagactttcttcctactaggcactacctcctctgcagcggaaaccaaggaggtggaccaggaatcacagagacatggagacatcatccaaaaggatttcctcgatgtttattacaacctgacgctcaagaccatgatgggcatcgagtgggtgcaccgcttttgcccacaggccgctttcgtaatgaaaaccgattctgacatgtttattaacgtcgattatctgacggagcttctgctgaaaaaaaataggaccacaaggttcttcacagggtttctgaaactgaacgaatttcctatacgtcagccgttttctaagtggttcgtgagtaagagtgagtacccttgggaccggtatcccccattttgctccggaactggctacgtattctctggcgatgtggccagccaggtatacaatgtgtccaagagtgtgccatatatcaagctggaggatgtgtttgtgggcttgtgcctcgagagacttaatattagacttgaggaattacactcccagccaacctttttccccggaggcctgcgtttcagcgtctgcttgtttcgccgcatcgttgcgtgccatttcatcaaaccgcgtactttgctggattactggcaggccctcgaaaacagtagaggtgaggattgccctcctgtctag

SEQ ID NO: 139944 - DNA, 933 bp, Artificial Sequence
  Description of Artificial Sequence: Synthetic coding sequence
atggctttcccaaagatgcgcctaatgtacatatgcctcctggtcctgggggctctatgcctctacttttctatgtattccctgaatccttttaaggagcagtcctttgtttacaaaaaggacggaaatttcctcaagctccctgacaccgattgcagacagacaccacctttcctcgtgctgctcgtgacctcatcccacaaacagctggcagagcgaatggctatccgccaaacctggggaaaagagagaatggtaaagggcaaacaactcaagaccttcttcctgctgggtacaacaagttccgctgcagagaccaaggaagtcgatcaggagagccagcggcacggcgatatcatacagaaagacttcctggatgtctattataaccttacacttaagacaatgatgggaattgagtgggtacataggttctgcccacaggccgcctttgtcatgaagacggacagtgacatgttcatcaatgtcgactacctgaccgagctgctactgaagaagaatcgtaccacccgcttttttacgggattcctcaagctcaatgagttccctatcagacagccgttttctaaatggttcgtcagcaagtccgagtacccttgggacagatatccacccttttgttctggtacagggtacgttttcagcggcgacgtggccagtcaggtgtacaacgtgtcaaagtcagtgccctacataaagctggaggatgtgtttgtcggcttgtgtctggaacggctcaatatccgtctggaggagctacattctcagcctactttttttcctgggggcctgaggtttagcgtatgcctctttcggagaatcgttgcatgccacttcattaaaccaagaacccttctggactattggcaggctttggaaaattcccggggagaggattgcccaccggtttag

SEQ ID NO: 139945 - DNA, 933 bp, Artificial Sequence
  Description of Artificial Sequence: Synthetic coding sequence
atggcttttccaaagatgcggctgatgtacatctgtctgctggtgcttggagcactgtgtctctatttcagcatgtatagtttaaacccttttaaagagcagtcatttgtttacaaaaaagatggcaacttcctcaaattaccagacacagattgccgacaaactcctccattcttggtactgctggtgaccagtagtcacaagcagctagcagagaggatggcgatccgccagacctggggaaaggaacgcatggttaaaggcaagcaactgaagactttcttcttgctgggaacaacctcttcagcagcggaaacgaaggaagtggaccaggagagccagaggcatggagatatcatccaaaaagattttctggatgtatactataacctgaccttgaagactatgatggggattgagtgggtccaccgcttctgtccccaggccgcttttgtcatgaagactgattccgacatgttcatcaacgttgactacctgaccgaactgctgttaaagaagaacaggacaacacgatttttcaccgggtttctgaaactcaacgaatttcctatcagacagccattctccaagtggttcgtgtctaagtccgagtacccatgggacaggtacccacccttctgcagcggtacaggatacgtttttagcggagacgtggcctcacaggtgtacaacgtttccaagagcgtgccttacattaagcttgaggatgtgtttgtggggctctgcctggaacgccttaatattcggctggaagaactccactcacaacccacattcttcccaggaggactaagatttagtgtctgcctgtttcgccgtatcgtggcttgtcactttattaagccaaggacattactcgattactggcaggccctcgagaacagccgcggggaggattgccctcccgtctag

SEQ ID NO: 139946 - DNA, 933 bp, Artificial Sequence
  Description of Artificial Sequence: Synthetic coding sequence
atggctttccccaaaatgcgcctgatgtatatttgtctgctagttctgggggcactttgtttatatttcagcatgtactcccttaaccccttcaaggagcagagcttcgtgtataaaaaggacggtaacttcttgaagctacctgacacagattgcaggcagactccccctttcctggtgctcttggtgacttcgtctcataaacagcttgccgagagaatggcgatccggcagacttgggggaaggagagaatggtgaaaggcaaacaactgaagacatttttcttgcttgggaccacatctagtgccgcagagacgaaggaggtggaccaagagtctcagaggcatggtgatattatccaaaaagacttcttggacgtttattacaacctgaccctcaaaacaatgatggggatagaatgggtccatagattctgtcctcaggcagcttttgtgatgaagaccgactccgatatgttcattaacgtggactacctgacggagctcctgctgaaaaagaaccgtacaacacggttctttactggttttctgaaactgaacgaattccccattagacaaccattttctaagtggtttgtctctaagtcggagtacccatgggatcgatatcctcctttctgctctgggacaggttatgtattctccggagatgtggccagtcaggtttacaacgtatctaaaagcgtcccttacattaagctggaggacgtgttcgtggggttgtgtctggaaagactgaacatcaggctggaggaattgcacagccagcccacattttttccgggagggttgaggttttctgtgtgcctcttccgcaggatcgtggcgtgccacttcatcaagcccagaaccctcctcgattattggcaggccctcgagaactcccgtggcgaggactgtcctcctgtgtag

SEQ ID NO: 139947 - DNA, 1197 bp, Artificial Sequence
  Description of Artificial Sequence: Synthetic coding sequence
atgcgactgcgagagccactgctgagtgggagcgctgcaatgccaggtgccagcctacagcgcgcttgtcgacttctggtagctgtctgcgctcttcatttaggggtaaccctggtttattacttagccggccgggatctgtcaagactaccacagttggtgggggtatccacaccccttcaggggggcagcaacagcgccgcagcgatcggccagtcctccggcgagttgcggacaggcggggcccgaccgcctccccccttgggagcttctagccaaccaaggccaggaggagactcaagcccagttgtggatagtggccccgggcccgcctccaatctgacttccgtgcccgtgccccacactactgctctatctctaccagcatgccctgaagaatctccgctccttgttggaccgatgttaatagagttcaacatgccagtcgatctggagcttgtggccaagcaaaaccctaacgtcaagatggggggacggtacgctccccgagattgtgtttcaccacacaaagtcgcaattattataccattccgaaacagacaggaacatctcaagtactggctgtattacttacacccagtgcttcaacgtcagcagctggattacggaatctacgttatcaaccaagctggtgataccatcttcaacagagccaaactgctgaatgtaggatttcaggaagccttaaaggattacgactatacatgtttcgtcttctctgatgtagaccttatccccatgaatgatcacaatgcctacagatgtttctcacagccccgacatataagcgtggctatggataagtttgggttctctttgccatatgttcagtactttggcggcgtttcagctctgagtaaacagcagttcctaactatcaatggcttccccaacaattactggggttggggcggagaggacgacgatatttttaatcgactcgtgttcaggggcatgagtatctctcggccaaacgctgtcgtcgggcgttgcaggatgatcaggcactctcgcgataaaaaaaatgagcctaaccctcagagatttgatcgcatcgcgcacaccaaagaaaccatgctgtcagacggactgaacagcctcacgtaccaggtcctcgacgttcaacggtaccccctctacacacagatcactgtcgacatcggcactccctcgtag

SEQ ID NO: 139948 - DNA, 678 bp, Artificial Sequence
  Description of Artificial Sequence: Synthetic coding sequence
atgcgcctgcgcgaaccactgctaagcggctccgctgcaatgcccggagcgagtctgcagagggcctgccgacttctagtggccgtgtgtgcacttcacctcggcgtaacgttggtgtattatcttgcaggtcgcgatctatcccggttgccccaactggtgggtgtaagcactcctttacagggtgggtctaacagtgccgctgctattgggcagtcctccggcgagctccggaccggaggggcgcgccctccccctccgctgggtgcatcttcccaaccacgacccggcggagactcaagtccggtggtggattcaggacctggaccggcctcaaatctgacctcagtaccagttccccacaccacggcactgtcactgccagcatgtccagaggagtctcctttgctcgtggggcccatgctcatcgaatttaacatgccagtcgacctggagcttgtagccaagcagaatcctaacgtgaagatgggagggcggtatgcgccacgcgactgcgtctcaccccataaggtggcaataataattccctttcgtaatagacaggagcatctgaagtactggctgtactatctccacccagtcctgcaaaggcagcaactggactacggaatatacgtgattaatcagtacgaaaagatccggagacttctctggtag

SEQ ID NO: 139949 - DNA, 1068 bp, Artificial Sequence
  Description of Artificial Sequence: Synthetic coding sequence
atgcgcctgagggaaccgctgctgagtggaagtgcagccatgcccggagcgtctttgcaaagagcctgcagactccttgttgcggtttgtgcattgcatttgggggtaactctcgtgtactacctcgctgggagggacctgtcccgcctgccacagctggtcggggtgagcactccggtggtggatagcggaccaggcccggcctccaatctcacctcagtgccggttccacataccaccgccctgtctctgcccgcctgcccagaggagtcccctctcctagtgggccccatgctgatcgaattcaacatgcccgtggacctcgagcttgtggctaaacagaatcccaacgtgaaaatgggcggacgctatgcccctagagattgcgtgtcaccacataaagtagcgatcataattccttttcggaaccggcaggagcatttgaagtactggttgtattacttacatcctgtgctgcagagacagcagctcgactatgggatttacgtgatcaaccaggcaggcgatacaatatttaacagagcaaaactgctgaacgtggggtttcaggaagccctgaaagattacgactacacctgcttcgtcttttctgacgtggatcttataccaatgaatgatcataatgcttatcgctgtttctcacagcctaggcacatcagtgtagctatggataagttcggattcagtctgccgtatgtacaatacttcggaggggtgagcgctctgtcgaagcaacagttcttgacaatcaacgggttccccaacaattactggggatggggaggagaggacgacgacatcttcaatcggctggtttttcgtgggatgtccatctcacgaccaaacgccgtggtgggtaggtgtagaatgattcgccatagtcgcgacaagaagaatgaaccaaacccccagcggtttgatcgcattgcccacaccaaggagaccatgctgtcagacgggctcaactccctgacatatcaagttctggatgtgcagcgatacccactgtacactcagattaccgtagacataggtactccctcatag

SEQ ID NO: 139950 - DNA, 438 bp, Artificial Sequence
  Description of Artificial Sequence: Synthetic coding sequence
atgaatgatcataatgcatacagatgctttagccagccccggcacatcagcgtggcaatggataagttcggcttctccctgccttacgtacaatacttcggcggagtgtctgcgctgtccaaacaacaattcttgacaatcaacggattccctaacaattactggggctgggggggcgaggatgatgatattttcaatagacttgtattcagaggaatgagtatctcacgccccaacgccgttgtgggcaggtgtcggatgatccgacactcccgagacaagaaaaatgagcccaatccgcagcgttttgatagaatcgctcacactaaggaaacaatgctgagtgatggtctgaacagtctgacctaccaggtgctggatgtacaacggtaccctttatatacacagatcaccgtggacattgggacaccgtcctag

SEQ ID NO: 139951 - DNA, 1206 bp, Artificial Sequence
  Description of Artificial Sequence: Synthetic coding sequence
atggctgtagaagtgcaagaacagtggccctgcctgccagcggcgggttgccctggccccctgggaggccccgtggccgcctgcgggatgtcaaggctgctgggcgggaccctggagagggtgtgcaaagccgtcttgctgctatgcctcctacacttcctggttgcagtgattctgtacttcgacgtatacgcccagcatttggccttttttagccgcttctcggcccggggacccgcacacgcactccatcccgcagcctcatcgagctcctcatcttcgaactgctctagacctaatgctacagcaagcagctctggtttgccagaggtgccaagtgccctgccaggcccaacagcccccacacttccaccgtgccctgatagcccccctggactggttggtaggctgctgattgagttcacctctccaatgccactggaacgtgttcagagagaaaacccgggggtgctaatgggtggccggtacactccacccgattgtactcccgcccaaaccgtcgccgtgatcatcccctttcggcatcgagagcaccacctgaggtactggctgcattatctacatccgatccttaggcggcagcggctcagatacggcgtctatgtaatcaaccagcatggggaggacaccttcaaccgtgcaaaactgttaaatgttggtttcctggaggctctgaaggaggacgccgcttacgactgcttcatctttagtgatgtggacctggtgccaatggatgacaggaatctttacagatgcggtgaccagcctcgccactttgccatcgccatggacaagtttggatttcgactgccttacgcaggctacttcggtggagtgagcggcttgtcaaaggcccagttcttacgcattaacgggttcccaaatgaatattggggatggggtggagaagacgacgacatattcaatagaattagtttgacaggcatgaaaatcagcaggcccgacatccggattggacggtatcggatgataaagcacgacagggacaagcacaatgagccaaaccctcagcgattcacgaagatacagaatacaaaacttacaatgaagcgcgatggaatagggagtgttcggtaccaggtcttagaagtgtcacgccagcccttgttcaccaacatcacggtcgacattggccgccccccaagttggccgccacggggatag

SEQ ID NO: 139952 - DNA, 1119 bp, Artificial Sequence
  Description of Artificial Sequence: Synthetic coding sequence
atgtccagattgttggggggtaccctggaacgagtgtgcaaggctgtgttattactttgcctgttacacttcctcgttgccgtgatcctctacttcgatgtctacgcccagcacttagcattctttagtagattcagcgcccggggacccgcccacgcgctgcatcccgctgctagctcatcctcctcaagtagcaattgcagtcgtccgaatgccaccgctagctcctccggcctgccggaagtgcctagcgctttacctggacccacagcccccactcttcccccctgtcccgactcaccccctggcttagtcggtaggctgctcattgagtttactagcccgatgccattggagagggtccagcgagagaatccaggggtcttgatgggtggacgctataccccaccggactgtacacctgcacagacagttgcagtcatcatcccatttcgtcatagggaacatcacctgcgatattggttgcattacttgcatccaatcctgcgtcgccaaagactgagatatggcgtgtacgtgattaatcagcatggcgaagacactttcaacagagctaagttattaaatgtgggatttctcgaagcgttgaaggaagacgctgcatatgattgcttcatcttcagcgatgttgatcttgtacctatggacgaccggaatctgtataggtgtggcgatcagccgcggcatttcgctattgcaatggataaatttgggttccgactcccttatgccggttatttcggcggggtgagcggcctatccaaagctcaatttctgaggattaacggattccccaacgagtattggggttggggaggcgaggacgatgatatctttaatcggatttcattaacaggcatgaagatcagcagacctgatatacgcattggcagatacagaatgatcaaacatgatagggataagcacaacgagcccaacccccaacggtttacaaagatacagaacaccaaacttacaatgaaaagggatggcattggatccgtccggtaccaggtgcttgaagtttcgcgccaaccccttttcacaaacatcaccgtagacattggacggcccccttcatggccgccccgcggctag

SEQ ID NO: 139953 - DNA, 1119 bp, Artificial Sequence
  Description of Artificial Sequence: Synthetic coding sequence
atgtccagactcttgggcgggacacttgaacgggtgtgcaaagccgtactcctattgtgtttactccacttcttggttgcagtcattctctattttgacgtttacgctcagcatctggccttcttttcgaggttttctgccagaggtcctgcccatgcgctccatcccgcagccagctcatcttcctcctcaagtaactgcagcaggcccaacgctaccgcaagttcaagcggcctcccagaggttccatcagcactgccaggtccaaccgcccccactttgccaccttgccctgattctccaccggggcttgtcgggcgcctactaattgaattcacatcacccatgcccctagagagagtgcagcgggagaacccaggggtgcttatgggcggtaggtacactcctcccgactgcacaccggcgcagaccgtggccgtgatcataccctttcgtcaccgggagcatcaccttcggtattggcttcactatttacatcctattttgcgacgccaaaggctgagatacggcgtgtatgtaatcaaccaacacggagaagacacattcaacagagccaagttgctcaacgtcgggttcttggaagccttaaaggaggatgctgcgtacgactgcttcattttcagcgacgtagaccttgttccaatggatgacaggaacctgtaccgctgcggggaccagccgaggcatttcgccattgcgatggataagttcgggtttcgactcccctacgcaggatacttcggtggagtttctggtctgtctaaggcacagttcctgaggataaacggttttcccaatgaatactggggctggggaggcgaagatgatgatatcttcaacaggatcagcctcacaggaatgaagatctctcgtcctgacatccggattgggagatatcgcatgatcaagcacgatcgggacaagcataatgagccaaatccgcagcgatttactaagatccagaatactaagctgacgatgaagagagatgggataggcagtgtacgctaccaggttctagaagtgagcaggcaaccactgtttacgaatatcacagtggacatcgggagacccccttcatggccacccagaggctag

SEQ ID NO: 139954 - DNA, 921 bp, Artificial Sequence
  Description of Artificial Sequence: Synthetic coding sequence
atgccttccacgcagctgttagccgctgctgccgccgcagccactgcccctggaccaacacctcctcccctcgctcctggttctttacgaagcccggttccatgcccggtgccacgcctgcccagatgccaccctgtcctcactcgtcacctggttttgcgcgtgcagagagagaatcccggagtgctgatggggggcagatataccccacccgactgtacgccagcccagactgtggccgttattatcccattcaggcacagagagcatcacctccggtactggctgcactacttacacccaatccttcggaggcagcgcctcaggtacggggtgtatgtgattaaccaacatggcgaggacacctttaatcgggctaaactgttaaatgtgggcttccttgaggcactcaaagaggacgccgcttatgactgctttattttttccgatgttgacctggtccctatggatgatcggaacctgtacaggtgtggtgaccagccccgacattttgcaattgccatggacaagttcggattccgcctgccctacgctgggtacttcggcggagtctctggcctgtcaaaggcccagttcctcagaattaatggcttcccaaacgagtactggggctggggcggcgaggatgacgacattttcaacaggattagcctgactgggatgaaaatttcccgaccagatattagaatcggccggtatcggatgataaaacatgatagggacaagcataacgagcccaacccgcagagatttacaaagatacagaataccaaactcacgatgaaacgagatggcataggatccgtccgctatcaggtgcttgaagtcagtcggcaaccgctgttcaccaacattaccgtcgatattggtcgtccaccaagctggcctccacgcgggtag

SEQ ID NO: 139955 - DNA, 441 bp, Artificial Sequence
  Description of Artificial Sequence: Synthetic coding sequence
atgctgaggaggcttcttgagcgcccgtgcacactcgccctgctagtgggcagccaattagcagttatgatgtatctctccctgggtggttttagatcactctctgcgctgttcgggcgtgaccaggggccgacattcgattactcgcacccacgcgacgtctacagtaacctgtcccacctcccaggcgcccctggagggcctccagccccacaagggttaccctattgtcccgagcggtctcctctccttgttggccctgtgtctgtttccttttctcccgttcccagtctcgcggaaattgtagaacgtaatccgagagtcgagcctggaggaagataccgccctccagccgcgctccctcctgcccccctgctcgcggctccagctgcctgcctgtggcacctgtgtcatccaccaggctggaaatggaacatctag

SEQ ID NO: 139956 - DNA, 1182 bp, Artificial Sequence
  Description of Artificial Sequence: Synthetic coding sequence
atgctcaggaggctgttagagcgcccgtgcactctcgctctgctcgtcggctcccagctggcagtgatgatgtacctgagtctgggaggctttagatcactgtcagccctgtttgggcgggatcagggacccacatttgactattcacaccccagagatgtctattctaacctctcccacttacccggggcccccggcggacctcccgcaccacaaggtctgccatactgtcccgagcgaagccctctgctggttggtcccgtctccgtcagcttttcccccgttccatccctggccgagattgtcgagcggaacccaagagtcgagcctggtgggcggtatcggcccgcaggctgcgagccccgttcacgcacagctattatcgttcctcatcgtgcacgagaacaccaccttcgcttgctcctatatcacctccatcccttcttacaacgccagcaactggcgtatgggatctacgtaatccaccaggccgggaacggcacattcaatcgggccaagctgttaaacgtgggcgtgagggaagcgctgagagacgaagagtgggattgtctgttcctccacgatgtcgatctgctcccggagaatgatcacaacctgtacgtttgtgatcctcgtggacctcgacacgttgcagtggccatgaataaatttggttactcgctcccgtacccccaatatttcgggggcgtcagcgcactcacccccgatcaatatctgaaaatgaacggatttcctaatgagtactggggttggggcggtgaggatgatgacattgccaccagggtgcgcttggcaggcatgaagatctcaagaccacccacaagtgtcgggcactacaagatggtgaaacatagaggcgataagggaaacgaagagaatccccatagatttgatttgctcgtgaggactcagaatagttggacccaggacgggatgaattcactgacctatcagctgttagccagggagttgggcccactctacaccaacattaccgctgacatcgggacagacccgcgaggcccacgggcccccagcggtccccgatatccgccgggaagtagccaggcctttagacaggagatgcttcagcgcagacctcctgccaggcccggacctttatctaccgcaaaccacacggccctcagaggatcacactag

SEQ ID NO: 139957 - DNA, 1182 bp, Artificial Sequence
  Description of Artificial Sequence: Synthetic coding sequence
atgctccgaaggttgctcgaaaggccctgcaccctggcactgctggtgggttctcaattagcagtgatgatgtatctgagcttaggtgggttccgctcattgagcgcactttttggccgtgaccaaggtcccacctttgactatagccatccacgagacgtttactcaaacctgtcccacctccccggcgcacccggaggaccgcccgctccccaggggctaccctactgcccagagagatccccactgctggtaggccctgtttctgtcagcttttcacctgtgccaagcctcgccgagattgtagaacggaatccccgcgtcgaaccgggagggagatacagacccgccggctgtgagccgaggtcgcggactgccattatcgtgccacaccgcgctagagagcatcacttgcgattactcctataccacctacatcctttcctgcagaggcagcagctggcatacggaatttatgtgatacatcaagccggcaatggcacctttaaccgcgccaagctgttaaacgtcggcgtccgggaggctttgcgcgacgaggaatgggattgtctcttcttgcatgacgtcgacctgcttccagaaaacgaccacaacttgtatgtatgtgatccgagggggcccaggcacgtcgccgtggcgatgaacaagttcgggtatagtttgccttacccacagtacttcggcggggtttcagcactgactcctgaccagtatctgaagatgaatggctttcccaacgagtactgggggtgggggggggaggacgacgatatcgccactcgcgtgaggctggcagggatgaaaataagccggcccccaacttctgttggccactacaaaatggttaaacatcggggcgataagggaaatgaggagaatcctcatcgctttgacctgctggtgcgcacacagaacagctggacgcaggatggcatgaactctctcacctaccagcttttggctcgtgaactcggaccactttacactaatatcacggccgatataggaacagaccctaggggccccagggccccttcagggcccaggtatccccctgggtcatcccaagccttcaggcaagagatgctgcagcggcgcccacccgctcgacccggacccctgtcaacagcgaatcacaccccttccgaagtgcatacttag

SEQ ID NO: 139958 - DNA, 1182 bp, Artificial Sequence
  Description of Artificial Sequence: Synthetic coding sequence
atgctgaggcggctcttggaacggccttgcactctggcgctgctcgtcggatcccagctggcagttatgatgtacctgagtttaggtggcttccggagtttgagtgctctgtttggccgcgaccagggccctactttcgattattctcatccaagggacgtctactccaacttgagtcatttacctggggctcccggaggcccgccagctcctcagggcctgccctattgccctgaaaggagcccccttctggtcggaccagtttccgtcagtttctcacctgtgccctcacttgccgaaatcgtggagcggaatccaagagtggaaccaggcggaaggtacagaccagctggatgcgagcctcgatcaaggaccgctataatcgtaccccatcgggcccgagagcatcacctgcgactgttactttatcacttacaccctttcctgcaaaggcagcagctggcgtatggtatttacgtgatccaccaggcaggtaacggtacctttaatcgggcgaagctgctgaatgtgggtgtccgggaagcgctgagagatgaagagtgggactgtttatttctccatgacgtcgatcttttacctgagaacgaccacaatttatatgtgtgtgaccctaggggtccccgccatgtggcagtcgcaatgaataaattcgggtatagtctgccatacccacaatacttcgggggcgtctccgctcttacccccgaccagtacctgaagatgaacggatttcctaacgagtactggggctggggcggcgaggatgacgacatcgccacaagggtacggctggctgggatgaaaattagccgcccacccacgtccgtcggtcattataaaatggtcaagcatcggggagacaaaggcaacgaggaaaacccacaccgcttcgatttgctggttcgtacgcaaaacagctggacgcaggatggtatgaactcccttacctatcagctgctagctcgcgagctcggacctctctacaccaacattaccgctgacatcggaaccgaccctagaggaccccgtgctccttcaggacctcgctaccctcccgggtcatctcaggcatttcggcaggaaatgcttcaacgaaggcctccggcccgccccggaccactctccactgccaaccacactgctctacgaggatcacactag

SEQ ID NO: 139959 - DNA, 1113 bp, Artificial Sequence
  Description of Artificial Sequence: Synthetic coding sequence
atgctgcggagactgctcgaacgcccctgtacattggctctctttggtcgcgatcaaggaccgacgtttgattattcacacccaagggacgtttattccaacttgagtcacttaccaggcgcacccggcggaccacctgctccccagggactgccatactgccccgagagaagcccactgcttgttggcccggtgagcgtgagtttctctccagtgcccagcctcgcagagatcgtcgaaagaaacccaagggtggagcctggaggaagatatagaccagctgggtgtgagccaaggagccgcacggcgataattgtccctcatagagctagggaacaccatttgaggcttctgctgtatcaccttcatcctttccttcagaggcagcagttggcctacgggatatacgtgatccatcaggccggtaatggaaccttcaatcgggctaagctcctcaatgtgggagttcgcgaggctctcagggacgaggagtgggactgtctgtttttacacgatgtggacctgctgccagagaacgaccacaacctttatgtgtgcgatccccgtggcccccggcacgtagccgttgcaatgaataagtttgggtattccctgccataccctcaatactttggaggcgtaagcgcgttaacccctgaccagtatctcaagatgaacggattccccaacgagtactggggctggggcggtgaagatgatgacattgctactagagtgcgcttggccgggatgaagatcagtagaccacctaccagcgtgggccactacaagatggtgaagcaccgcggggataaagggaatgaggaaaacccgcacaggttcgatctgctcgtcaggactcagaactcgtggacccaggacgggatgaattcccttacttatcaactgctagcccgtgaacttggccctttgtacaccaatatcacagctgacattggcaccgacccccgagggccccgcgcacccagtggtcctcggtatcctcccgggtcttcccaagcttttaggcaagagatgctccaacgcaggcccccggcccggccaggacccttatcaaccgccaaccacacagcattaaggggatcacactag

SEQ ID NO: 139960 - DNA, 684 bp, Artificial Sequence
  Description of Artificial Sequence: Synthetic coding sequence
atgctgcgtaggttgttagagcggccctgcacgctggcactattggtaggctcacagcttgcagtgatgatgtacctgagcctcgggggcttcaggtcattaagcgctctgttcgggagagatcagggtccaacgttcgactacagtcacccgcgtgacgtgtactctaacctgtcacatctgccaggcgcccccggcggtcctcctgcaccccaaggcctgccctattgccccgagcggtccccactgctggtgggaccagtgtctgtctccttctctcctgttccttccctggccgagattgttgagcgcaacccaagggtagaaccaggcgggagataccgtccagcggggtgtgagcctaggagcaggacagcaatcatcgtgccgcaccgggccagagaacatcacctgcgtcttctgctgtaccatctgcaccccttccttcagaggcagcagttagcctatggcatctacgtcatacatcaggcaggcaatgggaccttcaatcgggcgaaactgctaaacgtgggtgtgagggaggccttgagagatgaggagtgggactgcttgtttttacatgatgtcgacctcctgcctgagaacgaccataatctgtacgtgtgcgacccgcggggcccaaggcatgtggccgtcgccatgaacaagttcggctaccgatag

SEQ ID NO: 139961 - DNA, 1035 bp, Artificial Sequence
  Description of Artificial Sequence: Synthetic coding sequence
atgggctttaatttgacatttcacctgtcttacaagtttcggttgcttctgctgctgactctgtgcctcaccgtggttggatgggccacgagcaactattttgtcggggccatacaggagatcccaaaagcaaaagagttcatggcaaatttccataaaaccctgatactagggaaggggaaaacccttaccaatgaggcttcaactaagaaagttgaattagacaactgtccctccgttagtccatacttaagggggcaatccaaattgatcttcaaacccgatcttacgcttgaggaagtgcaagcggagaatcccaaagtctcaagaggccggtatagaccccaagagtgtaaagccctgcagagggtggccattcttgtccctcatcggaaccgggaaaagcatctgatgtatttgcttgaacaccttcacccttttctgcagaggcaacaactagattatgggatttacgtcatccatcaggcagaagggaagaagtttaacagggcaaaactcctaaacgtgggttatcttgaagcgttgaaggaagaaaactgggactgcttcatcttccatgacgtggatctggtgccagagaatgattttaatctgtataaatgtgaggagcaccccaagcatctggtggttggaagaaatagcactggttaccggttgcggtacagcgggtatttcggcggagttaccgcgctgtcaagggaacagttctttaaagtcaacgggttttcgaataattattggggatggggtggagaggatgacgacctgagattgcgcgttgagctccaacggatgaagatttcgcgaccattacccgaagtcggaaaatacacgatggtcttccacacccgcgacaagggcaatgaagtcaacgcagagcgtatgaagctcctgcatcaagtctctcgcgtgtggcgaacggatggcctgtccagctgctcctataagctggtttcagtggagcataatcctttgtacatcaacatcactgtggacttctggttcggcgcctag

SEQ ID NO: 139962 - DNA, 1035 bp, Artificial Sequence
  Description of Artificial Sequence: Synthetic coding sequence
atggggtttaaccttaccttccatctatcctataagttccgattactcttgctgctcaccctgtgtctgacagtggtaggctgggccacgtccaattattttgtcggagctatccaagagataccaaaagccaaggaatttatggccaatttccataagacgctgatccttggcaagggaaaaacactgacaaacgaagcttcaaccaaaaaggtggagttggacaactgtccctccgtgagcccctacctgcggggccagtcgaaactcattttcaagccagatctgacactggaagaggtgcaagcggaaaatcccaaggttagtaggggacggtatcggccccaagagtgcaaggcgctccaacgggttgccattttagtgcctcatcgaaacagagagaagcatctcatgtacctgctggagcatttacaccctttcctgcagaggcagcaactggactatggaatttatgtgatccaccaggctgaaggtaaaaaatttaaccgcgccaagctactcaatgtcggataccttgaggctctcaaggaggaaaattgggattgcttcattttccacgatgttgatctggtgcctgagaatgattttaacctgtacaagtgcgaggagcatcccaagcacctcgtggttggacggaacagtaccggctatcggctcagatacagcggctactttggcggggtgactgcgctgtcaagggagcagttttttaaagtaaacgggttcagtaacaactactggggctggggcggcgaggatgatgatctccgactaagggtggaactgcagagaatgaaaattagcaggcccttgcctgaggttggtaagtacacaatggtattccacacccgcgataagggtaatgaggtgaatgctgagcgcatgaagttgttgcaccaagtttcccgcgtttggcgcactgacgggctgagctcctgcagctacaagctggttagcgtggaacacaatccactgtatattaacatcaccgtggatttctggttcggcgcttag

SEQ ID NO: 139963 - DNA, 21 bp, Artificial Sequence
  Description of Artificial Sequence: Synthetic coding sequence
atgggctttaacctgacgtag

SEQ ID NO: 139964 - DNA, 9 bp, Artificial Sequence
  Description of Artificial Sequence: Synthetic coding sequence
atgggttag

SEQ ID NO: 139965 - DNA, 168 bp, Artificial Sequence
  Description of Artificial Sequence: Synthetic coding sequence
atgggattcaacctaacctttcacctttcgtacaagtttcgcctgcttctgctcctcaccctatgcctgaccgtggtagggtgggccacctctaattactttgtgggtgccattcaggagatccctaaagctaaagagttcatggcaaattttcacaaaacactttag

SEQ ID NO: 139966 - DNA, 66 bp, Artificial Sequence
  Description of Artificial Sequence: Synthetic coding sequence
atgggcttcaacttgacttttcatctgagctacaagttcagacttttactccttctgacgctctag

SEQ ID NO: 139967 - DNA, 411 bp, Artificial Sequence
  Description of Artificial Sequence: Synthetic coding sequence
atggggttcaatctcacttttcaccttagttataagttccgcctactcctgctgctcacactctgcctgaccgtggtaggctgggccacttctaactactttgtgggtgctattcaggagattcccaaggccaaggaattcatggccaacttccacaagacacttatactcgggaagggaaagaccctgacaaacgaagcatccaccaaaaaggtcgagctggacaattgcccgagcgtctccccctatttgagagggcagagtaagctgatattcaaacccgacctgacactcgaggaagtccaagcagagaatcctaaagtaagccgaggtagatacagaccccaggagtgcaaagcgctccagagagtagctattttggtaccccacagaaatcgcgaaaagcattag

SEQ ID NO: 139968 - DNA, 357 bp, Artificial Sequence
  Description of Artificial Sequence: Synthetic coding sequence
atgggattcaacctaactttccacctgagttataagttccggctgctgttgctgctcactctatgtcttacggtggtagggtgggccacatcaaattactttgtgggggcaattcaggagatccccaaggcaaaggagtttatggcgaatttccacaagacactaatccttggcaaagggaaaacattgaccaacgaggcctcgaccaaaaaagtagagttagataactgcccctccgtgagcccttacctgcggggacagtcaaaactgatcttcaagcctgacctcaccttggaagaagttcaagccgagaaccccaaagtctcgagggggcgctatcgaccccaagagtgttag

SEQ ID NO: 139969 - DNA, 1035 bp, Artificial Sequence
  Description of Artificial Sequence: Synthetic coding sequence
atgggattcaatctgacatttcatttgagttataagtttcgcctactgctcttattaacgctgtgtctcactgtcgtgggctgggctacatctaattactttgtgggggcgatccaggagatccccaaggccaaggagtttatggctaacttccacaagactttgattctgggcaagggcaagaccctcacaaacgaagcatctactaaaaaggtcgagctcgacaactgcccaagcgtgtctccctacctgcgagggcaaagcaaattgatcttcaagcctgatcttacactggaggaagtgcaggcggaaaaccccaaagtatcaaggggccgctatcgtccccaggaatgtaaggcactgcagcgggtagctatcttggttccccaccgcaatcgagagaaacacctgatgtatttgctggagcacttacacccctttctgcagaggcagcaattggactatggtatctatgttatccatcaggccgaggggaagaagtttaacagagcaaaattactgaatgtcggataccttgaggcattaaaagaggagaactgggactgttttatctttcatgacgtggatttggtgcccgaaaatgatttcaatctgtacaaatgcgaggaacatccaaagcatctggttgtcggaaggaatagcacagggtatcgcctgcggtacagtgggtatttcggcggggtcaccgcactgtcccgcgaacagtttttcaaagtgaatggcttctcaaataattattggggctggggaggcgaagatgatgacctaagactgcgggttgaactccagcgaatgaaaatctcacggcccctccccgaggtcggaaagtatacaatggtgtttcatacccgggataaagggaacgaggttaatgctgaaagaatgaaactcttgcaccaggtttccagggtctggcggacagatggactctctagttgttcctacaagcttgtcagcgtggagcacaatcctctgtacattaacataactgtcgacttctggttcggggcttag

SEQ ID NO: 139970 - DNA, 129 bp, Artificial Sequence
  Description of Artificial Sequence: Synthetic coding sequence
atgggattcaatctaacctttcatctgtcttataagttccgcctcctactgctactgacgctgtgcctgaccgttgtaggctgggcgactagcaattactttgtgggtgccatccaggagataccttag

SEQ ID NO: 139971 - DNA, 1167 bp, Artificial Sequence
  Description of Artificial Sequence: Synthetic coding sequence
atgagagcaaggagagggcttctgagactgccgcgcagatccttgctggcagccctctttttctttagcctcagctcgtcactcctgtattttgtgtatgtggcaccagggatagtaaatacctatctgttcatgatgcaggcccagggcatcctcatccgggataatgtgcgcacaataggggctcaagtttacgaacaggtgctgcgatccgcttacgctaagagaaatagctcagtaaacgactcagattaccctctggatctgaatcacagcgaaacttttttgcagactaccacattcttaccagaagactttacttattttgccaaccacacctgtccagagcgcttaccatcaatgaagggtccaatcgacattaacatgtctgaaattggcatggattacatccacgagctctttagtaaagacccgactatcaagctgggtggtcattggaaaccttctgattgtatgccccgctggaaagtggctattctgatcccttttcggaaccggcatgaacatctgcctgtgctgttccgccatctccttccgatgcttcagcgtcagcgcctccagtttgcattctatgtggtggagcaagtcgggactcaacctttcaacagagctatgctgtttaatgtcgggttccaggaggctatgaaagatctcgactgggattgcctgatcttccacgatgtggaccacatcccagaatctgaccgaaactattacggctgtggacagatgccacggcatttcgccactaagttggacaagtatatgtacctgctgccttataccgagtttttcggaggtgtctctggcttaaccgtggagcagtttcgaaaaatcaacgggtttccaaatgctttttgggggtggggtggagaggacgatgacctgtggaacagggtgcagaacgcgggctattctgtgagccggcctgagggtgacacaggcaagtacaagtctattcctcatcaccacaggggggaagtgcagttcctcggcaggtatgctttgctgaggaaaagtaaagaaaggcaaggattggatggcttgaataatctgaattacttcgcaaatatcacctacgacgcgctctataaaaacataactgtgaacttaacgccagaattggctcaagtaaacgaatattag

SEQ ID NO: 139972 - DNA, 1032 bp, Artificial Sequence
  Description of Artificial Sequence: Synthetic coding sequence
atgagcgtgctcaggcgcatgatgagggtgtctaatagatcgctgctcgctttcattttctttttcagcttatctagcagttgcctgtatttcatttacgtggctcctgggattgattacccagagggaaacaattcgtctgattacctggttcagaccacaacttatctgccggagaacttcacctattccccctacctgccatgtccagagaagctgccctatatgcgggggttcctaaacgtgaatgtgtctgaagtgtccttcgacgagatccaccaactgtttagcaaagacctcgatatcgaaccaggcggacactggcgcccaaaggactgcaagcctagatggaaggttgccgtcctgatacccttcagaaatcggcacgagcaccttccaatctttttcctgcacttaattcctatgctccagaaacagagattggagtttgctttttatgttatcgagcagactggtacacaacccttcaaccgcgccatgctgtttaatgtaggctttaaggaagccatgaaagatagtgtttgggattgcgtgattttccacgacgtggaccatctgcctgaaaacgatcgtaattactacgggtgcggcgaaatgccgaggcatttcgcggccaagttggacaagtatatgtatattctgccatacaaggagtttttcggcggcgttagcggactgactgtcgaacaattcaggaagattaatggcttcccgaacgccttctggggctggggcggtgaagatgatgatctgtggaatagggtgcactacgccggctataacgtaactcggccggagggggatctgggcaaatataagtccatcccccaccaccacagaggagaggtccagtttctaggtcgttataaactactgcggtacagcaaggagagacagtatattgacggactgaacaacctgatttatcggccgaagattctggttgacagactatacacaaacatctcagttaaccttatgccagagctcgctccgattgaggattattag

SEQ ID NO: 139973 - DNA, 1149 bp, Artificial Sequence
  Description of Artificial Sequence: Synthetic coding sequence
atgtcagtgcttaggcgcatgatgagggtaagtaacaggtctctgctcgcttttatctttttttttagtttgtcatcgagctgcctgtattttatttacgttgcgcctggaatcgccaatacttatctgttcatggtccaggcgcgtggaatcatgctgagggaaaacgtgaagacaataggacacatgatacggctctatactaacaaaaactcaaccctaaatggaacagattatcccgaggggaacaacagttctgattatctggtgcagacaaccacatatttacctgagaatttcacttactctccatatctcccctgtccagagaaactgccctacatgcggggcttcctgaatgtaaacgtgtcagaagtctcgttcgatgagatccaccagctgttctccaaagacctggatattgaaccgggcggccattggcgcccaaaagactgtaaaccccggtggaaagtggctgtgttgattccttttaggaacagacatgagcacctgccaattttctttctgcaccttatccctatgttacaaaagcagagacttgagtttgccttctacgttatcgaacagaccggcacgcagccattcaatagagctatgctgttcaacgttggcttcaaagaagcaatgaaggactcggtctgggattgcgtgatctttcacgatgttgaccaccttcctgaaaacgatagaaattactatgggtgtggcgaaatgccacggcacttcgccgcaaaattagacaaatatatgtacatcctcccatataaggagttttttggaggcgtttcagggctcacagtggagcaattccggaagataaacggttttccaaacgcattttggggctgggggggtgaggatgacgacctctggaatcgcgttcactatgccgggtataatgtcacaaggcccgagggagatctgggcaagtacaaaagtatccctcaccaccatagaggggaagtgcagtttttagggcggtacaaactcttgcggtatagtaaagaacggcagtatattgatgggctgaacaatctgatctatagacctaagatccttgtggatagattgtacactaacatcagcgtgaatttaatgcccgaactcgcccctattgaggattattag

SEQ ID NO: 139974 - DNA, 1032 bp, Artificial Sequence
  Description of Artificial Sequence: Synthetic coding sequence
atgtcagtcttgcggcgtatgatgagggtcagtaatcggtctctgctggcgtttatcttcttttttagtctgagctcatcatgcctgtactttatctatgtcgcgcctggaatcgcaaatacatatcttttcatggtgcaggcacgagggatcatgctgagagaaaacgtcaaaactattgggcatatgattaggctttatacaaacaaaaattcaactcttaacggaactgactacccggagggcaacaacagctcagattatctggtgcagactaccacatacttgccggaaaacttcacctattctccttaccttccttgcccggagaaactgccttacatgagaggttttcttaatgtaaacgtctcagaagtatcatttgatgagatccatcagttattttccaaagacctcgacatagaacccgggggacattggagaccaaaagattgtaagccacgctggaagaccggcacacagcccttcaatagagcgatgctgttcaatgtgggatttaaggaggctatgaaagattccgtctgggattgtgtgatctttcatgatgtggatcatttgcccgaaaacgatcgcaactactatggatgtggggagatgccacgacacttcgcagccaaattggacaagtatatgtatattctgccctacaaagaattctttggcggagtgtccggtttaaccgtggaacagttccgcaaaattaacgggtttcccaatgcattttggggatggggaggagaagacgatgacctgtggaaccgcgtacactacgcaggctacaatgtgacccgccctgagggggatttggggaagtacaagagcatccctcaccaccatagaggtgaggtgcaatttctgggacgctacaaattgctaagatacagtaaagaacgacagtacatagatggcctcaataacctcatctataggcccaagatcctggtggaccggctttatacaaatataagcgtcaatctgatgcccgagctggcacccatagaagattattag

SEQ ID NO: 139975 - DNA, 1047 bp, Artificial Sequence
  Description of Artificial Sequence: Synthetic coding sequence
atggccgaaaaagttctggttaccggcggggcagggtatatcgggtcacacaccgtactcgagttactggaggcaggttatctgcccgttgtgatcgacaactttcataacgcattccgggggggaggttctcttcccgagagtcttcgacgggtccaagagttgacaggaaggagcgttgaattcgaggagatggacattctggatcagggagctcttcagcgtctgttcaagaagtactcattcatggccgttatccattttgctggacttaaagcggtcggcgagtccgtccagaagcctctggactattatcgggtaaacctcacaggcactattcagctgctcgaaatcatgaaagcccatggggtgaagaatctcgtattctccagcagcgccactgtgtatggtaacccccagtacttgccactggatgaggcacatccaacgggcggctgtaccaacccttatggcaagagcaagttcttcatagaagagatgataagagacctgtgtcaggccgataaaacctggaacgccgtgctgctgaggtactttaatccaaccggagcccacgcttctgggtgtattggcgaagacccccaggggattcccaacaacctcatgccgtatgtatctcaagtcgctattggccgtagagaagcacttaatgttttcggaaacgactatgacacagaggatggtacaggcgtgagggactatatacatgtggtggacctagctaagggccatattgccgcactgcgcaaattgaaagaacaatgcggctgcaggatttacaaccttggaacaggaacagggtactcagtgctgcagatggtgcaggcaatggagaaggcatccggtaaaaagatcccatacaaggttgtggctcgacgggagggcgatgtcgccgcttgctatgccaaccctagcctggctcaggaagagctggggtggaccgcagccctaggactggataggatgtgcgaagatctctggaggtggcagaagcaaaatccctccggcttcgggacccaggcttag

SEQ ID NO: 139976 - DNA, 777 bp, Artificial Sequence
  Description of Artificial Sequence: Synthetic coding sequence
atggacatcctagatcagggagccttgcagaggttgtttaagaagtatagcttcatggctgttatccatttcgcaggcctgaaagctgttggagagagtgtgcagaaaccgttggactattatagagtgaacctcaccggaacgatccagcttttggagattatgaaagcacacggcgttaaaaatctcgtcttttcaagctctgcgacggtgtacggtaaccctcagtacctgccactcgacgaggcccatcccactggtgggtgtacaaatccgtatgggaagagtaagttttttatcgaggaaatgatccgggatctctgtcaagctgataaaacatggaatgccgtcttgctgcgatacttcaatcctacgggcgcccacgcgtctggatgtattggtgaggacccacagggcatcccaaacaacctaatgccttacgtctctcaagtggccataggaaggcgagaggctctgaatgtgttcggcaacgattacgacacagaagacgggacgggagtccgggactacatccatgtcgttgatctcgcaaaaggacatattgctgcacttcgaaagctgaaagagcagtgcggctgtaggatcccatacaaagtggtagctaggagagagggggacgtcgctgcatgctacgctaacccttccctggctcaagaagaactgggatggactgcagcactgggtctggataggatgtgtgaggatttgtggaggtggcagaagcagaaccctagtggattcggtacgcaggcctag

SEQ ID NO: 139977 - DNA, 684 bp, Artificial Sequence
  Description of Artificial Sequence: Synthetic coding sequence
atggatatcttggatcagggagccctgcagcgactgtttaagaaatacagctttatggctgtaatccatttcgctggcttgaaggcggttggcgaatccgtgcagaagcccctggattattatagagtgaacctcactgggaccattcaacttctagagatcatgaaggcgcatggtgtgaagaatctcgttttttcatcatctgccacagtctacggcaacccacaatatctgcccctagatgaggcccacccaaccggaggttgtacaaatccttacgggaagtcgaaatttttcattgaagagatgattcgggatctctgtcaggcagacaagacttggaacgcggtgctgctgcgctatttcaatcctacaggggcacatgccagcgggtgtattggtgaggatcctcagggtattcccaacaatttgatgccttacgtgtcccaggttgccataggcagaagggaggctttaaacgtctttggaaacgattacgacaccgaggacggcaccggagtgcgagattatattcacgtcgtggacctggccaaggggcatattgcggccctacgaaagcttaaagagcagtgtggctgtagaatctacaacctgggcactggtacaggatactctgtgctacagatggtgcaggctatggagaaagctagcggaaagaaatag

SEQ ID NO: 139978 - DNA, 588 bp, Artificial Sequence
  Description of Artificial Sequence: Synthetic coding sequence
atggctgaaaaggtgctcgtgaccggcggagctgggtatatcggaagccataccgtccttgagctgctcgaggctggttacttgcccgtggtcatcgataactttcacaatgctttccgtggcggcggttcactacctgaaagcctccgccgggtacaggaactcacagggcgatccgttgagtttgaagaaatggacattttggatcagggagccctgcagcgcctttttaagaaatatagctttatggctgtaatccattttgccggtctcaaagccgtcggcgagtccgttcagaaacccctggattattatagagtcaatctgacaggcactattcagctgctggagatcatgaaggcccatggcgtcaagaaccttgtcttcagcagcagcgctactgtatatggcaatccccaatacctgcccctggacgaagctcatcccactggaggatgcacaaatccctacgggaagagcaaattttttatcgaggaaatgattagggacttatgccaagcagataagacatggaacgcagttctgcttagatattttaatcccaccggggcgcatgcttctggctag

SEQ ID NO: 139979 - DNA, 720 bp, Artificial Sequence
  Description of Artificial Sequence: Synthetic coding sequence
atggatatactagatcagggcgccctgcagaggttattcaagaagtacagcttcatggcggtaatacatttcgccggcctgaaggcagtgggggagagcgtgcagaaacctctggattactatagagtgaatctgactggaaccatccagttgctcgagatcatgaaggctcacggcgtgaagaatcttgttttcagcagctctgccaccgtttatggcaacccgcagtacctgccactggacgaggcccacccaaccggagggtgcacaaatccctatggaaaaagtaagttttttatcgaggagatgatccgcgatctgtgccaggcagataagacctggaacgccgtcctgttgcggtactttaacccaacaggagctcacgcaagtgggtgtattggtgaggacccacagggaattcctaataacttgatgccttacgtgtctcaggtggccatcggacggcgcgaggctctgaatgtgtttggcaacgattacgacacggaggacgggaccggcgtgcgcgattacatccacgtagttgatctggcaaagggtcacatcgccgccctccggaagttgaaagagcagtgcggctgcagaattccctacaaggtggtggcacgacgcgaaggtgacgtggccgcttgctacgcgaatccatccttggctcaggaagagttgggctggacggcagccctggggcttgatagaatgtag

SEQ ID NO: 139980 - DNA, 585 bp, Artificial Sequence
  Description of Artificial Sequence: Synthetic coding sequence
atggcggaaaaagttcttgtgacgggcggcgcaggctacatcggatcgcacactgtgttagagttgctcgaagccggctatttgccagttgttattgacaacttccacaacgcttttcgcgggggtgggtccctgccagagtctcttcggcgcgtccaggaactgacaggaaggagcgttgaattcgaagagatggatattttagatcagggcgctctgcagcgacttttcaaaaaatattccttcatggctgtgatccacttcgctggacttaaggcggtgggagagtccgtacagaaacccctggactactaccgcgtgaacctgacaggaactatccagctccttgagattatgaaagcccatggggtgaagaacctggtcttttcttcttctgcaactgtgtacggtaacccacaatatctgccactggatgaagctcatccaaccgggggctgtacaaatccctacgggaagtcaaagtttttcatcgaagagatgattagagacctgtgtcaggcagacaagacctggaacgctgttcttttgcgctacttcaatcccacgggcgcgcacgctagctag

SEQ ID NO: 139981 - DNA, 327 bp, Artificial Sequence
  Description of Artificial Sequence: Synthetic coding sequence
gtcgcaattgggcgacgcgaagctctcaatgtgtttgggaacgactacgacactgaggatgggactggcgttcgggattacatccatgtggtggacttagccaaggggcacattgcggccctgaggaaactgaaggaacaatgcggatgtaggatcccatataaggtggtggctcggagagaaggagatgtggctgcgtgctatgcaaacccttctctggcacaggaagaactggggtggaccgccgctctgggcctcgacaggatgtgtgaagatctgtggagatggcaaaagcagaatcctagcgggtttggaactcaggcctag

SEQ ID NO: 139982 - DNA, 1119 bp, Artificial Sequence
  Description of Artificial Sequence: Synthetic coding sequence
atgaagtacctgaggcatagacgtccaaatgcgacgcttatcctcgccattggggcctttacactgctcttgttctctctgttggtttctccaccaacatgtaaagtgcaggagcagcctccagcaatcccagaggctctggcctggccaactccaccaacgcgtcccgctcccgccccctgccatgcgaacacctctatggtgacccaccccgacttcgccactcagccacaacatgtccagaatttccttttataccgacactgcaggcattttcccctcctgcaagatgtgcctccatccaaatgcgcccaacccgtgtttcttcttctggtgataaagtcgagtcctagcaactatgtccggagggaattgctgagaaggacatggggcagggagagaaaagtgagggggctgcagcttcgcctgctctttttagtcggcacagcctctaatccacacgaggccagaaaggtgaaccgcttgctggagctggaagctcaaacgcacggcgacatacttcagtgggactttcacgacagtttcttcaatttgaccctgaagcaagtgttattccttcagtggcaagaaacaaggtgtgctaacgcgtcttttgttcttaacggcgacgacgacgtgtttgcacatacagacaacatggtgttctatctgcaggatcacgacccagggagacacttattcgtgggccagcttatccagaatgttggacctatcagggccttctggtctaaatattacgtgcccgaggttgtaacacagaatgaacggtaccctccttattgcggtggcggcggattcctgctaagtcgtttcaccgccgccgctcttcgtcgggccgcacacgtgctcgatatcttccctatcgacgatgtatttctgggcatgtgcctcgaattggaaggcctcaagccagctagtcacagtgggatccgtacctccggcgtgcgcgctccctcacagcgcctttccagctttgatccctgcttttatagagatctgctacttgttcaccgcttcctgccttacgagatgctactaatgtgggacgcactaaaccagcccaatcttacatgcggtaatcaaactcagatatactag

SEQ ID NO: 139983 - DNA, 1137 bp, Artificial Sequence
  Description of Artificial Sequence: Synthetic coding sequence
atgctgccccctcagcctagtgccgcacaccaggggcgaggcggtaggtcagggctcctgcctaagggtccagctatgctgtgtagactgtgctggctggtgtcatactcgctggcggtgcttctcctgggctgccttctgttcctgcggaaggcagctaagcccgccggggacccaacggcccaccagccgttctgggcccccccaaccccccgacattctcgctgtcccccaaaccacaccgtgagctccgcttccctctccctgccctctaggcacaggttgttcctgacataccggcattgtcggaatttctcaatcctcctcgaaccatccggatgcagtaaggatacatttcttctgcttgcaattaagagccaaccagggcatgtggagcgcagggccgccatcagaagcacttggggcagagttgggggctgggcgcggggcagacagttgaagcttgtgttcttgctgggcgttgctggcagcgcacctcctgcccagttgttagcatacgagtcccgggagttcgatgacatactgcagtgggatttcaccgaggactttttcaacttaaccctgaaagagctccacctgcaacgatgggtggtggctgcctgcccccaggcccacttcatgctgaagggcgatgatgatgtctttgtgcatgtgcccaatgtactggagttccttgatggctgggacccggcccaggacctgctagtgggtgacgtaatccgccaagccttgcccaaccgtaataccaaggttaagtacttcatccctccttccatgtatcgggctacacactacccaccctatgccggaggaggaggttatgtgatgtccagagcaacagtccgacgcctgcaggccatcatggaggatgccgaattattcccaatcgacgacgtatttgttggaatgtgcctccggagactgggactgtcccccatgcatcacgcaggattcaaaactttcggtattagacggcctctggatccacttgacccttgtttgtatagaggcttattgcttgtgcatcggctatctcctcttgagatgtggactatgtgggcccttgtgacggatgagggtttgaaatgcgcagctggccctattccacagagatag

SEQ ID NO: 139984 - DNA, 1062 bp, Artificial Sequence
  Description of Artificial Sequence: Synthetic coding sequence
atgctttgcaggctgtgctggttagtttcttattcactcgccgtgctcctgttaggttgcctgttgtttctccggaaggccgctaaacccgccggagaccccacagcccatcagccattttgggccccacctactccccgccacagtagatgcccgcctaaccataccgtatcttccgcaagcctctcactgcccagccggcataggctctttctgacatacagacactgccggaacttcagcatccttctggaacctagcggctgttcaaaggatacgtttctgcttctggccataaaatcacagcctggacacgtggaacgcagggcagctatccggagcacctggggccgggtgggaggatgggctcgtggacggcaactcaaactggtgttcctcctaggcgtggccggcagtgcgccccctgctcaactgctggcctatgagtctcgggagttcgatgacatcctacagtgggactttactgaagatttttttaacctgaccttaaaggagctgcatttacagaggtgggtggtggccgcctgtccccaagctcatttcatgctgaaaggtgatgacgatgtattcgtgcacgtacccaacgtgctggagtttcttgacggctgggatcctgcacaggacttactcgtgggtgacgttatccgccaggccttgccaaatcgaaatactaaggtcaaatatttcatcccaccctctatgtaccgcgccacgcactatcccccctatgccgggggtgggggctatgttatgtccagggccacggtgaggcggctgcaagccataatggaggacgcggagttgttcccgatagatgatgtatttgtcggaatgtgtctgcgacggcttggcttgagcccgatgcaccacgcaggcttcaaaacgttcgggatccgccggcctcttgatcccctagatccttgtttgtaccgcgggctcctccttgtgcatcgcctgagccccctggaaatgtggacaatgtgggcccttgtaactgacgaggggcttaagtgcgctgccgggcctatcccacagagatag

SEQ ID NO: 139985 - DNA, 1062 bp, Artificial Sequence
  Description of Artificial Sequence: Synthetic coding sequence
atgctttgccgactgtgctggctggtgagctactctctggcagtgttgttgctaggctgccttcttttcctgcggaaagctgccaaacctgccggggacccaactgcccaccaacccttctgggcaccccccacgccaaggcacagtagatgtccacccaaccatacagttagctccgcaagtctttccctgccaagcagacatcgtctttttctaacctaccggcattgtcgtaacttctctattttactggagccctcaggatgttctaaagatacgtttctgctgctcgccataaaatcccagccagggcatgtcgaaagacgagccgctataaggtcaacgtggggccgcgtgggcggctgggcaagaggtcgacagctcaaactggtctttctgttgggggtagcaggatccgcccccccggctcagctgctggcctacgaatctagagagttcgatgatattcttcaatgggattttactgaggatttttttaacctaactttgaaggaactacatctgcagagatgggtggttgcagcgtgtccacaggcccatttcatgctgaaaggggacgacgacgtgttcgtccacgtgcctaacgtgctcgaatttctggacggatgggaccccgcacaagatcttctcgtgggtgacgtgattagacaggctctccccaataggaataccaaggttaaatactttatccctccctccatgtaccgggctacacattatcccccatatgctggaggtggggggtacgtcatgtcccgcgctacagtgagacgcctgcaggccattatggaggacgccgagctatttcctattgacgatgtgtttgtcggtatgtgcttacgacgcttgggcctgtcgcccatgcaccacgccggctttaagacctttggcataagacggcctctggaccctctggatccttgcctctatcggggtttactcctggtgcacaggctgtcccctttagagatgtggaccatgtgggcactcgtcactgacgaaggcctaaaatgtgccgcgggaccaattccgcagcgctag

SEQ ID NO: 139986 - DNA, 1485 bp, Artificial Sequence
  Description of Artificial Sequence: Synthetic coding sequence
atgtttgagatcaagaagatctgctgtatcggggctgggtatgtcggcgggcccacatgcagcgtgatagcccacatgtgccctgaaataagggttacggtggtggatgttaatgaaagcagaatcaacgcctggaattcccccactctgcctatttacgagccaggactgaaagaggttgtggaaagttgtagaggaaagaacctttttttttccacaaacatcgacgatgccatcaaggaagcggatctcgtgttcatatctgtcaacacccctactaagacatatggtatggggaagggcagagcggcagatctgaagtatattgaggcctgtgctaggaggatagtacagaatagtaacgggtataagattgtgaccgaaaagtctaccgtcccagttagggccgcagagtcaattcggagaatctttgatgccaatactaaacccaatttaaatctgcaggttttgtctaacccagagttccttgccgaaggaactgccatcaaggatctcaaaaaccctgacagggtgctgattgggggtgatgaaacaccagagggccagcgcgccgttcaggcactgtgtgctgtgtacgagcactgggtgccaagagaaaagattcttacaactaatacctggtcctcggaactctctaagctggccgctaacgcattcctcgcccaaagaattagcagcataaacagtatctccgccctgtgcgaagctaccggagcagacgtggaagaggtagccaccgcgatcgggatggatcagcgcatcgggaataaattcctgaaagcatccgtgggctttgggggttcctgtttccagaaggatgtgctgaatctagtctacctgtgtgaggccctcaacctccccgaggttgcgagatattggcagcaagtaattgatatgaacgattatcagaggcgacgattcgcatcccgcattattgattctctttttaataccgtgaccgacaaaaaaatcgcgattctgggcttcgcgtttaagaaagacacaggggacactagagagagcagtagcatatacatttcgaaatatctcatggacgagggggcacatctgcacatttatgacccgaaggtacccagagagcaaattgtggtcgacctgtcacaccccggtgtgagcgaggacgatcaggtgagcaggctggtaacgatcagcaaagatccgtacgaggcctgcgacggggctcacgccgtggttatctgcacagaatgggacatgttcaaggagttggactatgagcgaatccacaaaaaaatgttgaaaccagccttcatttttgacggccgtcgggtcctcgacggactccacaatgagctgcagactatcggcttccagatagagacaatcggcaagaaggtgtcatctaagaggatcccctacgcaccgtctggggagatccctaaattcagcctccaggacccccctaataaaaagcctaaggtgtag

SEQ ID NO: 139987 - DNA, 1284 bp, Artificial Sequence
  Description of Artificial Sequence: Synthetic coding sequence
atgtttgagattaaaaaaatttgctgcattggggctgggtatgtggggggaccgacctgtagtgtgatagcccacatgtgccccgaaattagggtgactgttgtggacgtgaacgaatcacgtattaacgcctggaatagtccgaccttgcccatttatgaacctggactgaaggaggtggtggaatcatgcagaggaaaaaacctatttttctccacaaacatcgacgacgctataaaggaggctgacctggtctttatctcagtgttgagcaatccagagtttcttgcagaaggcaccgccatcaaggacctgaagaatcccgatagagtcttgattggcggcgatgagacaccagaaggccagcgagccgtgcaggcgctgtgtgctgtctacgaacattgggtaccaagggaaaagatcctgactacaaatacctggtcgtccgaactcagcaagctagctgctaacgcttttttggcacaacggatctccagcatcaattctatcagcgccctttgcgaagccacaggcgcagacgtggaggaggtggctacagccattggaatggatcagagaataggaaataagtttttgaaggcgtccgttggattcgggggttcatgctttcagaaggacgtcctgaacctggtgtatctgtgtgaggccctgaatctgccagaagtggctcgctattggcaacaggtgattgacatgaatgattaccagcgcagaaggttcgccagtagaattatcgactctttgttcaacaccgtgacagacaagaagatcgcgatactgggttttgcctttaagaaagatacaggtgataccagagagtcttcttcaatttacattagtaagtatctgatggacgaaggcgctcatctgcatatatatgaccccaaggtcccccgagagcaaatagttgtcgatttgagccatcctggagtgtccgaggacgatcaagtttcccggctagtgactatctccaaagatccttacgaagcttgtgacggagcccatgccgtggtcatttgtacagagtgggatatgtttaaagagctggattatgaaagaatccataagaaaatgctgaagcctgcatttatatttgacggcagaagagtcctggacggcctgcataacgagctccagacgatcggattccaaattgaaaccatcggaaagaaagtgtcttctaagaggattccctacgctccttctggagagataccgaaattcagcctccaggatcccccgaacaagaagcctaaggtttag

SEQ ID NO: 139988 - DNA, 168 bp, Artificial Sequence
  Description of Artificial Sequence: Synthetic coding sequence
atgttcgagatcaagaagatttgctgtattggagccggttatgtagggggtcccacttgtagcgtcattgcgcatatgtgtccagagattcgagtgaccgtcgtggacgttaacgagtctcggatcaacgcttggaacagcccaacactccctatttatgaggattag

SEQ ID NO: 139989 - DNA, 258 bp, Artificial Sequence
  Description of Artificial Sequence: Synthetic coding sequence
atgttcgagatcaagaagatatgctgcatcggcgctgggtacgtgggtggccccacatgttcagtgattgctcacatgtgtcctgagattcgggtgactgtagtggatgtcaatgaatctagaattaacgcttggaactctcctacgctcccaatatacgaaccgggacttaaagaagtggtggagtcatgccgggggaaaaatctcttcttctctacgaacatcgacgacgccattaaagaagccgatcttgtttag

SEQ ID NO: 139990 - DNA, 1485 bp, Artificial Sequence
  Description of Artificial Sequence: Synthetic coding sequence
atgtttgagattaaaaagatctgctgcattggggctggttacgtcgggggccccacgtgttcagtgatcgcgcatatgtgtcccgagatccgcgttacggtggtggacgtcaacgagagcaggattaacgcatggaattctcctacactgcctatctacgagccaggcttgaaagaggtagtggaatcctgtcgcggaaaaaacctgttcttctccacaaacatcgacgatgcaatcaaagaagccgatctggtgtttatttctgttaatacccccaccaagacttatggaatgggcaaaggacgggctgctgacctcaagtacatagaggcctgtgccaggcggatagtgcagaactctaatggctacaagattgtgaccgaaaagtccacagtgcctgtcagagcagctgagtccatacgaaggattttcgatgcgaatacaaagccgaaccttaatctgcaggtgttgagtaaccctgagttcctcgccgaaggaacagccattaaggatttgaagaatcccgatcgggtgctaatcggaggcgacgagacccccgagggacagcgggctgtacaggctctttgtgcagtttacgaacattgggtgccacgcgagaagattctgaccaccaacacatggtcaagcgagctctcaaaacttgcggctaatgccttcttggctcaacggattagctcgatcaatagtattagcgccctctgcgaagcgaccggtgccgacgtagaggaggtcgccaccgctattgggatggatcagaggatcgggaataagtttctgaaagccagcgtgggctttggcggtagttgcttccagaaagatgtcctgaaccttgtatacctgtgtgaagccctcaacctgccagaagttgcaaggtactggcagcaagtcattgacatgaacgattatcagaggcggagattcgcctccagaatcatcgatagtctctttaatacagtcacagacaagaaaattgccatcctagggttcgcttttaagaaagataccggggacactcgcgagtcatcaagcatctatatatccaagtatctcatggacgaaggcgcccacctccatatatacgacccgaaggtccctagggagcagatcgtggtagatctgtcgcatcctggagtgtccgaagatgaccaggtgagtaggctggtgaccatcagcaaagatccatatgaggcctgtgacggagcccacgctgtggtgatttgcacagagtgggacatgttcaaagaacttgattatgaacgaatccacaaaaagatgctcaagcccgcctttattttcgacggccggcgcgtcctcgatggtctgcacaacgaactacagacaatcggattccagatcgagaccatcggcaaaaaggtctcatccaaacggattccatacgctccgagcggagaaattccgaaattttcactgcaggaccccccaaataagaaaccaaaagtttag

SEQ ID NO: 139991 - DNA, 1194 bp, Artificial Sequence
  Description of Artificial Sequence: Synthetic coding sequence
atggggaagggaagggctgcagatctgaagtacatagaagcatgtgccaggcgtatcgtgcagaacagcaacggatacaaaatcgtgaccgagaaaagtaccgtgcccgtcagagctgcagagtcaatccgcaggattttcgatgccaacaccaaaccaaacctaaaccttcaggtgcttagcaaccccgagttcttggccgaaggtaccgccatcaaggacctcaagaatccagaccgtgtgctcatagggggggatgagacaccagaagggcagagggctgtgcaggcgctatgcgccgtctatgaacattgggtgcctcgtgagaagattcttaccaccaatacatggtcgtctgagcttagcaaactggcggccaacgccttcctcgcacagagaatttcctccatcaattccatttccgcgctttgtgaagcaactggagcggacgtggaggaagtggccactgccataggtatggaccagaggattgggaacaaattcctcaaagcttcagtcggctttggaggctcctgctttcagaaggatgtgttaaacttggtttacctttgcgaagctctgaatcttccagaggtggcacgctactggcaacaagtgatcgatatgaacgactatcaacgcaggcggttcgcaagtcggataattgattccctgttcaacacggtgacagacaagaaaatcgccatcctgggattcgccttcaaaaaggataccggcgacacccgagaatcctcatcaatatacatttctaagtaccttatggatgaaggcgctcacctgcacatctacgacccaaaagtgccccgtgaacagattgtcgtagacttaagtcaccctggagtgtcagaggacgatcaagtgtcccgtttggttactatttccaaagacccttatgaggcatgtgacggcgcccacgcagttgtgatttgcacggagtgggatatgttcaaggaactggattacgagcggattcacaagaagatgttgaaacccgcatttattttcgacgggagaagagtcctggacgggctgcataacgagttgcagaccatcggatttcagatcgaaacgattggaaagaaagtatcttcgaagaggatcccgtacgcaccctctggcgagatccctaagttctccttgcaagacccgccaaataaaaaacctaaagtttag

SEQ ID NO: 139992 - DNA, 393 bp, Artificial Sequence
  Description of Artificial Sequence: Synthetic coding sequence
atgtttgaaattaagaagatttgttgtattggcgcggggtacgtggggggtcccacctgcagcgttatcgcgcacatgtgcccagagattagagtgacggtggtcgacgttaacgaaagcaggattaacgcatggaattcaccaacactgcccatctacgagcccggccttaaagaagtggtcgagtcgtgccggggcaagaacctgttcttctccacgaacattgacgatgccatcaaagaggccgatttagttttcatctccgtcaacacccctaccaagacctatggcatggggaaggggcgagccgccgacctaaaatacatcgaagcatgcgccagacgaatcgtccagaatagtaacggctacaaaatcgtcactgaaaaaagctag

SEQ ID NO: 139993 - DNA, 162 bp, Artificial Sequence
  Description of Artificial Sequence: Synthetic coding sequence
atgtttgagatcaaaaagatttgttgcataggagcaggctacgtcggcggcccaacctgctctgtcatcgctcatatgtgcccagaaatccgagtgactgtggtggacgtcaatgagtcgaggataaatgcttggaatagtcccaccttgcctatctattag

SEQ ID NO: 139994 - DNA, 168 bp, Artificial Sequence
  Description of Artificial Sequence: Synthetic coding sequence
atgttcgagatcaagaagatctgttgcattggagcggggtatgtgggcggtcctacctgttctgttatagcacatatgtgccctgaaataagggtcactgttgtagacgttaacgaaagcaggataaatgcctggaactctccaaccttgcccatctatgaggattag

SEQ ID NO: 139995 - DNA, 462 bp, Artificial Sequence
  Description of Artificial Sequence: Synthetic coding sequence
atgtttgaaattaagaagatctgttgtatcggtgcagggtacgtcggcggccccacatgcagcgttatagctcacatgtgccctgagattcgggtgaccgtggtggacgttaatgagagtcgcattaacgcatggaattctccgactctccccatctacgaacctggactgaaggaggtggttgagtcatgtcgcggcaagaacttgtttttctccaccaacatagacgacgccataaaagaggcagatctcgtgtttatatcagtgaacacacctaccaagacttacggcatggggaaaggccgagccgccgatctgaaatacattgaggcctgtgcaaggcggatcgtgcagaatagcaatggctacaagatcgtcacagaaaagtccacagtgcccgtgcgagcagccgaaagtattaggcgtatattcgatgctaacaccaagccgaacctgaattag

SEQ ID NO: 139996 - DNA, 546 bp, Artificial Sequence
  Description of Artificial Sequence: Synthetic coding sequence
atgtggtcatctggcctactgatccaggacagtaccattatgtttgagataaagaagatctgttgtattggtgctgggtatgtcggcgggcctacctgttcggtcattgcccatatgtgtccagagatcagagtgaccgttgtagacgtgaacgagtcaagaattaatgcgtggaacagtcccacactccccatctatgagcccggcctcaaggaagtcgtcgagagttgtaggggcaaaaaccttttcttctcaaccaacatcgacgatgcaattaaggaagcggatcttgttttcatttcagttaacacccccaccaagacctacgggatgggtaaaggccgggcagcagatcttaaatatattgaggcctgcgccagaaggatcgtccaaaattccaatgggtacaagatagtgactgagaagtcaactgtgcccgtaagggcggcagagtcaatcagaagaattttcgacgccaatactaagcctaacttgaatctgcaagtgctgagcaacccagaatttctggcggagggaaccgcatag

SEQ ID NO: 139997 - DNA, 1185 bp, Artificial Sequence
  Description of Artificial Sequence: Synthetic coding sequence
atggcgctgttggacctggctctggaaggcatggccgtgttcggcttcgtgctgttcttggtgctttggctgatgcatttcatggccattatttacacgaggttacacttaaataagaaggcaactgataagcagccatacagcaagctgccaggggtgagtctactgaaacctttgaagggggtcgatcccaacctgataaataatctcgagaccttctttgagctggactacccaaaatatgaagtgctgctgtgcgttcaggaccatgacgatccagccattgacgtttgcaaaaaattgctcggaaagtacccgaatgttgacgctcggctttttattgggggcaaaaaggtgggcatcaacccgaaaattaacaacctgatgccgggttatgaggtagcaaagtacgaccttatatggatttgtgactcaggtattcgggttattcctgacactttaacggatatggtgaatcaaatgacagagaaggtcggactggtgcatggccttccatatgtcgccgaccggcaagggttcgcggctaccttggagcaggtgtacttcggaacatcccaccctaggtattatatttcagcaaacgtgaccggctttaaatgtgtgacaggaatgtcatgtttgatgagaaaggatgttctggatcaggccggaggtctgatcgcctttgcccaatacatagccgaagactattttatggctaaagccatagccgataggggatggcggtttgctatgagcactcaggtggcaatgcagaatagtgggagctattccatctcacagttccagtcccgtatgatcaggtggactaagttacgaataaatatgctgcctgccaccatcatatgtgagccaatcagcgagtgtttcgtcgcttcgttgattatcggctgggctgcacatcacgtcttccgctgggacattatggtcttttttatgtgtcattgtctagcatggtttatttttgactatattcagttgcgcggcgtgcagggtgggactctgtgcttcagtaagcttgattacgcagtggcatggttcatacgcgaatctatgacaatctacatcttccttagtgcactgtgggatcccacaattagctggcggacaggccgctaccggctgagatgtgggggcacagccgaggaaattttagatgtctag

SEQ ID NO: 139998 - DNA, 4668 bp, Artificial Sequence
  Description of Artificial Sequence: Synthetic coding sequence
atgggctgcaagggagacgcttcaggggcttgcgccgcaggggcattgcccgtgacgggcgtttgctacaagatgggagtattggtcgtgctcacagtcttgtggctcttctcgtcagtcaaggcagattctaaagccatcactacaagcctgactaccaagtggttctcaactccactgctgcttgaagcctccgagtttctggctgaagatagccaggaaaagttctggaatttcgttgaggcgagccagaacatcgggtcttctgatcacgacggaaccgactatagctactatcatgctatattagaggctgcattccagttcctcagtcctttgcagcagaacttgtttaaattttgtctgtccctgaggtcctatagcgccactatccaagctttccagcagattgcggctgacgagcccccccccgagggttgcaacagcttcttttcagtacatggcaagaagacttgtgagagcgacacacttgaggcactgttgctgaccgcctctgaacgacctaagccactgctcttcaaaggtgaccatcgatacccctcatccaatcccgagtcccccgtagttattttttacagtgagatcggcagtgaggaattcagtaattttcacagacagctgatttccaagtcaaatgcaggcaagatcaattatgtgttccggcactatatcttcaaccctcggaaggaacccgtctatctttctggatacggcgttgaactggcaattaagtcaaccgagtacaaagccaaagatgatacccaggtcaagggcacggaggtgaacaccaccgtgataggggagaacgatcccattgatgaagtccaaggctttttattcgggaagcttcgggacctccaccccgacctggagggccagttgaaagagctgagaaagcacctggtggaatcaaccaatgaaatggccccactcaaagtgtggcagttgcaggacttgagcttccagactgccgctagaatcctggcaagcccagtggagctggccttagtcgtcatgaaagacctttctcagaacttcccaactaaggcccgagccataactaagacagctgtgagttcagagctccggaccgaggttgaggaaaatcagaagtacttcaaaggcacattgggcctgcaaccaggagatagcgccctgttcatcaatggcttgcatatggacctggacacacaggacatcttttccttatttgacgttctgcgaaacgaggcaagagtgatggaaggacttcaccgcctgggcatcgaaggtctgagtctacataatgttctaaaactcaatatacaacctagcgaggcggattacgctgtggacatcagatcgcctgccatttcctgggttaacaatttggaagtagactcgcgatataactcctggcccagttcactgcaggagttactgcgacctacctttcctggcgtgattcgccagattaggaagaacctgcataacatggtatttatagtggatcccgctcacgagactaccgccgaattgatgaatactgccgagatgtttttgtccaatcacatccccctccgcattggattcattttcgtagttaatgacagcgaagacgtggatggaatgcaggacgccggggtggcagtgcttagggcgtacaattacgtggcccaggaagtcgatgactaccatgctttccagaccctgactcacatatacaacaaggtcagaaccggcgaaaaggtaaaagtggagcatgtggtgtccgttcttgagaagaagtacccatatgtcgaagtgaactccatactcgggatagacagcgcttatgataggaacagaaaggaggccagaggttattacgagcagaccggagttggccccctgccagtggtcctcttcaacggcatgcccttcgagagggagcagctcgatccagatgaactggagacgatcacaatgcataagatccttgagacgaccacctttttccagcgcgcggtgtatctcggtgaacttccacacgatcaggacgtggtggaatatatcatgaaccagccaaacgttgtcccacgcattaatagcagaatcctcacagccgagcgggactacttggatctgaccgcctccaacaactttttcgtggatgactatgcacgctttacaatcctcgacagtcagggaaaaacagctgccgtggctaactccatgaattacctgacaaagaaaggaatgtcctccaaagaaatctacgacgactcctttatcagacccgtgacgttctggattgtgggagatttcgactccccctccggacggcaactgctgtacgatgccatcaagcaccagaaaagctctaataatgtcagaatctccatgatcaataacccagctaaagagatatcatacgagaatacgcagatatcaagggccatatgggccgcactgcagactcaaacatccaacgctgcgaaaaattttattactaaaatggcgaaggagggagcagcagaggccctagctgcaggggcggatatagccgaattttcggtgggtggcatggactttagtctttttaaagaggtgtttgaaagtagtaagatggattttatcctgtcacacgccgtttactgtagagatgtccttaaattgaaaaaaggtcagagagcagtcatctctaatggacgtataatcggccccctagaggattctgaactgtttaaccaagacgattttcacctccttgagaacattattttgaaaacgtcaggccaaaagattaagtcccacatccagcagttgagggtcgaagaagacgtggcctcggaccttgttatgaaggttgacgcacttttgtccgcccagcccaagggcgacccacggattgaatatcagttcttcgaggacagacacagcgcgatcaagctgaggcccaaagaaggggagacatatttcgacgtggttgctgtggtcgacccagttacacgggaagcgcaacggttggcacccttgttactcgtcctcgctcagctgattaatatgaacctgcgggtgtttatgaactgccagtcaaagctgagcgatatgcctctgaaaagtttttatagatacgttctcgaaccagagatatccttcactagtgacaactcattcgccaaaggccctattgccaaattcttagatatgcctcagagccccttattcaccctcaatctgaatacccccgagtcatggatggtcgagtccgtgcgtactccgtacgacctagataatatctaccttgaggaagttgatagcgttgtggcagctgaatatgaactcgagtatttgcttctcgaggggcattgctacgatattaccacgggtcagccaccaaggggacttcagttcaccctgggcaccagcgccaaccctgtgatcgtggacactattgtcatggccaaccttgggtattttcagctcaaggcaaaccccggagcctggattctgcgcttgcggaaaggcagatccgaggacatttatcgaatttactcccacgacggcacagatagtcctccagacgcagatgaggtggtgatcgtccttaataacttcaagagtaagatcatcaaagtgaaagtgcagaaaaaagcagacatggtcaatgaggacctgttgtccgatggcaccagcgagaatgagagcggattttgggacagttttaagtggggcttcaccggccagaagacagaggaagtcaagcaagataaagacgacattataaacattttctccgttgcaagcggacatctgtacgagaggtttctgaggataatgatgctgtcagtccttaaaaataccaaaactcctgttaagttttggttcctgaaaaattacctcagcccaacttttaaggaatttatcccttatatggcgaacgagtacaacttccagtacgaattggttcagtataaatggcccaggtggcttcatcaacagacagagaagcagcgaattatttggggatataagattctgtttctggacgtgctgtttcctctagttgttgacaagttcctgttcgtggacgctgatcaaatagtgcgcaccgacctcaaagagctgcgggacttcaacctcgacggagcgccctatggttatactcccttttgtgactcacgacgagaaatggacggatatcgcttctggaagtccggatactgggctagccatctggcagggcgaaagtaccatatctctgctctgtacgtcgttgaccttaagaaattcagaaaaatcgctgccggcgatcgtttgcgggggcaatatcaggggttgtcacaggacccaaatagtctcagcaatctggatcaagatctgccaaacaacatgattcatcaagttccgatcaagagtctcccccaagagtggctttggtgtgaaacatggtgcgacgacgcctccaagaaacgggctaaaacaatagacctttgtaacaatccaatgactaaggaacctaaactggaagccgccgtgagaatcgttcccgagtggcaagactacgaccaggagataaagcaactccagatccgctttcagaaagaaaaagagaccggtgcgctctataaagaaaagacgaaggagccctcacgtgagggtccacagaagagagaagaattgtag

SEQ ID NO: 139999 - DNA, 4596 bp, Artificial Sequence
  Description of Artificial Sequence: Synthetic coding sequence
atgggggtcctggtggtgctcacagtgctatggcttttctcatccgttaaggcggactctaaagccatcaccacatcattgacgaccaagtggttctccaccccattgctgttggaagcatccgaattcttggctgaggatagtcaggagaagttctggaatttcgttgaggctagccagaacatcggcagctccgaccatgatggcaccgattactcttactaccatgccatcctggaagctgcattccagtttcttagtcctctgcagcagaatctcttcaagttctgtctctcccttcgatcatattcagccacaatccaggcatttcaacagattgccgcagacgaaccccctcctgaggggtgtaactcttttttcagtgtgcacgggaaaaaaacctgtgagagcgataccctggaggccctcctactgaccgcctccgaacgccccaagccgttgctgtttaagggtgatcaccgatatcctagcagcaacccagaatcacccgttgttatcttttatagtgagattggcagtgaggagtttagcaatttccacagacagcttataagcaaaagtaatgccggcaaaattaactacgtgtttaggcattatatctttaacccgcgaaaggaaccggtgtacctaagcggatacggcgttgaattagctatcaaatccactgagtataaggccaaagatgatacccaggtcaaagggacagaagttaatactacagttatcggcgagaacgaccctatagacgaggtacaaggcttccttttcggaaagctcagggatctgcacccggacctcgaggggcagctaaaagagctccgtaagcacctcgtggagtcaacaaatgagatggcccccctgaaagtttggcaactccaggatttgagctttcaaaccgccgcaagaattttagcatcacctgtggaattagcgctggtggttatgaaggatctttctcaaaatttcccaacgaaagcccgggctattacgaaaaccgcagtgtcctcggagctgaggactgaagtagaggagaaccagaaatattttaagggcacactcgggctccagccgggtgattccgccttatttataaacggacttcacatggatctggacacacaggacattttttctctgtttgacgtgctccgcaacgaggccagagtaatggagggcctccacagactgggaatcgaaggattatcactccataacgtgctgaagttgaatatacagcctagcgaagctgattacgccgtcgacattcgtagcccggcaatctcctgggtcaacaatctggaagttgattccagatataattcttggcctagctcattgcaggagcttctacgacctacgtttccaggggtgattcggcagatcaggaaaaacctacataacatggtcttcatcgtagatccagcccacgaaaccacagcagaactgatgaataccgccgaaatgtttctgagcaatcatattccacttaggataggctttattttcgttgttaacgacagcgaggacgtagatggcatgcaggatgccggagtcgccgtgctcagagcttacaactatgttgctcaggaggtggatgattatcacgcctttcagacgctaacgcacatttataataaggtgcggactggagaaaaggtgaaggtggagcatgtggtgtcagttctggaaaaaaagtatccttacgttgaagtgaactccattctgggcattgacagcgcctacgaccgcaacagaaaggaggcacgaggatattatgaacaaacaggagtaggaccactacccgtagtgctgtttaatggcatgcctttcgagcgcgaacagctcgaccccgatgagttagagaccattaccatgcataaaatcctggaaactacaaccttcttccagcgcgcagtgtatctcggagagctgcctcatgatcaggacgtagtggagtacatcatgaaccagcctaatgtggtcccccggattaacagtcgcattctcactgctgagagggactatctagatttaaccgctagtaataattttttcgtggacgattatgcgaggttcacaatcttggactcccaaggcaaaaccgctgcagtggccaacagcatgaactatctcactaaaaaggggatgtcttccaaggagatttatgatgacagcttcattcgacctgtcacattttggatcgtgggagacttcgattctccctcaggacgccagttgctttacgacgctatcaaacatcagaaaagctcaaacaacgttagaatttctatgatcaacaacccagcaaaggagatttcgtacgaaaatacacagatcagtagggccatctgggcggcgttacagacacagaccagtaatgctgctaagaatttcatcactaaaatggctaaagagggtgccgccgaagcattggctgcaggagcagacattgccgagtttagtgtgggaggaatggacttctctctatttaaggaggtctttgagtcaagtaaaatggacttcattctgagccacgctgtgtactgccgagacgttcttaaactcaaaaaaggacaaagagccgtgatcagcaatggcagaataataggtcctcttgaggattctgagctgttcaaccaagatgattttcatttgttggagaacatcatcctgaagacaagcggtcagaagattaagagtcatatccagcagttacgtgtggaggaggatgtggcctctgacctcgtaatgaaggttgacgccctgctcagtgcccagcccaaaggcgatccccgaatcgaataccaatttttcgaggatcggcactccgctatcaagctgcgccctaaggaaggggaaacctattttgacgtggtagctgtcgtggaccccgtgacccgggaggctcagaggcttgctcctctcctacttgtactcgcccagctcataaatatgaacctaagagttttcatgaattgccagagcaagttatcagatatgcccctcaagagtttctataggtatgtgctggagccagaaatttctttcacatctgacaactccttcgccaaaggccccatcgccaaatttttggatatgccccagtcccctctgttcactctgaatctcaatactcctgagtcgtggatggtggagagtgtgcggactccctacgatctcgataatatctatcttgaggaagtggatagcgtggttgcagccgagtacgaactggaatatctgctgttggagggccactgctacgatattacaaccggccagccaccaaggggtctacagttcaccctgggcacatccgctaatcccgttatcgtcgacacaatcgtgatggctaatctcggctactttcagctgaaggcaaaccctggtgcctggatacttcggctacgcaagggccgcagcgaggacatttacaggatctatagccacgacggaactgactcacctcccgatgccgacgaggtggttatcgtgctcaacaatttcaaaagtaaaataattaaagttaaggttcagaaaaaagccgacatggtcaatgaggacctgttgtccgacgggacatcagaaaacgagtccggattctgggattcgttcaaatggggatttaccggacagaaaaccgaggaggtcaagcaggataaagacgacattatcaacattttcagcgtggcatcaggtcacttgtatgaaagatttctgcggattatgatgctaagcgtgctcaagaatacaaaaacaccagtcaaattttggttcctgaaaaactatctgtcgcccacttttaaggaatttatcccgtatatggccaatgaatacaattttcagtacgagctggtgcagtacaagtggccccgctggctgcaccagcagacagaaaagcagcggattatctggggatacaaaattctgtttctggacgtgctattccccctggtggtcgataagtttctgttcgttgacgctgaccagatcgtgcgcaccgacctcaaagagctgcgggacttcaacttggatggcgcaccctacggttacaccccgttctgcgattcgaggagagaaatggatggctacagattctggaagagcggatactgggcttcacacctcgcaggccgaaaatatcatatttccgccctgtacgttgtggatctcaagaagttccggaaaatcgccgcaggggacaggcttcggggtcagtatcaagggctctcacaagatccaaacagtctcagcaacttagaccaagacctgccaaacaacatgatccaccaggttccgattaagtcactgcctcaggagtggctgtggtgtgaaacctggtgtgatgacgccagcaagaagagagccaaaaccatagatctgtgcaacaaccccatgacaaaagaacccaaactggaggcagctgtgcggatcgtcccagagtggcaggattatgaccaggaaattaaacagctgcagatcaggtttcagaaggaaaaagagaccggcgccctgtacaaggaaaagactaaggagcccagtagggaagggccccagaagcgggaagagctttag

SEQ ID NO: 140000 - DNA, 843 bp, Artificial Sequence
  Description of Artificial Sequence: Synthetic coding sequence
atggccccagccaaggccacgaacgtcgttcgtctgttgctgggttctacggctctgtggctctcccagcttgggtccggaactgtcgccgcttccaagtccgttacagcccatctggcagctaaatggcccgagacaccgctcttattggaggctagcgaatttatggcagaggagagtaacgaaaaattctggcagttcctcgagacagtccaagagctggctatttacaaacaaactgaatcagattattcttactacaatctcattctgaagaaggcggggcagttcctggacaacctgcacattaatttgctcaaatttgcattttccattcgggcctattcacctgccatccagatgtttcagcagatcgccgctgacgaaccacctccagatggctgcaatgcttttgtcgtgatccacaagaagcatacatgtaagataaacgagattaaaaaactcctcaaaaaagcggcaagccggacccggccctacctgtttaaaggcgatcataagttccccaccaataaggaaaacttaccagtggtgattctctacgctgagatggggactcgcacattcagtgcctttcacaaagtgctcagcgaaaaggcccaaaatgaagagatcctttatgtgctacgccattacatacaaaagccaagctcaagaaaaatgtatctctccgggtacggagttgagttagcaattaaaagtacagaatataaagctctcgatgacacccaagtgaaaaccgtgaccaacacaacagtggaagacgagactgagaccaatgaggttcaggggttcctcttcggcaagctgaaactggtctactag

SEQ ID NO: 140001 - DNA, 837 bp, Artificial Sequence
  Description of Artificial Sequence: Synthetic coding sequence
atggcccctgctaaagccaccaatgtggtgcggctgctgcttggctccaccgccctgtggctgagtcaactgggctctggcaccgttgccgcctctaagagcgtcaccgcacaccttgccgccaaatggccagagaccccactgcttctggaggcttcagagttcatggctgaagaaagcaacgaaaaattctggcagtttctcgaaacagtgcaggaattagccatctacaagcagactgagagcgactactcatactataatctgattcttaaaaaggctggccagttccttgacaaccttcatatcaacttactcaagttcgcctttagcatccgagcctacagccctgccattcaaatgtttcaacagatagcagctgatgaacctccccccgacggttgtaacgcgttcgtcgtaatccataaaaagcatacatgtaaaataaacgagataaagaaactccttaaaaaggctgctagtcgaacccggccatatctcttcaagggtgaccacaaatttccgaccaacaaagaaaacctgcctgtagtcattctatatgcggaaatgggaactcggacgttctcagcttttcacaaagtactcagcgaaaaggcgcagaatgaggagatcctttatgttctgcggcattatatacagaagccgtcctctcgtaagatgtacttgtctggatacggagtcgagctggcaataaagtccactgaatataaagccttggacgatacccaggtgaaaaccgtgacaaacacgaccgttgaggacgaaaccgagaccaacgaggtgcaggggttcctctttgggaagctaaagagctag

SEQ ID NO: 140002 - DNA, 786 bp, Artificial Sequence
  Description of Artificial Sequence: Synthetic coding sequence
atggctcctgctaaagctaccaatgtggtgcgcctcctgctgggctccacggccttgtggttatctcagttggggagcggtacagtcgccgcctctaagtccgtgactgcacacctggccgctaaatggccagaaaccccactgttgctggaggccagtgagtttatggccgaagaatctaacgaaaaattttggcaattcttggaaaccgttcaggagctcgccatctacaagcagacagagagtgactacagctattacaatctcatcctaaaaaaagccgggcaattcctggataatttgcacatcaacctcctgaaattcgcgttttctatccgagcctattcgccagcaatacagatgttccaacagattgcagccgacgaacctcccccagacggctgcaatgcttttgtggtgatccataaaaagcacacctgcaagatcaacgagatcaaaaaactgctgaaaaaggcagcctcccggacccgaccttacttatttaagggggatcataaatttccgaccaataaggagaatttgcctgtggtgattctgtacgctgagatgggaacaaggaccttttctgcattccataaagttctgtccgaaaaagcccagaacgaagaaattttgtatgtgctgcgccactacattcagaagccatcaagcagaaagatgtacctttcggggtacggcgtggagcttgctatcaagagcacagagtataaagctcttgacgatacacaggtcaaggtattccaagaccctgaagcctttttctag

SEQ ID NO: 140003 - DNA, 4551 bp, Artificial Sequence
  Description of Artificial Sequence: Synthetic coding sequence
atggcccccgctaaggcaactaatgtagtgcgtctactgttgggcagcacagcgctctggctgtcacaacttggatctgggacagtggctgcctccaaatcagtaacagctcatctggctgctaagtggccggaaacgccacttctgctcgaggcaagtgagttcatggccgaagagtccaacgaaaagttctggcagtttctggagacggtccaggagctggcgatctataagcagacggaaagtgattacagctactataacctgatcctgaaaaaagccgggcagtttttagacaaccttcacatcaacttgctcaagtttgccttttccatccgcgcgtacagcccagccattcagatgtttcagcagatcgctgctgatgagccaccaccagatggctgtaacgcattcgtcgtgatacacaagaaacatacatgcaaaattaacgagattaaaaaattgctcaaaaaagcagcaagccgtacccgtccctacttgttcaaaggggaccacaaatttcccacaaataaggaaaacctccccgtggttatcctgtacgccgagatggggacccgaacatttagcgcattccacaaagtacttagcgagaaagcccagaacgaggagattctttatgtgctgagacactacattcagaaaccttccagccgaaaaatgtacctctctggttatggggtcgagcttgccatcaagtcaacggaatataaagcattggacgacacacaagtcaaaaccgtgactaatacgacagtcgaagacgagactgagactaatgaagtgcagggattcctcttcgggaaactcaaggagatctattctgacctgcgcgataaccttactgcctttcagaagtaccttatcgagagtaacaagcaaatgatgccgctcaaagtgtgggagcttcaagacttgagctttcaggccgcctcccagatcatgagtgcaccggtctacgactccataaagcttatgaaggacatctctcagaatttcccaatcaaagccaggtctctcacacgtattgcggtgaaccaacatatgcgcgaagaaatcaaagagaaccagaaggacttgcaggtccgatttaaaatacagccaggcgacgctcggctgtttattaacgggctgcgtgttgacatggacgtttatgatgctttctccatcctcgatatgctgaaactggagggcaaaatgatgaatggcctgcggaatttgggcattaatggcgaagatatgagtaaattcttgaagctgaatagtcacatctgggaatatacgtacgtcctggacatccgtcactcaagcatcatgtggatcaacgacctcgaaaatgacgatctgtatatcacctggcccacctcttgccagaaactgttgaaaccagtcttcccaggtagtgttccctctattagacgaaacttccataacctcgtactgtttattgatccagctcaggaatacactttggactttatcaaacttgccgatgtcttctacagccatgaggtccctcttcgcatcggtttcgtttttattctcaacacggatgacgaagtggatggcgcaaatgacgctggggtggccctctggagggcattcaactatattgccgaggagttcgatatctctgaagctttcatctcaatcgtgcacatgtatcagaaggtgaagaaagaccaaaatatcctgacagtggataatgtcaagtctgtgctccaaaacacctttccccatgccaacatctgggatatcttggggattcattcaaaatacgatgaggaacgcaaggccggggcatccttttacaaaatgaccgggctgggtccgttgcctcaggcgctgtataatggtgaaccatttaagcatgaggagatgaatattaaagaactgaagatggcggtactacagagaatgatggatgccagcgtgtacctgcaaagggaagtgtttctgggaacacttaacgaccggaccaatgccatcgatttcctcatggatagaaacaacgtcgtcccgaggatcaacaccctcattctgcgtacaaatcagcagtacctgaacctcatctctacctctgtaacagctgacgttgaagatttttctacatttttttttctggattctcaggacaaaagcgccgtgattgctaagaatatgtattacctgactcaggacgatgagagcatcatttcggcagttaccctctggattatcgctgacttcgataagccatccgggcggaagctgttattcaatgctttgaaacatatgaagacaagtgttcacagcaggttaggtatcatatataaccccacctcaaaaattaatgaagaaaacactgctatttccaggggtatactggccgcctttctgacacagaagaacatgtttctcagatcattcctcggccagttggccaaggaggagatagctaccgcgatttactcaggcgacaaaatcaaaacattcttgattgaagggatggataaaaatgccttcgagaagaagtataatacggttggagtgaatatctttcgtacacatcagttattctgtcaggacgtcctgaagctaaggccaggtgagatggggatagtttcaaacgggaggttcctgggtcccctcgatgaggatttttacgcagaggacttctatctacttgagaaaatcaccttctcaaacttaggggaaaagattaaaggcattgtggagaacatgggaataaacgcaaacaacatgtccgattttataatgaaggtggacgccttgatgagttccgttcctaagagggcaagcaggtacgatgttacatttctaagagagaatcattccgtcatcaagaccaaccctcaggagaacgatatgtttttcaatgttattgcgattgtggaccctcttacaagagaggcccagaagatggcccagctgctggtggtgctaggtaaaatcatcaacatgaagatcaagctcttcatgaactgccgcggaaggctgtcagaagcaccactggagagcttttatagatttgtcttagaaccagagctgatgagcggggcgaacgatgtttccagtcttggtcccgtcgccaagttcctagacattccagagtcccctctgttgattctgaatatgatcacacctgagggctggctcgtggagactgtccactcaaactgtgaccttgataacatacatctgaaggatacagagaagaccgtcactgcagagtacgagctcgagtacttgttattggaggggcagtgcttcgataaggtgactgaacagccaccccgcgggctgcagttcaccctgggcactaagaacaaaccagccgtcgtggacacgatcgtgatggcccaccacgggtacttccagctgaaagccaatccaggagcctggatcctgagactacaccagggaaaaagtgaggatatttatcagatcgttggtcacgagggcacagattcccaggcagatcttgaggacattattgtggtgctgaactcgttcaagagcaaaatcctgaaggtgaaggtaaagaaggagaccgacaagataaaagaggacatactaacagacgaagatgagaagacaaagggactgtgggacagtattaagtcattcacagtctccctacataaggagaataagaaagaaaaagatgtgcttaatattttctctgttgcatctggtcatctgtacgaacgcttcctcagaattatgatgctgagtgttctgagaaacaccaaaacccccgtgaagttctggcttctcaaaaattacctctcccccacattcaaggaggttattccgcatatggcaaaagaatacgggtttcgctacgaattagttcagtacaggtggcccagatggctgagacagcagacggagcggcagcgtattatctgggggtacaaaatcctgtttctggatgtgctttttcctctcgctgttgacaaaatcattttcgtggacgctgaccagatcgtgaggcacgacctgaaggagctgagagatttcgatttggatggggccccctacgggtacactcctttttgcgatagccgtcgcgagatggatggataccgcttctggaagactggctactgggcgtcccatctgctgagaaggaagtatcatataagcgccctgtacgtggtggatttgaagaaatttcgccgaatcggcgcaggcgaccggctcagaagtcagtaccaagccctgtcacaggaccccaacagccttagcaacctggaccaggatttacccaacaatatgatttaccaagtggcaatcaagtcactcccacaggactggttgtggtgtgagacgtggtgcgacgatgaatctaagcagcgggcaaagaccatcgatctctgcaacaatccaaaaacgaaggagtcaaagctgaaggctgctgctagaatcgtccctgaatgggtagagtacgatgcagagatccggcagttactggatcacctcgagaataaaaaacaggataccattctcacacacgatgagctatag

SEQ ID NO: 140004 - DNA, 1119 bp, Artificial Sequence
  Description of Artificial Sequence: Synthetic coding sequence
atggcccctgccaaagccaccaacgtcgtgaggcttctgctaggatcaacagccttgtggcttagccaactgggatctggaaccgtagctgcatccaagtctgtaaccgctcacctcgccgctaagtggcccgaaacccctctgctcctggaagctagcgaatttatggccgaagagtctaatgagaagttctggcagttccttgaaacagtgcaggaacttgcaatctataagcagactgagtccgattattcgtattacaacctgattctgaagaaggcggggcaatttctggacaacctgcacattaacctattgaagttcgcctttagcataagggcttacagcccggctatccagatgtttcagcaaatcgcagctgacgagccccctcccgatgggtgtaacgcgttcgttgtgattcataagaagcatacatgtaagatcaacgaaattaagaagttgctaaagaaagcagcctcgaggactagaccctacctgttcaaaggcgaccacaaatttccaactaataaggaaaacttgcccgtagtcatcctgtacgcagaaatgggtacgcgcaccttctcggccttccataaagttctgtctgaaaaagctcagaatgaggagatactgtatgttctccgccactacatacagaagccatcctcacgcaaaatgtacctgtctggctacggggtcgaacttgcaatcaagtctactgagtacaaggcattagacgatactcaggtgaagactgtgaccaatacaactgtggaagacgagaccgagacaaacgaggtgcagggatttctgttcgggaaattgaaagagatctatagtgacctgcgcgacaaccttaccgcctttcagaaataccttatcgaaagtaacaaacaaatgatgccattgaaggtttgggagctgcaggacttgagcttccaggccgcatcacagattatgtcagcacccgtgtacgacagcataaagctaatgaaagatatttctcagaatttcccaataaaggctaggttgaggatgaacattctgatctgtttgttccaatcaacactgaatgtgaaaaatctaagaagcaggcacttatacaataagacttag

SEQ ID NO: 140005 - DNA, 1527 bp, Artificial Sequence
  Description of Artificial Sequence: Synthetic coding sequence
atgtctcgcttcgtccaggacttgtcaaaggccatgagtcaggatggggcatcgcagttccaggaggttatcagacaggagcttgaactaagcgttaagaaagagttagaaaagatacttaccactgcctcctcccatgaattcgaacatactaagaaggatctggacggctttaggaagctgtttcaccggttcctacaggagaagggaccgtcagtggactggggtaagatacagcgacctcctgaggatagtatacagccctatgaaaaaatcaaggccagaggtctgcccgacaacatctcgagcgtgctgaacaaactggtagtggtgaagctcaacggcggcctgggaacctctatggggtgcaaggggccaaaatcccttattggcgttcggaatgagaacaccttcctcgacctgacagtgcagcagattgaacatctgaataagacatataataccgacgtcccactagttctgatgaactctttcaataccgatgaagacaccaagaaaattttacagaagtacaaccactgtcgggtaaagatctacacctttaatcaaagtcgctatccccgcattaataaggagagtctgctacccgtcgcaaaggatgtctcctacagcggcgaaaacaccgaagcatggtaccctcctggccatggggacatctacgcttcattttacaatagtggcctgttggatacttttattggcgagggtaaagaatacattttcgtctctaacatcgataatctgggcgccaccgtggatctgtatatcttgaatcacctgatgaatccccctaatggaaagaggtgtgagttcgtcatggaagtgaccaataagacccgagccgatgtaaaaggcggcacactcacgcagtatgaaggcaagctgagactcgttgaaatcgcacaggttccgaaagctcacgtcgatgaatttaagtcggtttctaagttcaagatctttaacaccaacaatctttggatctccctcgctgcggtgaagaggctgcaggagcagaacgccattgatatggagatcattgttaacgccaaaaccctcgatggagggctcaatgtcattcagctagagaccgctgtgggggctgccattaagagttttgagaatagtctcggaattaatgtgccccggtctcggttcctgccagtgaagactacttctgacctgctcctagtgatgtccaacttatactctctgaacgcaggttcactgacaatgagcgagaaacgggaatttcctacagtacccctcgtcaagttagggtcaagcttcacgaaggtgcaggactatctgcgccgttttgagtccatacccgacatgttagagctggaccacttgaccgtcagtggcgacgtcacttttggaaagaacgtttcacttaaaggcacagtcatcatcatcgctaatcacggagacagaatagatattccgccaggcgccgtcctggaaaataagatcgttagcggcaacctgcgaatcttggatcactag

SEQ ID NO: 140006 - DNA, 1494 bp, Artificial Sequence
  Description of Artificial Sequence: Synthetic coding sequence
atgtctcaggacggcgcaagccagtttcaagaagtaatcaggcaggagctggagctcagtgtgaaaaaagagctggagaagattctcacaacagcaagctcacacgagttcgaacacaccaagaaggacctggatggctttcgcaaactgtttcaccgctttttgcaggaaaaggggccctccgtggactggggcaagatccagcgccccccagaggactcaatccagccatatgagaagattaaggcccggggactacccgacaatatctctagcgtcctgaataagctggtagtagtgaagcttaacggcggcctcgggaccagtatgggctgtaagggcccaaagagcttgattggcgtaagaaacgaaaatactttcctggacctgaccgtgcaacagatagaacatcttaacaagacctacaacaccgacgtgccacttgtgctcatgaattcattcaacacagacgaggatacaaagaagatcctccaaaagtacaatcattgtagagtaaagatatatacctttaaccagtccagatatcccagaattaacaaggaatccttactgccggtcgccaaggacgtcagctacagtggtgagaacacagaggcttggtatcctcctggtcatggcgacatttacgcaagtttctataattcaggcctgctggacaccttcataggggaagggaaggagtatatattcgtgagtaacatcgacaatcttggtgcaacagtggacctgtatatcctgaaccatctgatgaacccccccaatggaaaacgatgtgaattcgtgatggaggtaacgaacaaaaccagagccgacgtcaaggggggaaccctaacgcaatacgaaggcaagttaagacttgtcgagatagcacaagtacccaaggcccacgtagatgagttcaaatctgtctccaaattcaagatattcaataccaacaatctgtggattagtctggctgcagtgaaacggttgcaggaacagaatgctattgacatggaaatcatagtgaatgcgaaaaccctggacggcgggctaaacgtaattcagctcgagaccgccgttggcgctgcgatcaagagctttgagaattcacttgggatcaacgtgccccgctcgagattcctacctgtcaagacaacatcagatcttctacttgttatgagcaacctgtactcacttaacgctgggtccctcaccatgagcgaaaagcgcgagtttccaacggtgcccctggtaaaactgggatcgtctttcacgaaagtgcaggattaccttcgacgcttcgagtctataccagacatgttggagctggatcatctgaccgtctcaggagacgtgactttcggcaagaacgtgtcgctcaagggcacagtgatcattattgcaaatcacggtgacaggattgatattccaccaggggctgtcctggaaaacaaaatagtctctggaaaccttcgaatccttgaccactag

SEQ ID NO: 140007 - DNA, 1554 bp, Artificial Sequence
  Description of Artificial Sequence: Synthetic coding sequence
atgctcttataccccgctggcttcagcttcgcatctctgaaaagcgatctgtctaaggcgatgtctcaagacggggccagtcagtttcaggaagtaatcagacaggagctggagctgtcagtcaagaaggagctcgagaagattctaacaactgcgtcctcgcatgagttcgagcatactaagaaagatttggacggttttcgaaaactctttcacagatttcttcaagagaaagggccgagtgttgactgggggaagattcagagaccccccgaggattcaattcagccgtatgagaaaataaaggcaaggggattgcctgacaacatctctagcgtcctcaacaagctggtggtggtgaagctcaatggcggccttgggacctccatgggctgcaaggggcctaaatctctgattggggtccgaaacgagaatacttttctcgaccttacagtgcagcagatcgaacacctgaataagacgtacaacacagatgtccctctcgtgctaatgaatagcttcaacacagatgaggatacgaaaaaaatcctgcaaaagtataaccactgcagagttaagatttacacgttcaatcagagccgttacccgcgaattaataaagagtccttgctgccagtggcgaaagacgtgagctatagtggcgaaaacactgaggcctggtaccctcccggacacggcgatatatacgcctcgttttacaactctggattgctggacacatttattggcgagggtaaggagtatattttcgtgtcaaacatcgacaacctgggggccacggtggatctgtacattcttaaccatcttatgaatccgccaaacgggaaacgttgtgaatttgtcatggaggtgacaaacaaaacaagggccgatgttaagggaggaactctgactcagtatgagggcaaactgcggttagtggagatcgcccaggtcccaaaggcccatgttgacgagttcaagtcagtcagtaagtttaagatcttcaacaccaacaatttgtggatttcccttgctgccgtcaagaggctacaagaacagaacgctatagacatggagattatcgtcaacgccaagaccctcgatggcggcctgaacgttattcagctggaaacggcagtaggcgccgccatcaagtctttcgagaacagtcttggcattaacgtgcccagatcacggtttctgcccgtgaagacaaccagcgacctcttgctcgtaatgagcaacttgtactctctgaacgccgggtcactcaccatgtcggagaaaagagaatttccgacagtgccgctggtgaaactggggtcgtccttcaccaaggtacaggattatctgagacgcttcgaaagcattcctgatatgctggaactagatcacttgaccgtgagcggagatgtcactttcggcaagaatgtgagcctcaagggcaccgttattattatcgcaaaccatggcgacaggattgatatcccaccaggggcagtgctggaaaacaaaattgtctctggaaaccttaggatcctggaccactag

SEQ ID NO: 140008 - DNA, 1494 bp, Artificial Sequence
  Description of Artificial Sequence: Synthetic coding sequence
atgagccaggacggtgcatcccagtttcaggaagtgattcggcaggagctcgaattgtccgtgaaaaaggaactggaaaagatcttgaccactgcgtcgtcacatgagtttgagcacaccaaaaaagacctcgatggattccggaagctctttcatcgttttttgcaggagaagggcccgtccgtggattgggggaagatccaacgtccccctgaggactctattcagccttacgaaaagatcaaagcccggggcctaccggataacatatcaagcgtgctgaataaactagtagtcgtgaagctgaacgggggtctgggaacaagcatgggatgcaaaggccccaaatccctgatcggagtgcgcaacgagaatacattcctggatcttacggtgcaacagattgagcacctgaataagacctataacaccgacgttcctctggtgttaatgaattcttttaataccgacgaggatactaagaagatactccagaagtataatcattgtagggtcaagatctacacctttaaccaaagccgttacccaagaatcaacaaagagtctctgctgcccgtagcaaaagatgtgtcttattcaggcgagaatacagaggcctggtaccccccaggacatggcgacatctatgcctcattctataattcagggttgcttgatactttcataggggaggggaaggagtacattttcgttagtaatatagacaacctgggcgcaaccgtggacctgtacatactaaaccacctgatgaacccgcccaacggtaagaggtgcgaattcgtgatggaggtgacaaataaaactcgcgcagacgtgaagggcggaacccttacgcagtacgaagggaagctccggcttgtggagatcgcgcaagttccgaaagcccacgtcgatgaattcaaatccgtgtctaagttcaagatcttcaatacaaacaatttgtggatcagcttggcagccgttaaacgactacaggagcaaaacgcaatcgacatggaaatcattgtcaacgccaagactctcgatggtggcctgaatgtcatccaattggagacagctgtcggggcagcaattaagtcgttcgagaactcacttggcataaacgtgcccagatcgcgatttcttcccgtgaagaccacatccgacctcctgttggtgatgtcaaacttatactccctgaacgctgggagcctcaccatgtcggagaagcgggagttccccaccgtcccactggtgaagctgggctctagttttacgaaagtgcaggattatctgaggcggttcgagagtatccctgacatgctcgagctagaccaccttaccgtgtcgggagatgtgacgttcggcaaaaacgtttcgctcaaaggaaccgtgattattatcgcgaaccacggtgatcgcattgatataccccccggggcagtcttagagaataagatcgttagcggcaatcttcgcatccttgatcattag

SEQ ID NO: 140009 - DNA, 453 bp, Artificial Sequence
  Description of Artificial Sequence: Synthetic coding sequence
atgagccaggacggggcgtcacagttccaggaggttatcagacaggaactggagttatcggtgaaaaaagagctcgagaagatcctgaccactgcctcttcccacgaatttgaacacacaaagaaagatctggacggcttccgcaagctgtttcacagattcctccaggagaaggggcctagcgtggattggggaaagatacagaggccaccagaggactctattcagccctacgaaaagatcaaggccagaggactcccggataacatatctagcgtgctaaataaattggttgttgtgaaactgaacggagggctgggcacctccatggggtgtaagggacctaagtcccttatcggggtgcggaacgagaacactttcttggacttaaccgtacaacagattgagcacttgaacaaaacatataacacagatgtacccctggtgctttag

SEQ ID NO: 140010 - DNA, 516 bp, Artificial Sequence
  Description of Artificial Sequence: Synthetic coding sequence
atgtcacaagacggcgcttctcaattccaagaagtgatccgccaggaacttgaacttagtgtgaaaaaagagctcgagaaaattttgactactgcctcttctcacgaattcgagcacacgaagaaggacctagatggcttccgtaaactgttccaccggttcctgcaagaaaaggggcctagcgttgattggggtaagattcagcgccccccggaggacagtatccagccttacgaaaagatcaaggcccgtggactgcccgataatataagcagtgtgttgaataaattggtcgtcgtcaaattaaacggcggtctggggacgtcaatgggctgcaaaggcccgaaaagcttaatcggtgtgcgaaacgaaaacacctttctcgacttaactgtccagcagatcgaacacctcaacaaaacttataacaccgacgtgccactggtgctcatgaactcctttaacactgacgaggacactaagaaaatactccagaagtacaatcattgtcggtag

SEQ ID NO: 140011 - DNA, 117 bp, Artificial Sequence
  Description of Artificial Sequence: Synthetic coding sequence
atgtctcaggacggggcctcccagttccaagaggttatccgccaggagttggagctcagcgtcaagaaagagttggagaaaatcctgaccaccgcctcttctcacgagttcgaatag

SEQ ID NO: 140012 - DNA, 318 bp, Artificial Sequence
  Description of Artificial Sequence: Synthetic coding sequence
atgagccaggacggtgccagtcagttccaggaagtgattcgtcaggaacttgaattatcagtgaagaaggagctggagaaaatcctgacgaccgcctcaagccatgaattcgagcacaccaaaaaggacctggatggcttcaggaaactcttccacagattcctgcaggagaagggtccttccgtcgactggggcaaaatacagcgccccccggaggacagtatccagccctacgagaagatcaaggcccgagggctgcctgataacatcagcagtgtgctaaataagcttgtggtggtgaaactcaacggtggatag

SEQ ID NO: 140013 - DNA, 150 bp, Artificial Sequence
  Description of Artificial Sequence: Synthetic coding sequence
atgtcccggttcgtgcaggacctcagtaaggcaatgagtcaggatggggcaagtcagttccaggaagtgatcagacaggagttagagctttccgtgaagaaagaattggagaaaatcttgactactgcttcaagccacgagttcgaatag

SEQ ID NO: 140014 - DNA, 408 bp, Artificial Sequence
  Description of Artificial Sequence: Synthetic coding sequence
atgtctcaggacggtgccagccagttccaggaggtgatccgccaggagttggaactgagcgtgaagaaagaacttgaaaagatcctcactacagcctcctcccatgagtttgaacataccaagaaggacctagatggcttccgtaagctgttccatcgctttctgcaggagaaagggccatcagtggattggggcaagatccagcggccacctgaagattctatccagccgtacgagaagatcaaagcacgcggcttaccggataatatctcatccgtgctaaataagctggtagtagttaagttaaacggggggcttgggactagcatgggttgcaaaggcccaaagagcctgattggcgtacgcaacgagaatacttttctcgatctgacagtgcagcagatctag

SEQ ID NO: 140015 - DNA, 642 bp, Artificial Sequence
  Description of Artificial Sequence: Synthetic coding sequence
atgtcacaagatggggcttcacagtttcaggaggttattaggcaggaattggagctgagtgttaaaaaggagcttgagaaaattctcaccaccgcaagcagtcatgaattcgaacacacaaaaaaggatctggatggattcaggaaactctttcacagatttctgcaagagaaaggcccttcagtcgattgggggaaaatccagcgcccccctgaagattctatccaaccgtatgagaaaattaaagctaggggactgcccgataacattagtagtgtgttaaacaagttggtggtcgtgaaactgaacggggggctcggtaccagtatgggttgtaagggccctaaatcattaattggcgtcaggaatgagaacacgttccttgatcttaccgtgcaacagattgagcacctgaacaaaacttacaacacagatgtgcccttagtgttaatgaactccttcaacacagacgaggacacaaagaaaatcttacaaaaatacaatcactgtagggtcaagatctatacatttaaccagagcaggtaccctcggataaacaaagaatctcttctcccagtggctaaggatgttagctatagcggtgaaaatactgaggcatggtatccaccagggcacggctag

SEQ ID NO: 140016 - DNA, 1278 bp, Artificial Sequence
  Description of Artificial Sequence: Synthetic coding sequence
atggtgtcaaaggctctgctccggttagtttctgcagtcaatagaaggagaatgaagctgttactgggtattgccctgctcgcctatgtagccagtgtttggggcaatttcgtcaacatgtcatttctcctgaacagatccatccaggaaaatggagaactgaaaatcgaatctaaaatcgaagagatggtggaacccctgagggaaaagattcgcgacctggagaagtcctttacccagaagtatcccccagtgaagttcctctcagagaaagatcggaaaagaattttgatcacaggcggagccggatttgtaggcagtcacctgacagacaaattgatgatggacggccacgaggtcaccgtggtcgataactttttcacagggaggaaaaggaatgtagagcactggatcggacacgagaactttgaactgattaatcatgacgtcgtggagcctctgtatatcgaggtcgatcagatttaccatctcgcgagtccagccagtcccccaaattatatgtacaacccaattaaaacactcaaaactaacacaattggaacactgaacatgctgggtctggcaaaaagagtgggcgcgagattattgttagcttccacctccgaagtatacggcgaccctgaggtccacccgcagtccgaggattattggggacacgtgaacccaatcggaccaagagcatgttatgatgaagggaagcgtgttgccgaaaccatgtgctacgcctacatgaaacaggagggcgtggaggtacgggttgctagaattttcaacacctttggcccccgaatgcacatgaatgatggcagagtcgtctcgaactttattctgcaggctcttcaaggggagcctctgaccgtgtatgggtcagggtctcagacaagagcatttcagtacgtcagcgaccttgtgaatggactcgtggcattgatgaactccaacgtgtcttctcccgtgaaccttggcaatccagaggagcacaccatcctcgaatttgcacagctcattaaaaatctcgttggctcagggagcgaaatccagtttctctccgaagctcaagacgaccctcaaaaaaggaagccagatataaagaaggccaagctcatgttgggatgggaaccagtcgtgcctctggaagaaggactgaataaggctatccactatttcaggaaggagctggaataccaggcaaataatcaatatatcccaaagccaaagcctgccagaataaagaaagggagaaccaggcatagctag

SEQ ID NO: 140017 - DNA, 759 bp, Artificial Sequence
  Description of Artificial Sequence: Synthetic coding sequence
atgtacaaccctatcaagaccctgaagaccaacaccattgggacgctgaacatgctcggcctggccaaacgcgtgggggctaggttgctgctcgcttcgaccagcgaggtgtatggcgaccctgaggttcatccacagtcggaggattattggggccacgtgaacccaatcgggccgcgagcttgctacgacgagggtaaaagagtcgccgagacgatgtgttatgcttatatgaagcaggagggcgtagaagtcagggttgccagaatcttcaatacgtttggcccccggatgcatatgaatgacggccgggttgtaagtaatttcatactacaggccctccaaggagagccactcacggtgtatggctcggggagtcagacaagggcatttcagtacgtctcagatttggtgaatggcctagtagccttgatgaatagcaatgtgagcagcccggtgaaccttggcaacccagaggagcacaccatcctggagtttgctcaactgataaagaacctggtaggcagtggatcagaaatccagttcctgtctgaggcacaggatgatccacaaaaaagaaaaccagatattaaaaaggccaagttaatgctcggctgggagccggttgtgccccttgaggaggggctgaataaggccatccactacttcaggaaggagttggagtaccaagccaacaaccagtacatcccaaaacccaagcctgcaaggataaagaagggcaggacccgacactcatag

SEQ ID NO: 140018 - DNA, 1263 bp, Artificial Sequence
  Description of Artificial Sequence: Synthetic coding sequence
atggtgtctaaggcactgttacgacttgtgagcgctgttaacagacggcgaatgaaattgctgctgggcatcgctcttctggcgtatgtggcgtctgtctggggtaattttgtgaatatgcggagtatacaggaaaacggcgagttgaaaatcgaatcgaagattgaggagatggtggagccgctgcgcgagaaaataagggatcttgagaaaagtttcactcagaagtacccgcctgtcaagttcctgtcggaaaaagaccgcaagcgtatcctgattacaggaggtgccggattcgtggggtcccatctcaccgacaaactaatgatggacgggcacgaggtgacagtagtggacaacttctttacaggaaggaaacgcaacgtggaacactggatcgggcatgaaaatttcgaattgatcaatcacgatgtggtcgagcctctctatattgaagtagaccagatctaccatctcgcctcacccgctagcccgcctaattacatgtacaaccctattaaaactctgaagaccaatactatcgggaccctgaacatgctaggactcgctaagagggtaggagcgcgcctcctccttgcgagtactagcgaggtgtatggtgatccagaggtgcatccacagagtgaggattactggggacacgtaaacccaattgggcctcgcgcctgttacgacgaggggaaacgggtggccgaaactatgtgctacgcatacatgaagcaggagggagttgaggtcagggtggccagaatttttaatacattcggtcctcggatgcacatgaatgatggtagagttgtctccaactttatccttcaggccctgcaaggtgaaccacttaccgtgtacggctccggttcacaaacacgggccttccagtacgtttctgatttggttaacggcctcgtagcccttatgaacagcaatgtgtcatcgcccgtaaatctcgggaacccggaggaacatactattcttgagtttgcgcagctgattaagaatctggttggcagtggtagcgagattcaatttctgtcagaggcccaggatgacccacaaaagcggaaaccagatattaagaaagcaaagttgatgttgggttgggagccagtggtcccactcgaggaaggccttaataaggccatacattattttcgaaaagagctggagtatcaagccaataaccaatatatccctaaacccaagcccgcccgtatcaaaaaaggtagaacacgccacagttag

SEQ ID NO: 140019 - DNA, 405 bp, Artificial Sequence
  Description of Artificial Sequence: Synthetic coding sequence
atgtataaccctatcaagaccctgaagaccaatacaattggtacgttgaacatgctgggacttgcaaagcgggtcggagccaggcttctcctggcgtctacctctgaagtgtatggcgaccctgaagtgcatccacaatccgaagactattggggtcacgtgaaccctattggcccaagagcttgctacgatgaagggaagcgggtggcggaaactatgtgttacgcctacatgaaacaagaaggggtcgaggttcgggtggcccgcatctttaacaccttcggacctcggatgcacatgaacgacggcagagttgtttccaattttatactccaagctcttcagggcgaacccctgaccgtgtacggatcaggatctcagacccgggctttccaatatgtctag

SEQ ID NO: 140020 - DNA, 558 bp, Artificial Sequence
  Description of Artificial Sequence: Synthetic coding sequence
atggtcagcaaggctctccttcggttggtcagcgccgttaaccgtaggcgcatgaaactgctgcttggaatagctctgcttgcatatgtcgcctggctggccaaaagggtgggcgcacgcttgctcctggctagcacctctgaagtgtatggagatcctgaggttcatccacaatctgaggactattgggggcatgtgaatcctatcggaccccgcgcgtgttacgacgagggaaaacgggtagccgagactatgtgctacgcatacatgaagcaagaaggggtcgaggtacgcgtggcacggatattcaatactttcggccctcggatgcatatgaatgatggccgcgttgtatctaactttatccttcaggcactccagggagaacctcttactgtatatggatccggatcgcagaccagagcttttcagtatgtttccgaccttgtgaatggactagtcgctctgatgaattccaatgtgagcagccctgtcaacctggtatcggccccgctgccacccttgtgtcgaactgctcaaactttcgtccacctgtag

SEQ ID NO: 140021 - DNA, 159 bp, Artificial Sequence
  Description of Artificial Sequence: Synthetic coding sequence
atgtacaacccaattaaaacactcaagaccaacactattgggactttgaatatgttagggctggccaaacgagtcggggcccggctcctgttggccagcacatctgaggtgtatggagatccagaggtacacccccagtcggaggactactggggctag

SEQ ID NO: 140022 - DNA, 366 bp, Artificial Sequence
  Description of Artificial Sequence: Synthetic coding sequence
atgtacaaccccatcaaaaccttgaaaaccaacactatcggaacactgaatatgttgggtctggccaaaagagtgggggctagattgttactcgcaagtacctctgaagtgtatggggatccagaggtccatccccagtccgaggactactgggggcatgtcaatccaataggcccccgtgcgtgctatgacgaaggcaagcgtgtagctgagacaatgtgttacgcttatatgaaacaggaaggcgtagaggtccgggttgctcgaatctttaacaccttcggtccccgcatgcacatgaacgacggtcgggtggtgtcaaacttcatccttcaagccctccaaggagagcctctgaccgtctag

SEQ ID NO: 140023 - DNA, 1092 bp, Artificial Sequence
  Description of Artificial Sequence: Synthetic coding sequence
atggttgaaccgctgcgggagaagatccgggacctcgagaagagctttacccagaagtaccccccagtgaagtttctctcggaaaaggaccggaagaggatattgatcaccgggggagctggctttgttggttcccatcttaccgacaaattaatgatggacggtcacgaagtaacagtggtggataatttctttactgggaggaagaggaacgtagaacactggatcggtcatgaaaactttgagctcattaaccacgatgtcgttgagccactgtatatcgaggtggatcagatctaccacctagccagtcctgccagtcctcccaattatatgtacaacccaattaagacactgaagactaatactatcggaaccctaaatatgcttggtctggcgaagcgggtaggcgcccgtttgctgttagctagcacatcggaggtgtacggcgatcccgaagtccatccgcagtctgaggactactgggggcatgtgaaccccatcggccccagggcgtgttatgacgagggtaaaagggtggccgagaccatgtgttatgcatacatgaagcaggagggtgtggaagtaagagtggccaggattttcaataccttcgggccacgaatgcatatgaacgacgggcgtgtagtgagcaacttcatattgcaggcgctacagggcgaacccttaacggtgtacggatccggatcacagacgcgtgcatttcagtacgtgtcagatctggtgaatgggctggtagcgctgatgaactcaaacgtgtcctctccggttaatctggggaaccctgaggaacatactatactggagttcgcccagctgataaagaatctggtcggttcaggctccgagattcagtttttatcagaggcacaggacgacccccagaaacggaaaccagatatcaaaaaggctaagctcatgcttggttgggagcctgtcgtgcctctcgaagaaggactcaacaaggccatccactatttcaggaaggaactcgaataccaggctaacaaccagtatatccccaagccaaagcccgcaaggattaagaagggccggacaaggcactcttag

SEQ ID NO: 140024 - DNA, 1680 bp, Artificial Sequence
  Description of Artificial Sequence: Synthetic coding sequence
atgcgaaagtttgcatattgcaaagttgtgctagccaccagtcttatttgggtgttgctcgacatgtttctactgctatattttagcgagtgtaataaatgtgatgaaaagaaagagagaggcctgcctgctggcgacgtactggaacccgtgcagaaaccccacgagggtccgggggaaatgggaaagcctgtggtgattccgaaagaagaccaagagaaaatgaaggagatgtttaaaatcaaccagttcaacctgatggccagcgaaatgatcgcgctgaataggtctctccctgatgttcgactcgaaggttgtaaaacaaaggtctaccccgataatttgcctacgacaagtgtggtgatcgtctttcacaacgaggcctggagtacacttctgagaactgtgcacagcgtgatcaaccgcagcccgcgacacatgatcgaggagatcgtcctcgtcgacgacgctagtgaacgagattttttgaaacggcccctggagtcatatgttaagaagctaaaggtaccggtacatgtgataaggatggagcagcgatctggattgatccgcgccagattgaaaggcgccgccgtgtccaagggccaagtgattacatttttagatgctcactgtgagtgtaccgtggggtggctcgaaccactgttggctcgtattaagcacgatcgaagaacagtcgtgtgccccattattgacgtgatttccgacgacaccttcgagtacatggctggttcagatatgacctacggcggttttaattggaaattgaattttcgctggtatccagtgcctcagcgagagatggaccggcgaaagggtgaccgcacactgcctgttaggactccaacaatggctggcgggctgtttagtattgatcgagactatttccaggagataggaacttacgatgctgggatggatatttggggcggtgagaaccttgaaatcagcttccgaatctggcagtgtggtggcacactcgagatcgtgacgtgctcccacgtgggccacgtttttcgtaaggccaccccgtatacctttcccggcgggaccggccagataatcaataagaataatcgtcggttggcagaagtctggatggacgagttcaaaaattttttctatataataagcccaggagtgacaaaggtcgactacggggacatttcgtcacgagtgggtctgcgccacaaactccagtgtaaaccattcagttggtatcttgagaatatataccctgatagtcaaatacctcgccattatttcagtctgggagagatccggaacgttgaaactaaccagtgccttgacaatatggcgagaaaggagaatgaaaaagtaggcattttcaattgccacggcatgggtggcaaccaggtgttcagttatactgcaaataaagaaataaggaccgacgatctgtgtttggacgttagcaagctgaacggtcccgttaccatgctcaagtgtcaccacctgaaggggaaccaattgtgggaatatgatcctgtgaaactaacattacaacatgtgaattccaatcaatgcctggacaaggcaactgaggaggattcccaggtcccatccattagggactgcaatggctcccggtcgcaacaatggttattacgtaacgttacactgcccgaaatcttttag

SEQ ID NO: 140025 - DNA, 1500 bp, Artificial Sequence
  Description of Artificial Sequence: Synthetic coding sequence
atggggaaacctgtggttatcccaaaggaggaccaagaaaagatgaaggagatgtttaaaattaatcagttcaatctcatggcttccgaaatgatcgctttgaaccgcagtctgccagacgtgcgcctcgagggatgtaagaccaaagtgtatcctgacaacctgccaacaacttcagtcgtgatagtttttcataatgaagcctggtcaaccctcctccggactgtccactcagtcatcaatcgatcaccccgccatatgattgaggagattgtcttggttgatgatgcttcagagcgggattttcttaagcgtcccctagagtcgtatgtcaaaaaactcaaggtgcccgtgcacgtgattagaatggaacaaaggagcggactgattagagcacgactcaagggggctgcagtcagcaaaggacaggtaatcaccttcctcgacgcacactgtgagtgtactgtgggttggctggaaccacttttggccagaataaagcatgaccgaagaacagtcgtgtgccctattatagacgtaatctccgacgacaccttcgaatacatggccggaagtgatatgacttacggcgggtttaactggaaactcaacttcaggtggtaccctgtgcctcagcgcgagatggaccgccgtaaaggggatcgaacactgcctgttcgtactcccactatggccggagggctgttttccatcgacagggattattttcaggaaatcggtacctacgatgcaggcatggacatatggggaggagaaaacttggagattagctttagaatctggcagtgtggaggcaccctggagattgtaacttgttctcatgttggccatgtgtttcggaaagccaccccgtacacattccccggaggtactggccagattattaacaagaacaaccggcgcctcgcagaggtgtggatggacgagttcaagaatttcttttatatcataagtccaggtgtgacgaaggtggactacggcgatatctcaagccgcgtcggactcagacacaagttacagtgtaagccttttagctggtaccttgaaaacatctatccagatagccaaattcccaggcactacttcagtcttggggagatccgtaatgtggagaccaatcagtgtctggataatatggcccgaaaggaaaatgagaaagtgggcatatttaactgtcacggaatgggaggtaatcaggtattctcttatacagcgaacaaggagatcaggacagatgatctgtgtctggatgtgagtaaattgaacggacctgttacaatgttgaaatgccatcatctcaaaggtaatcaactgtgggaatatgacccagtgaagctgacgctgcagcacgtaaactcaaatcagtgcctggacaaagcgactgaagaggatagccaggtccctagtatacgagattgcaacggctcaaggtcacagcagtggctcctgagaaatgtcactctaccggagatattttag

SEQ ID NO: 140026 - DNA, 1680 bp, Artificial Sequence
  Description of Artificial Sequence: Synthetic coding sequence
atgcggaaatttgcctactgtaaggtcgtgttagcaacatccctcatctgggtcttactggacatgtttttgctgctctatttttctgaatgtaacaaatgcgacgagaaaaaagagcgcggccttcccgctggtgatgtcttggagccagtccagaagccacacgagggtcccggggagatggggaagcctgttgtcattccaaaagaggatcaggaaaaaatgaaagagatgtttaagatcaatcaattcaatctgatggcctctgagatgatcgccctgaaccgatctctgcccgatgtgaggctcgagggctgtaagactaaggtctatcctgataacctcccgaccacatccgtggtgatcgtctttcataatgaggcatggtccaccttgctacggacagtgcactccgtgatcaatagaagcccaagacacatgatcgaggagattgtgttggtcgacgatgcctctgagagagatttcctgaaacggcccctcgagagttacgttaagaagctgaaggttccagtgcacgtgattcggatggagcagcggtctggccttatccgcgccaggcttaaaggcgcagcggtctcaaaagggcaagtgataacttttcttgacgcacattgcgaatgcaccgtcggctggcttgagcctctcctcgccagaatcaaacacgaccgtcgaaccgttgtatgcccgatcatcgacgtgatcagtgatgacaccttcgagtatatggccgggagtgacatgacctacggtggttttaattggaaactgaacttcaggtggtacccagtgccacaacgcgagatggatcgtagaaaaggtgaccggactttgcccgttcgaacaccgaccatggccggaggactattcagcatcgacagggactattttcaagagatcggcacatatgacgctggaatggatatctggggaggggagaatctagaaatatcgttccgcatctggcagtgtggtgggactttagaaattgtaacctgttctcacgtcggccacgtttttaggaaagccaccccttacacctttcccggcggaaccggccagatcataaacaaaaataataggcgactggccgaagtatggatggacgaattcaaaaacttcttttatattatctctcccggtgtgacaaaagttgactatggggacattagcagcagagtgggactgcggcataaactgcagtgcaaacccttctcttggtatctggagaacatttacccagactcacagattccaagacactacttttcccttggagagattcggaacgttgagactaaccagtgcctggacaatatggccagaaaagaaaatgagaaggttggaatttttaactgtcacggaatgggcggcaatcaagtgttctcctatactgctaataaggaaatccggaccgacgatctctgtctcgacgtcagtaaacttaacggaccagtcacgatgctgaagtgccaccacctgaagggcaaccagctctgggaatacgacccagtgaaactcaccctgcaacatgttaattccaaccagtgcttagataaggcgaccgaggaggactcacaggtgccctctatacgagactgtaacggatcacgcagccagcagtggctgctgcggaatgtcacgcttccggagatcttctag

SEQ ID NO: 140027 - DNA, 1812 bp, Artificial Sequence
  Description of Artificial Sequence: Synthetic coding sequence
atgcggagaaaggaaaaaaggttactacaggcagtcgcacttgtgctggccgctttggtcctcctgcctaacgtggggctgtgggcactatatagggagagacaacctgatggcacccctgggggcagtggcgcagccgttgcaccagcagccggccagggatcccattccagacaaaagaaaaccttctttctgggagacggccagaagctaaaggactggcacgacaaggaagccattcggagggatgcccagcgcgtgggcaatggcgagcagggacgtccttatccaatgacagacgctgagagggtcgatcaagcataccgcgagaacgggtttaatatatacgtttcagataagatttcactgaaccggtccctaccagatattcgacaccctaactgcaacagtaaacgttaccttgagacacttccgaatacaagtataattattccctttcacaacgaaggatggagtagtctactgcgcactgtgcattcagtactcaaccgttcaccacccgaactagtcgcagaaatagtgcttgtggacgacttcagtgaccgcgaacatttgaaaaagcccctcgaggactacatggccctgttcccaagtgtgaggatactgcgcaccaaaaagcgggaagggctgattcgcacacgtatgcttggagcaagcgtggctaccggggatgtgattacgttcttggattctcactgtgaagccaatgtaaattggctccctccgctgctggataggattgccagaaaccgcaaaaccatagtgtgtcccatgattgacgttatcgaccatgatgattttagatatgaaactcaggccggagacgccatgagaggagctttcgattgggagatgtattacaagcggattcccattccccccgagctacagaaggcggacccttccgacccattcgagagtccggtgatggccggtggcttgtttgctgtcgaccggaagtggttctgggagcttggcgggtacgatccagggctcgaaatctggggcggcgaacagtacgagatcagttttaaggtgtggatgtgcggcgggcggatggaagacatcccttgcagcagggttggacatatctaccgcaaatacgttccctataaggtgcccgccggggtatcgttggcaaggaatttgaagcgggtggcagaagtctggatggacgagtacgctgagtacatctatcagagacgacctgaataccgacacttgtcagccggtgatgtggctgtccagaagaaattgaggagttcgctgaattgtaagagctttaagtggtttatgacgaaaattgcctgggatcttccaaagttctaccctcctgttgaaccaccagccgcggcttggggagaaatccgaaacgttggcaccggactatgcgctgacacaaaacacggggccttaggtagccctctgcgcctagaaggctgcgtccgggggagaggcgaggctgcatggaataatatgcaggtttttacgtttacatggcgcgaggatatcagaccgggtgatccacaacatactaagaaattttgttttgacgctataagccacacttcccccgtcactctgtacgactgtcattcaatgaaaggcaaccaactgtggaagtaccgaaaggacaaaacactgtatcatccagtctcaggctcttgcatggattgcagtgagtctgaccacagaatcttcatgaacacctgtaacccatcaagtctaacgcagcagtggctgttcgagcacactaacagcacagtgctggaaaagttcaaccgaaattag

SEQ ID NO: 140028 - DNA, 831 bp, Artificial Sequence
  Description of Artificial Sequence: Synthetic coding sequence
atgctagcctggagagatggcgaactggaggccgagacgtctagctcccttttcctgctggccatgcaagtctggatgtgcggtgggcgaatggaggatattccatgtagtagagtgggacatatttatcgcaagtacgtgccatacaaagtgccggctggggtcagtttggcccgggtccggaaccttaagagggtggctgaagtgtggatggatgaatatgcagagtatatatatcagagacgccctgagtacagacatttgtcagctggcgacgttgccgtccagaagaaattacgctcctcgttgaactgtaaaagctttaaatggtttatgactaaaattgcgtgggacctgcctaagttttaccctcccgtcgagccaccagctgccgcttggggggagattcggaatgtaggaacaggtttatgcgccgacactaagcatggagcccttggaagtcccctgagactagagggttgtgtaagaggaagaggggaggctgcctggaacaatatgcaggtttttacatttacgtggagagaggacatcagaccaggcgatccacagcataccaagaagttctgttttgacgccatctcccatacgagtccggtgactctatacgactgccactcaatgaaggggaaccagctgtggaagtacagaaaagataagaccctgtatcaccctgtttcaggctcatgcatggattgctcggaaagcgatcaccgaatattcatgaacacctgtaacccttcatcactcactcaacagtggttgttcgagcatactaactcaaccgttcttgagaaattcaacaggaactag

SEQ ID NO: 140029 - DNA, 1626 bp, Artificial Sequence
  Description of Artificial Sequence: Synthetic coding sequence
atgcgtaggaaagagaaaagactcctgcaggcggttgctctcgtgttggccgctctcgtgctgttgcccaacgtcggcctgtgggccctgtacagggagcgacagcccgatgggacccccggcggctccggtgccgcagtggcacccgccgctggccagggctcacacagcaggcagaaaaagaccttctttctgggagatggacagaaactaaaagattggcacgataaggaggccatcaggagagacgctcagcgagtgggaaacggagagcagggccgcccttatcccatgaccgatgccgaacgggtggatcaggcgtacagggagaacggcttcaatatctatgtgtccgataaaatctccttgaacaggtccctccccgacatcagacaccccaattgtaactcgaaaaggtacctggagacactgccaaatacgagcatcatcataccctttcacaacgagggctggtcatctctcctgagaacagttcacagcgttttgaatcgaagtccaccagaattggtagcagagatcgtgttggtggatgatttctccgatcgggaccgcatcgcccgcaataggaagacgatcgtgtgtcctatgatcgacgtgattgatcacgacgactttcgctatgagacccaggccggagacgctatgaggggcgcttttgactgggaaatgtattacaagcgcattcccattccccccgagctccagaaggccgacccttcggatccgtttgaatcacctgttatggccgggggattgtttgctgttgacagaaaatggttctgggagttagggggatatgaccccggcctcgaaatctggggtggtgaacagtatgaaatttccttcaaggtgtggatgtgcggcgggcgtatggaggacattccatgcagcagggtgggacacatctacaggaagtatgttccctacaaggtgcccgctggggtgtccctggcccgtaatctgaaaagagtggctgaagtctggatggatgaatacgccgagtatatatatcaaaggcgtccggagtaccgacatcttagcgcaggcgatgtagccgtacagaaaaagttgagatcctccctgaactgtaaatctttcaagtggttcatgacaaagatcgcttgggacctccctaagttctacccccctgtggaacctcccgcagcagcttggggcgaaattagaaacgtggggaccgggttgtgtgcagacacgaagcacggagcattgggcagccctcttcgcctggaaggctgcgtccggggccggggcgaggccgcatggaataatatgcaagtgtttacattcacgtggagggaggacattagaccaggcgatccacagcacactaagaagttctgcttcgacgccatatctcataccagtccggtgaccctgtacgattgccactccatgaaaggaaatcagctgtggaagtaccgcaaggacaagacattgtatcacccggtctccgggagctgtatggactgctccgaatcggatcatcgcatctttatgaatacctgtaatccctcttctcttacacagcagtggttgttcgagcatacaaattcaaccgtgctagaaaagttcaataggaactag

SEQ ID NO: 140030 - DNA, 1101 bp, Artificial Sequence
  Description of Artificial Sequence: Synthetic coding sequence
atgaggagaaaagaaaagaggctgttacaggcagtagccctggtattggcagctttggtactcctgccaaacgttggcttgtgggccttatacagagaaaggcagcctgatggcacaccaggaggttccggcgcagcagtggcgcccgcggccggacaaggttctcacagcaggcagaagaagacattctttctgggagacgggcagaaactaaaggattggcatgataaagaggccatacgaagagacgcacagcgggtcgggaacggagaacagggacggccttatcctatgaccgatgcggagcgagtcgatcaggcttacagggaaaacggattcaacatttacgtgtcagataagatcagtctaaaccgttccctccctgacatacggcaccccaactgcaacagcaagcggtaccttgaaaccctgcccaacacatccattatcatcccattccacaatgaaggctggagcagtctgctcaggaccgtccacagcgtgctgaacagaagcccccctgagctggtcgctgagattgtgctggtggatgacttctctgaccgggaacaccttaaaaaaccccttgaggattatatggctctgtttcccagcgtgcgaattctgagaaccaagaaacgcgagggcctgatacggacgcggatgctgggagcatctgtggcaaccggggatgtgatcacgtttctggattcccactgtgaggccaacgtgaactggctgccacctctgcttgaccggatagcacgaaaccggaaaactattgtgtgtcccatgattgacgtgatagaccacgacgactttaggtacgagacgcaggctggagacgcaatgaggggggcgttcgactgggaaatgtattacaagagaattccaattcccccagagctccagaaggcagaccctagcgaccctttcgaaagcccggtgatggcaggcgggctgttcgctgtggatcgtaagtggttctgggagcttgggggttatgaccccggcctggagatctggggaggtgaacagtatgaaatcagttttaaggtctcccagctctcccggcggcctgtgttaggcacggcgtcctag

SEQ ID NO: 140031 - DNA, 1746 bp, Artificial Sequence
  Description of Artificial Sequence: Synthetic coding sequence
atgtggggacggaccgcacgccgcaggtgccctagggaactccggcgggggagagaagcgctgttagtgctcctggctctgctcgctcttgcaggtcttggaagtgtgctacgcgcacagagaggggccggagctggcgccgcagagcccggtcccccaaggacaccacgccctggcagacgtgagcccgtcatgcccaggccacctgtcccagcaaatgccttaggggccagaggcgaagcagtgcgtttacagttgcagggtgaggaattgcgactccaggaggagagcgtgcgcctgcaccagatcaatatctatttatctgacagaatctctctgcatcggcgcctaccggagcgttggaatccactatgcaaggaaaagaagtacgactatgataacctgcctcggacctcagttattatcgcattctacaacgaggcttggtccaccttactgcgtacggtgtactccgtgctggagacaagccctgacatactcctcgaggaggtcatactcgtcgacgactacagtgaccgcgaacacttgaaggagagacttgccaatgagctctctggactgcctaaggtgcgtttaatccgtgctaacaaacgcgagggtctcgtgcgggctcgcctgctgggtgcaagcgcagcgcgcggcgacgtcctcactttcttagattgtcactgtgaatgtcatgaagggtggctcgagccacttttacagcggatacatgaagaggagtcggcagtggtctgtcctgtcattgacgtgattgattggaatacctttgaatacctgggcaactctggcgagccccagatcgggggattcgattggagactcgtgtttacctggcatacagtccccgagcgggaaaggattcgaatgcagtcacccgtagacgtgattagatcacccactatggcgggcggtctgttcgccgtcagcaagaaatacttcgagtatctaggatcctatgacactgggatggaagtgtggggcggcgagaacctggaattcagctttcgcatttggcagtgtgggggtgtcttggagacccacccttgctcccacgttggccatgtgtttccaaagcaggcaccgtattccaggaataaggcccttgccaatagtgtgcgagccgcggaagtgtggatggatgagttcaaggaattgtactaccaccgaaatcctcgcgcccgcctggagccgtttggagacgtgaccgagagaaagcagctgcgggataagttgcagtgtaaagatttcaaatggtttctggagacggtctacccagaacttcacgtgccagaggataggccaggcttcttcgggatgctgcagaataagggtctcacagactattgctttgattataaccctcctgacgagaatcaaatagtaggccaccaggtaatcctctacctctgccatggcatgggtcagaaccagttttttgaatacacaagccagaaggaaatccggtacaatacacatcagccagaaggctgcatcgcggtcgaagccggaatggacacactcattatgcacctgtgtgaggaaacagccccagaaaatcagaagttcattttgcaggaggacggctccctgtttcacgagcagtccaagaaatgtgtccaggccgccagaaaagaaagctccgattcttttgtaccccttttgcgcgactgcaccaacagcgaccaccagaaatggttctttaaggagcggatgctgtag

SEQ ID NO: 140032 - DNA, 1671 bp, Artificial Sequence
  Description of Artificial Sequence: Synthetic coding sequence
atgagacgctttgtgtattgcaaggtggtgctcgccacatcattgatgtgggtgctggttgatgtgtttttactgctctacttctctgaatgtaacaaatgcgacgataaaaaggagagatctctgcttcccgcattgcgtgcggttatttctagaaatcaagaagggcccggagagatgggtaaggccgtgctcattcctaaagacgaccaggagaaaatgaaagagctcttcaaaatcaaccagttcaacctgatggcctctgatcttatagctttgaataggtccctgccagacgtccgattggagggatgcaagaccaaggtttatcctgatgagttaccgaacacttccgtcgtgatcgtgtttcataacgaggcatggagcaccctcctgcgaactgtttactcagttatcaaccgcagtcctcactatctgctgtctgaagtgatactggtcgatgatgccagcgaacgcgacttcctgaaactgaccctggagaactatgtgaaaaacctggaggtgcctgtaaagattatccggatggaagagagaagtggtcttattagagcaaggctgagaggtgccgccgcctcgaaaggccaggttatcactttcctcgatgcccactgtgagtgcacactcggttggctggaaccacttttagccaggatcaaagaagatcggaagactgtggtctgcccaataattgacgtcatctctgacgacaccttcgagtatatggctggctcagacatgacctatggggggttcaattggaagctcaattttaggtggtatcccgtcccacagagggaaatggaccgtcggaagggcgataggacattgccagtccgcactcccaccatggcaggcggcttattctccatcgatcggaactactttgaagaaattgggacctatgatgcaggtatggacatctggggcggcgagaacctagaaatgtcttttcgtatctggcagtgcggagggtctttggaaatcgtcacctgttctcacgtgggacacgtgtttaggaaggccacaccgtatacattccctggaggaactggccatgttattaataagaacaacagacgactggccgaagtttggatggacgagtttaaagactttttttatatcatttcgcccggagtggtgaaagtagactacggtgacgttagcgtcaggaagaccctgcgggagaacctcaagtgcaagccgttcagttggtatctggaaaatatttaccctgatagccagatacccaggagatactattccctgggcgaaattcggaacgtcgagaccaaccagtgcctggataacatgggccgcaaggagaatgagaaggtaggaattttcaattgtcacggcatgggggggaaccaggtgtttagttacaccgctgacaaggagattagaaccgatgatctgtgcctagatgtgagccgacttaacgggcctgtgatcatgcttaagtgtcaccacatgcgtggaaaccagctctgggagtacgatgctgagcggttgaccctcaggcacgtcaattctaatcagtgtttagatgagccttccgaggaagataagatggtgccgaccatgcaggactgcagcggtagtaggtcgcagcagtggctcctgaggaacatgacgctgggcacctag

SEQ ID NO: 140033 - DNA, 1686 bp, Artificial Sequence
  Description of Artificial Sequence: Synthetic coding sequence
atgcgccgcttcgtgtactgtaaagtcgtgctcgccacaagcctcatgtgggttctggtcgacgtgtttctgcttttgtacttctccgaatgcaacaagtgcgacgataaaaaggaaagaagcctactgccggccttacgagctgtcatctctcgaaaccaagaaggccctggggaaatgggtaaagctgtgttgattccaaaagatgaccaagaaaaaatgaaggagctgttcaagatcaaccagtttaatctcatggcttcagatttaatcgcactcaaccgttctttgcctgacgtacgtctcgagggctgtaaaaccaaggtgtaccctgacgagctgcccaacaccagcgtagtcattgtgtttcataacgaagcttggagtaccctgctccgaaccgtgtacagcgtgataaatcgctccccacactatctgctgtccgaagtgatactggtggatgacgcatctgagcgagatttccttaagctcaccctcgagaactacgtcaaaaatcttgaagtgccagtgaaaattatccgaatggaagagcgaagtgggctcatacgcgcacgcctgcgcggcgccgccgcaagtaaaggacaggttataacttttcttgatgcgcattgcgagtgcactctggggtggctcgaacctcttctagcccgcattaaggaggaccggaagacagtggtgtgccccattattgatgtcatttccgatgatacctttgaatatatggccggctcagacatgacttatggggggttcaattggaagctcaatttcaggtggtatcccgtgccacagagagaaatggacagaaggaagggcgatcgaactctgcccgtgaggactcccacaatggccggaggcctatttagtatcgacagaaattattttgaagaaattggaacctacgatgctgggatggacatctgggggggtgaaaatctggagatgtcctttaggatctggcagtgcggaggttcactggagattgtgacgtgctcccacgtggggcatgtcttcagaaaggcgacaccttatacattccccgggggcaccggacacgttattaacaaaaataaccgcagactcgccgaagtctggatggacgagtttaaagattttttttatattataagccctggcgtggtgaaagtggattatggagacgtgtcagtcagaaaaaccctccgggaaaacttgaaatgtaagccattctcttggtaccttgaaaatatatacccagacagccaaatccccaggagatactattcgctcggcgaaataaggaacgtggaaacaaatcagtgtctcgataatatgggccgaaaggagaacgagaaagtgggaatttttaactgtcacggaatggggggtaatcaggtgttctcgtacacagcagacaaagagattcgcaccgatgatctgtgccttgatgtgtcacggctgaacggccctgttattatgcttaagtgtcatcacatgcgcggcaaccaattatgggagtatgatgccgaaagctgcttgagtgtaaataaggtagcagatggcagtcagcatccaaccgtggaaacctgcaacgattccacactgcagaagtggctgcttaggaattatacccgtatggagatctttcggaatatattcgggaactctacggactatatattgtag

SEQ ID NO: 140034 - DNA, 60 bp, Artificial Sequence
  Description of Artificial Sequence: Synthetic coding sequence
atgcgtagattcgtgtattgcaaagtcgtgctggccacatccctcatgtgggtgctgtag

SEQ ID NO: 140035 - DNA, 1659 bp, Artificial Sequence
  Description of Artificial Sequence: Synthetic coding sequence
atgcgcagacttacccgccggctggtcctgcccgtctttggagttctgtggattacggtcctgttattcttttgggttacaaagagaaaactggaggtgcctacaggtccggaagtgcaaactcccaagcctagtgatgccgactgggatgatctctgggaccagttcgacgaacgacggtacctgaatgcaaagaagtggcgcgtcggcgatgacccctacaagctgtacgcctttaatcagcgggaatctgagaggatctccagcaatagagccatcccagataccagacacttaagatgcaccctcctcgtgtactgcaccgatctgcccccaacatctattattatcactttccataatgaggccaggtccacccttctccgcaccatcaggtcagtgctcaaccgcaccccaactcacctcataagagagattatcctcgtagacgactttagtaacgaccccgatgattgtaagcagctgatcaagctgccaaaggttaagtgcttgcgcaacaatgagcggcagggcctagtgagaagccggattaggggcgccgacatcgcacagggcacaaccttgactttcctggacagccactgtgaagtcaacagggattggctgcagcccctcctgcatcgggtcaaagaagattataccagggtcgtgtgtccggtgattgatatcataaatcttgacacctttacgtatatcgagtccgccagtgagctgcgaggcggctttgattggagcctgcatttccagtgggaacaattgtccccagaacagaaggccagacgcctggatcctactgaacctatcaggactcctattattgccgggggcttgtttgtgatcgataaggcgtggttcgactacctcggcaaatatgacatggatatggatatctggggcggcgagaatttcgaaatatcttttcgcgtgtggatgtgtggaggatccctcgagatcgtgccttgctcaagagttgggcatgtctttcggaaaaagcacccatacgttttcccagacggcaatgctaacacttacatcaaaaatactaaacgcaccgccgaagtatggatggacgaatataagcagtactactacgctgcaaggccatttgctttggaacgtccatttggtaacgtagagtcccggttagacctgcgcaaaaacctccgatgtcaatctttcaagtggtaccttgaaaatatttatcctgagctctcaattcctaaggagagtagcatacagaaggggaacatccgacagagacagaagtgcctggagtctcagagacaaaataaccaggagactcccaatctcaaattgtctccttgtgcgaaggtgaagggggaagacgctaaatcacaggtgtgggccttcacttacacacagcagattctacaggaggaactgtgcctttctgtgatcacgctctttccaggggcacctgtcgtactggttctctgtaagaacggggacgaccgacagcagtggactaagacggggtcccatatagaacatattgcctcccatctgtgtctggatacggacatgtttggcgatggaaccgagaacgggaaggaaattgttgtgaatccctgcgagagtagcctcatgtcccaacactgggacatggtgtccagttag

SEQ ID NO: 140036 - DNA, 1560 bp, Artificial Sequence
  Description of Artificial Sequence: Synthetic coding sequence
atgcggcggctgacaagacggctggtgctgcccgtcttcggcgtgctttggatcacagtgctcctttttttctgggtcacaaagcgcaagttggaggtgcccacaggccccgaggtccagacacccaagcccagcgacgccgactgggacgacttatgggatcagtttgacgaacgacgctacctcaatgctaaaaagtggagggtgggtgatgatccatataagttgtatgcgttcaatcagcgggaaagcgaaagaatcagctcaaacagagcgatacctgacactcgccaccttagcgtgttgaacaggactccgacacatctgatcagggagatcatcctcgtggatgatttcagcaatgaccccgatgattgtaagcaacttattaagcttcctaaagttaagtgcctgcggaataatgagagacaaggactggtcaggtcccgtatacggggagccgacattgcccagggcacaactctcacttttctggactctcactgtgaggtgaatagggattggttacaacccctcctgcacagagtaaaagaagactacacacgagtggtctgtcccgtcattgatattataaacctcgatacctttacttatatcgagtctgcatcagaactccgcggaggattcgactggtctctccactttcaatgggagcaattgtctcccgaacagaaagcgcggagactggaccccacggagcctattcggactcccattattgcaggcggcttattcgtcatagacaaggcctggttcgactacctcggaaagtatgatatggacatggacatctggggcggcgagaattttgagataagctttagagtgtggatgtgcggcggaagcctggagatcgtaccctgttcccgggtgggacacgtgtttcggaagaagcatccctacgtattccctgatggcaacgcgaacacgtacatcaaaaatactaagcgcactgccgaggtatggatggacgagtacaagcagtactactacgcagcaagacccttcgctcttgaacgacctttcgggaatgtcgaatcacgactggaccttaggaaaaaccttcgatgccagtcattcaaatggtacctggagaatatctatccggaactttcaatccctaaggaaagtagtattcagaaaggaaacatccgacaacgtcagaagtgcttagagagtcagaggcagaataaccaggagactccaaatctcaagctgtcgccttgcgctaaagtcaagggagaagatgcaaagagccaggtgtgggccttcacatacacacagcagatcctacaagaggagctctgtctgtccgttatcacactcttcccaggggctcccgtggtcctcgtgttgtgtaagaatggcgacgatcggcagcagtggacaaagaccggctctcacatcgagcacatagcgtcacatctgtgtctggacaccgacatgtttggcgatggcactgagaacggaaaagagatcgtcgtgaatccatgtgagtcctccttgatgagtcaacattgggacatggtcagttcatag

SEQ ID NO: 140037 - DNA, 1599 bp, Artificial Sequence
  Description of Artificial Sequence: Synthetic coding sequence
atgtcctttcctatgtccctagcgcgatctagcgtccctttcgcagactcgggtctttcctccagccagcctagcgacgcagactgggacgacctgtgggatcagtttgacgagcgccgctacctcaacgccaagaagtggagggtgggagatgacccctataaactttatgcttttaaccagcgcgaatccgaacggatttccagcaatcgagctatccccgataccaggcacctccggtgcaccttgctcgtttattgcaccgatctcccaccgacttctatcatcataacattccacaacgaagctagatcaaccctgctgaggaccattcgcagtgtcctaaatagaaccccgactcatctgatccgggagataatcttggtggatgattttagcaacgacccggatgattgtaaacagcttattaaattgccaaaagtgaagtgccttagaaataacgaaaggcagggacttgtcagatcacgcattcgaggggccgacatcgctcaggggacgacgctaacgttcctggatagtcactgtgaagtgaatagggattggctgcagcctctgttgcatcgcgttaaggaggattacactagggttgtgtgccctgtgattgatatcatcaacctcgacacttttacctacattgaatctgccagtgagcttcgcggaggtttcgattggtcactgcattttcaatgggagcaacttagccctgaacaaaaggcccgtcgcttggatcccacagaacctatccggaccccaattattgcgggcggcctcttcgtaattgacaaagcgtggttcgattatctcggcaagtatgacatggacatggatatctggggcggggagaacttcgagatttccttcagggtatggatgtgcgggggttcgcttgaaattgtgccctgctcccgagtcgggcatgtctttagaaagaaacacccctatgttttccccgacggaaatgctaatacttatatcaaaaataccaaacggaccgccgaggtgtggatggatgaatacaaacaatactactacgctgccagacctttcgccctcgagaggcccttcgggaacgtcgaaagtcgcttggacctgcgtaagaacctgcggtgccagtccttcaagtggtacttagaaaatatctaccctgagctctctattcccaaagagtcctccatacagaagggcaacattcgccagcgacagaagtgtctagaaagccaaaggcagaataaccaagaaactcctaacttgaaacttagcccatgcgcgaaggttaagggcgaagatgcaaaaagccaggtttgggcattcacttacacgcagcaaattctgcaagaggaactgtgtctcagtgtgataaccctctttccaggagcccctgttgtccttgtattgtgcaaaaacggcgatgatagacagcaatggacgaaaacaggctcccatatcgagcatatcgctagtcatctctgcctggacacggacatgttcggcgacgggaccgaaaatggtaaggagatcgtggtgaatccttgcgagtctagtctgatgtcacagcactgggatatggtctcatcctag

SEQ ID NO: 140038 - DNA, 1554 bp, Artificial Sequence
  Description of Artificial Sequence: Synthetic coding sequence
atggcacaggacgagtcatgccctccaagcgacgccgactgggacgacctgtgggatcaattcgacgagagaaggtatctgaacgccaaaaagtggcgtgtgggtgatgatccgtacaaactgtatgcgttcaatcagagggagtctgagcgtattagttcaaatagagcaatacctgacaccaggcatctgcgttgtactctcctagtttattgtaccgatctgcccccaacttccataatcattacattccacaacgaggccagaagtacactgcttcgcactatcaggtctgtgcttaatcgcacccctacccatttaattcgggagatcatactagttgatgacttcagtaacgatcctgatgattgcaagcagttgattaagttgccaaaggtgaagtgtcttcggaataacgaaagacagggccttgtaaggagccggattagaggagccgatattgcacagggtactactctgaccttcctggacagccactgcgaagtgaaccgggattggctccagcctttgttgcaccgcgtaaaggaagattacacacgtgtggtctgtcctgtcatcgatattatcaacctggatacctttacatatattgaatcagcatccgaactgcgaggcgggttcgactggagccttcactttcaatgggagcagctgtcccccgagcagaaagcgcggcgccttgacccaaccgaacctatcaggactcccatcatagctggagggctgttcgttattgacaaagcatggtttgactacctgggaaagtatgacatggacatggacatttggggcggggaaaacttcgaaattagtttcagggtgtggatgtgcggaggatcactcgaaatagtgccatgctcaagagtcggccacgtgtttagaaaaaaacacccatatgtgtttccagacgggaatgctaacacatatatcaagaacacaaagaggacagccgaagtctggatggacgaatataagcagtattactacgcagccaggccctttgcccttgaaaggccctttggtaacgtagaatctcgcctggacctgaggaagaacctccgatgccaatcttttaaatggtacctcgagaatatttatcccgaactgtccatcccaaaagaaagctctatccaaaagggcaacatccgccagagacaaaagtgtctggaaagtcagcggcaaaacaaccaggagacaccaaacttgaagctgtccccctgtgccaaagtcaagggcgaggacgcaaaaagtcaagtctgggcgttcacgtacactcaacagattctccaagaagagctgtgcctgagtgttattactttgtttcctggtgcccctgttgtcctggtgctctgtaagaatggggatgatcgacagcagtggaccaagaccgggtctcatattgaacatatcgctagccacctgtgcctggacacagatatgttcggcgacggaacagagaacggcaaagagattgtcgtgaacccctgcgagagcagcctgatgtcacaacactgggacatggtctctagttag

SEQ ID NO: 140039 - DNA, 1674 bp, Artificial Sequence
  Description of Artificial Sequence: Synthetic coding sequence
atgcgccgccttaccaggcggctcgtgctacccgtattcggagttctctggatcacagttttactcttcttctgggtgaccaaacgcaagttagaggttccgacaggtccagaggtgcagaccccaaaggtgtggtcactgttttttaaagtcgccggtatgagcccatgggctccccaagttcctgtgtctccgacccccccttaccaaagaggccatctgccgacaggtggtcacctggctgtttgccattttccatgcctgttgcaggaggcccaatttcacttgcagacccaggtttttttgcaggtgcgctgtactctactagtctactgcacagacttgccacccacctccattattatcacttttcataacgaagccaggtctacactactcaggacgatccgcagtgttcttaataggacccccactcacctgatcagagagataatcctggtagacgacttctcaaacgatccggacgactgtaagcagctgatcaagctacctaaagtcaaatgcctacgaaacaatgagaggcaagggctggttaggtctcgcatccgcggcgcggatatcgcccagggaaccacgctcactttcctagactctcactgcgaagtcaacagggattggcttcagcccctattacaccgggtgaaggaggattacactagggtggtgtgcccagttatcgatattattaacctcgatacatttacatatattgagagtgcctctgaactcagagggggctttgattggagtctccattttcagtgggaacaacttagccccgaacagaaagccagacgtcttgatcctaccgagcccatcagaactccaatcatagccggaggtctctttgtgatcgataaggcgtggttcgactatttaggaaaatatgacatggatatggacatctgggggggagaaaacttcgagatatcctttcgggtctggatgtgcggagggtccctcgagatcgtgccctgcagcagggtgggtcacgtatttcggaagaaacatccgtacgtgttccccgacgggaacgccaacacatacattaagaatacaaaacggacagctgaggtgtggatggatgagtataagcagtattactacgccgcaaggccctttgctttagaacggccattcggaaacgtcgaatccagactcgatctgcgcaaaaacttgcgctgccagtcttttaagtggtatctcgagaatatctaccccgagctcagcattcccaaagagtccagtatccagaagggaaatataaggcagcggcagaaatgtttagagtctcagagacagaacaatcaggagacaccaaacctgaaactaagcccatgtgccaaggtcaaaggggaggacgcgaagtcacaggtctgggccttcacatatacccaacaaattctgcaggaagagctttgtctgtcggttatcacactgttccctggagcgcccgtcgtcctggtgctgtgtaagaacggtgacgaccgtcagcagtggacaaagacagggtcacatatcgagcacatcgcaagtcatttatgccttgacaccgatatgttcggggacggcacggagaacggcaaagaaatcgttgtgaacccttgcgagagctcattgatgagtcaacactgggacatggtatcgtcctag

SEQ ID NO: 140040 - DNA, 1716 bp, Artificial Sequence
  Description of Artificial Sequence: Synthetic coding sequence
atgagaagaagaagccgtatgcttctgtgcttcgcgttcctgtgggtcttagggatcgcttactacatgtacagcggcggtgggtccgcgctcgcagggggggccggcgggggtgccggcagaaaggaagattggaacgagattgatcctatcaaaaaaaaggatctacaccatagtaatggcgaggaaaaggcacagtcaatggagacactcccaccaggcaaggtgcggtggcccgatttcaaccaggaggcttatgtaggaggcaccatggtgagatccggccaggatccttacgcccgtaataagttcaatcaagtcgagagcgataagctccgaatggatagggccatccctgacacaaggcacgatcaatgtcaaagaaagcagtggcgggttgacctccccgccactagtgtggttatcacattccacaatgaagcaaggtcagccctgctgagaacggtggtgagcgtgttgaagaaatctccgccacacctgatcaaggagattattttagttgatgactactccaatgaccccgaagatggggcgttgcttggaaagatcgagaaggtacgcgtcctgcgcaacgacaggcgcgaggggctgatgaggtcgagggtccgaggtgcggacgctgcccaggccaaagtactcaccttcctcgactctcactgtgagtgcaatgagcactggctagagcctctcttggagcgcgtggcagaagaccgcacccgcgtcgtgagtcccatcattgatgtcattaatatggataattttcagtatgtgggtgctagcgctgacctgaagggcggcttcgactggaacctcgtctttaagtgggactatatgacccccgagcaaaggaggtctaggcagggaaatcccgtggctccaatcaagactccaatgattgcaggtggactcttcgtgatggataagttttacttcgaggagctggggaaatacgatatgatgatggatgtctggggtggagaaaacttggaaatcagcttcagggtgtggcagtgtgggggctccctggagataattccctgttctagggtagggcatgtgtttaggaaacagcatccttatacatttcccgggggatctggtacagttttcgctaggaacacaagacgggcagccgaagtatggatggacgagtacaaaaacttctactatgctgctgtgccctcagcccgcaacgtgccctatgggaacattcaatcaagactggagctcagaaagaagctctcgtgtaagccattcaagtggtatctggagaatgtatacccagagttgcgcgtgcccgaccaccaggacatcgctttcggcgccctgcagcagggcaccaactgcctcgacacactgggccacttcgccgacggtgtcgtgggagtatatgagtgtcacaatgcgggaggcaaccaagagtgggccctgacaaaggagaagagtgtgaaacatatggacctgtgccttaccgtagttgatcgggcaccgggatctctcattaagcttcagggttgtcgggagaacgactcccggcagaaatgggagcagatcgaggggaatagtaaattaagacatgttggttccaacttgtgcttagacagccggaccgccaagtccgggggtctgagtgtggaggtctgcgggccggcgttatcacagcagtggaagtttacattgaatctgcaacagtag

SEQ ID NO: 140041 - DNA, 798 bp, Artificial Sequence
  Description of Artificial Sequence: Synthetic coding sequence
atggtcagaagcgggcaggatccgtacgcccggaacaagtttaaccaggtggaatctgataaactgcgcatggatcgggccatccctgatacgagacacgatcaatgccagcggaaacagtggcgggttgacttaccagctacttctgtggtcataactttccataacgaggccaggtccgccctattacgtacagtggtcagcgtgttgaaaaagagcccgcctcacttaatcaaagaaatcatcctggtcgatgattattctaatgatcccgaagatggagcacttctgggtaagatcgaaaaggtgagggtactgagaaacgaccgccgggaaggacttatgaggagcagagtcaggggagcagatgccgcccaggctaaggtactaacatttctcgacagccactgtgaatgcaacgaacattggctcgagcctctactggaacgggtggcagaagaccgcacaagagtggtgagccctatcatagacgtgatcaacatggacaacttccagtacgtcggagctagcgcagatctgaagggaggcttcgactggaacttggtctttaaatgggactacatgactcctgaacagcggcgctcgagacagggaaacccagtggccccgatcaaggacctggttcctagagtggcagtatggtggcagccaggggatcatccggtccagccttgtgggactagggttccagaggcggcaccgctgcacgtccctggatggcagtggcactgcctgtgtcctaaacatcccccgggctcaagaggactggacggttag

SEQ ID NO: 140042 - DNA, 1086 bp, Artificial Sequence
  Description of Artificial Sequence: Synthetic coding sequence
atgagaagaagatctaggatgctactgtgctttgcatttctatgggtgctgggaattgcctattatatgtacagcggcggcggctccgccctcgcaggaggcgcgggaggtggagcggggcggaaagaagactggaatgagatcgacccgatcaagaagaaggatctgcaccatagcaatggtgccgaggatggagcccttctgggaaaaatcgagaaagtaagagttctgaggaatgaccggcgggagggcctgatgcgttccagagtgaggggtgcggacgctgcacaggcgaaggtgttgacttttctcgattctcattgcgagtgtaacgagcattggctggagcccctgctggaaagggttgctgaggatcgtacaagagtggtgtcacctatcatcgacgtaataaacatggataactttcagtatgtcggcgcctctgccgatttgaaagggggcttcgactggaatctagtatttaaatgggactacatgacgcctgagcagcgccgctccagacagggcaacccagtagcccccattaaaacgccaatgattgccgggggactctttgtgatggacaagttctatttcgaggagctgggcaagtacgatatgatgatggacgtctggggcggcgagaacctggagatttcctttcgggtgtggcaatgtggcggatccctggagatcattccctgctctagggttggacacgtttttagaaaacaacacccttacaccttccctggcggcagcgggactgtattcgcaagaaataccaggcgagctgccgaagtctggatggacgagtataagaacttttactatgctgccgtcccatctgccaggaatgtaccttacggcaacattcaaagcaggcttgaactgcgcaaaaaattatcctgcaaaccattcaagtggtacctcgagaatgtttatcctgaattgcgggtgcctgaccaccaagacattgcctttggggccctgcaacagggcaccaattgcttagatacactggggcacttcgctgatggagttgttggcgtctatgaatgtcacgttgctggactgaggcagtag

SEQ ID NO: 140043 - DNA, 1602 bp, Artificial Sequence
  Description of Artificial Sequence: Synthetic coding sequence
atggccgacagagaggattggaacgaaatcgaccccattaaaaaaaaggatctgcatcacagcaatggcgaagagaaagcccaaagcatggagactctgccacctggaaaggtcaggtggccagactttaatcaagaggcatacgttggtgggactatggttcgatcaggccaggacccttatgcccgaaataagtttaaccaagtcgagtccgataaactgcgtatggaccgcgccattccagacactagacatgatcagtgccagcggaagcagtggagagtagacctgcccgccacgagcgtggttatcaccttccataacgaggcccggagcgcgctcctcaggacggtggtgtcagtgttaaagaaaagccctccgcatttgataaaggagattatccttgttgacgactactctaacgatccagaggacggcgcactgttaggcaaaattgaaaaagtgcgtgtactgaggaatgacaggagggagggtttgatgcggtccagggtgcgaggcgccgatgcagcccaggcaaaagtcttaacctttttggactcccactgtgagtgcaatgaacactggctagaacccttactcgagcgagtggctgaagatcgaacacgggtagtctctcccataatagatgtgattaacatggataacttccagtatgtgggcgcctccgccgatcttaagggggggtttgactggaacctcgtctttaagtgggactatatgactccagagcagcgacggagcaggcagggaaacccagtggcccccatcaagacccctatgatcgcaggcgggctgttcgtgatggacaagttctacttcgaagagctgggaaaatatgacatgatgatggacgtgtggggaggagagaacctggagatcagttttagggtctggcagtgtgggggcagcctagaaatcatcccatgctctagggtcggacacgtctttcgaaagcagcacccttacacatttccagggggcagcggaacagtgttcgcacggaatacacgaagggcagcggaagtctggatggatgaatataaaaacttctattatgcggcagtgccatcagctcgaaatgtaccatacggaaacatccaaagccgtttggaactgaggaagaagctgtcttgtaagccatttaaatggtacctggaaaacgtttacccggagcttagggtcccagaccaccaggacatcgcatttggcgctctccagcaaggaacaaactgcctggacacactgggtcatttcgccgatggcgtggtgggcgtatacgagtgtcacaacgccggaggtaaccaggaatgggccttaactaaggagaagtctgttaaacacatggatctgtgcttaactgttgtggatcgcgcccccggaagcttaatcaagttgcaaggctgcagggagaacgattctaggcagaaatgggaacagattgagggaaacagcaagctgcgccacgtgggatccaatctctgcctagattcccggactgctaagtctggcgggctgagtgtggaagtgtgcggtccagctttgtcccaacagtggaagtttaccctgaatctgcaacagtag

SEQ ID NO: 140044 - DNA, 1902 bp, Artificial Sequence
  Description of Artificial Sequence: Synthetic coding sequence
atggcccacctcaaaaggttagtcaaactgcatattaagagacactatcacaaaaaattctggaaactgggcgcggtcattttcttctttattatagtcctggtcttgatgcaacgtgaagtaagcgttcagtacagtaaggaggagagccggatggagagaaatatgaaaaataaaaataagatgctcgaccttatgcttgaagcggtgaataatattaaagatgctatgcctaagatgcagataggggccccagtgagacaaaatatagatgcgggcgaacggccttgtctgcagggttactataccgctgccgagctgaagcctgtcctggacagacctccacaggatagcaatgcgccgggcgcttcaggcaaggcttttaaaactactaatttaagcgtcgaagaacaaaaagaaaaagagagaggcgaagcaaagcactgctttaacgcctttgcttccgatcggatctcgctgcaccgggatcttggacccgacacacggccacctgaatgtattgagcaaaaattcaagagatgccctcccctgcccacaacctccgtcattatcgtcttccataacgaagcgtggtctacccttttaagaaccgtgcacagcgttctctactcatcacccgccattctcctgaaggaaataatcctggttgatgacgctagcgtcgacgaatatctgcatgataagctggacgaatacgtgaagcaattttctattgtcaagatagttcggcagcgggagcgaaaagggctcatcaccgccagactgctgggcgccactgtggctaccgctgaaacactgactttcctagacgcccactgtgaatgcttttacggatggctcgagccgctgctggctaggattgctgagaattacacagccgtggtgagccccgatattgccagcatcgatctcaacacttttgaattcaataaaccttctccatacggctccaaccacaatagagggaattttgactggtcactgagttttgggtgggaatcgctgccagaccatgagaagcagagaagaaaggacgaaacttatcccatcaagactcccacgttcgccggaggactcttcagcatttccaaagaatattttgaatatatcggtagctacgatgaggaaatggaaatctggggaggagagaacattgaaatgtcgttcagggtgtggcagtgcggcggccaactggagattatgccctgtagcgtggtggggcatgtcttcaggtctaaatcgccacattcctttccgaaaggtactcaggtgattgcccggaaccaggtccgcctggccgaggtttggatggacgaatacaaggaaatattctacaggagaaacactgacgcagccaagattgtcaagcagaaggccttcggcgatctgtctaagcgtttcgaaatcaaacataggctccagtgcaaaaactttacctggtatctaaataatatctacccagaggtttatgtgccagacttgaaccccgtgatctcaggttatattaaaagtgtagggcagccattgtgcctcgacgtgggagagaataaccagggcggcaaacctttgatcatgtacacctgccacgggctgggtggcaaccaatattttgaatacagcgcgcagcacgaaatacggcacaatattcaaaaggagctctgtctacacgccgcacagggcctagtccaactgaaggcgtgtacatacaaaggacacaagactgtggttacgggtgagcagatctgggaaatccagaaggaccaattactgtataaccccttcctgaagatgtgcctgagcgctaatggagagcatcccagcctggtttcttgcaaccctagtgacccccttcagaaatggatactgagccaaaatgattag

SEQ ID NO: 140045 - DNA, 1395 bp, Artificial Sequence
  Description of Artificial Sequence: Synthetic coding sequence
atggcccacctgaagagactggtaaagctgcatatcaagcgacactaccacaaaaagttctggaaattgggggctgttatatttttctttattattgtcctggtgctcatgcagcgcgaagtgtccgttcagtatagcaaagaagagtctagaatggagcggaacatgaaaaataaaaataaaatgctggacctcatgctggaagccgtcaataatatcaaggatgccatgcctaagatgcagatcggtgctcctgttaggcagaacatcgacgccggtgagcgaccatgcctccaggggtattatactgccgccgaactgaagcccgttcttgaccgccctccccaagattctaatgcacctggagcgagcgggaaggctttcaagacaaccaacctctcagtggaggagcaaaaagagaaagaaaggggcgaagccaagcactgcttcaatgccttcgcgtccgacaggatcagcctccatagggatctaggacccgatacacgtcccccggaatgtatcgagcaaaagttcaaaaggtgcccaccactccccaccacatccgtgatcatagtgtttcacaatgaagcatggtctaccctgctgagaacggttcatagcgtcctgtattccagtccagccattttactcaaggaaatcattctggtcgacgatgcctccgtggacgaatacttgcatgacaaactggacgaatacgttaaacagttctccatagtgaagatcgtccggcaacgcgagcgtaaaggcctgatcacggcccgactgcttggcgcaactgtggccaccgcagagacgcttaccttcttggatgcgcattgcgagtgcttctacggctggctggagccattactcgcccggattgcagagaattacaccgctgtagtaagtcccgacatagcttccatagacctgaataccttcgaattcaacaaaccatcaccctacggcagcaaccacaaccgaggtaactttgattggtccctgagctttggttgggaaagcttaccagatcacgaaaaacagaggcggaaggacgagacttatcccatcaaaacccccaccttcgccgggggactcttttccattagcaaagaatatttcgagtacatcgggtcatatgacgaagagatggagatctggggaggagagaacattgaaatgtctttcagagtctggcagtgcggcggccaactcgaaatcatgccatgttccgtggtcggtcatgtgtttcgttccaaaagtcctcactccttcccgaagggcacgcaggtgatcgcaagaaatcaggtgcggctggctgaggtatggatggacgagtacaaagaaatcttttataggcgaaacaccgatgctgcaaagatcgtcaagcagtag

SEQ ID NO: 140046 - DNA, 174 bp, Artificial Sequence
  Description of Artificial Sequence: Synthetic coding sequence
atggcccatttaaagagattagtgaagctgcacatcaagcggcattaccataaaaaattttggaaactcggggcagttattttttttttcatcatcgtcctcgttctgatgcaaagggaagtttccgttcagtatagcaaagaagagtcccgcatggagagaaacatgaagtag

SEQ ID NO: 140047 - DNA, 78 bp, Artificial Sequence
  Description of Artificial Sequence: Synthetic coding sequence
atggctcatttgaagcgcctagtgaagctgcatataaaacggcactaccataagaagttctggaaactaggcgcctag

SEQ ID NO: 140048 - DNA, 273 bp, Artificial Sequence
  Description of Artificial Sequence: Synthetic coding sequence
atggctcaccttaagcgcctggtgaaactccacataaaaaggcactatcataagaagttctggaaattgggcgccgtgatcttttttttcatcattgtactcgtgctgatgcagagggaggtcagcgtccagtattctaaggaggagagtaggatggagaggaatatgaagaataaaaacaaaatgctagaccttatgcttgaggccgtaaacaatattaaggatgcgatgcccaagatgcagatcggagctccggtacgccagaacatttag

SEQ ID NO: 140049 - DNA, 36 bp, Artificial Sequence
  Description of Artificial Sequence: Synthetic coding sequence
atggcccacctaaagaggctagtgaagcttcattag

SEQ ID NO: 140050 - DNA, 1737 bp, Artificial Sequence
  Description of Artificial Sequence: Synthetic coding sequence
atggctgtgcggtggacctgggccggtaagtcatgtcttctgcttgccttcctcactgttgcctacatattcgtcgaacttctggtcagtaccttccacgcttcggccggtgctggtagagcccgcgagcttggctctaggcgtttaagtgatctgcaaaaaaatacggaggacctcagccgaccactctacaaaaagccccctgcagactccagggccctgggggagtggggcaaggccagtaaactccagctcaacgaagatgagctgaaacagcaggaagaacttattgagaggtacgccattaacatctacctaagcgaccgcatatccctccaccgccatatagaggacaagcggatgtatgaatgtaagagccagaagtttaattacagaacactgcccaccacttccgtcatcatcgccttttataacgaggcctggtctaccctgctgcgaacaatccatagtgtcttagaaaccagtcctgccgtcttactgaaggaaataatcctggtcgacgaccttagtgaccgggtttatctgaagacacagttggaaacatatatatccaatctggaccgagtccggctgatccggaccaacaagcgggagggcctcgtgagagcaaggcttatcggcgccacatttgctactggcgatgtgctcacgtttcttgactgccactgtgagtgcaacagcggatggctggaaccgcttctcgagaggattggtagagacgagaccgccgtcgtttgcccagtgatcgacacaatagattggaacactttcgagttttatatgcagattggcgagcctatgatcggaggcttcgattggcgattgacttttcaatggcacagcgtcccgaagcaagaacgtgaccgtcggatttcccgcattgatccgatcaggtcccctacaatggcgggtggactatttgctgtcagcaaaaaatacttccagtatttgggcacatacgataccgggatggaggtgtggggcggtgaaaacttggaactctcttttagggtctggcaatgcggcgggaagcttgagattcatccctgtagccacgtaggacatgtcttcccaaagagagccccatacgcacggcccaacttccttcaaaataccgcgcgcgcagcggaggtgtggatggacgagtacaaagagcacttttataacagaaacccaccagctcgcaaggaagcatatggtgatatatcagaaaggaaacttctccgagagaggctgcgctgcaagagctttgactggtacctaaagaatgtcttccctaatctacatgtgccggaagacaggcccgggtggcacggcgctatcagatcccgcggcatcagttctgaatgcttggactataatagccccgacaataatcctacaggggcaaacctcagcctttttggctgtcatggccaaggaggtaatcaattttttgagtacacctcaaataaggagataaggtttaactccgttactgagctgtgcgccgaagtgccagaacagaagaactacgtcgggatgcaaaattgccctaaggacggattccctgtgcctgctaatatcatctggcactttaaggaggatggaactatcttccaccctcactcaggactctgccttagcgcctaccgcactcccgagggccgtccggacgtccaaatgcgcacctgtgacgctttggacaaaaatcagatctggtccttcgaaaaatag

SEQ ID NO: 140051 - DNA, 1869 bp, Artificial Sequence
  Description of Artificial Sequence: Synthetic coding sequence
atgcggctgttacggcgccgccacatgcccctccgcttggccatggtggggtgcgcgtttgtgctgtttctcttcctcctgcatagagatgtgtcttcgagggaggaagcaaccgagaaaccatggttaaagtccttggtgtctcggaaagatcacgtcctggacctgatgcttgaggccatgaacaaccttagagactcaatgccaaaactccaaattagagcaccagaagcccagcagactctcttctccatcaaccaaagctgtcttcccggcttttatactcctgccgagctgaagccattctgggagagacctccccaggatcctaatgcccccggagccgacgggaaagcctttcagaaatcgaaatggactcctctcgaaactcaggaaaaagaggaagggtataaaaagcactgcttcaatgccttcgccagtgatcggataagccttcagcggtcgctcgggcccgatacacgtccaccagaatgcgtggaccagaagtttaggagatgtccgccactcgcaacgacatcggtgatcattgtgtttcacaacgaggcatggtcgacattgctacggacggtgtatagcgtgctgcacaccacacccgccattcttctgaaggagattatcttggtagatgacgccagcacggaagagcacctgaaagaaaagcttgagcagtatgtcaagcagcttcaagtcgtgcgggtcgtgcgtcaggaggagaggaaaggtctcatcactgccagactcctgggggcctccgtggcacaggccgaagtcctcactttccttgacgcccactgtgaatgtttccacgggtggcttgaaccgctgctcgcacggatagcggaagataaaacagtcgtggtcagtccagatatcgtgacgatcgaccttaacacatttgagtttgcgaaacccgtacagcgaggaagggtgcactcccgcggtaatttcgattggtccctaacctttggatgggaaacgttaccaccccatgagaaacagcggcggaaagacgaaacctacccaattaagagtccaactttcgccgggggtttgttttctatctccaagtcctacttcgagcacatcggtacgtacgataatcagatggagatttggggaggggagaatgtggagatgtcatttcgtgtctggcaatgcggtggccagcttgagatcatcccttgtagcgtggttggccatgtgtttaggaccaagagtccccacaccttccccaagggaacatcagttatcgctcggaaccaggtgcggctggcagaggtctggatggattcctacaaaaaaattttctacagacgaaatctgcaggccgcaaagatggctcaggagaagtcttttggcgacatcagcgaacgattgcagctcagggaacagctccattgccataatttcagctggtacctccataatgtctacccagaaatgttcgtgcccgatcttacaccaacattttatggtgctatcaaaaacctgggcacaaatcagtgcctcgacgttggggaaaacaacagaggcggcaagccattgattatgtatagttgccatgggctgggagggaatcaatactttgagtatactactcaaagggacttaaggcacaacatcgcgaagcagctgtgcctccatgtgtctaagggtgccttaggactcggatcctgtcattttacaggcaagaatagccaggtccctaaggacgaagagtgggagttagctcaggatcagctgatccgcaatagcggttcaggcacatgcctgacttcccaggataagaaacctgccatggctccttgcaatccctccgaccctcaccagctgtggctgttcgtctag

SEQ ID NO: 140052 - DNA, 1869 bp, Artificial Sequence
  Description of Artificial Sequence: Synthetic coding sequence
atgcgcctgttgcgcagaagacacatgccgctgaggctggccatggtgggatgtgcctttgtattgtttctgttcctgttacatcgcgatgtgtcctcaagggaagaagctaccgaaaagccatggctgaagtcacttgtaagtcgcaaggaccacgtgcttgacctgatgttggaagctatgaataatctaagggactctatgcccaagttgcagatcagagcgcctgaggcccagcaaactctgttcagcatcaatcagtcgtgcctgccagggttttatacacctgccgaactcaagcccttttgggaaagaccaccgcaagatccaaatgcaccaggggctgatgggaaggctttccagaagagcaagtggactcccctcgaaacccaggaaaaagaggaggggtataaaaagcactgcttcaacgccttcgcatcggacagaatcagtctccagcgaagtctcggtcctgacacacgacccccagagtgcgtcgatcagaaattcagacggtgcccccccctagcaaccacttcagtgattattgtgtttcacaatgaggcctggtctaccttactgagaaccgtctatagcgtcctccataccacccctgccatcctgcttaaagagattatcctggtcgacgacgcctccaccgaggaacatctgaaagagaaactggagcaatacgtgaagcagttgcaggtggtccgcgtggtccgccaggaggagcggaaggggctgataactgctaggctgctgggggcctctgtcgcacaggcagaggttctgacctttctggatgcacattgcgagtgtttccatggctggcttgagccactcttggcaagaatagctgaggacaagactgtagttgtttccccagacatagtaactatcgacctgaacaccttcgagttcgcaaaacctgtccaacgcggacgggtccactcaagaggaaactttgattggagtctaacgttcggttgggaaacactcccaccacacgaaaagcagagacgcaaggatgaaacctacccaattaaatcccccaccttcgctggcggtctcttttctattagtaagagctatttcgaacacattgggacatacgacaatcagatggagatctgggggggggagaatgtggaaatgtcgtttcgtgtgtggcagtgcgggggtcagctcgaaatcataccttgtagcgtcgtgggacatgtattcaggaccaagtctccgcacacctttcctaagggcacctcagtcatagcccggaaccaagtccggctggcagaagtctggatggactcttacaaaaagatcttttacaggcgtaatcttcaggccgctaagatggctcaggaaaaatctttcggggacatcagcgaacgcctgcagttgagagaacagctgcactgtcacaacttttcatggtacttgcataatgtttacccggaaatgtttgtgcccgatctgacaccaacgttctatggagccatcaaaaatctgggcacaaatcagtgcctcgatgtgggcgaaaacaataggggaggcaagcccctcatcatgtatagttgtcacggtctgggggggaaccagtactttgaatacaccacccagagggatctccgacacaatattgccaagcagttgtgtctccatgtctccaagggggctcttggccttggtagttgtcacttcaccggtaagaattcacaggtgccaaaagatgaggagtgggagctagcccaagatcagctgataagaaactcaggtagtgggacatgcctgacctcccaagacaaaaagccggcgatggccccctgcaacccctctgatccccaccaattgtggctgttcgtgtag

SEQ ID NO: 140053 - DNA, 1812 bp, Artificial Sequence
  Description of Artificial Sequence: Synthetic coding sequence
atgcggttgctcaggagaaggcatatgcccttgcggctggctatggtgggctgtgcatttgtgctgttcctcttcctgctggtaagccggaaagatcatgttctggacctcatgctggaggcaatgaacaatctgcgtgacagcatgcctaagctgcaaatcagagctcccgaggctcagcagaccttattctctattaaccaatcctgcctgcccggcttctacacaccagcagagctcaagccattctgggagaggccgcctcaggatcccaatgcaccaggagcagatggtaaagcctttcagaagagcaagtggacacccctggagacccaagaaaaggaagaagggtataagaaacattgcttcaacgcattcgccagtgatagaatcagcctccagcggtctctagggccagatactcgcccaccagaatgtgtagatcagaaattccggaggtgcccccccctagcaactacatccgtgataattgtgttccacaacgaagcgtggtcaactctgcttcgtaccgtgtactcagtgctacacaccacccccgctatcctgttgaaagagattatcctggttgatgacgcaagcaccgaagaacacctgaaggagaaattggaacagtatgtcaaacaactgcaggtggtgcgagttgtgcgacaggaggagagaaaaggccttataacagcacgcctgttgggagcgtccgtcgctcaggcagaggtgctcactttcctggatgcgcattgtgagtgttttcacggctggctggagcccctgcttgcccggattgctgaggataagaccgtggttgtgtccccagacattgtcacaattgacctcaatacctttgaattcgctaaaccagtccagaggggcagggtccactcaaggggcaattttgattggtccctgacttttggatgggaaacactgcccccacacgagaaacaacgacgtaaggatgaaacctaccctatcaagagcccaacatttgctggaggcctgttctcaatttcaaaatcttattttgagcatattggcacctatgataatcagatggaaatatgggggggggaaaacgtcgagatgtcctttcgggtgtggcagtgcggtggacaacttgaaatcattccatgttctgtggtgggtcacgtgttccgcacgaaatcccctcacacttttcctaaaggcacgagtgttattgcccgcaatcaagttcgtctcgccgaagtctggatggactcctacaaaaaaatcttctaccgccgcaacttgcaagccgccaagatggctcaggagaaaagttttggggatatctctgagaggttgcagttaagagaacaactgcactgccacaacttcagttggtatctccacaatgtgtaccctgagatgtttgtgccagaccttaccccgaccttttacggtgcaattaaaaaccttgggacgaatcaatgtctggatgtaggcgagaataaccgtggaggtaagccactgattatgtactcttgtcacggcttgggagggaatcagtacttcgaatacactacacaacgcgacttacgccataatatcgccaagcaactgtgtctgcatgtgtctaagggagccctggggctgggatcctgtcacttcacaggaaaaaattcccaggtacccaaggacgaggaatgggaacttgctcaggaccagctcatacgcaattctggctccggaacctgccttacatcccaggataagaaaccggcaatggccccttgtaacccctcagatcctcaccaattgtggctgtttgtgtag

SEQ ID NO: 140054 - DNA, 1974 bp, Artificial Sequence
  Description of Artificial Sequence: Synthetic coding sequence
atgcgcttgaaaattggttttattctgagatctctgctggtggtcggaagctttctgggtctggtggttctctggagttcgttgactccaagacccgatgacccctctccgctgtcccgcatgagggaggaccgcgacgtgaatgaccccatgcctaatcggggaggaaacggactggcacctggggaggacaggtttaagcccgtggtgccctggccccatgttgagggcgtggaagtcgaccttgaatcaatccgccgaatcaacaaggccaagaatgaacaggaacaccacgctggtggtgattcacagaaggatattatgcagagacagtacctcacctttaagcctcagacattcacgtaccatgatcctgtcttgagaccggggatcttgggaaacttcgagccaaaagagcctgaaccacccggtgtcgtgggaggacccggtgagaaggcaaaaccactggtgctggggcctgagtttaaacaggctatccaagcctcaataaaagagtttggcttcaacatggtagctagtgatatgatctcattggacaggtccgtgaacgacctacgacaggaagaatgtaaatattggcattacgacgaaaatctgttaacgagttcggtggttattgtctttcacaatgagggttggtcgacgctgatgagaactgtgcacagcgtcatcaaacggactccacggaaatatttagccgaaatcgtcctgatcgacgattttagcaacaaagagcacctcaaggaaaagctcgatgagtatatcaagttatggaacggattagttaaggtgttcagaaacgaaagacgtgaaggccttattcaggccaggtctataggcgcccaaaaagcgaagctgggccaggtacttatctacctagatgcccactgcgaggtcgctgtaaactggtatgccccgctcgttgctcctatttcgaaggatagaacgatctgtaccgtcccattgatagacgtcattaatgggaacacgtacgagatcattcctcagggcggcggagatgaggacggatacgcaagaggagcctgggactggagtatgctatggaagcgcgtccctttgacaccccaggaaaaaaggttgcggaaaactaagacagaaccctaccgcagcccggcgatggccggtggactttttgccatagagagggagttcttcttcgagctggggctgtatgatcctggcctgcagatttgggggggcgaaaacttcgagatctcatacaagatatggcagtgcggggggaagctactatttgtgccctgttcacgcgttggccatatctacaggttggaaggctggcaagggaaccccccacctatatatgtggggtcttcacccactctgaaaaactatgtaagggtcgttgaggtttggtgggatgaatacaaagactacttctatgcaagcaggccggagtcgcaggctcttccctacggagatatctcagaactgaaaaaatttcgcgaagatcataattgcaagtcatttaaatggtttatggaggaaatcgcctatgacatcacatcccattacccgttaccacctaaaaacgtggactggggagagattcgaggattcgagacagcttattgtattgattcaatgggcaagacaaacggagggttcgttgaactcggcccgtgccatcgcatgggcggcaaccaacttttccgaattaatgaggccaaccagttgatgcagtatgatcaatgtcttacgaagggagccgacggcagtaaggtaatgattacacattgcaacctgaatgagtttaaagagtggcagtattttaaaaacctgcacaggttcacccatatcccttccggcaaatgtttagacaggagcgaagtcctacaccaggtattcatttccaattgcgattcaagcaagaccacacagaagtgggaaatgaacaatatccactccgtctag

SEQ ID NO: 140055 - DNA, 717 bp, Artificial Sequence
  Description of Artificial Sequence: Synthetic coding sequence
atgcgtacagtacatagtgtcatcaagagaaccccacgaaagtacttggctgagatcgtcttgatagatgatttttctaataaggagcatttgaaggaaaaactggatgaatatattaagctgtggaatgggctcgtgaaagtcttccgcaatgaaaggagagagggcctgatccaagctagatccatcggagctcagaaggcaaagctcggccaggtgttgatctacttagatgctcactgtgaggtggcagtcaactggtacgccccactcgtcgcccccatttctaaagacaggacaacgtgcacagtaccattgatcgattatatcgacggaaacgattacagtatcgaaccccagcagggaggcgatgaggacggctttgccaggggtgcctgggattggagtctcctgtggaagcgcatccctctgtcacacaaggaaaaagctaagcgtaaacacaagaccgaaccatatcgcagcccagccatggctggcgggctttttgctattgagcgcgaatttttcttcgaactcgggctgtatgaccctggcctacagatctggggaggaaagacccttcgttctcatacccggtatggctccgtggtggccaactattatctatttttggtgctagtgctcgacatatcaactgttctgagggcaggaaaggagatcttacgtccgtttatgttaggactgctccagctatag

SEQ ID NO: 140056 - DNA, 1914 bp, Artificial Sequence
  Description of Artificial Sequence: Synthetic coding sequence
atgatgttttggaggaaactccctaaagcccttttcattggtttgacactcgcgatcgcagtaaatcttctgctggtgtttagcagtaagggtaccctacaaaatctgttcactggcgggctgcaccgcgagctacctttgcacctgaacaagcgatatggcgcagtgatcaaaagactctctcacctggaggtggagcttcaggatctgaaagaaagcatgaaactcgccctgcggcaacaggaaaacgtaaatagcaccttaaagcgggccaaggacgaggttcgtcctctcctgaaagccatggagacaaaggtcaacgagaccaaaaagcataagactcagatgaaactctttcctcacagtcagctgttccggcagtggggagaggatctgagtgaagcacagcagaaagccgctcaggatctttttcgcaagttcggatacaatgcatacctgtcaaaccagctgccactaaacaggacgatcccagacacaagggattatcggtgcctccgaaagacgtacccaagtcaacttccctcgctctcggtcatcttgatttttgtgaatgaagccttgagcattattcagcgggcaatcacatctataatcaaccgcacaccttcccggctgttaaaggagattatcctggtggacgatttcagtagtaatggggaattgaaggttcacctcgatgagaagatcaagctgtataaccagaaatacccagggctccttaaaatcattcggcaccccgagagaaaaggactggctcaggcacgcaatacagggtgggaggcagcaacagctgacgtggtcgccattctggatgcccacatcgaagtaaatgtgggttgggccgagccaatcctggctagaattcaggaggaccgaaccgtcattgtgtctcccgtttttgataacattcgattcgacaccttcaaactcgacaaatacgagctcgccgtagatggctttaattgggagctgtggtgcaggtacgatgccttgcctcaggcatggattgatctgcacgatgtgaccgcccccgtcaagtcaccaagcatcatgggtatcctggccgccaatagacacttcctgggagaaatcgggtctctggacggtggcatgctgatttacgggggggagaacgtagaactctcgctgcgtgtgtggcaatgtggcggcaaagtggagatcctgccatgctcccgtattgcgcacttggaaagacaccacaagccgtatgcgctggaccttacggccgccctgaaaagaaacgctctccgggtggctgagatctggatggatgaacataagcatatggtttacctcgcttggaatatccctctgcagaattccggcattgacttcggggacgttagctcacggatggccttgagagagaagctcaagtgcaagacttttgactggtacctgaagaacgtctatcctctacttaaaccactgcacacaatcgttgggtacggacgcatgaagaatctcttagacgaaaatgtgtgcctcgatcagggaccggtccctggtaacacccctataatgtactactgtcacgaattttcctcacaaaacgtgtattatcacctgactggagagctgtacgtcggccagctgatcgcggaggcttctgccagcgacagatgcctaactgaccccggaaaggccgagaagcccacactggagccatgttctaaagcggccaaaaaccggctgcacatatactgggacttcaagcccgggggagccgtgattaatcgggacacaaagaggtgtttagagatgaagaaggatctcctgggcagccacgtgctggtcttacagacctgtagtactcaggtttgggagatccagcacacggtgagggattggggccagaccaactctcaatag

SEQ ID NO: 140057 - DNA, 648 bp, Artificial Sequence
  Description of Artificial Sequence: Synthetic coding sequence
atggaatttgactgcgaggggctgcgcagattgctgggaaagtacaaattccgggacctgactgtggaggaattgcgaaatgtaaacgttttcttcccacatttcaagtacagcatggacacatacgtgttcaaagattcctctcagaaggatctcctgaattttacaggaactatcccagtgatgtatcaaggaaatacctataatatcccaattcgattctggatactagattcacacccctttgctccaccaatctgctttctcaaaccgaccgccaatatggggattctggtgggcaagcatgtagatgcccaggggcggatttacttgccctacctgcagaattggtcacatcccaagtccgttatcgtgggcctgattaaggagatgattgctaaatttcaggaagagctacctatgtactccctttcctcttccgacgaagcaaggcaggtggacctgttggcttacattgccaaaattacagaaggagtgtccgatacgaatagcaaatcctgggcaaaccacgagaacaagaccgtgaataagatcacagtagtgggcggcggcgagctcggtatcgcttgcactttggccatctctgccaaggtcgagagccgcagcgtcacccaggcaggagtatag

SEQ ID NO: 140058 - DNA, 1416 bp, Artificial Sequence
  Description of Artificial Sequence: Synthetic coding sequence
atggagtttgactgcgaaggtctgagacggctactcggaaaatataagtttagagatctcactgtggaggaactaagaaacgtcaatgttttctttccccactttaaatactcaatggacacttacgtgttcaaagactctagccagaaggatctcctcaacttcacggggaccatacctgttatgtatcagggcaacacgtataacataccaataagattctggattcttgacagtcatccctttgcacctcctatatgctttcttaaacctaccgccaatatgggcatactggtcggtaaacacgtggatgctcagggaagaatttaccttccttatttgcaaaactggtctcaccccaagtctgtcattgttgggttgattaaagagatgatcgctaagttccaagaagagctgccaatgtacagtctgtcgtcttctgatgaagctagacaggtcgacctgctggcctacattgccaagattaccgagggggtgtcagataccaacagcaaatcttgggctaaccatgagaacaagaccgtcaacaagattacagtggttggcgggggggaactgggcatcgcttgcacgctagccatctcagctaagggtatcgcggaccggttggtgctgctagatttatccgagggcaccaaaggagcgaccatggatctcgagatcttcaatctgcctaacgtcgaaatttcaaaggacctttctgcatcagcacattcgaaggttgttatcttcaccgtgaacagccttggtagttctcagagctatctggacgttgttcagtccaacgtggacatgttcagagcactggtcccggcattgggacactactcacaacatagcgtgcttctcgtcgcctcgcagcctgttgagataatgacctacgtcacttggaagcttagcaccttccccgccaatcgtgttatagggattggatgtaatttggacagccagcgcttgcagtatatcattaccaatgtattaaaggctcaaacatctggtaaagaggtttgggtcattggagaacagggcgaggacaaggtgttgacttggagcggtcaagaagaagtggtgtcacacacaagccaggtgcagctgtcaaacagagcaatggagcttcttcgggtcaagggccagaggagctggtcagtcggcctgtctgtcgcagatatggtggactcgattgtgaataataaaaagaaggtgcatagcgtgtccgcgcttgctaagggatactacgacatcaattccgaggtttttttgtctttgccttgtatcttaggcacaaacggagtgtcagaagtcattaagaccactctgaaagaagatactgtcacagaaaagctccagagttctgcgtcatccattcattccctccagcagcagttgaagctttag

SEQ ID NO: 140059 - DNA, 747 bp, Artificial Sequence
  Description of Artificial Sequence: Synthetic coding sequence
atggacctcgagattttcaatctgccaaacgtggagatctctaaggatctcagcgctagcgctcactctaaagtggttattttcactgtgaattccctgggctcgtctcagtcttatctggacgtcgtccagagcaacgtagatatgtttcgcgccctggtgccagctctgggccattattcacagcactcagtcctcctcgtggcgtctcagcccgtggaaatcatgacttacgtcacatggaaattgtcaacattcccagcaaatcgtgtcatcggtataggctgcaatcttgactcacagagactgcaatatataattaccaacgtgctgaaggcccaaacaagcggaaaggaggtgtgggtcatcggcgagcagggagaggataaagtgctgacctggagcggacaggaggaagtggtgagtcatactagtcaggttcagctatctaatcgcgctatggaactgctgagggtgaagggccagaggagctggagcgtggggctttcagtggctgatatggtcgatagcattgtgaacaacaaaaaaaaggtgcatagcgtttccgctctggctaagggctactatgacataaattctgaagtgttccttagtctgccctgtatcctcggcacaaacggggtgtccgaagtgatcaagaccactctcaaggaagatacagtgacagaaaaactacaatctagcgctagttcaattcatagtctccagcaacagctgaagctgtag

SEQ ID NO: 140060 - DNA, 1140 bp, Artificial Sequence
  Description of Artificial Sequence: Synthetic coding sequence
atggagtttgactgcgagggtctgaggcggctgcttggcaagtacaagttccgtgatctgaccgtggaggagttgcgcaatgtgaacgtcttttttccacactttaaatattccatggacacatatgtatttaaagattctagccaaaaagacttgctgaatttcacagggaccatccccgtgatgtaccaaggcaatacttacaatatcccaattaggttttggattctggactcacatccctttgcaccccccatctgtttcctgaagccaaccgctaatatgggcattttggtgggtaaacacgtggatgcccagggaagaatctaccttccctaccttcagaactggtctcaccccaagtctgtgattgtgggcttaattaaagagatgatcgccaagtttcaagaagagttgccaatgtacagcctgtcctcttcagatgaagcaaggcaggtggatttacttgcctacatcgcaaaaataaccgagggtgtgagcgacaccaatagcaaatcttgggcaaaccacgagaataagacggtgaataaaatcaccgtcgtcggcggcggtgaactcggtatagcatgtacccttgctatcagtgccaaagggattgctgatcggcttgtactcctggatctctctgagggtaccaaaggcgcaactatggatttggagatctttaacctcccaaacgtcgagatatcgaaagatctgtcagcatctgcccattcaaaggtggttatcttcactgtcaacagcctaggctcttcccaatcttacctcgatgtggtccagtcgaatgtggatatgtttagagccttggttcccgctttaggacactattcccaacacagtgtcctgcttgtcgcttcccagcccgttgaaatcatgacttacgtgacttggaaactgtctacctttcccgcgaatagggtcatcggaataggatgtaaccttgattcccaaaggttacaatacatcattaccaatgtcctgaaggcccagacctccggtaaagaggtgtgggtaatcggcgagcagggcgaggataaggtgttgacttggtccggtcaggaggaggtggtgtcacacacaagccaggtgcagctgtctaatcgcgatataatgatttag

SEQ ID NO: 140061 - DNA, 1350 bp, Artificial Sequence
  Description of Artificial Sequence: Synthetic coding sequence
atggaattcgattgcgaaggcctgcgccgcctgctagggaaatacaagttcagagatttgaccgtcgaagagttgcggaacgtgaacgtgttttttcctcacttcaaatactcgatggatacctacgggaatacatacaacatccccatcagattttggatcctcgatagccatccattcgctccgcctatctgctttctaaaacccactgccaatatgggcatcctagtcgggaaacatgttgacgcccaggggaggatttatctgccctatttgcagaactggtctcatcctaagagcgtcatcgtgggtctgatcaaggaaatgatagcaaagttccaagaggagctccccatgtactcactttccagtagcgatgaagccagacaagtggatctgctagcctacatcgccaagatcactgagggcgtttcagacacaaatagtaagtcttgggcaaaccatgaaaacaaaactgtgaacaagatcaccgtggtggggggtggcgaactgggcatcgcctgtaccctcgcaatctccgcaaaggggattgcagaccggttggtcctgttggacctaagcgagggaaccaaaggagccactatggatcttgaaatcttcaatttgcctaatgttgaaatttctaaagacctgtcggccagcgctcactcaaaagtcgttatttttaccgtgaactcattgggatccagccagagctatctcgacgttgtgcagtcaaacgtcgacatgtttcgagccctcgtgcccgctctgggacactattctcaacacagcgttctgctggtggcaagccaacctgtggagatcatgacctatgttacatggaaattaagcacatttcccgctaatcgggtaatcggaattggctgtaacctggattcccagcgtctgcagtatatcattaccaatgtgctgaaggctcaaacatcaggcaaagaggtgtgggtgatcggtgagcagggggaagataaggtgctcacatggtccggtcaggaggaggtggtgtcacacaccagccaagtgcaactgagtaaccgtgctatggaactgctgcgagtcaagggccaaagatcatggagcgtggggctttccgtggccgatatggtcgattctatcgtcaacaataaaaaaaaggtgcactcagtgtccgctctcgctaagggatattacgacatcaactcggaggtgttcctctccttaccgtgcatcctggggacaaacggcgtttctgaagtgatcaagaccactttaaaggaggataccgtgacagagaaactacaaagcagcgcaagttccatacactccctgcaacagcaactaaagctctag

SEQ ID NO: 140062 - DNA, 429 bp, Artificial Sequence
  Description of Artificial Sequence: Synthetic coding sequence
atgggagacaagcccccagggttccgcggcagcagagactggattggatgtgtggaggcaagtttgtgcttagctcactttggcggtcctcagggccggctgtgccatgtaccgcggggggtcggtctgcacggcgagctggaaagattgtacagtcactttgccggcggcggggggcctgtaatggttggcggtgatgccgacgcacggtccaaagctctgctgggtgtttgtgtcggctcagggacagaggcgtatgtgctggtgttggatcctcactattgggggacgcccaagtcgcccagtgagttacaggctgccgggtgggtgggatggcaggaggtgtctgctgcttttgaccctaactctttctataacctttgtctcacatctttatcctcccaacagcaacagcgtacattagattag

SEQ ID NO: 140063 - DNA, 1410 bp, Artificial Sequence
  Description of Artificial Sequence: Synthetic coding sequence
atggtgatttccgaatctatggacatcctgtttaggatcaggggaggcctggatctcgcattccagttagccaccccgaacgagattttccttaaaaaggccctgaagcacgtgctgtcggatctcagcaccaagctctcttccaatgcactggtgttccgaatttgtcatagctctgtgtacatctggccctcaagcgatattaatacaatccctggtgagttgaccgacgctagtgcatgcaaaaacatcctccgttttatccagtttgaacctgaagaagacattaagcgaaagttcatgcgcaagaaggacaagaaattgagtgacatgcaccaaattgtcaatatcgatttgatgctcgagatgagcacatcgttagccgccgtcacacctatcatcgagcgcgaatctgggggccaccattacgtgaatatgacactgccagtggatgcagtcatcagtgtagctcctgaagagacttggggtaaggtgaggaaactcctcgtggacgcaatccataatcaattgaccgacatggaaaaatgcatcctaaagtacatgaagggcacatccatcgtagtgcccgagcctctccactttctgttgcctggcaagaagaatctggttacaatctcctacccctcaggcattcccgatgggcaactgcaagcctaccgcaaagaactgcatgatctatttaatctgccccatgatcgcccatacttcaagagaagcaatgcctatcacttcccagatgaaccatataaggacggctacatacgcaaccctcacacatatctgaacccccccaatatggagacagggatgatctacgtcgttcagggtatctatggataccatcattacatgcaggataggattgacgataacggatggggatgcgcataccgctctctccagacaatctgtagctggttcaagcaccaggggtatacagagcgctcaatccctacacatagggagattcaacaggcactggtcgatgcgggagataaacccgcaacctttgtcggttcaagacagtggatcggctccatagaagtacaactcgttctgaatcagttgatcgggatcacaagcaagatcctgtttgtgagccagggaagtgagattgctagtcagggtagagagctggctaatcactttcagtccgagggcacccctgtgatgatcgggggaggagtgctagctcacaccatcctgggggtggcctggaatgagattactgggcaaattaaatttcttatcctggatccgcattacacaggggcggaagatttacaggtgatcctggaaaagggttggtgcggatggaaaggacccgatttctggaacaaggacgcctactataatctgtgtctgccccagcgcccaaatatgatctag

SEQ ID NO: 140064 - DNA, 2484 bp, Artificial Sequence
  Description of Artificial Sequence: Synthetic coding sequence
atggtagtgcaaaagcctcacggtacaatggaatatacagccggcaaccaggacaccctgaactctattgctctcaagtttaacatcacgcccaataaactcgtggaactcaacaaactcttcacccatactatcgtgcccggccaggtgctcttcgtacccgacgccaattccccctcatcgacactgagactatctagtagttcccccggcgcgactgtctcgccctcgagctccgatgcggagtacgataagctccctgacgccgatctcgccagaaaggccctgaaacctatcgagcgcgtgctttcaagcactagcgaggaggatgaacctggagtcgtaaaattccttaagatgaattgtcgctattttaccgatggcaaaggggtggtaggcggagtgatgatcgtaactcccaacaacatcatgtttgaccctcacaagagcgatcccctcgttatagaaaatgggtgcgaggagtacggtctcatttgtcctatggaggaggtggtgtccatcgctttatacaatgatatcagtcacatgaagatcaaagatgctctgcccagtcctggcgaatgggaagatctggcgtccgagaaggatatcaaccctttcagcaagtttaagtccatcaataaagaaaaaaggcagcagaacggtgaaaaaataatgacatctgatagccggcccatcgtaccactagaaaaatcaacaggacacacacctactaaaccttccggctcatccgtgtccgaaaagctaaaaaaactggattcgagtagggaaacatcccatggctccccaaccgtgactaagctgagtaaggagccatccgataccagtagcgctttcgaatctacagcaaaggaaaacttcctgggcgaagatgacgacttcgtggacttggaggaattaagctctcaaaccggcggcgggatgcacaagaaggacaccctaaaggaatgtctcagcctggaccccgaggaaagaaagaaagcagaatcccagataaacaactctgccgtggaaatgcaggtgcaatctgccctggcctttctggggaccgaaaatgacgtagaattgaagggcgccctggacctggaaacatgcgaaaagcaggacatcatgcctgaagtggacaaacagtccggatcacccgagtcccgggtggagaataccttgaacatccatgaggatctggacaaggtgaagttgatcgaatactacctaactaagaacaaggaaggcccacaggtgtccgaaaacctccagaagaccgaactgtctgacgggaaaagcattgaacccggtggtatagatatcacactctcttctagtctctctcaggcaggggaccctataacagaggggaataaggaaccagacaagacatgggttaaaaaaggggaacccctgcctgttaagctcaattctagtacagaggccaacgtcataaaggaagcccttgatagctccctggagtcaaccctggataactcatgccaaggcgcccagatggataataagtccgaagtccagctctggctcttaaaacgcatccaggtgccgattgaggacatacttccatccaaagaagaaaagagcaagacacctcctatgtttctgtgcattaaagtgggaaaaccaatgcggaagtcttttgctacgcataccgccgcaatggtgcagcagtatggaaagcgaaggaaacaaccagaatactggttcgccgtgccacgcgagagagttgatcacctgtataccttcttcgttcaatggtcccctgacgtgtatgggaaggacgcgaaagaacaaggattcgtcgtggtggagaaagaagagctcaatatgattgacaacttttttagcgaacctacaaccaaaagttgggagataattaccgttgaagaagcaaagagaaggaagtcaacgtgctcatattatgaggacgaagatgaggaggtcttgccagtgctaaggccgcattcagctctacttgagaatatgcatattgagcagctcgcacgtagactgcccgcccgggtgcagggctacccatggaggctggcctattccactttagagcacgggacctccctgaagactctgtaccggaaatcagcatcactggactcgccagtactcctagtgatcaaggacatggacaaccaaatttttggcgcatacgctactcatcctttcaagttctctgatcactactatggcacgggagaaacatttctgtacacattctcacctcactttaaagttttcaaatggagtggggagaattcttatttcatcaacggcgatattagttccctggagttgggcggtggggggggccggtttgggttatggttggacgcagacctgtaccatgggcgctccaatagctgcagcacttttaacaatgacattctctccaaaaaggaggattttatcgtgcaggatctggaagtctgggcttttgactag

SEQ ID NO: 140065 - DNA, 735 bp, Artificial Sequence
  Description of Artificial Sequence: Synthetic coding sequence
atggccgccgccgctagccctgcgttcctcctctgtctgccactgctgcacctgctctcagggtggtcccgcgctggatgggtggatacacactgcctttgctacgactttataattacccccaaatccagacctgaacctcagtggtgcgaagtgcagggtcttgtagacgagaggccatttctccactacgactgcgtcaaccacaaggcgaaagcctttgcctctctggggaagaaggtgaacgtcactaagacgtgggaagagcagacggaaactcttagggatgtggtggatttcctgaaaggccagctcctggacatacaggttgagaatctcattcccatcgagccgctgaccctgcaggcccggatgagctgcgaacacgaagcacacggccacgggaggggaagctggcagttcctgtttaatggtcaaaaattcctgctgttcgactccaacaaccgaaagtggaccgcactgcacccaggggccaagaagatgactgagaaatgggaaaagaaccgtgacgtgactatgttttttcaaaaaatctctctcggagattgcaaaatgtggttggaggagttcctcatgtactgggaacagatgctggacccaacaaagcctccgagtcttgcacctggcaccactcagccaaaagcaatggctactaccctttccccttggtccctcttgataatttttctgtgcttcattttggcaggcagatag

SEQ ID NO: 140066 - DNA, 741 bp, Artificial Sequence
  Description of Artificial Sequence: Synthetic coding sequence
atggcagcagcagcggcaacaaagatcctgctgtgtctgcccctgcttctgctgctcagtgggtggagcagagcagggcgagcagaccctcactctctatgttacgacattactgtgatacctaagttccgcccgggtcctaggtggtgcgccgtacagggacaggtagatgagaagacttttctccattatgactgtggcaacaaaactgttactcctgtctcgccactgggcaagaaattgaatgtgacaaccgcatggaaggcacagaatccagtgctgagggaggtcgttgatatcctgactgagcagttacgggatatccagctcgagaactatacccccaaggagcctctgaccctgcaggccaggatgagctgcgaacagaaagctgagggccattcttccggctcctggcagttcagtttcgacgggcagatctttctcctattcgattccgaaaaaagaatgtggacgactgtgcatccgggcgcgcgtaaaatgaaagagaagtgggagaacgacaaagtagtcgctatgtccttccactatttctctatgggagactgcatcgggtggctcgaagacttcctgatgggaatggattcaaccctggagccatccgcaggcgccccgctggcaatgagttctggaactacccagttgcgcgcgaccgccacaacattgattctgtgttgtctcttgattatcctaccctgctttatcctgccagggatatag

SEQ ID NO: 140067 - DNA, 510 bp, Artificial Sequence
  Description of Artificial Sequence: Synthetic coding sequence
atggcagcagcagcctcccctgcaatccttccccgactcgcgatcttgccctacctccttttcgactggagcgggactggcagggctgatgcccatagcctgtggtataatttcacaatcatacacctgccccgacacggacagcaatggtgcgaggtgcagtctcaggtggaccagaaaaattttctgtcgtacgactgtggttctgacaaggttctgtctatgggacatctagaggagcagctgtacgctaccgatgcgtgggggaagcaattggaaatgttgcgcgaagtgggtcagaggctcaggctcgaactggcggacaccgagctggaggattttaccccaagtggcccactgaccctccaagtgcggatgagctgcgaatgtgaggccgatggatacattcgagggagctggcagttttcatttgatgggaggaaattcctcctttttgactccaataatcgtaagtggactgtggtccacgctgggctcgggaccagttag

SEQ ID NO: 140068 - DNA, 735 bp, Artificial Sequence
  Description of Artificial Sequence: Synthetic coding sequence
atggcggcagcagcttcaccagccatccttcccagactggccatcctgccgtacttgctctttgactggagtggcaccggtcgggctgatgctcattccctatggtataacttcactatcatccacctcccaagacatggccagcagtggtgtgaggttcagagccaggttgaccagaaaaacttcctttcctatgattgcgggagcgacaaagtgcttagcatgggtcacctcgaagagcagctgtatgctaccgacgcctgggggaaacagctcgagatgctcagggaggtagggcagcggttgaggttagagctggccgatacagaactggaagatttcacaccgagcggacccctgacactgcaggtcaggatgtcatgtgagtgcgaagccgatggctacatcagagggtcatggcaattctcctttgatggcaggaagtttctgttgttcgatagcaataacagaaagtggaccgtagtgcacgcgggggcccgaagaatgaaagaaaagtgggagaaggattccggcttaactactttttttaaaatggttagtatgagggattgcaagtcctggctgcgcgattttctaatgcacagaaagaagaggctggaaccaacagccccaccaaccatggcaccagggctagctcagcctaaagccatcgccacgacactctctccctggagcttcctgatcatcctgtgtttcatcttgcccggaatctag

SEQ ID NO: 140069 - DNA, 393 bp, Artificial Sequence
  Description of Artificial Sequence: Synthetic coding sequence
atggccgctgccgcctccccagctattctgccccggctggcgatccttccctacctcttgtttgactggtctggcactgggagggcagaagagcagctttacgcaactgatgcttgggggaaacaacttgaaatgctgcgggaagttggtcagcggttgcggcttgaactggccgatacggagctggaagacttcaccccatcaggtcctctaaccctccaggttagaatgtcatgcgaatgcgaagctgacggatatattcggggaagctggcagtttagctttgacgggagaaagtttctgttgtttgattccaacaacagaaagtggacagtcgtgcatgcaggagcacggagaatgaaggagaagtgggaaaagtcccacctggaatag

SEQ ID NO: 140070 - DNA, 735 bp, Artificial Sequence
  Description of Artificial Sequence: Synthetic coding sequence
atggcagcagccgcatcaccagccatacttcctcgcctggccattctgccctacctgctgtttgactggagcgggacaggccgtgcagatgcccattccttgtggtataatttcactataattcatctgccaaggcatgggcagcagtggtgcgaagttcagtcacaggttgatcagaagaacttcctatcttacgactgcggctcagataaagtcttatcaatggggcacttagaggagcagctgtacgcaaccgacgcctggggaaagcagctggagatgctgcgagaggtggggcagcggctccgacttgagctggcggataccgagttggaggacttcacacctagtggcccgctcacactgcaggtgagaatgagttgcgaatgtgaagccgacgggtatatcagggggagttggcagttcagtttcgatgggcgcaaatttttgctgttcgactccaacaaccgtaaatggactgtggtccacgccggcgctcggagaatgaaagagaagtgggagaaggattcgggcttgaccactttcttcaagatggtgtctatgcgcgactgcaaatcatggcttcgggacttcctcatgcaccgcaagaaaaggctggagcctaccgcacctcctaccatggcccccggtctggctcagccaaaagccattgcaaccaccttatcaccttggtcattcctgatcatactgtgttttattctccccggaatctag

SEQ ID NO: 140071 - DNA, 663 bp, Artificial Sequence
  Description of Artificial Sequence: Synthetic coding sequence
atgaaggttaagaaggggggtggaggagctggcacagcaactgaatccgcccccggcccctcaggacaaagcgtagcaccaatcccacagccccctgctgagtccgagtctggcagcgaatctgaacctgacgctggtcctgggcccagaccggggccactacagcgcaaacagcccattggcccagaggacgttttgggcctacagcgaattacaggcgactatctgtgttctcccgaggagaacatttacaagattgattttgtccgtttcaagatccgggatatggacagcgggacagtattattcgaaatcaaaaagccccccgtttcagagagactaccaatcaaccgacgcgacctggatccaaatgccggcaggttcgtccgctaccaatttactccggcgtttctgaggctgagacaggtcggcgccaccgtcgaatttaccgtgggtgacaaaccggtcaacaacttccgcatgatcgaaaggcactactttcgaaaccagctccttaagtctttcgacttccattttgggttctgtataccatctagtaagaatacttgcgagcatatatacgattttccgccgttatctgaggaactttcagcacgcgctgggtctagtggctctggagaggtgggagcctcaagagattag

SEQ ID NO: 140072 - DNA, 723 bp, Artificial Sequence
  Description of Artificial Sequence: Synthetic coding sequence
atgaaggtgaaaaagggtggcggcggagccggaactgctaccgagagcgctcccggcccctctggtcagtccgttgcgcctattcctcagcccccagctgagtcggaatcgggctcagagtctgagcccgatgctgggcctggccccaggcctggacctctgcaacggaagcagccaatcggcccagaggacgtactcgggcttcagagaatcactggcgactacttgtgctcgccggaagaaaatatttataagatcgactttgtccgctttaagattcgcgatatggacagcggtaccgtgctctttgagattaaaaaaccaccagtctctgagcggctccccatcaaccggcgagacctcgaccccaatgccggaagattcgtcaggtaccagttcacccccgctttcttgcgattaagacaggtcggcgcgaccgtcgaattcacagtaggcgataaacctgtgaacaacttccgcatgattgaaaggcactacttccggaatcagctgctcaaatccttcgatttccacttcggattctgtatacccagttctaagaatacttgcgagcacatatatgacttccctcccctgagtgaggagctgatctccgaaatgatccgtcacccctatgaaactcagtctgattcattctattttgtggacgatagacttgttatgcataacaaggccgactacagttatagcggaaccccttag

SEQ ID NO: 140073 - DNA, 627 bp, Artificial Sequence
  Description of Artificial Sequence: Synthetic coding sequence
atgaaggtgaagaaaggcggtggcggggcaggcaccgccactgaatctgcacctgggccaagcggacagtccgtagctccaatcccccaaccgcccgcagagtcagaatccggttctgagtctgagcctgatgcaggacccggacctcggccaggcccactgcaacgcaagcagcccatcgggccggaagatgttctgggattgcagaggatcacgggcggagcccggcccctgttccccgcgtggcggttcaagattcgcgatatggattcaggcacagtgctctttgagatcaaaaagccccctgttagcgaacgactgcctattaatcgccgcgatctggacccaaatgctggacgctttgtgcgataccagttcacgcctgcgttcctgagattgcgccaggtaggggcaactgtcgaatttaccgtaggggataaacccgtaaataatttccgaatgattgagaggcattacttccggaatcagctgctaaaaagctttgacttccacttcggcttttgcattcccagctctaaaaacacgtgcgaacacatctacgattttcctcctcttagtgaggagttaagcgctagagcagggtcaagtggcagcggagaagtctag

SEQ ID NO: 140074 - DNA, 5112 bp, Artificial Sequence
  Description of Artificial Sequence: Synthetic coding sequence
ctgagtcttctgtgcgttagcctgaagaaagctaagttcgacggagcacaggaaaaattcaacacctatgtaacccttaaagtccaaaacgttaagagcacaaccatcgctgtccgggggtcgcaaccttcttgggagcaggattttatgtttgagatcaacaggctggatttaggactgacagttgaggtttggaacaagggcctaatctgggatacaatggtaggcaccgtttggattcccctgaggactatccgtcagtccaatgaggaggggcccggtgagtggctcacactggatagtcaagttatcatggctgatagtgaaatatgtggtacaaaggatccaacgttccatcggatactgctggatacccgctttgaattgcctcttgatatccctgaggaggaggctagatactgggctaagaaactggagcagttgaatgctatgcgcgaccaagacgaatactcattccaagacgagcaggacaagcctctccccgttccaagcaatcaatgctgcaactggaattacttcggctggggggagcagcacaacgacgatcccgattctgccgttgacgaccgggatagtgactaccgttccgagacctctaattctatcccccccccttactacacaaccagccaacctaacgcctccgtgcaccagtactctgtgaggcctccaccactggggagtcgtgaatcatactccgacagcatgcacagttacgaagaattctccgagccacaggctctgtcacccacgggctctagccgttatgcaagttcaggcgaactcagccagggaagttcccaattatctgaagatttcgacccagatgaacactccctgcagggcagcgacatggaggacgaaagggatcgggactcataccattcctgccatagtagtgtaagttaccacaaggacagcccccggtgggatcaggatgaagaggagttggaggaagatttagaggatttcctggaggaggaagaactgcccgaagatgaagaggaactggaggaagaagaagaagaagttcccgacgacctggggtcatacgctcagagagaggacgtagctgtagctgagccaaaagatttcaagagaatatccctcccccctgcggcacctggtaaggaggataaggcccccgtggcccccactgaggcccccgatatggccaaggttgcgcccaagccagctacacccgacaaggtacctgcggcggaacagatccccgaggctgagccgccaaaagatgaagagtcctttcgcccacgtgaggacgaagagggtcaggagggtcaggattcaatgagccgcgccaaggccaattggcttcgggcctttaataaggtcagaatgcagctgcaggaggcccgcggcgagggagagatgtcaaaaagtctatggttcaagggtggcccgggtggtggactgattatcattgattctatgccagacattaggaagaggaagcccatacccttagtcagcgacctggctatgagcctggtccagtcacgcaaggcagggatcacaagcgctttagcttccagtaccctgaataatgaggaactgaaaaaccatgtatacaaaaaaactctgcaggctctgatctatcccatctcatgtacgacaccccataactttgaggtgtggaccgcaacaacaccgacctattgttatgaatgtgaaggcctgctgtggggaattgcgcgacaggggatgcggtgcacagaatgcggggtaaagtgccatgaaaagtgccaggatttactgaacgctgattgccttcaacgggcggcagaaaaaagctcaaagcacggcgcggaggaccgaacccagaacatcatcatggttttgaaggatcgcatgaagatccgggaacggaacaagcccgagatctttgaacttattcaggaaatcttcgcggtgactaagaccgctcacactcagcaaatgaaggcagtcaagcagtcagttcttgacggaacatcaaaatggtccgctaagatcagcattaccgtcgtttgtgcccaggggcttcaagcaaaggataagacagggagttctgacccatatgtcaccgtgcaggtgggcaaaactaagaagcggaccaaaacaatctacggaaacctcaatcctgtttgggaggagaactttcattttgagtgtcataattccagtgaccggataaaagtacgtgtgtgggatgaggatgacgacattaagtccagggtcaaacagaggtttaagagggagtcggatgactttctaggtcagaccattattgaagttagaaccttatctggggagatggacgtttggtacaatctggacaaacgcaccgataagtcagccgtgtcaggtgcaatacgtttgcacatttcagtcgagatcaagggggaagaaaaggtggctccgtaccatgttcagtacacctgcctacacgagaacttatttcattttgtgaccgacgtgcagaacaacggagttgttaagatacctgacgcgaagggtgatgatgcatggaaagtgtactatgacgagaccgcccaagagattgtggatgaattcgctatgaggtatggcgtggaaagcatatatcaggccatgacccactttgcctgcttatcctcgaagtatatgtgtccaggagtgccggccgtcatgagtactcttctggcaaacataaacgcctactacgctcatactacggccagcactaatgtgtccgcatctgatcgcttcgcggcctccaactttggcaaggaaagatttgtcaaattgttggatcagttgcataactctctccgtattgacttatcaatgtacagaaataattttccggcttcctcgcctgaacgtcttcaagatctcaagtccaccgtggacttgctgacctctattactttcttcagaatgaaggtacaggaactgcaaagcccaccccgcgccagtcaggtcgtgaaagactgtgtcaaagcgtgtctcaacagcacctacgaatatatatttaacaattgccacgagctatatagcagggagtaccaaacagatcccgctaagaagggggaggtgctccctgaagagcagggcccatccatcaagaaccttgatttctggtctaagttgattaccctgattgtgtccatcattgaggaagataagaacagctatacaccctgtcttaaccagtttccacaggagttgaatgtgggcaagatatccgccgaagtgatgtggaacctgtttgcccaggatatgaagtacgctatggaggaacacgacaagcaccggctctgtaaatcagctgactatatgaacctacatttcaaagtaaaatggctctataacgagtacgttacagagttgcctgctttcaaggatcgcgtccctgagtatcctgcttggtttgaaccattcgtcatccagtggcttgacgaaaatgaagaggtatctagagacttcctccacggagccctcgagcgtgataagaaagacgggtttcagcaaacttccgagcacgcgctcttcagctgcagtgttgtcgacgtgttttctcagttaaatcagagttttgagattatcaaaaaattggagtgtccggaccctcagatagtgggccactacatgcggcggttcgcaaaaactatatccaacgtgctgctgcagtacgcagacataatcagcaaggactttgcatcctattgttccaaagagaaggagaaggtcccctgcatcctcatgaacaacacacagcagctgagggtccagctcgaaaaaatgttcgaggctatggggggcaaggaactagacgctgaggcaagtgacatactgaaggagctgcaggtaaaacttaacaacgtgctggatgagctctcaagagtgtttgccacgtccttccagccacatatcgaggagtgcgtcaagcagatgggtgatattctcagccaggtaaagggaacaggcaatgtgcccgcctcagcgtgctctagtgtggctcaggatgccgataacgtcctgcagccgattatggacttattggattcaaatctaacactgtttgccaagatctgcgagaaaactgtcctgaaacgggtgctgaaagaactatggaagctggtcatgaacacgatggaaaagactatcgtactgccacccctgactgaccagacactccaggggaatctactgaggaaacacgggaagggtctcgagaagggaagagtgaagctgccttcacattccgatggtactcagatgatcttcaacgctgctaaggaactcgggcagctcagcaagctgaaggaccacatggtgagggaagaagccaagtcacttacgccaaagcagtgcgccgtggtggagcttgccctggatacaataaagcagtacttccacgcagggggtgtcggccttaaaaaaacattcctggagaagagtccagacctacagagccttcggtacgccctatcactgtatactcaagctaccgatctgcttatcaaaacattcgtacagactcagtccgcccaaggcctgggcgtggaggaccccgttggtgaggtatccgttcacgtggagctcttcacccatcccgggacaggggaacacaaagtgaccgtgaaagtcgtggccgccaacgacctgaagtggcagacttctggaatctttcgtccttttattgaagtgaacatcattgggccacagctaagtgataagaaaagaaaattcgccacaaaatccaagaataactcatgggcccctaagtataatgagagcttccagtttactctgtctgccgatgccggaccggagtgttatgaactgcaggtctgtgtcaaggattactgttttgcgcgagaggatcgcactgtgggactggctgtgctccagttacgcgaactcgcacagcgaggaagcgctgcctgttggttgccgctgggacgtagaattcacatggacgatactggtctgaccgttctcagaatcttatctcagaggtctaacgatgaggtggctaaagaatttgtgaagttaaaaagcgacacccgctctgccgaagagggcggggccgcgcccgccccatag

SEQ ID NO: 140075 - DNA, 5376 bp, Artificial Sequence
  Description of Artificial Sequence: Synthetic coding sequence
atgggagggggcggtacttgcaccatctctgtgcaggtgagggtttgcacaggcggcaatcttcttgggggacggagaaggccgctgagtccctgtaatgaggaggtctggggagaggccccactgcctggcgcaagacctttcaatgctccacccgctcggtcggcccctgccccatccggagtaccagggctaagacttcccgcccctcatcaaaggcatagccggcctgggcgcctacggccaacatgcgaactgggtgacatgagtctgctgtgcgtcggcgtgaagaaggcaaaatttgatggagcacaggagaagtttaacacctatgtgacactgaaggtgcagaacgtgaagtctactactattgccgtgagaggatcccagccaagttgggagcaggacttcatgttcgagatcaatcgtctggacttgggcttgaccgtggaggtgtggaacaaagggctaatctgggacacgatggtcggaactgtctggattccactgagaactattcgacagagtaacgaagaggggccaggtgaatggttaactttagacagccaagtgatcatggccgactcagagatctgtggtaccaaggatccaaccttccatagaattctgctcgacacacggtttgaactcccgctggacatcccagaggaagaagcacgatactgggccaaaaagctagagcagctgaacgcgatgcgcgatcaagatgaatactccttccaggacgagcaggataagccactgcccgtgccctcgaaccagtgctgcaactggaactactttggatggggcgaacaacacaatgatgaccctgactccgcagtggatgacagagacagtgattatcggagcgagacgtctaactccatacctccaccgtattacacgacaagtcagccgaacgcctcggtgcatcagtattcagttcgcccaccccccttgggctcccgtgaaagttacagcgacagcatgcactcctacgaggagttttcagaaccccaggcactgtctccaactggctccagtaggtacgcaagctccggggaactctcccagggtagctcacagctcagcgaggacttcgaccctgatgagcactctctacagggcagcgacatggaggatgagagagaccgagactcttaccacagctgtcactctagtgtctcctaccacaaagactccccccgctgggatcaggatgaagaggagctggaagaggacctggaggactttctggaagaagaggagctgccagaggatgaagaggagctcgaagaggaagaagaggaagtgcccgacgacctgggaagctatgcccagcgggaagacgtagccgtcgcagagccaaaggattttaaaaggatctccctgccgccagctgccccgggtaaggaagataaggctcccgtagcacctaccgaggccccagacatggccaaggtcgcccccaagcccgccacacctgataaagtgccagccgccgagcagatcccagaggccgagccgcctaaagatgaagagtctttcagaccccgggaggacgaggaaggacaggagggacaggacagtatgagccgcgccaaagcaaactggcttagagcattcaataaagtcaggatgcaactccaggaggctcggggagagggagaaatgagcaaaagcctctggtttaagggcggacccggagggggactgatcatcattgactctatgccggatattcgtaaacgaaaacccattccactggtctccgacctggctatgtctctggtgcaaagccgcaaagcaggaatcacctccgccctcgcgagctccacactgaataacgaggagctcaagaaccacgtctataagaaaactctgcaggctctcatctaccccatcagctgtaccacgccccacaatttcgaagtgtggaccgcaactactcctacttactgctacgaatgtgaagggcttctttggggaattgctcgacagggcatgcgctgcaccgagtgtggcgtgaagtgtcatgagaagtgccaagacttgctaaatgccgattgcctccagcgtgccgcagaaaagtcctctaagcacggagccgaagatcggacacagaacattatcatggtgctgaaagaccgcatgaaaattcgggagcgaaataaacctgagatatttgaacttatacaggagatatttgcagtgactaagacagcccacactcagcaaatgaaagcagtgaaacagagtgtgctggacggcacaagcaaatggagcgctaagatcagcattaccgtcgtgtgtgcgcagggcctgcaggcgaaagataagacaggcagttcggacccctatgttactgtgcaggtaggtaaaactaaaaaacggactaaaactatatatggaaatcttaatcccgtctgggaagagaactttcacttcgagtgtcacaactctagcgataggattaaagtccgggtgtgggacgaagatgacgacatcaagtcccgggtgaaacagcgatttaagagggagtccgatgactttctaggccagacaatcatcgaggtgagaacactgagcggagaaatggatgtatggtataacttggacaagaggacagataagtcagccgttagtggagccatacgtctgcacatttcggtcgagatcaagggcgaagagaaggtggctccttaccacgtgcagtatacatgcctgcacgaaaacttgttccatttcgtcacagacgttcaaaataacggtgtggtaaagatacccgatgcgaagggagacgacgcttggaaggtctattacgatgaaactgctcaggagatcgtggatgagtttgctatgcggtacggggtcgaatctatctatcaggccatgacacattttgcatgtttatcttctaaatatatgtgtcccggggtcccagcagtgatgagcaccctgctggctaacatcaacgcttattacgcccataccactgctagcaccaacgtgtccgccagcgatcggtttgctgcctcaaattttgggaaggagagattcgtaaaattgctcgatcaactacacaactccctgcgtattgacttaagtatgtaccgtaacaactttcctgcttccagccccgaacgactacaggacctgaaatcaacggtggacctcttgactagtattaccttcttcaggatgaaggtgcaggagctacagtctcctccaagggcctcacaggtggtcaaagactgtgttaaggcttgtctcaactctacatacgagtacatctttaacaactgtcacgaactgtactcacgggaatatcaaaccgacccggccaagaaaggcgaagtgctgccggaagagcagggacccagcattaagaacctggacttttggtccaagttgataactttgatcgtttcaataattgaagaagataagaatagttacactccctgccttaaccagttcccccaagagctcaatgttgggaagattagcgctgaagtcatgtggaatctcttcgctcaggatatgaaatatgcaatggaggaacacgataagcaccggctgtgcaaaagcgcggactatatgaatctgcactttaaggttaaatggctttacaatgaatatgtcacagagctcccagcctttaaggatcgcgtccctgaataccccgcttggttcgagcccttcgtcattcagtggttagatgaaaacgaagaggttagtcgagactttttacacggagccctcgaacgggacaaaaaggatggcttccagcagaccagcgaacatgcgctgtttagctgcagcgttgtcgatgtattcagccagttgaatcagtcttttgagatcatcaagaagttagaatgcccagacccgcagatcgtgggccactacatgcgacgctttgcaaagaccattagtaatgtgctgcttcaatatgcggacatcatcagtaaggattttgctagctattgctccaaagaaaaggagaaagttccctgtatcctcatgaataatacacagcagctacgtgtccagctagagaagatgttcgaggccatgggaggaaaggaactggacgcagaggctagcgacatattgaaggaactgcaggttaagctcaataatgttcttgacgagctgtccagagtcttcgcaacaagtttccagccccacatcgaagaatgtgtgaagcaaatgggggacatcttgtcgcaagtcaagggcacgggaaatgtcccagcgtccgcatgcagcagcgtggctcaggacgccgataacgtactgcaacccattatggacttgctggatagtaacctgaccttgttcgcaaaaatctgcgagaagaccgtcctcaagcgcgtgctcaaggaactctggaagctcgtgatgaataccatggagaagacgattgtgttgcctccactgaccgaccagaccatgattggtaatttgctgcggaaacatggaaaggggcttgagaaaggaagggtgaaactcccaagccactcagatggcactcagatgattttcaatgcagcaaaggagctcggtcagttgtccaagctgaaagatcacatggtgcgcgaggaggcaaagtcattgacccctaaacagtgcgcggtcgtagaattggctctggatactataaagcagtacttccatgctggcggggtcggcctgaaaaaaacttttctcgaaaaatcccctgacctgcagtcactaaggtacgcacttagcctttacactcaggccacagacttgctcatcaagacgtttgtgcagacacagagcgctcagggcctaggagtcgaggaccccgtgggagaagtgtcggtccacgtggaactgttcactcatccaggaactggcgagcacaaagtcaccgttaaagttgtagccgccaatgacctgaagtggcagacgagcgggatttttagacccttcattgaagtgaacataattggcccccagcttagcgataaaaagcggaagttcgctaccaagtcgaaaaacaattcttgggctccaaagtataacgagtcctttcagttcacactgtccgctgatgctggacccgagtgctatgaactgcaggtatgtgtaaaggactattgctttgctagggaggacagaacggtggggcttgccgtgcttcaactcagggagctcgcccagcgagggtccgcagcctgctggctaccacttggcaggcggatccatatggatgacaccggtctcactgttcttagaattctgagtcaacggtccaacgacgaagtagcgaaggagtttgtcaagctcaagagtgacacgcggtccgcagaagagggaggggcagccccggccccttag

SEQ ID NO: 140076 - DNA, 5112 bp, Artificial Sequence
  Description of Artificial Sequence: Synthetic coding sequence
atgagcctgctgtgcgtcggagtcaagaaagctaagttcgatggcgctcaggagaagtttaacacttacgttacccttaaggtgcagaacgtgaagtctacaaccatagcagtaaggggctctcagccatcctgggaacaagattttatgtttgaaattaacaggctggatttgggattgaccgtggaggtttggaacaagggtctgatctgggatacaatggtgggcactgtgtggatacctcttagaacgatcagacagtcaaacgaagagggtccgggggaatggctgaccttagatagtcaggtgattatggcagatagtgagatttgcgggaccaaagacccaacgtttcacaggattctgctggacacaagattcgagttgccgctggatattcccgaagaggaggctcgctactgggccaaaaagctggagcaactgaacgcgatgagagatcaggacgaatactccttccaggacgaacaagacaagcccctgccagtgcctagcaaccagtgttgtaactggaactactttgggtggggtgagcagcacaacgacgatccggactctgccgtagatgatcgggacagcgactaccgttctgaaaccagcaacagtattccaccgccgtattataccacgtcgcagcccaatgcgagcgtgcatcagtatagcgtgcgtcctccacccctcggctctagagagtcctatagcgattccatgcattcctatgaggaatttagcgagccccaagcattgtctcccactggatcctcccggtacgcctccagcggggaactgtctcagggaagttctcagctgtccgaggacttcgaccccgacgagcacagcctccagggctccgatatggaagatgaacgggatcgggactcttatcacagttgtcattccagcgtgtcctatcacaaagacagtcccaggtgggatcaggacgaagaagagctggaagaggacctcgaagattttctggaagaagaagagcttcctgaggatgaggaagagttggaagaggaggaagaggaagtcccagacgatctcgggtcttatgctcagagagaggacgtagctgtagccgaaccgaaagatttcaagcgcattagcctcccccccgcagctccaggcaaagaagataaagcccctgtggccccaactgaggcacccgatatggcaaaagtcgctccgaagcccgcgaccccagacaaagtaccagcagcagagcaaattccagaggccgagccacccaaagacgaagaatcctttcgcccacgcgaggacgaagaaggtcaagaggggcaggatagtatgtccagggctaaagccaattggctccgggcctttaacaaagttcgtatgcaactgcaggaagcccgtggcgaaggagagatgtcaaagagcttgtggtttaaaggaggtcctggaggcggcctgatcatcattgattcaatgccagatattcgcaaacgtaaaccgatccctcttgtgagcgacctggctatgtcactcgtgcaaagccgcaaagcaggaataaccagtgctttggccagcagcaccctaaataacgaagaactgaaaaaccacgtgtacaagaaaaccttgcaggccctcatttatcccatttcatgcactaccccgcataacttcgaggtatggaccgcaacaaccccaacttactgttatgaatgtgaggggctgttgtggggtatagctaggcaggggatgcggtgcacagagtgcggcgtgaagtgtcacgaaaaatgccaggatctgctcaacgctgactgcctgcagcgggcggctgaaaagtcaagtaagcatggggccgaggatagaacacagaacattatcatggtcctcaaggatagaatgaagataagagagaggaacaaacccgagatctttgagctgattcaggaaatctttgccgtgaccaaaacagcccatacacagcagatgaaagccgtgaagcagtcagtgctggatgggacatccaaatggagtgctaaaatatccattacagtggtgtgtgcccagggactccaagccaaagataagaccggttctagtgacccctacgtgacggtgcaggtcggaaagaccaagaaacgaaccaagactatttacggcaatctgaatcccgtttgggaggagaattttcactttgaatgtcataatagtagcgatcggatcaaagttcgggtctgggacgaagacgatgacataaagtctagagttaagcagagattcaagcgcgaaagcgacgactttttgggacagaccatcatcgaggttcgaacactttccggtgaaatggatgtgtggtacaatctagacaagcgaaccgacaagtctgccgtgtcgggcgcaatacgcctgcatatttccgttgagattaagggcgaagagaaagttgccccttatcatgttcaatacacctgccttcacgaaaacctgttccatttcgtgacagatgtacaaaataatggggtcgttaaaattcctgacgctaaaggcgacgacgcctggaaggtgtactatgacgagacagcgcaggaaattgtggatgagtttgccatgcgctacggtgtggaatcaatctaccaggccatgacccacttcgcttgcctgagctctaagtatatgtgtcccggcgtacctgcagtgatgtccactctcctggccaatatcaacgcatactacgcccacaccacagcgagcaccaacgtcagcgccagtgatcggtttgccgcatccaattttggcaaggaacggttcgtaaagctgcttgaccagctccataacagtctacgaattgacctgtccatgtacaggaacaacttcccagcctccagtcccgaaagactccaggatcttaagtcaactgtggatcttcttacttccatcacattcttcagaatgaaggtgcaggagctgcagtccccccccagggcgtcccaggtggtcaaagattgcgtgaaggcctgcctgaactccacttacgagtacatctttaacaactgccatgagttatactcccgagaataccaaactgatcctgctaaaaagggggaagttttacctgaggagcagggaccgtctattaagaatctcgatttttggtccaagctgattaccctgattgtgtccatcattgaggaagacaaaaactcatacaccccatgtctcaaccagtttccacaggagcttaatgtgggaaagatcagtgcggaggtgatgtggaacctgtttgctcaagatatgaaatatgcaatggaggagcatgacaaacacaggttatgtaaatcggccgattatatgaaccttcatttcaaggtgaagtggttatataatgagtacgtcactgaactacctgccttcaaggatagagtgcctgaatatcctgcgtggtttgaaccatttgttatacaatggcttgacgagaacgaggaggtgtctcgggacttcctgcacggtgccctggaacgggacaaaaaggatgggtttcagcagactagtgaacacgcccttttcagttgctccgtagtggatgtgttttcccaacttaatcagtcttttgaaatcattaaaaagctggagtgccccgacccccagatcgtaggacactacatgcgaagatttgccaaaacgatttcaaacgttcttttgcagtatgccgacattatatctaaggattttgctagctactgctctaaggagaaagaaaaggtcccctgcattctgatgaacaatacacagcaactgagagtgcagctcgaaaaaatgtttgaggctatgggaggaaaagaactggacgcggaagctagcgacatcctcaaagagcttcaggtgaagttgaataatgttcttgacgagttgagccgcgtcttcgctacttccttccagccacatattgaggaatgcgtgaaacagatgggagacatcctcagccaggtgaaaggtactggtaacgtgccagcaagcgcttgtagttccgttgcgcaggacgctgacaatgtgctacaaccaatcatggaccttctggatagtaacctgacattgttcgctaaaatctgtgagaaaactgtcctgaagcgggttctgaaagagttgtggaaactggtgatgaacactatggaaaaaaccattgtcctgcctccacttaccgatcagaccatgatcggtaatcttcttcggaagcacggaaaagggcttgagaaggggagagtcaaactgcctagccactcagacggcacccaaatgattttcaatgccgcgaaggaactgggccagctgtccaagctgaaagatcacatggtgcgggaagaggctaaaagcctcacgcccaagcagtgtgccgtcgtggagctggccctggacaccataaaacaatactttcatgctgggggggtggggctcaagaaaaccttcctggagaagtctcctgaccttcagagccttagatatgccctgagcctgtacacccaggcaactgacctgcttatcaaaacattcgtgcagacccagtccgcccaaggtttgggggtggaagaccctgtcggagaggtgtccgtgcacgttgagctctttacacaccccggcactggagagcacaaggtcaccgtaaaggtcgtggccgcaaatgatctgaaatggcagacttcaggcatcttccgcccttttatcgaggtgaatattatcggaccacaactgagtgacaaaaagcgaaaattcgctacaaagagcaagaacaactcttgggcccccaagtacaatgagtcttttcagttcaccctcagcgcagatgccgggccggaatgttacgagctgcaggtctgtgtaaaggattactgctttgccagggaggacaggacagtcgggctagctgtgctccaactgcgtgagctcgcccagagagggagtgccgcctgttggcttcctctaggtcgccggatacacatggacgacacggggctaacagtgctaaggattctcagccagcgaagtaacgatgaggttgccaaagaattcgtgaagcttaaatccgataccaggtctgccgaagagggaggcgctgccccggccccttag

SEQ ID NO: 140077 - DNA, 1293 bp, Artificial Sequence
  Description of Artificial Sequence: Synthetic coding sequence
atggctaccctctctgtgaagccatccagacgctttcagttgcccgactggcataccaacagctatctcctgagcaccaacgcccagttgcaacgcgacgcctcccaccagattcgccaggaagctcgtgtgctccgtaacgaaacgaacaaccaaacaatctgggatgaacatgacaaccggacgagactggtggagagaattgacacagtgaatagatggaaggagatgctcgataagtgtttaacagacctggatgctgaaatcgacgcgttgacgcaaatgaaggagtctgctgagcagaatcttcaagcgaagaatctcccattggacgtggcaatagaatgcctcacactccgcgagagtagacgcgatatcgacgttgtgaaggatcctgtggaagatgagctccacaaggaggtagaggtgatcgaggctacaaaaaaagccttgcaacagaaggtctcgcaggctttcgagcagctatgtttgcttcaggaggtccaacagcagctgaacagcgatcaccggggaaagatggagactctggaaattgaccgcggctgcctaagtcttaaccttaggagtccaaacatttcactgaaggtcgaccccaccagggtgcccgatggctctacaactctgcagcagtgggacgactttagtcgctttaacaaagacagggccgaagcggagatgaaggctgctactgagctgcgggaagccacagccctgaccatcgctgaaacaaataacgaattggaagcacaaagagtggccaccgagttcgcattccggaaacggttgcgagagatggaaaaagtctatagcgagttgaaatggcaagaaaaaaacacgctagaggaaattgcagagctgcaggaggatatccggcatcttgaggaggatctccgcacaaagctgctgagtctaaaactgagtcacacccgtctggaggcccggacctatcgtcccaacgtggagctttgcagggatcaggcccaatatgggcttaccgatgaggttcaccagctggaagctaccattgcagctttgaagcaaaagttggcacaggctcaagatgcactggatgccctctgcaagcaccttgcaagactgcaggccgacatcgcgtgcaaagcgaattctatgctgcttgatacgaagtgcatggacaccagacggaagctaacagtcccagcagaacggtttgtacccgaagtagatacgttcacccgcacaaccaactcaaccttgtctccattaaaatcatgccagctcgagctcgcttag

SEQ ID NO: 140078 - DNA, 3429 bp, Artificial Sequence
  Description of Artificial Sequence: Synthetic coding sequence
atggccacacttttgagtcatccccagcagcgaccaccttttctgcgccaggcgatcaagattcggagaaggagggtgcgggatcttcaggatcctccacctcagatggcgcccgagattcagccgccaagccatcatttttcgcccgagcagagggccctactttatgaggatgcactgtataccgtgcttcatcggctgggccaccctgagccaaaccatgtgacagaggcatcagaactcctgcggtacttgcaggaagccttccacgtggaacccgaggagcatcagcagactctccagcgtgtccgggagctggagaagccgattttttgcctcaaggcaacagtgaagcaggctaagggcatcttgggaaaagacgtgagcgggtttagtgatccttactgcctgctggggatcgaacagggggtcggagtgccaggcggaagccccgggagccgtcacaggcaaaaggcagtggtgcggcatacgattcccgaggaagagactcatcgcacacaggtgattacccagactttgaatccggtgtgggatgaaacattcatcctggagttcgaagatatcaccaacgccagcttccatctggacatgtgggacctcgacacagttgaaagcgtgagacagaagctcggcgagctgaccgaccttcacggactgagacgtatcttcaaggaagcccggaaagataagggtcaggacgattttctgggaaatgtggtactacgactgcaggacctgcgatgtcgagaagatcagtggtacccccttgaacctagaacagagacatatcccgacagaggacaatgccacttgcagttccagctgatccacaaacggcgggccacctctgcgtctcggtcgcagcctagttacacggttcacctgcacttactacaacagcttgtgtcccacgaggtgacacagcatgaagcaggctccacttcttgggacgggtctctgtcccctcaggctgccacggttttgttcctccatgcaacccagaaagacttatccgactttcaccaatcaatggcccaatggctggcctattcacgcctgtaccaaagcctcgagtttccctcttcttgcctactgcatcccataacttctatcgaatatcagtggatccagggtcgccttaaggctgaacaacaagaagaacttgcggctagcttctcatccctgctaacttacggtctgtcgctcattcgtcgttttagaagcgtgttccccctgtcagtgagcgactcgcccgcacgcctacaaagcctccttcgggtgcttgtccagatgtgcaagatgaaggcttttggagaactctgccccaacactgcaccccttccacagctggtgaccgaagctctccagaccgggacgaccgaatggtttcacctgaagcagcagcatcaccagcctatggtgcaaggaatccccgaggctggcaaagccttactaggcttagtgcaggatgtcataggagatctgcaccaatgccaacgcacctgggacaagatcttccataacacgttgaagattcacctgttcagtatggcttttagggagctacagtggctcgtggcgaaaagagttcaggatcacaccactgttgtgggagacgtggtttcacctgagatgggggaatctctgtttcaactgtacatatcgttaaaagagttgtgtcagcttcgaatgagcagctccgaaagggatggcgtgctcgccctggacaacttccatagatggttccagcccgccatcccatcatggttacagaaaacctacaatgaggccctggctcgggtgcagcgtgcggtccaaatggacgaattagtgcctctgggggagcttactaagcacagcacctcagcggtcgatcttagtacctgtttcgcacagatcagccataccgcgcggcaactggattggcctgatcctgaggaggcctttatgatcacggtgaagttcgtcgaggatacctgccgcttagccttggtgtactgttccttgatcaaggcacgggccagggagctgtcgagcggccagaaggaccagggtcaggctgctaacatgctctgcgttgtggtcaacgacatggagcagcttagattggtcatcgggaaactcccagcacagctagcctgggaggcgctcgagcagcgcgtgggagctgttctggagcagggccagctgcaaaatactctacacgcacagttgcagagtgccttggccgggctaggacatgaaatccggactggtgttcgcaccctcgccgagcagttggaggttggcatagccaaacacatccagaaactggtgggcgtccgtgaatctgtattgccagaggacgccattttgccactcatgaaattcctcgaagtggagctgtgctacatgaacaccaatctggtccaagagaacttctcttctctcttaaccctgctgtggacccataccctgactgtgctggtggaagctgccgcatcccaacgctcatccagtttggcctctaaccgtcttaaaatcgcactgcagaatctggagatctgtttccacgcagagggatgcggccttccacctaaagcactccatacagccacgttccaagccctgcagagggatctagaactccaggccgcatcttcacgggaactgatacggaaatacttctgctcgaggatccagcaacaagctgaaactacctccgaggagctgggggctgtgaccgtgaaagcgtcctaccgcgcctccgagcagaaactacgtgtggagctcctttccgcttcatcactgctgccgcttgactccaatggatccagtgacccatttgtccagctcacccttgagccacgccatgaattccccgagttggccgctagggagacccaaaagcataaaaaggacctgcacccactgttcgacgagacctttgagtttctcgtacccgccgaaccatgcaggaaagcaggggcctgcctgctgctaacagtgcttgattacgatactcttggcgcagacgatttggagggggaggcctttctgccactgagggaggtccccggcctgagcggctccgaggagcctggcgaggtgcctcagactcgacttcccctcacttacccagcaccaaatggggaccccatattacagcttctggaagggaggaaaggagaccgggaagcacaggtgtttgtcagactgaggcggcaccgggcaaagcaaggcattggcccgagcgtgtcctggccatggccaatctgcctcctcgcctttttgtttcagcctctgggatggggacctgggtcccttggccccgggttgcaagctcaaagcctcctcgaaaagggcgaaggcactctgccaaaaatgagacttcagctgccctggggcgaaggagggggccattattag

SEQ ID NO: 140079 - DNA, 2835 bp, Artificial Sequence
  Description of Artificial Sequence: Synthetic coding sequence
atggccacgctcctgagccacccgcagcagcggccccccttcctccgacaggctataaagatcagaagacgccgggttcgtgatctgcaggatccccccccgcagatggccccagaaatccagccacctagccaccatttctctccggagcagcgcgccctgctgtatgaggacgcactttacactgtgctgcacagactgggccatccggaacccaaccacgttaccgaagctagcgagctactccgttacctccaggaagcatttcacgtggagcctgaagagcaccagcagaccctacaacgagtgcgcgaactggaaaagccgatcttctgtcttaaggccaccgtgaaacaggctaaaggcatcttaggcaaggacgtttcaggcttttccgacccgtactgcctgctgggaattgagcagggcgtgggagtaccgggtggctctccaggcagtagacacaggcaaaaagctgtggtgaggcacacaattccggaggaagaaacccatcgtactcaggtgatcacacagaccctaaatccagtgtgggatgagaccttcatcctggaattcgaggacatcacaaatgcctcatttcatctggatatgtgggacctggacactgtcgagtctgtccggcagaaactgggggaattaactgaccttcacggccttcggcggatatttaaagaagccaggaaagataaggggcaggatgacttcttagggaacgtcgtgctgaggctccaagatctcaggtgcagggaagaccagtggtacccactcgaacctagaaccgaaacatacccagatcgcgggcaatgtcatctgcagtttcagctgattcacaaaaggagagcaactagtgcttcgagatcccagccaagctacaccgttcacctgcacctgctacagcagctcgtgtctcacgaggtgactcagcacgaagccgggtccacatcatgggatggctctctgtcaccgcaggccgctaccgtactgttcctacacgctacccagaaggacctgtccgatttccaccagtctatggcccagtggctggcatattctcgcctgtaccagagtctggagtttcccagctcttgcctgctgcatccgattacatctattgaatatcagtggattcagggcaggctgaaagccgagcagcaagaggaattggctgctagcttcagctccttgcttacgtatggccttagtctgatcagacggtttagaagtgttttccctctgtcagtttccgattcgcccgctagactccaaagcctgttaagagttctcgtgcagatgtgcaagatgaaagcttttggggagctgtgcccgaacacagcaccactacctcaacttgtgactgaggccctgcaaaccggaaccactgaatggttccacttgaagcagcagcaccatcagcccatggtgcagggcattccggaggccggaaaagcattacttgggctggtccaggatgtgatcggcgacttgcatcaatgccagcgaacatgggataaaatattccacaatacacttaaaatccatctgttttcaatggccttcagggaactccagtggctcgtcgcaaagagggtgcaggatcatacaacagtggttggagacgtggtgtcacctgaaatgggtgaaagtctgtttcagctttacattagtttgaaagagctgtgccaactgcgcatgtcctcgagtgagcgagacggagtgctggccctcgataatttccacaggtggtttcaacccgcaattccctcttggttacagaagacatataacgaggccctggctagagttcagagagcagtgcagatggacgagctcgtccccttgggtgagcttacaaaacattcaacgtcagcggttgatttatctacttgcttcgcccagatcagccacacggccagacagctggactggcctgaccctgaggaagcctttatgataacagttaaatttgtggaggacacatgccgcctggcgctcgtgtattgcagcctgatcaaggcgcgtgcccgggagctcagctccggacaaaaagaccaggggcaggctgctaatatgttgtgcgttgtcgttaacgatatggagcaactgcggctggtcattggcaagctgcccgcccagctggcttgggaggccctcgaacaacgggtcggagccgtgctggagcagggtcaactgcagaacacactccacgcccagcttcagtccgctctggccggcctgggccatgaaatccgaacaggagtacggactctggctgaacagctcgaagtcggaatagctaaacatattcaaaagctggtgggagtgagggagtccgtgctccctgaggatgcaatcctgccactgatgaaatttcttgaggttgagctttgctatatgaatactaatttagtgcaagaaaactttagctctttactgaccctactgtggactcacaccttgactgtcctggtggaggccgcagccagtcagcggtccagcagtctggcctccaaccgccttaagattgcgttgcagaaccttgagatctgttttcacgcggaagggtgtggccttccaccgaaaacgctacctttaccagctagtcaaaagagctgctgtggcggtcaagggattggtccctcggtttcttggccctggcccatttgccttctggcgttcctgtttcagcccctgggatggggccctgggtccctcggccccggtcttcaggcccagagcttactggagaaaggagagggaactttgcccaaaatgcgcttacagctaccatggggagagggaggaggacattattag

SEQ ID NO: 140080 - DNA, 2790 bp, Artificial Sequence
  Description of Artificial Sequence: Synthetic coding sequence
atgacggcatccagtgttgaacagttacggaaggaaggtaacgaactgttcaaatgtggcgactacggcggtgctctggccgcgtatactcaggcactcggcctggatgccacgccacaggaccaggcagtactgcatagaaaccgtgccgcatgccacctcaagctggaggattacgataaggctgagactgaggcttccaaagctatagagaaagacggaggggacgtaaaagcactctaccggagatcccaggcgctggaaaaacttggtcgccttgaccaggcggtgttggacctccaaaggtgtgtgtctctggagccaaagaacaaggtgtttcaagaggcacttaggaacatcgggggccaaattcaggagaaggttcggtacatgtcttcaacggacgccaaagtcgagcagatgttccagatacttttggacccagaggagaaaggtaccgagaaaaaacagaaagcctcccagaacctggtcgtgctagcaagagaggacgcgggcgccgaaaaaattttccggtcaaacggggtacagttactgcagcgactgctcgatatgggtgaaactgatcttatgctcgcggccctcaggacactggtcggcatctgctctgaacaccagtccagaaccgtagcaactctgagtatcttgggcacccgaagggttgtttcgatcctcggggtcgaaagccaagcagtctcccttgccgcatgccacctcttgcaggtcatgtttgacgcactcaaagagggggttaaaaagggtttcagaggaaaggagggtgcaatcattgtagacccagcccgcgaactgaaggtcctaatatcgaacttgctggacctgctcacagaagttggcgtgagcggtcagggaagggataacgcacttaccctactgataaaagccgtgcccaggaagtcactgaaagaccctaacaatagtcttactctctgggtcatagatcagggcctaaaaaagattttggaggtgggcggttccctgcaggaccccccgggagaactggctgtcacggcaaacagcaggatgtccgccagtatcttgctaagcaagttgttcgatgatttgaagtgtgatgctgaacgtgagaatttccatcgcctgtgtgaaaattatataaagtcttggtttgaggggcagggcttggccggtaagttacgagctatccagacagtctcctgccttctgcaggggccctgtgacgcaggtaatagggctttagaactctcgggagtgatggagagcgtgatagctctgtgcgccagtgagcaggaggaggagcagctggtagccgtggaagcgctaattcacgcagccggcaaggctaagagggcaagcttcatcaccgccaatggcgtttccctgctgaaagatctttacaagtgcagcgagaaggactccattcgtattagggctctggtgggcctgtgtaagctgggttccgctggagggacagacttcagtatgaagcagttcgctgaaggctctacactgaaactggcaaaacaatgtcggaaatggttatgcaatgaccagattgacgcggggaccagacgatgggcggtcgaaggtcttgcttacctgacctttgacgccgacgtgaaggaggagttcgtggaagacgccgcggctctcaaggccttattccagctgagcagactagaagaacggagcgttttgtttgccgtggcttctgcactggttaactgcaccaattcctatgattatgaagaaccagatccaaaaatggtggagctcgccaagtacgcaaaacagcacgtacctgagcagcatcccaaagacaaaccaagctttgtacgggcacgcgtgaaaaagctactggcagcgggcgtcgtctctgctatggtgtgcatggtgaagaccgagagcccagtcttgacctcctcctgtagagagctgctttctcgtgtgtttctcgcactcgtggaggaggtcgaagacagagggacagtggtggcccaggggggagggcgagctctcataccactggcccttgagggaacagatgtcggccagaccaaagctgcccaagccttggctaaactcactataacatcaaaccctgagatgacgtttcccggcgagcggatctatgaagttgtgcgcccactcgtgtcactgctgcatcttaactgttcaggtctccaaaatttcgaagctcttatggctcttacaaacctggcgggtattagcgaacgccttcgtcagaaaatactgaaggagaaggccgtgccgatgattgaggggtacatgtttgaagagcacgagatgatccgcagagccgctaccgagtgtatgtgcaaccttgccatgagtaaagaggtccaggatctgttcgaagcacaggggaatgatagacttaagttgttagtgctgtatagcggagaagacgatgagctcctccaacgcgcagctgccggcggactggccatgcttacaagcatgagacccaccctgtgtagccgaattccccaggtaacgactcactggttggagatcttgcaggcgctgctactgtcgtctaatcaggagttgcagcatagaggggccgtggtggtgctgaatatggtcgaggcatccagagaaattgcaagcacccttatggagagtgagatgatggagatcctgagtgtcctggcgaaaggcgaccactcgccggtgacacgggcagccgccgcgtgtttggataaagcggtggagtatgggctgatacaaccaaatcaagacggtgaatag

SEQ ID NO: 140081 - DNA, 2835 bp, Artificial Sequence
  Description of Artificial Sequence: Synthetic coding sequence
atgacggtctccgggcctggtacgcccgagcccaggccagccacccccggggcctcaagcgtcgagcagctacgtaaagagggaaacgaactgtttaaatgcggcgactatgggggtgcgctggcagcatacactcaggccctgggtttggacgccacaccacaagaccaagccgtgctgcaccgtaaccgggctgcctgtcatttgaagctggaggactatgacaaggcagagacagaggccagcaaagccattgagaaggatgggggagacgtgaaagccctctataggcgctctcaagccctggagaagctggggcgcctggatcaggctgtgctcgacctgcagaggtgcgtttctttggaacctaaaaacaaggtattccaggaagccctgagaaatatcggcgggcagatccaggagaaggtacggtacatgagctccaccgatgcgaaggtcgaacagatgtttcagattctgcttgaccctgaggagaaggggaccgaaaagaaacagaaggccagtcagaacctggtagtgttggcacgggaagatgccggggccgagaaaatcttcagatctaacggggttcaactcctccagaggttgcttgacatgggagagacagatctgatgctcgcagccctgcggactctggtggggatttgtagcgagcatcagtcgaggactgtggcgacactctctatcctgggaacccgacgggtcgtgtctatcctgggcgtggaatctcaggcagtttccctggccgcttgccacctgttgcaggtgatgttcgatgccctgaaggagggcgtaaagaaaggttttcgcggcaaggagggtgctatcattgtggatcctgctagggagctgaaggtcttaatctctaatctcctggacctcctgactgaggtcggggtctccgggcagggccgcgataacgctctgacactactcatcaaagccgtccccagaaagtctctgaaagatccgaataactctctcacactgtgggtcatcgatcagggtctcaagaagatactggaggtgggcggctctttgcaagatcccccaggtgagctagctgttaccgccaattctcggatgagcgcctcaatccttctcagtaagctgtttgatgatctaaagtgcgacgccgagcgcgagaatttccatcgcttgtgtgagaattatatcaagtcttggtttgaaggtcaaggcctggcaggtaagttacgcgcaatccagacagtgtcctgtctcctgcagggcccatgcgacgccggtaaccgagctctggagctgtctggcgttatggaaagtgtcatcgctctgtgcgcgagcgagcaggaagaggaacagttagttgccgttgaagcacttatacatgcagcagggaaggcgaaacgtgcttcatttatcactgcaaacggcgtctccctgctcaaggacctctacaagtgtagcgaaaaggattctatcaggattcgagccttggtcggactgtgcaaattgggctcagccgggggcactgacttcagtatgaaacagttcgcagaagggtcaaccctaaagctcgcaaaacagtgcaggaaatggctttgcaacgaccagatcgacgcaggcacccggagatgggccgtggaggggctggcttatctgacctttgacgcagatgtaaaggaagagtttgtggaggatgccgccgcccttaaggctctctttcagctctcgcgtcttgaagaacggtcagtgcttttcgccgttgcctctgccttggtgaactgtacaaattcttacgactacgaggaaccagatcctaagatggtagaattggccaagtatgcaaaacaacacgtcccagaacaacatcccaaggacaagccttcctttgtccgcgcacgcgtcaaaaagctgttggccgccggtgttgtatcagccatggtgtgcatggttaagactgaaagtcctgtgctaacatccagctgtcgagaactgctaagccgcgtattcttagcactggtcgaagaagtcgaagatcgggggaccgtggtagcgcagggcggaggacgagccttgattccccttgctcttgagggtacagacgtgggccaaacgaaggcagctcaagccctcgccaagctgacaattacatctaacccagaaatgacattccccggagagagaatctatgaggtggtgaggccacttgtgtcactgctccacctgaattgtagtggcctgcagaatttcgaggccctgatggcactgaccaatcttgccggaattagcgagcgcctgagacagaagattttgaaggaaaaggctgtccccatgatcgaaggatatatgttcgaggagcacgagatgattcgccgtgcagcaaccgagtgcatgtgcaacctcgcaatgagtaaggaggttcaggatctgtttgaagcgcaaggcaatgaccggctcaaattgttagtgctctactccggggaagatgacgaactcctgcaacgggctgccgctggaggcttggccatgctcacttccatgaggcctaccctatgcagtcgaataccacaggtcactactcactggttggagattttgcaggcactgctgctgtctagcaatcaggaactgcagcatagaggagccgtcgtggttctgaacatggttgaggcctctcgggaaatcgccagcacactcatggagagcgaaatgatggagatcctgagtgtgttggccaagggggatcacagccctgtaacaagagccgctgccgcttgtttggataaagcagttgagtatggcctcatacaacccaaccaggacggtgaatag

SEQ ID NO: 140082 - DNA, 2409 bp, Artificial Sequence
  Description of Artificial Sequence: Synthetic coding sequence
atggcaggaacaagtgaaaggtctctgatttcctcaatcagccagccaaaggcgattgagtgtttcgaggtgaagaagaaggcattcctgacacacggaaggtaccacggcagtggagccacacctcctaaaactaaggatccgaaacccgaaacattctgtggccagaccggactgcctactatggaagttaggattaacgttagcaggcagcaagtagaaaaagtgtttggtctggaggaatactggtgtcagtgcgtggcctggagcagcagtgggacgacaaagagccaaaaagcctacatccggatcgcatatttgcggaagaattttgaacaggagcctttagcaaaggaggtctccctcgagcagggcatagttttaccatgcagaccccccgagggcatcccgccagctgaggtggagtggttgaggaatgaggacctggtggacccctctttagaccccaatgtgtacattactcgggagcactcgctggtagtgagacaggcccgactggcagacacagccaattatacatgtgttgccaaaaacattgtggccagaagaagatccgcgtccgctgctgtcatcgtgtatgtggatggcagctggtccccctggagcaaatggtcggcttgtggcctcgattgcacccactggaggagtcgagaatgttctgaccctgcacctcgaaacgggggggaagagtgtcagggaaccgacttggacactcgaaactgtacgtcagatctgtgtgtgcacactgccagcggaccggaagacgtagccctatacgttgggctgattgcggtggccgtgtgtttagttttactcctattagtgcttattctcgtctactgtaggaagaaggagggactggactccgatgtagccgactcttctatccttacttccgggtttcagccagtctccatcaagccttctaaggccgataacccacacctcctgaccattcagcctgatttgtccactacgactactacttaccagggcagcctgtgtccccgtcaggacggaccttcaccaaagttccagctcaccaacggacatctcctgtcccctctgggaggcgggagacatacactgcaccattcatctcccacttcagaagcggaagagttcgtctcacggctgtctacccaaaactattttcggtccctgccgcggggcacaagcaacatgacttacgggacctttaacttcctgggagggaggctaatgatacctaacaccggaatctctctcctgattccccccgacgcgattcctcgggggaagatatacgagatctacctgactctgcataagccggaggacgttcggctgcccctggcaggctgtcagaccttactgagtccaatcgtaagttgtggtcctcctggggtgcttcttaccagacccgtgatcttagcgatggaccactgtggcgagccatccccagattcatggtccctgcgcctgaaaaagcaatcttgtgaggggtcttgggaggatgtattacacctgggtgaggaagccccctcacacctgtactattgccaattggaggcctccgcgtgttacgtgtttaccgagcaattagggcgcttcgcactcgtcggcgaagcgctctccgttgcagcagccaagagactgaaattgcttctgttcgcccctgtggcctgcacatctttggaatacaatatcagagtctattgccttcatgatactcacgatgctctcaaggaggtcgtccaactggagaagcagctgggtgggcagttgatccaagagcctagagtcctacatttcaaagattcatatcataacctgcgattgtctatccacgacgtccctagttccctgtggaagagcaagctactagtctcctaccaggaaattccattttatcacatatggaacgggactcaacgttatctccattgtacctttactctggagcgcgtttctccatccacatctgacttggcatgcaaactctgggtatggcaggtggagggagacggtcagagttttagtatcaacttcaatatcacaaaggacacccggttcgctgagttactggcgctggaaagtgaagccggggtgcctgctctcgtgggacctagtgcctttaagatcccctttcttattaggcagaaaatcatttcaagcctggatcccccatgccgtcgtggggcagactggcgcacactggcgcagaagctccacctcgacagtcatctgtcattctttgcatcaaaaccctcacctaccgcaatgattcttaatctgtgggaagctcgacattttccgaacggaaaccttagccagctcgccgcagcggtggccggacttggacagcccgatgccggtttattcactgtgtcagaggctgagtgttag

SEQ ID NO: 140083 - DNA, 2529 bp, Artificial Sequence
  Description of Artificial Sequence: Synthetic coding sequence
atggctgttcgacccggtctgtggccagccctactgggcatcgtcctggccgcttggttgcgggggtctggggcacaacagagtgctaccgtcgcaaaccccgtaccaggtgctaaccccgatttgctccctcattttctggttgagcccgaggacgtgtacattgtcaagaataaacctgtgcttttggtttgcaaagctgtgcccgcgacgcaaatatttttcaaatgcaacggggaatgggtcaggcaggtggatcatgtcattgaacgcagcactgatgggtcctccggcctgcctaccatggaagtccgcattaacgtctctcgccagcaggttgaaaaggtgttcggactggaggaatattggtgccaatgtgtggcatggtcttcctcaggcactactaaatctcagaaggcatacatccgcatcgcctatctgcggaagaacttcgagcaagaaccactggccaaggaggtctcattggagcaggggatagtgctcccgtgtcggcctcccgaggggattccccccgccgaggtcgaatggctacgcaacgaagatttagtcgatcctagcctggaccctaacgtgtacatcactagagagcacagcttggtcgtccgccaggccaggctggctgatacagcaaactacacctgcgtcgccaagaatatcgtcgcccggcgacggtccgcatccgctgctgttatcgtctacgtagacggctcatggtccccatggtcaaagtggtccgcctgcggcctcgactgtacacactggaggagcagagaatgctcagaccctgcaccccggaatggaggagaggagtgccagggcaccgatctggatacccggaactgcacaagcgatttatgcgtacacaccgcctccggtcctgaagacgtggccctttacgtcggcctaattgcagttgccgtgtgtttggtgctgttacttctggtgctcattctggtttactgccgcaagaaagaggggctggattctgacgtcgccgactctagcattcttacttccggcttccaacctgttagtatcaagccctccaaggcagataacccacaccttcttaccatacaacctgatctctcaaccaccactacaacataccaggggtcattgtgcccgagacaggacggtccgtcacctaaatttcagctgactaacggacatttgctgtcacctctgggcggcgggagacatacactgcatcatagtagcccaaccagtgaggcggaggagtttgtatcgaggctgtccacgcagaactattttcggagcctgccaagggggacctcaaacatgacctacggtactttcaatttcttggggggacgcctgatgattccaaacacaggcatttcactcctcatacccccagatgcgatcccacgtgggaaaatttacgagatctatctgaccctccataagccggaagacgtaaggttgcctcttgccggatgccagaccctcctatctcctattgtctcatgtggaccaccgggagtcctcttgaccaggcccgtcattttagcaatggatcactgtggcgagccctccccagattcttggagtcttcgcctgaaaaagcaatcttgcgagggtagctgggaagacgttcttcacctgggagaagaagcaccttcccacctatactactgccagcttgaggcttcggcttgttacgtattcaccgagcagctgggccggttcgcgttagtgggcgaggctctgagtgttgctgctgctaagagactcaagttgctgctgttcgcacccgtcgcatgcacttcgttggaatataacatcagggtgtactgtctgcatgacactcatgatgctctgaaagaagttgttcaattggaaaagcagttgggcggtcaactcattcaggagccaagagtcctccactttaaggatagctaccataatctcagattgtcaattcacgacgttccgagctcgctgtggaagtctaagctccttgtctcataccaggaaatccccttctaccacatctggaacggcacacagaggtacctgcattgtaccttcacccttgaacgggtctctccttccacaagtgatctcgcatgtaaactgtgggtgtggcaggtggagggggacggacagtcattctccattaattttaacattactaaggatacccggtttgctgaactgttagcactggagagtgaggcaggagtgcccgccctggtcggcccttccgcatttaagattccgtttttaatccgtcagaagattataagctccctcgatcccccttgtcgaagaggcgcagattggcgtaccctagcccagaaactccatctggacagtcacctttctttttttgcctcaaagccctcccccacagcgatgatccttaatctgtgggaggcaagacactttcctaacggcaatctgtctcagctggccgcagccgtggcagggcttggacagccggacgcagggctgttcacagtttcggaggccgagtgttag

SEQ ID NO: 140084 - DNA, 2838 bp, Artificial Sequence
  Description of Artificial Sequence: Synthetic coding sequence
atgggagctagaagcggggctcgcggcgcgctgctgcttgctcttttgttatgctgggatccacgcctaagccaggccgggacagatagtggaagtgaagtcctccctgactccttccctagcgcccctgccgaaccattgccatactttctgcaggaaccccaggacgcttatatagtgaaaaataagccagtggaactacggtgtcgagcgtttccagctacccagatctacttcaagtgcaatggagaatgggtgagccagaatgatcacgtgacccaggagggcttggacgaggcaaccggacttcgagtgagagaggtccaaattgaggtctccaggcagcaggtggaagagctcttcgggctggaggattattggtgtcagtgcgtggcttggtcgtccgctggcacaaccaagtcccgtcgggcatatgtgcgaatcgcttaccttaggaaaaacttcgatcaggagccactaggtaaggaggtcccactggatcatgaggtgttacttcagtgtcggcctcccgagggagtgccagttgcggaagtggagtggttaaaaaacgaagacgttattgaccccacacaggacacaaacttcttgctcacaattgatcataatcttattattaggcaggcccgactgtcagatactgcgaactacacttgcgtcgcgaagaatatcgtcgcaaagcgaagatccaccaccgctacggtaattgtgtatgtgaatgggggatggtcgagttgggcagagtggagtccatgcagtaatcggtgtggccgcggatggcaaaagagaacaaggacctgcacaaatcctgcgcctttgaacggcggggctttttgcgaaggtcaggccttccagaaaactgcctgcacaactatttgccctgtcgacggagcctggactgagtggagtaagtggagtgcgtgctcaacagagtgcgcgcactggcgtagcagggaatgcatggcccctccaccccagaatggaggaagagattgctctgggacccttctggacagtaaaaattgcactgatggcctgtgcatgcagaacaaaaaaacactcagcgaccctaacagccatctcctggaagctagcggagacgcggcgctatacgcaggactcgtggtggccatttttgtggtcgtggcaatcctcatggccgtcggcgtagtcgtttaccgacgaaattgtagggattttgacaccgacatcacagattcctcagcagctctcactggcggattccacccggtaaatttcaaaacagctagaccatccaatcctcaattgcttcatccttccgtgcctccagacctgactgcatccgctggaatctaccgaggaccagtgtacgccctgcaggattccactgacaaaatccccatgaccaatagccccctgctggatcctctgccctccctgaaagtgaaggtctacagctcatctacaaccggctctggacccgggctcgccgatggtgccgatctgttgggggtgttacctcccgggacttaccctagtgacttcgccagagacactcatttcctgcatctcagaagtgcttctctcggctcccagcagctgcttggactccccagagatccaggctcttccgtttcaggcaccttcggatgcctcggaggaagactttctatccccgggacaggggtgagccttcttgtccctaacggcgcgattcctcagggtaaattctacgaaatgtacttacttatcaacaaggctgaatccaccctgcccctaagtgagggtacacaaacggtgctgtccccctcagtgacctgtggcccaacgggtctcctgttgtgtaggcctgtgatcctgaccatgccccactgtgccgaggtcagcgctcgcgactggatctttcagcttaaaacacaggctcatcaggggcattgggaagaggtcgttactttagacgaagaaacactcaataccccatgttactgccaactcgagcctagggcctgtcacatactgctggaccagctgggcacctatgtgtttacaggagagagctactcacgctctgccgttaaaaggctgcagctggccgtcttcgctccagccctatgtacttcccttgagtattcactgagggtgtattgcctggaagatactcctgtcgcactcaaagaggtgctggagctcgagcgcaccctgggtggctacctcgtggaggagcccaaacccttgatgtttaaagactcctatcacaacctgcgcctgtcactccacgatctgccccatgcccactggaggtccaaattgctggcaaagtaccaggagataccattctaccacatctggagtgggagtcagaaagcactccactgcacattcaccctggagaggcattcgctcgctagcaccgagctgacgtgtaaaatatgcgtcagacaggtcgagggcgaagggcagatattccaactgcacacaacactcgccgaaacaccagcgggttctcttgacactctctgctctgctcctggtagcaccgtgactacacaacttggaccatacgcttttaaaatccctttatcaattcggcaaaaaatttgcaattctctagacgccccgaattccaggggaaatgattggagaatgctggcccaaaaactttctatggatagatatctcaactattttgctactaaggcctcacccaccggcgtgatcctggatctatgggaagccctacaacaggacgatggcgatctgaacagcctggcgtctgccttggaggagatgggcaaaagcgagatgctggtcgctgtcgccactgacggggactgttag

SEQ ID NO: 140085 - DNA, 2805 bp, Artificial Sequence
  Description of Artificial Sequence: Synthetic coding sequence
atgggggcccgcagtggagcccgtggcgccctgttgctcgcactccttctttgttgggacccacgcctgagccaggcgggtacagactcaggttccgaggttctgccagacagtttcccctcggctcccgccgagccccttccctatttcctgcaggagcctcaagatgcctacattgtgaaaaacaagcccgtggagctgaggtgtagagcctttccggcgacccagatttacttcaagtgtaacggggaatgggtatcgcaaaatgaccacgtcacacaggaagggttggacgaagcgacgggattacgcgtgcgggaagtgcagatcgaggttagccggcagcaggtcgaagaactgttcggtcttgaagactattggtgccagtgtgttgcatggagttccgcgggcaccaccaaatctcggcgggcctatgtcaggattgcttatcttaggaaaaacttcgatcaggagcccctggggaaggaagtgccactcgatcatgaggtgctgcttcagtgtaggccccccgaaggcgtgccggttgctgaggtagaatggcttaagaatgaagacgtgatcgaccctacacaggatacaaatttcctgctcactatcgaccacaatcttatcatccgccaggcgcgactgagtgacaccgccaattatacctgtgtggccaagaatatcgttgctaaaagacgctccaccactgccacagtaattgtgtacgtgaacggaggctggagctcctgggcggagtggtcaccatgctcgaatcgctgcggtaggggctggcagaaacgcactcggacgtgcactaatcctgcaccccttaacggtggcgcattttgtgagggtcaggcttttcagaagacagcgtgtaccacaatttgccccgtagacggcgcttggaccgagtggagcaaatggtcagcttgtagcacagagtgcgctcactggcgatcgcgggaatgtatggcccctccacctcagaacggaggcagggattgctcgggcactctgctagatagcaagaattgcacagacggcctgtgcatgcagatgttggaagcttctggcgacgcggccctctatgctgggttggtggtcgctatttttgttgtggtggcaattttaatggcagtgggtgtggttgtgtaccgccgcaattgtcgcgatttcgataccgacatcactgattccagtgcagccctgacaggagggttccaccccgtcaactttaaaaccgctaggccaagtaacccccagctcttgcatcccagtgtgccgccagacctgacagcctcggcagggatctatcgcggtcctgtgtatgctctgcaggattccaccgacaagattcctatgacaaattccccactcctggatcccctgcctagcctaaaagtgaaagtctattcttcaagcacaaccggatccggccctggactggcagatggggccgatctgttaggcgttctaccacctgggacctacccatctgactttgcgcgcgacacccactttttgcacttgagatcagcaagtctgggaagccagcaactcttgggattacctcgagatcctggatcctccgtttcaggaactttcgggtgcctagggggcagactgtctattcccggcaccggtgtgtctctgctggtcccgaacggggcaatcccccaaggtaaattttacgagatgtacttgctgattaacaaggcagagtccactttacccctttctgaaggaacgcagacagtgctcagcccgagtgttacatgcgggcccacaggattgttattgtgcaggccagttatactaaccatgccacattgtgcagaagtgagtgcaagggactggatttttcagttaaaaactcaggctcatcaggggcactgggaggaggtagtcacccttgacgaggaaacacttaacaccccgtgttactgtcagttggaaccccgagcctgccatatacttctggatcagctcggcacttacgtcttcaccggcgaatcctactcacgctctgctgttaagcgactgcaactcgctgtcttcgcccccgcactgtgcacatcgctggaatattccctaagagtttattgtctcgaagatacacccgtggccctgaaggaagtactggaacttgagcgaaccttaggagggtatctggtcgaagagcccaagcccctcatgtttaaggattcgtatcataatctgaggctaagtcttcatgacctgccacatgcccactggcgttctaagttgctggcaaagtatcaggagatccctttctatcacatctggtcgggctcccaaaaagccttacactgcacttttactctcgagaggcacagtttagcttccaccgagttaacctgcaagatttgcgtacgacaggtcgaaggtgaaggccagatcttccagcttcacaccacgctggcggagacacctgccggctctctggacaccctctgttcggcacctggctccacggtcacgacccaattaggtccttacgcttttaagattcctctgagtatccgacagaagatctgtaacagcctcgatgcacccaacagtcgaggaaacgattggagaatgctggctcagaagctttccatggatcggtacttaaattactttgcgactaaggcctctcccacgggcgtcatattagacttgtgggaagccttgcagcaagatgatggtgacctgaactctttggctagtgccctggaagaaatggggaaatccgagatgctagtggccgttgccaccgacggcgattgttag

SEQ ID NO: 140086 - DNA, 2673 bp, Artificial Sequence
  Description of Artificial Sequence: Synthetic coding sequence
gatgacgatttctttcacgagctgccagaaacctttccttcagaccctcctgaacccttaccgcactttcttatcgagccggaggaagcatacatcgtcaaaaataaacccgtgaacctctattgcaaggccagccccgcgacccagatctacttcaagtgtaattcagaatgggtgcatcagaaagatcacatcgtcgatgagcgcgtagacgaaacttccggactgatcgttagagaggtgtcaatcgaaatttccagacagcaggttgaggagttgttcggccccgaggactactggtgccaatgcgtcgcatggtcaagcgctgggaccaccaaatctaggaaagcctatgtgaggattgcttacctgcgcaagacattcgagcaggaaccactggggaaagaagtgagtctcgaacaggaagtcctgctccagtgcagaccccctgagggaatccctgtggctgaggtggagtggttgaagaacgaggatatcatcgacccagtggaggatcggaacttctatatcaccattgatcacaacctgattattaagcaggctagattgagtgacaccgccaattacacttgtgtggcaaagaatatcgtcgccaaacgtaagagcaccacagcaactgttattgtttacgtgaacggtggctggtctacatggaccgaatggtcagtgtgtaatagtaggtgtggcaggggctaccagaagaggactcgtacctgcacgaatcctgcccctctcaatgggggggctttctgtgagggacagagcgttcagaagatcgcatgcactaccctttgcccagtggatgggaggtggaccccatggtcaaagtggagcacctgtgggaccgagtgtacacactggcgcagacgagagtgtaccgcccctgcccctaagaatggggggaaagactgcgacggactggtgctccaatcaaaaaactgcactgacgggctctgcatgcaaactgcgcctgactcagatgacgtggccctatatgttggcattgtcattgcagtgatcgtgtgcctagccatttccgtcgtggtggcattgtttgtgtatagaaagaatcatcgcgactttgagtctgatattattgacagttcggcattaaatggcggatttcagccagtcaatatcaaagcagccaggcaggatctgctggctgtcccccccgatctgacgagcgccgccgcaatgtatagaggccccgtctacgctctgcacgacgtcagtgataagatcccaatgacgaacagcccaatactggatcctctccccaatttgaagatcaaggtatacaacacctctggggcagtcacaccccaggacgatctgagcgagtttacttctaagctgtccccacagatgacccagagcctgctcgagaatgaggccctgagtctgaaaaaccaatccctggctcggcaaaccgaccccagctgcactgctttcggcagctttaatagtctgggcggccacctgatcgtgcctaatagcggcgttagtctcctgatccccgcaggtgccatcccacagggcagggtgtacgagatgtatgtcacagtgcatcgtaaggagaccatgaggcctcccatggacgacagccagacattgcttacccccgttgtcagctgtgggcctccgggggcgctgttgactaggcctgtggtgctgacaatgcatcattgcgctgaccccaataccgaggactggaagatcttattgaagaatcaggctgcacagggacagtgggaagacgtggtggtggttggcgaggaaaactttactacaccctgttacattcaactggacgccgaggcttgtcacattctcactgagaacttaagtacttatgcgttggttggtcacagcactaccaaggcggcagccaagagattgaaattggcaatcttcggacctctctgctgcagcagtctagagtattcaattcgtgtgtattgtctcgacgatacccaggacgctttgaaagagattctgcatctggagcgccagatgggcggacaattattagaagagccaaaagccctgcactttaaaggtagcacccataacctgagactgagcatccacgacatcgcacacagcttatggaaatcaaagctacttgctaaataccaggaaatccctttttaccacgtatggagtgggtcccagcggaatcttcactgcacttttactctggagcggttcagtctaaatactgtggagctcgtgtgtaaactgtgtgtcaggcaggtcgagggtgaaggacagatattccagttgaattgcactgttagtgaggaacccacaggcatagatctgccactactcgatcctgcaaatacaataaccaccgtgaccgggccatctgccttttccatccccctaccgattagacagaagttatgttcatcgctcgacgcacctcaaaccagaggtcatgactggcgcatgttggcccacaaactgaatctagaccgctatctgaattatttcgctacaaagtcctctcccaccggggttatcctggatctgtgggaggctcagaattttcccgatgggaatctcagcatgctcgctgcagtgctggaagagatgggtcggcacgagaccgttgtcagtctggctgcggaggggcagtactag

SEQ ID NO: 140087 - DNA, 2796 bp, Artificial Sequence
  Description of Artificial Sequence: Synthetic coding sequence
atgcggaaaggcctacgagctactgccgcaaggtgtggattgggactggggtaccttctacagatgttagtgctacccgccttggctctgctttcagcctcaggcaccggatcagccgctcaagacgacgacttctttcacgagcttcccgagacattcccttctgacccacctgagccgctgcctcacttcctgattgagcccgaggaagcttacattgtgaagaacaagcccgtgaacctgtactgtaaagcgagccccgccacccaaatctacttcaagtgtaattcagagtgggtacatcaaaaagaccacatagtggatgagagagtggacgaaacctcaggccttatcgttcgagaggtgagtatcgaaatctctcgtcagcaggttgaagaactcttcgggccagaggattattggtgtcagtgcgttgcctggagttccgccggcacgaccaaaagccgcaaggcctatgtacggattgcttacctgagaaagacattcgaacaggagcctctgggaaaggaagttagtctggagcaagaggtgctcttgcagtgccggcctccagagggtatcccagtggctgaagtcgagtggctcaagaatgaggatatcatagatccagtggaggacagaaacttttatatcaccatcgatcacaaccttatcattaaacaggctagattaagcgacactgcgaactacacatgtgttgcaaagaacattgttgcgaagcggaaatctacaacagcaactgtcatcgtgtacgtgaatggcgggtggtccacttggacagaatggtctgtatgcaactctagatgcgggcggggctatcagaagagaacgcgtacctgtactaatccagctcccctgaatggaggcgcattttgcgagggccagtctgtgcagaagatcgcgtgtacaacactctgcccagtggacgggcgatggaccccttggtcaaagtggagtacctgcgggacagagtgcacacactggcgcagaagggagtgcaccgcacccgctcctaagaatggaggaaaggactgtgatggtctggtgctgcagagtaagaactgtaccgatggactgtgcatgcagactgcaccggactctgacgacgtggcactctatgtggggatcgttatcgccgtcattgtttgcctggccatctctgtggtggtggccctcttcgtctataggaaaaatcacagagatttcgagtccgacatcatcgattcgagtgccctgaatggcggattccagccagtcaacatcaaagcagctagacaagatctgcttgccgtcccccccgacctcacgagcgccgcagccatgtacagagggcctgtttacgctttacacgatgtgtcagacaagattcccatgactaatagcccgattcttgacccgttgcccaatctcaaaataaaagtttataataccagtggggctgtgacaccacaagatgatctcagcgagttcacatcaaaactctcgccacaaatgacacaatctctactggaaaatgaagccctgtcactgaagaaccaatcccttgccagacagacggatccttcctgtacagcgttcggatcgtttaattcactggggggacacctgatcgtgcccaattcgggcgtgagcctactcatcccagctggagccatcccacaggggcgtgtgtacgagatgtacgttacggtacacaggaaagaaacaatgaggccaccgatggacgactctcagacgctgctcactccagtggtcagctgcggaccaccgggagctctacttactagaccggtagtgctgacgatgcaccattgtgccgatcctaacactgaggattggaaaatacttttaaaaaatcaggccgcccagggccaatgggaggacgtcgtggtggttggcgaggaaaacttcacgaccccctgttacatacaactcgacgcggaggcttgccatatcctcacagagaacctgagcacctacgccttggttggccattcaacaaccaaagccgcagctaaaagattaaagcttgctatcttcggccccttgtgctgcagctcattggaatatagcatcagggtgtattgcctggacgacacacaggatgccctaaaagaaattcttcacctggagagacagatgggtggccagttactagaggaaccaaaagccctgcatttcaagggttccacccataatttgaggcttagcatccatgacatcgcccattccctatggaaatccaagctcctcgctaagtatcaggaaattccattttatcacgtgtggtccggctcccagcgcaacctgcattgtacctttacgctggagcgcttctccctgaatacagtcgaactcgtctgcaagctgtgcgtgaggcaggtggaaggggagggacagatctttcaactgaactgcacagtgtccgaggagcccactggcatcgaccttccgctcttggaccccgcaaacacaattacgacagttacaggaccatccgccttttccattcctctgccaatccggcagaaattgtgctcctccctggatgcgccgcagacacggggtcacgattggaggatgttggcgcataaactgaatcttgaccggtatcttaattacttcgcaactaaaagttcccctaccggcgtgatcctcgatctttgggaggctcagaacttccccgatggcaacttaagcatgttggcagccgtccttgaggaaatgggaaggcatgaaactgtcgttagcctcgccgctgaaggacagtactag

SEQ ID NO: 140088 - DNA, 3153 bp, Artificial Sequence
  Description of Artificial Sequence: Synthetic coding sequence
atggaacctggtagggggggcacggaaacggttggcaaatttgaattcagtagaaaggatctgattggacatggcgcattcgctgttgtcttcaaggggcggcaccgcgagaaacacgacctcgaggttgccgtgaagtgcatcaataagaaaaacctcgccaaaagccagactctcctgggtaaagagattaaaattctaaaagagttaaaacatgaaaacattgtggcattgtatgatttccaagagatggcaaattctgtttacctggtaatggagtactgtaacggcggcgatctcgctgactatctgcatgccatgagaactctctccgaggacactatccgtttatttcttcagcagattgctggggccatgcggcttttgcatagtaaggggatcatccacagagacctgaagccacagaacatactgttgtcaaacccagccggtagacgtgctaacccgaactctattagggtgaaaattgcagatttcggattcgcccggtatctgcaaagcaacatgatggcagcaaccttatgtggcagcccaatgtacatggccccagaggtcatcatgtcccagcattatgatggcaaggcagatctctggtccatcggcacaatcgtgtatcaatgtctcacggggaaagcaccctttcaggcgtcctctcctcaggatctccgactcttctatgagaaaaacaagacgctggtccctaccattccccgagaaacgtcagcacctttacggcagctccttctggccctgctacaacgcaaccataaagaccgaatggactttgatgagttttttcaccatccatttctggatgcgagcccaagtgtccgtaagtcgccgcccgtgcccgtgccatcgtatcccagcagcggatctggaagcagctcaagcagttcctctacaagccatcttgctagtccgccgtcactgggtgagatgcagcagctccagaaaacactcgcctcgcctgccgatacggccggattcctgcactcgtcgagagactctgggggatcgaaggactcctcatgcgataccgacgacttcgttatggtgcctgcccaatttcccggcgacctggtcgcggaggctccctctgctaagccacctccagacagcctgatgtgttctggttcctcactggtggcatctgctggtctggaatcacacggcagaacaccatctccctcaccgccctgctcctcaagccctagccctagtggtagagctggacctttctcctcgtcacgctgcggcgcttctgtgcccatccccgttcctacgcaggtccagaactaccagcggatcgaaagaaacttacaatctcccacccagttccagaccccacgctcttccgccatccgtcgaagtggttcaacgagccccctgggcttcgccagggcgtcaccgagcccaccggcccatgcggaacatggcggcgtgctggcccgaaaaatgtccctgggtggtggcagaccctacacaccgtctccccaggtgggaacgattcccgagcgcccaggttggagcggtactcctagccctcagggcgcggagatgcgcgggggtcggagcccccgtccagggagctcagcccccgaacactctccaagaacttctggcctcggatgtcgtctgcattctgctcccaacttgtctgatttgcacgtggttcgaccaaagttaccgaaacctcctacagatcctcttggtgccgtcttttctcccccccaagcgtcacctccccagccgagccacgggctgcagtcctgcagaaatcttaggggaagccccaaactgccagactttctgcagcgcaaccccttgccgcctattctaggcagccccacaaaggctgtgccaagttttgactttccaaagactcccagcagtcagaatttgctcgctcttctggctaggcagggcgtagtgatgactcctcctcgtaatcgtacacttccagacctgtcggaagttggccctttccacggacagccactggggcccggtctgcgccccggagaggacccaaagggccccttcggcagaagtttttctacatctaggttgacggatctgctgctcaaggccgccttcgggacacaagcccccgaccctggctcaaccgaatccttgcaggagaaacctatggagattgcaccctctgccggctttgggggcagtctacaccccggcgcaagagctggcggtacttcgtctccaagtcccgtcgtttttaccgtgggatctccaccatccggatctactcctcctcagggtcctagaacacgaatgttttcagctgggccaactggcagtgcttctagctccgcgaggcatcttgtacccggtccctgttctgaagccccagcccccgagcttcccgccccgggtcatggctgttctttcgctgacccgatcacggcaaacctggagggggcagtcacctttgaagcaccagacctgcccgaagaaaccctaatggaacaggagcatacagaaattctgcggggtttacgcttcacccttttatttgtacagcacgtactggagattgccgccctgaagggttccgcatccgaggcagccggggggcctgaataccagctccaggagtctgtggtggctgatcagatatctctgctgagcagggaatgggggttcgctgagcaactggttctctacctgaaagtggccgagctgcttagctccggtttgcaaagtgccattgaccagattcgcgcagggaagctgtgccttagtagtaccgtgaagcaggttgtgaggcgattgaatgaactgtacaaagctagcgtggtgtcatgccaagggctgtcattacgcctgcagcggtttttcttggataagcagcgacttctggatcgaatacactcaataaccgccgagaggcttatctttagccacgctgtacagatggtgcagagtgcagctcttgatgaaatgtttcagcatagagagggatgcgtaccacgataccataaggcactgctgctcctagagggcctgcagcatatgctctctgaccaggccgacatagagaacgtcaccaaatgcaagctttgcatcgagcgccggctgtctgccctgcttacaggtatatgtgcatag

SEQ ID NO: 140089 - DNA, 1452 bp, Artificial Sequence
  Description of Artificial Sequence: Synthetic coding sequence
atgcagcgaaatggatcagcctcccgtggacttgaaaagacaaggctgcgactatgccgcgaggctagaatcccagagtctgcctttcttacaggccttacacgagaatcctgggaggcaagatgttggtgtgctaaagatactcgcgaggtcgtagccatcaaatgtgtggccaaaaagagtttgaacaaagctagcgtggaaaacctgttgacagaaatcgagatcctgaaagggataaggcatcctcacattgtccagctgaaagactttcaatgggacagcgataatatatacttgatcatggaattctgtgctggcggcgacctgtctaggtttatccatacacggcgcatcctaccagagaaagttgcgcgcgtgttcatgcaacagctggctagcgcattgcagtttcttcatgagcgcaatatctcccacctagatctgaagccccaaaacatcctgctatcctctctggagaagcctcatctgaagcttgcagactttgggtttgctcagcatatgtcaccatgggacgaaaagcacgtgctccgtggaagtcccctctatatggcgcctgagatggtgtgccagcgccagtacgacgcccgcgtcgatctttggagcatgggagtgattctgtatgaagctctgtttggccagccgcctttcgccagcaggagttttagcgagctggaggagaaaattcggagcaacagagtgatcgagctccccctccgcccccttttgagtcgtgattgccgggacttgctgcagaggctgctagagcgcgaccctagtagaagaatttcatttcaggacttttttgcccacccatgggtggacctcgaacatatgccaagcggcgagagcctggggcgagccactgccctcgtggtgcaggcagtgaagaaagaccaggaaggcgatagcgccgcagccctaagcctgtactgtaaagctttggacttttttgtcccagccctacactatgaagtcgacgcacagcgcaaagaggccattaaagccaaggtcgggcagtatgtgtcccgagccgaagaattaaaagccatagtgagttcctccaatcaagcacttctcagacaagggacttccgcccgggaccttctgcgggagatggcccgggacaaaccacgactgttggctgcactcgaggtggccagcgccgccatggcaaaggaagaggccgccgggggggaacaagacgccctcgacctataccagcactctttgggcgagttgctactgctactggcagccgaaccccctggtcggaggcgggagctgctgcatacagaggtccagaatctaatggctagagccgagtacctgaaggaacaggtgaaaatgagagaatcacgatgggaagctgacacactggataaagagggcttgtcagaaagcgtgcgaagctcttgtaccttgcagtag

SEQ ID NO: 140090 - DNA, 1419 bp, Artificial Sequence
  Description of Artificial Sequence: Synthetic coding sequence
atggccggtccaggttggggtccacctcgcttggatggtttcatcttgacggaaagactggggtccgggacttatgctacggtgtacaaggcctacgcgaaaaaggacaccagggaagtggtggcgatcaagtgcgttgccaagaagtccctgaataaagccagcgttgagaatcttctgacagagatcgagattcttaagggaattcgccatccacacattgttcaactgaaagacttccagtgggactcagataacatttacttgatcatggagttctgtgcagggggggacttaagcagatttatccatacaaggaggattctacctgagaaggtcgctagagtgttcatgcagcagctggctagcgcgctgcaatttttgcatgaacggaacatcagccatctggacctgaagcctcagaatatcttactatctagtctcgagaaaccccacctgaaacttgccgatttcggattcgcccaacatatgtctccatgggacgagaaacacgtcctacgcggcagcccactgtacatggcgccagaaatggtgtgccaacgtcagtatgacgctcgcgtcgacttatggagcatgggcgtgattctgtacgaggccctttttgggcaaccaccgttcgccagccggtctttctcagaactggaggaaaagattcgaagtaacagggtgattgaactgccactcaggcctcttctgtctcgggactgccgcgacttactccaacgcctactggaacgcgacccgtcccggaggatatccttccaggactttttcgcccacccttgggttgatctggagcacatgccttctggggaatctctcggcagagcaacggctttagtggtccaagcagtcaaaaaggaccaagagggagactctgctgcagcactaagcctgtattgtaaggccttagatttctttgtgccagccctgcattacgaggtggatgcccagagaaaggaggcaattaaggcaaaggttggccagtacgtgagcagggcagaagaactgaaagccatagtttcctcctctaaccaagcattgctgaggcaaggcacatccgcacgcgatctgctgcgcgagatggcccgggataaaccacgcctcctggccgcccttgaggtggcgagcgctgccatggctaaagaagaggcagcaggaggggaacaggatgctctcgatctgtaccagcacagcctcggcgagcttctcctgcttttagccgctgaacctccagggcggagacgcgaacttttgcatacggaggtccagaacttgatggcccgcgccgaatacttgaaggaacaggtcaagatgagagaatcgaggtgggaggctgacactctggacaaagaaggtctgagtgaaagcgtgcgctcctcttgtacactacagtag

SEQ ID NO: 140091 - DNA, 9705 bp, Artificial Sequence
  Description of Artificial Sequence: Synthetic coding sequence
atggttaaacggaagagttctgaaggccaagaacaggacggggggagaggtatccctctcccaattcaaaccttcctctggagacagacttcagccttcctgagacccaagctggggaagcagtatgaggcctcctgcgtttcctttgagcgggttctggttgagaacaagctacacggccttagcccagctctctccgaagccattcagagtatcagcaggtgggagctggtccaggcagccctgccccatgtcctgcactgtactgccactcttctatctaatagaaataagctggggcaccaggacaaactcggggtcgccgaaacaaaacttctgcacactctccattggatgcttctggaagcacctcaggactgcaataatgagaggtttgggggaaccgaccgtggatctagttggggcggatcctcctctgctttcatccaccaggtcgagaaccaggggtcaccgggtcagccgtgccaatcttcctccaacgacgaggaagagaacaacagaaggaagatattccaaaattcaatggctacggtggagctctttgtgttccttttcgcaccgctggttcaccgaatcaaggagagcgatttgaccttcaggttggctagtggtttagtcatttggcagcccatgtgggagcatcgacagcctggagtgagcggtttcaccgcgcttgtgaagcctatcagaaacatcattaccgccaagaggagtagcccaattaactcccagtctagaacatgcgagtcccccaatcaagacgcacggcatctggagggactgcaggtcgtttgtgaaacatttcaaagtgactccatttcgccgaaggcgaccatctcaggctgccaccgcggaaattcttttgatggcagcctcagctctcagacatctcaggagagaggaccatcacactccagagcttccttagttatccccccatgtcagagaagtcggtatgcaacttacttcgacgtcgctgtgctgcgttgtctccttcaaccccattggagtgaggagggcacgcaatggtctctcatgtattacctgcaaagacttcgacatatgttagaggagaagcccgagaaaccccccgagccggatattcccctattacctcggcccagatctagcagcatggtggccgccgccccttccctcgtgaacactcataagactcaggacctaaccatgaaatgcaacgaggaggaaaagtcacttagtagtgaggccttctccaaggtttcgctcactaaccttcgccggtccgccgtcccagatctcagtagcgatttgggcatgaacattttcaagaaatttaaatcgcggaaggaggacagggagcggaaaggatccatcccatttcatcacactgggaagagaagaccccgtcgaatgggggtgcctttcctcctccacgaggaccacctggatgtgtcacccacgaggagcaccttttccttcgggagcttctctggcctgggggaggataggagggggatcgagaaaggcggatggcagacaacaattttgggaaagctgacaagacggggctctagcgatgcagctacagagatggagtctctctccgccaggcatagtcactctcatcacaccctcgtgtctgacctgccagaccctagtaactcccacggtgagaatactgtaaaggaggtgcgatctcagatttcaactattaccgtggcaacatttaacacaactctggcgtcttttaatgttggctacgccgattttttcaacgaacacatgagaaagctgtgcaaccaggtgcctattccagaaatgccccacgaacctctcgcatgcgccaatctgccacgaagtctcacggatagttgcatcaactattcctacctggaagatacggagcacatagacgggacaaacaacttcgtgcacaagaacgggatgttagatctgagcgtcgtgcttaaagccgtgtatttggtgctgaatcacgatatctcttcacgcatttgcgacgtagcgctgaacatcgtcgagtgcctgttacagctgggcgtggtcccttgcgtagagaagaatcgaaagaaaagcgaaaacaaagagaatgagacactggaaaagcggccatcagaaggtgcatttcagtttaagggtgtgtccgggtcctctacctgcgggtttggtgggccggctgtgagtggcgcgggtgatggggggggcgaggagggagggggtggagacggcgggggaggcggaggcgatggggggggaggcggaggaggcggcggaggaccttatgagaaaaatgataagaaccaggaaaaggacgaatcaacacccgtgtccaaccatcgtctggccttaaccatgcttatcaagattgtgaagtcactcggttgcgcctacggctgtggcgaaggtcatcgaggtctttcaggcgacaggcttaggcaccaggcccagaattgcctgactaaactttacaagctcgataagatgcaatttcgccaaacgatgcgggactatgtgaacaaggactccctgaacaacgtcgtggactttctccatgcgctgctcgggttctgtatggagcccgtcacagacaataaagccggctttggaaataacttcaccactgtcgataacaagtccaccgctcagaatgtcgaaggcatcatagtgtcagccatgtttaaatctctcatcactcgctgtgcttccaccacccatgaacttcatagtccagaaaacctcggcttatactgcgacattaggcagctggtacaatttatcaaagaggcccacgggaatgttttccggcgggtcgccctttccgctctcttggattctgccgaaaaactcgcccccggaaagaaggtggaagaaaacgaacaagaatcgaaaccagccggcagtaaaaggtccgaagctggaagcatagtggacaagggccaggtcagctctgccccggaggagtgtcgctcctttatgagtgggaggccctcccagacacctgagcacgacgaacagatgcagggggcgaatctggggcgcaaggatttctggcgcaaaatgttcaaatctcagtcagcggcatccgatacttcctcccaatcggaacaggatacgtcggaatgcacaactgctcatagcggaaccacctctgatagacgcgcacgatcacggagccgcagaatctctttgcgcaaaaagctgaagctcccaattgggaaaaggaattggctgaaacgatcttcactttcgggcctggccgatggtgtcgaggacctcctggatattagttccgtggacaggctgtcttttattcgtcaatctagtaaggtgaaatttacctccgccgtgaagctgagtgaaggaggccccgggtctggtatggagaatggacgtgatgaggaggagaatttctttaagcggctggggtgccatagctttgatgaccatctcagtcccaatcaagatggtggaaagtccaagaacgtagtgaatcttggcgcaatcaggcagggcatgaagcggtttcagtttctgctgaactgctgcgagcccggcacgatccccgatgccagcatcctggctgcagctctagacctcgaggccccagtagtggcgagagctgcgctcttcctggagtgcgcgcggttcgtgcacaggtgcaatcgggggaattggcccgagtggatgaaaggtcaccacgtcaatatcaccaagaagggtttgtctcgcggcaggagtccaatcgttggaaataagcgcaatcagaaactgcagtggaatgctgctaagttgttttaccagtggggcgatgctataggcgtgcggctgaacgagctgtgccatggcgagagcgagagtcccgccaacctgcttgggctgatctacgatgaagagacgaaacgacgcctgagaaaagaggacgaagaggaggatttcctagatgattccacggtcaatccatcaaaatgtggatgtccatttgcgctgaaaatggctgcctgccagctgctcctcgaaatcacaacattcctccgagagactttcagctgtttaccacgccccagaaccgagccactcgtcgatctggagagctgccgtctgcgattggatcctgaactagatcgccatcggtatgaacgtaagataagtttcgccggcgtgttggatgagaatgaggattctaaagatagtctgcactcttcatctcacacccttaagagcgacgcgggagttgaagagaagaaggagggcagcccttggtctgctagtgagccttctatcgagcctgagggaatgtcaaacgcgggagctgaggaaaactaccatcgaaacatgtcttggcttcatgtgatgatcctcctctgtaaccagcagagctttatctgcacacatgtggattattgccaccctcactgctatttgcaccattctcgtagttgcgctaggctggtgagagcaatcaaactgttgtatggtgattccgttgacagcttacgcgagtcgagcaacatctcttccgtcgctctgagaggcaagaaacagaaagagtgttcagacaaaagttgcctccggacaccaagcctcaagaagagagtatcagacgccaatctcgagggaaaaaaggattctggcatgctgaagtacattcgtctgcaagtgatgtctctcagtccagcacccctcagcctgctgattaaagctgctccgattctgacagaggagatgtatggggacatacagccggccgcgtgggagctacttttaagtatggacgagcacatggccggcgccgcggccgccatgtttctgttatgcgctgtgaaagttcccgaggccgtgtccgacatgctcatgagcgagttccaccatcccgaaaccgtgcagcggctgaatgccgtacttaaattccacacgctgtggcgctttaggtaccaggtgtggccgcggatggaggaaggtgcgcagcaaatctttaaaatacctcccccctccattaattttacgctgccctctccggtgttaggcatgccaagcgtgcctatgtttgatccaccatgggtacctcagtgttctggcagtgtgcaggaccccattaatgaggaccagtccaaatccttcagtgccagggccgtctctaggagccatcagagggcagagcacatcctgaaaaaccttcaacaggaagaggagaagaaacggctcggccgcgaagcatctctgattacagcaataccaattactcaggaagcttgttacgaacctacttgcacccccaattctgaacccgaggaagaagtcgaagaagttacgaaccttgcatctcggcggctaagtgtctcacccagttgtacaagttctacctcccacagaaactacagttttcgtcgggggagtgtgtggtctgtgcgaagtgcagtcagtgcagaagatgaagaacacacgactgaacacactccgaatcatcacgtgccgcaaccaccacaagcagtctttccagcatgcatttgtgcggcagtgcttccgatcgtacatctcatggaagacggagaagtgcgggaggacggtgtggcagtgtccgccgtggcccagcaggtactgtggaactgtctgatagaagacccaagtaccgtcctgcgccacttcctggaaaagctgacaatcagcaaccgccaagatgaactgatgtacatgttacgcaaactgctgctgaacatcggagacttccccgcccagacaagccacattctttttaattacctagtggggctgatcatgtattttgtgcgcacaccttgcgaatggggaatggacgctattagtgccacgttgacatttttgtgggaggtggtgggatatgtggaaggtctcttcttcaaagacctgaaacagaccatgaagaaggagcaatgcgaggtaaaactgctcgtgacagctagcatgccggggacaaaaacactggtggtgcacgggcaaaatgaatgcgacatccccacacaactgcccgtgcacgaagacactcagttcgaagccctgctgaaagaatgcctggagttcttcaacataccagagtcccagtccactcattactttcttatggacaaacgctggaacttaatacattacaacaaaacatatgtgcgcgacatatacccattccgtcgcagtgtttcccctcagctcaaccttgtacacatgcatcctgagaagggacaagagctgattcagaaacaggtgtttactcgaaaactggaagaagttgggagggtgctgttcttgattagcctcacccaaaaaatccccactgcccacaagcagagtcatgtgtccatgctgcaagaagatttgctgaggctgccttccttccctaggagtgcaattgatgccgaattttctttattctctgatcctcaggctgggaaagagctcttcgggttggacacactgcaaaagtcgctttggatccaactgttggaggagatgttcctcggcatgccctctgagttcccttggggggacgaaatcatgctgtttctcaacgttttcaatggtgccctcatccttcaccccgaggattccgctttattacgccagtacgccgctaccgtgatcaatacagccgtccacttcaaccacctgttctcgctttcgggataccagtggatccttcccactatgctacaggtgtatagtgactatgagagtaacccccagctgcgccaggcaatcgagttcgcatgccaccaattttatattctacaccgtaaaccatttgtgttgcagctgttcgccagtgtggctccactgctggagtttccagacgcagcgaataacggacccagcaaaggcgtcagtgcccaatgcctgttcgacctcctgcagagcttggaaggtgagacaacagatatcctggatatactggagctggtcaaggctgagaagccactgaagagtctggatttttgctacggcaatgaagatctgacattctctataagtgaagcaattaaattgtgcgtaactgtggttgcttatgctccagagagcttccgttccctgcagatgctgatggtgcttgaggcgctggtcccttgctatttgcaaaaactgaagagacaaaccagccaggtcgaaacggtgcctgccgccagagaagaaatcgctgccactgccgctctggctactagtctccaggcacttctgtattccgtggaagtgctgacgcgacctatgactgccccgcagatgtcccggtgtgatcagggccacaaagggaccacaacagcaaaccatacaatgagcagtggggtgaataccagataccaggagcagggagccaagttgcacttcattagggagaacctgcacctcctcgaagaaggccagggaatcccgagagaggagttagatgagagaatcgcccgtgaagagtttcgtagaccccgagaaagcctcctcaacatttgtactgaattttacaagcactgtggaccccgtctgaagatcctgcaaaacttggccggcgagccccgggtgatcgcgctggagctcctcgatgtcaagtcccatatgaggctagccgagatagcgcacagtctgctgaagctcgccccttacgatactcagaccatggagagtagaggcctccgaaggtatatcatggagatgctaccaattacggattggacagccgaggccgtgcgccccgcgctgatcctcatcctgaaaagactggatagaatgttcaacaaaatccataagatgcccacattaagacggcaagtggagtgggagcccgcctccaatcttatcgaaggggtctgcctgaccctccagaggcagcccatcatcagctttctaccccatctgagatcactgatcaacgtttgcgtgaaccttgttatgggagtggttggcccttcaagtgtcgcagacggccttcctttgttacacctcagcccttatctgagcccgccgcttcccttctcaactgcggtggtccggctcgtggctttgcaaattcaagcccttaaggaagacttcccattatcccacgtcattagccctttcaccaaccaggaacggcgcgaaggaatgttgttgaacctgctgatcccctttgtgttgacagtcggctcggggtcgaaagactcaccttggttggagcaaccggaggtccagctgcttctccagaccgtcattaatgtcttattgccaccgagaatcattagcacatccagaagtaagaattttatgttggaaagcagccctgcccattgttcaacacctggtgacgcgggaaaagatttgagacgggagggactcgcagagtcaacaagccaggcagcctatctggcgctcaaagtaattttggtttgcttcgagaggcagttaggctcccagtggtactggctctcacttcaagtgaaggaaatggcgctgaggaaggtgggcgggctggcactgtgggactttctggactttattgtgcgtactcgcatccccattttcgtgctgctccgcccttttatccagtgcaaactgctcgctcagccggccgagaaccatgaagagttaagcgcccgacaacacatcgcagaccaactggaacgtcgattcataccccgtcctctgtgcaaatcctccctgatcgccgaattcaattccgaactcaagattctcaaggaggccgtgcacagcggatcagcttaccaggggaaaacttccatatctacagtgggtactagtaccagcgcataccgcctgtcactggccaccatgtctcggagtaataccggcacaggaacggtttgggagcaggactctgagccatcacagcaagcctctcaggacactctctctcgaactgacgaggaagacgaggagaacgattctatctccatgcccagtgtcgtgtccgagcaggaagcttacctcttgagcgccattggtagaaggcgtttcagctcccacgtgtcaagcatgtcagtgcctcaagccgaagttggaatgcttccaagtcaaagggtcgctagtatccaatctgaacctgggcagcagaatctgctggtacagcagcccctgggccgtaagcgggggctgagacaactgcggcgccctctactatctagacagaaaactcagacagagccgcgtaatcggcagggtgccagactcagcacaactagacggtccatccagccgaagacaaagcccagcgcggaccaaaaaaggtcagtcacttttattgaagcacagcctgagcccgctgcggcacctactgacgcactgcctgccactggacagctgcagggatgctcaccagcccccagccgtaaacccgaggccatggacgagccagtcctcacctcgtcccccgcaattgtggtcgctgatttacactcagtctcgcctaagcagtcagagaattttccaactgaagaaggggagaaggaagaggatactgaggctcagggcgccactgctcattcccccctcagcgcacagctgtccgaccctgacgacttcactggcctcgagacgagctccttactccagcacggggacacggtgcttcacattagcgaggagaatgggatggaaaatccgcttctgagttcgcagtttactttcactccaaccgagctcggaaagactgacgccgttttggacgaatctcacgtgtag

SEQ ID NO: 140092 - DNA, 9777 bp, Artificial Sequence
  Description of Artificial Sequence: Synthetic coding sequence
atggtgaaacggaaaagcagcgagggccaagagcaggacggtggaagaggcattccacttcccatccagaccttcttgtggcggcagacttccgctttcttgagaccgaaactaggcaagcagtatgaggcaagttgtgtgtcattcgagagagttctggtggagaacaagctgcacgggctgagtccggcactgtccgaagccatccagtctatttcccggtgggaactggttcaagccgcattaccacacgtgctgcattgcaccgctacgttgctgtcaaacagaaacaagctcggccaccaggacaagcttggggtagctgagaccaaacttttacatacactgcattggatgttgctggaagcgccacaggactgtaacaacgaaaggttcggaggaaccgaccgaggcagtagttggggcgggagttcgtcagctttcatacaccaggttgagaaccaagggagccccgggcagccatgtcaatcatcctcaaacgatgaagaagagaacaatcggcgcaaaatctttcagaatagcatggcgaccgtagaactgtttgtgtttctcttcgcccccctggtacaccgaatcaaggagtcagatctgactttcagattagcttctgggctagtaatttggcaacccatgtgggagcacagacagccgggagtatctggattcaccgccttggtgaagcctattcggaatattatcactgcgaaacgatcctcccccatcaatagccagagccggacctgtgagtctcccaatcaagacgcaagacaccttgaaggactccaggtcgtttgcgaaacctttcagtccgactcaatatcacctaaagccactatcagcggctgtcaccgaggcaatagtttcgacggtagcctgtctagccaaacgtcccaggaacgcgggccttctcattcaagggctagtttggtgatccctccttgtcagagatctcggtatgccacttatttcgatgtggccgtgctgcgatgcctcctgcagccccattggtcggaggaggggacacagtggtcactgatgtactacctgcagagacttcggcatatgctcgaagaaaagcccgagaaaccaccggaacctgacattccactcctgccccggcctaggtcatctagcatggtggcagctgctcccagtctggtgaatacacacaagactcaagatctgacaatgaaatgcaacgaggaggagaaatccttatccagcgaagcgttcagcaaggttagtctcacaaatttacgaagatccgctgttcctgacctctcaagcgatctgggcatgaacatcttcaaaaagttcaaaagtcgtaaagaggaccgggagcggaagggctcaattccttttcaccacacgggtaaaagaaggccgagacggatgggggtgccctttctgctgcatgaggaccatctcgacgtgtctcctaccaggagcacgttctctttcggatctttcagcgggctgggagaggaccgcagaggcattgaaaagggcggttggcagacaaccatcttggggaagctgacaagacgcggttcttctgacgccgcaactgagatggagtccttgtccgcgcgacatagtcacagtcatcacacactggtgtccgacttgccagacccttcaaactctcacggggagaatacagtgaaggaggtgcgctcccaaatttcaaccattacggtagctactttcaatacaaccctggcgtcattcaacgtgggttatgcggatttttttaacgagcatatgaggaagttatgcaaccaggtcccaatcccagagatgcctcacgagcctctggcctgtgccaatctaccacgtagcctgaccgactcctgtattaattactcatacctggaagacaccgaacatatcgatggcaccaacaattttgttcataaaaacggcatgctggacctatcagtggtgctgaaagccgtctacttggtgttaaatcatgatatttcctcgcgtatctgtgatgtggcacttaacatcgtcgaatgcttactgcaactaggtgtcgtcccgtgtgtcgagaaaaatcgtaagaaatccgagaacaaggaaaatgagacattagagaagcggccctcagagggggcctttcagttcaaaggtgtgtccggttcttctacatgtggcttcggtggtccagcagtgtccggagcgggagacggcgggggcgaagaaggtgggggtggcgacggaggcgggggcgggggggatggtggcgggggagggggcggtggtggcggcccttatgagaagaatgacaagaatcaagagaaagatgaatcaactccagtttctaaccataggctagctctgaccatgcttattaagatcgtgaaatctcttggctgtgcatacggttgcggcgaagggcacagaggcctcagtggggatcgactgcggcatcaggtgtttagagaaaacgctcagaattgcctcacaaagctgtataagctcgataaaatgcaattcaggcagacaatgcgcgactatgtcaataaagacagcttgaacaatgtggtggatttcctacacgctctgctcgggttctgcatggaaccggtgacagataacaaagctgggttcggaaataacttcacgactgtcgataataagtcaacagcccagaatgttgagggcatcattgtttctgcaatgttcaagtctttgattaccagatgcgcctccacaacccacgagcttcattctcctgagaacctcgggttatactgcgatatacgacagctggtgcagtttattaaggaggcccatggaaacgtgtttagacgcgtcgccctctcagccctattggattcagctgagaaactcgccccaggcaaaaaagtcgaggagaacgaacaagagagcaagccagccggctctaaacggtctgaagctggatcgatcgtggataagggacaggtgagttctgcaccggaggaatgcaggagcttcatgtctggaaggccttcacagacacctgaacacgacgagcagatgcagggagcaaacctcggcaggaaagatttctggcggaagatgttcaagtcgcagagcgcggcaagcgacacttctagccagtctgagcaggacacctcagagtgtactacagcccacagtggcaccactagtgaccgaagggcccgatcccgatccagaaggatttccttgcgtaaaaaactcaagctgccgatcggtaagaggaactggctgaagcggtcttctcttagtgggctagccgatggcgtggaggacctgctggacatttcatccgtggaccgactgagcttcatcaggcagtcaagcaaggtcaaatttacctccgccgtaaagctgtctgagggagggcccgggtcgggtatggagaatggccgagatgaagaagaaaatttctttaaaaggcttgggtgccattccttcgatgaccacctctctccaaaccaggatggcggaaaatcgaagaacgtggtgaatttgggcgccatccgacaggggatgaagaggtttcagttcctccttaactgttgtgaaccaggtactatacctgatgcctctatcctggctgctgcccttgatctggaggcccctgtggttgccagggcagcattgttcctggagtgcgcacgctttgtccataggtgtaataggggtaattggcctgagtggatgaaggggcatcacgtcaacattacgaagaaagggctgagtcggggtagatctcccattgtaggtaacaagcgcaaccaaaaattacagtggaatgcagctaagctgttttaccagtggggagacgcaatcggtgtgcgtttaaacgagctgtgccacggtgaatccgagtctcccgctaatctgcttggattaatctacgatgaagagaccaagcggagactgcgtaaagaggacgaagaggaggacttcctcgacgactcaacagtgaatccatcgaagtgtgggtgtccattcgctcttaaaatggccgcctgtcagctgctgctggaaataactactttcctgcgcgagacattctcatgcctgccacggccacgcacagagcctctagtggacttggaatcatgtaggctccgccttgatccagagctcgaccggcacagatatgaacggaagatctcgtttgcaggcgtactagacgagaatgaggacagcaaggatagcctgcacagttcatctcatacactgaaatcggacgccggcgttgaggagaaaaaggagggatcgccttggtcagcaagcgagccctcaatagaaccagagggtatgagcaacgccggggctgaagagaactaccacaggaacatgtcatggctacatgtgatgattctcctgtgtaaccagcagagcttcatctgcacccacgtcgattactgccacccccactgttacctgcaccacagccgttcttgtgcaagactggtccgtgccatcaaacttctatatggcgacagtgtggattcccttcgagagagttcgaacatctcttctgttgcattacgtggcaagaaacagaaggagtgctctgataaaagctgcctgagaactccttccctaaaaaaacgggtgtcagatgcaaacttggaagggaagaaagactccgggatgctcaagtacattcggttgcaggtaatgtcgttatctccagcccctctaagccttctcataaaagcggctccaattctgaccgaggagatgtacggtgatatacagcccgctgcctgggaacttctgctgtcaatggatgagcacatggccggtgccgccgcagcaatgttcctgctgtgtgcggtgaaagtgccagaggctgtaagtgacatgctgatgtccgagtttcaccaccctgagacagtgcaacgacttaatgcagtcctaaagtttcacacgctgtggcgatttcgttatcaagtgtggcctcgcatggaagagggtgcccagcagatttttaaaattccccctccgagtatcaactttacccttccatcccctgtgcttgggatgccatcggtcccgatgttcgaccccccctgggtaccgcagtgctccgggagtgtccaagaccccatcaatgaagatcaatccaagtcattcagtgcccgcgctgtgagccgatcccatcagcgggcggagcatattctcaagaaccttcaacaggaggaagagaagaaacgcctcgggagggaagcatctctcattacagcgatccccattacacaggaggcctgttatgagcccacatgcaccccgaattcagagcctgaggaggaagtggaggaggtgacgaacctggctagccgccgcctgtcagttagtccctcctgcacctcatctacttctcatagaaattatagttttcgtcgggggtccgtgtggtccgtgcggtccgcagtgagcgccgaggacgaggagcacactaccgagcacacgccaaatcaccatgtacctcaaccaccacaggccgtattcccagcatgcatctgtgcagccgtcctgcccattgttcatctaatggaggatggcgaagtgcgcgaggacggcgtcgcggtgtccgcagtggcccagcaggtgttatggaactgcttaatagaggatccaagtacggtgctacgtcattttctggaaaaattaaccatctctaatagacaggacgaactgatgtatatgctcaggaagttacttctgaacatcggagattttcctgcccagacatcacatatcctgttcaattaccttgtcgggttgatcatgtacttcgtgcgaaccccttgcgaatggggcatggacgccatctctgcgaccctgacgtttctgtgggaggtggtgggatatgtggaaggcctgttttttaaggatctaaagcagactatgaagaaagagcagtgtgaagttaagctcttggttaccgctagtatgcccgggacaaaaacactcgtggtgcacgggcaaaacgagtgcgatataccgacacagttacccgtccatgaagatacccaattcgaggcgctcctgaaggagtgtctagagtttttcaatatccccgagtctcagtccacacactactttctaatggataaaagatggaacctcatccactacaacaaaacatatgtccgagatatctatccctttagaaggtcggtgtcaccccaacttaatttagtgcacatgcatcctgaaaaaggccaggagctgattcagaagcaggtatttacacggaagctcgaggaagtggggcgagtgcttttcttaatcagtctgacacaaaaaatcccaacggcacacaagcagagccatgtcagcatgctgcaggaggacctgctcaggctgccttctttccccagatctgccatcgatgcagaatttagtctcttctccgatccacaagctggcaaggagttgttcggccttgacaccttgcagaaatccctgtggatccagctgctggaggagatgtttcttggcatgcccagcgagttcccatggggcgatgaaatcatgttatttctcaacgttttcaacggggctttgattctacatccagaagattctgctctgttaaggcaatacgctgctactgtgatcaataccgcggtacatttcaatcacctcttttccctgtcaggttatcaatggatcctgccaacaatgcttcaggtctacagtgattacgagagcaatccccaactccgccaggcgatcgaatttgcctgtcaccagttctatatcttgcatagaaaaccattcgtactgcaactttttgcttccgtggccccactgctcgagtttcctgacgcggcaaacaatggcccttctaagggtgtatcagcacagtgtctgttcgatctcttgcaatccctagagggagaaacaacagatatcctggatattttagaattggtgaaagctgagaagcccctcaagagcttggacttttgttatggaaatgaagatctgacattcagtatatcggaggcaatcaaactgtgtgtcacagtcgtcgcttatgcccccgaaagttttcggtcccttcaaatgctgatggtactcgaggcccttgttccatgttacctccaaaagctgaaacgacagacatcccaggtggagacagtgccggccgcccgcgaagagattgccgccacagcagctttagcaacgagcctacaggccttgctttatagcgtggaagtgctgactcgcccgatgactgctccacaaatgagccgctgtgatcagggccataaaggaacgaccaccgctaaccacacaatgtccagcggggttaatacccggtatcaagagcagggagctaagttgcactttatcagggagaacctgcacctgctggaagaaggacagggaatcccacgagaagagctcgacgagcggatagctcgagaggagttcagacgaccccgcgaaagcctgttgaacatttgcacagaattctataaacactgtggcccacgacttaaaattttgcagaacttagcaggggaacctagggtcatagctctggaactgttggacgtaaagtcccacatgagactggccgaaatcgcccacagcctgctgaagctagctccctatgatacgcagaccatggaatctagagggcttcgccgctacataatggaaatgctgcctatcacggattggaccgccgaagcagtgaggcccgcccttattctcatcctgaagcggctggaccgcatgttcaacaagatacataagatgcccaccctgagaaggcaggtggagtgggagccggcgagcaacctgattgagggcgtttgtctgactctgcaacggcaaccaatcatttcattcttgcctcatctgaggagcctcatcaacgtgtgtgtaaatctggtcatgggcgtggtgggtccctcaagcgtggctgatggactgccactactacacctaagtccatacctctctcctcccctacctttttcaacagcagtggtgagattggtggcactgcagatccaggctttgaaggaagattttccccttagtcatgttatctctccttttacgaatcaggagcgacgggaggggatgctcctcaacttgctcatacctttcgtgctgaccgtgggatcagggtcaaaagactctccctggttggaacagcctgaagtgcaactgctgctacagactgtaattaacgtgttactgcctccaaggatcatttctacatctagatccaagaactttatgctggagtccagtccagctcactgctcaacaccaggagatgctggaaaggatttgcggagagagggactcgcagaatctacctctcaggccgcctacttggccctgaaagtcattcttgtttgtttcgagaggcagctggggagtcaatggtattggctaagcctgcaagtaaaggagatggcactacgaaaagtcgggggtttggccttatgggattttctcgatttcattgtccggactcgaatccccattttcgttctgctccgcccattcattcagtgtaaactgctggcacagccagcagagaatcatgaagaactgagcgctcggcagcatattgccgatcagctcgaaaggaggttcataccacgtcctctctgtaagtcgagcctaatcgctgaattcaatagtgagctgaagatactcaaagaagccgtgcacagcgggtcagcatatcaaggtaaaacctccattagcacggtggggacaagcacttctgcctatcggctctcactcgctaccatgagccggtctaacacaggcaccgggactgtatgggaacaggattcagaaccatcccagcaagccagccaggataccctttcaaggactgatgaagaggatgaggagaatgacagtatttctatgccgagtgtagtgtctgaacaggaggcttatctgttaagcgctatcggaaggcgccgtttcagcagtcacgtttcatctatgagcgtgccacaggccgaagtgggcatgcttccctctcagtcagaaccgaatgtgcttgacgactcccagggcctggctgcggaggggagcctcagtcgggtcgcatctatacagtctgaaccagggcagcagaatctccttgtgcaacagccgctcggacggaagagaggactacgtcagctccgaagaccactgttgtcaagacaaaagacacagaccgaaccccggaaccgccagggagctcgcttatcaaccactcggcgctctatccagccgaagaccaagccttccgctgaccagaaacgatctgtgacattcattgaagctcaacccgaaccagcagctgcacccacagatgccttgccagcaacagggcagctccaggggtgttccccagcaccctcaagaaagcccgaggccatggacgagcccgtactgacgagtagtcccgcaattgtagtggcagacctgcatagtgtttcaccgaaacagagtgaaaactttcctacagaagaaggagaaaaggaagaggatacagaggcccagggcgctactgcccatagtccgttatcagcacagttgagcgaccccgatgatttcaccggcctcgagacctccagcctgttgcaacacggtgacacagtgctgcacatttctgaagaaaatggaatggagaatcctctattatcctctcagtttacgttcactccaaccgaactgggtaagacggatgctgtgttagacgaaagtcatgtctag

SEQ ID NO: 140093 - DNA, 1401 bp, Artificial Sequence
  Description of Artificial Sequence: Synthetic coding sequence
atggagtcacgaggtctccgtcgctatatcatggagatgctgcccattaccgattggacagcggaagccgttcgtcctgcgctcatcctaattctcaaacgactggataggatgtttaacaagattcataaaatgcctactctgagacgccaggtggaatgggaaccggcctccaatctgatcgagggggtctgcctcacactgcaacgccagcccatcatttcattcttaccccatttgcggtctctcatcaatgtgtgtgtgaatttagttatgggagtggtcgggccttctagtgtcgctgacggattgcccctgcttcacctgtcaccttaccttagcccgccattgcctttttcgactgcagtagtgcgtctagttgccctgcagattcaggctttaaaggaggatttcccgttgtctcacgtgatctctcccttcacaaatcaggagcgccgcgaaggaatgctgctgaaccttcttattccctttgtgctgaccgtcggttctggttccaaggattccccatggctggagcagcccgaggttcagcttctcttgcagaccgttataaatgtcctgctcccgcccagaatcatctctacctccaggagcaagaatttcatgctggagtcgagtccagcccactgctctacgccaggcgacgccgggaaagacctcagacgcgagggcctggcagagtctacatctcaggcagcgtatctcgctctgaaggtgattttagtgtgcttcgaacggcaacttggatcccagtggtactggctgtcactccaggtcaaggagatggctttgcggaaggtcgggggcctggctctgtgggatttcttggattttattgttagaacaaggatcccaatttttgtgttactgaggccctttatacagtgtaagctgctggcacagccagcagagaaccatgaggagttgtccgcacgacagcacatcgccgaccagcttgaacggcggtttattcctcgtcctctgtgtaaatctagtctgattgccgaatttaactctgaactcaagattctaaaggaggctgtccacagcggctcagcgtaccaaggaaagaccagcatcagcactgtagggacttctacttccgcctataggctcagcctggctactatgtcccgctcgaatactggcaccggtacagtgtgggaacaggacagtgagccaagtcagcaggcttcacaggacactctaagtcgtaccgatgaggaggatgaggagaatgacagcatctcaatgccaagcgtggtctcagagcaggaggcatacctcctctcagctataggcagacggagattctcttctcatgtgagttccatgtctgtcccacaggccgaggtcggcatgctgccttctcagcgatag

SEQ ID NO: 140094 - DNA, 786 bp, Artificial Sequence
  Description of Artificial Sequence: Synthetic coding sequence
atggcgagtcagctgcagaatcggctgcgctctgccctggccctggtgactggagctggttccgggattggcagggctgtgtctgtgcgtctggccggggaaggcgcaactgtcgccgcgtgtgatttggacagagccgcagctcaggaaacagtgcgcctattgggaggacccggttccaaggaggggcctccaagagggaatcatgcagccttccaggctgatgtaagcgaagcacgggcagcccggtgcttactagagcaggtgcaggcctgcttctcacggcctccctctgttgtggtgtcttgcgccgggatcacccaagacgaattcctgttacatatgtctgaggacgattgggacaaggttatcgctgtcaacttgaagggaacatttcttgtgacacaggcggctgcacaggctttggtgagtaatgggtgccggggttctataatcaacattagctccatcgtgggcaaagtaggaaacgtcggtcagaccaactatgctgcgtcaaaagctggtgtgattggcctgacgcagaccgcagcccgagagttgggccgccacgggatccgatgcaactcagtgctgcccggattcatcgcgacaccgatgacacaaaaagttccacaaaaggttgttgacaaaattacagaaatgattccaatgggacatctgggggacccagaagacgtcgccgatgtagtcgcattcctagcctcagaggatagcggctatatcacaggcacatccgtggaagtgactggcggactgtttatgtag

SEQ ID NO: 140095 - DNA, 1248 bp, Artificial Sequence
  Description of Artificial Sequence: Synthetic coding sequence
atggaccgcagccttagaaacgtgttggtcgtgagcttcggatttttacttttatttaccgcgtacggagggctccagagcctacaatcctccttatatagtgaggaaggactcggagtgactgccctctctacactgtatggtggtatgctcctgagttccatgttcctccctccactcctcatcgaacgcctgggctgcaaggggaccattatcctgagcatgtgcgggtacgtagccttttctgtgggcaatttcttcgcatcatggtacacactgatcccgaccagcatcctcctgggtctgggagccgccccgctgtggagcgctcagtgcacatacctaacgatcacagggaatacccatgcagagaaagcaggaaagaggggcaaagacatggtgaatcagtactttgggatcttcttcctaatatttcagagctccggcgtgtggggaaatctaatttcaagccttgtgtttgggcaaacaccgagccagggctctggagtccttgcagttctgatgattgctgcttttttacagccaatcagggacgtccagagagaatccgaaggagaaaagaaaagtgtacctttctggtctaccctcttatctactttcaaattgtatagggataaaaggctctgtctactaattttgctcccactatactctggattgcagcagggattcctttcctctgaatacacaagaagttacgttacatgtacgctgggtattcagttcgtaggttacgtaatgatttgtttttctgctacagatgcgctgtgttcagttctttatggtaaggtcagtcagtacactggccgggccgtgttgtacgtgctgggcgcagtcacacacgtttcctgtatgattgcccttcttctctggcgcccgcgcgccgaccatttagctgtgtttttcgtctttagcggcctgtggggtgtggcagacgccgtgtggcagacccagaataacgccctgtatggagtattgttcgaaaagtctaaggaagccgcatttgctaactacagattgtgggaagccctaggctttgtcatagcctttggttacagtatgtttctgtgtgtgcacgtcaaactttacattctgctgggtgtactgagtcttactatggtggcttacggactcgttgaatgtgtcgaaagcaaaaacccaattcggcctcatgcacccgggcaggtgaaccaggcagaagatgaggaaattcagaccaagatgtag

SEQ ID NO: 140096 - DNA, 435 bp, Artificial Sequence
  Description of Artificial Sequence: Synthetic coding sequence
atggaccgctctcttagaaacgtgttggtcgtctcattcgggttcttacttctttttacagcctatggaggtctccagtctctccaatcgtccctgtattcagaggagggcttgggcgtgacagccctttcaacactttacggcgggatgctactgagttccatgtttcttccgcccctcttaatcgagcggctcggctgcaaaggcacaatcattttgtccatgtgtgggtacgtcgcgtttagcgtgggaaacttttttgcttcttggtacacactgatccctacatcaatcttactcggtctgggagcggcaccactatggtctgctcaatgcacatatttgaccatcaccggaaatacgcatgcagagaaagcgggcaaacgtggtaaggacatggtgaatcagtattttgggattttctttctgatctag

SEQ ID NO: 140097 - DNA, 1545 bp, Artificial Sequence
  Description of Artificial Sequence: Synthetic coding sequence
atgtcgagatggctgtggccctggtccaattgcgtgaaggagcgggtgtgcagatatctcctgcatcactacctgggccatttctttcaggagcacctatcgctagatcagttgtccttagacctctacaaaggatccgtcgccttacgggacattcatcttgagatctggagtgtcaacgaagtgttggagagtatggagagtcccctggagctagttgaagggttcgtaggaagcatagaggtagcggtgccttgggccgccctacttacggatcactgtactgtgcgggtgtccggattgcagctgaccctgcagcctcgaagaggccctgctccaggagcagctgatagccagtcctgggccagctgcatgaccacctcactgcagctggctcaggaatgtttacgcgatggcctccccgagccttccgaacctccacagcccctggaggggctagagatgttcgctcagaccatcgagacagtgctgcgtaggataaaggttacgtttctggatacggtcgtgcgggttgagcactccccaggcgatggggaaagaggagtggcggtggaagtgcgggtacagcgactggaatattgtgacgaggcggtacgcgatcccagccaggccccgcctgtagatgtccaccaaccgcccgcctttttgcacaaattactgcagcttgccggggtcagactgcactacgaagagctgccagctcaagaggagccacccgagccgcctttacagatcggcagctgctccggttatatggaactgatggtgaaactcaaacagaatgaggcttttcctggcccaaaactggaggttgctggccaactgggttccctacacctcctgctgacgcctcgacagctgcagcaactgcaagagttgctgagcgcagtctccctgactgatcatgagggcctggccgataaactgaacaaaagccggccactgggggccgaagacctctggctcatcgaacaggacctgaatcagcagcttcaggcaggtgcggtcgccgaaccactgtcccccgatccgctaacaaatccgctcctaaacctggataatacagatctgtttttctcaatggcaggccttactagctccgtggcaagcgccctctccgaactgagtcttagcgacgtggacctggccagcagcgttcggagtgatatggcctcccgaaggctgtcagcccaggctagacccggtctggccctccaggggatggccactgtgaaggatgcatttccagcgtgccctctaccgatctgctgcgagaggggcgcttctctgccctggggcctctctccgggttcggcgctgttcctgcgaggggagagaacgttacccctgccacgaccgggccctactctgttgcccagtccacgaacagaggccttcggtccaagcgaccccattcccctctcccaagtgtccttctgtgtctggggagaagaaggtatgatcagcgtttggtttgacgtccttttcctgtccagcgtgtctgcctgggtatctgtgtgctag

SEQ ID NO: 140098 - DNA, 924 bp, Artificial Sequence
  Description of Artificial Sequence: Synthetic coding sequence
atgggcggtctgacagcctctgacgtccacccaacattgggagtgcaactgtttagcgcgggcatagctgcgtgcttggctgatgtgattacatttccactcgacacagccaaggtgcgcctccaggttcaaggggagtgcccgacttctagcgttattcgctacaagggggtcttaggcacaatcactgccgtggtgaagacagaaggacgcatgaaactgtattctgggctcccagccggactccagcgccagatttcttccgccagtctcagaatcggcctctacgatacggtacaagagttcctgaccgctggcaaggagactgcccctagtctcgggagcaagattttagctggtttgacaaccggtggcgttgcagtgttcatcggacagcccactgaagttgttaaggtgaggctgcaggcccagagtcacctccacggcatcaagccacgctatactggcacttacaacgcatacaggatcatagcaaccacagagggcctaacaggtctttggaaaggtacgacccccaatctcatgcggagcgttatcattaattgtacagaattggtgacatatgatctgatgaaggaggcctttgtcaaaaacaatattctggcggacgatgtgccttgtcacctggttagtgctctcattgccggcttctgtgcgacagcaatgagttccccagtagacgtggtgaagactcgctttatcaacagccctccgggacagtacaagtctgtgccgaactgcgcaatgaaggtttttacaaatgagggtccgactgccttttttaagggattggtaccatccttcctaagactgggctcatggaatgtgatcatgttcgtatgctttgagcagctgaagagggagctctctaaatcccgccagacgatggactgcgccacttag

SEQ ID NO: 140099 - DNA, 930 bp, Artificial Sequence
  Description of Artificial Sequence: Synthetic coding sequence
atggtgggctttaaagccactgacgtgccgccgaccgctaccgttaaattcctgggagctgggacagcggcctgtattgctgatctgatcacttttcctctggacacagccaaagtgcggttgcaaattcagggggagagtcaaggacctgtccgcgcaacagcctccgcacaatacagaggggtaatgggaacaatattgaccatggttcgtacagaaggacccaggtctctttataacggtcttgttgcaggtttgcagcggcagatgagttttgcctccgttagaattgggctgtacgactcggttaagcagttctatacaaagggaagcgagcatgcttccatcggaagcaggctgctggccgggtctacaacaggcgccctggccgtcgccgtcgcccagcccaccgatgtggttaaagttcggtttcaggcccaggccagggcgggtggcggtcgccgctaccagtcaaccgtcaacgcctataaaaccattgcgagagaagagggattccgcggcctgtggaagggaacatcccctaacgtggcacgaaatgctattgttaactgtgccgagttggtgacatacgacctcattaaggatgccctgctgaaagccaatcttatgactgatgacttgccttgccattttacatccgctttcggagccggcttctgcacgactgtgatcgcctcccccgtggacgtcgtgaaaacccggtacatgaattccgccctcggccagtactccagcgcgggtcactgtgcgctgaccatgctccagaaagagggaccccgggcgttttacaagggcttcatgccaagcttcctgaggctgggctcatggaacgtcgtgatgtttgtgacatatgagcagctgaaacgcgccctcatggctgcctgtacatcaagagaagccccgttttag

SEQ ID NO: 140100 - DNA, 102 bp, Artificial Sequence
  Description of Artificial Sequence: Synthetic coding sequence
atggtcggattcaaagcaaccgatgtcccacccaccgctactgtgaagttcctgggtgccgggacagcggcctgcatcgcggatttgatcacctttccttag

SEQ ID NO: 140101 - DNA, 939 bp, Artificial Sequence
  Description of Artificial Sequence: Synthetic coding sequence
atggtgggactcaagccctccgacgtgcctcctaccatggccgtgaagtttctcggcgccgggaccgccgcctgtttcgccgacctggttacattcccgctggatacagcgaaggtgcgcctgcagattcaaggtgaaaatcaagccgtgcagaccgctcggttagtgcagtacagaggagtcctgggaactatactgaccatggttaggactgagggcccctgttcaccttataacggtctcgtggctggacttcagcgacagatgagtttcgccagtatccggattggattgtacgacagtgtgaaacaagtctatacaccaaaaggtgcggacaacagctcactgaccactcggatcctggctggctgtacaactggagccatggctgttacatgcgctcaacccacagatgtggtgaaggtacgctttcaggcttcaatccatctcggtccttctcggagtgaccgcaaatattcgggcactatggatgcctataggactattgcacgggaagagggcgtgcgaggcctgtggaaggggaccctcccaaatataatgcgaaacgctatcgtgaactgtgcagaggttgtgacttacgatatactcaaagaaaaactcctcgactatcaccttttgaccgacaattttccatgtcactttgttagcgcctttggagccggcttttgtgcaaccgttgtggcatcccccgtggacgtggtgaaaaccagatacatgaattccccccctggccagtactttagtccactggattgtatgatcaagatggtggcccaggagggcccaacggccttttacaagggttttacgcctagtttcctcagactgggatcatggaacgttgtaatgtttgtgacatacgagcagcttaaacgagcgcttatgaaggtgcaaatgcttagagaaagcccattctag

SEQ ID NO: 140102 - DNA, 633 bp, Artificial Sequence
  Description of Artificial Sequence: Synthetic coding sequence
atggtaggtcttaaaccctcagatgtgcccccgactatggccgtcaagttcctcggcgccggaactgcagcttgctttgctgaccttgtcacattccctctcgatactgcgaaagtaagactgcagatccagggagaaaaccaagccgtacaaactgctagactggtacagtaccgtggagttctgggcacaatcctcaccatggtgcgcaccgagggcccctgctcaccttataacggcctggttgccgggctccagagacaaatgagtttcgcatccatcagaattggtctctatgactccgtgaagcaggtctatactcctaagggcgccgataacaatttcccttgtcactttgtatccgccttcggtgccgggttttgtgcaacggttgtggcttccccagtggacgtcgttaaaacccgttacatgaacagtccaccaggccaatacttttctcctttggactgcatgattaagatggtcgcacaggagggcccaactgcgttctataaaggctttactccttctttcctccgacttggttcctggaacgttgtcatgtttgtcacttatgagcaactgaagagagccttaatgaaagtacagatgctcagagaatcacctttctag

SEQ ID NO: 140103 - DNA, 828 bp, Artificial Sequence
  Description of Artificial Sequence: Synthetic coding sequence
atggtcggcctgaaaccgtcagatgtgccccctacgatggcggttaaatttctgggagcgggcacggcagcctgctttgctgacctggtcaccttccccctagatacagcgaaggtcagattgcagattcaaggagaaaaccaggccgtccagacagcacgactagtccagtaccgtggagtcctcggaactatccttaccatggtccggacagaaggtccatgctctccttataatggtctggtcgccggactgcagcggcagatgtcttttgcttccattaggatcggtttatacgactccgtcaagcaggtgtacaccccaaaaggcgctgataacagctcattaactacacggatcttagccggatgcacaaccggtgctatggctgttacatgtgctcagccaaccgacgttgtcaaagtgcgtttccaggcctcgatacatcttggtcctagccggtcagaccgcaagtatagtgggaccatggacgcttaccggacaatcgccagagaagaaggggtgagaggcttgtggaaaggtacactacccaatatcatgcgcaacgcgattgtcaactgcgccgaagtggtaacttacgatatcttgaaagagaagttgctggactaccacctcctgaccgacaatttcccctgccacttcgtgagcgccttcggagcaggcttctgtgcgaccgttgtggcaagtcccgtagacgttgtgaagacccgatacatgaattctccccccggacaatacttctctcctctcgattgcatgattaagatggtcgctcaagagggccccactgccttttacaaagggtag

SEQ ID NO: 140104 - DNA, 291 bp, Artificial Sequence
  Description of Artificial Sequence: Synthetic coding sequence
atggtgggtctcaagccgtctgacgtgccacccacaatggccgttaaatttctgggggctggaactgccgcttgcttcgccgacctggtcacctttcctttggatactgcgaaggtgcggcttcagatccagggggagaaccaagctgtgcagacggctcggcttgtgcagtaccgaggagtcctgggcaccattctcacaatggtgaggactgaggggccatgctctccctataacggcctggtagccgggctgcagcgacagatgagtttcgcttccattcgcatctag

SEQ ID NO: 140105 - DNA, 1026 bp, Artificial Sequence
  Description of Artificial Sequence: Synthetic coding sequence
atgctgctgcgccctcgcagaccccctcccctggcccccccggcacccccatcgccagccagccctgatcctgaacctcgcacccccggggatgcgcctggaactccccctcgacgacccgcatccccaagcgctctgggcgagctcggcctgcctgtttcgcccgggtcagcccaaagaaccccctggagtgcaagagagacagaactcttgctgggaaccctcctccaacctgccgtatggcgggccctgctactggaccggcggcaagcactcccaacctacagaagggtcagtgctgcactggcacagcagcaggtgaggcggaccccggcacaatgtagaaggaggtacaagttccttaaagataagttccgggaggcacacggacaacctccgggcccgtttgatgaacagataagaaagctgatggggctcttaggggataacggtaggaaacggcccagaaggagaagtccagggtccggtcgaccccagagggcgcggagaccggtgcctaacgctcatgcccctgcaccttctgagcctgatgcgaccccgctgccaacagccagggatagagatgctgaccccacctggaccctgagattttctccgagtccccctaagtctgcagatgcttcacccgcccccgggtccccccctgctcctgccccgacggcattggccacttgcatcccggaggacagggcaccggtgagaggcccaggttccccacccccgcctcctgcaagggaagaccccgattccccgccgggaaggcctgaagattgtgcccctccaccagcggccccccccagtctgaacactgcattactccagaccctggggcacctgggagatatagctaacatacttggacccctgagagaccagctcctgacgttaaatcagcatgtagagcaattacggggggccttcgatcagaccgtcagcctggccgtgggattcatacttgggtctgccgcagccgaacggggggtcttacgagacccttgccaatag

SEQ ID NO: 140106 - DNA, 3357 bp, Artificial Sequence
  Description of Artificial Sequence: Synthetic coding sequence
atgtcggtggaggcgtacggaccatcctctcagactctgactttcctcgacactgaggaggccgagctcctgggggctgacacgcaggggtctgaattcgagtttacagactttaccctgccctctcagacccagacaccccccggtggccctgggggccctggaggtggtggtgccgggggccctggcggcgcaggtgccggagcagctgccggtcagctagatgctcaagttgggccggaaggcattttgcagaacggcgccgtggacgattcagtcgccaaaacaagtcagctcttggccgagctcaactttgaggaggacgaggaggatacctactatactaaggacttgcccattcacgcctgtagctactgcggcattcatgatccggcctgcgtggtctattgcaacactagcaagaagtggttctgcaatggccgcggcaataccagcgggtctcacatagtgaaccatctggttcgggccaagtgtaaggaggtgacgctccacaaagatggtccattaggagagacagtcctggagtgctataattgtggctgcagaaatgtgtttttactgggcttcatcccagccaaggctgactccgttgttgtcttgctgtgcagacagccctgtgcgagccagagctccctgaaggatatcaactgggactcctcccagtggcagccactgatacaggatcggtgcttcttgtcttggctggtcaagattcccagtgagcaagagcaactgagagctcggcaaattactgcacaacagatcaacaagctggaagagctgtggaaagaaaatccatccgccacactggaggatttggagaagccaggagtggatgaggaaccacagcatgtgcttctgagatacgaagatgcgtatcagtaccaaaatatatttggacccctggtcaagctggaggccgactacgataagaagctgaaggagagccagactcaggacaatatcacagtgcgttgggatctgggtctgaataagaagcggatcgcttacttcacactgccaaagacagacagtgatatgcggctgatgcaaggcgacgaaatctgcctgcgatacaagggcgacctggcacctttgtggaagggcattggacatgtgattaaggtgcccgacaactacggagatgagattgcaatcgagctgcgcagctcagttggcgcacccgtggaggtgacgcacaatttccaggttgacttcgtgtggaagagtacgtcttttgacaggatgcagtcggccctaaagacgttcgcagtcgatgaaactagtgtgagtggctatatctatcataagctgctcgggcacgaggtggaggacgtgattattaaatgtcaattaccaaagaggttcactgcccaaggtctcccagacctgaatcacagtcaggtctatgccgttaagaccgtacttcagcggcctctcagcctgattcaggggcctcctgggactggcaaaaccgtcacatccgcaacaattgtgtaccacctggccaggcaaggaaacgggccagtgctggtgtgcgccccgtcaaacattgcggtcgaccaattgacggagaagattcaccaaactggactgaaagtcgtccggctttgtgcgaagtcccgggaagccattgactccccggtgagcttcctagcccttcacaatcagattcgtaatatggattcgatgcctgaactgcagaaactgcagcaacttaaggacgaaaccggggagctttccagcgccgatgagaagaggtatagggccctcaagcggacagccgagagggaactgctcatgaacgctgatgtgatatgctgcacgtgcgtaggggccggcgatccaaggctggctaagatgcagtttcgttccattctcattgacgagagcacccaggctactgagcccgagtgcatggtccccgttgtgctgggcgctaaacagttgatcctggtgggagatcactgccagctgggaccagtcgtgatgtgtaaaaaagccgctaaggcagggctgtcccagagccttttcgaacgtctcgtggttcttggtatccgacctatacggctgcaggtgcagtacagaatgcaccctgccctgagtgctttccccagcaatatattttatgaagggagtctgcagaatggagtgaccgcagctgatcgagtaaaaaagggttttgacttccagtggccccaaccagataaacccatgttcttttatgtcactcagggacaagaagaaattgcttcaagcggtactagctatcttaataggacggaagcggcgaacgtagaaaagattaccactaagttgctcaaggcaggggcaaagccagaccaaattggtattatcactccatatgagggtcaacgcagctacctggtgcagtacatgcagtttagcggctcgctccatactaaattatatcaggaagtcgagatcgcgtccgtggacgcatttcaggggagggaaaaagacttcatcatcttaagctgtgtccgggctaacgagcatcaggggatcggctttctgaatgatccacgccggcttaatgtggccctcaccagagcccgctatggagtaattatagtcggcaatccaaaagctctaagtaaacaaccactctggaaccatctgctcaattattataaggagcagaaggtactggtcgaaggacctctgaacaacctccgtgaatctctcatgcaattctctaagccaagaaagcttgtgaataccataaacccaggcgccaggtttatgaccacggcaatgtacgatgcccgggaagccattattccagggagtgtgtacgacagatcttctcaaggcaggcccagtagcatgtatttccagacgcatgatcagattggaatgatctccgccggaccgtcccacgtggccgccatgaacattcccatccctttcaatttagttatgcccccgatgcctccacccgggtacttcggacaggctaacggacctgccgcaggtcgcggaactcccaagggtaaaacagggagaggcggacgacaaaaaaataggtttgggcttcctggaccctcacagaccaatcttcccaattcacaggctagccaggacgtggcgtcccagccattcagccagggggcattaacccagggttacatcagtatgtcccagccatcccagatgtctcagccagggttgagtcagccggagcttagtcaggattcatatctgggcgatgagttcaagtcgcaaattgatgtggcactctcacaggattccacctatcagggcgagcgtgcttatcagcacggaggcgtcactggactgagtcaatattag

SEQ ID NO: 140107 - DNA, 1740 bp, Artificial Sequence
  Description of Artificial Sequence: Synthetic coding sequence
atgcccgcagaacgcaagaaacccgcctccatggaagagaaggactcactacccaataacaaggagaaagattgctccgagcgcagaacagtcagttccaaggagcgcccaaaggatgatatcaaactgaccgccaagaaagaagtttcaaaagcccccgaggagtcaaaaaaaaaagaagaggaagagaagaagaagcaccaggaggaggagcgcaagaaacaagaagaacaggctaagcggcagcaagaagaggaggccgctgctcaaatgaaggagaaggaggagtccatccagctgcatcaggaggcctgggagcgccaccacctgcgcaaagagctgcggtcaaagaaccagaatgcccctgattctcgtccagaagaaaatttcttctccagactggactcaagcttgaaaaaaaatactgctttcgttaagaagctgaagactatcaccgagcagcaacgagatagtctcagtcatgacttcaatggtctgaatctgtcgaagtacattgccgaagcagtagcatccatcgtcgaggctaagcttaaaatatcggacgtgaattgtgccgttcatctgtgtagcctgttccatcaacggtacgccgacttcgctccttcactacttcaagtctggaagaagcatttcgaagccaggaaggaagaaaagaccccgaatattaccaagctgcgcactgatctgcgtttcatcgctgagcttacaatcgtcggaatttttactgataaggaagggttgtccctaatctacgagcagttgaaaaacataataaacgctgaccgagagtcacacacccatgttagtgtcgtgatcagtttttgccgacattgcggtgatgacattgctggcctcgtgcccagaaaggtgaaatccgctgccgaaaaattcaatctgagtttccctccttccgaaataatcagccccgagaagcaacagccattccaaaatctattgaaggaatacttcacatcacttacaaagcacctgaaaagggaccaccgcgaacttcagaacaccgagcgccagaataggaggatattgcactctaagggagagctgtctgaagatagacacaagcaatacgaagaattcgctatgagttatcagaagcttctggcaaactcccagtcactggcggatttattggacgagaacatgcctgatttaccccaagataagccaaccccagaggagcacggccccggtattgacatcttcactcccggcaagccaggggagtacgacctggaaggaggcatatgggaggatgaggacgccaggaacttttacgaaaatttgatcgacctcaaagcgttcgtacctgctatcctatttaaagacaacgagaaaagttgccagaataaggagagtaacaaagacgataccaaagaggccaaagaatcaaaggagaacaaggaggtctcttcacctgatgatctggagttggagcttgaaaatctagagataaatgatgacacactggagctcgaggggggggatgaggccgaggatcttactaagaaactgctagatgaacaggaacaagaggatgaagaggcctccacaggctcacatctgaaactgatcgttgacgcattcctgcagcaattgccaaactgtgtgaatcgcgatttgattgacaaagctgagaaagccttctgcaatggaaacctggccagggtgaacctactgctacgcatggccgtgaaaaagtag

SEQ ID NO: 140108 - DNA, 3819 bp, Artificial Sequence
  Description of Artificial Sequence: Synthetic coding sequence
atgccagcagagcggaagaaacccgcctccatggaggagaaggactcattacctaataataaagagaaagattgttcagagcggcggacggtgtcatccaaggagagaccaaaagatgatattaagctgaccgccaaaaaagaagtttctaaggcacccgaagataaaaaaaaacgtctcgaggacgataaacgaaagaaggaagacaaagaaagaaaaaagaaagatgaggaaaaagttaaagccgaggaagagagtaaaaaaaaggaagaggaggaaaaaaagaagcaccaggaagaagaacggaaaaaacaggaggagcaggccaaaaggcagcaggaggaagaagccgctgctcagatgaaggaaaaagaggagtcaatccaattgcatcaggaggcatgggagcgacatcaccttagaaaagaactacgaagcaaaaatcagaatgctcccgattcacgacccgaggagaactttttctccagactagattctagtctgaaaaaaaatacagcattcgtgaagaaactgaaaactattaccgagcagcagagggattccctaagtcacgattttaacggtctgaacctgagcaaatatattgcagaagcagtggccagcatagtggaggccaaactgaaaatctccgatgttaactgcgctgttcacctgtgttcactgttccaccagagatacgccgatttcgctcccagcttgctgcaggtgtggaagaagcactttgaagcacgtaaggaagaaaagacccccaacattaccaaattgaggacagatcttcgattcatcgctgaactaactatagtggggattttcaccgataaggagggactgagccttatttacgagcagctgaagaacatcataaacgccgatcgagagtcccacacgcacgtatcggtggtcatttccttttgtaggcattgtggtgacgatattgctggcctcgtgccccggaaggtgaagagcgctgccgaaaaatttaacctttcattcccacccagtgagattatatctccagaaaagcagcagccttttcagaatttgttgaaggaatattttacctcactgactaagcatttgaagcgtgaccacagagagcttcaaaatacagaacgacagaaccgcagaatcctccactcgaagggagagctctctgaggaccgccataaacaatacgaagagtttgccatgtcctatcagaaactgctggccaactcccagtcactggctgacctgttggacgaaaatatgcctgacttaccacaggacaagcccactccagaggagcatggcccaggcatagatatttttactccaggcaagccgggcgagtatgacctagagggcggtatatgggaagatgaggatgccaggaatttttatgagaatttaattgatctcaaagcgtttgtacctgcgatcctctttaaagataatgagaagagttgtcagaataaagagtccaataaggatgacacaaaagaggccaaggagtccaaagaaaataaggaggtttcaagccctgacgatctggagctggaactggagaacctggagatcaatgatgacacccttgagctggaaggcggggacgaagccgaggatctgacaaaaaagctgttggatgaacaagaacaagaggatgaagaggcctccacaggatcccatctgaaacttattgtggacgcgtttcttcagcagctacctaattgtgtaaatcgggaccttatagataaggccgctatggacttctgtatgaatatgaataccaaggccaatcgcaagaagcttgttcgggcactgttcatcgttccccgccagcggcttgacctattaccattttacgcaagactcgttgcaaccctgcacccgtgcatgtctgatgtcgcagaggacctgtgctctatgctgaggggcgattttcgattccacgtacggaagaaggatcagattaacattgaaacaaaaaacaagacggtgcgatttatcggcgaactcacaaagtttaagatgtttacaaagaatgacacgctacactgtctgaaaatgctcttgagcgacttttcccaccaccacattgagatggcctgtacccttcttgagacgtgtggccgattcctgttcagaagccctgaatctcacctccgcacatcggtgctcctcgagcagatgatgcgtaaaaaacaagctatgcatttggatgccagatacgtcactatggtcgaaaatgcttattactactgtaatcctccaccagctgaaaaaaccgtgaaaaagaagagaccccccctacaggaatatgttcgcaagttactgtacaaagacctctctaaggttacaacagaaaaagtgctgcggcagatgagaaagctgccatggcaggatcaggaagtgaaagactacgtcatctgctgcatgattaatatctggaatgttaagtacaattccatccattgtgtagcaaatttacttgccggactggttttgtaccaggaggacgttggaattcacgtagtggacggggtgcttgaagacatacgactgggaatggaggtgaaccagcctaaatttaatcagcgacggatctcatctgcaaagtttctcggagagctgtataactaccggatggtggaaagcgcagtaatcttccgcactctttattccttcaccagcttcggcgttaacccagacggcagcccttcctccctcgatccaccagagcatctgtttcgcataaggttagtctgcaccattctggatacatgcgggcagtacttcgatagaggatctagcaaaaggaagctcgactgttttctcgtgtactttcagagatatgtatggtggaaaaaaagcctggaagtgtggactaaagatcaccccttccccatagacattgactatatgatcagtgacaccctggaactactgagacctaagattaagttgtgtaatagtctagaggagtctattaggcaggtgcaggatctcgaacgcgagttcctcataaagctgggccttgtgaatgataaagattctaaggattccatgactgagggcgagaacctggaggaggatgaggaggaggaggagggcggcgccgagactgaggaacagtccggtaatgaatctgaagtgaacgaaccggaggaggaagaaggatccgataacgacgacgacgaaggggaggaggaagaggaagagaacacagattatctgacagattccaataaggagaacgagactgacgaggaaaataccgaagtcatgataaaaggcggcgggttgaaacacgtgccctgcgttgaggacgaggactttatccaggctttagataagatgatgttggaaaatctgcaacaaaggtcgggagaatccgtgaaagtccaccaattggatgtggcaatcccactgcatcttaagagtcagcttcgaaaaggacctcccttgggtggaggggagggagaagcagagtctgccgacacaatgccattcgtcatgctgacgagaaaggggaacaagcaacaattcaaaatcttgaatgtccccatgtcttctcagctcgcagcaaaccactggaaccagcagcaagctgagcaggaggagcggatgcgcatgaagaagctgaccctggacataaacgagcgtcaagagcaggaggattatcaggagatgctgcaatccctcgcccaacgacctgccccggctaataccaaccgtgagcgcaggcctagatatcaacaccccaaaggggcacctaatgcagacctaatattcaaaactggcggcagaaggcgttag

SEQ ID NO: 140109 - DNA, 3819 bp, Artificial Sequence
  Description of Artificial Sequence: Synthetic coding sequence
atgcctgccgaacgcaagaaacccgcaagcatggaagagaaggacagcctgcctaataataaagaaaaagattgctccgagcgaaggaccgtgagttccaaggaaaggccgaaagatgacataaagttaacggcaaaaaaagaggtcagcaaagcgccagaagacaagaaaaagagactggaggacgacaagaggaaaaaggaggacaaggaacgaaaaaagaaagacgaagaaaaagtgaaggccgaggaagagagtaaaaagaaagaggaggaggagaaaaaaaagcaccaagaggaagagagaaaaaagcaagaagaacaggcaaaaaggcagcaggaagaggaggcggctgcccaaatgaaggaaaaggaggagagcatccagctccaccaggaagcttgggagcgacaccacctgcgtaaggagttgagaagtaaaaaccagaatgctcccgacagtaggccggaagaaaacttcttcagtcggcttgactcaagtcttaaaaaaaacacagctttcgtgaaaaaactcaaaaccattaccgagcaacagcgagactccctcagccacgatttcaatgggctcaatctgagtaagtacattgcagaagccgttgcatccatcgtggaagccaagttaaagatttcggacgtgaactgcgcggttcatttgtgcagtctcttccaccagcggtatgccgactttgctccctcattgctgcaggtgtggaaaaagcacttcgaagcacgaaaagaagagaaaactccaaacatcacaaaactgcgcaccgaccttaggttcattgcagagcttactatcgtaggcatcttcacagacaaagagggactctctctcatatatgaacaactcaagaacattatcaacgctgatcgcgagtcccatacacatgtgtctgtcgtaatctcgttttgcagacattgcggagacgatatagccggattggttcctcgcaaggtcaaaagcgctgcagaaaagttcaatctgagctttcctccctccgaaattatatcccctgaaaagcaacagcccttccagaatctccttaaggagtactttacatccctgaccaagcacctcaaaagggaccaccgggagctgcaaaatactgaaagacagaacaggagaattctacactcaaagggagaactgtccgaggaccgtcataaacagtatgaggaattcgcaatgtcttatcaaaaattgctcgcgaactcccaaagtcttgcggatctcctggatgaaaatatgccggacttaccacaggataagcccacaccagaggagcatgggcccgggatcgacatctttacacctggcaagcccggtgaatatgatctagagggaggcatttgggaagatgaagacgccaggaatttttatgagaacctcattgatctgaaagcatttgttccggcaatactttttaaggacaacgaaaagtcatgtcaaaataaagagagtaataaggatgacactaaagaggctaaggaaagtaaggaaaataaagaagtaagcagccctgatgatctggaattggaactggagaatctcgaaatcaatgacgacaccttagaattagaaggaggagacgaagcagaagacctgaccaagaaactgctggatgaacaggagcaggaggatgaggaagcatccacgggaagccatctaaaacttattgttgacgcctttttgcagcagctgccaaattgtgtgaaccgcgacctgatcgacaaagccgcgatggatttttgcatgaatatgaatactaaagccaataggaagaagctagtcagagctttgtttattgtacccaggcaacgcctagatttgttgccattttatgctagactcgtggccaccctgcacccatgtatgagcgacgtggccgaggatctgtgctcaatgctgagaggagacttccggtttcatgtgcggaagaaagatcagattaacatcgaaactaaaaacaagaccgtgcggttcatcggcgaactaaccaaatttaagatgttcaccaagaacgatactctgcactgtttaaagatgctgctgagtgacttttctcatcatcacattgagatggcatgcaccctgcttgagacctgtggacggttcctgttcaggtcccctgagtcccacctgcgcacctccgtactgttggagcagatgatgagaaagaagcaggccatgcatctggatgcacgctacgtcactatggttgagaacgcttactactactgtaacccacctcctgctgaaaagacggtgaagaagaaacgcccaccacttcaagagtatgtgcggaaactgctgtataaggaccttagtaaagttacaacagagaaggtactgaggcaaatgcgcaagctgccatggcaggatcaggaggtgaaagactacgttatttgttgcatgatcaacatatggaatgtgaagtacaatagcatccattgtgtggcaaatttactcgctggactggttttataccaagaagacgtcggcatccatgtggtcgacggcgttttggaggatataaggcttgggatggaggtgaaccagccgaagtttaaccagagacgaattagctctgccaagttcttgggggaactgtacaactatagaatggtcgaatcagctgtcatctttcggactttatactctttcacaagtttcggtgtgaatcccgacggaagcccgagtagtctcgaccctcctgaacacctgttccgaatccgcctagtctgcacaatattggatacttgtggccaatacttcgatagaggaagtagcaaacggaaattggactgcttcctggtctactttcagcgctatgtctggtggaagaagtctctcgaagtgtggaccaaagatcatccgtttcctattgatattgactacatgatctcagacactcttgagctgctcagaccgaagatcaaactgtgcaattcacttgaggaatctattcgacaggtacaggacttggaacgtgaattcttgataaaactgggtctcgtgaatgataaggactccaaagactcaatgacagaaggggagaatcttgaggaggacgaagaggaagaggaaggaggagcagaaaccgaagaacagtccggaaacgagtctgaggtcaacgagccagaagaagaagaaggctccgacaatgatgacgatgagggcgaggaggaagaggaagaaaacacagactaccttactgattctaacaaggagaacgagaccgacgaggaaaacacagaagtgatgataaaagggggtggactgaaacatgttccatgcgttgaggacgaggacttcatccaggctctggataagatgatgctggagaatctgcagcagaggtccggtgagtcagtgaaggtgcatcaactggacgtcgccattccacttcacctgaagtctcagctacgtaaagggcccccccttggcggcggcgagggtgaagcagagtctgcagacaccatgcctttcgtcatgctcactagaaagggcaataagcaacagtttaaaatcttgaacgttcctatgtcaagtcaactcgcggccaatcattggaaccaacagcaggcagaacaggaggaaagaatgcgtatgaagaagctgaccctggatattaatgaaaggcaggagcaggaggactatcaggaaatgctgcagagcttagctcaaaggccagcgccagctaacacgaatagggagcgccgcccccgctatcagcatcccaaaggtgccccgaacgctgatctcatattcaaaacggggggacgaagacggtag

SEQ ID NO: 140110 - DNA, 375 bp, Artificial Sequence
  Description of Artificial Sequence: Synthetic coding sequence
atgatcaagggagggggcttgaagcatgtgccctgcgtagaggacgaggactttatacaggccctagacaaaatgatgctggagaacttacagcagcgcagcggggagtcagtaaaagtccatcagctcgacgttgccatcccactccaccttaagagtcagctgcgaaagggccccccattggggggcggcgagggcgaggcggagagtgcagataccatgccctttgtgatgcttactcggaagggaaataagcagcagtttaagattctgaatgttcctatgagctcacagctggcagccaatcactggaaccagcagcaggcggagcgacgcgaagatgaaaatgagaaggctcacactcgatatcaatag

SEQ ID NO: 140111 - DNA, 1740 bp, Artificial Sequence
  Description of Artificial Sequence: Synthetic coding sequence
atgcccgctgaacggaagaaaccggccagcatggaggaaaaagactcgctgcctaataataaggaaaaagactgctcggagcggcgcaccgtctctagtaaggagcggcccaaggatgacataaaacttaccgccaaaaaggaagtgagtaaagcacccgaagagtcaaagaaaaaggaggaggaagagaagaaaaaacatcaggaagaggagagaaagaaacaggaggaacaggccaagcgccaacaggaggaggaggccgccgcacagatgaaagagaaggaagagtccatccagctgcatcaggaagcatgggagcgacatcacctccgcaaagagttaagatccaaaaaccagaatgcacccgactcaaggccagaggaaaacttcttctcacggctggactcgagccttaagaagaacaccgcctttgttaagaaattgaaaacaataactgagcagcagagggattcactgagccacgatttcaatggactgaacctgtcgaaatacatcgctgaggccgtagcgtcaatagtcgaggccaaactcaagatctctgacgtgaactgcgccgtacacctgtgtagcctgtttcaccagcggtacgcagattttgctccttctctactgcaggtgtggaagaagcacttcgaggcccgcaaggaagagaagacgccgaacatcaccaagctacggacagatctgcgcttcatcgcggagctgacgatcgttgggatcttcacagataaggagggcttgagcttgatctacgagcagttaaaaaatattatcaacgccgaccgggaaagccacacgcacgtgtctgtggtcatttccttctgtagacattgcggagacgacatagctggcctggtaccccgcaaggtgaaatccgcagctgagaaattcaatttgtcatttcctccatctgagataatctccccagagaagcagcaaccctttcagaacctgcttaaggaatacttcacttcccttacaaaacacctgaaacgggaccacagggagctccaaaatacagagcgccagaaccgacggattctgcattcgaagggcgaattgtccgaagaccgccataagcagtacgaagaatttgcgatgtcttaccagaagctccttgcaaacagtcagtctctcgccgacctgctcgacgaaaatatgcctgacctcccccaggataagccaacccctgaggagcatgggccaggaatcgatatttttactcctggcaagcccggcgagtacgatttggagggcggcatttgggaggatgaggacgcgcgcaatttctacgagaatctgatcgatttgaaagctttcgtgccagccatcctgttcaaagacaatgagaagagctgccaaaataaggagtctaacaaggacgataccaaggaggcgaaggaatcaaaggaaaataaagaggtgtcctctcccgacgatcttgagctcgagctcgagaacctggagataaacgacgatactctcgaactcgagggtggtgacgaggcggaagacctcactaagaagttgctggatgagcaagagcaagaagacgaggaggcttctaccggctcgcatctgaaacttatcgtggacgcctttcttcagcagctgcctaactgtgtgaatcgtgatctaatagataaggcggagaaggctttctgcaatggcaatctcgctcgagtcaatcttctcctccggatggctgtgaaaaagtag

SEQ ID NO: 140112 - DNA, 3819 bp, Artificial Sequence
  Description of Artificial Sequence: Synthetic coding sequence
atgcccgccgagagaaagaagcccgcttctatggaggagaaagacagcctgccaaataataaggaaaaggactgttcagagaggcgcactgtgtcctccaaggagcggcctaaggacgatatcaagcttaccgccaagaaggaagtgagtaaggctcctgaggataaaaagaaacgactggaagacgataaaaggaagaaagaggacaaggaacgcaagaaaaaggatgaggagaaagtgaaggccgaggaggaatcgaagaaaaaagaagaggaggaaaagaaaaaacatcaagaggaggagcgaaaaaaacaagaggagcaggccaaaaggcaacaagaggaggaggcagcagcccagatgaaagagaaagaagagagcatccagctgcatcaggaagcctgggaacgccatcacctgcgaaaggaactacgtagcaaaaaccagaatgctcctgactcacggcctgaggagaacttcttttctaggctcgattcctctctgaaaaagaatacagctttcgtaaaaaagctgaaaacaattaccgagcagcaacgggacagtctcagtcacgatttcaacgggctgaacctgtcaaaatacattgccgaagccgtagcctccatcgttgaggctaaacttaagatctcagacgttaactgtgcagtgcatctgtgctctttgttccaccaaagatacgcggattttgccccatcactgctgcaggtctggaagaaacatttcgaggctcgcaaagaggaaaagaccccaaacatcactaaactgagaactgatctgcggttcatagctgagctgacaatagtgggcatattcaccgacaaggaaggactgtctcttatttacgagcaactaaaaaatattataaatgccgaccgggagtcgcacacacatgtgtctgttgttatctccttttgtcgccactgtggcgatgatattgctggattggtgccccggaaggtgaaatcagccgcggaaaagtttaatctcagcttcccccctagtgagatcatctcgcccgaaaagcaacagcccttccagaatctccttaaagagtacttcaccagcctaacaaaacacttaaagcgggatcaccgcgagctgcagaatacggaacgacaaaatagacgcatcttgcattcgaagggtgaactttcagaggacaggcataagcagtatgaagagttcgcgatgagctatcagaagctgttagcaaactcacagtccttggcggatctgctggacgaaaatatgcccgatctgcctcaggacaagcccacacccgaagagcacgggcccggaatcgatatctttacccctggcaagccaggggaatacgacctcgaaggtgggatttgggaagacgaagacgcacgcaacttttatgagaacctcatcgatttgaaagcctttgtgccagccattttattcaaagacaatgagaaatcttgtcagaataaggaatctaacaaggatgacaccaaagaagcaaaggagtccaaagaaaataaagaggtcagttcccccgacgacctggagctggaattggagaatctggaaattaacgatgacacactcgagctcgagggtggtgatgaagccgaggacctgactaagaagctgctcgacgagcaagagcaagaggatgaagaggccagcaccggaagccacctgaagctgatcgttgacgccttcttacagcagttaccgaattgtgtgaatcgtgacctgatagacaaggctgctatggatttttgcatgaacatgaatacaaaggctaaccgcaaaaagctggtccgggccctgtttattgtgccgagacagcggctggacttgttaccattttacgcacggctggttgctacattgcatccctgtatgagcgacgtcgcagaggatctatgttcaatgcttagaggagattttaggttccatgtccgtaaaaaggaccagattaatatcgaaacaaagaataagaccgtccgttttatcggagaactcaccaagttcaagatgttcaccaagaatgatacattgcactgcctcaaaatgctgttatccgacttcagccaccaccacattgaaatggcgtgtacgctccttgagacatgcggccgttttctttttcgcagtcctgagtcccacctacgaactagtgtgttgcttgagcaaatgatgcgcaaaaaacaagctatgcatctcgacgcgcgctatgtcactatggtggagaatgcatattactactgcaaccctccacctgctgagaagacagtgaaaaagaaaaggcccccactgcaagagtacgtgagaaaactgttatacaaagatctttcaaaggtcaccactgaaaaggttttgcggcagatgagaaaattaccatggcaagatcaagaggttaaggactatgtgatttgttgtatgatcaacatctggaatgtcaaatacaactcaattcactgcgtcgcaaacctgctcgcagggcttgtgctgtatcaagaggatgtgggtattcacgtggtggatggtgttctcgaggatataagactggggatggaagtgaatcagccaaagttcaaccagagaagaatatcctctgccaagtttctcggggagctctacaactaccgcatggtagagagcgccgtgatcttccggacactctatagttttacaagttttggagtgaatccggatgggtcaccaagcagcttggaccccccagaacacctgtttcgcatccggctcgtttgtaccatcttggacacctgcggacaatacttcgatcgagggtcatctaaacggaaactggattgctttctcgtatatttccagcgttacgtgtggtggaagaaaagtcttgaagtttggactaaggaccaccctttcccaatagacatagattatatgatctccgacactctggagctgcttcggcccaagatcaagctatgcaattcgttggaggaatctatccgacaggtgcaggatctggagcgcgaatttctgatcaagcttggcctggtgaacgataaggactctaaagacagtatgacagagggggaaaaccttgaagaagacgaagaggaggaggaggggggcgctgagacggaggaacagagtggaaacgagagtgaagtgaatgagccagaggaagaggagggctccgataacgatgacgacgagggagaagaagaagaggaggagaacacagattatctgactgactccaataaggagaatgagactgacgaggagaacaccgaggtgatgattaaaggcggagggctcaagcacgttccctgcgtggaagacgaggatttcatacaagccttggataaaatgatgcttgagaatctccagcagcgatcgggagagtctgtaaaggtccaccaactcgacgtggccataccactccatttgaagtcccagctgcgtaaagggccaccattagggggcggggagggcgaagctgaatccgccgacaccatgccatttgtgatgcttacccgaaagggcaataagcaacagttcaagatcttaaatgtccccatgagtagtcagcttgcagcaaaccactggaaccagcagcaggctgagcaagaagagcgcatgcggatgaaaaagctgacactcgacatcaacgaacgtcaggaacaggaggattaccaggaaatgttgcaaagccttgctcagcggcccgcccctgccaacacaaatcgcgaacggcgcccccggtaccagcatcctaagggcgctccgaacgcagacctgatctttaagaccggcggtcgtcgccggtag

SEQ ID NO: 140113 - DNA, 1332 bp, Artificial Sequence
  Description of Artificial Sequence: Synthetic coding sequence
atgcgatcagaaaaggaaggagctgggggcctgagggccgccgtcgccgcccgaggacccagtggccgcgagaaattatccgccctggaggtacagttccatagggatagccagcaacaggaggctgaaaccccacccacaagctcctccggctgtggcggcggggccggcaagcctcgagaggaaaaacgtacggcactcagtaaggtcgtgattaggcgcctgccacccgggttgaccaaagagcagttggaggaacaactgagacctttgcccgcccacgattactttgaatttttcgccgctgacctgagcttgtatccccacctatatagccgcgcttatataaacttccgcaatcccgatgatatcctgctcttcagggaccgatttgacggatacatctttctggatagcaaggatcccgagtataagaagtttctagagacctattgcgtggaagaagaaaagacgtcagcaaatcctgaaaccctcctcggcgagatggaggcgaaaacccgggagttgatcgcgaggaggacgaccccattgctggagtatatcaaaaaccgcaagctcgaaaaacagcggatcagggaggagaagagggaagagcggcggcggcgtgaactggagaagaaacggctccgtgaggaggaaaaacgacgaaggagggaagaagaaagatgcaaaaagaaggaaacggacaagcaaaagaagattgctgaaaaggaggtgagaatcaaactgctgaagaagcccgagaaaggcgaggagccaaccaccgagaaaccaaaggaacgaggcgaggaaatagacacagggggcgggaaacaagaatcttgtgcccctggtgctgtagtgaaagcccgcccaatggagggatccctcgaggagccccaggaaacctctcactctgggtctgataaggagcacagagacgtggaacgttcacaggaacaggagtctgaggcccagaggtaccacgtggatgacggcaggagacatagggcacaccacgagccagaacggctaagccgccgatccgaggacgaacagcgctggggcaagggaccaggacaggacaggggaaagaaggggagccaagactccggggcaccgggggaggccatggaacgactgggcagggcgcagcgctgcgacgactctcccgcccctcgaaaggaaagactggcaaacaaagacaggccggcattgcagttgtacgatcccggcgcccgtttccgtgcccgtgaatgtgggggcaaccggcgaatatgcaaagcggagggctctggtactggcccagaaaaaagggaagaggccgagtag

SEQ ID NO: 140114 - DNA, 1431 bp, Artificial Sequence
  Description of Artificial Sequence: Synthetic coding sequence
atgcggagcgaaaaagagggggccggcggcttaagagccgcggtggctgctcgcggtccttccgggcgcgagaaacttagtgccctggaggtccagtttcatagggattcacaacaacaggaggccgagacccccccaacctctagctcaggctgtggcgggggagcaggcaagccccgcgaggaaaagcgaaccgctttgtccaaagtcgtgattaggagacttcccccagggcttacgaaggagcagctggaggaacagctgaggcctttgcccgcgcacgactacttcgagtttttcgccgctgatctgtcgctctacccccacctttacagtcgcgcgtatatcaatttccgcaatcccgacgacatactgctcttccgtgacagattcgatgggtacatcttcctcgattccaaggggctcgagtaccccgccgttgtggaatttgctccatttcagaaaattgctaagaaaaagctccggaagaaagatgccaagacaggttctatcgaggatgaccctgagtacaagaagtttctggaaacatactgcgttgaagaagaaaaaaccagtgccaaccccgagacactgctcggcgagatggaggccaagacaagggagctcattgcaaggaggaccaccccattattagagtacattaaaaacaggaaattagagaaacaacgaattagagaagaaaagcgggaggaaaggcgccggagggaactcgagaaaaaacgtctcagagaggaagagaagcgcagaagacgggaagaagagcggtgtaaaaaaaaggagaccgataaacagaagaagatcgctgagaaggaggtgcgcatcaagttattgaaaaagcctgagaaaggtgaggagcccactacagagaagccaaaagaaagaggcgaagagatcgacacaggcggcggtaagcaagagagttgtgcccctggagcagtcgtgaaggcaaggcctatggagggctcactcgaggagccacaggagacatcccactcaggatctgacaaagagcaccgagatgtcgaaagaagccaggagcaggaatccgaagcccaaagatatcacgtggatgacgggcggcgacacagagcacaccacgagccagaaagactgagtcgacgtagtgaggatgagcagcggtgggggaaaggtcctgggcaggaccgtgggaaaaaaggaagtcaggattcaggcgcaccaggagaggctatggaacggctcggaagggcccaaaggtgtgatgactctccagccccgagaaaggagagactcgccaataaagacaggcctgcattgcaactgtatgatcctggtgcacggttccgcgctcgagagtgcggaggaaacagaaggatttgtaaggctgaagggtctggtaccggcccagagaagcgggaggaagctgagtag

SEQ ID NO: 140115 - DNA, 627 bp, Artificial Sequence
  Description of Artificial Sequence: Synthetic coding sequence
atggaggccaagactagagagcttattgctaggcgcacaaccccattgctggaatatattaagaaccggaagttggaaaagcagagaatacgcgaggagaagagggaggagcggcgacgacgcgaacttgaaaagaaacgtttaagggaggaagagaagcgacgcagaagggaggaggagcgctgtaaaaagaaagagacagacaaacagaaaaagattgcggagaaggaggtgcgaatcaagttgctgaagaaaccggaaaaaggcgaagagcctactaccgaaaagcccaaggagcgcggtgaggaaattgacaccggaggcggcaagcaggagagctgcgctccaggagcagttgtgaaggctcggcccatggagggcagtcttgaggaaccccaggaaacttcccacagtggatccgacaaggaacatcgggatgtagagagatcccaggaacaagagagcgaggcccctagaaaagagcggctggcaaataaagacaggcctgctctccagctttacgatccaggcgcacgttttcgtgccagagagtgtggaggaaacaggaggatttgtaaggcagaagggtcgggcactggaccagaaaagcgtgaggaggccgaatag

SEQ ID NO: 140116 - DNA, 1452 bp, Artificial Sequence
  Description of Artificial Sequence: Synthetic coding sequence
atgaaagaagaaaaggagcataggccaaaggagaaaagggtaaccctgctgaccccggcgggggctactgggtctggcggtgggacaagtggagattctagtaagggggaagataaacaagacagaaataaagagaagaaggaagcattgagcaaggtcgtcatccgccggttgccaccaaccctcaccaaggaacagctacaggaacacctgcagcctatgcccgagcacgattacttcgaattcttttctaacgatacatctctgtacccacatatgtacgcacgcgcttatatcaactttaagaaccaggaggatataattttattcagggaccgatttgacggttacgtctttctggataacaagggccaggagtacccagcaattgtggagttcgctcctttccagaaagccgccaaaaagaaaacgaaaaaacgcgacacgaaagtgggaaccatagatgatgaccctgagtaccgcaaatttctggaatcatacgccactgacaacgagaagatgaccagtaccccagaaacactgctcgaagaaatcgaagccaaaaaccgtgagttgatcgcaaagaaaaccacccctcttctgagttttttgaagaacaagcaaagaatgcgtgaggagaagcgggaagagcgccggcgccgagaaatcgaacggaagagacagagagaggaagagagacgtaagtggaaggaagaagaaaagagaaaaagaaaagacatcgagaaactcaaaaagatagatcgcattcccgagagagataaattgaaagatgaaccgaagataaaagtgcacagatttctgctgcaggcagtgaatcaaaagaacttattaaagaaacccgaaaagggggacgagaaagaattggacaaaagagaaaaggccaagaagcttgacaaggaaaatctgtcggacgaacgggcctctggtcaatcgtgtactctccctaagcgctcagacagtgagctgaaggacgaaaaacctaagcggcccgaggacgaatctggcagagattatagagaacgggagcgcgaatacgagcgtgatcaggagcgcatactccgtgaacgagagaggctaaagagacaggaggaagagcggagaagacagaaggaacgctacgagaaggaaaaaaccttcaagcgtaaggaggaggagatgaagaaggaaaaagacactctcagggacaagggcaaaaaagcagaatctacagagtccatcggatctagcgagaaaactgaaaagaaggaggaggtggtcaagagagaccgtatccgcaacaaagatcggcccgccatgcagctttaccaaccaggggcccgctctaggaacaggctttgtcctcctgatgacagtaccaaaagtggagatagcgctgccgaacggaagcaggaatccgggatttcccatcggaaagagggtggggaggagtag

SEQ ID NO: 140117 - DNA, 1413 bp, Artificial Sequence
  Description of Artificial Sequence: Synthetic coding sequence
atgaaggaggagaaagaacaccgcccaaaagaaaagagagtgacactgctgacgcccgccggagcaaccggtagtggaggcgggacatccggcgattccagtaagggtgaagataagcaggatcgtaacaaggagaaaaaggaggccctttcgaaggtcgtgatacgtcgtctgccacctacactgaccaaggaacaacttcaggagcacttgcaacccatgcctgaacatgattactttgaatttttcagtaatgacacgagcttgtatccccatatgtatgctcgagcttacattaacttcaagaatcaggaagacattattctcttcagggatcggttcgatggctatgtttttctggacaataaaggacaggaatatcctgccatcgtggagttcgccccgtttcaaaaggctgccaagaagaaaaccaaaaaacgcgacaccaaagtgggtacaatcgatgacgatccagaataccgcaagtttctggagtcttatgccaccgataacgagaaaatgacctctactcccgagaccctcctggaagaaatcgaggctaaaaaccgggaactgattgccaagaagaccactcccctgttgtcatttctcaagaataagcagaggatgagagaagaaaagcgcgaggaaagaaggcgccgcgaaattgaaaggaagaggcagcgagaggaagagagaaggaaatggaaagaggaagagaagagaaaaagaaaggatattgagaaactcaagaagatcgatagaatcccagaaagagacaagctgaaggatgagcccaagataaagctcctgaagaagcctgagaagggtgatgagaaagagctggacaaacgcgagaaggctaaaaagctggacaaggagaacctaagtgacgagcgggcgagcggccaatcttgcaccttgccaaaaaggagcgattccgaattaaaagacgagaagcccaagcgaccggaggacgagtccgggagagattaccgagagcgcgagcgtgaatacgagagggatcaggaacgaatcttgagggaacgggaacgcctgaaaaggcaggaggaggaacggcgacgacaaaaagagcggtatgaaaaagaaaaaacattcaagcggaaggaggaagagatgaaaaaagaaaaggacactctcagggacaaggggaaaaaagccgagtctaccgaaagcatcggatcttcagaaaaaacagagaagaaagaagaggttgtgaagagggatcggatcagaaataaggacagacccgcaatgcagctttaccagccgggcgctcgctctcggaaccgcctgtgcccccctgatgactctacgaaatcaggcgattcggccgcagaaagaaaacaagaaagcggcattagccacaggaaagaggggggtgaggagtag

SEQ ID NO: 140118 - DNA, 657 bp, Artificial Sequence
  Description of Artificial Sequence: Synthetic coding sequence
atgaaagaagaaaaggagcatcgaccgaaagagaaaagggtgaccctgttaaccccagcaggcgcgaccggctccggaggcggtacctcaggcgacagtagtaagggggaggacaaacaggataggaataaggagaaaaaggaagccctgtcaaaagtggtaattagaaggctgccgccaacactgacaaaggagcagctacaggagcatctccaaccgatgccagagcatgattacttcgagttttttagcaacgatacctccctgtaccctcacatgtacgccagggcctacattaactttaagaatcaggaagatattatcctgttccgcgataggtttgatggctacgtgttcctggacaacaaaggccaggaataccctgctatcgtggagtttgccccatttcagaaagccgctaagaagaaaactaagaagagggataccaaggtgggcactatagacgacgacccagagtatcgtaaatttttagaaagctacgcgactgacaacgagaagatgactagcaccccagagacactgctcgaggagatcgaagccaaaaatcgcgaactgattgctaagaagacaacaccgcttctatcatttttgaaaaataagcagaggatgagagaggagaaacgggaagatttctag

SEQ ID NO: 140119 - DNA, 441 bp, Artificial Sequence
  Description of Artificial Sequence: Synthetic coding sequence
atgatgtggcaaaagtacgccggctcgcggcgatccatgccactcggcgctaggatcctctttcatggcgttttttacgcagggggattcgctatcgtctattatctgattcaaaaatttcactcaagggccctgtattacaagctcgcagtggagcagctgcagtcacatccagaagcccaggaggctctgggaccaccgctgaatattcattatctgaagctgattgatagagaaaactttgtcgatatcgtcgatgccaaacttaaaatccctgtgagtgggagcaagtccgaaggactgctgtacgtccactcaagcagaggaggtccatttcagagatggcatcttgacgaggtcttcctggaactgaaggatggtcagcaaatccccgttttcaaactctcaggagagaatggcgacgaggtgaagaaagagtag

SEQ ID NO: 140120 - DNA, 2667 bp, Artificial Sequence
  Description of Artificial Sequence: Synthetic coding sequence
atggaaggtgatgactgtgagttccgctatggcgacgggacaaatgaagcccaagataatgacttccccacagtggaacgcagccgcctgcaggagatgttgtcactcttggggctggagacgtaccaggttcagaagcttagcctgcaagattccctccagatatcctttgactctatgaaaaactgggccccccaggtaccaaaagacttaccctggaatttcctgagaaaacttcaagcactcaacgccgatgcgcggaatacaacaatggtcctagacgtgttacctgacgctagaccagtggagaaggaatctcaaatggaggaagaaataatctattgggacccagccgacgacctggctgcagatatttatagctttagcgagctccctactcccgacacccccgtcaatccgctggacctcttatgcgctttgctgctgtcatcagattcttttttacaacaggagatcgctttaaaaatggccctatgtcagttcgccctaccgcttgtgctaccagatagcgagaatcattaccacacatttcttttgtgggccatgcggggtattgtgagaacttggtggtcccagccccctaggggaatgggctcttttcgtgaggattctgtcgtgttgtcacgcgcccccgcgttcgcatttgtgcggatggatgtttctagcaacagcaaatcccagttgctgaacgctgttctgtcccccggacaccgtcagtgggactgtttttggcacagagacctgaatctcggcacgaacgcgagggagatttctgatgggctggtggaaatcagttggttttttccctctggaagggaggacctagacatcttccccgagccagtcgcttttctgaatttaagaggcgacatcggcagccactggttacagtttaagcttctgacggaaattagtagcgcagtctttatcctgaccgataatatttccaaaaaagagtataagctcctgtattcgatgaaggagagtactacaaaatactacttcatccttagcccataccggggcaaaaggaatacaaaccttcggtttctaaataagcttatccctgtactcaagatcgaccactcccatgttctagtgaaagtcagcagcactgatagcgactccttcgtgaagagaataagggccatagtgggaaatgtccttcgagccccttgccgacgggtgagcgtggaggatatggctcatgcagccagaaagctcggtctgaaagtggatgaggattgcgaggagtgtcagaaagcgaaggacaggatggaaagaataacgcgaaaaattaaagatagtgacgcctatcggcgcgacgaattgcgccttcagggggacccatggcgtaaggcggctcaagttgaaaaggaattttgccagttgcagtgggcagtggatccaccagaaaaacatagagctgaactgcgcaggcggttattagaacttcgaatgcaacaaaatggtcacgaccccagctccggagtccaagagttcattagcggcatcagtagtcctagtctatctgagaaacagtattttcttcgatggatggaatggggccttgcccgagtggcgcagcctcgactccgccagccccctgagactctgctgaccctgcgccccaaacacggcgggacaacagatgtaggtgagccactgtggccagagccactgggagttgagcacttcctgcgcgaaatgggtcagttctacgaggcagagtcgtgcctcgttgaggcaggcaggcttcctgcaggccaacggcggtttgctcatttccctgggctggcctctgaacttcttctgaccgggttgccactcgaactaattgatggtagcaccctgagcatgcccgtgcgatgggttactggattacttaaggagctgcacgtgaggcttgaaaggcgtagcaggctcgttgtattgagtactgtgggcgtgcctggcacaggtaaaagcaccctcctcaataccatgtttgggctgaggttcgccacagggaaatcgtgcggacctcgaggggccttcatgcagctgatcaccgtggcagagggttttagccaggatttgggctgcgatcacatactggttattgatagcggcggcctcataggaggcgcccttacaagcgccggagatagatttgagctagaggcctcactggccaccctgttgatgggtctgtccaacgtcacggtgatctctctcgctgaaaccaaggacatcccggcagctattctgcacgccttcctgcggctcgagaagacaggacatatgcccaactaccagtttgtgtaccagaatctgcatgacgtttcggtacccggcccaagaccgcgcgataaaagacagctgttagaccctccaggtgacctgagccgtgctgcggcccagatggaaaaacaaggcgatggttttcgggccctggccggcttagccttttgcgatccggagaaacagcacatctggcacattccaggactgtggcacggagctcctcctatggctgcggtttctctggcatactccgaggctattttcgagctcaagcgctgcctcctcgagaatattagaaacgggctcagcaaccaaaacaaaaatatccagcagctcatcgagttggtgagaaggctctag

SEQ ID NO: 140121 - DNA, 2769 bp, Artificial Sequence
  Description of Artificial Sequence: Synthetic coding sequence
atggcttcccccggccattctgatcttggtgaggtcgctcccgagatcaaagcctctgaacggcggacagcagtcgctatcgcagatctggagtggagagaaatggaaggcgatgactgcgaattccggtatggtgacggcactaatgaagcgcaggataatgacttcccaacagtagagagatcccgtctgcaggaaatgctcagtttactgggcctcgaaacataccaggtgcagaaactgagcctgcaggactctctgcaaatatcctttgactctatgaagaactgggccccccaggtcccaaaagacttaccttggaatttcctgagaaagctacaggccctcaatgcagacgcccggaacaccaccatggtcctggacgtcctaccagatgccaggcccgtggaaaaggagagtcagatggaggaggaaatcatttattgggatcccgcggatgatttggccgccgacatctactccttcagtgagctcccaaccccggatacgcccgtgaatcctttggacctcttgtgcgcactgctcctctccagcgattccttcctgcaacaggaaattgccttaaagatggcactgtgtcagtttgcgttgcccttggtgctgccggattctgaaaatcactatcacaccttcctcttatgggcgatgcgcggcattgtcaggacatggtggagccagccacccagggggatgggctcattccgcgaggacagtgtggtgctgtctcgagccccggcatttgcttttgttcgcatggatgtgtcctcaaatagcaagtcacagctgctgaacgcggttctgtccccaggccaccggcagtgggattgtttttggcatcgagatctgaacctcggaacaaacgcacgggagatatccgatgggcttgtggaaatttcctggttctttccctctggccgggaggatttggatattttcccagagcccgtagcttttctgaacctccgcggcgatataggctctcattggctccagtttaaattgctgaccgagatatcgtccgctgtgttcattctgactgacaatattagtaagaaagagtataaactcctctattcaatgaaagagtcgacgaccaaatactacttcatcctgtctccttacagaggaaagcgtaacactaatcttaggtttctcaataagttaattccagtgctgaaaatcgatcacagtcatgtgctggtgaaagtgagcagcaccgacagcgacagtttcgttaaaaggattcgtgcaattgtggggaacgtactaagggcaccttgtcgcagggtgagtgtagaggatatggcgcacgctgctagaaaacttggcctcaaagtggacgaagactgtgaagagtgtcaaaaagcgaaagaccgtatggagcgcattacccggaaaatcaaggactcagatgcctacaggcgcgacgagctgcgattgcagggagatccatggcgaaaggccgcccaggtagagaaagaattttgccaactgcagtgggccgtcgacccacccgagaaacatcgcgccgagctgcgtcgaagactgctagagcttaggatgcagcagaatggtcacgacccatccagcggtgtgcaggagttcatctctggtataagttcaccatccctgtcggagaagcagtacttccttcgctggatggagtggggcctggcgagggtggcgcagccacgtttgaggcagccgccagaaacattactcacccttagacctaaacacggtggaacgaccgatgttggggagccactgtggcccgaacccctcggcgtcgagcacttcctgcgagagatgggacaattctacgaagccgaatcctgtttggtcgaagctggtcgcctgccagccggacagaggaggtttgcccactttcctggcctcgccagcgaactgcttttgacaggcctgccactcgagctcattgacggcagcacactgtccatgcccgtccgctgggtgaccggactcctcaaggaattacatgtgcggttggaacggagatcgcgcctcgtcgtgctttccaccgttggggttcctggaacgggcaaatctactcttcttaacactatgtttggcctgcgctttgctacgggaaaatcttgtggcccacgaggtgcattcatgcaactaatcactgtagccgagggcttttcccaggatctggggtgtgatcatattctcgtgatagactccggcggcctgatcgggggggctctgacctccgccggggatcgattcgaacttgaagctagcttggccacactccttatgggtttgtctaatgtgactgtcatttctcttgcagagactaaagatatccccgccgccattctccatgcgtttttgagactagagaaaactggtcacatgccgaactaccagttcgtgtaccagaatctacacgacgtgtctgtgccggggccacgaccacgcgacaagcgtcagctcctcgacccccccggtgatctatctagggctgctgcccagatggaaaagcagggggatgggtttcgagctttagctgggctagccttttgcgacccggagaagcagcacatctggcacattccaggcctgtggcacggcgcacctcctatggctgcagtgtccctggcctattccgaggccatttttgagctgaaacgctgtttgctcgaaaacatccgcaatgggctttctaaccaaaataaaaatatacagcagttgatcgagctcgttcgccgcctttag

SEQ ID NO: 140122 - DNA, 492 bp, Artificial Sequence
  Description of Artificial Sequence: Synthetic coding sequence
atggagggtgacgattgtgaattcagatacggtgatggtactaacgaggcacaagataatgactttcccactgtggagcgatctcggcttcaggagatgcttagtttactggggctggagacgtatcaggtccaaaagctctctctgcaggattcactccaaatatcttttgactcgatgaagaattgggcaccgcaggttcctaaggacctgccctggaactttttacgtaagctgcaagccctcaacgctgacgcccggaacacaactatggtccttgatgtcctgcccgacgcgcgcccagtggaaaaggagtcccagatggaagaagagatcatttattgggacccagcagatgacttagccgcagacatttactctttctcagaacttcccactcccgacacccccgtcaaccctcttgacctcctctgcgccctgttgctgtccagcgacagttttctgcagcaggagatcgcactgaagatgtag

SEQ ID NO: 140123 - DNA, 2667 bp, Artificial Sequence
  Description of Artificial Sequence: Synthetic coding sequence
atggagggtgacgattgcgaatttcgttacggcgacgggacaaatgaagctcaggataacgacttccctacagtagaaagaagccggctgcaggaaatgctgtctctgctggggttggagacctaccaggtccagaaactgtccctgcaggactccctgcagatctcatttgactcgatgaagaattgggccccacaggtcccaaaagatttaccctggaattttctcaggaaactgcaggctttaaatgccgacgcccgaaacacgaccatggtgttggacgttctcccagacgccagacccgtggaaaaggagtcccagatggaagaagaaattatctactgggaccctgctgatgacttagccgctgacatttattctttcagcgagttacctactccagatactccagtcaaccccctcgatttactctgcgccctgttgttatcctctgactcatttcttcagcaggaaatcgcactgaagatggccttatgtcagttcgccctccctctagtcctaccagacagtgagaaccattaccatacctttctgctgtgggcaatgaggggaattgttagaacctggtggagccaaccacctcggggcatggggtccttccgcgaggattccgtggtgttatctcgggccccggccttcgccttcgttcgcatggatgtatcttcgaactccaaatcccaattgctgaatgctgttctgtctcctggacacagacagtgggactgtttttggcacagagatctgaatctgggtactaatgcccgtgaaatatctgatggcctggtggagataagctggttctttccttccggccgggaagacctggatatctttccagagcccgtggctttcttgaatctccgcggcgatattggtagtcactggctacagtttaagctgctgactgaaataagttctgctgtgttcatcctgactgacaatatctctaaaaaagagtataagttgctctattcaatgaaggagagcaccaccaaatattatttcattctgtccccatacaggggaaagaggaacacaaacctgcggtttctcaacaagcttattccagtgctcaagattgatcactcccacgtgctagtaaaggtgagctctactgacagcgatagcttcgtaaagagaatcagggctattgtgggcaacgttctcagagcaccctgtaggagagtctctgttgaggacatggcccacgccgcccggaaactaggtttgaaggtagacgaagactgtgaagaatgtcaaaaggccaaggacaggatggagcgcattactcgcaaaatcaaggactccgatgcctaccgcagagacgaactccgactgcagggcgacccatggcggaaagcagcccaggtcgagaaggaattctgccagctccagtgggccgtggatcccccagaaaagcatcgcgctgagttgcggcgacgcttgctagagctacgaatgcaacagaatgggcacgatccgtctagcggagtgcaggagtttatttctggaatctcatccccaagtctgtcggagaagcagtacttcctcagatggatggagtgggggctggcacgagtggcccagccccggctgaggcagccccctgaaacgcttctcaccctgagacctaagcatggcggaaccactgacgtgggagaacccctgtggccagaacccctcggggtggaacacttcttgagggagatgggccaattctatgaggctgaaagctgtctggtggaggctggaagactgcccgccggccagcgacgttttgctcactttccaggacttgcctctgagctgctgttaaccggtcttcctctggaactgattgacggctctaccctgagcatgccagtacgttgggttacaggcctcctgaaggagctgcatgtgcggctcgagagaaggagccggttggtcgtgttgtcaacggtgggcgtgcctggaactggcaaatcaaccctcctcaacaccatgttcgggctgaggtttgccacggggaaatcttgtggtccacgcggggcattcatgcagttgatcacggtcgccgagggtttttcccaagacctgggatgcgaccacatccttgtaatcgattcaggagggctgattgggggtgcattaacgagtgccggagaccggtttgagctagaagcctctttagccactctgctcatgggcctttccaatgttacagtgattagtctggcagaaacaaaagatattccagctgctatactccatgcatttttgaggctagagaagactggtcacatgcctaattatcagtttgtctaccagaatctccatgatgtgagtgtccccggtccccggccgcgcgacaaacgccagttactcgaccccccaggtgatctgagtcgtgccgctgcacagatggaaaagcagggagacgggtttagagcacttgcaggtttggctttctgcgatcctgagaagcagcacatatggcacatcccgggactgtggcatggcgcccccccaatggccgccgtgtcattagcatacagcgaagcaatcttcgagctcaagcgctgtcttctggagaatattcggaatggcctgtccaatcagaacaagaatattcagcagctcatcgagcttgtgagacgcctgtag

SEQ ID NO: 140124 - DNA, 2667 bp, Artificial Sequence
  Description of Artificial Sequence: Synthetic coding sequence
atggaaggcgatgattgtgagtttcgttacggagatggcactaatgaagcacaggataatgactttcctactgtagagcggtcccgactgcaagagatgttatctctgctcggactggagacataccaggtccagaagctgtccttgcaggattccttgcaaataagttttgattccatgaaaaactgggctcctcaggtgccgaaggatttgccctggaatttccttaggaaactgcaggcccttaacgccgatgcacggaatactactatggtactggacgttctacccgatgcccgcccagtggaaaaagaaagccagatggaggaggaaattatttattgggatccagctgacgaccttgccgcggacatttattccttctcagaactgcccacacctgatacacccgtgaacccgctggatctgctgtgcgctctgctcttgagcagtgactcgtttctccaacaagagatagcattaaagatggccctctgccaatttgcgctgccgcttgtcctaccggattctgaaaatcattaccacactttcctgctctgggccatgcggggcatcgtaagaacgtggtggagccagcctccgcgagggatggggtccttcagggaggacagtgtcgtcctcagcagggcgcccgcctttgcctttgtgagaatggacgtgtcaagcaattcaaagtctcagttgcttaacgcagtgctctcacctggccacaggcagtgggactgtttctggcatagagacttgaacctggggacaaatgcacgtgagattagtgacggcctagtcgaaatttcgtggttcttcccttcaggccgcgaagacctcgacatatttcccgaaccagttgcgttccttaacctgcgcggtgatatcggatctcactggctgcagttcaaactcctcactgaaatcagcagtgccgttttcattttaacagataatatatccaaaaaagagtataaattactctattccatgaaagagtcaactactaaatattactttatcttatctccttatcgcggaaagcggaacacgaacttgcggttcctgaacaaattgattccggtcctgaagattgatcatagccatgtgctcgtgaaagtcagtagcaccgactctgactccttcgtgaaaaggataagggcgattgtgggaaatgtgctgagagctccatgtcggcgagtcagcgtagaagacatggcccacgccgcacgcaaattgggcttgaaagtcgacgaggattgtgaggagtgtcagaaggcaaaggaccgcatggaaagaataacacgcaagattaaagatagcgacgcttacaggagggacgagcttcgcctccagggtgatccgtggcgtaaagccgcacaagtggaaaaagaattctgtcaattacaatgggctgtcgaccctcctgaaaagcaccgcgccgagctcaggcggaggctactggaactgcgtatgcagcagaatggtcacgatccgagcagcggggttcaggagttcatcagcggcatctctagcccaagcctgtccgagaagcagtacttcctgaggtggatggaatggggactggctcgcgtcgcccagcctagactgcgacagccccccgagactctgcttaccctccggccaaaacatggcggcaccacagacgtaggagagcctctgtggcctgagcccttgggcgtggaacacttcttgagagagatgggacagttttacgaggcagagagctgtctcgtggaggcaggtcgactccctgcgggccagcgacgtttcgctcactttcctggactcgcgtcagagttgctgctcactggactccctctagagcttatcgacggctctactctgagcatgccggtgaggtgggtcaccgggttgcttaaggaactccatgtacgattggagcgaaggtccaggctggtggtgctgtcaacagtgggcgtccctggaaccgggaagtctacactcctcaatactatgttcggcctgcgatttgccactggaaagagctgtgggcctaggggggctttcatgcaattaattacagtcgccgaggggtttagccaggatctgggctgtgaccatatactggtgatcgattctggtggacttattggtggagcgctgactagcgctggtgatagatttgaactggaggcgagtttggctaccctgctcatgggcctgagcaacgttactgtgatctctctcgccgagaccaaagatatccccgccgccatcttacacgcctttctgaggctggagaagacaggtcatatgccaaattatcagtttgtgtatcagaatcttcatgacgttagtgtccctggccctagacctcgggacaagaggcagctcctggacccacccggcgacctcagccgtgcggccgcgcagatggagaagcagggggatggtttcagggcgctggcaggactggccttctgtgaccccgaaaaacagcacatatggcacattcctggtctctggcatggcgctccccccatggcagccgtgtcacttgcctacagcgaggccattttcgaactcaagcggtgtctgctggagaacatccggaacgggctgagtaatcagaacaagaatatccagcaactgattgaactcgtccgtcgcctatag

SEQ ID NO: 140125 - DNA, 2796 bp, Artificial Sequence
  Description of Artificial Sequence: Synthetic coding sequence
atggctagccccggaatagaagtggagttactcggaaaaggacactccgatctaggagaggtggcgccagagatcaaggcatccgagaggaggaccgccgtggcgatcgctgacctggaatggcgggagatggaaggtgatgattgcgaatttaggtatggtgacggaacgaacgaggcccaggataacgacttcccaaccgttgaaagatctcgactccaggaaatgctgagcttattaggtctggagacgtatcaggtgcagaagctttcactccaggactctctgcagatcagctttgattcaatgaaaaactgggctcctcaggttcccaaggatctgccctggaatttccttcgcaagttacaggcactgaacgctgatgcacgcaatacaacgatggtcctggacgtattgccagatgcacgaccggtggaaaaggaatcacagatggaggaggagataatatactgggatcccgctgacgacctggccgctgacatctatagcttttcggaactgcccacccccgatacgccagtgaatccgctggatctgctttgcgccctgcttttgagctcggactcctttctgcaacaagaaatcgccctcaaaatggcactatgtcagttcgccctccctctggtcctgcccgactctgaaaatcattaccacaccttcctcctgtgggcaatgaggggaattgttcgcacctggtggagtcaaccaccgaggggcatgggttcattccgggaagattccgtcgtgctgagccgtgcccccgctttcgccttcgtcagaatggatgtgagcagcaatagtaagtcccaactcctgaacgctgtcctgtcaccaggccatagacagtgggattgcttttggcaccgggaccttaacctcggaacaaacgcacgcgaaatatcagatggcttggtagagatctcttggttctttccttccggccgagaagacctagacatatttccagagccagtcgcctttctgaatctgagaggtgacatcggtagtcactggttgcagtttaagttgctcacagagatatcctccgccgtgtttatcctcactgacaacatctcgaaaaaggaatataagctgctttattctatgaaggagtctaccactaaatactactttattctgagcccttatcgcggtaaaaggaacaccaacctgcggtttctcaacaagttgatacccgtcctgaaaatcgatcactcacacgtgctggttaaggtttcatccactgactcggatagcttcgtgaaaagaatcagagcgatcgtcggtaatgttctgcgagccccctgcagacgggtctcagtggaggacatggcacacgccgctcgcaaactcgggcttaaagtagacgaggactgtgaggaatgtcagaaggccaaggaccgtatggaacgcattactagaaaaattaaagattcagacgcctatcggcgagatgaactcagacttcagggagacccatggagaaaagccgctcaagtagagaaagagttctgtcagctgcagtgggccgtggatcccccagagaaacaccgggcggaactcagaagacggcttctggagctgcgcatgcagcagaacggacacgatccatcctcaggcgtacaggaattcatctcaggcatttcctccccctccctctctgagaagcagtactttcttcgttggatggagtggggactggcaagagttgcccaaccacgcctgagacaaccccctgagaccctgctgacattgcggcctaagcacggtgggactactgatgtcggggagcccctgtggcccgagcccctgggcgtggagcactttttgagagaaatgggacagttttatgaagccgagtcttgcctggtggaggcagggaggctccccgccggccaacggcgatttgcccactttcctggcttggcgtctgaacttttattgacaggtctccccctggaactgatcgatgggtcgaccctttctatgcctgtccggtgggtcacaggactcctcaaggagctccatgtgaggctggagaggcgctcccgtcttgtggtcctctctactgtgggtgtccctggcactggcaagtctacgctgctgaacacaatgttcggtctacggttcgctacaggcaaatcttgcggcccccgtggagcttttatgcaactgattaccgtggccgaaggattctctcaagacctcgggtgcgaccacatcctggtgatcgactcgggcgggttgataggcggtgcgttaacttctgctggtgacaggtttgagctggaagcctcactggcaactctcctcatgggactcagcaacgtgaccgtgatttcacttgccgaaacgaaggatataccggccgctattctgcatgccttcctccggttagagaaaaccggtcacatgcctaattatcagtttgtataccaaaatctgcacgatgtgtccgttccggggccacgacccagagacaagcggcaactgcttgaccccccaggcgatctgtcaagggccgctgctcagatggagaagcagggggatggctttcgtgcccttgccggcctggctttctgtgatcctgagaagcaacacatttggcacattcccggattgtggcacggggcacctcccatggccgccgtgtccctggcctactcggaggctatttttgagttgaagcgctgccttcttgagaacataaggaacggacttagcaatcagaataagaacatccagcaattaattgaacttgtgagaagactctag

SEQ ID NO: 140126 - DNA, 369 bp, Artificial Sequence
  Description of Artificial Sequence: Synthetic coding sequence
atggaaggagatgattgtgagttccggtatggagacgggactaacgaggctcaagataacgattttcctaccgtcgagaggagccggttgcaagagatgctgtctctgctgggcctggagacttaccaagtgcaaaaactatcattacaggacagtctgcaaatctcatttgatagcatgaagaactgggctccacaggtgccaaaagatctcccctggaattttctcaggaagctgcaggccctgaatgctgacgctagaaatacgacaatggtgcttgacgtccttcctgatgctcgcccggtcgaaaaagagagccaaatggaggaagagatcatctattgggaccctgctgatgatctggcctag

SEQ ID NO: 140127 - DNA, 1623 bp, Artificial Sequence
  Description of Artificial Sequence: Synthetic coding sequence
atggcctgggtgctcaagatggatgaggttattgagagcggcttggtgcatgactttgatgcgagcctgtcagggattggacaggagttaggagctggggcctatagtatgagcgacgttctcgcactgccaatcttcaaacaggaggatagtagcctgccgctcgatggggagactgagcatccaccctttcagtacgtcatgtgcgccgcaacgagtcccgcggttaagctccacgacgagacactaacatacctgaaccaaggccagagttatgagatccggatgctggacaacagaaagatgggggatatgcctgaaatcaacgggaaactggtgaagtccatcattagggttgtcttccacgacaggcgtctccagtacaccgaacatcagcagctggaaggatggaaatggaatagaccaggcgacaggctgctggacttggatattccgatgtccgtgggcatcatcgacacccggaccaacccatcccaactcaacgcggtggagtttctgtgggaccctgccaagagaacgagtgcatttatccaggtgcattgcatttctactgagttcacgccccgaaagcacggaggtgaaaaaggtgtgcccttccgcatacaggtagacacgttcaagcagaacgagaacggtgagtatactgatcacctacatagtgccagttgccagatcaaggtatttaaacctaagggagcggacagaaagcagaaaacagatcgcgaaaagatggagaagagaaccgcccacgagaaggagaagtaccagcccagctatgacaccaccattttgaccgagatgcggctcgagcctattatcgaagatgcggtcgagcatgagcagaaaaagagtagtaaacgtacacttcctgccgattacggagattctctggccaagagaggcagttgttctccctggcccgatgcccccactgcctacgttaacaatagcccttccccagccccaacattcacaagcccccagcaatctacctgttccgtgccagactctaattcgtcctcacctaatcaccagggcgacggcgcatcccagacatctggagagcaaattcagccttccgccaccattcaagagacacagcagtggctgttaaaaaatcgatttagcagctatacccggctgttttctaactttagtggcgccgatctgcttaagctgacgaaggaagacctggtgcagatctgtggcgcagctgacgggattcggttgtacaactccttaaaaagccggtccgttcggccccgactcacaatctacgtgtgtcgagagcagcctagctccacagtgctgcaaggacagcagcaggctgcaagtagcgctagcgagaacggcagcggggccccgtacgtctaccatgccatctatttggaagagatgattgcctctgaggtcgcccgcaagctcgccctggtgtttaacatcccgctgcatcaaattaatcaagtgtatcgccaggggcctactggtattcacattctggttagtgaccagatggtgcagaactttcaagacgaatcttgctttctgtttagtaccgtaaaggccgaaagctcagacggcatacatattatcttgaagtag

SEQ ID NO: 140128 - DNA, 1623 bp, Artificial Sequence
  Description of Artificial Sequence: Synthetic coding sequence
atggcttgggtgctgaaaatggacgaggtgatagagagtgggctggtccacgacttcgatgcaagtctgtcagggattggccaagaattgggcgcgggcgcctacagcatgtctgatgtgctagccctgcccattttcaagcaggaggattctagtctcccactagatggcgagacagaacatcctccatttcagtatgtgatgtgtgctgccacgtccccggcggtgaaattgcatgatgaaacccttacctatctgaatcagggtcagtcctacgaaatcagaatgctcgacaatcgcaaaatgggagacatgcctgagatcaatggcaagctggtcaagtccatcattcgagtggtgttccatgaccgcaggcttcagtacacagaacatcaacagttagagggttggaaatggaataggccaggcgatcggttgctggacctcgacataccaatgagtgtcggaatcatagatactcggactaacccatcccagctcaatgcagttgagttcctgtgggatcccgctaagaggacgtctgcttttatccaagtccactgcatctcaacagagttcactcccagaaaacacggcggcgaaaaaggggtaccttttcgcatccaggtcgacacctttaagcaaaacgaaaacggtgaatacacagaccacctgcattcagcctcctgtcaaatcaaggtatttaaaccaaagggagctgataggaagcaaaaaaccgatagggagaagatggaaaagcggacagcccatgagaaagaaaagtatcagccttcttacgacacaaccatactcactgaaatgaggctggagccaataatcgaagatgctgtggaacacgaacagaagaagagctctaagcgtacactccccgccgactatggtgattcattggcaaagcggggttcctgttctccttggccagacgccccaacagcttatgtcaataattccccttcaccagcgcccacttttactagcccccagcagagtacttgctctgtgcctgatagcaactcgagctctcctaaccaccagggcgacggggcatcccagacctccggcgagcagatccaaccttccgccactatccaggaaacccaacaatggttattgaagaaccgcttctcctcgtatactcggctcttctctaatttctcaggggccgacttactcaaactgaccaaagaagatctggttcagatatgcggcgccgccgatggaattcggttgtataactcactgaagtcacgtagtgtgaggcctaggctcacaatctacgtgtgccgcgagcagccgtcctctactgtgctgcaagggcagcagcaagctgctagctcagcgtccgagaatggatctggagcaccctatgtctatcacgccatctacttggaagagatgattgcaagtgaggtggcacggaagctagcgctggtattcaatattccgctccaccagattaatcaggtttaccggcagggcccaaccggaatccacatactggtcagcgatcagatggtgcagaatttccaggacgaatcgtgcttcctgttctctaccgtgaaagctgagtcttctgacggtattcatatcattttgaaatag

SEQ ID NO: 140129 - DNA, 1515 bp, Artificial Sequence
  Description of Artificial Sequence: Synthetic coding sequence
atggcctgggttctgaagatggatgaggtgattgagagtggcctggtgcacgatttcgacgccagcttatctggaattggtcaagaattaggagcaggagcttacagtatgagcgacgtcctcgccctgccaatcttcaaacaggaggacagctctctgcccttggatggggaaaccgagcaccctccgttccagtatgtgatgtgtgccgccacctctcctgccgtgaaactgcatgatgagaccttgacctacctcaatcaaggccagtcctacgagattaggatgctggataataggaagatgggagatatgcccgagattaatggcaaacttgttaaatctatcattagagttgtatttcacgataggcggctgcagtacaccgaacatcagcagctcgagggctggaagtggaacaggccaggagaccgtctcctggatttagatattcccatgtccgtaggcatcatcgacacaagaacaaacccaagtcagctgaatgccgtcgaattcctgtgggacccagccaagagaacctccgccttcatccaagtgcattgcatctctacagagtttacaccccggaagcatggaggagaaaagggcgtgccctttcggattcaagtggacacgtttaagcagaacgagaatggcgaatatacggatcacctgcacagtgcatcatgccagattaaggtgtttaagcctaaaggagccgatcgaaagcagaaaactgacagagagaagatggagaagaggactgcacacgagaaggagaagtaccagccctcatacgataccaccattctgacagagtgtagcccatggcccgatgcacctaccgcctacgtcaataactcaccgagtccggctcctacgttcacctcaccacagcagtctacttgttctgtcccagacagcaacagttcttcacctaaccaccagggtgatggagcatctcagaccagcggggaacagattcagccgtcggccaccatacaggaaacccagcagtggcttctgaaaaacaggttttcatcctacacaaggctatttagcaacttcagcggagcagacctcttaaagctcacaaaggaggatctggtacagatctgcggcgcggccgatggtatccgcctgtataattccctcaagtctaggtctgtaagaccaaggttgacaatttacgtgtgtagagaacagccttccagtacggtgctacaaggccagcagcaggccgcttcttctgcctccgagaatggctcaggcgccccttacgtgtaccatgcaatctatctcgaagagatgatagcttctgaagtagctcgcaagcttgctctagtgttcaatatccccctgcaccagatcaatcaggtgtaccgccagggaccaaccggcattcacatcctggtgagcgaccagatggtgcaaaacttccaagatgagtcttgctttttgttttctactgtgaaggccgaaagtagtgatgggattcacattatcctgaaatag

SEQ ID NO: 140130 - DNA, 447 bp, Artificial Sequence
  Description of Artificial Sequence: Synthetic coding sequence
atggcatgggtgctcaagatggacgaggtgatcgaatccggccttgtacatgatttcgatgcgtccctgtcaggtatcggccaggaactgggcgccggggcatattccatgtcggatgtgctcgcgctgcccatcttcaagcaggaggattccagcttgcccctcgacggcgaaactgaacaccccccattccagtacgtcatgtgtgccgctacatcacccgccgtgaaactgcacgacgaaactctgacgtatctgaatcaaggtcagtcgtacgagattcggatgctcgataatcggaagatgggagacatgccagagataaatggaaagctcgtgaaatccatcattcgcgtagtctttcacgataggaggcttcagtataccgaacaccagcagttggagggatggaagtggaaccggcccggagatcgacttctcgattag

SEQ ID NO: 140131 - DNA, 2295 bp, Artificial Sequence
  Description of Artificial Sequence: Synthetic coding sequence
atgaacggagaagccgactgccccactgatttagagatggcggccccaaaaggacaagataggtggagtcaggaggatatgctgactttgctggagtgcatgaagaataatcttccttccaacgactctagtaaatttaaaaccacggagtctcacatggattgggagaaagtggccttcaaggatttttccggtgacatgtgcaagctcaaatgggtcgagattagtaatgaagtgcgcaaatttagaactctgactgaactcatcctagatgctcaggagcatgtgaagaatccatataaaggaaagaaacttaagaagcatcccgatttccctaagaaaccactgaccccctacttccgcttttttatggaaaaaagagcaaagtacgccaagctgcatccagagatgtcaaatttagatttgacgaaaatattatccaagaagtataaggagttaccagagaagaaaaaaatgaaatatattcaggattttcagagagagaaacaggaatttgagcgcaatctagcgcgctttcgtgaggatcatccagacctgatacagaacgctaaaaagtcagacatccccgaaaaacctaagaccccccagcaactgtggtacacccacgagaagaaggtgtatctgaaggttagaccagacgcgaccacgaaagaggtgaaagatagtttgggtaagcagtggagccaactgagtgataagaaaaggctcaagtggattcataaagcccttgaacagagaaaagagtatgaggagataatgagggattacattcagaaacacccggaacttaacatcagcgaggaggggattacaaaaagtactctgacaaaggccgagcggcaactgaaagataaattcgatggacggccgacaaagccacctccaaatagttattcactttactgcgctgaactgatggcgaatatgaaggacgtgccttccaccgaacggatggtgctatgctcccagcagtggaaactgctcagccaaaaggagaaagatgcatatcacaagaaatgtgatcaaaagaagaaggattacgaagtcgagctgctcaggtttctggagtccctcccagaagaggaacagcagagggtcttgggggaggaaaaaatgttaaatatcaacaaaaaacaggccacttctcctgcatcaaagaaacctgcccaggaaggcgggaaggggggctccgagaagcctaagcggccagtatccgctatgtttattttttcagaagagaaacggagacagctgcaggaggagaggcctgagctgtcagagagcgaacttacaaggttattagcaaggatgtggaatgacctgtccgagaagaaaaaggccaaatataaggcaagagaagcggccctgaaggcccagtccgagagaaagcccggaggcgaaagggaagaacgtgggaagctgcccgagagtcctaaacgtgcggaggaaatatggcagcagagtgtgatcggcgactatctggctagattcaaaaacgaccgcgtcaaagccctaaaagcaatggagatgacatggaacaatatggaaaaaaaagaaaaactgatgtggatcaaaaaggccgccgaggatcagaaaagatatgagcgggaactaagtgaaatgagagcccccccagctgctacaaacagctccaagaagatgaagttccagggtgaacctaagaagcctcccatgaacggttatcagaagttcagtcaagaactcctcagcaacggcgaactaaaccatttacctctcaaggaaaggatggtggagattggtagtcggtggcagaggattagccagagtcagaaagagcactataagaagttggctgaggagcagcagaagcagtataaggtgcaccttgacctctgggtgaaaagtctcagtcctcaggatcgtgctgcttacaaagaatacatatccaacaaaaggaagtccatgaccaagcttagaggccctaatcccaagagcagtagaacaaccctacagtccaaaagcgaatcagaggaggatgacgaggaagacgaagatgatgaggatgaggacgaggaggaggaggacgacgaaaacggcgactcttccgaggacggaggagatagttccgaaagctccagcgaagacgagtcagaggatggggacgaaaatgaagaagacgatgaggacgaagacgatgacgaggacgatgatgaagatgaagataatgagagtgagggctcatcctcatccagcagcagcagcggcgactcctctgattcagattccaactag

SEQ ID NO: 140132 - DNA, 2184 bp, Artificial Sequence
  Description of Artificial Sequence: Synthetic coding sequence
atgaatggagaagcggattgccccacggacttggaaatggcggcccccaagggccaggataggtggagtcaagaagacatgttaactctgctcgaatgcatgaagaataatctgccaagcaatgactcatcaaagtttaagacaacagagtcccacatggactgggagaaagtggctttcaaagacttctctggcgacatgtgcaaattgaagtgggtggagatttcaaatgaggtaaggaaatttcggactctgaccgagttaatcctcgacgcacaggaacacgtgaagaatccttataaaggcaagaagctaaagaaacaccccgattttccgaagaaacctttgactccctatttccgcttttttatggagaagagagccaaatacgccaagctgcatcctgaaatgtcaaatctggacctcacaaagatcttgtctaagaaatataaagaactgccggagaagaagaagatgaagtacatccaggattttcaacgtgagaagcaggaattcgagaggaatttggccagatttcgggaggatcacccagacttgattcagaatgcaaagaagtcagatataccagaaaagcctaaaaccccccagcagctctggtatacacacgaaaagaaggtctatctaaaggtccgaccagatgagattatgcgcgattatattcagaagcatcctgaacttaacatcagcgaggaaggtataaccaaaagcacactgacaaaggccgaacggcagctgaaggacaaattcgatggacgaccaactaaacccccccctaattcctattctctctactgtgctgagctgatggctaatatgaaagatgtcccctccaccgaacggatggtcctgtgcagtcaacagtggaagctactctcgcagaaagaaaaggacgcctatcacaagaaatgtgaccagaaaaagaaggactatgaggtggagcttttgcgtttccttgaatcgcttccagaggaggagcagcagcgggtgctgggtgaggaaaagatgcttaatatcaacaagaagcaggccacatcgcccgcatctaagaaaccggcgcaggagggaggcaaaggcggcagtgagaaacctaagcggcccgtgagcgctatgttcattttctccgaagaaaagaggaggcagcttcaggaggagagacccgagctcagcgagtcggaattgacaagactgcttgcacgcatgtggaacgacttgtccgagaagaaaaaggccaagtataaggccagggaggctgccctgaaagcacagtcagagcgcaaacccggaggggagcgggaagagagagggaagctgcccgagtccccgaaaagggcggaggagatctggcagcagtccgttatcggcgactacctagcaagattcaaaaatgatcgagtaaaggctcttaaagcaatggaaatgacctggaataacatggagaaaaaggaaaagttgatgtggatcaaaaaggctgcagaagaccagaagcgttacgaacgggagctatctgagatgagggcacctcccgcagctaccaatagctctaagaaaatgaagttccagggagaaccgaaaaagccgcccatgaacggctatcagaagttcagtcaggagcttttgtccaacggggagttgaaccatctgcctcttaaagaaagaatggtcgagataggatctcgttggcagcgcatatcccagagccaaaaagaacactataagaaacttgcggaagagcaacaaaagcagtacaaagtgcacctggacctgtgggtcaagtctctgtcaccccaggacagagccgcctataaagagtatatcagcaataagcgcaaatcaatgacaaaactgagaggaccaaatccaaagagcagtagaacgacactccaatccaagagtgaatcagaagaggacgatgaggaggatgaggacgatgaagatgaggatgaagaagaagaagatgatgagaacggggatagttcagaagatggaggcgactcgtctgagagctccagcgaggacgagtccgaggacggagatgagaacgaggaggacgatgaggacgaggacgacgacgaagacgacgacgaagacgaggataatgagagcgaaggatcgtcctcatcttctagctcgtctggggattcctcagatagtgactcaaattag

SEQ ID NO: 140133 - DNA, 2184 bp, Artificial Sequence
  Description of Artificial Sequence: Synthetic coding sequence
atgaatggcgaggcagactgccccacggatctggaaatggccgccccgaagggccaagaccgatggtcacaggaagacatgctgaccctgctcgaatgtatgaaaaacaatctgcccagcaacgacagtagcaagtttaaaactactgagagccacatggactgggaaaaggttgccttcaaggatttctccggagatatgtgcaagctgaagtgggtggagattagtaatgaagtacgaaagttccgaacactgacagagctgatcctcgacgcacaggagcacgttaaaaatccttacaagggcaagaagctgaagaagcatccagatttccccaagaaacctcttactccctactttagattcttcatggagaagagggctaagtatgccaagctccaccctgaaatgtcaaatctagatctgactaaaattctcagtaagaagtacaaggagctgccagagaagaagaagatgaagtatatccaggacttccagagagagaaacaagagttcgaacgaaatttggctagattcagggaggaccaccccgatttaattcagaatgccaagaaatcggacatccctgagaaacccaagacccctcaacaactgtggtacacacacgaaaagaaagtctatctgaaagtccgcccggatgagatcatgagagactatattcaaaaacatccagaattgaacattagcgaagaagggataaccaagagcactctgaccaaagctgagaggcagttgaaggacaagttcgacgggagacccaccaaaccccccccaaattcgtacagcttgtactgtgctgaactcatggcaaatatgaaagacgttccgtccacagagagaatggttttgtgttcacagcaatggaagctcctatcacagaaggaaaaggatgcttaccacaagaagtgtgatcagaagaagaaggactacgaagtggaactactccgctttcttgaatctttgcccgaagaagagcagcagagggtgctgggtgaggagaagatgctgaatatcaacaaaaagcaagccacctccccagccagcaaaaagccggcccaggagggaggcaagggcggctccgagaagccgaagaggccagtttcggccatgttcattttttccgaggaaaaacgtcgacagctccaagaggagcgtccagagctctccgagtcagagctaacaagactgttagctaggatgtggaacgacctcagcgaaaagaagaaggcgaaatacaaggcccgcgaggccgccctgaaagcacagtccgagcggaaacccggaggggagagggaagaacggggaaaactgcctgagagcccgaaaagggcagaagaaatctggcaacagagtgtgatcggggattatctggcccgattcaagaacgatcgcgttaaggccctgaaggctatggagatgacctggaacaacatggagaagaaggagaaacttatgtggatcaaaaaagctgcagaagaccagaaaagatatgaacgggaactaagcgagatgcgggcccctccggccgcaactaactcttccaaaaaaatgaaattccagggcgaaccgaagaagccgccgatgaacggttaccaaaaattttcacaagagctgttgagtaacggggagctgaatcatcttcctttgaaagaaaggatggtggagataggatctagatggcagcgtatttcgcaatcacagaaggagcactataagaaattggcagaggagcagcagaagcagtataaagtgcacttggatctgtgggtaaagagcctctctcctcaggatcgggccgcctacaaggagtacatatctaacaagcggaaaagtatgactaagcttcgcgggcccaacccaaaatcttcccgcaccacactgcagtcaaagagtgagtcggaagaagatgatgaggaggatgaggacgacgaagacgaggatgaagaagaggaagacgatgagaatggagactcatcagaggacggcggggacagctccgagagttcatctgaggacgaatctgaagacggcgacgaaaatgaagaagatgacgaagatgaagatgatgacgaggacgacgatgaggatgaggataatgaatcagaaggttcctcttcttcaagcagtagtagcggcgatagtagcgacagcgactctaattag

SEQ ID NO: 140134 - DNA, 2295 bp, Artificial Sequence
  Description of Artificial Sequence: Synthetic coding sequence
atgaatggagaggcagattgtcccacagacctggaaatggccgcccccaaaggtcaagaccggtggtctcaggaggacatgctcaccctgcttgagtgtatgaaaaacaacctgcccagcaacgattcatctaagttcaagacaaccgagagtcacatggactgggaaaaagtggcttttaaagatttttcgggagatatgtgcaaattgaaatgggtggagatcagcaacgaagtccgaaagttccgcaccctgaccgagttgatcctggatgctcaggaacacgtgaaaaacccatataaaggtaagaaactcaagaagcatcctgactttcctaagaagcctctgactccgtactttaggtttttcatggagaagagggctaagtatgctaaactgcatcctgagatgagtaacctagatctgactaagatcctgtctaagaaatataaggagttgcccgagaagaagaagatgaagtatatacaggacttccaaagagaaaaacaggagttcgagagaaacctggcccgctttcgggaggatcaccctgacctaattcaaaatgccaagaaatctgatatccctgagaagccaaaaacaccacagcagctttggtatacgcatgagaagaaagtttacctgaaagtgagacccgacgccacaacaaaggaagttaaagatagcttgggcaaacagtggtcgcagctgtcagacaagaaacgactcaagtggattcataaagccttggaacagcgaaaggaatatgaggaaattatgagggactacatccaaaaacatcctgagctaaacatctccgaggagggaattaccaaatctaccttgactaaagctgaaaggcagctgaaggataagttcgatgggcggcctactaagccccctccgaacagttacagtttatattgcgccgaactgatggccaacatgaaagatgtgccaagcacagaacgtatggtgctttgcagccagcagtggaagctgctgagccagaaagagaaagacgcctaccataagaagtgtgatcaaaagaaaaaggattacgaagtcgagctgctccggtttcttgaatccctgcctgaggaggagcagcagagagtgctgggagaagaaaaaatgctcaatatcaataagaagcaggccacatcacccgccagcaaaaaacccgctcaggagggtggcaaaggtggttccgagaagcctaaacgacccgtgagcgcaatgtttatcttctctgaagaaaaaaggcgtcagctccaggaggaacggcccgagctgagcgaatctgagctgacacgcttattggcgcgaatgtggaatgatctctcagaaaagaagaaggcaaaatacaaggcgcgggaggctgccctgaaagctcagtccgaacgaaagccaggcggcgaacgggaggaacgaggaaagttgcccgagagcccaaagagggccgaggagatctggcagcagtcagtgataggggactacctggcaaggttcaagaacgatcgggtcaaagctttgaaggccatggaaatgacttggaacaatatggagaagaaggagaaattaatgtggatcaaaaaagccgctgaggatcagaagcggtatgagcgtgagctatcggagatgagagcgcctcccgcagccactaatagcagcaagaaaatgaagtttcagggcgagcctaaaaagccaccaatgaacgggtatcagaaattttcccaggaattgttgtccaacggcgaactcaatcacttacctttgaaggagcgaatggttgagatagggtctaggtggcaaagaatctcccagagccagaaggagcactacaagaagctggctgaagagcagcagaaacaatataaggtccacctggacctgtgggtcaagtccctgagcccgcaagaccgggctgcctataaggaatatatctccaataagcggaagtctatgactaagctccggggaccgaatcccaagagctctcgaactaccctgcagagtaagtctgaaagcgaggaggatgacgaagaggatgaagatgacgaagacgaagacgaggaagaagaagacgatgaaaacggcgactcatccgaggatggcggggactcttctgagtcttcaagtgaggatgagtccgaagacggagatgagaacgaagaggatgatgaagatgaagatgacgacgaagatgacgatgaggacgaagacaacgagagtgagggatcaagttcttcatcaagctcctctggtgatagctccgatagcgatagcaattag

SEQ ID NO: 140135 - DNA, 2184 bp, Artificial Sequence
  Description of Artificial Sequence: Synthetic coding sequence
atgaacggcgaggccgactgtccaaccgatctcgagatggctgctcccaagggacaggataggtggagccaggaagacatgttaacccttcttgaatgcatgaagaataatcttccttctaacgatagtagcaaattcaagacgacagaatcccacatggattgggagaaggttgcttttaaggacttttctggcgacatgtgcaaactgaagtgggtggaaatttccaacgaggttcgcaagtttagaacactgacagaactgatcctcgacgcccaggagcacgttaaaaacccgtataagggtaagaagctaaaaaaacatcctgactttccgaaaaaacctcttactccctatttccgattctttatggaaaagcgcgcaaaatacgctaagttgcatccagagatgtccaaccttgacctcacaaagatactatccaagaagtacaaggaactgccagaaaaaaagaagatgaaatacattcaggatttccagcgcgagaagcaagaattcgagagaaacctggctcgatttagggaggatcatccggatctcatacagaatgctaagaagtctgacataccagagaagcccaaaactccacagcagctgtggtatacacacgagaagaaggtctacctgaaggtgaggcctgatgaaatcatgagagattatatccaaaagcaccctgagctgaacatctccgaggagggcataaccaagagtacattgacaaaggctgagcgccagctgaaggacaagtttgacggtaggccgacgaaaccacccccgaattcctacagtctgtactgcgcagagctgatggccaacatgaaggatgtgccgagtacagagagaatggtcctgtgtagtcagcaatggaagcttctgtctcagaaagagaaggatgcttatcacaagaagtgtgatcagaaaaaaaaggactacgaggtggagttgctccgatttctcgaaagcctacctgaagaggagcagcagcgggtcctgggcgaggaaaagatgctgaacatcaacaaaaagcaggctactagcccagcaagcaaaaaacctgcgcaggagggaggaaaagggggcagtgagaaacccaagcgtcccgtgtcagcgatgtttatcttttcagaagaaaaacggcgacagcttcaagaggaaaggccagagctctcagagtcggaattgactaggctgttagcaaggatgtggaatgatctgagtgaaaagaagaaagccaaatataaagcaagggaggccgcgttgaaggcacagagcgagagaaagccagggggagagagggaggaaagaggtaagcttcctgagtccccgaagcgagctgaagagatctggcagcagtccgtgattggtgactacctggctaggttcaaaaatgatcgggtcaaggccttgaaggccatggaaatgacttggaataatatggaaaagaaggaaaaactgatgtggatcaaaaaagccgcagaagaccagaaaaggtatgagcgagagctttccgagatgcgcgctcctcccgccgctacgaactcgtctaaaaaaatgaaatttcagggcgagccaaaaaaaccacccatgaacgggtatcagaagtttagccaggagttgctgtctaacggcgagttgaatcacttgcccctgaaggaacgcatggtagagatagggtcccggtggcagaggataagtcagtcgcagaaggaacattacaagaagctcgctgaagagcagcagaagcaatacaaagtgcatctcgacctgtgggtgaaaagtttaagcccgcaggaccgggccgcctacaaggagtacatcagcaacaaacgcaagtcgatgaccaagctccgtggacccaaccccaagagcagtcggaccacacttcagagtaagagtgagagtgaggaggatgacgaggaagatgaagacgacgaagatgaggacgaagaagaagaagatgatgagaacggcgattcgtcggaggatggcggcgactcctccgagagttctagcgaggatgagagtgaggacggagacgagaacgaggaggatgatgaagatgaagatgatgatgaggacgacgacgaggacgaagataacgaatccgaaggatcctcctctagctcttcctccagcggtgattcctccgactcagattctaattag

SEQ ID NO: 140136 - DNA, 2295 bp, Artificial Sequence
  Description of Artificial Sequence: Synthetic coding sequence
atgaatggagaggcagattgcccaactgatttagaaatggccgcaccaaagggtcaggaccggtggtcccaggaagatatgcttactcttctcgagtgcatgaagaataatctcccctctaatgactctagcaagtttaaaactacagaaagtcatatggactgggaaaaggtagctttcaaggacttcagtggtgacatgtgcaagctgaaatgggtagagatcagcaatgaggtgagaaagttcagaactctcacagagcttatcctcgatgctcaggagcatgtgaaaaatccatacaagggcaagaagttgaaaaaacaccccgactttcctaagaaacctctgactccctacttccgcttcttcatggagaaacgggcaaaatacgccaaactccatcccgagatgtccaacctcgacctgaccaaaatcctctcgaagaagtacaaggaacttccagaaaagaagaaaatgaaatatatccaggatttccagagagagaaacaggagttcgagagaaacctcgcacgtttcagagaggaccaccccgacctgatccagaatgcaaaaaaatcagatataccagagaagcccaagacaccccagcagctgtggtacactcacgagaaaaaggtatatctgaaagtccggccggatgcaaccaccaaagaggttaaggattctttagggaaacagtggagccagctgagtgacaaaaaacggctcaagtggatacacaaggcactggagcagcgcaaggaatatgaagaaatcatgagggactatatccagaaacaccctgaattgaacattagtgaagaaggtatcactaaaagcaccctgactaaggctgaaagacaactcaaggataagtttgatggtcgaccaaccaaacctccgccaaattcttattccctatattgtgccgaacttatggccaacatgaaggacgttccttctaccgagagaatggttctgtgtagtcagcagtggaaactcctgagccaaaaggaaaaggatgcttaccacaaaaaatgcgatcagaaaaaaaaggattacgaggtggaactactgcgctttcttgagtccctaccggaggaggaacaacagcgcgtcctgggtgaggagaaaatgctgaacattaataagaagcaggccacctcacccgcatccaagaaaccggctcaggaaggaggaaagggtggcagtgagaagcctaaaaggcctgtctccgcaatgtttatattttcagaggaaaagcgacgccaactgcaggaagaacgacctgaacttagcgaatccgaactaacccgtctcctggcgagaatgtggaacgatctatctgaaaagaagaaggccaaatataaggccagggaggcagctctgaaggcccagtcagagcgcaaaccaggtggcgaacgggaggagcgtggaaagctccccgagagccccaaacgagccgaagaaatttggcagcagtctgttatcggggattatctggctcggtttaaaaacgacagagtgaaagctctaaaggcaatggaaatgacatggaataatatggagaagaaggagaagctaatgtggattaagaaagccgccgaggaccagaagcgttatgaacgggagttaagtgaaatgagagcacccccggctgctactaatagctccaagaaaatgaagtttcagggagagcccaaaaagccccctatgaatggttatcagaaattcagccaagaactgctctccaatggggagctgaatcacctacccctgaaagaacggatggtagaaatcggcagtcggtggcagcggatctcccagagccagaaggagcactacaagaagttggctgaagaacaacaaaagcaatataaggttcacctcgatttatgggtaaagtccctctctccgcaggatcgcgcggcctacaaagaatatatctccaacaagaggaaatctatgacaaagctgcgcgggcccaaccctaagtctagccgcacaacactgcagagcaaaagtgaaagtgaggaagacgatgaagaagatgaggacgatgaggatgaagatgaagaggaggaggacgacgaaaacggagatagctcggaggatggcggcgatagcagcgaatcaagcagcgaggacgagtctgaggatggagacgagaacgaagaagacgacgaggacgaggacgatgacgaggacgacgacgaggatgaagacaatgagtctgagggaagttctagctcatcctcttcgagtggcgacagttcggatagcgacagtaattag

SEQ ID NO: 140137 - DNA, 2184 bp, Artificial Sequence
  Description of Artificial Sequence: Synthetic coding sequence
atgaatggcgaggccgactgccccactgacctggagatggccgcgcctaaggggcaggaccgctggagccaagaagacatgttgacgctcttggagtgcatgaagaacaatttaccgtccaatgatagcagcaagttcaaaaccacagaatcacacatggattgggaaaaagtggcctttaaagattttagtggcgacatgtgtaaactcaagtgggtcgagatcagcaacgaggtgcgaaaattccgaactttaaccgagctgatattagatgcgcaggagcacgtaaagaatccctacaagggaaagaagctcaagaagcaccctgacttccctaagaagcccctcactccgtatttcagattcttcatggagaaacgcgcaaaatacgcgaagttacaccccgagatgtcaaatcttgatctgaccaagattctttcaaaaaagtacaaggagctgccggagaaaaagaagatgaaatatattcaagatttccagcgtgaaaaacaggaatttgaaaggaacttagctcggtttcgggaagaccaccccgacctgattcagaacgcaaaaaaaagtgacattcccgaaaaacctaagaccccccagcagctgtggtacactcacgagaagaaggtttatttgaaagtgcgtcccgatgagattatgagggattacatccagaagcaccccgaactcaatataagcgaggaagggattaccaagtccacactgactaaagcggaacggcagcttaaggacaaatttgatggacggcccactaaaccacctcctaattcttacagtctatattgcgccgagttgatggccaacatgaaagacgtgccttctactgagcggatggtcctgtgctctcagcagtggaaactgttgtcccagaaagagaaggatgcttaccacaaaaaatgcgatcagaagaagaaggactatgaggtagagctgctgaggtttctggagtctctgcccgaggaagagcagcagcgggtgcttggggaagaaaagatgcttaacatcaacaaaaagcaggccactagccccgcttcaaagaagcccgcacaggaggggggaaaaggcgggtccgagaagccaaagcgccctgtgtccgctatgtttattttcagcgaggagaagagaaggcagctacaggaggaaagaccagagctatccgagtcggagcttacaaggctgctggcaaggatgtggaacgatctgagtgagaagaagaaagccaagtataaggctcgggaggccgcactgaaggcacaaagcgagcgcaagccagggggggaacgagaggagcgcgggaagctgcccgagtcccctaaaagagccgaggagatttggcagcagagcgtgataggtgactacttagcacggtttaagaacgatagagtgaaagcactgaaggccatggagatgacttggaataacatggaaaagaaagagaaacttatgtggataaagaaggcagctgaggaccagaaaaggtacgagagggaattgagcgaaatgcgtgctccccctgctgcaaccaactcaagtaagaagatgaaattccaaggggaacccaaaaagcctcctatgaatggctatcaaaagttttcccaggaattgttgagcaatggcgaactgaatcacctccccctgaaggagcgaatggttgaaataggctccagatggcagaggatttctcaatctcagaaagaacattataagaagcttgctgaggaacagcaaaagcagtataaagtgcatttagacctttgggttaagagtctgagccctcaggatcgcgcggcctacaaagagtatatctcaaataagcgtaagagtatgactaagctgcggggcccgaatccaaaatccagcagaacaacccttcagtccaagtcagagagcgaggaggacgacgaggaggacgaggacgacgaagacgaggatgaggaggaagaagatgatgagaacggtgacagttcagaggacggtggagacagctcggaaagctccagcgaagatgaatccgaggacggcgatgaaaacgaggaggatgatgaagacgaggacgacgacgaggatgacgatgaggacgaagataacgagagtgaagggagctctagttcatccagtagttctggtgatagtagcgacagtgattccaattag

SEQ ID NO: 140138 - DNA, 849 bp, Artificial Sequence
  Description of Artificial Sequence: Synthetic coding sequence
atgaagggacagcaaaaaacagccgagaccgaggaagggactgttcagatacaggaaggcgctgtcgctacaggagaggaccctaccagcgtggctatcgcatcaatccagtccgccgctacatttccggatcccaatgtgaaatatgtgtttagaactgaaaacggtgggcaggttatgtatagggtgatacaggttagtgaggggcaactagatggccagactgaggggacgggcgctattagtgggtacccggccacccagtcaatgacacaggcagtcatccaaggcgcctttacaagcgatgacgcagtcgatactgagggaacagccgccgagacccactacacatatttcccttctacagcggtcggagatggtgcgggcggccaattttttgtgatgatgagccctcaggaggtactgcagggcggctctcagcggagcatcgctccccggacacatccatactcccctaagtccgaggctcctagaaccacacgagacgagaagcggcgagcacagcacaatgaagtcgagagacggcgacgggacaagatcaataactggatagtgcagcttagcaagatcatcccggactgctccatggagagtaccaagtcagggcagagtaagggggggatattaagcaaggcctgcgactatattcaggaattgaggcaatccaaccaccgcttgtccgaggagcttcaagggctcgaccaactgcagctggataacgatgtgctacggcagcaggtcgaggacctcaaaaacaagaacttattgttgcgggcccagctacgccatcacggtctcgaggttgtgataaagaacgactcaaattag

SEQ ID NO: 140139 - DNA, 933 bp, Artificial Sequence
  Description of Artificial Sequence: Synthetic coding sequence
atgaagggtcagcaaaaaactgctgagaccgaagaaggtactgtccagatccaagagggtgctgtcgctaccggtgaagacccaaccagcgtggccatcgccagtatacagtctgccgcgacctttcctgaccccaatgtaaaatatgtgttcagaaccgaaaatggcggtcaggtcatgtacagagtcattcaggtcagtgaaggtcaattggacgggcagaccgaaggaaccggggctattagcggatatcccgccactcaaagcatgacccaggctgtgattcaaggagcgtttacctcagatgacgcggtagatactgagggtactgctgcagaaacacactacacatattttccgtctaccgctgtgggggatggcgccggtgggaccacatcggggagcacagccgcggtcgtcacaacacaggggagtgaagctttgctcggacaggccaccccacccggaacaggacagttttttgtcatgatgtcccctcaggaggtgttacaggggggttcccagagatctattgccccaagaacccacccatactcgcccaaaagcgaggcccctcggacaacacgggacgagaagcgacgcgcccaacataatgaggtagagcggcggaggcgcgacaagattaataactggatcgtgcagctgagcaagataatccccgattgcagcatggaatccactaagtctggacagagcaaagggggcattctgtctaaggcttgcgattacattcaagagctgcgacagagtaaccacaggctgtccgaagagctccagggactcgatcagcttcagctggacaacgatgttttacggcagcaggttgaggatcttaagaataaaaatttacttcttagagctcagctacgacaccacgggttggaagtcgtgataaaaaatgactcaaattag

SEQ ID NO: 140140 - DNA, 933 bp, Artificial Sequence
  Description of Artificial Sequence: Synthetic coding sequence
atgaaaggccagcagaaaacagctgagaccgaggaaggtactgtccagatccaggaaggggctgtagccacaggggaagacccgacaagcgttgcaattgcatctatccagtccgccgcgactttccccgatcccaacgttaaatatgtcttcagaacggaaaatggcggacaagtaatgtaccgtgtcattcaggtgtccgaggggcagctggacggccagacggaaggcaccggggccatcagcgggtaccccgccactcaatctatgacccaagccgttatccaaggagcctttacttctgatgatgccgtggacaccgagggtacagccgccgagactcactatacatattttccctccactgctgtcggcgacggcgccgggggcactactagcggttcaaccgccgcagtcgtgacaacgcaggggagtgaagcacttttgggccaggccacaccccctggcacgggacagtttttcgtcatgatgtctcctcaggaggtattgcaaggtgggtcacagaggagcatcgctcctcggacccacccttacagcccaaaaagtgaggccccgcggaccacaagggatgagaagcgcagggcccaacacaacgaagtggagcgcaggcggcgagacaaaattaataactggatcgtacaactgagcaagatcatcccagattgttccatggagtctacaaagagcggccagagcaaggggggaatcctgagtaaggcatgtgactatattcaggaacttcggcagagcaaccatagactgtccgaagagctccaaggtctggaccaactccaactggacaatgatgtgctcaggcaacaggtggaagatctaaagaataagaacctgctactgcgcgcacagctgcggcaccacggactcgaggttgtgattaaaaatgactctaactag

SEQ ID NO: 140141 - DNA, 756 bp, Artificial Sequence
  Description of Artificial Sequence: Synthetic coding sequence
atgtatagggtcatccaggtgtccgagggccagttggatggccagacagaaggcacaggtgcaattagcggatatcccgcaacccagtctatgacacaggctgttatccagggggctttcacgagcgacgatgccgttgacaccgagggcactgccgccgagacccactatacctattttccgagcaccgctgtcggcgacggagcaggtgggacaacttctggatcaacagcggcagtggtaaccacacagggttcagaagccctgctgggccaggcaacccctcccgggactgggcagttttttgtgatgatgagcccccaggaggtgttgcagggcggatcccaacgctcgatagctccccgtactcacccatattctccaaaatccgaagccccacgcaccacaagggatgagaagcggcgcgcacagcacaacgaagtcgagcgacggcgacgggacaagatcaataactggattgtccagctatcgaagatcatcccagattgttcaatggagagcacaaaaagtgggcagagcaaaggaggaatactgtccaaagcgtgcgactatatccaggaactccgccaatctaaccaccgactgtcagaggaacttcagggtctcgaccagctccagttggacaacgacgttctccgccaacaagttgaagatctgaagaacaagaatctgctactccgtgcccagctccgccaccatggcctagaagtagttattaaaaatgattccaattag

SEQ ID NO: 140142 - DNA, 1155 bp, Artificial Sequence
  Description of Artificial Sequence: Synthetic coding sequence
atggccggcgccgagtggaaatcccttgaagagtgtctcgagaagcatctgcctctgcctgatctgcaggaggtgaaacgggtcctctatggtaaggagctgcgtaagttggacctgcctcgcgaggccttcgaggccgctagccgcgaagacttcgaactgcagggctacgcttttgaggccgcagaggagcaactccgtcgaccaagaatcgtgcatgtaggcttggtgcaaaatcgcattcccttgcctgccaacgctccagttgctgagcaggtgagcgcgctgcatagaaggattaaagccatcgtcgaggtggctgccatgtgcggagtgaatattatttgtttccaggaggcgtggacaatgcccttcgctttttgcactcgcgagaaattgccttggacagagtttgctgagtcggccgaagatggaccaaccacccggttctgtcagaaactggccaaaaatcacgatatggtggtggtgagcccaatcttggaacgggattccgagcacggggatgtcctctggaatacagccgtagtgattagtaatagtggtgctgtgttgggcaaaactcggaagaatcacatcccccgagttggagactttaatgaatcaacatactacatggagggcaacttaggacaccctgtctttcagacccagtttggaaggattgccgtcaatatttgctacggccggcaccaccctctgaattggctgatgtacagtatcaatggtgccgagattattttcaacccttccgccaccattggggctttatctgagagcctgtggcctatcgaagcaagaaatgctgccattgcgaatcattgctttacttgtgccatcaacagagtcgggactgaacatttcccgaatgaatttacatcgggagatggcaagaaggcacatcaagatttcggttatttttacggtagctcctatgtcgccgccccagacagttctaggacgcctggcctttctagaagcagagatggactgctggtggctaagcttgacctgaatctctgccaacaggtcaatgatgtgtggaacttcaagatgactggacggtacgaaatgtatgcaagagaattggccgaagccgtgaagtctaactactcgcctactatcgttaaagagtag

SEQ ID NO: 140143 - DNA, 951 bp, Artificial Sequence
  Description of Artificial Sequence: Synthetic coding sequence
atgctgggcgaggcccctgccgctccccgtctcgcaggctctgaagccaggtctctttggcaggggacacaagtctcagccctccatcgccgcattaaagctattgttgaagtggctgcaatgtgcggtgtcaacatcatttgcttccaggaagcctggaccatgcccttcgctttctgtacacgcgagaagctgccctggacagagttcgccgaaagtgcggaggatgggcctaccactcgcttctgccagaaactcgccaagaatcatgacatggttgtggtgagtccaatcctggagcgtgattccgagcacggggacgtcctctggaataccgcggtggtcatcagtaacagtggtgccgtgctggggaagacccgcaagaatcacatccccagagttggagatttcaacgaatctacatactacatggagggcaatctgggacaccccgttttccaaactcaattcggccgaatcgccgtgaacatttgttacggacggcaccatccactgaactggctgatgtattccataaacggcgctgagattatctttaaccctagcgctaccattggggcgctctccgaatcgctgtggccaattgaggctcgcaatgctgccatcgctaatcattgtttcacctgcgcgattaatagagtaggtacagagcacttcccaaacgaatttacgtcgggtgatggtaaaaaggctcatcaggacttcggttatttttacggctcttcctatgtcgccgcaccagactcaagccgcacccctggcctgagccggagtagagacggccttctcgttgccaagctggacctgaatctctgccagcaggtgaacgacgtgtggaattttaaaatgacaggccggtatgagatgtacgcgagggaactggctgaggcagtcaagtctaattatagcccaactatagttaaagagtag

SEQ ID NO: 140144 - DNA, 561 bp, Artificial Sequence
  Description of Artificial Sequence: Synthetic coding sequence
atggccggtgcagaatggaaatctttagaggagtgcctggaaaaacacctgcccctgcccgaccttcaagaggtcaagagggtactgtatggaaaagaattaaggaagctggacttgcctcgagaggccttcgaggctgctagcagagaagactttgagctgcaagggtacgcgtttgaggcggccgaggagcagttgcggcggcctaggatcgtacatgttgggctggtccagaataggattccacttccagcaaacgcgccggtcgcagagcaggtctctgcacttcaccggcgcatcaaggccattgtggaagtggccgcaatgtgtggggtgaacattatatgctttcaggaggcctggattctgcgacctcaccaccaggagcctcgtccaccatgctgctatgcaccctcctgttgcctcatcccatctgtgttcccccatcgctccgagagcatccgctctagtcccagcctgtatcaccacctagtgcaggcccctggatccagccccctggcttttgttatccctagttcgtggtcaccagtgccaagctag

SEQ ID NO: 140145 - DNA, 2955 bp, Artificial Sequence
  Description of Artificial Sequence: Synthetic coding sequence
atggacgacagatacccggcattacagagggctcaactgcgcctcgattttattcatgcgaatagcacgacacattctttcttgttcggggccttggctgagttacttgacaatgctcgggatgctggcgctgagcgattggacgtgttcagtgttgacaacgaaaagctccaaggtggttttatgttatgttttctggatgacggctgcggaatgtctccagaggaggcttccgacataatatactttggaaggtctaagaaacgcttatcaacccttaagttcatcggacagtacggaaacggacttaaatctggaagtatgagaatcggaaaagattttattctgtttactaaaaaggaggagacaatgacgtgcgtgttcttttctcagaccttttgcgaagaagagagtctttcagaggtcgtcgtgccgatgccatcttggctcatccgaactagagagtcggtcaccgacgatccacagaaatttgcgatggagctgtcaattatatacaagtactccccttttaaaacagaggcagagttaatgcaacagttcgatgtgatttacgggaaatgcggtacattgctggtgatctacaatctcaagttactgcttaacggcgagcctgagctcgatgtgaaaacagacaaggaagacatcctgatggcaggagctcttgaggacttccctgcccggtggagcttccgcgcatataccagcgtcttgtattttaatccatggatgcgtatctttatccaggccaagcgcgtgaaaacaaagcacctgtgttattgtctgtacaggcctcggaaatatctatacgttaccagtagcttcaagggcgcatttaaagacgaggtaaagaaggccgaggaggctgtgaagattgcggaaagcatcctaaaagaggcccaaatcaaggtcaaccagtgcgaccgcacaagcttatcaagcgcgaaggatgtgctgcagcgggccctcgaggatgtggaggcgaagcagaaaaacctgaaggagaagcagcgagaactgaagaccgccaggactctgagcttgttttacggcgttaacgtcgagaacagaagtcaggctggcatgtttatttattcaaacaatcggcttattaagatgcacgaaaaggttggaagccagttaaagctaaagagtctgttgggtgctggtgtcgtcgggattgtcaatatcccactggaggtgatggaaccctctcacaataagcaagagtttctcaacgtccaagaatacaaccatctgctaaaggtaatgggccaatatctggtccaatattgcaaagatacaggaataaataacagaaatctcacattgttttgcaatgaattcggctatcagaatgacatcgatgttgaaaaacctctgaattcattccagtaccagcggcgacaagcaatggggattccctttataatccaatgcgatttatgtctgaaatggagagtgctcccgtctagtacgaactaccaagagaaagaattttttgatatctggatttgcgcgaacaatcccaatcgtctggagaatagctgccaccaggtggagtgcttaccatccattccgctggggaccatgagcaccatctctccctcgaagaatgagaaggaaaaacaactaagagagtctgtcattaagtatcagaatcgcttagccgagcagcagccacagccccagttcatccctgtcgacgagattaccgttacatctacctgcctgacatcggcacataaagagaacacgaaaactcagaagattaggttactgggggatgatcttaaacacgagagtctgtctagctttgagctcagcgcttctcggagaggacagaagcggaatattgaggaaactgatagcgacgtcgaatatataagcgaaaccaagattatgaagaaaagcatggaggaaaaaatgaacagtcagcagcagagaattcccgttgcacttcccgaaaatgtaaagctggccgaacgttcccagagatcacagatcgccaatatcaccaccgtttggcgggctcagccaacagaaggatgcctgaagaatgcacaggcagcttcttgggaaatgaagcgcaagcaatcattgaactttgtggaagaatgtaaagtcctcactgaggacgaaaatacatctgattcagacataattctcgtgagcgacaaatccaatacagacgtgagtctgaagcaggagaaaaaagagattccactgcttaatcaggagaaacaggaattatgtaacgatgtactggcgatgaagaggagctcttccctccccagttggaaatccctccttaacgtgccaatggaagatgtgaatttgagtagcggccacatcgcacgcgtgagcgttagcgggtcatgtaaggtggcatccagccccgcttcttctcagagtacgccagtgaaagaaacagtgcgaaagctgaagagcaaactgcgggagattctgttatattttttccccgaacaccagttgcccagcgagctagaggagcctgcactctcttgtgagctcgaacaatgtcctgagcagatgaataaaaaactgaaaatgtgcttcaaccagatccagaacacttacatggtgcagtacgagaagaaaatcaagcgaaaactgcagtcaattatctacgattcaaatacaagaggcattcataatgagatctccctgggacagtgcgagaataagagaaagatttctgaggacaagctcaagaatctccggatcaagctcgcattgttgcttcagaaactgcagctcgggggacccgaaggcgacctggagcagactgatacctaccttgaagccctcctgaaagaggacaatttactcttccagaataacttaaacaaggtaaccatagatgctaggcaccggctgccgctggagaagaacgagaagacctccgaaaattag

SEQ ID NO: 140146 - DNA, 618 bp, Artificial Sequence
  Description of Artificial Sequence: Synthetic coding sequence
atgctggagattcttgagcagcaaaagaaagtggacgctgagaccgtgggaagagttaaacggttcatacaggagaacgtctttgtcgccgctaatcacaacggtagtccactttcaattaaggaggcacccaaggaacttagttttggcgcccgcgccgagctgcctcggatccaccccgtggcttctaaactgctgaggctgatgcagaaaaaagagacaaacctgtgtctgagtgccgatgtgtccctggccagggaattgcttcagctggcggacgcattaggtccttccatctgcatgcttaaaacgcacgttgacatcctgaacgacttcactttggatgtaatgaaggagctgatcaccctggccaaatgtcatgagttcctgatttttgaggatcgcaagttcgctgacataggcaacacagtgaaaaagcagtacgagggcgataaccttggtcagcagtacaactcaccccaggaggtcataggtaagcgtggttcagatatcatcattgtcgggagaggaataatctctgccgcagaccgcctcgaggcagcggagatgtatcgcaaggccgcctgggaagcctacttgagccgacttggggtatag

SEQ ID NO: 140147 - DNA, 1167 bp, Artificial Sequence
  Description of Artificial Sequence: Synthetic coding sequence
atgctgattaggagaaaagaaaccaaagactatggtacaaagcggcttgtggaagggacaattaatcctggagaaacgtgtctgatcatcgaggacgtagttacttctggaagcagtgtgctcgaaaccgtggaggtgcttcagaaggaaggccttaaggtgaccgatgcaattgttctacttgatagagaacaggggggaaaggacaagctgcaagcacacggtatcaggttacattccgtgtgcaccttaagtaagatgctggaaatcctagagcagcagaaaaaggtggatgctgaaacagtcggccgggtaaaacgatttatccaggagaacgtttttgtagccgccaatcacaacggatctcccctcagcatcaaggaggcacctaaagaacttagcttcggagcccgggccgagctgccccggatacacccagtcgccagcaagctgctgcgcctcatgcagaagaaggagacaaacctttgcctgtccgctgatgtcagtttggcccgtgaactgctccaactagctgatgcccttgggccctctatatgtatgctaaaaacacacgtggatattctcaacgatttcaccctggatgtcatgaaagaacttatcaccctcgccaaatgccatgaattcctgatttttgaggatcggaagtttgccgatatcggaaataccgtgaaaaagcagtacgaggggggcatctttaagatagctagctgggccgatctggtgaacgctcacgtggtccctggatccggtgtcgtcaagggtttgcaagaggtgggtcttccattgcatagagggtgcctactgatcgccgagatgtcgagcactggctcactggccactggagattatacccgagccgccgtgcgaatggctgaggaacattctgaattcgttgtaggctttatatcaggatcaagggtcagcatgaaacctgagttcctgcacctgacccctggagtgcagctggaggccgggggcgataatctgggacagcaatacaattctcctcaagaagtgatcggtaagcgaggcagcgatataattattgttggtagggggattatctcagcagccgacagattagaggctgctgagatgtatcgcaaggccgcctgggaggcgtatctgagtcgactcggcgtctag

SEQ ID NO: 140148 - DNA, 909 bp, Artificial Sequence
  Description of Artificial Sequence: Synthetic coding sequence
atgctcgagatactggagcagcaaaaaaaagtagatgcggaaaccgtcggacgggtcaagcgtttcatacaggagaacgtatttgttgcagctaatcacaacggaagccctctaagcataaaggaagcccccaaggagctcagttttggggcacgggctgaactgcctaggattcatcctgtggcctctaaacttctgaggctgatgcagaagaaggagacaaacctgtgcctctccgcggatgtaagtctggcccgggagctactgcagctagccgacgccctcggcccctcgatttgtatgctgaagacacatgtcgatatcctcaacgacttcacattggacgtgatgaaggaactgatcaccctcgcgaaatgtcacgagtttcttatttttgaggaccgcaaattcgcggacatcggaaataccgtaaaaaagcagtacgagggaggaatcttcaaaatcgcaagctgggctgacctggtgaacgctcacgtcgtaccagggagcggggtggtcaagggtcttcaggaagttggactgcctctacaccgaggctgcctcctcatcgcagaaatgtcttctaccggatctttagcgaccggagattatacgcgggccgccgttaggatggccgaggagcattctgagttcgtggtgggctttatctctggatccagagtgtcaatgaaacccgagtttctacacctcacacctggcgtgcaacttgaggccggcggggataatctgggacagcaatataatagcccacaggaagtaatcgggaaaagaggcagtgatattatcattgtcgggcgcggtattatctcagctgctgatcgtctggaggccgcggaaatgtaccggaaagcggcctgggaagcatatctgagcaggctgggcgtgtag

SEQ ID NO: 140149 - DNA, 933 bp, Artificial Sequence
  Description of Artificial Sequence: Synthetic coding sequence
atggccgcaacaggtgccaatgctgagaaggcggaaagtcataacgactgcccagtgagactacttaatcctaacattgccaagatgaaagaggacattctctatcactttaacctgactacgagcaggcacaacttcccagcactcttcggtgatgtcaaatttgtgtgtgtgggtggttccccaagcagaatgaaagccttcattcggtgcgtcggggcggagcttggcctggactgccctggacgcgactatccaaacatctgcgcaggaaccgatagatatgcgatgtataaggtgggacccgtattgtccgtaagccacgggatgggtatcccttctatttcaattatgctgcatgaacttattaaactcctgtattatgctcgctgctctaacgtgacgatcatcaggataggaactagtggtggcatcggcctcgagcctgggaccgtggtgattaccgagcaagctgtcgacacttgttttaaagccgaatttgaacaaatagtgctggggaaacgggtcatcaggaagaccgacctgaataagaagctcgtgcaggagttgctgctttgctccgccgaactgtcggagttcacaactgtggttggtaacaccatgtgtactttggacttttacgaggggcagggccgcctcgacggggctttatgtagctatacagaaaaagacaaacaggcttacctggaagccgcctatgctgctggggtccgcaatatcgaaatggaatctagcgtgtttgcggccatgtgctcagcatgtggcctccaggccgccgttgtgtgtgtgactttactcaaccgtcttgagggcgatcagatctcttcaccaaggaatgtgctgagcgaataccagcagaggccacagaggcttgtgtcctacttcattaagaaaaagctgtctaaagcctag

SEQ ID NO: 140150 - DNA, 933 bp, Artificial Sequence
  Description of Artificial Sequence: Synthetic coding sequence
atggcagccaccggcgctaacgctgaaaaggctgaatcacacaacgattgcccggttcggttgcttaatcccaacattgcgaagatgaaagaggatattctctaccatttcaatttgaccacttcccgacacaacttccccgcactttttggtgacgtgaaattcgtctgcgtaggagggtcacctagcaggatgaaggccttcatccggtgcgtaggggcagagctgggtctggactgccccgggagagattatccaaacatctgcgcaggcaccgatcgttacgcaatgtataaagtcggccctgtgctgtccgtcagccacggtatgggaattccctcgatttccattatgttgcacgagctgatcaaactcctgtactatgcgcggtgttccaacgtcactattataagaatcgggacttcaggcggtattgggctcgagccgggtactgtcgtgatcaccgagcaggcggttgacacctgctttaaagcggagtttgaacaaattgtcttggggaagagggtaattcgcaaaactgacctgaataagaagctcgtgcaagagctgctactctgttcagcggaactgtctgagttcaccacagtggtgggtaacaccatgtgcacactcgatttttacgagggtcaggggcgcctcgacggcgcactatgctcttatacagaaaaagataaacaggcctacctggaagccgcctacgccgcaggagtgcgaaacatagaaatggaaagcagcgtgtttgccgctatgtgcagtgcctgcggactgcaagcagctgtggtgtgcgtcactcttctaaaccgcctcgagggtgaccagattagttctcctcggaacgttttaagtgagtatcaacagagaccccaaagattggtaagttatttcataaaaaagaaactatctaaagcttag

SEQ ID NO: 140151 - DNA, 933 bp, Artificial Sequence
  Description of Artificial Sequence: Synthetic coding sequence
atggccgccaccggcgcaaacgccgagaaggccgagtcacataatgactgccccgtgcggctgctgaatccgaatattgctaaaatgaaggaagacatactgtatcactttaatttaacaacgtcccgacacaatttcccggcattatttggcgatgtgaaatttgtttgtgttgggggcagccccagcagaatgaaggccttcattcgctgtgttggagctgagctgggccttgactgtccaggcagggattatccaaacatctgcgccggaacagaccgatatgctatgtataaagttggccctgtgctgtcagttagccatggaatgggcatccccagtatctctatcatgctgcatgaactcataaagctactttattacgccagatgtagcaatgtgacaataattcggattggcacttcaggaggcattggcctggagcccggcaccgtcgtcataaccgagcaggctgtcgacacatgcttcaaggcagagttcgagcagatcgtactgggaaagagggtgattagaaaaacagacctgaacaagaagcttgttcaggagttgcttctctgcagcgctgagctcagcgagtttaccacagtggtggggaacaccatgtgcacgctagatttctatgagggacaggggagactcgacggggccttgtgtagctacaccgaaaaagataaacaggcttacctcgaggctgcctacgcagctggcgtgaggaacatcgagatggagagtagcgtctttgctgccatgtgtagtgcctgcggtcttcaagctgccgtggtttgcgtcacattgctgaatcggctcgaaggagatcagatatctagtccaagaaatgtactgagcgaataccagcagaggccacagcgccttgttagctactttatcaaaaagaagttatctaaagcatag

SEQ ID NO: 140152 - DNA, 435 bp, Artificial Sequence
  Description of Artificial Sequence: Synthetic coding sequence
atggctgccaccggggccaacgcggaaaaagcggaatctcacaatgattgtcctgtgcgcctcttgaaccccaatattgctaaaatgaaagaggacattctctaccactttaacttgacaacatcaagacataacttccccgcacttttcggagacgtaaaatttgtgtgcgtaggcggatcaccctctaggatgaaggcttttattagatgtgtgggcgcagaactgggtcttgattgccctgggcgggactatcccaacatctgcgccggtactgacagatacgctatgtacaaggtcggccctgtgctgtccgtctctcatggtatgggcatcccatcgatatcaataatgctgcatgagctcataaaactgctctactatgcccgttgttctaacgtgacgatcattcgtataggaactagcggcggatag

SEQ ID NO: 140153 - DNA, 516 bp, Artificial Sequence
  Description of Artificial Sequence: Synthetic coding sequence
atggccgctactggggccaatgccgaaaaggccgagtctcataatgactgccccgtgcgactgctgaacccgaacatagccaagatgaaggaggacatcctctatcacttcaacctgaccaccagtcggcataatttcccagctctcttcggggacgtgaagtttgtgtgcgttgggggcagcccctcgaggatgaaagccttcattaggtgtgtgggggcagaactgggcttagactgtccgggaagggattaccccaacatctgcgcgggcaccgatagatacgccatgtataaagtcggccccgttctgtctgtgtcacatggaatggggataccctcaatatccatcatgcttcacgagctcataaagttactgtattacgctcgctgctcaaacgtgactattattcgaattggtacgagtggtggaatcggtattctgaagcacctgaggcgtaaagacaccggcaagtcgaaaggcggcagagaacgaaggtctacaaagctgagatag

SEQ ID NO: 140154 - DNA, 522 bp, Artificial Sequence
  Description of Artificial Sequence: Synthetic coding sequence
atgcagaggaagctgaaagtgacgtcattggaaccgggcacggtcgtgataacagaacaggctgtagatacctgtttcaaagctgaattcgaacagatcgtgctggggaagcgggtgatacgcaagacagatcttaacaaaaaactcgtgcaagagttactgttgtgctcagctgagctgtctgaattcacgacagtggtaggaaatactatgtgcactcttgatttctacgagggtcagggcaggctggacggcgccctctgctcttatacagagaaggacaaacaggcgtatttggaagcggcctacgctgctggcgtgcggaacatagagatggaaagctcagtgtttgctgcaatgtgctctgcctgcggccttcaagccgccgtggtgtgcgtcacgttactgaatagactcgagggtgatcagatttcgtctcccaggaatgtactgagcgaatatcagcagcggccccagcgtctggttagttacttcataaagaagaaattatctaaggcatag

SEQ ID NO: 140155 - DNA, 90 bp, Artificial Sequence
  Description of Artificial Sequence: Synthetic coding sequence
atggctgcgactggagccaatgccgaaaaggccgaatcccacaatgactgccctgtgcggctgctcaacccaaacattgcgaagatgtag

SEQ ID NO: 140156 - DNA, 441 bp, Artificial Sequence
  Description of Artificial Sequence: Synthetic coding sequence
atggccgcgacaggggcaaacgccgagaaggcagagagtcacaatgactgcccggtgagattactaaatcccaacattgccaagatgaaggaggatattttataccactttaatcttactacaagcagacataacttcccagcactcttcggggacgtcaaattcgtatgcgtgggcggttctccgagtaggatgaaggctttcatcaggtgcgttggtgccgaactgggtctggactgtccaggcagagattacccaaacatatgtgccggcaccgacagatatgctatgtataaggtagggccagtactgagtgtgagtcatggcatgggtatccctagcatctccattatgttgcatgagttaattaagctgctgtattacgccagatgttctaacgttaccattatcaggattggaacatccggcggcatcggctag

SEQ ID NO: 140157 - DNA, 606 bp, Artificial Sequence
  Description of Artificial Sequence: Synthetic coding sequence
atggctagcgcaggaggcgaggattgcgaaagccctgcgccagaggctgatagaccacatcagcgacctttccttatcggagtcagcggtggcacagctagtggtaagagcacggtatgtgagaaaatcatggaactgttgggtcagaatgaggtcgaacagagacagcggaaggtagtaatcctgagccaggaccgcttttataaggtgctgactgctgagcagaaggccaaggcactcaaagggcaatacaactttgaccaccccgacgcgttcgacaatgatctgatgcacagaactctaaagaatatagtggaggggaaaaccgttgaggtgcccacgtacgattttgtgacccactccaggcttcctgaaaccacggtggtctatcctgccgatgtagtgctgttcgagggcatcctggtgttctattcccaagagattcgggacatgttccatctcagactgtttgtggacactgattcagacgttcgtctgagccgccgtgataaagaagtgtgccgatgtgatcatcccgcccgctcaggacagtacgggtgccaccagcctgatagggcggcccacccaggacacagcgagtggtag

SEQ ID NO: 140158 - DNA, 807 bp, Artificial Sequence
  Description of Artificial Sequence: Synthetic coding sequence
atggcaagcgccgggggcgaggactgtgaaagccctgctccagaggcggacaggccacatcagcgtccatttctgataggcagcaccgtgtgtgagaaaatcatggagttgcttgggcaaaatgaggtggagcagcggcagcgcaaggtcgtcattttgagccaagatagattctataaagtgcttacagcggaacagaaggctaaagccctcaagggccagtataactttgatcatcctgatgccttcgataacgacctgatgcacaggaccctgaaaaacattgttgaaggcaagacagttgaagtccccacatatgacttcgtgactcattcgcgcttacccgaaaccaccgtggtttatccagccgatgtagtactgttcgaggggattctcgtattctattctcaggaaataagagacatgtttcaccttagactgttcgtggacactgatagtgacgtgcggctgtcaaggagggtacttcgggatgtgagacgcgggagagatttggagcagatactgactcagtacacaacctttgtcaaaccggccttcgaggaattttgtctgccaaccaaaaaatatgctgacgtaatcatccctcgaggggttgataatatggtggccatcaacctgattgtccagcatattcaagatatactgaatggagatatatgtaagtggcacagggggggaagcaacggacggagctataagagaacatttagcgaacctggcgatcatcccggaatgctgacatcaggcaaaaggagccatctggaatccagcagcagaccccactag

SEQ ID NO: 140159 - DNA, 849 bp, Artificial Sequence
  Description of Artificial Sequence: Synthetic coding sequence
atggcaagcgccggtggcgaagactgcgaaagccccgcgccggaggccgatcgcccacaccagagaccatttctgatcggggatgagaggttccaggctgggattcctctgttgtgtctccagtccaccgtgtgcgagaagatcatggaactgcttggacagaatgaggtggagcagaggcagagaaaagtagtgatcctgagccaagaccggttttacaaggtgttgacagccgaacagaaggccaaagcgctcaaaggacaatacaacttcgatcaccccgacgcattcgacaatgacttaatgcatcggactctgaagaatatcgtggagggcaagacagtcgaggtccccacttacgactttgtaacacacagccgactgcctgaaaccaccgttgtgtatccagctgacgtggtgttgttcgagggcatcctggtgttctacagtcaggaaattcgcgacatgtttcacctgcgcctgtttgtcgacaccgactctgatgtacgcctgagtcgtcgagttcttcgggacgtacgacgcggccgcgatctagaacaaattctcactcagtacacaacattcgtaaagcccgccttcgaagagttctgtttacctactaagaaatacgcagacgtcatcatccctagaggcgtggataatatggtagccattaacctgattgtgcagcacatacaggacattctgaacggcgacatctgcaagtggcacagaggtggatctaacgggcgttcttataaacgtacattctccgaaccgggagaccaccctggaatgctgacatcaggcaagcgatctcatttagagagctccagccggccccactag

SEQ ID NO: 140160 - DNA, 834 bp, Artificial Sequence
  Description of Artificial Sequence: Synthetic coding sequence
atggcaagcgccggcggtgaggattgtgaatcacctgccccagaggcagatcgcccacatcagcggccttttttgattggtgtgagcggaggaactgcatccggcaagagcacggtgtgcgaaaagataatggagctgttggggcagaatgaagtggagcagcggcagagaaaagtcgttatcttgagccaggacaggttctacaaagtcttaactgcggagcagaaggccaaagcacttaaaggccaatacaatttcgaccaccccgatgctttcgacaatgacctgatgcatagaaccctgaaaaacatagtcgaggggaaaacagtggaggtccctacctatgatttcgtaacacactctaggctgccagagactacagttgtttatccagccgatgtggtgctgttcgagggaatcctggtgttctatagtcaggagatccgagatatgtttcatctgcgtctcttcgtggataccgacagcgatgtgaggctctctaggcgcgtcctcagggatgttcggcgaggtagagacctcgaacagatcctaacgcagtacactacttttgtcaagccggcttttgaagagttctgcctcccaactaagaagtatgccgatgtcattatcccccgcggcgttgacaacatggtggccattaatctgatagtgcagcatatacaggacattttaaatggcgacatttgcaagtggcacagagggggcagtaacggcaggtcttacaaaaggacattcagtgaaccaggcgaccaccccggtatgctgactagcgggaaacgttcgcacctggagtcctcatccaggcctcattag

SEQ ID NO: 140161 - DNA, 1647 bp, Artificial Sequence
  Description of Artificial Sequence: Synthetic coding sequence
atggcagccccccccgcacgggccgatgccgacccttctccaacaagtccaccgacagccagggacacacccggtcggcaagcggagaaaagcgaaacagcctgcgaggataggagtaatgctgaatctctggataggctcctgcccccagtcggtaccggccgaagtcctaggaaacgtaccacttctcaatgcaagagtgagccccctctgctaagaacatctaaaagaaccatttacaccgcagggaggcccccttggtacaacgagcatggaactcagagtaaagaagcatttgccattggcttgggaggggggagtgctagtggcaaaacgaccgttgcaagaatgatcatagaagctttggatgtgccttgggtcgtcctgttgtctatggatagcttttacaaggtcctgaccgaacagcagcaggagcaggccgctcataacaactttaactttgaccacccagatgcgttcgattttgacctgattataagtacattgaagaagctgaagcaggggaaaagtgtcaaggtaccaatctacgactttacaacacattcccggaaaaaggactggaaaactctttatggcgcaaatgtgatcatctttgagggaatcatggcttttgccgataagaccctgctcgaactactagacatgaagatctttgtggacacggactccgatatccggttggtacgcagactccgccgggacatttctgagcggggtagggacatagaaggcgtcatcaaacagtataacaaattcgtgaagcccagttttgaccagtacattcagcccactatgaggctggccgatattgttgtccctcgaggctctggcaacactgtggctatcgatttgatcgtgcagcacgtccacagtcagctggaggagcgcgagctgagtgtcagagcagccctggccagcgcgcatcaatgtcatccgttgcctcggacgctgtccgtgcttaagagtaccccacaggttagagggatgcacactatcattcgcgacaaagagacctcacgagacgagtttattttttattcgaagcgactgatgagattgctgattgaacacgcactgtcttttctccccttccaggattgtgtggtgcaaacaccacagggacaagactatgccggtaaatgttacgcaggaaaacagatcactggagtatcaatccttagagcgggggagactatggagccagctctcagggctgtatgcaaagacgtcaggattgggacaatcctgatccagacaaatcagctgaccggcgagccagagttacattacctccggctgcccaaggacattagtgatgatcatgtgatactgatggactgtacagtgtcaaccggggccgcagctatgatggctgtgagggtgttactggatcatgatgtgcctgaagacaagatctttttgctgagcctccttatggccgagatgggggttcacagcgttgcatacgcattcccgagggtccgcatcatcactacagccgtggacaaaagggtgaacgacctgtttagaattatcccaggaatcggaaattttggagaccggtactttgggaccgacgccgtgccagatgggtctgacgaggaggaggtcgcatatacaggctag

SEQ ID NO: 140162 - DNA, 1260 bp, Artificial Sequence
  Description of Artificial Sequence: Synthetic coding sequence
atggccgctccaccagcgagggccgacgcagacccaagtccgacgtccccacccaccgccagagacactcccggccggcaggccgagaagtctgagactgcgtgcgaagacaggtccaacgctgagtccctggacagactcctgcctcccgttggcaccggcagaagccctaggaagagaacaactagtcagtgtaagtcagaacccccgcttctcagaacctcaaaacgaaccatctataccgctgggcggccgccctggtacaacgagcacggcacacagtcgaaggaagctttcgccatcgggctggggggtggttcagcctccggaaagacaaccgtggctcgaatgattatcgaagccctcgacgtgccgtgggttgtgctgcttagtatggacagcttttacaaagttctgacagaacagcagcaagaacaggccgcccacaataacttcaatttcgaccacccagacgctttcgattttgacctgattatctccacgctcaagaagctgaagcaaggcaaaagtgtgaaagtaccgatctatgactttaccactcacagccgcaaaaaagactggaaaaccctgtatggagctaacgtcatcattttcgaaggcatcatggcttttgcggataaaaccctgcttgaactcctcgacatgaaaattttcgtggacactgattcagatatcaggctggtgcggcgactgcgccgagacataagcgagcggggtcgcgatatcgagggtgttatcaagcaatataataagttcgtgaagccctcctttgaccagtatattcagccaacaatgcgtcttgccgatattgtggtcccccgaggatcaggtaacactgttgctatcgatctcatcgttcagcatgtccacagtcagcttgaagagggatgtgcaggactgggaaccccagtaccccccgctgcccccgatgctgaacgtccagaggaacatgcggctggaaccggtcacgctcatcaccaccaggttagagcccacttgggcacaggccgcccgcgcgcccgggcccctgcccagttgctggccccccagggtcaaggagaccagagcaggcgagtgcaccttctgctgcaggaaaccgacgctgccgcccaccgggccagggcactactccccgccctgtctggcctgcgcagaactgaccctgctggggccggcctgtgtgggcaggtgctgtgcggagaagctgatcataggtgcgtacactccgcccgcagatag

SEQ ID NO: 140163 - DNA, 1647 bp, Artificial Sequence
  Description of Artificial Sequence: Synthetic coding sequence
atggcagctccacccgccagggccgacgccgatccgtcccccacatccccacctaccgctcgggacacacccggccgtcaggccgagaagagtgagacagcctgcgaggatagatccaacgccgagagcctggatagactgttgcctccagtgggaaccggacgcagtccccgcaagcggactacgtcacaatgtaagagcgaacctcctttgttgagaacctccaaacggactatttatacagcaggtaggcccccctggtacaatgaacacggcacacagagcaaagaggccttcgctattggattaggcggggggtcagcctcagggaaaaccacagtggcccgaatgataatcgaagctctggacgtgccctgggtcgtgttgctgtccatggacagcttttataaggttctgacagaacagcagcaggaacaggctgctcacaacaacttcaatttcgaccacccagatgcctttgactttgacctcataattagcactctgaagaaactgaagcagggcaaatccgtaaaagtgccaatttatgattttactacgcactcgagaaagaaggactggaagacactttacggcgccaatgttattatttttgagggaattatggccttcgcagataaaactctgctggagcttttggacatgaagatctttgttgatactgacagcgacataagacttgtgcggcgactaaggcgggacatctctgagagaggccgtgacattgaaggagtaattaaacagtacaataagttcgtaaagccatccttcgatcaatacattcagcccaccatgaggctcgccgacatagtcgtgccacgtggtagcggcaataccgtagccatcgacctgatcgtacagcacgtacacagccagctggaagagctgcggttcgtcccaagagccgctctggcctccgcacatcagtgccatcctttgccacggaccctttctgtcctgaagtccaccccccaggtgaggggcatgcacacaattatacgtgataaggaaacctcccgcgatgagtttatcttttatagtaagcgcctcatgaggctgttgattgagcacgccttgagttttcttccatttcaggattgtgttgttcagacaccacaggggcaggactatgccggcaagtgctacgccggcaaacagattacgggagtgtctatactgcgggccggcgagacgatggaaccagcccttagagcagtctgcaaagacgtgagaattgggaccatccttatccagaccaaccagctcaccggcgaacccgagctgcattacctacgcctgcctaaggacatctcagacgatcacgtcatcttaatggactgcacagtatctacaggggccgccgccatgatggccgtgagggtgttattggaccatgatgttcccgaggacaagattttcctcctatcactcctcatggccgaaatgggtgtgcattctgtggcgtacgctttccctagagtgcgcataataaccaccgccgtggataaaagagtgaacgatctgtttagaatcatccccgggataggtaatttcggagaccggtatttcgggaccgacgcggtccctgatggcagtgacgaggaggaggtcgcatacacagggtag

SEQ ID NO: 140164 - DNA, 1602 bp, Artificial Sequence
  Description of Artificial Sequence: Synthetic coding sequence
atgtctagccctccggcgtatcccggcatccgaatctcaggatgtagagccttgggggccgaaggaagctccaacgctgaatcactggaccgactgctacctccggtgggcaccggtagatctcccagaaagaggaccaccagccagtgcaagtcagagccccctctgttgcggacctctaagagaactatatacacggcagggcggccgccctggtacaatgagcatgggacacaatcaaaagaggcatttgcaataggactggggggggggtccgcttccggaaaaacaactgtcgcaagaatgataatcgaagcgcttgatgtgccatgggtggttctcttgtcgatggactctttctataaagtcttgactgaacagcagcaggagcaggcagcccataacaacttcaacttcgaccaccccgacgcctttgatttcgatttgatcatttcaaccctcaagaaactgaaacagggcaaaagcgtcaaggttcccatctacgacttcacaactcacagtcgtaagaaggactggaaaacactgtatggcgcaaacgtgatcatatttgagggcattatggcgtttgctgacaagaccctgctggagctactcgacatgaaaatcttcgtcgacactgactccgatataagactggtgaggcggctgaggagagatatttcagagcgtggccgggatatcgagggagttattaagcagtacaataaatttgtcaagccgtcgtttgaccagtacatccaacctacgatgaggctggccgatatagtagtccctaggggatcagggaacaccgtggccattgatttgattgtacagcacgtgcactctcaactcgaggaaagggaacttagcgtaagggcagctctcgccagtgcccaccagtgtcacccgttaccaaggacactttctgtgctgaaaagcactccccaggtgcggggaatgcacactatcatacgggacaaggagaccagtagggatgagttcatcttttactcaaaacggttaatgagattgttgatcgagcatgcactctctttcctgccatttcaggattgtgtggtgcagactccgcagggccaagattacgcaggcaaatgctacgccggtaagcagatcaccggggtctccattctgagagccggcgaaactatggagcctgcgctgcgcgccgtttgcaaggatgtgcgtataggcactatactgatccagaccaatcagctcactggcgagccggagctgcattatctgcggctcccaaaagacatcagtgatgatcacgtgattttgatggattgtaccgtgagcacgggcgcggctgctatgatggccgtacgggtcctcctggatcacgatgttcctgaggataagattttcctgctttcacttctgatggcagagatgggggtacattctgttgcctacgctttccctcgagtacggataatcacaactgcagtggacaagagggtcaacgacctcttcagaattattcctggcatcgggaactttggggaccgctactttggcactgatgctgtgccagacggctcagacgaggaggaggtggcttataccggttag

SEQ ID NO: 140165 - DNA, 261 bp, Artificial Sequence
  Description of Artificial Sequence: Synthetic coding sequence
atgagcagtcccccggcataccctggaattagaataagcggctgtcgcgctctgggagcggaagggtcttccaatgccgaatctcttgataggctgttgcctcctgtcggcactggaaggagtcctcggaaaagaacaacctcgcagtgtaaatctgagcccccattgcttaggacctcaaagaggactatctacacggccgggcgacccccgtggtataacgaacacggcactcaatccaaagaggcttttgcaatctag

SEQ ID NO: 140166 - DNA, 408 bp, Artificial Sequence
  Description of Artificial Sequence: Synthetic coding sequence
atgcacaccattattcgtgataaggaaacgtcccgcgatgaatttatcttctactccaagagactcatgaggctgttgattgagcacgccctgagcttccttcctttccaggactgtgttgttcagacaccacagggacaagactacgccggcaaatgttacgctgggaagcagataacaggggtctctatcctgagagccggtgagaccatggagccagccctacgcgccgtatgtaaggacgtcagaattgggaccatcttaatccaaaccaatcagctaaccggagagcctgagctgcactatctccgcctgcctaaagatatttccgatgaccacgtaatactcatggactgcactgtgtccacgggggctgcagccatgatggctgttcgagtcctgctgtag

SEQ ID NO: 140167 - DNA, 786 bp, Artificial Sequence
  Description of Artificial Sequence: Synthetic coding sequence
atggcaggggactcggagcagaccctgcagaaccaccagcagcctaacggaggtgagccatttctcatcggcgtaagcgggggaacagcgagcggtaaaagttccgtgtgcgctaaaatcgtgcagctactaggccagaatgaggtggattacaggcaaaagcaggtggtgattctgagccaggattctttctatagagttttaacctctgaacagaaggccaaggccttgaagggtcaatttaacttcgaccatcccgatgcctttgataatgaacttattttaaaaaccctgaaggagattacagagggaaagacagtccagatcccagtgtacgacttcgtctcacatagccggaaggaggaaacggtgacagtgtaccccgccgatgtggtgctctttgaagggattttagcattctacagccaggaggttcgggatttattccagatgaaacttttcgtggatacagatgccgacacccggctatctcgccgcgttctgcgggatatcagtgagcggggccgggatctggagcagattttgagccagtacatcacatttgtaaagccggctttcgaggaattctgcttaccgacaaagaaatatgccgacgtgattatcccgcggggtgccgacaacctggttgccattaacctgatcgttcagcacatacaggatatcttgaatggagggccaagcaagagacagactaatgggtgccttaatgggtacactcctagcagaaaacggcaagccagtgaatcatcaagtcggccacattag

SEQ ID NO: 140168 - DNA, 393 bp, Artificial Sequence
  Description of Artificial Sequence: Synthetic coding sequence
atggcaggagacagcgagcagacgcttcaaaatcaccagcagccaaacgggggtgagccattcctgataggggtgtccgggggcacagcatccggcaaatcttctgtgtgtgctaaaatcgtgcaattgctgggccagaacgaggtggattacagacaaaagcaggtcgttatcctgagtcaggacagcttctaccgggtgctcacctcggaacaaaaggcgaaagcactgaaggggcaatttaactttgatcatccagacgccttcgataacgagctgattctgaagaccctcaaggagattacagagggcaaaactgtgcagatccctgtgtatgattttgtgtcccattcacgcataaagggccatcaaagagagaggcagggatcctag

SEQ ID NO: 140169 - DNA, 2031 bp, Artificial Sequence
  Description of Artificial Sequence: Synthetic coding sequence
atgtctagcctgcaggccttgtgctctggacttcccctacgaccgctgccagaaaatcggggtaggcaggccggcgtcccacatgctcccgtgcgcaccccgtctcttagccctgtggagaagcaactggcgctcaggaacgctcttcggtacttccctcccgacgttcaggagctgctcgcgcccgagtttgcccaggaactccagctctatggccacatttatatgtatcgtttttgccctgatatcgaaatgcgcgcctatccaattgagcaatatccatgccagactaaagtggcagccgctattatgcacatgattatgaacaacttagatcctgctgtggctcagttccctcaagaactggtcacttacggcggcaatggccaggtgttctctaattgggcacagttttggctcacaatgttttatcttagtaaaatgaccgaagaacaaacgctggtcatgtactccgggcaccccctaggcttattcccttcctcccggtccgctccacgcctggtcatcacgaacggcatggtgattcctaattatagttcaagaacagaatacgagaagttgtttgccctaggcgtgacgatgtacggccagatgaccgctggctcttactgttacatcgggcctcagggaatcgtccatgggaccgtgttgactgtgctgaacgctgccaggaggtaccttggtatcgaggatttggccggaaaggtgtttgtaactagcggcttgggtggcatgtcaggagctcaagccaaggccgctgtcatcgtcgggtgcatcggcgtgatcgccgaagttgacaaggccgcattggaaaaacgacacaggcaaggctggctgatggaagtcaccgatagcctggacagatgcatccagagactcagggaagctcgtaaaaagaaggaggtcctttctctaggttaccatggaaatgtggtcgccctttgggagcgcttggtccacgagcttgataccacaggggagtgtctggttgacctggggtccgaccaaacctcttgccacaacccatttaacggaggttattatcccgtgcagctgtcctttaccgaggcacagagcctcatggccagtaacccagcagtatttaaagaccttgtgcaggaatcactcagacggcaagtgtccgccattaatagactcgcggaggagaaattctttttttgggattacgggaacgcgttcttactggaagcacagagagctggtgcagacgtcgagaagaagggggctggtaggaccgagttccgctacccttcatatgtgcagcacatcatgggagacatattcagccagggcttcggcccattcaggtgggtgtgtacttcaggcgaccctcaggatctcgcagttaccgacgagcttgccacctccgtgctcgaagaagcaattgctgatggagtgaaagtctccgtgaaactccaatatatggataacatcagatggattcgggaagccgcacggcaccgtcttgtggtaggatcgcaggccaggatcctgtacagcgaccaaaaggggagagtggcaattgctgtcgcgataaatcaggctatcgcctgtagaagaattaaagctcccgtcgttcttagtcgtgatcaccatgacgtgtctggcactgattcacccttcagagaaacatctaacatctacgatggcagtgccttttgcgccgacatggccgtacagaactttgttggtgacgcgtgccgaggagccacctgggtggccctacacaatggcggaggagtaggttggggcgaagtcatcaacggcggattcggtctggtactggatggaacccctgaagcggaaggtagggcgcgtttgatgctatcgtgggacgtgtctaacggcgtagcccggcggtgttggtccggtaaccagaaggcctatgagatcatatgccaaacaatgcaggagaatagtaccctggtcgtcaccctcccccacaaggttgaggacgaacgggtgcttcagcaagcactacaactgtag

SEQ ID NO: 140170 - DNA, 2211 bp, Artificial Sequence
  Description of Artificial Sequence: Synthetic coding sequence
atgagctcgcttcaggccctgtgttccggccttcccctgcgccctctacccgagaatagaggccggcaggcaggcgttccccatgccccggttcgcacccctagtctgtccccagtggagaaacagctggcactcaggaacgccctccgatattttcctccagacgtccaagagctcctcgccccagagtttgcccaggaactgcagctctacgggcatatctacatgtataggttctgcccggatatcgaaatgagggcttaccctatagagcagtacccctgtcagaccaaggtggcagctgcaatcatgcacatgattatgaataatctcgaccccgccgtggcccagttcccgcaggagctggtgacatatgggggaaacggacaggtgttttcaaactgggcgcagttttggctgactatgttttacctttctaaaatgaccgaagagcagactctggtgatgtactcaggtcaccccctcggtctgtttccctcaagtcggagtgctccacgtctcgtcataactaacggcatggtcattccaaactactcctctcgaactgaatatgaaaaactctttgctctgggtgtgacaatgtatggccagatgacagccggaagctactgttacatcggcccacaggggattgtccacgggaccgtgctgacagttctgaatgctgctaggagatacctgggaattgaagatctggctggaaaagtattcgtgacctcaggcctcggcggtatgtcaggcgcccaggccaaagccgccgtgattgtgggatgtatcggcgtcattgctgaagtcgacaaggcggcgttggagaagcgccaccgacagggctggctgatggaggtcactgacagcctggaccgttgcattcagaggctgagagtcctccagcttggactccagcaggctctgggatgggcaggattaccagctgccttgggcttgtgcgttctgtcatgttttgtcaatctggctccacttggagaggggcggtgtctcgcaccttcaggcttcagccggcccctgctcggcgctcctgtgttactcctgtgtccgtcacgggaagccagaaaaaaaaaagaggtcctctcattgggctaccacggcaacgtcgtagcactgtgggaaaggctggttcatgagctcgataccactggggagtgcttggtagacctgggctcagaccaaacgagctgtcataacccctttaacggcggatattacccagtgcagctgagtttcacagaggcccagtctctgatggcttctaaccccgcagtcttcaaagacctcgttcaggagtctttacgccgccaagtgagcgccatcaatcgcttggccgaggagaagtttttcttctgggactatggtaacgcctttcttctcgaggcacagcgggccggggccgatgtggaaaaaaagggtgcaggaaggacggaattccgatacccctcatatgtccagcatattatgggcgatattttcagccagggtttcggccctttcagatgggtctgcacctcaggggacccgcaggacttggcggtgacagatgaactcgccacaagtgtgctcgaggaggctattgctgatggcgtgaaagtttccgtcaagttacagtacatggataatatcaggtggattagagaggcggccagacataggctggttgtcggaagccaagcaaggattctttacagtgaccaaaagggccgggtcgctattgcggtggccatcaaccaggcaattgcctgccggcgaatcaaagcccctgtcgtgctgtcacgggatcaccacgacgtatcgggcacagacagtcctttccgggagacctctaatatctatgacggctctgctttctgtgcagatatggccgtgcaaaactttgtaggcgacgcctgtagaggagccacctgggtggcacttcataacggaggtggcgtcggttggggggaggtgattaatggcggttttgggctcgtgctagacgggacccccgaagcagagggcagggccaggctcatgttgagctgggacgtttctaacggcgtggctcgacgatgttggtctggaaaccagaaggcttatgaaattatttgccaaaccatgcaggaaaactccacgctggtggtgacgctgccccataaggtggaagatgaacgggtgctacaacaggctctgcagctgtag

SEQ ID NO: 140171 - DNA, 375 bp, Artificial Sequence
  Description of Artificial Sequence: Synthetic coding sequence
atgcgtcaggcaggacgggctgccctgctggccgccctgctgttgctcgtccagctgtgcccaggctcaagtcaaagatcaccagaggctgctggtgttcaggatccttctctcaggtggtctccaggagcaagaaaccagggcgggggggcccgggcgctgttactattattggcagaacggtttcctcgaagagctggacctggccgtctgggcctgggcacagcgggggagcggcccaggcgtgacaatcctagcctgtctatcgatctgacctttcacctcctccggacattgctggagctagccagaacacaatctcagcgtgagcgtgcggagcagaacagaatcattttcgacagcgtgggtaaatag

SEQ ID NO: 140172 - DNA, 339 bp, Artificial Sequence
  Description of Artificial Sequence: Synthetic coding sequence
atgacaaggtgtgcccttcttctcctcatggtcctgatgctgggcagagtgctggtcgtacccgtgaccccgatcccgactttccagctgcgcccccagaattcaccccagaccacaccgagacccgcggctagcgaatccccttctgctgccccaacttggccctgggccgcacaatcccactgcagccctaccagacatcctgggagtaggatcgtgctgtctctcgacgtccccataggcctgctgcagatactgcttgaacaggccagggcgagagcagccagggagcaggctaccactaacgctcgtattctagcgagggtgggccattgctag

SEQ ID NO: 140173 - DNA, 1923 bp, Artificial Sequence
  Description of Artificial Sequence: Synthetic coding sequence
atggggcagcccagcctgacctggatgctcatggttgtcgtggccagctggtttattactaccgcagcaacagacacttctgaagcaaggtggtgctctgagtgtcatagtaatgccacctgcacagaagacgaagctgtgacaacttgtacatgtcaggagggttttacaggggacgggctcacttgtgtcgatttggacgagtgcgctatcccaggcgcacataattgcagcgcgaactccagttgtgtcaataccccagggtcatttagttgtgtgtgcccggaaggctttcggctgtctcccggtctcggttgcactgacgtggatgagtgcgccgaacccgggctaagccattgccacgctcttgctacctgtgtgaacgttgtgggatcatacctttgtgtttgccccgccgggtaccgtggcgacggatggcattgcgaatgctcccctgggagttgcggccctggattggactgcgttcccgaaggtgacgcattagtgtgcgctgatccatgccaggctcacagaaccctggacgagtattggcgttcaacggagtacggggagggctacgcttgcgacacagatctgagaggctggtataggttcgtagggcagggcggggcccgaatggctgagacttgtgtccccgtgctccgatgtaacaccgcagcaccaatgtggttaaatggtacccatccatcaagtgacgagggcattgtgtcccgtaaggcatgtgcccactggagtggtcactgttgcctctgggacgctagcgttcaggtcaaggcttgtgctggagggtattatgtgtacaacctgacggcgcctccggaatgccacctcgcctactgtaccgaccctagcagcgtagaaggcacttgtgaagagtgttccatcgacgaggattgcaagtccaacaacgggcgatggcactgtcagtgtaagcaggattttaacatcactgatatctcccttctggagcacaggctcgaatgcggggctaacgacatgaaagtaagcctcggaaaatgccagctaaagtctctgggttttgacaaagtgttcatgtacctgagcgattccagatgtagcgggtttaacgacagagataatcgcgactgggtaagcgtggttactcccgccagagatggaccctgcggtaccgttctgactcgcaatgaaacacacgccacctattctaacaccctctaccttgccgatgaaattatcatccgggacctgaacattaaaatcaacttcgcctgctcgtatcctctggatatgaaagtgagccttaagacagccttgcagccgatggtatccgccttgaatataagggtcggcgggacaggtatgttcactgtgaggatggcattgttccagacaccatcctatacacagccctatcaggggtccagcgtgactctgtccacagaggccttcctctacgtgggtactatgctcgacgggggggacttgagcagattcgccttgctcatgaccaactgctatgcaacgccgtccagcaacgccaccgacccattgaaatactttatcattcaggatcgatgtccccataccagagactccacaattcaagtggtggaaaacggtgagtccagccagggcagattctcggtccagatgttcaggttcgctggcaactatgatcttgtgtatcttcattgcgaggtttacctctgtgacactatgaatgagaagtgcaagcctacctgcagcggtacacgctttcgctccggttccgtcatcgaccagtctagggtcttaaacttaggccccatcacccgcaagggcgttcaggcaacggtgtcccgggcattctctagcctgggcttgctgaaggtctggctgcccctgttgctttcagccaccctcactcttactttccagtag

SEQ ID NO: 140174 - DNA, 2022 bp, Artificial Sequence
  Description of Artificial Sequence: Synthetic coding sequence
atggggcagccttctctcacatggatgctcatggtggttgtggcttcctggtttatcaccaccgcagccacagacacgtcagaggcccgtaccaagtacaattgccccgccagatggtcttggcgcactccacagagggggggagatacggaacagggcccagatgaggatttcacttcgcagggccggtggtgctccgaatgtcactccaatgccacatgcacagaagatgaggctgtgacaacatgtacatgtcaggaaggcttcaccggcgatggcttgacttgcgtcgacctggacgaatgcgcgatccccggggctcacaactgcagcgcaaatagttcctgtgttaataccccagggagcttttcctgtgtgtgcccagaagggttccgactcagtccaggtctcggatgtactgatgtagacgagtgtgctgagcccggcctaagtcactgtcacgcacttgccacctgtgttaatgtagttggttcatacttgtgtgtgtgtccagcagggtaccggggagatgggtggcactgcgagtgttcacctggttcttgcggacctggtctagattgtgttccagaaggcgatgccttggtgtgcgcagatccttgtcaggcccacaggaccctcgacgagtactggcgctcaacagagtacggcgaaggctacgcctgcgatacagacctgaggggatggtatcgattcgtgggccaagggggtgcccgaatggcagaaacctgcgtcccagtgctcaggtgtaacaccgccgctccgatgtggctaaacggaacacatcccagctccgacgaaggcattgtcagcaggaaagcctgcgcccattggagtggccactgctgtctctgggacgcctctgtgcaggtgaaagcctgtgccggcggatactacgtctacaacttaaccgcgccacctgagtgccatcttgcctattgcacggatccctcatctgtagaaggcacctgtgaggagtgctcgattgatgaggactgtaagagcaacaacgggcgctggcactgtcagtgcaagcaggacttcaatattacagatatttcattgctggagcaccgacttgaatgtggggcgaatgacatgaaagtgtctcttggaaagtgccagctgaaatccctgggattcgacaaagtgttcatgtacctctccgattcccgatgctccggcttcaatgaccgggataaccgcgactgggtgagcgttgtgactcccgccagagacggaccctgcggaaccgttctgacacgtaatgagacccacgctacgtacagcaacactctatacctagcagacgaaattataattcgcgacttaaatatcaaaattaattttgcatgcagctatccgcttgacatgaaggtgtccctgaagactgctctgcaacccatggtctccgcactgaatatccgcgtcggagggacaggcatgtttactgtccggatggctttattccagactcccagctatactcagccgtatcagggatctagtgtaacgctgtctaccgaggccttcttgtatgttggaacaatgctggatggcggcgacttgtctcggttcgctctgctgatgacgaactgctatgccacacctagctctaacgctaccgacccgctgaaatactttatcatacaggaccgctgtccccacacaagggacagcactatccaggtcgttgaaaacggagagagtagtcaggggcgattttctgtccagatgttcaggtttgccggtaattacgacctggtgtacctgcactgtgaggtctacctgtgtgacaccatgaatgaaaagtgcaaacctacatgttcaggcacaaggtttagatccggttctgtcatagaccagtctcgcgtgctaaatctgggccccattacgcgcaagggagtgcaggccactgtgtcaagagccttttcctctcttgggctattgaaagtgtggctcccactgctcttgagtgccaccctcaccctaacattccagtag

SEQ ID NO: 140175 - DNA, 1923 bp, Artificial Sequence
  Description of Artificial Sequence: Synthetic coding sequence
atgggacagccttctctaacatggatgctgatggttgtggtcgcaagttggttcataacgaccgccgctacagataccagcgaggcccgctggtgcagtgaatgtcattcgaatgctacctgtacagaggatgaagcagttactacatgcacatgccaggagggttttacaggtgacggcctgacttgcgtggacctcgacgaatgtgctattccaggagcccacaactgcagtgcaaattcatcctgtgtgaacactcctggttccttctcatgcgtctgccccgagggttttaggctgtcccccgggctaggctgcacagacgtggacgagtgtgccgaacctggtctgtcgcactgccacgcgctcgcaacatgcgtgaatgtagtcgggagctacctgtgcgtgtgtccagccggatacagaggggatgggtggcattgtgagtgctctcctggttcttgtggcccaggactggactgtgtccccgagggggatgccctggtgtgtgcggacccttgtcaagcgcaccgcaccctggatgagtactggcgatctacagagtacggcgaagggtatgcctgtgacacagacctgcgcggctggtaccggtttgtggggcagggaggggctagaatggcagagacatgcgtgcctgttttgaggtgcaataccgccgcacctatgtggctgaatggaacccacccaagttctgacgaggggatcgtatcaagaaaggcctgcgcccactggtccggccattgttgcctctgggatgcgagcgtgcaggttaaggcctgcgcaggtggatactacgtgtataacctgaccgcccctccagagtgtcacctggcctactgcaccgatccaagctctgttgaagggacatgcgaagaatgctctatagacgaggattgtaagtctaacaacggccgctggcactgccagtgcaaacaagatttcaacataactgacatcagtcttctggaacaccgcttagagtgcggagctaatgacatgaaagtaagcttgggcaagtgccagctcaagtccctcggattcgataaggtattcatgtatttgtcagattcgagatgcagtggcttcaatgatagggataaccgcgactgggtgagcgtggttacacctgcccgcgacggaccctgcgggacagtactaactcggaatgagacacatgcaacttattctaacacgttataccttgccgacgaaataatcattcgggacctcaatatcaagataaactttgcctgttcctacccactggacatgaaggtgagcctgaaaaccgctctccagccaatggtttctgctctgaatataagggtcggagggactggcatgtttactgtccgaatggctctgttccagacacccagctatactcagccgtatcaggggtctagtgttactctgagtactgaggctttcctatacgtgggcaccatgttggatgggggggacctgtcccggtttgccctcctgatgaccaactgctacgccacgccttcaagcaacgccaccgacccactaaaatatttcatcatccaggaccggtgcccacatacaagggactccaccatccaagtggtggaaaatggggagtccagccaaggaaggttcagcgtacagatgtttaggttcgccggcaattatgatctggtttatctccattgtgaagtgtatctgtgtgacacaatgaacgaaaagtgtaagccaacctgctccgggacgcggttccgcagcggatcagtgattgatcagtcccgggtgctgaacctcgggccgattactcgcaagggcgtccaagctaccgtcagtcgcgccttttcttccctgggtctgctcaaagtctggcttccccttctgttaagtgcaacactgactctgaccttccagtag

SEQ ID NO: 140176 - DNA, 1923 bp, Artificial Sequence
  Description of Artificial Sequence: Synthetic coding sequence
atgggccagccctcgttgacatggatgttgatggtggttgtagcctcctggttcatcaccaccgctgcaaccgatacctcagaagcccggtggtgtagcgaatgccatagcaacgcgacatgcaccgaagatgaggcagtgaccacttgtacctgccaggaagggtttacaggggatggtttgacttgcgtcgacttggatgagtgtgcgattcctggtgctcacaactgctctgctaatagcagctgcgtgaacactcccggatcattcagctgcgtttgtcctgagggctttcggctgagtcctgggctgggatgtacagacgtggatgagtgcgctgaaccagggctgtcacactgccacgccctggctacgtgcgttaatgtggtggggtcctacctttgcgtctgccccgccggctatagaggagatggatggcactgtgagtgctcccccgggtcatgtggcccggggctggactgcgtgcccgaaggtgacgccctggtgtgcgcagatccatgccaggcacaccgaacattggatgaatattggcgttccaccgaatatggtgagggttatgcttgtgacacagatctacgcggatggtatcgcttcgtgggtcaaggcggtgctcggatggcggaaacatgcgtaccagtcctccggtgtaacacggcagctccgatgtggcttaacggcacccacccctcttctgacgaaggaattgtatcgagaaaagcctgtgctcactggtcaggtcactgctgtctatgggatgcatccgtgcaagttaaagcctgtgcaggtggctactacgtttataatctcacggcccctcccgaatgccacctggcgtattgtacagatccaagctctgtagaggggacatgtgaggagtgttcgattgacgaggattgcaagtccaacaatggtagatggcattgtcaatgcaaacaggacttcaatatcacagacatctcattgctagagcataggcttgagtgtggcgccaacgacatgaaagtgtctctgggcaaatgtcagttgaagtcactggggtttgacaaggtgtttatgtatctgagtgactcgcgttgttcaggatttaacgatagagacaaccgtgactgggtctccgtggttacccccgccagagatgggccgtgcggtacagtcctcactagaaatgagacacatgctacatacagcaataccctataccttgccgacgaaatcattatacgtgacctgaacatcaaaattaacttcgcatgttcctaccctttggacatgaaggtgagcttgaaaacggccctccagcctatggtctctgccctgaacatcagggttggagggactggcatgttcacagttaggatggccctttttcagacaccctcctatacccagccttatcagggctcctccgtcactctttcgacagaggccttcctctacgtcggaaccatgctggatggcggcgacttgtccaggttcgccttgctgatgaccaattgttatgcgacaccttctagtaacgctacagaccccctgaagtacttcattatacaggatcggtgtccccacacgcgggatagcaccatccaggtcgtggagaacggggaatcctctcaaggccgctttagtgtacagatgttcaggttcgctggaaactacgacctggtgtacctgcactgcgaagtgtatctttgcgacacgatgaacgagaaatgtaagcccacttgctcggggacgcgattcagaagcgggtccgttatcgatcaatccagagtcttaaaccttggtcccattacccgaaagggtgtgcaggccacagtctccagggccttcagctccctgggccttttgaaggtgtggctgcctctgctgctgtccgctactttgaccctcaccttccagtag

SEQ ID NO: 140177 - DNA, 2022 bp, Artificial Sequence
  Description of Artificial Sequence: Synthetic coding sequence
atgggccaacccagcctaacctggatgctgatggtagtggtagcctcctggttcatcaccacagccgccacggacacgtcagaagccagaaccaaatataactgccctgcgagatggagctggaggaccccccagaggggcggggataccgaacaaggtcctgacgaagattttactagtcagggcaggtggtgttcagaatgccactcgaatgccacctgtaccgaagacgaagccgtgactacctgtacttgccaagaggggttcacaggggatgggctaacttgcgtggaccttgacgagtgcgcaatacccggcgcacacaactgtagtgctaatagctcctgcgtgaacacgcctggcagcttttcatgtgtctgccccgagggattccggttatctccaggtctcggatgtactgacgttgacgagtgtgccgaacctggcctgagccactgccacgctctggcgacatgtgtgaacgtggttggctcatacctgtgcgtttgccccgctggctaccgcggtgacggttggcactgtgaatgttccccaggaagttgtgggcccggcctggattgcgttcctgaaggcgacgcattggtgtgtgcagacccgtgtcaggcccatcgaactcttgatgagtactggcggtctactgaatacggggagggctacgcctgcgacacggatctccgcgggtggtatcggtttgtgggacaggggggagctaggatggcagagacgtgtgtccctgtcctgcggtgtaacaccgccgcgcctatgtggttgaacggtacacacccatctagcgatgaagggattgtttccaggaaagcctgcgcccattggtccgggcattgctgtctttgggatgcttctgtgcaggtaaaggcctgtgcgggaggatattacgtgtataatcttactgcaccacccgagtgtcatctcgcttattgcacagacccatcctccgtcgaaggaacatgtgaggaatgttccatcgatgaagactgcaagagcaacaacgggaggtggcactgtcagtgcaaacaggactttaacatcaccgacattagccttttagagcataggctggaatgcggagctaatgacatgaaggtgtcgctaggcaagtgtcagctcaagtcgctgggcttcgacaaggtatttatgtacctaagtgacagccgatgcagcggcttcaacgacagagacaatcgggactgggttagcgtggtgactcccgcacgcgatgggccatgcggcacagttctgacacggaatgaaacccatgctacttatagcaacaccctttacctggccgatgagatcataatacgggacctcaacataaaaatcaactttgcatgcagctatccactagatatgaaggtctcactcaagacagcccttcagccaatggtcagcgctctcaacataagggtgggcggcaccggtatgttcacagtgcgtatggccctgtttcaaaccccgtcgtatacccagccctaccagggaagctcagtgactctgtccactgaggcttttctgtatgtgggaacaatgcttgacgggggagatctcagccggttcgccttactcatgactaattgttacgcgactccctcctctaatgctaccgatcccctcaagtatttcatcatccaggatagatgtccgcacacacgggactccacaattcaggtggtagagaacggggaatcctcccagggccgcttttccgttcagatgttcaggttcgcaggcaattatgacctcgtgtacctgcactgtgaagtctatctgtgcgacaccatgaatgagaagtgcaagcccacgtgctcgggcaccagattcaggtcaggctctgttattgaccaaagtagggtcctgaacctcggtcccattactcgcaagggagtgcaagcaaccgtctctagggctttctcaagcttaggattgcttaaggtttggttaccactgctgctctccgcaacacttacgctgaccttccaatag

SEQ ID NO: 140178 - DNA, 1857 bp, Artificial Sequence
  Description of Artificial Sequence: Synthetic coding sequence
atgggccagccctctttgacttggatgctcatggttgtggtcgccagctggtttattacaacagccgcgactgatacctcagaggctcggtggtgttccgagtgccactcaaatgccacctgcactgaagatgaagctgtaactacgtgtacttgccaggagggctttactggagatggcctgacttgcgtggacctagatgaatgtgctatcccaggagcacacaactgcagtgcaaacagcagttgcgtgaacacacccggaagcttctcctgcgtgtgccccgagggcttccgtctcagtccaggcctgggctgcactgacgttgacgagtgcgccgaaccgggcctgtctcactgccacgccttggccacctgcgtgaacgtggtaggctcttgcggcccgggactcgactgcgttcctgaaggcgacgccctcgtctgcgcggacccttgtcaggcccaccggacgctggacgagtattggaggagtacagaatatggtgaagggtacgcgtgtgatactgatcttcgcggatggtaccgcttcgttggccaaggaggagcaagaatggccgagacttgcgtaccggtgctgagatgcaacaccgctgcaccaatgtggctgaacgggacccacccctcgagtgacgaggggatcgtgtctcgaaaagcctgtgcacattggagcggccattgttgtctttgggatgcctccgttcaagtgaaagcctgtgccgggggatactacgtgtacaatcttactgccccgccggagtgccatctggcatactgcaccgatccttcgagcgtcgagggcacctgcgaagaatgctcaattgacgaagactgcaaatctaacaatggacgctggcactgccagtgtaagcaggatttcaacatcactgacatttctttgctggaacataggcttgaatgcggagccaatgacatgaaagtgtctttgggaaaatgtcagttgaagagtcttgggttcgacaaagtgttcatgtatctctccgatagtcggtgcagcggatttaacgatcgcgataatagggattgggtcagcgtggtgacaccggcccgggacgggccctgcggtacagtgctaactagaaacgaaactcatgctacctacagcaatacactatatttggccgatgaaatcataatccgggatctgaatatcaagatcaattttgcctgtagctaccccctagatatgaaggtgagcttaaaaacagcgctgcaaccaatggtgagcgcattgaatatccgagtgggcgggaccggcatgttcactgttcgtatggccttatttcagactccctcttacactcagccctaccagggaagctccgtcaccctctccactgaggccttcttatatgtaggcaccatgttggatggaggcgacttgtcaaggttcgctctgttaatgacaaattgttatgcaacaccttcctctaatgccacagatcccctgaagtactttatcattcaggaccgctgcccgcacactcgagattcaacaatccaagttgtggagaacggcgagagctctcaagggaggttctctgtgcagatgtttcgctttgcaggcaattatgatctggtttacctgcactgcgaggtgtatctgtgtgatactatgaacgagaaatgtaagcctacctgtagtggtacccggtttcggtccggaagcgttatcgatcagtcaagagtccttaacttgggcccaatcaccaggaaaggcgtacaggcaacagtgtctagagcattctcctccctgggattactgaaggtttggctacccctgttgctgagcgcgactcttacactgactttccagtag

SEQ ID NO: 140179 - DNA, 759 bp, Artificial Sequence
  Description of Artificial Sequence: Synthetic coding sequence
atggcccccgccccccaagcccccgaacgggatccggttgggagctggtataacgtgacaattctggtgaaaatggacttcaaggaactgcagcaggtagatccccgccttctcaaccacatgagactgcttcacagtttggtcaccagcgcgcttcagccaatggctagcacagtgcatcatctgcactccgcacctggcaacgcttccaccaccgtgtcacggttgctcttgggcttaccacggcccctgccggtggcagacgtaagtacgcttctgggagacattgcgaagcgagtttacgaggtcatttcggtgcaggtacaagacgttaacgaatgtttttatgaagagctgaatgcttgtagcggaagagagctctgcgctaatctcgagggatcctactggtgtgtgtgtcaccaggaagccccagcaacatcccccagaaagcttaatctcgaatgggaagactgtccgccagtatcggactatgttgttctgaacgtcacctcagactcatttcaagtgtcctggaggttaaactccacccagaatcatacatttcacgtgagagtttacagggggatggagttgcttcggagcgccagaacacagtcccaggcgcttgctgtggcaggactggaggctggtgtgttatatcgagtcaagactagctaccaggggtgtggggccgacgtctccaccacactgacaatcaaaaccaagtacgtacttgaaaagttggatttccagtcttag

SEQ ID NO: 140180 - DNA, 555 bp, Artificial Sequence
  Description of Artificial Sequence: Synthetic coding sequence
atggcccctgccccccaagcacccgagagggatcccgtgggttcctggtataatgtgactatactggtcaaaatggatttcaaagaacttcagcaggtagaccctcgattgcttaatcatatgcgcctgctgcattcattggtgacaagtgcgctccagccaatggctagcacggtccatcatttgcactctgctcctgggaacgcaagcaccactgtgtcgcgtctgctgctgggcctccccaggccactcccagttgccgacgtatcgacactgctgggggacattgccaagagagtgtacgaagtgatctccgtacaggtccaagatgtgaacgaatgcttttacgaggagcttaacgcatgttctgggcgggaactgtgtgctaacttggaaggaagctattggtgcgtgtgccatcaggaagccccggccacttctcctagaaaattgaaccttgaatgggaagcacggggtctggagatacacctggagctccgcgcaacttcaacaagtcatggaacaccactgagcagcgctgagaattgcctctag

SEQ ID NO: 140181 - DNA, 3741 bp, Artificial Sequence
  Description of Artificial Sequence: Synthetic coding sequence
atggtctaccggacgcaatatctggtggtggaggtgcctgagtctaggaatgttactgactgctgtgaaggctatgagcagctcggtctttactgtgtcttgcccctgaaccagtccggccagtttacgagcaggcccggtgcctgtcctgccgagggacctgagccttcaaccagcccctgctccctggacatcgattgccccggattagaaaagtgctgtccctggagtgggggacggtattgcatggcgcctgccccccaggctccagagagggacccagtgggttcttggtacaacgtcacaattttagtgaaaatggatttcaaggagctccagcaggtagaccctaggttgctgaaccatatgcgtctgttgcattctttggtgacctctgcgctgcagccgatggcgagcactgtacaccaccttcactccgctcctggcaacgccagcactaccgtgtcgaggctgcttctaggtctaccacgccctcttcccgttgccgacgtctccacccttttgggcgatattgccaagagggtatacgaagtgatctccgtgcaggtgcaggatgtgaacgaatgcttttacgaagaacttaacgcatgttctggcagggaactttgcgctaacctagagggctcttactggtgtgtctgccaccaggaggcaccagcaacctcgcctaggaaactcaacctggagtgggaagattgccctccagtgtctgattatgtggtcctgaatgtgacatcagatagctttcaggtatcttggaggctcaattcaactcaaaatcatactttccacgtccgcgtttaccggggaatggaactgctgagatctgctagaacccaatcgcaggcactggctgtcgccggactggaggccggcgtgctgtaccgtgttaaaacttcttatcagggttgtggtgccgacgtttcaaccaccctgactattaaaacaaatgcccaggtcttcgaagtgaccatcaagatcgttaaccataacctcactgaaaaactccttaacaggtcctcggtagaataccaagatttctcccggcagctactgcatgaagtagagtctagtttccccccggttgtgagcgacctttatagaagcggaaaactgagaatgcagatcgtgtccttacaagcaggcagtgtggttgtgaggctgaagctgacggtgcaggacccaggctttcctatggggatcagcaccttggctcctatcctccagcccctgctggcgagcaccgtattccagatcgaccgccagggaactcgcgttcaggactgggatgagtgtgttgacagtgcggaacatgattgctcccccgccgcatggtgcattaatttggagggttcttacacgtgtcaatgtcgcactaccagggatgcgacgcctagccgcgctggccgcgcatgtgaaggagatcttgttagcccaatgggcggcggcttgagcgccgccaccggagttactgtgcccgggctggggacaggcacagccgccctgggactggagaacttcaccttgagcccatctcctggctacccccaaggtacacctgctgcgggacaggcttggaccccggagccgagtccgcggcgaggcggaagcaatgtcgtaggctatgatcgcaataatacaggtaaaggggtggagcaagaactgcagggaaatagtattatggaacctcctagttggcctagtccgaccgaagacccgacaggacattttctttggcatgccacgagaagtacaagagaaaccctgcttaacccaacctggttaagaaatgaagactcaggaccaagcggttcggtggacctgcccctcacatccaccctgacggcgctcaagactcccgcgtgcgtgcctgtcagtatcggcaggatcatggtcagtaatgtgacctctactggatttcatttggcttgggaggccgacctagcgatggattctaccttccagctgaccctcaccagcatgtggtctcccgcggtggtcctagagacttggaacacctcggtgactttgtcggggcttgaacccggagtgctccacctagtggagatcatggcaaaagcatgcggtaaggaaggcgccagggctcatttgaaagtcaggactgcagcccggaaactcatcggcaaggtgagaatcaagaacgtcaggtattcagaatcctttcggaatgctagttcgcaggaatatcgagactttcttgaactcttcttcagaatggttaggggctctctgcccgcaactatgtgccagcacatggatgcagggggcgtgagaatggaggtggtcagtgtaacaaatggctcgatagtggtggaattccatctgctgataattgccgacgtggatgtccaggaagtttcagccgcatttcttactgcctttcagaccgtacctctcctcgaagtgattcgtggcgacacattcatccaggactatgatgagtgcgagcgaaaagaagatgattgcgtgcccggaacgagttgtcgaaatacattagggtctttcacgtgctcttgcgagggtggtgcccctgactttccagtggagtattccgagcgtccatgtgagggggatagcccaggcaacgagacatgggccacctcacctgaacgacccttgactactgctgggacaaaagcagctttcgtgcaggggacctctcctacacctcaaggattgcctcagaggttgaatctgactggtgccgtccgagtactttgtgagattgagaaagttgtggttgcaattcagaaacggttcctgcagcaggagtccatcccggaatcctcgctctatctctcccacccatcctgcaacgtctcccactcgaacgggacacatgtccttctggaagcaggttggagtgagtgtgggactctaatgcagtctaacatgaccaacaccgtggtgcggacgacgcttcggaacgatttgagccaagaaggcattattcaccacctgaagatcctttcacccatttattgcgctttccagaatgacttacttacctcctccggattcacattggaatggggagtgtacactatcatcgaggatctgcacggcgctggaaacttcgttacagagatgcagctattcattggggactcgcctattccacagaactactctgtgtcagcttctgatgacgtccgtatcgaagtgggcctgtaccgacagaagagcaacctaaaggtggtactgacggagtgttgggcaacacctagctctaacgcgcgggatccaatcacattcagctttatcaacaattcgtgtcccgttcccaatacatacaccaatgtcatcgagaatggtaattctaacaaggctcagttcaaactgaggattttttcgtttattaacgacagcatagtgtatctgcattgtaagctgagagtttgtatggagtccccaggagcaacctgcaaaataaactgcaataactttcgcctgcttcagaactcggagacgagtgctacgcaccagatgtcttggggacctctcattcggtctgaaggggagccaccccacgccgaggccggactgggcgcagggtacgttgtcttaatcgtcgtggctatctttgtgctagtggctggcaccgccactctccttatcgtccgctatcagaggatgaatggtagatacaacttcaagattcaatctaataattttagttaccaagtcttttacgagtag

SEQ ID NO: 140182 - DNA, 4125 bp, Artificial Sequence
  Description of Artificial Sequence: Synthetic coding sequence
atggtatatcgcacccagtacctagtggttgaggtgccagaaagccgaaacgttacagattgctgtgaaggttacgagcagctaggattgtactgtgtgttgcctctgaaccaatcaggccaattcacctcccggcctggtgcttgccctgcagaaggccccgaaccatccacttccccctgcagtctcgatattgactgtccgggcctggagaagtgctgcccttggagcggaggcaggtattgtatggctcccgccccacaggctcccgagagagacccagtcgggtcctggtataacgtgacaatactggtcaaaatggactttaaggagctacagcaagtcgacccacgcttgttgaatcacatgagactgctccacagtcttgttacctcagcactccagccaatggcctcaacggtccaccacctgcactcggctcccggaaacgcaagtacaacggtgagtaggctgctcctggggctgccccgcccacttccagtcgcggatgtctcaaccctactgggagatatagctaaacgagtgtatgaagttataagcgtgcaagtgcaagacgttaacgagtgtttctatgaggaactcaacgcatgcagtggccgggagttgtgcgccaatctggagggctcttactggtgcgtttgccaccaagaagcacctgccacgtccccgaggaagctgaatctggaatgggaagactgcccaccagtgagtgactatgtggtgcttaacgtgacaagcgatagttttcaggtgagttggcgcctgaactctactcagaaccatacatttcatgtccgcgtgtaccgaggcatggagcttcttagaagcgcccggacccagagccaggctctggctgtcgcaggactggaggccggggtattatacagagtcaaaacatcataccaggggtgcggagcggacgtgagtactaccctgacgatcaaaaccaacgcccaggtcttcgaagtgacaatcaagattgtcaaccataacctgacagaaaagctgctgaacaggagttctgtggagtatcaagattttagcagacagctcctgcacgaggtcgaatccagttttcctccggtcgttagcgacctctatcgctctggaaaactgagaatgcagatcgtttctttgcaggccggaagcgttgtggtgagattgaaactgaccgtccaggacccgggtttccctatggggatttctacactagcccccattttacagcctctattagcttccactgtgtttcaaatagaccggcagggcaccagggtccaagactgggacgaatgtgttgacagcgcagagcatgattgttctcctgccgcctggtgtatcaacttggaaggctcttacacttgtcaatgtagaacaacacgagatgcaactccttctcgcgctggtcgcgcttgcgagggggatttagtatcgccaatgggagggggccttagcgctgccactggagtgaccgtgcccggtctaggcactggcaccgctgccctggggctggaaaactttacactgtctccatcacctggctatcctcagggcacaccagcagctggccaggcctggacacctgagccttcccctcgccgcggcggctcaaacgtcgtaggatatgatcgcaataataccggaaagggtgttgaacaagaagtcccatctaccgcaccgggtctgggaatggaccaagggagtcccagccaggtcaatccctcccagggctctcccagccaaggctccctgagacaggagtctacctcacaagcctcacccagtcagagatcaaccagccaggggtcgccaagccaggttaacccttctcagcgttccaccagtcacgcgaattccagccagggctctccttcacagggcagtccatcacaggagagccccagtcagggaagcacatctcaagcaagcccgtctcacaggaataccatcggcgtgatcgggacgacttcttcccccaaggcaacaggttctacccactcttttcccccaggggctaccgacggacccctagcccttccagggcagttgcagggtaacagcattatggaaccgccatcctggccatcacctaccgaggatccaaccggacactttctttggcacgcaacccgttcaacacgggaaaccctgctgaatcctacctggttgcgtaacgaggacagcggccccagcggcagcgttgacctgccattgacctctacgcttaccgccctgaaaacccctgcttgtgtccctgtaagtatcggcagaattatggtctctaacgttacctctactggctttcacttagcatgggaagccgatcttgccatggattctacattccagttgaccttgactagtatgtggtcccccgctgtagttctggagacttggaacacatctgtgaccttaagcggactggaacccggagtactgcaccttgtggaaatcatggccaaagcgtgtggaaaagaaggggcacgggcacacctgaaagtgagaaccgccgcccggaagctcatcggaaaggttagaataaagaacgtgcggtactctgaatcattccgcaatgcctcatcccaagagtatcgtgacttcctggaactgtttttccgtatggtacggggcagtctcccggctacaatgtgtcaacacatggacgccgggggggtgaggatggaggtggtatccgttaccaacgggagcatagtggtggagttccacctgctgatcatcgcggacgtggatgtccaagaggtgtctgcggcgtttctgacggcctttcaaactgtgccactgcttgaggttatccggggcgataccttcatccaggactacgacgagtgcgaaaggaaggaagacgactgtgttcctggcacaagttgccgcaataccctcggtagttttacttgttcgtgtgagggaggtgcccccgattttcctgtggaatacagcgagcgaccttgcgagggggattcgccaggcaatgagacctgggcaacatccccagaacgacccttgacaaccgcaggcaccaaagccgcctttgtgcaggggacctcaccaaccccacagggtttacctcagaggttgaatctgactggcgccgttagagttctgtgtgagattgaaaaggtggtcgtggcaatacagaagaggttcctgcaacaggaaagtattcctgaatcttccttatacctaagtcacccgtcgtgcaatgtgagccattctaatggcacacacgtgctccttgaggctggctggtccgagtgcggaacactaatgcagagtaacatgactaatactgtcgtgagaaccacgctgcgaaacgacctctcacaggagggaattattcaccacttgaagatactcagcccaatatactgcgcctttcagaacgatctgctgacctcctccggctttaccctggaatggggtgtttacacaataatcgaggacctacatggcgccggtaatttcgttactgagatgcagctgttcattggagactctcctatccctcaaaactattccgtgagtgcctcagacgacgtacgaatcgaggtcggcctgtatcggcaaaagtcaaacctaaaggttgtgctgacagaatgctgggccaccccctcctctaatgctcgcgatcctatcaccttcagtttcataaataacagttgccctgtcccaaatacatacactaacgtaatcgagaacggtaacagcaacaaggcccagtttaagctacggattttctccttcatcaacgattcgattgtgtacctacattgtaaacttagggtgtgcatggagagccccggcgcaacttgcaagattaattgtaacaactttaggcttctgcagaactcggagacgtcagcaacccaccagatgagctggggcccacttataaggtctgaaggcgagcctccccatgccgaggccggcctcggcgccggatacgttgtactgatagtggttgctatttttgtccttgtggccggaacagcaaccctgctgatcgtccgctatcagcgcatgaatggtcgttataattttaagattcaatccaacaatttttcctaccaggtattttatgaatag

SEQ ID NO: 140183 - DNA, 3957 bp, Artificial Sequence
  Description of Artificial Sequence: Synthetic coding sequence
atgctccgcacctctggcttagcgctcctcgccctcgtcagcgccgtaggcccctcacaagcatctggcttcactgagaagggcctctcactgttggggtaccaactctgttcgcaccgtgtcactcacacagtgcaaaaagtggaggcagtgcagaccagctatacaagctatgtttcctgtggggggtggattccatggaggagatgccctaagatggtgtatcgcactcagtatctcgtggtggaggtacctgagagcaggaacgtgacggactgctgtgaagggtacgaacagctcggattgtattgtgtgttacccttaaatcagagcggacaattcaccagtagaccaggcgcctgtccagccgaaggacctgagcctagtacctccccctgctccctggacatcgactgccctggcctggaaaagtgttgcccgtggagcggcggtcgatattgcatggcccctgcaccacaagctcccgagagagatccagtgggttcatggtacaacgttacgatcctggtgaaaatggacttcaaggagctgcaacaggttgacccaagacttctgaatcacatgagactgctgcacagccttgtgaccagtgcacttcagcccatggcatctaccgtccaccacctccactccgcccctggaaacgcgagcaccaccgtcagcaggctgcttcttggactgcctagaccccttcctgtggccgatgtttcgaccctactgggagacatcgcaaagagggtctacgaagttatctccgttcaggttcaggacgtgaacgaatgtttttacgaggaacttaatgcatgttccggccgagagctgtgcgccaatctcgaggggtcatattggtgcgtctgtcatcaagaggccccagcgacctcacctagaaagttgaatctcgaatgggaggattgcccacccgttagcgattacgtcgtcttgaatgtgacaagtgactcctttcaagtgtcgtggcgcctcaacagcactcagaatcacacattccatgtacgagtttaccgcggaatggaactgctgcgtagtgccagaacccaaagtcaggccctggcagtggccggtctcgaggccggagtcctttatagggtgaaaacatcttatcagggctgcggcgccgatgtatcaaccacacttaccattaagacgaacgcacaggtgttcgaggtgacaattaagattgtgaaccacaacctcacagaaaagctcctgaacaggtccagtgtagaatatcaagactttagccgccaactgttacacgaggtggaatcatcatttccgcccgtagtatccgacttatataggagcggtaaactgagaatgcagattgtgtccttacaggctggttccgttgtagtcagactcaaactaacagtacaggacccagggtttccaatgggcattagcactttggcccctattcttcaaccgctcctggcttccacagttttccaaatcgaccgccaaggtaccagagtgcaagactgggacgagtgcgtggatagtgcagaacacgactgtagccccgctgcatggtgcattaacctggagggttcatatacctgccagtgcaggactactcgggatgccactccatccagagcaggacgagcatgtgagggagatctcgtgtcccccatgggaggcggcttgtcagcagctaccggtgttaccgtgccaggattggggactggaaccgcagcgttgggtctcgagaattttactctaagcccttcacccggatatccccagggtaccccagctgcaggacaagcatggacccccgagccctcacctagacgggggggaagcaatgtcgtgggatacgatagaaacaataccggcaagggcgtggagcaggaactgcaggggaattctataatggagcctccctcctggccatccccgactgaagatccaacaggccattttctctggcacgccactcgctccactcgggagacgttgctgaacccaacctggctccggaacgaagattctgggccttccggctcagtggatctgccactaaccagcactctaaccgctcttaaaactcccgcttgcgtgcctgtgtctatcggtcgaatcatggtgagtaatgtgacaagcacaggattccacttagcttgggaggctgacctggccatggacagcacttttcaacttacactcacttccatgtggagccccgctgttgtgcttgaaacctggaatacatccgtcactctcagtggcctggagccaggtgtgctgcatctggttgagatcatggccaaggcctgtgggaaagagggggcgcgggcccatttgaaagttcgcaccgcagcaagaaagctgattggtaaagtcagaattaagaacgtgcggtatagtgaatcatttagaaacgccagctctcaagagtatagagacttcttagagcttttttttaggatggttcgaggaagcctcccagccaccatgtgtcagcatatggacgcaggcggcgtgcggatggaagtggtgagcgtcaccaatggatccattgttgttgagtttcatttgttgatcatcgcagacgttgatgtccaggaagtgtccgcagctttcctgactgcctttcagacagtgcctctcttagaggtgatccgaggcgacacgttcatccaagactacgatgaatgcgaaagaaaagaagacgactgtgtccccggaacgagctgtcgcaatacgttgggaagtttcacttgtagttgcgagggaggcgcccccgacttccccgtggagtactcagaaagaccttgtgaaggggattcgccaggtaacgagacctgggctacctcccctgagaggcccctcaccaccgccggaacaaaggctgcctttgtgcagggaacttctcctacacctcagggattgccacagaggctgaacctgacaggagccgtgcgtgtgctgtgcgagatcgaaaaggtggttgtggctattcaaaagcggttcttgcaacaagaaagcatacccgagtctagcctgtatttatcacatccctcctgcaatgtatcccactccaacgggactcatgtcctgctggaagccggttggtctgagtgtggcacccttatgcagtcaaacatgacaaacactgtggtgaggactacactgcgaaatgacctgtcacaggaaggtattatccatcacctgaagatcctgtcaccaatttactgtgcttttcaaaatgaccttcttacaagcagcgggtttaccctcgagtggggtgtatacactattattgaagaccttcatggagcaggcaactttgtgaccgaaatgcagctctttatcggggattcccccatcccacagaactacagtgtgtccgcatccgacgacgtaagaattgaagtcggtctgtatagacagaaaagcaaccttaaggtcgtgttgacagagtgttgggccacaccaagcagtaatgcccgagatccaatcacattctcattcattaacaatagctgcccggttcctaatacatacacaaacgtgatcgagaatggaaactcgaacaaggctcagttcaagttgaggatctttagcttcatcaacgacagtattgtctatctgcactgcaagctgcgagtgtgcatggaatcccctggagctacatgcaaaataaattgtaacaatttccgcctgctgcaaaactcagagacttctgccactcaccaaatgtcctggggaccattaatccggtctgagggtgagcctccccacgcagaagccggcctcggagctggttacgtggtcctgatagtcgttgccattttcgtgctggtggctgggactgcaacactcttgatcgtgagatatcaaaggatgaacggcaggtataattttaaaatccagagcaacaacttttcttatcaggtcttctatgaatag

SEQ ID NO: 140184 - DNA, 4341 bp, Artificial Sequence
  Description of Artificial Sequence: Synthetic coding sequence
atgcttcgtactagcgggcttgccctgttagccctagtttctgccgtcggaccctcgcaggctagcggctttactgagaaaggcctatcgctgctagggtaccagctgtgttcccatcgtgtcactcatacagtgcaaaaggtggaggccgtacagacgtcatatactagctacgtgtcctgcggcgggtggatcccctggcgccggtgcccgaagatggtttaccgaacacagtatctcgtggtcgaagtgcccgagagtaggaacgtgacagactgttgcgagggatacgagcagctcggtctgtattgcgtactgccccttaaccagtcgggtcagtttaccagcagacccggagcctgcccagctgaagggcccgagccatcgacctcaccctgcagcctggatatagactgccccggcctcgaaaaatgctgcccttggagcggcgggcggtactgcatggcacccgccccccaggcgccagagagagaccctgtgggatcttggtacaacgtgactatcttggtcaaaatggattttaaggaactgcagcaggtggacccacggctgctgaaccacatgcgtctgttgcacagcctggtgaccagcgcactccagcctatggccagcacagtgcaccacctgcattccgccccaggcaatgcatctaccaccgtcagcaggcttttacttggcctacccagacctctaccagtggccgacgtcagtactcttcttggcgatatcgcgaaacgcgtctatgaagttatatccgtccaagtccaggatgtcaatgaatgtttctatgaggaactgaatgcttgcagtggccgagaactgtgcgctaatcttgaagggtcatattggtgtgtgtgtcaccaggaggcccctgcaacatctccacgcaagctgaatctggaatgggaagattgccctccagttagcgattatgtcgtactgaacgtcacctccgatagcttccaggttagctggcgactcaattccacccagaaccacacctttcacgtgcgcgtctaccgcggaatggaattgctgaggtcagctaggacccaatctcaggccttagcagttgctgggctggaggctggcgtcctctatcgagtgaaaacttcttaccaggggtgtggtgctgacgtttccactactttgacaataaaaaccaatgcacaagtgttcgaagtgactattaagattgttaaccataacctgaccgaaaagctcctgaacagaagtagcgttgagtatcaggatttcagccgccagctcctccatgaggtcgagtcttcatttccgcctgtggtgtccgacctctataggtccggtaagttacgcatgcagatcgtatcactgcaggcaggtagtgtggtggtgcgactcaaactgacagtgcaggacccgggatttcccatggggattagcacattggcacccattctgcagcctctgctggcctccacagtgttccagattgacagacagggaacccgggtccaggattgggacgagtgcgtcgatagcgcagagcacgattgctcacccgccgcctggtgcataaacctggaaggcagttacacatgccaatgccgaaccacccgggatgcgacaccatctcgtgctggaagagcatgcgaaggagatctggtgtccccaatggggggaggcctgtctgccgccactggggtcaccgttcccggcctcggaacaggaactgctgctttaggactggagaattttacccttagtccttcgccgggatacccacaaggcacccctgcggccgggcaagcatggacccctgagccttccccaaggcgcggcggctccaatgtggtgggctacgaccgtaacaacacaggtaagggagtggaacaagaggtgccttctacagctcctggcctcggaatggatcaggggtcacctagtcaggttaacccatcccaagggagcccctcacaagggagcctcagacaagagagcacttcacaggcgtcacccagtcagcggagcacaagtcagggctctccatcacaggtgaatccatcacaacgatccacaagtcacgccaactcctcacaggggtctccctcacaggggtctccgtcccaggagtccccaagccaagggtccacaagtcaggctagtccctcgcaccgtaatactatcggggttatcggcactacgtcctcaccaaaggcgaccggaagcactcatagtttcccacccggggctactgatggacccctggctctcccaggccaactgcagggcaattcaatcatggaaccaccatcttggcccagtccaacagaagaccccacaggccacttcctctggcacgctacccggtccaccagagagactctgctgaaccctacatggttacgaaacgaggattctggcccaagtgggtccgtggacttaccccttacttccaccctcacagcgctaaagacccccgcatgtgtgcctgtaagtattggtagaataatggtgagcaatgtcacctcgactggatttcatctcgcttgggaggctgacctggccatggactccacgttccaactgaccctgaccagtatgtggtcgccagccgtggtgctggagacctggaacacatctgtgacgctgtcagggctggagcctggagtgctgcacctcgtggagatcatggctaaggcatgcggcaaggaaggagcccgagcccacctgaaagtgagaactgctgcaaggaagttgatcggtaaagtgcggattaagaacgtgcgttatagtgaatcattccgaaacgcctcttcccaggaatacagagatttcctggaactcttcttcagaatggtaagaggatctctccccgctacaatgtgccagcacatggacgctgggggagttcggatggaagttgtgtccgttaccaacgggtctatcgtcgtcgagttccatttgttgatcattgccgacgtggatgtgcaggaggtgtctgccgctttcttgacggcattccagacagttccgctgctggaggttatccgtggagatacatttattcaagactacgacgagtgcgaaagaaaggaggacgactgcgtgcctggaacatcctgcaggaacacactgggttcctttacatgttcctgcgaaggcggagcacctgattttcccgtcgagtactccgaacgcccctgcgaaggggatagccctgggaatgagacatgggcaactagtccagaaagaccactcactaccgccggtacaaaggcagcttttgtgcagggcacctctccgaccccacaggggctacctcagcggctgaatctcaccggggctgtccgggtcctgtgcgaaattgaaaaagtggttgtggccatccagaagagatttctgcagcaggagagtatccccgagtcgtcactgtacctgtcccatccctcatgcaacgtgtcgcactccaatggaacccatgtgctcctcgaagcagggtggtctgaatgtggaacactcatgcagtccaacatgacgaacaccgtcgtccgaaccacgctgagaaacgacctgtcccaggaggggattatccaccaccttaagatcctgtcacccatctattgtgctttccaaaatgacctcctcacaagtagcggcttcacgctcgagtggggcgtgtatacgatcattgaagatttgcacggagctggaaattttgtgaccgagatgcaattgttcatcggcgattcaccgataccacagaattacagcgtgagtgcttcagacgatgtccgcattgaagtggggctgtacaggcagaaaagtaacctgaaggtggtgctgacggagtgctgggctaccccttcaagtaatgctcgagatccaataactttcagctttatcaacaatagctgtcccgttcctaatacctacacaaacgtgattgaaaacggcaactcaaataaggcccagttcaagttacgaatcttctcctttattaatgactctattgtttacctgcactgcaagctaagagtttgcatggaatcacccggggcaacctgcaagataaattgtaataacttcaggttgctacagaattccgagacctccgcaacccaccagatgtcctggggtcccttgatcagatccgagggcgagcccccgcatgcggaggccggcctgggggcgggttacgtggtcttaatcgtcgtcgcgatctttgtccttgtggcgggaacggccacattgcttatagtccggtatcaacgcatgaacggccgctataattttaaaattcaaagcaacaacttctcctaccaagttttctacgagtag

SEQ ID NO: 140185 - DNA, 234 bp, Artificial Sequence
  Description of Artificial Sequence: Synthetic coding sequence
ccagtgggatcctggtacaatgtgactatattagttaagatggatttcaaggagctgcagcaggttgatccacgtctactcaaccacatgaggctgcttcactcattgatgtctatgtctgtgtcgatgagatcctccatgccagcattggagggaaattgcgctcaaacctggcgggcccggacaggggcctccgtaaccaggaagcttcagccaagactgcacggtagttag

SEQ ID NO: 140186 - DNA, 411 bp, Artificial Sequence
  Description of Artificial Sequence: Synthetic coding sequence
atgcaactgtttattggagactcaccaataccccagaattactcagtgagcgcctcagatgatgtgcgtattgaagtcggcctgtacaggcaaaaatccaatttgaaagtcgtgctgactgaatgctgggcaacccctagctcgaacgccagggacccgattactttcagcttcattaacaattcctgtccagtcccaaacacttacacaaacgttatcgagaacgggaactccaacaaggctcagttcaagcttaggattttcagctttatcaatgactctattgtgtatctacactgtaaactaagagtatgcatggaatcccccggggctacctgcaaaatcgccgctcttggtcggcgaacccacgtcgactggtgggcattccccatcagtcagtggctttcgtag

SEQ ID NO: 140187 - DNA, 1221 bp, Artificial Sequence
  Description of Artificial Sequence: Synthetic coding sequence
atgaaaaagaagcagcagcacccaggcggtggggcggatccatggccgcatggtgctcctatggggggggcaccccccggcctgggctcatggaaaagaagggtcccattgcttccctttcttcggtttagtctgagggattatggattctgtatggccaccctccttgttttctgccttggctcactcctctatcagttatctggcggcccccctcgattcctgctggatctgcggcagtacctgggtaattcaacctacctcgacgaccacggacccccccccagtaaggtactcccattccccagtcaagtggtgtacaatcgtgtgggaaagtgcggttcaaggaccgtggtgttactgctccgcatcctgagtgaaaaacatgggtttaacctcgttacctccgacatccacaacaagactagactcactaaaaatgaacaaatggaattgattaagaacattagcactgctgaacagccttacctcttcaccagacacgttcattttcttaatttctccaggtttgggggtgatcagccggtgtacatcaacatcatccgggacccagtgaaccggtttctttccaactatttcttccggcggttcggcgattggaggggcgaacagaatcacatgatccgtactcccagtatgcgccaggaggagcggtatctggacatcaacgagtgcatactggagaattatccggaatgttctaatccacgattgttttacataattccgtacttctgtggccagcaccccaggtgtcgagagcccggcgaatgggccctggagagagccaagctgaacgtgaatgagaacttcctcttggtcggtattctggaggaactagaggacgtgctcctgctcctggagagattcctaccccactattttaaaggcgtgctctccatttacaaggacccggagcataggaagttaggcaatatgactgtgactgtcaaaaaaaccgtcccttctcctgaggcggttcagatcctctatcagcgaatgagatacgaatacgaattctatcattacgttaaggaacagttccaccttctcaagcggaagtttgggcttaagtctcacgtctcgaagccccccctgcgaccacacttctttatcccgacccccctcgaaacagaggaacctatagacgatgaagaacaggatgatgagaagtggctggaggatatctacaaaaggtag

SEQ ID NO: 140188 - DNA, 2274 bp, Artificial Sequence
  Description of Artificial Sequence: Synthetic coding sequence
atggtacctgacacggcatgcgtgttactgttgaccttggccgctcttggcgctagcgggcaaggtcagagcccgctggggagtgacctgggccctcagatgctgagagagttgcaggagacaaatgccgccctgcaagacgtccgtgagctccttcgtcagcaagtgcgtgaaatcacctttctgaaaaatactgtgatggagtgcgacgcctgtggtatgcagcaatcagtcagaacgggcctcccaagtgtgcgacctctgctgcattgtgcaccaggcttttgttttcccggcgtggcctgcatacagaccgaaagcggggcccggtgcggtccgtgccccgcaggctttaccggcaacggcagccattgtaccgatgtcaatgagtgcaacgctcacccttgcttcccgagggtgcgctgcatcaacactagcccgggatttaggtgcgaggcatgtccgccagggtactctggacccactcaccagggcgtgggactcgcctttgctaaagcaaacaaacaggtttgcactgacataaacgaatgtgaaacagggcagcataattgcgttcccaattccgtttgcattaacacccgggggagcttccagtgcgggccttgccagccgggattcgttggcgatcaagctagcgggtgccaaagaagggcccagaggttctgtcccgatgggtcgcctagcgagtgccacgagcatgcagactgcgtactggagcgggacggttctaggtcctgtgtttgtgctgttggctgggctggtaacggaattttgtgtggcagggacacagatctagatggttttcccgacgaaaagttaagatgcccagagagacagtgtcgtaaagacaactgtgtgacagtgcctaacagcggccaggaggatgtggatcgggacgggattggggatgcatgcgatcctgatgccgacggagacggtgttcccaatgaaaaggacaactgtcccctcgtccggaacccggatcagaggaacaccgacgaggacaagtggggcgatgcctgcgataactgccgatctcagaagaacgacgaccagaaggacaccgatcaagacgggaggggtgatgcttgtgacgacgatattgatggcgatagaatacgcaatcaggcggataactgccctcgtgtcccaaatagtgaccagaaagactctgacggcgatggtattggcgatgcatgtgataactgccctcagaagagcaacccagaccaggccgacgtcgatcatgatttcgtgggcgacgcatgcgatagtgatcaggaccaggatggcgacggccatcaggatagccgcgacaattgccctaccgtcccgaacagcgcccaggaggactccgaccacgacggtcaaggcgatgcttgtgatgacgatgacgacaacgacggcgtccctgatagcagagataactgcaggctggtccctaatccaggtcaggaggatgctgatcgcgatggggtgggagacgtgtgtcaggacgatttcgacgctgacaaggtggtggacaagatcgatgtgtgcccagaaaacgctgaggtgacattaaccgactttagagccttccaaactgtcgtgttggacccggaaggagatgcccaaatagatccaaattgggttgtcttgaaccaaggccgggagatcgtgcagaccatgaattctgatcctggactggctgtgggctacaccgcattcaatggcgttgattttgaggggaccttccacgtgaatacagtgactgacgatgattatgctggttttatcttcggatatcaggattcttctagtttctatgtggtaatgtggaagcagatggaacagacctattggcaagcaaaccctttccgtgcagtggccgagcctggcatacaactaaaggctgtgaaaagcagtacaggcccgggcgagcagctgaggaatgccttgtggcacactggagacactgaaagtcaagttaggttactgtggaaagatccacgtaacgtgggctggaaagacaaaaaatcttacaggtggttcctgcagcacaggccacaagtcggctacattagagtccgcttttatgaagggccagaactggttgcagattctaatgtcgtactggatactactatgaggggcggacgtctcggagtgttctgtttcagtcaggaaaacataatctgggcaaatctgcggtacagatgtaatgatacaatccccgaagactacgagacacatcagctgagacaggcctag

SEQ ID NO: 140189 - DNA, 822 bp, Artificial Sequence
  Description of Artificial Sequence: Synthetic coding sequence
atggcttctgcagctgccgcagaagcagaaaaagggagtcctgtggttgtgggtctcctagtggttggtaacatcatcatactgctttcgggtctgtccctgtttgcagagactatttgggtgacggctgatcagtatcgcgtgtacccactgatgggcgtaagtggcaaagatgatgtgttcgccggagcatggatcgctatcttctgtggattttcattctttatggtggctagcttcggtgtcggcgcggctctgtgccggcgaagatccatggttctcacctatctggtgctgatgctgatagtgtatattttcgagtgtgcatcctgtattacatcgtatactcaccgtgactacatggtctctaatcctagcctgatcacgaaacaaatgctgaccttctactcagcagataccgatcagggacaagaactgaccaggctgtgggatcgggtaatgatcgaacaagagtgttgcgggacatcgggccctatggactgggtaaacttcactagcgcctttagggcggctacaccagaggtggtcttcccttggcctcccctctgctgccggcggaccggcaattttattccattgaatgaagagggatgtagactggggcacatggattatctgtttacaaaggctggcgtccagtggcacaatctctcatccctgcaaaggctgcccccgggatttaagggattcagccacttgtccttccagtcatcctgggactatcgagctgcctccaacacaagtgctacgcctagcactgccacccgaggtgtcagtcgtggcctcggactgccgtcttag

SEQ ID NO: 140190 - DNA, 783 bp, Artificial Sequence
  Description of Artificial Sequence: Synthetic coding sequence
atggccaaggataactccacagtcagatgttttcagggactgctgatcttcggtaacgtgattattgggtgctgtggcatcgctcttaccgctgagtgtattttcttcgtgtctgaccagcactctctttaccccctattagaggccaccgacaatgacgacatctatggcgccgcctggattggcattttcgtgggcatctgtctgttctgtctgagcgttctcggtattgtaggcatcatgaagtcttcccgcaaaatcctcctagcatactttatcctaatgttcattgtctacgccttcgaagtcgcatcatgcattactgcagccacccagcaggactttttcactcccaatctgttccttaagcagatgctcgagcggtatcagaataatagccctcctaacaacgacgaccagtggaagaacaacggggtgacgaagacctgggatcgactgatgctacaagacaactgttgcggggttaatgggccatcagactggcaaaaatatacctcagcatttcgaacggagaataacgacgcagactatccctggccacggcagtgttgcgtcatgaataacctgaaagaaccactcaatttggaagcctgtaagctgggggtccccggattctaccataatcagggctgctatgagctaatcagtggcccaatgaaccgccatgcgtggggcgtagcctggtttggttttgctatcctctgttggacgttttgggtactgcttggtacaatgttttactggtcgcggatcgagtattag

SEQ ID NO: 140191 - DNA, 510 bp, Artificial Sequence
  Description of Artificial Sequence: Synthetic coding sequence
atggccaaagacaactccactgtgcggtgtttccaggggctgttgatctttggcaacgttattattgggtgttgtggaatcgctttaaccgccgagtgcatcttctttgttagtgaccagcatagcctgtaccccctgttagaggcgacagataatgacgatatctatggagccgcctggattgggatcttcgttggcatttgcctgttttgcctgtcagttctggggattgtcgggatcatgaaatcttctcgaaaaattctgctcgcctacttcattttgatgttcatcgtttatgctttcgaggttgcttcatgcataaccgctgccactcagcaggatttcttcacacctaacctcttcttgaagcagatgctggaacgctatcagaacaactctcctcccaataatgacgaccagtggaaaaacaacggggtcacaaagacgtgggacaggctcatgctgcaagacaactgttgcggagtgaatggcccatccgactggcaatag

SEQ ID NO: 140192 - DNA, 570 bp, Artificial Sequence
  Description of Artificial Sequence: Synthetic coding sequence
atggcaaaggataactccacggtacgctgctttcaggggctactgatattcgggaatgtcattattggctgttgcgggatagccctgaccgccgagtgcattttctttgtcagcgatcaacacagcctctaccctctgcttgaggccaccgataacgacgatatttatggcgctgcgtggataggaatcttcgtcgggatctgccttttttgtctgtctgtgcttggaattgtcggcattatgaaatcatcaagaaagatcctcctggcttacttcatcctcatgtttattgtgtacgccttcgaggtggcttcctgcatcaccgccgcgacgcagcaagacttctttactccaaacctgttcttgaagcagatgctcgagcgttatcagaacaactcaccgcccaacaacgacgaccagtggaagaacaatggcgtgaccaagacttgggatcggttaatgctacaggacaactgttgtggcgtcaatggaccttcagactggcagaaatatacatccgctttccgaaccgaaaataatgacgctgattacccgtggccaaggcagtag

SEQ ID NO: 140193 - DNA, 555 bp, Artificial Sequence
  Description of Artificial Sequence: Synthetic coding sequence
atggcccccctgctgcccataagaaccctccctctgattttgatcctgctggctcttctatctccaggcgcagcagatttcaacatcagtagcctgtcagggcttttaagtcctgcccttacagagagcctcctggtagctctgcccccgtgccacctgactgggggtaacgcaaccctcatggtcagaagagccaacgactctaaggtggttacaagcagttttgtggtacctccctgcagaggacgcagagaactggtgtcagtggtggatagtggagctggatttaccgtgactagactgtccgcgtaccaggtcactaatttagtacctggtacaaaattttacatcagttatctggtgaagaagggaaccgctaccgaatcaagccgggagatccctatgtccaccctgccacgccgcaacatggagtctatcggccttggtatggccaggacaggaggaatggtcgttattaccgtgctgctctccgtggccatgttcttgttagtgctggggtttataattgccctggccctcgggtctcggaagtag

SEQ ID NO: 140194 - DNA, 333 bp, Artificial Sequence
  Description of Artificial Sequence: Synthetic coding sequence
atgagtatgacagacctattgaatgccgaagacatcaaaaaggcagtaggagccttttctgcgaccgattcatttgaccataagaagtttttccaaatggtggggcttaaaaaaaaatcagcagacgacgtgaagaaagtgtttcacatgctggacaaggacaagtccggcttcattgaagaagacgaactcggctttattttgaaaggatttagcccagacgccagggacctcagcgccaaggaaacaaaaatgctaatggctgctggcgacaaggatggagacggtaagatcggagtcgacgaattctcgacactcgtagccgagtcctag

SEQ ID NO: 140195 - DNA, 501 bp, Artificial Sequence
  Description of Artificial Sequence: Synthetic coding sequence
atgccaccgctctgggcactcttagccctcgggtgcttgcggtttggctccgctgttaatttgcagccacagctggcatctgtgactttcgccactaacaaccccaccctcaccactgtggcactagaaaagccactgtgcatgtttgacagcaaggaggctttaaccggcactcatgaggtctacctctatgtccttgtggacagtgttaccccatacagtaccatagacacctggccaggaaggaggtccggagggatgatcgtgattacatcaatcctgggtagtttgcctttctttctcttggtcggatttgccggcgctatcgcactttctctggtggacatgggctcatctgacggtgaaacgacgcatgactcgcagatcacccaggaggcagttcctaagtcactgggggcaagcgagtcctcatacacatctgtcaacagaggaccccctctggatagggccgaggtttattcatcaaagcttcaagactag

SEQ ID NO: 140196 - DNA, 963 bp, Artificial Sequence
  Description of Artificial Sequence: Synthetic coding sequence
atgggcttaccttggggacaacctcacctgggacttcagatgctgctgctagccctcaattgtctgcggccgtcactgtccttgggcgagtggggctcctggatggacgctagcagccagacacagggggcaggaggcccagctggggtgattggcccatgggctcctgcccccctgcggctcggagaggctgctccagggacccctaccccggtaagtgtagcccatctcctctcccccgtggccactgagctggttccttacacaccccagattacagcctgggatcttgagggcaaggtcacggctactaccttctctctcgaacaaccaagatgcgtttttgacggtctggcgagcgcaagtgacaccgtttggcttgtggtggccttctcaaacgccagccgtggattccagaatccagaaaccttggctgacatacccgcttcaccccagctcttaaccgatggccattacatgactcttccgcttagcccggaccagctaccgtgcggagatcctatggctgggagcggaggggcccccgttctgcgggtggggcacgaccacgggtgtcatcagcagccattttgcaatgcccccttgcccggacccggcccctatcgggaggacccaagaatccaccggcatctagcaagagctgccaagtggcagcatgataggcattacctgcatccacttttcagcgggagacccccaacccttgggctcctgggaagcctgtatcacgccctgctccagccagtggtggccggaggaggcccaggggctgcggcggaccggcttctgcacgggcaggcccttcatgatcccccccaccctacccagcgtggacggcataccgccggaggcctccaagcttggcctggacctcctccacagcctcagccgctcgcatggcctctctgtatgggtctcggcgagatggggcgatgggagtag

SEQ ID NO: 140197 - DNA, 831 bp, Artificial Sequence
  Description of Artificial Sequence: Synthetic coding sequence
atggggctgccatggggtcagccgcacctggggctgcaaatgttactcctcgcactcaactgtctgaggcctagccttagtctcgagcttgttccatacactccacagataacggcttgggacctggaaggaaaggttactgccacaaccttttctctggaacagccccgatgtgtctttgacgggcttgctagcgcgtctgacacagtctggttagtggtggcattctcaaatgccagccgcggctttcagaatcctgaaaccctcgcagacattccagctagtccccagttgctgactgacggacattatatgacactgcccctctcgcccgatcagctaccctgtggtgatcccatggctggctctggaggagcacctgtgctgagggttggccacgatcatggatgccaccagcagcccttttgtaacgcccctctaccaggtcccggtccatatcgcgtaaagtttctattaatggacacgagaggcagtcctagagccgaaactaagtggagcgatccaatcacactacaccagggtaagacacctggatcaatcgacacgtggccgggccgcaggtctggctccatgatagtgatcacctcaatcctctcctctcttgcgggtttactcctcttagcattcttagcagcctccacaatgcgattctcttcactgtggtggcccgaggaagcacctgaacaactgcgcatcggcagtttcatgggaaagaggtacatgactcaccatattccaccccgggaagctgccacactgcctgtcgggtgcaaaccaggtctcgaccctctgccatccctgtctccgtag

SEQ ID NO: 140198 - DNA, 963 bp, Artificial Sequence
  Description of Artificial Sequence: Synthetic coding sequence
atggggctgccatggggccagccccatctgggcctacagatgctgcttcttgcattaaactgcttgaggccctctttgagcctgggcgagtggggtagttggatggacgcctcctcacagacccagggagccggggggcccgcgggcgtcattggaccatgggcaccagctcctttacggcttggtgaggctgcccctgggacacctaccccagtgtctgtggcacatctgctgtcccccgttgcaactgagttagtaccatataccccacaaataactgcctgggacctagagggaaaggttaccgccaccaccttttctctggaacagcctaggtgcgtcttcgacggcttggcgtccgcatccgacaccgtgtggctagtcgtggctttcagtaatgccagcagaggattccagaaccccgaaacactggcggatattccagcaagccctcagctgcttaccgatggccattacatgacattacctttatcaccagatcagttgccgtgtggcgacccaatggccggttcaggtggagcccctgtgctacgggttggccatgaccacggttgccatcagcaacctttctgcaacgcaccgctcccaggacccggaccctaccgcgaggatccgcgcatacatcgacatttggcacgggcagctaagtggcaacatgaccgacactatttgcatcctctgttttcggggcgccccccgactttgggactgctggggtccctgtatcatgccctgcttcagccggtcgtggcgggcgggggtcccggagccgcagccgatcgtctgcttcatggccaggcactgcacgacccacctcatcccacccagaggggaaggcacacagcaggcggcctgcaagcatggcctgggcctccaccacaaccccagcctctggcatggcccttatgcatggggcttggagaaatgggtcgctgggaatag

SEQ ID NO: 140199 - DNA, 831 bp, Artificial Sequence
  Description of Artificial Sequence: Synthetic coding sequence
atgggcctgccatgggggcagccacatctcgggctgcaaatgctgctgttggcactcaattgcttgcgccctagcctttcactggaactggtcccctacacgcctcagattaccgcctgggacctggagggcaaggttaccgccaccacgttttcgctggaacagccacgctgcgtgttcgatgggctggcttccgcttcagataccgtgtggctggtggtcgcttttagcaacgcgagccgcggcttccagaatcctgaaaccctggccgacattccggcgtctcctcagcttctgactgacggccattacatgactcttccgctcagtccagatcagctcccttgtggtgatccaatggccggatccgggggcgcccccgtgcttagggtgggccacgaccacggctgccaccaacagccattctgtaatgccccattgccgggcccaggcccttaccgggttaaatttttgctaatggacacgagaggctctcctagagccgagactaaatggtcagatcctatcactttgcatcagggaaagacaccaggcagcatcgacacctggcctggtaggagatctgggagtatgattgtgatcacgtccatccttagtagcctggcaggactcctgcttctggcctttctcgctgcctcaaccatgcgtttctccagtctttggtggccagaggaagccccagagcagctgaggatcggctctttcatgggaaagcggtacatgacacaccatatcccgccgcgagaggcagctactttgccagtgggttgtaaacctgggctggaccccttacccagtttgtccccatag

SEQ ID NO: 140200 - DNA, 963 bp, Artificial Sequence
  Description of Artificial Sequence: Synthetic coding sequence
atgggcctcccttggggccaaccacatttggggctacagatgcttctgctcgcattgaattgcctaagacctagcctgtccctgggagagtggggaagctggatggatgcgtcaagtcagacgcagggcgccggcggaccagcgggtgttatcggtccttgggctccggccccactcagattgggtgaagctgcccccggcacccccactcctgtgtctgtggcacacctcttatctccggtagccactgaactggttccgtacacgcctcaaattacggcgtgggacctcgaaggcaaggtgactgcaaccaccttctccttggaacagccccgctgtgtttttgacgggttagcctctgcctctgacactgtatggttagtcgtggccttttccaatgccagccgagggtttcagaacccagagaccctggccgacatccccgcaagcccgcagctgctcacagacggacattacatgacactccccctgtccccagatcagctcccttgcggagatcctatggcaggcagtgggggcgcccctgttctccgggtgggtcacgaccatggctgccaccagcaaccattctgtaatgcgcccctgcctggcccgggcccctatagggaagaccccagaatccaccggcacctggctcgagcagccaagtggcagcatgacagacactatctgcatcctctattctccggacggccacccactctgggcttgctgggttccctgtatcatgcattgctgcagcccgttgtggccggcggaggccccggcgccgccgctgatagactgctccacggccaggcccttcacgatcctcctcaccctacccagaggggcaggcataccgccggaggcctccaagcatggccgggccctccaccccagcctcagcctctggcgtggccgctctgcatgggcctgggggaaatggggcgttgggaatag

SEQ ID NO: 140201 - DNA, 1104 bp, Artificial Sequence
  Description of Artificial Sequence: Synthetic coding sequence
atggaggccaatggcttaggtcctcagggctttccggagctaaagaacgacaccttcctgagggccgcatggggcgaggaaaccgattataccccggtgtggtgtatgagacaggctgggcgctatctgcccgagttcagggagacacgggctgcgcaggattttttctccacatgccgatcaccagaggcctgctgcgaactcactttgcagcctctgcggcggttcccactggatgctgccattattttcagcgacattttggtcgtgccacaggccctgggcatggaggtcactatggtcccggggaagggacccagttttcctgagccactgagggaggagcaggacctggagcgcctccgcgaccccgaagttgttgcctccgagctgggctacgtctttcaggccattaccctaactaggcaacggctggctggtagggtacccctgataggatttgccggcgctccatggacacttatgacgtatatggtcgaagggggtggctcaagtaccatggcccaggctaaacggtggctgtatcaacgccctcaggcttctcaccagctgctgcgtattcttaccgatgcattagtaccatatctggtgggccaagtcgtggccggagcccaggccttgcaattatttgagtctcatgcagggcacctgggcccacagctgtttaataagtttgctctgccgtatatcagggatgtcgcgaaacaggtgaaagctcggctgagagaagcagggctcgcgcctgttcccatgatcattttcgcaaaggacgggcatttcgccctggaagagctggcacaggcaggctacgaagtggttggcctcgactggaccgtcgctccaaaaaaggcccgcgaatgtgtcggcaagacagtgactctgcagggcaatctggatccgtgcgcgctgtacgcctccgaagaagagataggacagctggtgaagcagatgctggatgacttcggcccacaccgttatatcgccaacctggggcatggcctctaccccgatatggacccagagcatgtcggcgctttcgtagatgcggttcacaagcactccagactgcttcgccagaactag

SEQ ID NO: 140202 - DNA, 582 bp, Artificial Sequence
  Description of Artificial Sequence: Synthetic coding sequence
atggaagcaaacggcttaggacctcaaggctttcctgaactgaagaacgataccttcttacgcgctgcctggggcgaggaaactgattacacaccagtctggtgcatgaggcaggccggaaggtatctcccagagttcagggagactcgagccgctcaggatttttttagcacgtgcagaagtccagaagcttgctgcgagttaacactgcaagcactgggcatggaagtgactatggtccctggcaagggcccatcattccctgagcctctgcgagaagagcaggatctggaacgccttagagaccctgaggtggtcgccagtgagttgggctacgtgttccaggccattacgcttacccgacagaggctggcagggcgagttccccttattggctttgccggggctccgtggacattaatgacgtacatggtggaggggggaggaagctctaccatggcccaagctaagcggtggctgtatcagcgcccccaggcctcccatcagctcctccgtatattgaccgatgctcttgttccttatctcgtgggacaggttgtggccggtgcccaggccctgtag

SEQ ID NO: 140203 - DNA, 684 bp, Artificial Sequence
  Description of Artificial Sequence: Synthetic coding sequence
ccacagggattccctgagctcaagaacgacacctttctgcgggccgcttggggggaggagaccgactacactcctgtgtggtgtatgcgccaagccgggcgctacctgcctgaatttcgtgagacccgggccgcccaggattttttttcaacatgtcgctcccccgaagcctgttgtgaactgactctccagcctctcagaaggtttcccttggatgccgcaattatcttctccgacatattggtcgtgccccaggcactcgggatggaagtgactatggtgcctggtaaaggaccatccttccccgaacctcttcgtgaggagcaggacttagaacggttgcgggaccccgaggtggttgcaagcgaactgggatacgtttttcaggcaatcacattaacaaggcagcgcctggccgggcgcgtccccctgatcggatttgcaggggcaccggccctgcaactgttcgaatcgcacgcaggtcacctcggaccccagctattcaacaagtttgccctgccatacatcagggacgtggcgaagcaggtgaaagcacgtttgcgtgaggcgggccttgcccccgtgcccatgatcatcttcgccaaagatggacacttcgcgcttgaggaactggctcaggccggttacgaagttgtcgggcttgactggacagtggcaccgtag

SEQ ID NO: 140204 - DNA, 687 bp, Artificial Sequence
  Description of Artificial Sequence: Synthetic coding sequence
tgaccccagggcttcccagaactgaaaaacgacactttcctccgggccgcctggggcgaggagacagattacacaccagtgtggtgtatgcgtcaggcgggccggtacctaccggagtttcgagaaacccgcgccgctcaggactttttctctacgtgccggtccccagaagcttgctgcgagttgacactgcagccactgcgccgctttccacttgatgctgcaatcatcttttcggacatcctggtcgtcccacaggccctaggcatggaggtgaccatggtgcctggtaagggccccagctttcccgagccactgcgagaggaacaagatctggagaggcttagagatcccgaagtggtagcatcagagttgggatacgtatttcaggcgatcacgttgacccggcagcgactggccggcagagtgccgctaataggtttcgccggagcacccgccctgcagctgtttgaaagtcatgcaggccaccttggcccacagctgtttaacaagttcgcactcccatacattagggatgtagcaaagcaggtaaaggcgcgcctgcgcgaggcaggcttagctcctgtacctatgataattttcgccaaggacggccattttgctctggaggagctggcacaggctggatatgaggtggttggtctggactggactgttgctccatag

SEQ ID NO: 140205 - DNA, 582 bp, Artificial Sequence
  Description of Artificial Sequence: Synthetic coding sequence
atggaagccaacggcttgggcccacaagggtttcccgaactcaaaaatgatacattcctccgggctgcgtggggggaggagacagactatacacctgtgtggtgcatgcgacaggctggtagatacctgcctgaatttcgcgagactagggcagctcaggacttcttcagtacctgtcggtcccccgaagcatgctgcgagcttactcttcaggcactgggaatggaagtgacgatggtgcccggcaagggcccatctttccccgaaccattgagggaggaacaggacctggagagactaagggaccctgaggtagtggcctccgaactgggatacgtattccaggccatcaccctgacgagacagaggttggctggtagggtgccactaatcggattcgccggagccccctggaccctgatgacttacatggtcgaagggggaggcagctccactatggctcaagcgaagcgctggctttaccagagaccccaggcctcccatcagttgttgcgaattttgactgacgcccttgtgccctacctggtgggccaggtcgtggcaggcgcgcaagccctgtag

SEQ ID NO: 140206 - DNA, 402 bp, Artificial Sequence
  Description of Artificial Sequence: Synthetic coding sequence
atgaaggtccttcttctcaaagatgctaaggaagacgactgcggccaagacccttacatccgggagcttggcttgtatggactcgaagccaccttgatacctgtgctctccttcgagtttctgagtctgcctagtttctccgagaaattgtcccaccccgaagactatggcggcttgatctttacctcacctagggccgtcgaagccgcagagttgtgcctggagcagaataacaagacagaagtatgggagcgctcactcaaggaaaagtggaacgccaagagcgtgtacgtggtgggcaacgctacggcatccctagtttcgaagatcggattggacaccgagggcgagacttgcggcaatgctgaaaagctcgcagagtacatatgtagctctaaatag

SEQ ID NO: 140207 - DNA, 420 bp, Artificial Sequence
  Description of Artificial Sequence: Synthetic coding sequence
atgaaggtgctgcttctgaaagacgcgaaggaagatgactgtggtcaggatccctacattcgggaacttggcctgtatggcctggaagctaccctaatccctgtcctttccttcgaatttctgagcttaccatcctttagtgaaaaactgtcccaccccgaggattatggcggcctcattttcacgagccccagagcggtcgaagcagccgaattgtgtctggagcaaaacaacaagactgaagtctgggagcgatctctaaaggagaagtggaacgctaagtccgtgtacgtcgtcggtaacgccacagcatcccttgtcagcaagattggtctcgataccgagggcgagacctgcggtaatgccgaaaaactcgccgagtacatttgctcctccgaagaggtgaaggggattttttag

SEQ ID NO: 140208 - DNA, 798 bp, Artificial Sequence
  Description of Artificial Sequence: Synthetic coding sequence
atgaaggtgctgctgctgaaggacgctaaggaagacgattgcggccaggacccttatattagagagcttgggctgtatgggctagaggccactctgatacccgtgctgagctttgaattcctctccctgccaagcttctctgagaagctgagccacccagaggactatggcgggctgattttcacctccccacgtgctgtggaagccgctgaactgtgtctggaacagaacaacaagaccgaggtctgggaaaggtccctgaaggagaaatggaacgcaaagtctgtgtacgtagtagggaatgccaccgccagtcttgttagcaagatcggattagacacagaaggcgagacgtgcggcaatgccgaaaagttggccgagtacatttgttcacgtgagagcagtgccctgcctctattattcccgtgcggcaacctgaagagagagatcctgcctaaggcgctcaaggacaaggggatcgcaatggagagcatcactgtgtatcaaactgttgcacatcctggtattcagggcaatcttaacagttactactctcaacaaggtgttcccgcttcgataacattctttagtccttccgggctgacttattcactaaagcacatccaggagcttagcggtgacaacatcgaccagattaaattcgctgccatcggccctaccacagcccgtgctctagcagcccagggactgccagttagctgtactgcggagtcaccgaccccacaggccctggctacagggattaggaaggccctgcagccgcacgggtgttgctag

SEQ ID NO: 140209 - DNA, 798 bp, Artificial Sequence
  Description of Artificial Sequence: Synthetic coding sequence
atgaaagtgttgctgctcaaagacgctaaagaagatgattgcggccaggatccgtatatccgcgaactgggactgtatggcctggaggcaacgctcataccagttctgagctttgagttcctgtctctgccgtcattttccgaaaaactttcccacccggaggattacggtgggctgatcttcacctcacccagggccgtcgaggccgctgaattgtgcctggaacaaaacaacaagaccgaggtttgggagaggagcctaaaggaaaaatggaatgctaaaagtgtttatgtggttggaaatgccactgccagcctcgtctctaaaatcggacttgatacagaaggggagacatgtggtaacgcggagaaattagctgagtatatctgttcaagggagtcgagcgctttgccactgctattcccatgtgggaatcttaagcgcgagatcttacctaaagcactgaaggataagggaatagcaatggagtccatcaccgtgtaccaaactgttgctcacccgggtatccaaggcaacctaaactcctactattcacaacagggcgtgcccgccagcatcacgtttttttccccctcagggctcacctactccttgaagcatattcaagaattaagtggcgacaacatcgatcagataaaattcgctgctatcggccccacaacagcaagagcactggccgcacagggactgcccgtgtcctgtaccgctgagagtccgacccctcaggctctggctacaggaatccgcaaggcccttcagccccatggctgttgttag

SEQ ID NO: 140210 - DNA, 558 bp, Artificial Sequence
  Description of Artificial Sequence: Synthetic coding sequence
atgaaagtgctgctgctgaaagacgctaaagaagatgactgtgggcaagacccctatataagactcagccaccccgaagactacggcggtctgattttcacatccccacgagccgtcgaggccgccgaactatgcctcgagcaaaacaataagacggaagtgtgggaaagatccctcaaagaaaaatggaatgctaagtcggtttatgtcgtgggcaacgccacggcatccctcgtgagtaagataggcctcgataccgagggcgagacgtgcggtaatgctgaaaagctggcggagtatatctgcagccgtgaatcctctgccctgccattgctatttccgtgtggcaacttaaagcgcgaaattctgccgaaagccctcaaagacaagggcatcgccatggagtccattacagtgtaccagacagtggcccacccgggtattcaaggtaacttaaactcctattacagtcagcagggcgtccctgcctcaatcaccttcttctctccgtctggactgacatattccctgaagcacatccaagagctgtccggatag

SEQ ID NO: 140211 - DNA, 2700 bp, Artificial Sequence
  Description of Artificial Sequence: Synthetic coding sequence
atggatcgaaaggtagcccgcgaattcaggcacaaggttgatttcctcatagagaacgacgcagagaaggactatctctacgatgtccttaggatgtaccaccaaaccatggatgtggctgtgctcgtgggggatcttaagctggtgattaatgagcccagccgcctaccattatttgacgcaattcgaccactgattcctctcaaacatcaagtcgagtacgaccaacttactcccaggagatctcgcaaactgaaggaagtgagactggatcggctccatcccgaaggcctgggactgtccgttagaggcggccttgaattcggctgcggcctgtttatttcacatcttatcaagggagggcaggccgactccgttggccttcaagtgggcgatgagattgtccgcattaacggttactctatctcttcctgtacccatgaagaggtcattaatttgatccggacaaagaaaaccgttagcatcaaggtgaggcacattggtctaatacctgtgaagtccagtcccgatgaacccctcacctggcagtatgtggatcagtttgtatcagaaagcggcggggtgaggggctccctgggaagcccagggaatcgggaaaacaaggaaaagaaggtgtttataagtctcgtgggatcacgaggactcggatgtagcatttctagcggccctattcaaaaaccagggatattcatttctcacgtgaaacccgggtccctgagcgcagaagtcgggcttgaaattggggaccaaatagtggaggttaacggagttgatttttccaacctcgaccacaaggaagccgtgaacgtcttgaaatcgagtcgtagccttacgattagtattgtcgccgctgctggacgagagttgttcatgacagaccgtgaaagattagctgaggctcgccaacgggagctgcagaggcaagagctgctgatgcagaagaggctggccatggaaagtaacaaaattctccaggagcaacaggagatggagaggcagcgccgtaaagagatcgcccagaaggccgctgaagagaacgagaggtaccgaaaggagatggaacagatcgtcgaagaagaagaaaaatttaaaaagcaatgggaggaggattggggctccaaagaacagcttctcctgcccaagaccatcacagcggaagtccaccccgtaccattgaggaagcctaagtccttcggctggttctaccgctacgacgggaaattccctaccatcaggaaaaaagggaaggacaagaagaaggcaaaatatgggtcgctgcaagatctgcggaagaacaaaaaggagttggagtttgaacaaaaattgtataaggagaaggaggaaatgctggagaaggaaaaacagctgaagattaaccgactggcacaggaagttagcgagacggaaagagaggatcttgaggagtccgagaaaattcagtattgggttgagcgtctgtgccagacccggctggagcaaatcagcagtgccgataacgaaatatctgaaatgaccacgggccccccaccccctcctccttccgtgtcacctctagccccccccttgaggcgtttcgcaggaggcctgcacctgcacaccacagacttggacgacatccccttggatatgttctattatcccccaaagacaccttctgccctgcctgtcatgccacaccctccgccaagcaatcctccgcacaaggttcccgcacctcctgtgcttcctctttccggacatgtctctgcgtcaagctcgccttgggtgcagcggaccccaccccccatccctatcccgccgcccccttccgtgccgactcaagatcttacgcctacccgcccgctcccctccgctctggaggaggcactgtcgaaccatcctttccggacaggggatacagggaatccagttgaagattgggaagccaaaaatcattccggtaagcccacaaacagtcccgtgccggaacagagtttccctccaacgccgaaaacattttgcccctccccgcagccaccccgcggccccggagtctctacgatttctaagcccgtaatggtgcaccaagaacctaacttcatctatcgcccagcagtaaaaagcgaggttctgccacaggaaatgctgaagaggatggtggtgtatcagaccgcttttcggcaggactttagaaagtacgaggaaggttttgatccatactctatgtttacgccggagcaaatcatgggcaaagatgtgcggctgttgagaatcaaaaaggaaggttcattggatctggcgttggaaggtggagtagacagcccaatcgggaaggtcgtggttagcgctgtgtacgagcggggggccgccgaacgtcatggtggtatagtgaagggggacgaaatcatggccatcaatgggaaaattgttaccgattacacacttgccgaagccgaagctgccttgcaaaaagcttggaatcagggaggagattggattgatctggtggtggctgtgtgtcctccaaaggagtacgatgacgagctcgcttccctacctagttctgtggccgagtccccccagccagtccgaaagctgcttgaagaccgcgccgcagttcacaggcacggcttcttattacagctagagccgacagacttactgcttaaatctaaacgaggaaaccagattcacagatag

SEQ ID NO: 140212 - DNA, 1659 bp, Artificial Sequence
  Description of Artificial Sequence: Synthetic coding sequence
atggatcgcaaagtggcacgcgagtttcgtcacaaggtggactttctgattgagaatgatgcggagaaggactacttgtatgacgtgcttcggatgtatcaccagaccatggacgtcgctgtactcgtgggcgatctgaagctcgtgattaatgaaccatcacggctgccgctgttcgatgctattcgtccactgatcccgctgaagcaccaggtcgaatacgatcagctgaccccacgcaggagcagaaagctgaaagaggttcgactggaccgtctccaccctgaggggctgggactgagcgtgagaggcggattggagtttggctgtggactcttcattagccacctgatcaaaggaggccaggcggacagtgttggactgcaggtgggggacgaaatcgtaaggatcaatgggtactcaatttcttcctgtacgcacgaggaagtgattaacctaatcaggaccaaaaaaacagtgtccatcaaggtgcgccacatagggttaataccggtgaagagttcaccagacgagccactcacatggcaatacgtggaccagtttgtttctgaaagtggaggggtgcgcggaagtctcggatcccccggaaacagagaaaacaaggagaagaaagtgtttatcagcctagtgggtagtcgcggcttaggctgcagtatatccagcggccctatacaaaagcccggcatctttatctctcacgtaaaacccgggagcctttccgccgaggtgggattagaaattggcgatcagatcgttgaggtgaacggcgtcgatttctccaacctcgatcacaaagaggccgtaaatgtactcaaaagtagtagaagcttaacgattagcatagtggccgccgccggacgggaactttttatgacagatagagagcggctggccgaggcgaggcagagggagcttcagcgccaagagctgctgatgcagaagcggctagccatggaatccaacaaaatactgcaggaacagcaggaaatggaacgccagaggcgtaaggagattgcccagaaagccgctgaagagaacgaacggtataggaaagagatggagcagattgttgaggaggaggagaaattcaagaagcagtgggaggaggactgggggagcaaggagcagctcctcttgcctaagactataacagctgaagtccacccagtcccgcttcgcaagccaaagtatgatcaaggagtcgaaccagaactggagcctgccgacgacttggacggcgggacggaagagcagggggaacaggacttccgaaagtacgaagagggcttcgatccgtatagtatgtttacccctgagcagataatggggaaagatgtgaggctgctccgcatcaagaaggagggatccctcgacctggcacttgagggcggcgtggattcccccatcggaaaagtcgtggtgagcgccgtatatgagcgcggagcagctgagcgtcacggtggaattgtgaagggcgatgaaattatggcaatcaatggaaaaatcgttactgactacacattggctgaagcagaggccgccctccagaaagcgtggaatcagggcggggactggatcgacctggtcgtagccgtgtgccctcccaaagagtacgatgacgagctgacctttttctag

SEQ ID NO: 140213 - DNA, 1602 bp, Artificial Sequence
  Description of Artificial Sequence: Synthetic coding sequence
atggaccggaaggtggcacgcgaattccgccacaaggtcgacttcctgatcgagaacgatgcagaaaaggattatctttatgacgtactgcggatgtatcaccaaaccatggatgttgccgttctcgtcggagatctgaagctcgtgatcaacgagcccagcagactgccattgtttgatgccattcggccactgattccactgaagcatcaagtggaatacgaccaactgacaccgcggaggagcaggaagctgaaagaggtccgactggatcgcttgcatcctgaggggcttggacttagcgtgagaggcggactggaattcgggtgcggcctgttcataagccatttgatcaaaggaggacaagccgatagcgtggggctccaagtcggtgacgagattgtacgcatcaacggatatagcatctcgagctgtacgcacgaggaagtcatcaacctgataaggacgaaaaaaactgtctcgattaaggtgagacacatcggacttatccccgttaaaagtagccccgatgaaccattaacatggcagtatgttgaccagtttgtttctgagtcagggggggtccgcggtagcctgggttctcctggaaaccgagaaaataaagagaaaaaggtgttcatttccctggtggggagcaggggccttggttgttctattagctccggcccgattcaaaagccaggcatcttcatcagtcacgtaaaacccgggtccctcagcgctgaggtggggcttgagataggggatcagatcgttgaggtcaatggagtggacttcagcaatctcgaccacaaggagggacgcgagctgtttatgacggaccgggagcgcctggccgaagccaggcagagggagctccaaagacaggagttgcttatgcagaagcggctggcaatggagagcaataagatattacaggaacagcaggaaatggaacgacagagacgtaaggagatcgcccagaaagcagccgaggagaacgagaggtataggaaggagatggagcagattgtggaggaagaagagaagttcaagaaacagtgggaggaggattggggttctaaggaacagttgcttttgcctaagactattaccgccgaggtccatccagtgccgttaagaaagcccaagtacgatcagggtgtcgagcctgaactggagccggctgatgatctagatggaggaaccgaagaacagggggaacaagattttcgcaagtatgaggaagggttcgatccctatagcatgttcacgcccgagcagatcatgggaaaggacgtgaggctgctgcggataaagaaggaggggtcactggatctggccttggagggcggagtggactcccctatcgggaaagtggtagtgtccgcggtctacgaaaggggtgcggccgaacggcacggcggcattgtgaagggagatgagataatggccattaacggcaaaattgtgaccgattacactttggccgaggcagaggccgccctgcagaaggcctggaatcaaggcggcgactggatcgacttagtggtggcagtgtgccccccaaaagagtacgacgatgaacttacctttttctag

SEQ ID NO: 140214 - DNA, 1566 bp, Artificial Sequence
  Description of Artificial Sequence: Synthetic coding sequence
atgtatcaccagacgatggacgtcgccgtgctggtaggggacctgaagttggtgatcaatgaaccctctagactccctctgtttgacgctattcggcccctgatccccctgaagcaccaagttgagtatgaccagctgactccgcgacggtcgaggaagctcaaggaggtgcgcctagacagactgcacccagaaggactgggactttctgtaaggggcggtttggagttcggatgtggcctgttcatcagccaccttatcaagggcggccaggctgactcggttggcctgcaggtgggggatgagattgttcgaattaacggatactcaatctcttcttgcacccacgaggaggtgatcaatctgattcgcaccaaaaagacagtttccattaaggtgcgtcacataggccttattcccgttaaatcctcccctgacgaacccctgacctggcagtatgtggatcagttcgtgtccgaaagcggcggagtcaggggcagcttgggatccccagggaacagggagaacaaagagaagaaagttttcatttctctggtcggaagtcgtgggctgggctgctcaatatcatctggaccgatccagaaacctggaatctttataagtcacgtgaaacctggcagcctctctgccgaagtcggcttggagatcggcgatcagatcgtcgaggtaaatggagttgatttttcaaacttagaccacaaggaggccgtcaacgtgctgaaaagctcacgttcattgaccatatcaatcgtggccgctgccggacgggagctgttcatgacagatagggagcggctcgccgaagccagacagagagagctccagagacaggaactgttaatgcagaaacggctggccatggagagcaataagattcttcaggaacagcaagaaatggagagacaaagacgcaaagagatagctcaaaaagcggccgaagagaacgaacgttatcgaaaagaaatggagcagattgtggaagaggaggaaaagttcaagaagcagtgggaggaagattggggatcaaaggaacaactcttgctgcctaagaccattaccgccgaagttcatccagttccactgagaaagcccaagtatgatcagggcgtggaacctgagctggagccagctgatgacctggatggggggacagaagaacagggcgagcaggactttaggaaatatgaggagggttttgatccctactcgatgtttacacctgagcagattatgggaaaggatgtgcggttactaaggataaagaaggaaggcagtcttgacttggcacttgaagggggcgtggactcccctatagggaaggtggtggttagcgccgtgtacgaacgtggcgctgccgagcgacatggtggcatagtgaagggcgacgagatcatggccatcaacggaaagattgtgaccgattacactttagctgaggctgaagccgctcttcagaaggcttggaatcaaggcggagattggatcgacctggtggtggccgtgtgccctcccaaggaatacgatgatgaactgacattcttctag

SEQ ID NO: 140215 - DNA, 2112 bp, Artificial Sequence
  Description of Artificial Sequence: Synthetic coding sequence
atgagtgctagagcgactcgccctcgcagccggcggggaaggcatgcccctccgggcgagttggatccggtagcagagagcagcgaagaggtcgaggctgcttccgggtcatccaaaccttcttttgcccctcctcccgtgtcctcaggcttggagcagctcggacctatggaagaggtgtcggggcagggtcttggtagcaggacggacaagaaaatggatggagggtcagggagagagctcgcaagtgccccagaggtgccgcacaaacccgctgtggaggcccaccaggctccggaagctgccctccagtacaaggagacggtgccgccaggcaatggagctcccgatgtcttccaaacccttcaacatactctgagctccttggaggccgcggccgccgcatggcggcatcagcctccttctcatagtgggcccatggagttcgaaggaacctcagaaggaggggccggtagtttggggaagcaggaaggggccgggtcatgtcagcgggaggctgctcggctggctgagcggaacgcatggctgaggttggctctgtcctctcgcgaagacgaactggttcgcacgcaggcttccctcgaagcaatccgggctgagaaggagacactgcagaaggaggtgcaagagctgcaggatagcctcctgcggctcgagccctgcccacatctgtcgcataaccaggccggtgggtctggtagtggaagttcaagctccgaagctgaccgcgagccctgggagacccaagattctttcagcctggcccatccacttttgagacgtttgcggtcacatagctcaacacagatccttgggtctctgcctaaccagcccctgtctccggaaatgcatattatggaggctcagatggagcaactccgtgggtctattgagaagctgaagtgctttaaccgtcttctgtccgccgtgctccagggatataaagggcggtgtgagggcttaagcatgcagttgggacagcgtgaagccgaggccaccgccctgcacctcgcactccagtactcagaacattgcgaggaagcctaccgcgttttgttagcgctccgggaagccgactccggggccggggacgaggcacctatgtccgatctgcaagcagcagaaaaggaggcctggagactgctggcgcaggaggaggctgcaatggatgcaggagctcagcagaatccccagccttccccggagggctcatctgttgacaagcctaccccgcaggaggtggcattccagttgcgcagctacgtgcagcgactgcaggaacgccgatccttgatgaagatcctgagcgaacctggccccaccctggcgcccatgccaaccgtgcctagggccgaagccatggtacaggcgattctgggtacgcaggccggtcctgccctgccacggctagagaagacgcaaattcagcaggacttggtggctgccagagaggccctagccgacctgatgctgagattgcagctcgttcgtcgcgaaaagcgcgggctcgagctgagagaagctgccctgcgcgcactcggaccggcacacgttcttctcctcgaacagctgcgatgggagcgcgccgagctgcaagcaggtggcgcaaactccagcggcggccactcgagcgggggcggatccagcggggacgaggaagaatggtaccagggcctccccgccgtgccaggcggtacctctggaattgatggtggccaggtggggagagcctgggaccccgagaaactggcgcaagagttggccgcatccctcacgaggaccttagatctgcaagaacagttgcaaagcctcagaagggagctggaacaggtcgcacaaaagggaagagctcggcgcagtcaaagcgctgaactcaatagagacctgtgtaaggcacatagtgctctcgtgcttgccttcaggggggcccacaggaagcaggaggagcagcggagaaagctagagcagcagatggctctaatggaagcccaacaggcggaagaagttgctgtgctagaggctaccgcacgcgcccttgggaagccaagaccgccgctcccccccccccagttgggggatacattcttgtag

SEQ ID NO: 140216 - DNA, 1152 bp, Artificial Sequence
  Description of Artificial Sequence: Synthetic coding sequence
atgagcgctcgtgccacgaggccacggtcacgcagggggcgccacgcccctcccggagagctggatccggtggccgaatctagcgaggaggtggaggccgcctctgggagctccaagccatcgtttgctccacctcctgtctcaagtgggctggaacagctgggccccatggaggaggtgagtggacaggggctaggctccagaaccgataaaaaaatggacggtggcagcggccgggaactggcctccgctccagaggtgccacataaaccagcagtggaggcccaccaggcccccgaagcggctctccagtacaaggagaccgtacctcctggaaacggggcacccgacgtttttcaaacactccagcatacgctcagctctctcgaagccgctgcagcagcgtggcgccaccagccaccctcccacagcggacccatggaattcgaaggtacttccgaaggcggagcaggttcactagggaaacaagagggggccggaagctgccagagggaggctgcccgcctcgctgagcgcaacgcatggctaagacttgccctttcttctcgcgaagatgagctcgtgcggactcaggcaagcctggaggctatccgggccgagaaagaaaccttgcagaaagaagtccaagagttgcaagactctctgttgcgcctcgagccctgcccgcatctttcacataaccaggcaggcggatctggttctggctcaagttctagcgaggcggacagagagccatgggagacccaggatagcttttctttggcacaccctctcctgcgacgcctgagatcccactcatccacgcagattctgggctccttgcctaaccaaccactgtcacctgaaatgcatatcatggaggctcaaatggagcagctgcgcggcagcattgagaaactgaaatgtttcaacaggctgctttccgcggtactacaaggctataagggtaggtgtgaaggcctgtctatgcagctggggcagcgagaggccgaggccaccgcacttcacctagcactgcagtatagggttctgctgtgccacccagggtggtcagctgtggtcccatcctggctgaccgcgacatcagccagtcccgttcaggtgatcctgctcccacagccaccagagtag

SEQ ID NO: 140217 - DNA, 1920 bp, Artificial Sequence
  Description of Artificial Sequence: Synthetic coding sequence
atgcttcaccccacagacaagaagatggacgggggatctgggagggagctggcatctgcccccgaggtaccccataagcccgcagtcgaagcccaccaggcccctgaagctgccctccagtataaggaaaccgtaccaccaggaaatggggcgccggacgtattccagacgcttcagcatacgttgagcagtttggaggcggcagcggctgcatggcggcatcagcccccgtcccactcaggacctatggaatttgaaggcacttctgaaggcggggccggcagcctggggaaacaggaaggagccggatcgtgtcaaagagaggctgctagactcgcggagcgcaatgcctggctgagacttgcactgtccagtagggaagatgagctggtgcggacccaagcatcattggaagccatcagggctgaaaaggaaacgttacagaaggaagtccaggagctgcaggactcactcctgcgcctcgagccatgcccgcatctctctcacaaccaagctggcggctcagggagtggatcctccagttcagaggccgacagagagccatgggaaacccaggactcattttccctggcccaccccctgcttcggcgcctccggtcccactcctctactcaaatcctgggttcacttccgaatcagccattgagccccgagatgcatattatggaagctcaaatggaacagctgcgggggagtatcgaaaagctgaagtgctttaacagactccttagcgccgtgctgcagggatacaaagggcggtgtgaaggactgagcatgcagctgggccagcgggaagcagaggccaccgccctgcatctagccctccagtactccgagcactgtgaagaggcataccgcgtactcctagcgcttcgtgaggctgacagtggagcgggcgacgaggcgccaatgtctgacttgcaggccgccgagaaagaggcctggcgactcttagctcaggaggaggccgccatggatgctggcgcccaacagaaccctcagccatcccccgaaggaagcagcgttgataaacccactcctcaggaagtggcttttcagctccgatcttacgttcagcgactgcaggaacgccggagtctgatgaagatcctcagcgagcccgggccaacactggctccaatgcccactgtgcccagggccgaggcgatggtgcaggcgattctgggcacccaggctggacccgcactccctcgcctggaaaaaactcaaattcagcaagaccttgtcgcagctcgggaggctctggctgaccttatgttgaggctccaactggtgagaagagaaaaacgaggactcgagttgcgcgaagccgcattgcgcgcactgggccctgcccacgtgctactccttgaacagttaagatgggagagggccgaactgcaagcaggaggtgccaacagttcgggcgggcactccagcggaggaggttcatctggcgacgaagaagagtggtatcagggattgcccgcagtacccggagggacatctgggattgacggagggcaggtgggcagagcttgggatcctgagaagttggctcaggagcttgccgccagcttgacacggacattagacctacaggagcagctgcagtctctacggcgggagctggaacaagtggcccagaaggggagggctaggcgctcccagagcgccgaactgaacagagatctgtgtaaagcccactctgctcttgttttggcattcagaggagcgcatcgaaaacaagaagagcagagaagaaaactcgaacagcaaatggctctgatggaagcccaacaggccgaggaagtcgccgtgcttgaggcaacagcgagagcactgggtaaacctcgaccacccttaccaccgccccagttgggggacacgtttctctag

SEQ ID NO: 140218 - DNA, 1386 bp, Artificial Sequence
  Description of Artificial Sequence: Synthetic coding sequence
atgaatgatcaatatcatagagcagcacgcgatggctacctcgagctgttaaaggaagcaacacgcaaagagctgaatgctcccgatgaggatggtatgactcccaccctatgggctgcctatcacggaaatctcgaatccctgagacttattgtatccaggggtggagacccagataaatgcgacatttggggcaataccccgctccacctggcggcttctaacggccacctgcactgcttaagctttcttgttagcttcggagccaatatctggtgtttagacaatgattatcacacccctctagacatggccgctatgaaaggccacatggagtgtgtgagatacttggactctatagccgccaagcagtcttcgcttaacccgaagctggtcggtaaattgaaagacaaggcttttagggaagctgaacggaggatccgggaatgcgctaaactgcagcgcaggcaccacgaaaggatggaacggaggtataggagggaactggcagagaggtctgacactctcagctttagctctttgacctccagcaccttgtctcggagacttcagcatctcgccttgggcagtcatcttccttattctcaggccactctgcacgggacagcaagaggtaaaacgaagatgcagaaaaagttggaaagaagaaagcaaggcggcgagggaaccttcaaggtgtctgaggacggaagaaagtctgctcgttctctgtcagggctgcaacttggctccgacgtgatgttcgtccgtcagggcacctatgccaatcctaaggagtggggtcgggccccacttagggacatgttcctgtccgacgaagactccgtgtcacgtgccacactggctgctgaacctgctcatagcgaggtgtcaaccgatagcggtcacgatagtctttttacgaggcctggacttggcactatggtgtttcgcagaaattacctgtcgtctggtctgcacggactcggcagagaggatgggggactcgacggcgttggggcaccacggggccgcctgcaaagctctcccagccttgatgatgactcgttaggcagcgccaattctctgcaagaccggtcttgtggggaagagctcccctgggatgaattggatttagggctggatgaggacctggagccagagacttcccccttggagacatttttggcctccttgcacatggaggactttgctgccctgcttcgtcaagagaagatcgacctagaggccctgatgctctgcagcgatctggatctcagaagtataagcgtccccctcggcccgcgaaagaaaatcttaggtgctgtacgaaggcgcagacaggccatggaaagaccgccggctctggaggacaccgagctttag

SEQ ID NO: 140219 - DNA, 15609 bp, Artificial Sequence
  Description of Artificial Sequence: Synthetic coding sequence
atgaattgccccgtgctctcccttggaagcgggttcctttttcaagttattgagatgctcatctttgcttatttcgcatcaatcagtctgacggaaagccgaggcttgttcccacggttggagaacgttggggctttcaaaaaagtgtctatcgtcccaactcaagcagtgtgcgggctgcccgatcgctctactttctgccactctagtgctgccgcagaatctattcagttctgtacgcagcgtttctgcattcaagattgcccctaccgctccagtcatcccacatataccgccctgttcagtgcaggcctgagcagctgcatcacacccgataaaaacgatctacacccgaatgcccacagtaatagtgcttccttcattttcgggaatcacaaaagctgcttttcctcaccaccttctccaaagctgatggcgagctttaccctggccgtttggctcaagcccgagcagcagggcgttatgtgtgtgatagaaaaaactgtggacggccaaattgtgttcaagttgacaataagcgaaaaggagaccatgttctattacagaaccgtgaatggcctgcagccaccaatcaaagtaatgacactgggccggattcttgtgaaaaagtggatacacctgtccgtccaagtacaccaaactaagatctcgttctttatcaacggcgtggagaaagatcatacccctttcaacgctcgtaccttgtccggttccataaccgatttcgctagcgggacagttcagatcggccagagcctgaatgggttagaacaattcgtcggcagaatgcaggatttcagactttaccaggtcgccctcacgaatagagaaattctggaagtttttagtggagacttgctgcgccttcatgcacagagccactgtcgctgccccgggagtcacccgcgcgtgcaccctttagcccagaggtactgtatccctaatgatgccggtgataccgcggataatagagtttcaaggttgaatccagaagctcatccactgtcgttcgtgaatgataatgacgttggaacatcgtgggtctcgaacgtgttcacaaatataactcagcttaaccagggcgtgaccatatctgtcgatctcgagaatggccaataccaggtcttttatattatcatccagttttttagcccccagcctactgaaatccggatccagcgcaaaaaggagaacagcctagattgggaggattggcagtatttcgcgcggaattgtggggctttcggtatgaagaacaacggcgatctggagaagcctgactccgtcaattgtcttcagctgtctaactttactccatactcccgcggcaatgttacctttagtattctgacccccgggcccaattataggccgggatacaacaatttttacaataccccaagcctccaggaatttgtcaaggcaacacaaattcgattccacttccatggccagtattacactactgagaccgccgtgaaccttcggcaccggtattatgccgttgacgagattactatctcgggtaggtgccaatgccacgggcacgctgataactgcgatactacgtcacagccatacaggtgtttgtgttcccaggaaagctttactgagggccttcattgtgacaggtgcctgccactttataacgacaaaccattccggcagggtgatcaggtgtatgcctttaactgtaaaccatgtcagtgcaattcccattccaaatcttgtcactacaacatctccgtggacccatttccatttgaacacttcaggggcggcggtggcgtgtgtgatgactgtgaacacaatactactggacgcaattgcgagctgtgcaaggattatttcttcagacaagttggggccgatcccagcgcaatcgacgtctgcaagccttgcgactgtgacacggtgggcactaggaatggaagcattctgtgtgatcaaatagggggccagtgtaactgcaagcggcacgtatccggacggcagtgcaaccagtgtcagaacggattctacaacctccaagagctcgaccccgacgggtgcagcccatgcaattgtaacacatctggtaccgttgacggagacattacgtgtcatcagaactccggccagtgcaaatgtaaagccaacgtgatcggcctcagatgcgaccattgcaactttggatttaagtttctacgctcatttaacgacgtggggtgtgaaccttgtcaatgcaatctgcacggttctgtaaataaattttgcaatccccactccggacagtgcgagtgcaagaaggaggcaaaggggttgcagtgtgacacctgcagggagaacttctatggtctggacgtaacaaactgtaaagcatgtgactgtgatactgccggctccctgcctgggacggtgtgcaacgctaagacaggtcagtgcatctgtaaaccaaatgtggaggggaggcagtgcaataaatgtctcgaggggaatttttacctcagacaaaataacagttttctgtgtttgccttgtaattgtgacaaaactggtaccatcaatggctccttactctgcaataagtcaacagggcagtgcccgtgtaaattaggcgtcaccggcctgcggtgcaatcagtgcgaaccccaccggtataacttaacaattgacaactttcaacactgccagatgtgtgagtgcgattcactgggaactctgccaggtaccatttgcgaccccatttccggccagtgtctatgtgtcccaaatcgccagggcagaagatgcaaccagtgccagcctggtttctacatcagtccaggtaacgccacagggtgcttaccatgttcttgccataccacaggtgcggtgaaccacatttgcaatagtttaaccggccagtgcgtttgtcaggacgcaagcatcgccggtcagagatgtgatcaatgcaaggaccattacttcggatttgatccccaaactggcagatgccagccgtgcaactgccacctgtcgggggccctgaatgagacttgtcatttggtgactggccagtgcttttgtaagcagtttgtcaccgggtcaaagtgtgacgcttgcgtgcctagtgccagtcatcttgacgtgaacaacttgctgggctgttctaagacgcccttccagcaaccaccgccgagaggacaagttcagagctcctctgctattaaccttagttggtcaccgccggattctccaaacgcacattggctcacatactctctgctgcgtgacggcttcgagatttatacaaccgaggaccaatacccgtactccatccaatacttcctggataccgacctcctcccctacactaagtacagctattacatcgaaactacaaacgtacacggctctaccaggtccgtagctgttacatacaaaactaaaccaggggtgccagagggtaaccttactctctcctatataatccccattgggtccgactctgttactttgacctggaccactttgagcaaccagtccggtccgattgagaagtacatactgtcttgtgcgccactcgctggaggtcaaccttgcgtgtcttacgagggtcatgagacctccgctactatctggaacctggtgccctttgccaagtatgatttcagcgtccaggcttgtacatcaggcgggtgtttgcattcgctgcccatcactgtgactaccgcccaagcccctccccagcggctcagtccacctaagatgcaaaaaattagttcgaccgagctgcatgtggaatggtccccgcccgccgagctcaacgggattatcatcagatacgagttgtacatgcgcaggctcagatctacaaaagaaacaacatccgaggagagcagggtattccagtcctccggttggctgtccccccactcatttgtcgagagcgctaatgagaacgcccttaaaccacctcagacgatgaccacgatcaccgggctggagccgtataccaagtacgagtttcgagtcctggctgtaaacatggccgggagtgtgtccagcgcgtgggtctcggaaaggacaggagagtcagctccagtgtttatgatacccccttcggtgtttcccctatcttcctatagtcttaacattagttgggagaagccagcagataatgtgactcgcggaaaagttgtcggctacgatatcaacatgctgagcgaacagagccctcagcaaagcatccctatggctttcagccaattgctgcataccgcaaagagccaggaattgagctacactgtggaggggctcaagccctatagaatatacgaattcaccatcactctatgcaattccgtcggatgcgtcacatcagcgtccggagctggacagacactcgccgctgcacccgcccagttgcgcccgccccttgtgaaaggcatcaattccaccactattcacctcaggtggtttccccccgaagagttgaatgggccttctccgatctaccagctggaacggcgggagtcatctctgcctgctttaatgacaactatgatgaaagggataagatttatagggaacggctactgcaaatttccatcttctacacaccctgtcaatacggattttacaggcataaaagcgtctttcagaacaaaggtgcctgaaggcttaatcgtgtttgcagccagccccggcaaccaggaagagtacttcgctcttcagcttaaaaagggccgcctttattttctattcgacccccagggttcgcctgtcgaggtcacaacgacaaacgaccatgggaaacagtacagcgatggcaagtggcacgagataatcgccattcgacatcaggcatttgggcaaatcaccctggatgggatctatacaggcagttcagcaattctgaacggcagcacagtgatcggtgataataccggtgtattcctggggggcctgcctagatcttacaccattttgcgtaaagaccctgagattattcagaagggcttcgtgggttgcctgaaggacgtgcacttcatgaagaattacaatccaagcgccatctgggagcccctagactggcagtcaagcgaagaacagatcaatgtctacaactcttgggaaggctgccccgccagcctcaacgaaggagctcaatttctgggcgctggatttctcgagctccatccttacatgttccacggcggtatgaatttcgaaatctcctttaagttccgcacagatcaattgaacggtctcttgctatttgtgtataataaagacggacccgattttttggctatggagctgaaaagcgggattttgacatttcggctgaatacctcactcgcatttacacaagtggacctcttactggggctctcttactgcaacggcaaatggaacaaggtcatcattaaaaaggaaggcagctttatatcagcctcagtgaacgggctcatgaaacacgcctctgaatccggtgaccagccgcttgtggtaaactcgccagtttacgtaggtggcattccacaggaactcctgaacagttaccagcatctatgcttggagcagggcttcgggggatgtatgaaggacgttaaatttacccgtggtgcagtcgtcaatctcgccagtgtgtcctcaggtgcagtgcgcgtaaacctggacggttgcctgtcaacagactccgccgtgaattgcagggggaatgacagtatactggtttatcagggaaaagagcaatcagtgtacgaaggcggcctgcagcccttcactgagtacctctatagagtgattgcaagtcatgagggtggctcagtttattcagactggagcagaggccggaccacaggcgccgcaccgcagtccgttcccacccccagccgggtgagaagtttgaacggctactctattgaggtcacttgggacgagccagtggtcaggggggtgatagagaagtacatcttgaaagcttacagtgaagactcaacgcgaccccctaggatgccttctgctagtgccgaatttgtgaataccagcaacctgactggcatcctcactggtttgcttccatttaaaaattacgccgtcacattgactgcctgtaccctggctggttgcacggaatccagtcacgctctgaacatctctaccccccaagaggctccgcaggaggttcaaccacctgtcgccaaatctctgccttcctcactcctcttaagctggaacccacccaagaaggcaaacgggattattactcagtactgcctatacatggacggacgcctcatctattccggttcagaggaaaattatatcgtcacagatctggccgtattcaccccccatcagttcctcctgtccgcctgcacccacgtaggttgcaccaatagctcctgggtgttgctgtacacggcccaattaccaccagagcatgtcgattctccagttttgactgtgttagactcacggactatacatatccagtggaagcagcctagaaagatctccgggatcttggaacggtacgtgctgtacatgtctaatcatacccatgatttcactatctggtctgtcatttacaactcgaccgagctgttccaggaccatatgctgcagtacgtactccctggcaataagtaccttatcaaactgggcgcttgtacaggcgggggatgcactgtgagcgaggccagcgaagccctcaccgacgaagatatacccgagggtgtccccgccccaaaagcgcattcctactcgcctgattcttttaacgtctcatggacagagcccgaatatccaaacggcgtcatcacatcctatggcctgtaccttgacggcatccttattcataatagcagtgagctatcatacagagcctacggctttgccccttggagcctccactcctttcgtgtgcaggcctgtacggccaagggatgtgctctgggtcctctggtcgagaatcgcactttagaggcccccccggaaggtacagttaatgtgttcgtgaagacacaggggtccagaaaggcccacgtacggtgggaagctcccttccgccccaacgggttactcacgcattctgtcctctttactggcatattttacgtggaccccgttggaaacaattatactctcctcaatgtcaccaaagtgatgtatagcggggaagagaccaacctgtgggtgctcatcgacgggttggtgccttttactaattacacggtgcaggtaaatatatccaatagccaagggagcctgatcaccgacccaattacaattgccatgcctcctggagctccggatggcgtgctgcctccaagactgagttcggccacaccaacaagcctgcaggtcgtttggtcaacccctgccaggaataacgccccaggctcaccccgctatcagctgcagatgagaagcggggattccactcacggattcttggagcttttctccaatcccagtgcttccttgtcttatgaggtcagtgatttgcagccatacaccgagtatatgttcagactcgtggcgtccaatggcttcggaagtgcccactcctcgtggattcctttcatgacggcagaagacaagcccggccctgttgttcctcctatcctgttagacgtgaaatcacgtatgatgctggtcacctggcagcaccctaggaagagtaatggcgtgataactcactataacatatacctgcacgggcgcctgtacctaagaacccctggaaatgtgacaaattgtacagtgatgcatcttcacccatacaccgcttacaagtttcaggtagaggcatgtacatcaaaaggttgtagtctgtcccctgagtcccagaccgtgtggaccttaccaggcgcccccgagggaatcccctctccagaactcttctccgataccccaacgtctgttatcatcagttggcagcccccgacgcacccaaacgggttagtggagaactttaccatcgagcggcgggttaaaggtaaggaggaggttactacattagtgacgttacctagatctcattccatgagatttatcgataaaacctcagcactgagtccatggaccaaatatgagtaccgggtgctgatgtccactctgcacggaggaacgaatagttctgcctgggttgaagtcaccacacggccaagcaggccagcaggcgttcagcctccagtggtgacagtgctagagcccgatgccgtgcaggttacctggaagcctcccttgatacagaacggcgatattctgtcatatgaaatccatatgcctgaccctcatattacattgacgaacgttacttcagcagtattatcacagaaggtgactcatctgatcccatttaccaactatagcgttacaatcgtggcttgtagcggcggaaacggttacctcgggggatgcaccgaatccctgcctacctacgtgacaacccaccccacggtgccacagaatgtgggtcctctgtcagtgattccactgagcgagtcctacgtggtaatatcctggcagccaccttctaagccgaacggaccaaaccttaggtacgagcttctgaggcggaagatccagcaacctctggcttccaatcctcccgaggatcttaaccgctggcacaatatatactctggcactcaatggctgtatgaggacaagggcctgtcacggttcacaacttacgagtacatgcttttcgtccacaattcggtgggttttactccatccagagaagtaaccgtgacaaccctggcaggtttgccagaaagaggcgccaacctgaccgctagtgtactaaaccatacagctatcgacgtgcgatgggcaaagccaaccgtgcaggatttgcagggggaggtggaatactataccctgttctggagctccgccacgtccaatgacagtctgaaaattctgcccgacgtgaactctcacgttatcggccacctcaagcccaacacagagtattggatctttatctcagtgttcaacggggtgcacagtattaactccgcgggcttgcacgctaccacatgtgacggagaaccccagggaatgctgcccccagaagtcgtgattattaacagcacagcagttcgggtgatttggacctccccaagtaacccaaacggggtggtgacggaatactccatctatgtgaacaacaagctgtataagacagggatgaacgtaccaggatctttcatcctaagagatctctcacctttcactatctacgacatccaagtcgaggtgtgcacaatctatgcttgcgttaaatccaatggcacccaaattaccactgtggaggacacaccatccgacataccgactcctaccatccgcggcatcacctctaggagtctgcagatagactgggtcagtccccggaagcccaacggtataatcctcggttacgacctgctgtggaagacatggtatccctgtgccaaaactcagaagctggtgcaggatcagagcgacgaactctgtaaggccgttagatgccagaaacccgagtccatttgcgggcacatctgctattcttcggaggccaaggtgtgttgtaatggagtgctgtacaaccctaaaccgggccaccgctgctgcgaggagaagtacatcccatttgtgttgaactccacaggggtctgttgtggcggccggatacaagaggcccagcccaaccatcagtgttgctcgggttattatgctaggattctcccaggggaggtgtgttgcccggacgagcagcataaccgtgtgagtgtaggaatcggcgatagctgctgcggtcgaatgccatactcgacgagtggaaaccagatctgttgtgcaggccggctacacgatgggcacggccagaaatgctgcggccgacagatcgtctctaacgacctggaatgctgtgggggagaggaaggtgtggtctacaataggctcccgggcatgttctgctgcggccaggactacgttaatatgagcgatacaatctgctgctctgcatcgagcggggagtccaaagcgcacattaagaagaacgaccccgttccagttaagtgttgtgaaacggagctaatcccaaaatcacagaagtgctgtaatggtgttggctataaccctctcaagtacgtgtgctccgataagatcagcaccggcatgatgatgaaagagacaaaagaatgtcgcatcttgtgcccagcgtccatggaagcaacagaacattgcgggcgctgtgacttcaacttcacatctcacatctgcactgttattcgggggagtcataatagtaccggcaaggcttctattgaggaaatgtgctccagtgcagaagaaacaatccataccgggtctgtcaacacatactcctacacagacgtcaaccttaaaccatacatgacgtacgaataccgtatatccgcttggaactcttatggccgaggcctgagtaaagcggttcgggcgaggactaaagaggatgtcccgcagggtgtgtcaccacccacatggaccaagattgacaatctcgaggatacaattgtgctcaattggagaaagcctattcagagtaatggtcctatcatttactacatcttattgaggaacggtattgagagattcaggggcaccagccttagcttcagtgataaagaagggatccaaccattccaggagtatagttaccagcttaaagcgtgtactgttgccggttgtgccacatccagtaaagtggtggctgccactactcaaggggtgcccgaatccatacttccaccatcgatcaccgcattgtccgcagtcgccctgcatctgtcatggtctgtgccagagaagagtaatggcgttatcaaggaataccagataagacaagttgggaagggactgatccacacggacaccaccgatcgacgccagcacactgtcacaggccttcaaccttatacaaactactcttttaccctcactgcatgtacttccgccggttgcacttcctctgagccttttctgggacagactcttcaggccgcacctgagggagtgtgggtgacaccccgacatattattatcaattccacgacagtcgaactttactggagtctaccagaaaagcctaacggcctggtatcacagtatcagctaagccgaaatggtaacctgctgttcctgggcggcagcgaagagcaaaactttaccgataaaaatttggaacctaattccagatacacttacaagctagaagttaaaactgggggtggcagctcggcgtcagacgattacatcgttcaaacacccatgtctaccccagaggagatttacccaccatataatatcactgtgataggaccatattccatcttcgtcgcatggatccctcctggcatactgatccctgagatccctgtggagtataatgtgcttctgaacgacgggtctgttacacccctggcttttagtgtggggcatcaccaatcgaccctgctcgagaaccttactccattcacgcagtatgaaatcagaattcaggcttgccagaacgggtcgtgcggggtatcctctagaatgttcgtaaaaaccccagaggcagcaccaatggacctgaatagtcccgttctgaaagcactgggatccgcttgcatcgaaatcaaatggatgccacctgaaaaacccaatggcatcatcatcaattattttatctatagacgacctgccggtattgaagaggaatcagtactgtttgtttggtctgagggcgccctcgagtttatggacgaaggagacactctgcgtccatttacactctacgagtaccgagttcgggcatgcaactccaagggctcagtcgagagcctctggtccctcactcagaccctagaagccccgccccaggacttccctgctccatgggctcaggctaccagcgctcatagcgtcctgttgaactggacaaaaccggagtcccctaatggcattattagtcactaccgcgtcgtgtaccaggagaggcctgatgatcccaccttcaattctcccactgtgcacgccttcacagtcaagggaacatcccatcaggcccatctgtacgggctggaacctttcactacttatagaatcggagtggtggccgcaaaccacgctggagaaattctgtccccttggactctcattcagacccttgagtcatctccttcaggcctgcggaattttatcgtcgagcagaaagaaaacggccgggcccttctgctgcaatggtccgagccaatgcgcacaaacggggtgatcaagacatataatattttctccgacggctttctggagtactccgggctgaatcggcaatttcttttcaggcgcttggatccattcaccttatacaccttaaccttagaagcatgcacccgcgccggatgtgctcactccgcccctcagccactgtggaccgatgaggcccccccggactctcagctggccccaaccgttcatagcgtgaaaagcacttctgttgagctcagttggtccgagccagtcaaccccaatggtaaaataattaggtacgaggtgattcggcgctgtttcgagggaaaagcatggggtaaccagacaatccaggctgatgagaagatcgtgtttaccgagtacaatactgagaggaacacgtttatgtacaatgatactgggctgcaaccttggacacaatgtgagtacaagatatatacatggaattcagcaggccacacatgttcatcatggaacgtcgttcgcacgttgcaagctccacccgagggcctgtctccaccggttatctcatatgtctccatgaatccgcaaaagttgctgatctcctggattccgccagaacaaagcaatggaattatacagtcgtatcgcctgcagcgcaacgaaatgctctatcctttcagctttgacccagtaacattcaactatacagacgaagagctcctgccattttccacatattcctacgctttacaggcatgcacaagtggtggctgctctactagtaaaccaaccagtataacgacactggaggctgcgccaagcgaggtgagccccccggacctctgggccgtgtctgcaacccagatgaatgtatgttggtcaccacccactgtacagaatggcaaaattacaaaatatctggtcagatacgataataaagagtctctggcgggccagggtctctgcctgctggtgagccacctacagccgtattcccagtataacttcagcctcgttgcttgtaccaatggaggctgcacagcaagcgttagcaagagtgcatggacaatggaggccttaccagaaaacatggattcacctaccctgcaggtgactgggtctgagagcatcgagatcacatggaaacctccaaggaatcccaatggacagattcgctcctatgaattaaggcgggatggtacaatagtgtacacgggactagaaactcgctacagagacttcaccctgactccgggcgtagagtactcctacaccgttacggcaagtaacagccagggagggatcctgtcacctctcgttaaggacagaacctccccctctgccccgtcaggcatggaacctccaaaactacaggctcgtgggcctcaggagattcttgtcaactgggacccgcccgtacggaccaacggcgatataattaactatacattattcatcagggagctcttcgagagggagaccaagattatacatattaacacaacccacaattcatttgggatgcaaagttacattgtaaatcaattgaagcctttccacaggtacgaaatcagaatacaggcttgcacaacactaggctgcgcatctagcgattggacattcatccagacaccagaaattgcccctcttatgcagccacccccgcatttagaggtgcaaatggctcccggtggctttcagccaaccgtatccctgctatggacagggccattacaacctaacggcaaggttttatattacgagctgtaccggaggcagatagccacccaaccacgcaaatcgaatcccgttcttatttacaatggaagctctacatctttcatcgactccgaacttctacccttcactgagtatgaataccaagtgtgggcggtaaactctgcgggcaaagcaccatcctcctggacctggtgccgaaccgggcccgccccccccgagggcttgcgggcccccacctttcatgttatatccagcacccaagccgtcgtcaacatctccgctcccgggaaacccaacggaattgtatctctttatcggctgttttctagcagcgctcatggagcagaaaccgtgctgtcagaggggatggccactcagcagaccctgcacgggcttcaggcttttacgaactattcaatcggcgtcgaggcgtgcacctgtttcaactgctgctctaaaggtcccactgcggaattgcggactcaccccgccccaccgtcaggcttgagctcgccacagattgggaccttggcatcaagaaccgctagcttcaggtggagtccacctatgttcccgaacggtgtgatacactcttatgagctccagttccacgtggcctgtccacctgattcagctcttccatgcacacccagtcagattgaaacaaagtacaccgggcttggtcagaaagcctctctcggaggccttcaaccctacaccacttacaagttgcgggtggtggctcataatgaggtgggaagcaccgcttctgaatggataagcttcaccactcagaaggagttgcctcaatatagagcccccttcagtgttgacagtaacttgtccgtcgtgtgcgtcaactggtctgatacattcctattaaacggtcaactcaaagagtacgtgctgacagacggcggccgccgggtgtactcagggctggatacaaccctctatatcccccggaccgctgataaaaccttcttttttcaggtgatctgcaccaccgatgaggggtccgtgaaaaccccacttatccagtacgatacatctaccgggctgggtttggtcctcaccaccccaggcaaaaagaagggctcacgaagtaagtcaacagagttctatagcgaactgtggtttatcgtcctgatggctatgttaggcttaattctcctcgccatcttcctttccttgatcctccagagaaaaatacataaggagccttatatccgcgagcgcccccctctggtccccctgcagaagcgcatgtcccctctcaacgtgtatccacccggcgagaaccacatgggtcttgcggacaccaagattccacggtccggaactccggtttccattcgcagcaaccgctccgcttgcgtgctccgaataccaagccaaaatcaaaccagtctgacatactctcagggaagtctgcatagatcagtttcgcagttgatggatatacaggataaaaaggtgttaatggacaactctctttgggaagccattatgggtcataattctggcctgtatgtggacgaggaagatctgatgaacgctattaaggattttagcagtgtcactaaagagcggacaaccttcactgatacccacctctag

SEQ ID NO: 140220 - DNA, 4641 bp, Artificial Sequence
  Description of Artificial Sequence: Synthetic coding sequence
atgaactgtccagtgttatcacttggctcaggttttctcttccaggtgattgagatgctgatcttcgcttattttgccagcatcagcttgaccgagtctagaggactattccctcgccttgaaaacgtaggggcctttaaaaaggtttctatcgtccctactcaggcagtctgtgggctgccagaccgctccactttttgtcatagcagcgctgcagccgagagtatacaattctgcactcagcgcttttgcattcaagactgtccctacagaagttctcatcctacatatacagccttgttttcagcaggcctttcatcttgcatcacacccgataagaatgacttacacccgaacgcacattccaattcagcctccttcatctttggaaatcacaaaagctgtttttcctctcctccatcaccgaagttaatggccagcttcacgcttgctgtgtggttaaaaccagagcaacagggagtgatgtgtgtcatcgagaagactgtggacggccaaatagttttcaagctgaccatctcagaaaaggagaccatgttttactatcggacggtcaacggcttgcaaccacccataaaagttatgacattaggaagaatcctggttaagaagtggatacatttgtccgtgcaggtccaccaaacaaagatatctttctttataaacggcgtcgaaaaggaccatactccctttaacgcaaggaccctgtctggcagtatcacagatttcgcctcagggacagtgcaaataggacagtccctcaacggccttgagcaattcgtggggagaatgcaggactttaggctgtaccaggtggcgcttacaaatcgcgagattcttgaagtcttttccggagacttgctgaggctccacgcccagtcacactgccgatgccccgggtcccacccacgggtacaccctttagcccagcggtactgtataccaaatgacgcaggggacactgcagataatcgggtatctcgactcaatccggaggcccatccattaagctttgtaaatgacaatgatgttgggactagttgggtgagtaatgtatttaccaatatcacgcagctgaaccagggcgtgacaatttcggtagatctcgaaaatgggcagtatcaggtgttttatatcatcatccagttcttctctccccagcctactgagatacgaattcagagaaagaaagagaactcactcgactgggaagactggcagtacttcgccaggaactgcggcgcttttggaatgaagaataacggcgacctcgagaaaccagacagcgtcaactgtctgcagctctccaattttaccccttacagccgcggtaacgttacattcagtattctgacaccaggccctaactatcgccctggatacaacaatttctataatacgccttctctccaggagtttgtcaaggccacccagatccggttccattttcatggacagtactacacgacagaaactgcggttaatctgcgacaccgctactacgcagtggacgaaatcacaatcagtggtcgctgtcagtgccatggccacgcagataattgtgacacaaccagccagccttacagatgtctgtgctctcaggaatcctttactgaggggttgcactgtgacaggtgtctgcccctgtacaacgacaagccattccgccagggggatcaggtgtacgcctttaactgcaaaccttgtcagtgtaattcacatagcaagtcatgccattataatatcagcgtggatccttttccttttgaacatttcaggggggggggaggggtctgcgacgactgtgaacataatacaaccggtcgtaattgcgagctgtgcaaggactatttcttccgccaggtgggcgccgaccctagcgctattgatgtctgtaaaccttgcgactgcgacaccgtagggactcgcaacggatccatactgtgtgatcagattgggggtcagtgcaattgtaagcggcacgtgtcgggccgacagtgcaatcagtgtcagaatggattttacaatttacaggagctggacccggacggctgctcaccttgtaactgcaacacttccggcactgtggacggcgacatcacatgtcatcagaactcagggcagtgcaaatgcaaggctaacgttatcggcctgagatgcgaccattgcaacttcgggtttaaattcctccggagcttcaacgacgtcggttgcgagccttgtcagtgtaacctccatggttcagtcaacaagttctgcaacccccactccggccaatgcgaatgtaagaaagaggccaagggactgcaatgcgacacatgtagagagaacttctacggccttgatgtgactaattgcaaggcgtgcgattgtgacaccgccggctctcttccaggaacggtatgtaacgctaagaccgggcagtgtatatgcaagcccaatgtggagggccgccagtgtaacaaatgcttggaaggcaacttctacctgagacagaacaattctttcctgtgcttaccctgtaattgcgataagacagggacaatcaacggttctcttctgtgcaacaagagcaccggacagtgtccatgcaagctcggagttactggcctgcgatgtaaccagtgcgagccccacagatataatttgacaatcgacaactttcagcactgtcagatgtgtgaatgtgactcccttggaacccttcctgggactatctgtgaccccataagcgggcagtgcctatgtgttcccaatcggcagggtcgccggtgcaatcagtgtcagccaggattctatataagccccggaaatgctacagggtgtctgccctgtagctgccacacgaccggcgcggttaaccatatttgcaattcacttaccggacagtgcgtgtgccaggacgccagcatcgcgggccagcggtgtgaccaatgtaaggatcactacttcggatttgacccccagacgggtagatgtcaaccatgtaactgtcatttgtccggcgctttgaatgaaacatgtcacctcgttaccggccagtgcttctgcaaacagtttgtcaccgggtccaagtgcgacgcctgcgttccttcagcctctcatcttgacgtaaataacttgcttggttgttctaaaacacccttccagcagccaccaccgagaggtcaggttcaatcttcaagcgcgattaatctgtcctggtcgccaccggatagcccgaatgctcattggctcacctattcacttctccgagatggctttgagatctacacgactgaagaccagtacccctacagcatacagtatttcctggacactgaccttctaccatataccaaatactcttactacatcgaaacaaccaacgtgcacggatctactagatccgtcgccgtgacgtacaaaaccaaaccgggcgtgccggagggtaatctgacattgtcatatataattccaattggctcagattcagtcaccctcacgtggacaacactgagcaatcagtccggtcccatcgaaaaatacattcttagctgcgcaccactggccggggggcagccatgtgtctcctatgaagggcatgaaacaagcgcgacgatctggaacttggtcccctttgctaagtacgacttcagcgtccaagcttgtacctccggtggatgccttcatagcttgcctatcacagtgacaaccgcacaagctccacctcagaggctctctccccctaagatgcaaaagatcagttcaaccgagctgcatgtagagtggtctccaccagccgagctgaatggaattattattcggtatgagctctatatgcggaggttgagaagcacgaaagagaccaccagtgaagagtcacgcgtgtttcaatcttccgggtggctgagcccgcactccttcgtcgaatcagctaatgaaaatgcactgaagccaccccaaactatgaccaccatcaccgggctcgagccctataccaagtatgagtttcgagtgctagcggtcaatatggcagggtccgtaagtagcgcctgggtcagcgagaggacaggagaaagcgctcctgtcttcatgataccaccctctgtgtttcctctgtcttcttactcattgaatattagttgggaaaaaccagcggataacgttacccggggaaaggtcgtcggttatgacattaatatgctctccgaacagtcgccccagcagtctatcccaatggccttttcacagttgcttcacactgctaagtcacaagaactttcttacactgtggaagggctgaagccttaccggatctacgagttcacgattaccctatgtaacagtgttggctgtgtgacaagtgcctcaggcgccggccagaccctcgctgctgcccccgctcaattgagaccccctttggtcaaaggcatcaactctacaaccattcatctacgctggtttcctccagaggagctgaatggcccctctcctatttaccaactagagcggcgcgaatcctcgctgcctgccctgatgaccactatgatgaagggtatccggttcatcgggaatggctattgcaagtttccaagttctacccacccagttaatacggattttactggaaagtgtgtctag

SEQ ID NO: 140221 - DNA, 15681 bp, Artificial Sequence
  Description of Artificial Sequence: Synthetic coding sequence
atgaactgtcctgtcctttcgctgggatctggcttcctgtttcaggtcatcgagatgttaatcttcgcctactttgcttccatatctcttacagagagccgcggactgtttcccagactcgagaacgttggagccttcaagaaagttagtatagtgcccacacaggcagtttgcggactgcccgaccggtcaactttctgtcattcctccgcggctgcggaatcaatccagttctgtactcagcgtttttgcattcaggattgtccttacagatcttcacatccaacgtataccgctcttttctccgctggattgtcctcttgtatcacacccgataaaaatgatctgcaccccaatgcacactcaaattccgcatcatttatttttggcaaccacaaaagctgcttctcgtccccccctagcccgaagctaatggccagcttcaccttggccgtgtggctgaaacctgaacagcaaggcgttatgtgtgtgatcgaaaaaactgttgatggccagatcgtgtttaaattgaccattagtgagaaggagacaatgttttactaccggacagttaacgggttacagccacccatcaaggtgatgaccttgggaaggattctcgtcaaaaagtggatccacctgtccgttcaggtccaccagactaagatttctttcttcatcaacggagtggagaaagaccacacacctttcaacgccaggaccctctccggaagtatcacagatttcgcctccggcacagtacaaatcgggcagtcactaaatgggctggagcagttcgttgggagaatgcaggactttcgcctgtatcaagttgccttgacgaatcgagaaattcttgaagtcttctccggcgacctgctccgcctccatgctcaatctcactgtcgctgccctgggagtcatccccgggttcacccccttgctcagaggtactgtatcccaaatgacgcgggcgacaccgctgataacagagtgtcacgcctgaaccctgaagcccatccactgagtttcgtgaatgacaatgatgtgggcacttcctgggtttctaacgtgttcacgaatataacacagctcaaccaaggtgtgacaataagtgtggacttggagaacggccagtaccaggtgttctatattatcatccagttctttagcccccagcccactgagattcggatccagcggaagaaagaaaattctctggattgggaagactggcagtactttgctcggaactgtggtgcgttcggcatgaagaataacggtgatctggagaaaccagactctgtgaattgcctgcagctctctaattttacgccctattcgcggggtaatgtgacgtttagtatcttgacaccgggacccaactacagacccgggtataacaacttctataataccccctctctccaagagttcgtgaaggccacacagattcggttccactttcatggccagtactacactactgagaccgccgtcaatttgcgacatcgatattatgccgtggacgagatcacgattagtggccggtgtcagtgccacggacacgccgacaactgcgacaccacttctcagccctatcgatgtttgtgttctcaagaatccttcactgaagggttacactgcgacagatgcctgccactttacaatgacaaaccattccgccagggggaccaagtgtatgctttcaactgcaagccatgtcaatgcaatagccattccaaatcctgccattacaacataagtgtggatccctttccgtttgaacactttcgggggggcggcggggtctgtgacgactgcgagcacaatactaccggcaggaattgcgagctctgtaaagattacttcttcagacaagtcggagctgacccctccgcgattgatgtgtgcaaaccctgtgactgtgatactgtggggacacggaatggcagtatactctgtgaccaaatcggagggcagtgtaactgcaaacgccacgtgagcggccgccagtgtaatcagtgccagaacggtttctataatttacaagagctggacccagacggctgctctccatgtaactgtaacaccagcgggacagtggatggcgacataacctgtcatcagaatagcggtcagtgcaaatgcaaggcaaacgttataggcttgcggtgtgatcattgcaactttggatttaagttcctgaggtcctttaatgatgttgggtgcgagccttgccagtgcaacctgcatgggagcgtgaataaattttgcaatccccactctggccagtgtgagtgcaagaaggaggccaagggcctgcagtgcgacacttgcagagaaaacttttatggcctggacgttactaactgtaaggcctgcgattgcgataccgccggaagcctaccaggaaccgtgtgtaatgctaagactgggcagtgcatttgcaaaccgaatgtagaagggcgccagtgcaataagtgtctcgagggaaacttctatctgaggcagaacaatagctttttgtgcctcccctgcaattgtgacaaaacaggaactatcaacggatcattgctctgtaataagagcacagggcaatgcccctgcaagctgggcgtgaccggcctgcggtgcaatcagtgtgagccacacaggtataacctgactattgataactttcagcattgccaaatgtgtgagtgcgatagtctcgggactctacccggcacaatatgcgatccaatatccggccagtgcctatgcgtgcccaacagacaggggaggaggtgcaaccagtgccaacccggattctacatatccccgggcaatgcaacaggttgtctcccatgttcctgccacacaacaggcgccgtgaatcacatatgcaatagtctgaccgggcagtgtgtatgccaggacgccagtatcgccggccagaggtgtgaccagtgtaaggatcattattttggattcgacccccagacggggcggtgtcagccttgtaattgccatctctccggtgctctcaacgagacctgccatctagtgaccggacagtgcttctgcaagcagttcgtgacaggatctaaatgcgacgcttgcgtgccaagtgcttcccacttggatgtgaacaatctgctcggctgttccaagacacccttccagcagccgcctccacgtggacaggtccagagtagcagtgctatcaacctgagctggagtccccctgattctcctaacgctcactggctgacgtatagcctactccgggatggctttgagatctacacgaccgaggaccagtacccttacagtattcagtattttctcgatacggacctgctcccttatacaaagtattcttactatatcgaaaccacaaatgtgcacgggtctactcgttcagtggctgtcacctataagactaagccgggtgtgccagaagggaatctgactcttagctacattattcccatcgggtctgactctgtcactctcacctggacaaccctctcaaatcagtcaggaccaattgaaaagtacatcctctcctgcgctcccttggcaggggggcagccctgtgtgagttacgaggggcacgagacatctgcaaccatctggaacctggtgccattcgcaaaatacgacttttcagtccaggcctgtacgtctggaggatgcttgcattccctgccaattaccgttaccaccgcacaggcaccgcctcagcgattgtcacctcccaagatgcagaagatctcaagcactgagctgcatgtagagtggagtcctcctgcggagctgaacggtattataatcagatatgaactctatatgagaaggttaagaagcacaaaagaaactaccagcgaggagtcacgcgtcttccagagctccggttggctcagtccacactccttcgtggagtccgcgaatgaaaacgctcttaaaccacctcagaccatgactacgatcactgggctggagccttacactaagtatgagttcagagtgttagcggtcaacatggctggctcagtgagttccgcctgggtctctgagcgcaccggggaatctgcccccgtattcatgataccgcctagtgtcttcccgctgtcctcatattcactcaatattagttgggagaaaccagctgacaacgttactaggggaaaggtggtcggatacgatatcaacatgctctctgagcagagcccacaacaaagtatcccaatggccttctctcagcttctgcacactgctaagtctcaggagctatcatacaccgtagaagggttaaagccgtatcgcatatatgagttcacgatcaccctttgcaactccgtcgggtgtgtgacatctgcctcaggcgctgggcagaccctggcggctgcaccagcccagcttagaccgcccctggtcaaggggatcaactctacaacaatccacctgcgctggtttcctccagaagaactaaacggcccctcgcccatctatcagctggaaaggagagaatcctcacttccagcactcatgacaactatgatgaagggaatccggttcataggcaacggatattgcaaattcccttcctctacccaccccgttaacaccgacttcacaggaatcaaggctagcttccggactaaggttccagagggtctgattgtttttgctgcatcccccggaaatcaggaagagtactttgcgctgcaactgaaaaagggacggttgtacttcttgttcgacccacagggtagcccagtcgaagtcactaccacgaacgaccatggtaaacagtactcagatggcaagtggcacgagattatagcaataaggcaccaggccttcgggcagatcacacttgacggtatttacactggaagtagtgctatcctgaatgggtcaactgtaatcggagacaatacaggagtcttcctgggtggcttgccccggagttacacaatcttgcgaaaggatcctgagatcatacaaaaaggctttgtgggatgtctcaaggatgttcacttcatgaaaaattacaacccttcagctatctgggagccactggattggcagtcttctgaggagcagattaatgtgtacaactcctgggaaggatgtcccgcatctctcaacgagggcgcgcagttcctgggagccggattcttggaactgcacccttacatgtttcatgggggtatgaattttgagatctcttttaagttcagaaccgaccagttaaatggactattgctcttcgtgtacaacaaggacgggccagacttcctggctatggagctgaaatctggcattctcacctttaggctcaatacctctttggcatttacacaagtcgacctgttgctgggtctttcctactgcaatggcaaatggaacaaagtgatcattaagaaggaaggctccttcattagtgcctcggtgaacggattgatgaagcatgcatccgaatctggtgatcaacccttggtggttaattcacccgtttacgtgggcggcatcccacaggaactcctgaattcataccagcacctctgcttagaacagggcttcgggggatgcatgaaggacgttaagtttacccgcggcgctgtcgtgaacctcgcatcggtctccagcggagcagttagggtcaatctggacggttgtttgagcaccgattccgctgtcaactgtagaggaaacgacagcattctggtttaccaaggaaaggaacagagcgtgtatgaggggggcttgcagcccttcaccgaatatctctatcgcgtgatcgccagccatgaaggaggcagcgtctattcggactggtctagggggaggacaaccggggctgcgccacagtccgtgcctacccccagtcgcgtcagaagtctcaacggctattcaatcgaagtcacttgggacgaacctgtcgttcgcggtgtaatcgaaaaatacattctgaaagcctactcagaggattctacgcgacccccgaggatgcccagcgcgtctgctgagttcgtcaataccagcaatttgaccggaatcctcaccggcctcttgcctttcaagaattatgctgtgaccctgaccgcatgcacgctggcaggttgcactgaatccagccatgctctaaatatttcgacacctcaggaggctcctcaggaagtccagcctccagttgcaaagtctctgcctagttcccttctgctgagttggaacccacctaaaaaagctaatggaatcattacacagtactgcctgtatatggacggacgtctgatttactccggttccgaggagaactacattgttactgatctagcagtgtttacgccgcaccaattcctcctgtctgcctgcacccatgtaggatgcaccaatagttcatgggtccttctgtatacagcgcaactgcctcctgagcacgttgactctccagtactgaccgtactggattcacggacgattcatatccagtggaaacagcctcgaaagatttccggcattctggaacgctacgtgctgtatatgtctaatcacactcatgattttacaatctggagtgtgatctacaattctacagagctttttcaggatcatatgttgcagtacgtgctgcccggcaacaagtatcttatcaaacttggggcgtgtactggcggaggatgtaccgtgagcgaggcatcagaggccctgacagatgaggacattcccgagggtgtacctgccccaaaagctcattcttactcacccgattcatttaatgtgtcatggacagagcctgaatatccaaacggcgtaataacctcctatggactctatctggatggcatcctgatacacaattcctctgagctctcctacagagcttacggattcgctccatggtcgcttcattctttccgggtccaggcttgtacggccaaaggctgtgctcttggtcctctggtggaaaaccgaactctggaggccccaccggagggtaccgttaacgtctttgtgaaaacccagggtagccgaaaagcacacgttaggtgggaagccccgtttcgcccaaatggattacttacccactctgtattattcaccggcatcttttatgtcgaccccgtcggtaataattatacactgcttaatgtgaccaaggtcatgtattctggcgaggagaccaacctgtgggtcttaatcgacggactcgtccctttcaccaattacactgtacaggttaacatcagcaattctcagggtagcctgatcactgacccaatcaccatcgccatgccaccgggtgccccagatggagtattgcccccacggctatctagcgccactcccacctcgttgcaggttgtctggtcaacccctgccagaaacaatgctcctggctccccgcgctatcagttgcagatgcgttcgggcgactcaactcacggttttcttgagctgttcagtaatcctagcgcctcgcttagctacgaagtgtccgatctgcagccctacactgaatatatgtttcgtcttgtggcatccaatggatttgggtctgctcactcaagctggatcccatttatgacagctgaggataagcctgggccagtcgttccccctatcttgctcgacgttaagtcgcgtatgatgctcgtcacatggcagcatcctcgaaagtcaaacggtgtaattactcactacaatatttacttacatggtcgcttatatctgcgcacaccaggaaacgtgaccaactgcaccgtcatgcacctacacccttataccgcatataaattccaagtggaggcctgtacatctaaaggctgtagtctctctcccgagtcacagactgtgtggacacttcctggagcacctgaaggaattccctctcccgaactgtttagcgatacccctaccagcgtgataatcagctggcagcctcccacgcaccccaatgggctagtggagaacttcacgatcgagagacgggttaaaggaaaggaggaggtgaccacgctggtaactctcccgagaagccattccatgagattcatcgacaagacgagtgctcttagcccgtggaccaagtatgagtaccgggtcctcatgtccactctacacgggggcaccaactcctccgcttgggtggaggtgacgacacgtccgagtcggcccgccggagtccagccaccagttgttactgtcttggaacctgacgcagttcaagtcacatggaagccgcccctgattcagaacggtgacattctcagctatgagatccatatgcccgaccctcatataaccctaaccaacgtgaccagcgcagtgctctcccagaaggtgacgcatctgataccatttactaattacagtgtgactattgtcgcctgctctggcggaaacggatacctcggaggatgtacagaaagcctgcccacgtatgtgacgacacaccccacggtaccccagaacgtgggcccgttgtctgtcattccactctctgagagctacgttgtgatatcctggcagcctccatccaagcctaacgggccgaacctcaggtacgaactgttacgccggaaaatacaacagcctctggcttcgaacccaccagaggacctgaataggtggcataatatatacagcgggacacagtggctatacgaggataagggactgagcaggtttaccacgtacgagtatatgctgttcgttcataattctgtgggcttcaccccttctcgcgaggtcacggttactaccctggctggtctgccagaaaggggcgctaatctcaccgcctctgttctcaaccatacggctattgacgttcggtgggcaaaaccaactgtgcaggatctgcagggggaagtggagtactacactctgttttggagttccgccacatctaacgattccctgaagattctgcccgatgtaaacagtcatgtaatcgggcaccttaagcctaatacagagtattggatttttatctccgtgttcaacggagttcacagtattaattccgcaggactgcacgccaccacctgtgatggggaaccccaaggaatgctgccacccgaggtagtcattatcaatagtactgcagtgagggtgatttggactagtccctctaaccccaacggcgtcgtcaccgagtacagcatttacgtgaacaataagctatacaaaacgggaatgaatgttccagggtccttcatcttaagagatctctcaccgttcaccatttacgatattcaagtggaagtgtgtaccatttacgcttgcgtcaagtctaatggcacccaaattacaaccgtagaagataccccatctgatatcccgactccgacgataagaggcataacaagcaggagtctgcagattgactgggtgtcccctcgcaagcctaatggcatcatcttagggtacgatctcctctggaagacctggtacccttgtgctaaaacacaaaagttagtgcaggaccagagcgacgagctgtgtaaggcagtccgttgtcagaagcctgagagcatttgcggccatatctgctactcttctgaggctaaggtgtgttgcaatggggtgctgtataaccctaagccgggacatcggtgttgcgaggagaaatacatcccatttgtccttaacagtacaggtgtttgttgcggcggtagaatccaggaggctcagcccaatcatcagtgttgctctggttattatgcccgcatcctaccaggtgaagtttgctgtcctgacgaacagcacaacagggttagcgtgggaataggagattcctgttgtggcagaatgccatactccacatccgggaatcagatttgctgcgccggacgtcttcacgacggccacgggcaaaagtgttgcggtcgccagatcgtatctaacgacctggaatgttgcggaggcgaggagggggtggtgtacaaccgcctccccgggatgttttgctgtggccaggattacgtcaatatgtccgacaccatttgttgctcagctagtagtggcgagtcaaaagcccatattaagaagaatgacccagtgccagtgaaatgctgtgaaaccgagcttattccgaagtcacagaagtgctgtaacggagtgggctacaaccctctgaaatacgtctgctctgataaaatcagtacgggtatgatgatgaaggaaaccaaagaatgtcgaatcctctgccccgcctcaatggaagcgactgaacactgtggccggtgcgattttaactttacttcacatatctgcacggtgatacggggaagccacaacagcacaggcaaggccagtatcgaggaaatgtgtagctcagccgaggaaacgattcataccggctcagtcaatacctactcctatacagacgtgaacctgaagccttatatgacatacgaataccggatatcagcatggaactcctatggccgtggcctgtcaaaagcagttcgggcaagaacaaaggaggatgtgccacagggcgtgagtcccccgacttggaccaaaatagacaatttggaagataccattgtcctgaactggcgaaaaccaatacagtcaaatggccctatcatttattacattctgctgagaaatggaatagagcgcttccggggtaccagtctgagcttctccgataaggagggaatccagccgttccaggagtacagctatcagctcaaggcctgcacggtggccgggtgcgcaacaagctcgaaggtggtggcggccaccacccagggagttccagaatctatactgcccccaagtatcacagccctgtccgcagtggccctacatctctcatggagcgtgcctgagaaatcaaacggcgttattaaggagtaccaaattagacaggtcggcaaaggtctcattcatacggataccactgatcggcgccaacacacggtgaccggactgcaaccttatacaaattactcatttaccctgaccgcatgcacctccgctggctgcacaagtagcgagcccttcttaggtcagacactgcaagccgcacccgagggggtgtgggtaacgccccgccacattattataaactcaacgaccgtcgaactttactggagtctgcctgagaagcctaacggcctcgtctcacagtatcagttatcccgtaacggcaacctcctcttcctgggcggctcagaggagcagaatttcacagacaaaaacctggaaccaaattctcggtatacttataagctggaggtgaagacaggcggcggcagcagcgcttcagacgattacattgtgcagactccaatgtccacccctgaggaaatttacccgccctacaatataaccgtgatagggccatattcgatctttgtggcctggataccacccggcatactgatccctgagatcccagtggagtacaatgtgctgctcaatgatggttcggtcactcccctggccttctcagtgggccaccaccagagtacactcctggagaatctgaccccatttactcagtatgaaatccgtattcaggcctgccagaatggatcatgtggggtgtcgtcacgcatgttcgtaaagacaccagaagcggcacctatggatctgaactcacctgtgttgaaagcactcggctccgcttgtatcgaaattaagtggatgcctccagaaaaaccgaatggaattataatcaattactttatctataggcgccccgccggtatcgaggaggagtctgtcttgtttgtgtggtctgaaggcgctctagaattcatggacgagggagatacgctgcgaccatttacactttatgaatatcgtgtgagagcttgtaactctaaggggtcagtcgagagcctttggagcctcactcagaccttagaagctcccccacaagatttcccagctccttgggctcaggccacgtcagcccattcggttctactaaactggactaagcctgagtcccccaacggcattatctcacattaccgcgtggtgtatcaggagcgtccagacgacccaacttttaattcacccaccgtgcatgcctttaccgtaaagggaaccagtcaccaggcccacctgtacggcctggagcccttcacaacatatagaataggagtggtagccgcaaatcacgccggtgaaattctgtccccttggaccctgatccaaaccctagagtcaagtcctagcggcctacgtaacttcatagtggaacagaaggaaaatgggcgagctcttttgctgcagtggagtgaaccaatgcggacaaatggcgtgatcaaaacttataatattttttctgatgggtttctggagtatagcggccttaacaggcagttcttatttagacgactcgatccattcacgctctatactctgacactagaggcatgcacccgagccgggtgtgcccatagcgctccccaacccctgtggacagacgaggcacctccagattctcagcttgcaccaaccgttcactccgtgaaaagcaccagtgtggagctctcttggagtgagccagtcaacccgaatgggaagattatccgctatgaagtgatccgcaggtgcttcgaggggaaggcttgggggaaccagacgatccaggcggatgagaaaatagtgttcactgaatataatacagaaaggaacacatttatgtataatgacaccggcctccaaccttggactcagtgcgaatacaagatatatacgtggaattccgcgggccatacctgctcttcttggaatgtagtgcgaaccctccaggctcctcctgagggtctgtccccaccagttatatcctatgtgagtatgaatcctcaaaaactgctgatctcctggatcccccccgagcagtcaaacgggatcattcaaagctaccgcttgcagcgaaatgaaatgctgtatcctttttcttttgacccagtcacattcaactatacagatgaggaattactgcctttttcaacatactcttacgctctacaggcctgtaccagcggaggttgtagcaccagcaaaccaaccagcatcaccacacttgaagcggcgccgtctgaagtgagtccacctgatctgtgggccgtgtctgccactcagatgaacgtatgttggtctccaccaaccgtgcaaaatgggaagataacaaagtatttggtgcgatatgacaataaagagtcactcgcagggcaggggctgtgtttactcgtgtctcacctgcagccgtattcccagtataacttcagcctggtggcatgcacaaatggaggatgtaccgctagcgtcagtaaaagtgcctggactatggaggccctgccagagaacatggactctcctaccctgcaggtaacgggctcagagtccattgaaatcacatggaagccccctcgtaacccaaacgggcagatccgatcctatgaactgcggagagatgggacaatcgtctatactggcctggagacaagataccgtgactttactcttacccccggggtggagtatagttacacagtgacggcctctaattctcaaggcggaatcctcagccccttagtaaaagaccgtaccagtccgtccgcccccagtggcatggaacctccaaagctccaagcgaggggaccccaggaaattctggtaaactgggaccctcctgtgcggacgaacggcgatattattaactacacactatttatcagggaacttttcgagcgagaaactaagatcattcacattaataccacccacaactccttcggtatgcagagctacattgtcaaccaactcaaacctttccatagatatgagattaggatccaggcctgcaccaccctggggtgtgcgtctagcgattggactttcatccaaacccccgagatcgcccccctaatgcaaccaccccctcatctcgaagtccagatggccccaggaggattccagcccactgtgtctctgctgtggaccggcccactccagccaaatggaaaagtgctttactatgaattgtaccggaggcagatcgcaacccaacctcggaagagcaacccggtcctgatctacaacggatcctccacatcctttatcgactctgagctcctcccatttaccgagtatgagtatcaggtgtgggctgttaactccgcagggaaagccccttcctcttggacctggtgtaggaccggacctgctccccccgagggtctgagagccccaacgttccatgttatctctagcacccaggcagtggtcaatatctccgcccccgggaaacccaatgggatcgttagcttgtaccgtttatttagttcgtccgcccatggagccgagaccgtgctgagcgagggtatggcaactcagcaaacccttcatggactccaagcgtttactaattattctattggcgtggaggcctgtacatgttttaactgttgttcaaagggaccaacagccgagcttcgcacgcaccccgctccaccttcagggctgtctagtccacagatcggcaccttggcttctcggactgccagttttagatggtcaccccctatgttccccaatggcgtgattcatagctacgaactgcaatttcatgtggcctgtcccccagactccgctctgccctgcacaccctctcaaatcgaaacaaaatacaccggcttgggtcagaaagctagcctagggggtctgcagccatataccacttacaaactgcgggtggtcgcacacaatgaggttgggtccacagcctctgagtggatctcattcaccactcagaaggaattaccacagtacagagcccctttcagtgttgacagtaacctgagtgtggtgtgtgtgaactggagcgatacatttctattgaacggacagctgaaggaatacgtgctgacagacggagggcgccgcgtgtacagtggcctcgacaccacactgtatattcctcgcactgccgataaaacgttctttttccaggtcatttgcacaaccgatgagggctctgttaaaactcctctgatacagtatgatacaagtacaggtctgggcctcgtactgacaactccagggaagaagaagggctctcggagcaaatctactgagttttatagtgagctctggttcatcgtgctgatggccatgctggggctcattctgctggctattttcctctcgcttatccttcagagaaaaattcacaaagagccctatattagagagagaccccctctggtccccctccagaaacgcatgtcacccctcaacgtgtatcctccgggtgagaatcacatgtttgactccgtggccgacatctctgatgtttcttccaacgttacgctgaagagttatacaatgcactttgaggggcttgcggataccaaaattccccgcagtgggaccccagtttctattcggtccaatcgtagcgcttgcgtactccgcatcccctcacagaaccagaccagccttacttacagccagggcagcctgcatcggagcgtgtcacagttgatggatatccaggacaaaaaagtgctaatggataattcactctgggaagctattatgggacataattcagggctctatgtggacgaggaagacctgatgaatgccatcaaggatttcagctctgtgaccaaagagcgcactactttcacggacacccacctttag

SEQ ID NO: 140222 - DNA, 2538 bp, Artificial Sequence
  Description of Artificial Sequence: Synthetic coding sequence
atgcgtaccgaggccgtcgtgaacagtcaaggacaaaccgattatcttaccaaagactcagatcaggacgtcgccttgaagctggctcaggagagggcagagattgtggctaagtatgaccggggtcgtgagggcgcagaaattgagccgtgggaggatgctgactacctggtttacaaagtgaccgaccgattcggcttcctgcacgaagaagaacttccggatcataatgtggctgttgagagacagaaacaccttgaaattgaacgaacgactaagtggttgaaaatgctaaagggatgggagaaatataagaatactgaaaaattccatcggaggatctacaagggcataccgctgcaactgcgaggggaagtgtgggctcttctgctggaaattcctaagatgaaggaggagaccagagacttatatagcaagctcaaacatagagccagaggatgtagccctgacattagacaaattgacctggatgttaatcggacttttcgagatcacattatgttccgagaccggtacggcgttaagcagcaatccctcttccatgtgctcgcggcgtattccatctataatacagaggtcggctactgtcaaggcatgagtcagatcaccgctctgctgctgatgtacatgaatgaggaggacgcattctgggcgctggtgaaactgttttcagggcctaagcacgctatgcacgggtttttcgtccagggctttcctaaattgctacgctttcaggaacaccacgaaaagattctaaataagttcctaagcaaattgaaacagcacctggattcccaggagatttacaccagcttctacaccatgaagtggttcttccaatgtttcctggaccgaacaccctttactctgaatcttcgtatttgggatatctatatcttcgagggcgagcgtgtgctgaccgcgatgagctatactattctcaagctgcataaaaaacacctcatgaaactctccatggaggagttggtggaattttttcaggagaccctggctaaggacttttttttcgaagacgactttgtgatagaacaattgcagatctctatgactgaacttaaacgggccaagctggatcttcctgagccagggaaagaagacgagtatccgaagaaaccattgggccagctgcctcccgagctccaatcctggggcgtgcaccacttatcaaacggacagcggagcgtgggacgcccctccccgttggcatcagggcggagagaaagcggagctccacacaggaggcatgagcactccccacacccccagtcgcgaactgggactccagagcgggcacagccaccaagacggaaaagtgtggaggaggaatccaaaaaactcaaagatgaagccgactttcagaggaaacttccgtctggtccacaagactccagtcggcagtacaatcatgcagcagccaaccagaacagtaacgccacaagtaatattaggaaggaattcgtgcctaagtggaacaagccttcagacgtgtcagccacggagagaacagccaaatacacaatggagggtaaaggtcgtgccgctcatcctgctttggcagtcaccgtgcctggccccgcggaagtgagggtgtccaatgtaagacctaagatgaaggcgctagatgccgaggacggcaaacgcgggagcacagcttcacagtacgataacgtgccaggacccgaacttgattccggagctagcgtggaagaagcacttgagagagcctactcacagagtccacgacacgctctgtatccccccagcccgagaaagcatgccgagcctagcagctccccttctaaggtgagcaataagtttacttttaaggttcagcccccctctcatgcacggtatccttcccagttagacggagaggctaggggacttgcccacccaccttcttatagcaaccccccagtatatcacggaaacagcccaaagcacttccctactgccaacagctccttcgcttcaccacaattctctcccggaacccagcttaatccgagccgccgcccccacggctctacattgagtgttagcgccagtccagaaaagtcctacagcaggccgagtcctctagtcctgccctccagccgcatcgaagttctgcctgttgacacaggagctggggggtacagtggcaattccggtagtcccaagaatggaaaactgataatccccccagtcgactatctccccgacaataggacctggtccgaagtgagctacacatataggcctgagacacagggtcagtcgtggacccgcgatgctagcagaggcaacctgccaaagtacagcgcgttccagttggctccatttcaggatcatggccttcccgcagtcagcgtcgattctcccgttcgctacaaggcttctccggctgctgaggatgccagtccaagtggctacccctattcaggacctcccccgccagcctaccactaccggaacagagacggcctgagtatacaggagtctgtccttctgtag

SEQ ID NO: 140223 - DNA, 2487 bp, Artificial Sequence
  Description of Artificial Sequence: Synthetic coding sequence
atgaatagcgatcaggacgttgcactgaagcttgcgcaggagagggcagaaattgtcgccaagtacgacagaggacgggagggggccgagatcgagccctgggaagacgccgattatctggtttataaggttaccgatagattcggtttcctacatgaggaggaactgcccgaccacaatgttgcggtcgagcgtcaaaaacacctggagattgagcgtacaactaagtggctgaagatgctgaaaggatgggaaaagtacaaaaatactgaaaaattccacaggagaatatataaaggaattccgctgcagctgaggggggaggtgtgggccctcctgctggaaatccccaagatgaaggaagaaacaagggacttgtactcgaagcttaagcaccgggctcgaggatgttcacccgatatccgccaaattgatttggacgtcaatagaacttttcgggaccacatcatgttcagggatagatacggcgtgaagcagcaatccctcttccatgtcctggcagcatacagcatctacaacaccgaggtagggtattgccagggcatgtcacagataactgctttgttattaatgtacatgaacgaggaagatgccttttgggccttagtaaagctgtttagcgggccaaaacatgccatgcacggttttttcgtgcaaggatttcctaaattgctccgcttccaagaacatcatgaaaagattcttaacaagtttttgtcaaaattgaagcaacaccttgatagccaggagatatacacctcgttctataccatgaaatggttcttccaatgttttttagaccgaacaccgttcacactgaaccttcgtatctgggatatctacattttcgagggggaaagggtgctgacagccatgtcctatacaatcttgaaactccataagaagcacctcatgaaattgagcatggaggaactggtagaatttttccaggagacccttgcaaaagacttcttctttgaggatgactttgtgattgagcaactgcagatctccatgacagagctgaagagagccaagctggatctgccggagcccggtaaagaagacgagtatcctaagaaaccactggggcaactaccgcccgaactgcaatcctggggagtgcatcacttgtccaacggacagcgtagtgtcgggagaccttcaccattagcttccggccgaagagagagcggtgcgccccaccgccgacacgagcattccccacatcctcagtctaggaccggcactcctgagagggctcagcccccaagacgaaagtccgtagaggaagaatccaagaagttgaaagatgaagcagacttccagcgcaagctgcccagcggccctcaggatagtagtcgtcagtataatcatgccgccgcaaaccagaattccaatgcaaccagtaacatacggaaagaatttgttcctaaatggaataaacccagcgatgtgagcgctaccgagcggacggctaagtacacaatggagggaaaaggtcgggcagctcatccagcgctggccgtgacggtcccaggtcctgcagaagtgcgggtatccaacgttagaccaaaaatgaaagctctggatgctgaggacggaaaacggggcagcacagcctcacagtacgataatgttccaggtccagaactggactcaggtgcctccgtggaggaggcattggaacgagcgtattctcagtcaccgagacacgcactgtacccaccatcccctcggaagcacgccgagccaagctcttcaccgtccaaggttagcaacaagtttacattcaaagtgcagccacccagtcacgcccgatatccgagccaactggacggagaggcccggggcctggcccatccgccctcatattctaatcctcctgtgtatcacggcaactctcccaaacattttccgactgccaactccagctttgctagcccgcagtttagccctggtacacaactcaatccctctcggagaccccacggaagtacactctcagtttccgcctcacctgagaagagctactctcggccttctccactggtactacctagcagccgaatcgaggtccttcccgtggatacaggtgcaggcggttactccggcaacagtgggtctcccaagaacggtaagctgattatcccccctgtggactacctccctgataacagaacctggtctgaggtgtcatatacctatagacccgagacccaaggccagtcctggactagggatgcctccagaggaaacctcccaaagtatagcgcttttcagctggctccattccaagaccatgggttgccggccgtatccgtggactcacccgttcgctacaaggcgagcccagcagcagaggatgcgtcgccctcgggctatccatactctggccctcctccccctgcataccactaccgaaatcgggacgggttgtctatacaggagtccgtcttactttag

SEQ ID NO: 140224 - DNA, 2487 bp, Artificial Sequence
  Description of Artificial Sequence: Synthetic coding sequence
atgaacagcgaccaggacgtggcgctaaaactggcccaggagcgcgccgagatcgtggcgaagtacgatcggggcagagagggcgctgagattgagccttgggaagacgcagactatctcgtttacaaagttacagacagattcgggtttctgcacgaggaagagttgccagatcataacgtcgcagtcgagcgccagaagcacctcgagatagagcggaccactaagtggctcaaaatgctgaaagggtgggaaaaatataagaacacggaaaaattccatcgccgtatttataaagggattccactacaactgcggggggaggtgtgggccctgctgcttgaaatccccaagatgaaagaggaaactagggatctgtattcaaagctgaagcatcgcgcaaggggctgctctcctgatatcaggcaaatagaccttgacgtgaataggaccttccgggatcatataatgttccgggatagatatggtgtaaagcagcagtctctctttcatgtgctggcagcctacagcatctataacacagaggtgggctactgccagggcatgagccagatcacggccctgctgttgatgtacatgaacgaggaagatgctttctgggccttagtcaaactgttctcaggcccaaaacacgcaatgcacgggttctttgtgcagggctttcccaagctgttgcgctttcaggagcatcacgaaaagatcctgaataaattcctgagtaaattgaagcagcatcttgactctcaggagatctacaccagcttctacactatgaaatggtttttccagtgtttcctggatcggactccattcactttgaatctgaggatctgggacatttatatcttcgagggggaaagagtgctcacagccatgtcctatactatcctgaagctccacaaaaaacacctgatgaagttatctatggaggaactcgtggaattcttccaggagaccttggcgaaagacttcttttttgaggatgacttcgttatcgagcagctgcagatctcaatgactgaactgaaaagggccaaattggatctgcctgagccggggaaggaggatgagtatccaaagaaacccctgggccagttaccacccgagctgcaaagctggggcgttcaccacctctccaatggtcagcggtccgttggccggccatcacccctcgctagcggcaggagagagagtggagctcctcacaggcgacatgaacacagcccacatccgcagtcacgcacaggcaccccagaaagagcccagccccctcgaagaaagtcggttgaggaggaatccaagaagctcaaggacgaagctgactttcagagaaaactccccagtggacctcaggatagcagcagacaatataatcatgcagcggctaatcagaacagtaatgctactagtaacattcgaaaggaatttgttcctaagtggaacaaaccatccgatgtatccgctacggaacgtactgctaaatataccatggaaggcaagggaagggctgcacacccagcgctggcagtgacagtacctggacctgccgaagtgcgcgtgagcaatgtacggcctaagatgaaagccctggatgcagaagacggcaaaagggggagtactgcgtcccagtacgataatgtgccaggccccgagctggattctggggcgtctgttgaagaggcactcgaaagagcctactcacaaagtcccagacacgccctttatccaccaagcccaaggaaacacgccgagccatccagcagcccaagtaaagtctcaaataaattcaccttcaaagttcaacccccctcccatgctcggtatccaagtcagctggatggagaagcgcgtgggctagcccatcctccttcctacagcaaccctcccgtgtaccacggcaactctcccaagcactttccgactgccaatagcagcttcgcctcacctcagttttctcctgggactcagctgaaccccagcaggagacctcacgggtcaacactgtctgtgtctgcaagtccagaaaaaagctattcacgaccatctccactcgtgctccccagttctcgaatcgaggttctccctgtggataccggagccggaggctactcagggaattcagggagccccaagaacggcaaacttattattccacctgttgattatctccccgataatagaacatggagcgaggtaagttacacttacaggcccgagacccagggccaatcctggactcgggacgccagtcgggggaacctgcccaagtactctgcattccagctggccccttttcaggaccatggtctacctgcggtttcagtcgatagccccgtgcgatataaagcctcgcctgcagctgaggacgcaagccccagtggatatccctactcgggaccgccacctcccgcctatcactaccggaaccgcgacgggttatctatccaggaatctgtacttctgtag

SEQ ID NO: 140225 - DNA, 762 bp, Artificial Sequence
  Description of Artificial Sequence: Synthetic coding sequence
atggccgcagcgtttcggaaagccgcaaaatctcgacagagagagcatagagagagatcacagcctgggtttcgtaagcacctgggcttgctcgagaagaaaaaggattacaaactaagggccgacgactaccgaaagaaacaggagtatctgaaagcccttcggaagaaggcccttgaaaagaatcccgacgaattctactacaaaatgacccgagttaagctgcaggacggcgtccacattattaaggagactaaggaagaggttacccccgaacagctgaaattaatgcggactcaggatgtgaagtatatcgagatgaaaagagtggctgaggccaagaagatcgagagactgaaaagcgaattgcatttgctagacttccaaggcaagcagcagaacaagcacgtgttcttcttcgacacaaagaaggaggtcgaacagtttgacgttgccacgcacctgcagacagccccagagctcgttgatcgcgtgtttaacaggcctcggatagagactcttcagaaagaaaaagtcaagggcgtcacaaaccagaccggcctcaagagaatcgctaaagaacgtcagaagcagtataactgtctgacgcagcgaatagaacgggaaaaaaaactgttcgtgattgcccagaagattcagacacggaaagacctcatggacaagacccaaaaagtgaaggtgaagaaggagaccgtgaatagcccggccatttataaattccaaagtcgccgcaagagatag

SEQ ID NO: 140226 - DNA, 447 bp, Artificial Sequence
  Description of Artificial Sequence: Synthetic coding sequence
atggccgcagccttccgcaaggccgctaagtccaggcagcgcgaacatcgcgagcgctcgcaacctggcttccgcaagcatcttggtcttcttgagaagaagaaagattacaagctcagggccgacgactatcggaaaaaacaggagtacctgaaagcgttgcgcaaaaaggcgctcgaaaagaacccagatgaattttactataaaatgacccgcgtaaagctccaggacggcgtgcacataataaaagagaccaaagaagaagtgacaccagagcaactcaagctgatgcgaactcaagacgtgaagtatatcgagatgaaaagagttgctgaggcaaagaaaatcgagcggttgaagtcggaattgcatctgctcgattttcagggcaagcagcagaataaacacgtttttttttttgataccaagaaggaagccaactcctag

SEQ ID NO: 140227 - DNA, 2124 bp, Artificial Sequence
  Description of Artificial Sequence: Synthetic coding sequence
atgccagaagaggctggtttcccacccgccaagagatttcggccaggctcagggcctccgagtcgggccggctctttcccccctgggcgtcaggttgtgatgttactgactgcaggctctgggggccgtggcggcggtgggggccggcggcaacagcccccgctggcacagccttccgcgtccccttatccagaagcggtggagctgcagaggcgcagtcttcccatctttcaagcccgcggacagctgttggcccagctgcgaaacctagacaacgccgttctcatcggcgaaacaggctccgggaagaccactcaaattccccaatacctctatgaaggaggcatctcccgccagggcatcatcgctgtaacccaacccaggcgtgttgctgcaataagtctcgccacacgggtatccgatgagaagcgcacggaactggggaaactggtcgggtataccgtgcgctttgatgatgtgacctctgaggacacacggattaaatttcttactgacggaatgctgctgagggaggcaatttccgatagcctattaaggaaatattcatgtgttatactcgacgaggctcacgaaaggaccatacatacagatgtactatttggagtggttaaggccgcccagaaacggcgcaaggagctgggcaagttacccttgaaggtaatcgtcatgagcgcaacaatggacgtggatctttttagtcagtacttcaatggggctcccgtgctttatctggaaggcaggcagcaccccattcaagtgttttatactaagcagccacaaaacgattacctgcacgctgctctggtgtccgtatttcagatccatcaggaagcccccagctcacaggatatcctagtgttcctaaccggccaagaggagatcgaagcgatgtctaaaacatgtagggatatcgcgaaacatctgcctgacggctgccccgcaatgctagttctgcccctgtacgcgtctcttccttatgcccagcaattgcgagttttccagggtgcgcctaagggttaccggaaggttattatctccaccaatatcgctgagacaagtattaccattacggggatcaagtatgtcgtcgataccggcatggtaaaagctaagaaatataaccccgactcaggtctggaggtgctcgcagttcagagagttagtaagactcaagcatggcagaggaccgggagggcgggcagagaggatagtggcatctgctaccgcctttacaccgaagacgagtttgagaagtttgataaaatgacagttccagagatccagagatgtaacttagcctcggtcatgctgcagctgctcgccatgaaagtgccaaacgtgcttacgttcgactttatgtccaagccatctccagaccacatacaggctgctatagcacagttagatctgcttggagcactggaacacaaagacgatcaactgactctgacccccatgggccggaagatggccgcattccccctcgagccaaagtttgctaagaccatcttgatgtccccaaaatttcattgcaccgaagaaatactcaccatagtgtctctcttgtccgtcgacagcgtgcttcacaaccccccaagtcggcgtgaggaggtgcagggagtcaggaagaaattcatcagtagtgagggtgaccacatgacactcctcaatatctacaggaccttcaagaacttgggcgggaataaggactggtgcaaggagaacttcgtcaactcaaagaatatgacactggtggctgaagttcgcgctcaacttcgcgatatttgcctgaagatgtccatgcctatcgccagctctaggggagatgtcgaatcagtcaggaggtgtttggcccattccttgttcatgagcactgctgagcttcagcccgacggaacctatgccactacggatacacatcagccagtggcaatccatccctcgtcagttctcttccattgcaagcctgcatgtgtcgtatacacagaactcctctacaccaataaatgctatatgcgggatctgtgcgttattgacgcccagtggttatacgaagctgcccctgagtattttcggcgcaagctgaggacagcacgaaactag

SEQ ID NO: 140228 - DNA, 1566 bp, Artificial Sequence
  Description of Artificial Sequence: Synthetic coding sequence
atgaggcccgattggaaagcgggcgccggaccagggggcccacctcaaaagccggcaccgagcagtcagcgtaagccccccgcaaggccctctgcagccgctgcagcaatcgcagtggcagctgccgaggaggagagacggctgcgacagcgcaataggctgaggctcgaggaggacaagcccgccgtcgaaaggtgtcttgaggaactggtatttggcgacgtcgaaaacgatgaggatgcactactgagacggctccggggaccaagggttcaggagcacgaggactcaggggactccgaagttgaaaacgaggccaaagggaatttccctccacaaaaaaagcccgtatgggttgacgaggaggacgaggatgaagagatggttgatatgatgaataacaggtttcgtaaagatatgatgaagaacgcctctgaatcaaaactttccaaagataatttgaagaaacggctcaaggaagagtttcagcatgctatggggggggtgcctgcctgggctgagacgaccaaaagaaaaacatcaagcgacgatgagtccgaggaagacgaggacgatttgctccaacggactggaaacttcatcagtacctctacctctctgccccggggcatcctcaaaatgaaaaattgccagcacgctaatgctgagaggccgaccgtggccagaatctcatctgtgcagttccatccaggagcccaaatcgtcatggtcgcaggcctcgataacgcagtgtcacttttccaggtcgatggcaagaccaacccaaagattcagagcatctatcttgaacgattccctatttttaaggcttgtttttcagctaatggcgaggaggtgttggcaacctcaacccatagtaaggtgctttacgtgtatgacatgctcgccgggaagctgatcccagtgcaccaggtgaggggcctgaaagagaagatagtgcggtctttcgaggtctcacccgatggatctttcttactgatcaacgggatcgccgggtacctgcacctgctcgctatgaagactaaagaactgatcggatctatgaaaatcaatggacgggttgccgccagcacattctctagtgacagcaaaaaggtgtacgccagtagtggcgatggcgaagtgtatgtgtgggatgtcaactcccggaagtgcctgaacaggtttgtggatgagggatcgctctatgggctcagtatcgccacctctagaaacggacagtacgtggcctgtgggagtaattgcggcgtcgtaaatatctataaccaggactcctgcctgcaggagactaacccgaagcctatcaaagccattatgaacctggtgaccggagtcacgtcacttacatttaaccctaccacggagatactggctatcgcctcagagaagatgaaggaggcggtaaggcttgtgcacctgcctagttgtacagtttttagtaattttcctgtgatcaagaataaaaacatttcccacgtgcatacaatggacttttccccgaggtctggatacttcgctttagggaacgaaaaggccaggccctag

SEQ ID NO: 140229 - DNA, 8358 bp, Artificial Sequence
  Description of Artificial Sequence: Synthetic coding sequence
atgaaaactaaacctgttagccacaaaacagaaaatacataccgattcctgacctttgcggagaggttgggaaacgtgaatatcgatataatacataggatagaccggactgcatcttatgaagaagaggtggaaacctactttttcgaaggcctactgaagtggagggagctgaatctcaccgaacactttggtaagttttataaagaagtgatagataagtgtcagagcttcaaccagctggtgtatcaccagaatgagatcgttcagtcacttaaaacccatcttcaggtaaagaattccttcgcatatcagcccttgctggatctggtggtgcagctggctcgtgacctgcagatggatttttatcctcatttccctgaattcttcctgacaatcacgtcgatcttggaaacccaggatacggaattgctggaatgggccttcacttctctcagttatctatacaagtacctgtggaggcttatggtgaaagacatgtcatcaatatatagcatgtacagcaccctgttggctcataagaagcttcacatccgcaactttgccgccgagtccttcacgttcctgatgcgcaaggtgtcagacaaaaacgcactgttcaatctcatgttcctggacctcgataaacacccagaaaaggttgaaggggtgggccaactgctatttgaaatgtgtaagggagttagaaacatgttccactcgtgcacaggacaggcggttaaactcattctgaggaagctgggcccagtgaccgaaaccgagacacagctcccttggatgcttatcggcgaaactctgaagaacatggttaaaagcactgtgtcttacatctcgaaggaacacttcgggacctttttcgaatgtctccaggaatccttgctcgacctgcatacaaaggtgacaaaaaccaactgctgcgagagcagcgagcagattaaacggctgctggagacctacttgattctggtcaagcacggctccggtacaaaaatcccaacccccgcagatgtttgtaaagttctgtctcagacgcttcaggtcgcaagcctcagtacatcctgctgggaaactcttttggacgtgatctccgctttgatcttgggtgagaatgtgtctttaccagagaccctgatcaaggagaccatcgagaagatattcgaatctagatttgagaagaggttgatcttttctttttcagaggtgatgtttgccatgaagcagttcgagcaactttttcttcctagcttcctgtcctatatcgtaaattgcttcctgatcgatgacgctgtcgtcaaggacgaggcactcgccatcctagctaaacttatcttaaacaaggcggctccaccgaccgcaggaagtatggccatcgaaaagtatccactggtgtttagtccccagatggtcgggttctatattaagcagaagaaaacaaggtccaagggtcgcaacgagcagtttcccgtgctggatcatcttctgtccattattaaactgccccccaataaggatacaacttaccttagccagtcatgggccgctctggtggttctccctcacatcagacctctcgaaaaggaaaaggtcatcccgctcgtgactggattcattgaagccctgtttatgactgtagataaaggttccttcggcaaggggaatctgttcgtcttgtgccaagccgtcaatacactgttatctctggaagaatcaagtgagctcctgcacctggtcccggtggagcgcgttaagaatttagtcctcacctttcctctggaacccagcgtcttattgctgactgacctctattaccagaggctggcactctgtggctgcaaggggccccttagccaggaagcactgatggagcttttccctaaactgcaggcgaatattagcaccggtgtttcgaaaatccggctgctcactatccgtatcctaaatcacttcgacgttcagctccctgaatcaatggaggatgacgggctgtcagagcgacaatccgtcttcgccatcctgcggcaggctgaactggtgccagcaactgtcaatgactacagagaaaaactgctccaccttagaaagctgcgacacgacgtggtccaaaccgccgtgcctgatggcccactgcaggaagtgcccttgcggtatcttctaggcatgctgtacattaatttctccgccttgtgggaccctgtaattgagttgatctcgtctcatgctcacgagatggaaaacaaacaattttggaaggtgtattacgagcatctggaaaaggctgccacccacgcagagaaggagctccagaacgacatgaccgatgaaaagtccgtaggagacgaatcgtgggaacagacccaggaaggtgatgtgggggctctgtaccacgaacagttggctctgaaaacagattgtcaggaaagactcgaccacacgaactttaggtttctgttgtggcgggcacttaccaaattcccagagcgagtggaacctcgctctcgggagctttctcccttgttcctcagattcatcaataacgagtattatccagcagacctgcaggtggcccccacacaggatctgcgtagaaaaggcaaggggatggtcgcagaagagatcgaagaagaaccagcagctggggatgatgaagagctcgaagaagaagctgtgccccaggatgagtcaagtcagaagaaaaagacgcgacgggccgctgccaaacagctcatcgcccatctccaggttttctcaaaattttctaatccaagagctctatacttggagtccaagctttacgagctgtatctccaactactcctgcatcaagaccaaatggtgcagaagataacactggactgcataatgacttacaaacacccccatgtcctgccctatagggagaacctgcagcggctcttagaagataggtcttttaaagaggaaattgtgcactttagcattagcgaagataacgctgtcgtcaagactgcacatcgagctgatctgtttcccattttgatgcggattttgtacggccgtatgaagaacaaaaccgggagcaaaacacagggtaagtccgcaagtggcacccggatggctatagttttaaggtttctggcaggcactcagccagaggagattcagatattcttggacctactctttgagccggtacgccattttaagaacggggagtgccattccgccgtgatccaggctgtagaggatctcgacctaagcaaagttctcccgctgggacgccagcatgggatattgaattccctggaaatcgttctgaagaatatctcgcatctgatctcagcatatttaccaaagatcttgcagatcctcctgtgcatgacagccaccgtctcgcatattctggatcagagggagaagattcagctacgctttattaaccccttaaaaaatcttcgtcgtttaggcatcaaaatggttactgatatctttctagactgggaaagctaccagtttcgcacggaggagatcgatgccgtatttcatggcgcggtgtggccgcaaatctcaagactcggaagcgagtcccaatatagcccaacgcctctgctgaaactgattagtatctggagccgtaatgctcggtacttcccacttcttgctaagcagaagcctggtcaccctgaatgcgatattttgacaaatgtgtttgcaattttatccgcaaagaatctgtccgatgccacagcttctattgtcatggatattgtggacgatttactgaatctgcccgatttcgagcccaccgagactgtgctaaacctgttggtgaccggatgtgtgtatccaggtatcgcagagaatatcggggaaagtatcactataggagggcgactgattttaccacatgtgcctgcgatcctccagtatctgtccaagacaactatatccgctgaaaaggtcaaaaaaaagaaaaatagagcccaagttagcaaggaacttggaatcttgagcaagatatctaagtttatgaaagataaggaacagagttccgttcttatcacactgctgctaccctttttacatcggggcaacatagccgaagacaccgaggttgacattctcgtgacagtgcaaaatctactgaaacactgtgtggatccaacaagtttcctcaagcccatcgcaaagcttttcagtgtgattaaaaacaagttgagcagaaaattactctgtactgtgtttgaaactctgtctgatttcgagtccggactcaaatatattaccgatgtcgtgaagctaaacgccttcgaccaacgtcacctcgacgatatcaatttcgatgtacgcttcgagacctttcagacgattaccagttatattaaggagatgcagatcgtagacgttaactacctcataccagtgatgcacaactgtttttacaacctggagctgggggacatgtctttgagcgacaacgctagcatgtgccttatgtccattatcaaaaagctggctgctctgaatgtgactgagaaagattaccgcgaaattatccatcgatctctgctggaaaagctgagaaagggtcttaagtcccagacagagagtatccagcaggattataccactattctttcatgcctcattcagacttttccaaatcagttggagttcaaggatttggtccaactgactcactatcatgatcctgagatggatttttttgaaaacatgaagcacatccaaatacatcgaagagcccgggcactgaagaagttagcaaagcaactgatggagggtaaggtggtactgagttccaaaagcttgcagaactacatcatgccatacgccatgacacccatttttgacgagaaaatgcttaagcatgagaatatcacgactgccgctaccgagattattggtgcaatctgcaaacacctcagctggagcgcatatatgtactatctcaagcattttatacacgtcctgcaaactgggcaaattaaccagaagctgggcgtctctctgctggtgatcgttttggaggccttccattttgatcataaaacactggaggagcaaatgggcaaaattgaaaacgaagagaatgctattgaggcaatcgagctgccagaaccggaggccatggagctggagcgcgtggacgaggaggagaaggaatatacctgcaagtcactgtccgacaatgggcaaccaggtactcccgaccctgccgattcaggaggcacctctgctaaggaaagcgagtgcatcacgaaacctgtctcattccttcctcagaacaaagaggaaattgagcggacaattaaaaatattcaagggaccatcaccggggacatccttccacggttacataagtgcttagcttcaaccaccaagcgtgaggaagaacacaagctcgtgaagagcaaggtggtcaatgacgaagaggttgttagggttcctcttgcatttgcaatggtgaagttaatgcagtcattgccacaggaggttatggaagccaacttgccaagcatcctgctcaaggtctgtgcgttgctcaagaacagagcacaggagattcgtgatatagcccgctcaaccctggctaaaatcatcgaggatctgggggtacatttcttactatacgtgctgaaggaattgcagaccactttggtgcgtgggtaccaggtccatgttctgactttcacagtacatatgttgctgcagggcttgaccaataagttacaggtcggagatcttgattcttgcttggacataatgatcgagatcttcaatcacgaattgtttggggcagtggccgaggagaaggaagtcaaacagattctctccaaggtcatggaagcaagaagatcaaagagctacgattcgtacgaaatactcggtaagttcgtaggaaaagatcaggtgaccaagctcattctgcccctaaaagagatcctccagaatactacaagtctcaagctggcccgcaaagtccacgagacacttaggaggatcaccgttgggcttatcgtgaaccaggagatgacggccgagtccatcctcttactctcttacggcctgataagtgagaatctgccgttgctgacggagaaagagaagaatccggtggctcctgccccagaccctcgattgccccctcaatcttgtctgttactgccgcctaccccggtgcgcggaggccagaaagccgtggtttcccggaaaactaacatgcacattttcattgaatcggggcttagactgcttcacctgagcctaaagaccagtaagattaagtctagcggggagtgcgtgctggaaatgctcgacccctttgtgagtctactaatcgattgcttgggaagcatggacgtcaaggttattacaggcgcactccagtgtttgatatgggttctgcggttccccctcccgtccatcgagaccaaagccgaacaacttacaaagcacctgttcctgctgctgaaggattatgctaaactgggagccgcgcgtggccaaaacttccacctggtcgttaattgctttaaatgtgtcactattctagtgaaaaaagttaagtcataccagattaccgagaaacaacttcaggtactgctggcatacgccgaggaagacatctacgatacctcgcgacaagccaccgcgtttggtctcctaaaagccatcctcagcagaaagttattggtccccgagattgacgaagtgatgagaaaggtgtccaagttagctgtgtctgcccagtctgagccagctagagttcagtgcaggcaggtttttctgaagtatatccttgactatcctttaggtgataaacttcgacctaatttagagttcatgttagcgcaactaaattatgagcatgagacgggtcgcgagtctacgctggaaatgatcgcttacttgttcgacacatttccccagggcctcctgcacgaaaattgtggcatgtttttcatacctctgtgcttaatgacaattaacgatgactccgccacttgcaaaaaaatggccagtatgaccatcaaaagccttttgggaaaaattagtctggagaaaaaggattggctgtttgatatggtgaccacatggtttggtgctaagaagcggctcaaccgccagctagcagccctgatctgcggcctttttgtagaaagcgagggggtcgatttcgagaagaggttgggcacagttctccccgtgattgaaaaagagattgacccggagaattttaaagatataatggaagagacggaagaaaaggcagccgataggctcctcttctctttcctcaccctgatcacaaagttgataaaagagtgtaatataatccagtttacaaaacccgccgagactctgtctaagatctggagtcacgtacattctcacctgcgccaccctcacaactgggtctggttaaccgcagcccagatcttcggccttcttttcgcctcctgccagcccgaagagctcattcagaagtggaatactaagaaaacgaaaaaacacctacctgaacccgtggcgatcaagtttctggccagtgatttggatcaaaagatgaagagtatcagcctggcctcttgtcatcagctccactcgaagttcctggaccaatcacttggcgagcaggtggttaaaaacctcttattcgccgctaaagtcctgtacctcctggaattgtattgcgaggataagcaatctaagattaaagaggacttggaggaacaggaagccttggaagatggagttgcatgtgcagatgaaaaagccgagagcgacggcgaggagaaggaagaggtaaaagaggaactggggcgtccagccactttactctggctcatacagaaactgtcccgaatcgcaaagctggaggctgcctatagtccgcgcaatcctcttaaaaggacatgtatcttcaagtttctgggagccgttgcgatggacctaggtattgacaaagtgaagccttaccttcctatgatcatcgccccacttttcagagagctcaacagtacctacagcgagcaggatcccctgttaaaaaacctctcccaggagatcatcgagctgctgaagaaactggttgggctggagagcttctctctggctttcgcctctgtgcaaaaacaggctaatgaaaagcgggctctgagaaaaaagcgcaaggccctggagtttgtcaccaatcccgacattgcagcaaaaaaaaaaatgaaaaaacacaagaataagtctgaggccaagaagcggaagatcgagttcctccgacctggttacaaggccaagcgacagaagtcccacagcctaaaggatcttgccatggtggagtag

SEQ ID NO: 140230 - DNA, 1440 bp, Artificial Sequence
  Description of Artificial Sequence: Synthetic coding sequence
atggtggggcgatcaaggagacgcggtgcggccaaatgggccgcagtgagagcaaaagcaggccctaccctgaccgacgagaatggggacgatctgggtttgcccccctccccgggcgacacgtcatattaccaggatcaggtggatgactttcatgaggcacgcagtcgggctgccctggccaagggatggaatgaagtgcagtctggggacgaggaagacggcgaagaagaagaagaggaggttctagcattggacatggatgacgaagacgatgaagatggggggaacgccggagaggaggaagaggaagaaaacgcggacgatgacgggggtagttcagtccagtccgaagcagaggctagcgtggacccaagcctgagctggggacaacgaaagaagctgtactacgacaccgactacggttctaagtctagaggtaggcagtcacagcaggaggccgaggaggaggagcgagaggaagaagaagaagcacaaataatccagcgacgcctggcccaggcactgcaagaggacgattttggagtcgcgtgggtggaggcttttgcaaaaccggtgccgcaagtggatgaggccgagaccagggtggtcaaggaccttgcaaaggttagtgtaaaggaaaaattaaagatgctgcgcaaagaaagccccgagctgttggagctgatcgaggacttaaaggtcaagcttaccgaggtgaaagatgaactcgagccgctgctggaactggtggagcagggtatcataccccccggcaagggttcgcagtacctccggaccaaatataatctgtatttgaattactgcagcaacatttccttctatctcattcttaaggccaggcgagtgccagcacacggtcatcccgtcatcgagcgactggtgacttaccgcaacctcattaataaactgtccgtggtggaccaaaagctgtctagtgagattcgtcatctactcacactgaaggacgatgccgttaagaaagaattgattcccaaggcgaaatcaacaaaaccaaagcccaagagcgtgagtaaaacctccgctgcagcttgcgccgttacagacttgtcagacgattctgatttcgatgaaaaagccaagctgaagtactataaagagatcgaagaccggcagaaactcaagcgtaaaaaggaagagaattccacagaggagcaggcactggaggaccaaaatgctaagcgtgccattacataccaaatcgccaagaatcgagggctgacccctaggaggaagaagatcgaccgtaacccccgcgtaaaacatcgtgagaagttccggcgcgccaagatcagacgacgtgggcaggtgagagaggtgaggaaggaagagcaaaggtactcgggcgagctcagcggcattcgtgctggagtgaagaagtccatcaagctgaagtag

SEQ ID NO: 140231 - DNA, 756 bp, Artificial Sequence
  Description of Artificial Sequence: Synthetic coding sequence
tgaatcgggctgatgagtttgagcaagggcctacttgaagagaagtatcgatacctgtttaaagaggtcgctggccccactgagatgtgcgaccagaggcagcttggactgctgctccatgatgcaattcagattcctcgtcagctgggagaggtcgcagcatttggcgggagtaacatcgaaccaagtgtgcgcagttgctttcagcagaacaacaacaaacctgaaatcagcgtgaaggagtttatagattggatgcatctagagccgcagagcatggtgtggctgcctgtgctgcacagggttgctgctgccgaaaccgccaagcaccaggcaaaatgcaatatctgcaaggagtgcccaatcgtaggctttcgttataggtcacttaagcacttcaattatgacgtgtgtcagtcatgcttttttagtggcagaacagccaagggacacaagcttcactatccaatggtggagtactgcatcccaaccaccagtggcgaggacgttcgcgactttacaaaggttttgaagaacaaattcagatcaaaaaaatatttcgcgaagcacccacgcttgggctatttgcctgtacagacggtgctggagggagataaccttgagaccccgagtcagtccccccaattgtttcacgacgatacacatagccgcattgagcagtatgccactaggctagcccaaatggaaagaacgaatggaagcttcctcactgacagctcttcgaccacagggtag

SEQ ID NO: 140232 - DNA, 201 bp, Artificial Sequence
  Description of Artificial Sequence: Synthetic coding sequence
atgattggcctcaatttcaatctgcgagagttacttactaaatttgagaaggacattcaggcggagatcgatgcccataacgatatttttaagagcatcgacgggaatcgacagaagatggtgaaggctctcgggaacagtgaggaggcaacgatgctgcagcataggctggatgacatgaaccagagatggaacgattag

SEQ ID NO: 140233 - DNA, 2967 bp, Artificial Sequence
  Description of Artificial Sequence: Synthetic coding sequence
atgcagatcctcagatgccttcagaagtgtggcaagctgaagatgatggctgttgttcgtacttccctgcagaaggtggtggtactcctgcaccggttacagcgaatggcggttagttcccccagataccagaagctgtgtaaggatattcaagcggaaatcgatgcccacaacgatatctttaaatccattgacggaaatcgacagaaaatggtgaaggctctggggaattcagaagaggctacaatgttacaacacagactcgacgatatgaatcaacgctggaatgatctgaaggctaaatcagcctccatcagagcacacctggaggcctctgctgaaaaatggaatcgcctgcttatgtccttagaggaactgataaagtggctgaacatgaaggacgaggaattaaaaaaacagatgcccatcgggggagacgtgccagcactgcagcttcagtacgatcattgcaaggcactacgccgcgagctcaaagaaaaggagtattcagtactcaacgcagttgatcaggcaagggttttcctcgccgaccagcctatagaggctcccgaagagccaaggcgcaaccttcagtcgaagactgagctgacccctgaagagagggcgcagaaaatcgcaaaagccatgcgcaaacagagttccgaagttaaggaaaagtgggaaagcctgaacgctgtcacaagcaattggcaaaaacaggtggacaaggctctcgagaaactgagagatctgcagggagccatggacgacctcgacgcagatatgaaggaagctgagtccgtacgcaacgggtggaagcctgtcggtgatctgctcattgacagtcttcaagatcatattgagaaaattatggcgttcagagaagagatcgccccaattaatttcaaggtcaagactgtgaacgatctgagttctcaacttagcccactggacctccatccatcccttaaaatgagtcggcagctggacgacctgaacatgcgctggaagctcctgcaggtgtccgtagacgacagacttaagcagttacaggaagctcaccgcgacttcggtccatccagccagcacttcctgagcacgtctgtccagcttccttggcagcggtctatttcacacaacaaggtgccctattatatcaatcaccagacacagactacttgttgggatcatccaaaaatgaccgaactctttcagtccctcgctgatctgaataatgtccgcttcagtgcatatcggacggccataaaaatccgccggctccagaaagccctgtgcctggacctactcgaactgtccactaccaatgaaatattcaagcaacacaaactgaaccagaacgaccaattgcttagtgtccctgacgtgataaactgccttacaacaacctacgacggcctggagcagatgcacaaggacctggtgaacgttcccctgtgtgttgatatgtgcttgaactggctgctcaacgtttatgatacaggtcgcaccgggaagatcagggtgcagtcactcaagatcggactgatgtcattgtccaagggcctccttgaggagaaataccggtacctcttcaaagaggttgccggacccacagaaatgtgtgaccagcggcagctgggccttctattgcacgatgccatccagatccctagacagttgggcgaagtggcagcttttggaggctcaaatatcgagccctctgttcgaagttgcttccagcaaaataataacaagccagagattagtgtgaaagagttcatagactggatgcacctcgagccccaatccatggtatggctcccagttctccatcgtgtggctgctgccgaaacagctaaacaccaggcaaagtgcaacatctgcaaagagtgccccatcgtgggttttcgatataggtctttgaagcacttcaattatgatgtgtgccagagctgttttttcagcggacggacggccaagggacacaagctccattatcctatggttgagtactgcattcccactacctcaggcgaagatgtgcgggacttcaccaaggtgctgaaaaataagtttcgcagtaaaaaatactttgccaagcatccacgtcttgggtacttgcctgtccagaccgttttggaaggcgacaaccttgaaactcccatcactctgatttcaatgtggcctgagcactacgacccctctcaatctccacagttgttccacgatgatacacatagtcggattgaacagtatgcaacaaggctggcccagatggaacggactaatggatccttcttgactgactccagctcgaccacaggctcggtcgaagacgaacatgcattaatccaacagtattgtcagaccctggggggagaaagtcccgtgagccagcctcagtctcctgcccagattcttaagagcgttgaaagggaggaacgcggcgaactggagcgaatcatcgctgatctggaagaggagcagagaaatttgcaagtggaatatgaacagctgaaggaccagcacctgaggcgtgggctgccagtggggtctcctcccgaatccataatctcaccacatcacacctcagaagatagtgaactaattgccgaggccaagctgctcaggcagcacaagggccggttagaggcaagaatgcagatcctcgaagatcacaacaagcagttagagtctcaactgcaccgtctaaggcagctcttagagcagccagaatccgacagtcggatcaacggtgtttctccatgggcttccccgcaacatagcgccctatcttatagtctcgatcccgatgcctctggacctcagttccatcaggctgccggcgaagatctgttggcacctcctcacgacacatccaccgatctcaccgaagtgatggagcagattcactccacgtttccatcctgttgccccaacgtcccttcccgtccccaagccatgtag

SEQ ID NO: 140234 - DNA, 3069 bp, Artificial Sequence
  Description of Artificial Sequence: Synthetic coding sequence
atggctaagtacggagagcacgaggcgagtcccgacaacggtcagaatgagttttctgatattatcaaatccagaagtgacgagcacaatgacgtacaaaaaaaaacctttaccaaatggatcaacgccagatttagtaaatcagggaaacctcccatcaacgacatgttcactgacctgaaagacggcaggaagttgctcgatctgctggaaggcctcaccggcacatctctgcctaaggagcgcggaagcacaagagtgcatgccctaaacaatgttaatcgcgtattacaagtcctgcaccagaataacgtggagctcgttaatattggaggcaccgacattgtcgatggcaaccataagctgactctaggacttctttggtcaattatccttcactggcaagtgaaggacgtgatgaaggacgtgatgtcggatctgcagcaaacaaactctgaaaagattttgctttcatgggtcagacagactacccggccgtactcacaggtcaatgtgctgaatttcaccaccagttggactgatggcctggcttttaacgccgtactgcatcggcacaaacctgatctgttttcctgggataaagttgtcaagatgtctcctattgaacgactcgagcacgcattctcaaaggctcaaacatatctcggaatcgaaaagctactagatcctgaagacgttgccgtacaattgcctgataaaaagtctattatcatgtacctgacatccctttttgaagtcctgcctcagcaagttaccattgatgcaattagggaggtggaaacactcccaaggaagtataagaaggagtgcgaagaagaggccatcaacatccaaagcacggcccctgaagaggaacatgagtccccccgtgcggagacgccatccacagtcactgaggtggatatggacctggattcttaccaaatagcactggaagaagttctgacatggctgctgagcgccgaggataccttccaagagcaggatgatatctctgacgatgtggaagaggtgaaagatcagtttgctacacatgaggctttcatgatggaactgacggctcaccagtcctctgtggggtccgttctacaggctgggaatcagcttatcacacagggcactctaagcgacgaggaggagtttgagatccaggaacagatgaccctgctcaacgctaggtgggaggccctgcgcgttgagtcgatggaccgccagagccggctacatgacgtcctcatggagctgcaaaagaaacaactgcagcagctctctgcctggctaacattgaccgaggaacgaattcagaagatggagacttgccccttagatgacgatgtcaagtctctccaaaagctcttggaagagcacaagagtctgcagtcggacctggaagcagagcaagttaaggttaacagtttaacacatatggtcgtcatcgtagacgagaacagcggcgaatcggccaccgcaatcctagaagaccaacttcaaaagctaggagaaaggtggacggcggtctgtaggtggactgaggagcgatggaaccgattgcaagagattaacattctctggcaagaacttcttgaggagcaatgtctgctgaaagcctggctgaccgagaaagaggaagctcttaataaggtgcaaacatccaactttaaagaccaaaaggagctgtccgtttctgtgcggcggcttgcgattctaaaagaagacatggagatgaagcgccaaacgttagatcaactctctgaaatcggccaggacgtaggacagttactcgacaacagtaaagcctccaaaaagataaattccgactctgaggagttgactcagcggtgggactcccttgtccagagactggaagatagtagtaatcaagtgacgcaggcagttgcgaagctgggtatgtcccagatcccccagaaagacctactcgagaccgtgcgggtaagggagcaggctatcacaaagaaatccaaacaggaactgccacccccgcccccacccaaaaaacgacaaatacacgttgacattgaagccaagaaaaagttcgacgccatctcagccgaactgctgaattggattctcaagtggaaaactgcaatacagaccactgaaattaaagagtacatgaaaatgcaagacacatctgagatgaaaaagaagctcaaggcattggagaaggaacaaagagagcggatcccccgtgccgacgagctcaaccaaacagggcagatcttggtcgaacagatgggcaaagagggattaccaacagaggaaattaaaaacgtgctggaaaaggtgagcagcgagtggaaaaacgtgtcccagcacctggaagacctcgaacgaaagatccagctgcaggaagatatcaacgcttacttcaaacagcttgacgagctggaaaaagtaatcaagaccaaggaggagtgggtgaagcatacatcaatttcagagtcttctcggcaatctctgcccagcttgaaggactcctgtcagcgtgaactgactaacctcctgggactgcaccctaaaatagagatggcaagagcatcgtgtagcgctctgatgtcccagccaagtgctcccgactttgtgcagcgcggctttgactccttcctcggtaggtaccaggctgttcaagaggccgttgaggatcgccagcagcatctagaaaatgagctaaagggccaaccgggccatgcttatctggaaacattgaaaacactgaaggatgtgctgaacgacagcgagaacaaagcccaggtgagtctcaatgtgctgaacgatctggccaaggttgagaaagccctgcaagaaaaaaagacccttgatgagattctggaaaaccagaaacccgctctgcacaaattagctgaagagaccaaagcactggagaagaacgtgcaccccgatgtggagaagttgtacaagcaggaatttgatgatgtgcaaggaaagtggaacaagctcaaagtgcttgtcagcaaagacttacatttgcttgaagagattgcattgactctaagggctttcgagtag

SEQ ID NO: 140235 - DNA, 10302 bp, Artificial Sequence
  Description of Artificial Sequence: Synthetic coding sequence
atggccaaatacggagaacatgaagcctccccggacaacggtcagaatgaattctcggacattatcaagtctcgcagcgacgaacataacgacgtccagaagaaaacctttactaaatggatcaatgctcggttcagcaagtccggcaagcctccgatcaatgacatgttcacggatctgaaagatggccgcaaactactggacctgctggaggggctcaccggaacatccctcccaaaagaacgcggatcaacacgcgtacacgcccttaacaacgtcaaccgtgtccttcaggtactgcatcagaacaatgttgaactcgttaacattggagggaccgatattgttgacggcaatcacaaactcaccctgggcttactttggtcaatcattctgcattggcaggtgaaagacgtgatgaaggatgtcatgtctgatctccagcagactaattctgaaaagatactgttgagttgggtgcgccagacaactaggccatatagccaagttaacgttctgaatttcactacctcatggacggatgggctcgccttcaacgccgtcctacacagacacaaacctgacctctttagctgggacaaagtcgtcaaaatgtccccaattgagaggctggagcacgcattctccaaagcacagacctacctggggatagagaagctcttggacccagaggatgtcgctgtgcagttacccgacaagaaaagcattattatgtaccttacctctctgttcgaggtactacctcagcaggtaaccattgacgccattcgggaagtggagacgctgcctaggaaatataagaaagagtgcgaagaggaggccatcaacattcagtctacagctcccgaagaggaacatgagagtccacgtgccgaaaccccgagtaccgtcaccgaggtagatatggatctggattcgtatcagattgcactggaggaagtgctcacgtggttactcagtgccgaagacacctttcaggagcaggacgacatctcggatgacgtggaggaagtcaaagaccagtttgccacgcacgaggcatttatgatggaattgacggcccaccagagttccgtgggctctgtgctgcaggcagggaaccagctgattactcagggaaccttgagcgacgaggaagaattcgaaattcaggagcagatgacgctgctcaatgccaggtgggaagctctgcgcgtggaatcaatggatagacagagtcgattgcacgacgtactcatggaactgcagaaaaagcaactgcaacagctgtcagcatggttaacacttactgaggagagaatccagaaaatggagacatgccccttagacgatgacgtcaaatccttgcagaagctactggaagagcacaaatccctgcaatctgatctagaggccgagcaggtgaaggtgaatagtcttacccacatggtcgtgatcgtggatgaaaacagtggggaatctgccacagccatcctcgaggaccagctgcaaaaactgggggaacgctggaccgctgtctgccgctggactgaggagagatggaaccggctccaggagattaacattctctggcaggaactgctggaggagcaatgcctgctgaaggcctggctaacagagaaggaggaagccttaaataaggtgcagacaagcaactttaaggatcagaaggagttgagcgtttctgtgcggaggctcgccatcctgaaagaggatatggaaatgaagcgccaaaccttagatcagttgagtgaaatcggacaggatgtaggacagctgcttgacaattccaaagctagtaaaaagatcaattcagacagtgaggaactgacccagagatgggactcattggttcagagactggaagattcgagtaatcaagtcacacaggccgtagctaaacttgggatgtcacagatcccccagaaggacctgctcgaaactgtgcgggtgcgggagcaggccatcactaagaagagcaaacaggagcttcctccccctcctccccccaaaaagaggcagatacacgtggatatcgaagcaaagaagaaattcgacgccattagcgctgagctgctgaactggatcctgaaatggaaaacagccattcaaacgaccgagatcaaagagtatatgaagatgcaggatacctcggagatgaagaagaaattaaaagcacttgaaaaggagcaacgagagcgtatacccagggcagacgaactgaaccaaacaggacagatactggttgagcagatgggcaaggagggcctccccacagaggaaataaagaacgtgcttgagaaggttagctctgagtggaagaatgtttcacagcacttggaagacctcgaaaggaagatacagctgcaggaggatattaacgcctactttaagcagctggacgagctggagaaagtgattaagactaaggaggaatgggtaaaacacacgagcattagtgaatcttcccgacagagtcttccgtctctgaaggattcatgccagagggagctgactaacctgcttggcttacatccaaagatcgaaatggccagagctagttgcagcgcactgatgagtcagcctagcgctcccgatttcgtgcaacggggattcgacagctttctgggtcggtatcaggctgtccaggaggccgtggaagacaggcagcagcacttggaaaatgaactgaagggccaaccaggccatgcttatctggaaacccttaagacactgaaggacgtgctcaacgattccgaaaataaggcacaggtgtcattgaacgttctgaatgacctcgccaaggtcgaaaaggctcttcaggagaagaagaccttagacgagattttggagaaccagaagcctgctctgcacaagttggcagaagaaaccaaagccctcgaaaagaatgtgcatcccgacgtagagaaactgtacaagcaggaattcgacgatgtgcaagggaagtggaataaactcaaagttcttgtgagcaaagacctccacctgctggaggagatcgccctgacactgagagcttttgaggccgactcaacagtgatcgaaaaatggatggacggcgtcaaggatttccttatgaaacagcaggccgcccagggagatgacgccggcctgcagagacagctcgatcagtgttccgccttcgtgaatgagattgagacaattgaaagcagtctgaaaaatatgaaggagatagaaacgaatttgcggtccggccccgttgccggaattaagacatgggtacagacaaggcttggagactatcaaacccagctggagaaactctcaaaagagattgcaacccaaaagtcccggttaagtgaatcacaggagaaggcagccaatctgaagaaagatctggcagaaatgcaggagtggatgactcaagccgaagaagagtacctggagcgggacttcgagtacaaaagtccagaggagctcgaatcagctgtggaagagatgaagagggccaaggaagacgtcctccagaaagaggttagagtgaaaatcctgaaagacaacatcaaactcctggccgcaaaggtgccttctgggggtcaggagcttacaagtgagttgaatgtagtgcttgaaaactatcagctgctgtgtaaccgtattagaggaaagtgccacacattggaggaggtctggtcctgttggattgaactactgcactacctagatctcgagacaacttggctgaacacactagaggaaaggatgaagtcaactgaagtcctccccgagaagacggatgcggtgaatgaggcgcttgagtcacttgaaagcgtactgagacacccagctgacaacaggacacagatccgtgagttaggacaaaccctgatcgatggtgggattttagatgacattatctctgagaagctcgaggcgtttaactcgcgctatgaagatttatcccacctggccgagtcgaaacagatttccctggaaaaacaactgcaggtgttgcgtgagaccgatcagatgttacaggtgctgcaggaaagcctgggcgagcttgataaacagcttaccacttacttgactgatagaattgatgctttccaagttccccaggaggcgcaaaaaattcaggccgagataagcgcccacgagctcacattagaggagttgaggaggaatatgaggtcacagccattaacctcccccgagagccggacggctcgggggggcagccagatggacgttctacagcggaagcttagagaggtatcgaccaaattccagctcttccagaaaccagccaattttgagcagcggatgctggactgtaaaagggtgttggatggggttaaggccgagctacacgtcctggacgtaaaggatgtggaccccgatgtaatccaaacgcacctggacaaatgcatgaagctttacaagacacttagtgaggtgaaactggaggtcgagacggtcatcaaaaccggaagacacatcgttcagaaacagcaaactgacaatcctaaaggtatggacgagcagttgaccagcttaaaagtgctgtataacgatctcggagctcaggtaactgaaggaaaacaggatcttgaacgagccagccaactcgctcggaagatgaaaaaagaagccgcctctctctccgagtggctatctgccacagagaccgagctggtgcaaaagtccaccagcgaaggtcttctgggggacttagataccgagattagttgggccaaaaacgtgctgaaggacctggaaaaacggaaggcagatctgaatacaattacggaatcatccgctgctctccaaaacctgattgaaggcagcgaacctatactggaggaaagactgtgtgtgctgaacgcaggatggtcccgggtgcgtacctggaccgaggattggtgtaatacgctgatgaatcaccaaaaccagttagagatattcgacggtaacgttgcccatatcagcacgtggttgtaccaggctgaggcccttcttgatgaaatcgagaagaaacccactagcaagcaggaggagatagttaagcggctggtcagcgaactcgatgacgcaaacttgcaggttgagaacgtgagagaccaggccctgatcctgatgaacgctcgcggttcatcctcgcgtgagttggtggagcctaaacttgcggagctaaaccggaattttgaaaaggtatcccagcacataaaatcagcgaaactgctcatagcacaggagcccctgtatcaatgtttggtgacaaccgagacctttgagaccggtgtaccttttagtgacctcgaaaagctcgaaaatgacatcgagaacatgttgaagtttgtagagaaacaccttgagtctagcgatgaggatgagaaaatggatgaagagtctgctcaaattgaggaggtgttacaaaggggtgaggagatgctgcaccagcctatggaggacaacaagaaagagaaaattcgcctgcagcttctccttttgcacacgagatacaataagatcaaggccatcccaatccagcaacggaaaatgggccagctggccagcggcatccgatcctccctgttgccaacggactacttggtggagataaataaaattctgctgtgcatggatgacgtcgaattatctctgaacgtgccagagttgaatacggcaatttacgaggattttagtttccaggaggattcactgaaaaatatcaaagaccagctggacaagttaggcgagcagattgcggtcattcatgagaagcagcccgatgtcattctagaggcctccggaccggaagccatacaaattcgcgatactcttactcagctcaacgctaaatgggatcgcattaatcgtatgtattcggaccggaaggggtgtttcgatcgagcgatggaggagtggcgccaattccactgcgacctgaacgatttaactcagtggattacagaggcagaggagttactggtggatacctgtgctccagggggctcactagatctcgaaaaggcaaggatccaccagcaggagctcgaagtcgggataagttcacatcaaccatctttcgccgcactaaacaggactggagacggcatcgtacagaagttatctcaggccgatggtagcttcctgaaagaaaaactggctggcctcaaccagaggtgggatgccatcgtcgccgaggtcaaggatcgtcaacctaggctgaaaggggaaagtaagcaggtgatgaagtaccggcaccaactcgatgagattatctgttggttgactaaagcagaacatgctatgcagaaaaggtccacgacggagcttggcgagaatctacaggagctacgagacctgacacaagagatggaggttcatgccgagaagttgaagtggttgaaccgcacagaactggaaatgctgtccgacaagtcgttgagcctcccggagcgcgataaaattagtgaatccctgcgcactgttaatatgacctggaacaaaatctgccgagaggtccccaccactcttaaggaatgcattcaagagcctagttcagtgtctcagactcggattgccgcccaccccaatgttcagaaagtggtcctggtgtccagcgcatccgatatacccgtgcagagtcatagaactagcgaaattagcattcccgcagacctggataagactataacagagctggccgactggctggttctgatcgatcagatgctaaagtctaacatcgtgaccgtgggcgatgtcgaagaaataaataagaccgtctctaggatgaagattactaaagccgatcttgagcagcggcatccccagcttgactatgtgtttactctggctcagaacttgaaaaacaaggcttcttcttctgatatgcgtaccgccattacagagaaacttgaaagagtgaaaaaccagtgggacggcacccaacatggtgttgaactcaggcagcagcagctcgaagatatgattattgattccctgcaatgggacgaccatcgggaagaaacagaggagctgatgcgcaagtacgaagctcgactatacatactgcagcaagctcgccgtgaccccttaaccaagcaaatttcagacaatcagattctactgcaggagctcggaccaggagatggaatcgtgatggctttcgataatgtgctccagaaactgctggaagagtacggctctgacgatacccggaatgtaaaggagactacagagtacctgaaaacttcatggatcaatctcaaacagtcaatcgcagaccgccaaaacgctctcgaggccgaatggcgcaccgtgcaggccagccgccgtgacctcgagaattttctcaagtggattcaggaggccgaaactacagtcaacgtgctcgtagacgctagtcaccgggagaacgctctgcaggatagtatcttggctcgcgagttgaagcagcagatgcaggatatccaagcagagattgatgctcacaatgatatcttcaaaagtatcgacgggaaccgacagaaaatggtgaaggcactggggaactcagaagaggctacgatgctgcagcaccggctggatgacatgaaccagcgctggaatgatctaaaggcaaagtcagccagtatcagagctcacctggaggcaagcgccgagaagtggaacaggcttctgatgtccctggaggaactgatcaagtggctgaacatgaaagatgaagaactgaagaagcaaatgccaataggcggagatgtgcccgccctgcagctgcagtatgaccattgtaaagccctgagacgagagctgaaggaaaaggagtattccgtgctcaacgcagtcgaccaggctagagtgttcctggcagaccagcctatagaagccccagaggaacctcgccgtaatttacaatctaagactgagttgacaccggaggagagagcacagaaaatagcgaaagccatgaggaagcagtccagtgaggtaaaagaaaagtgggaatccttaaacgcagtgacgtctaactggcaaaagcaagtagacaaggcgttagaaaaactacgcgacctgcaaggtgcgatggacgatttggatgctgacatgaaagaagccgagagtgttcggaacggctggaagccagttggagacttgctcatcgactctttgcaggaccacattgaaaagattatggcctttagagaggagattgcccctattaattttaaggtgaagaccgtgaacgacctaagttcccagctgagtcccctcgatttgcaccctagtctgaaaatgtctaggcagctggatgatctcaacatgcgttggaaactcctgcaggtgagcgtagacgacagactcaaacaactgcaagaggctcatcgcgatttcggacctagttcccagcactttttatcaaccagtgtccagctgccatggcagcggtctatttctcacaacaaagttccatactacataaatcatcagacacagaccacatgctgggaccaccccaaaatgaccgagctgtttcagagcttggccgacctgaacaatgtgcgcttcagtgcttacagaacagctataaaaatccgcaggctacagaaagccctttgcctcgacctcttggagctcagcactactaacgagatattcaagcagcataaacttaatcagaacgaccagctgctcagtgtcccagacgtgatcaactgccttactaccacctacgacggactcgagcagatgcacaaggatttagtgaacgtgcctctctgtgtagacatgtgtctgaattggctcctgaatgtgtacgacacaggaagaaccggaaagattcgggtgcagagcctgaagatcggtctgatgagtctgtctaagggcttgctggaggaaaagtataggtacctcttcaaagaggtggctggccccactgagatgtgcgaccaacggcagcttggcttactcctccatgatgctattcagattccacgccagctgggggaagtggccgccttcggtggctcaaatatcgaaccaagtgtgcgctcatgcttccaacaaaacaataataaacccgaaatcagcgttaaggaatttattgattggatgcacctcgaaccccaatctatggtttggctgccagtcctacaccgcgtcgccgccgcagaaacagccaagcatcaagctaaatgcaatatctgtaaggaatgtcccatcgtcggattccgctaccgctctctgaaacactttaattacgacgtgtgccagagctgtttcttcagcggcagaaccgcaaagggacataagctccactaccccatggtggaatactgtatcccaacaacctccggggaagacgtgagggattttaccaaggtgcttaaaaataaatttcgttctaagaaatacttcgccaagcacccccgccttggctacctgcctgtacagaccgtcctcgagggtgacaatctggaaaccccaatcacgctgatttcaatgtggcccgagcactacgaccctagtcagagcccacaactgttccacgacgatacccactcaaggatagaacaatatgcaacaaggttggcccagatggagcgtactaacgggtcctttttgaccgacagctcttctactaccggatccgttgaggatgagcatgccctaatacaacaatattgccagactttaggcggagagtctcctgtgtcacaacctcagagtccagctcagattctaaagtcagtcgaacgtgaggaaaggggtgaacttgaaaggataatcgccgatcttgaggaagagcagcgaaacttacaagtggagtacgagcaacttaaggatcaacatctccgacgggggctaccggtaggcagcccaccagaatcgattatttctccacatcacacatccgaggattcggagcttattgccgaagccaagttgttgaggcagcacaagggcagactggaggctcgaatgcagatcctcgaggaccacaacaaacaactggagtctcagctgcataggttgagacaactgctcgagcaacctgaaagtgattctcggattaacggagtgagtccttgggcctccccccagcactcagcactttcttattcattggacccggatgccagcggaccacaattccatcaggccgccggtgaggacctgctggcaccgccccacgacacttcgaccgatctgaccgaggtaatggaacagatccatagcacatttccatcttgttgtccaaacgtcccatcccgtccccaggccatgtag

SEQ ID NO: 140236 - DNA, 555 bp, Artificial Sequence
  Description of Artificial Sequence: Synthetic coding sequence
atgcatctcgaaccccagtctatggtttggcttccagttctgcaccgtgtggccgctgctgaaactgctaagcaccaagcgaagtgtaatatttgtaaggagtgccctattgttgggtttcgttaccgaagcttaaaacattttaactatgatgtgtgccagtcttgcttcttctccggtagaacagcaaagggccacaagctacactacccaatggtggaatactgtatccctacaactagtggcgaagacgttagagatttcacaaaggtgctaaaaaacaaatttcgctcaaaaaagtattttgctaaacacccacggctcggctatctgcccgttcagacagtccttgagggtgataatttagagaccccttctcaatccccacagttgtttcatgacgacacacacagcagaatcgagcaatatgccacaagactggcacagatggagcgaacaaacggctctttcctgaccgactctagtagcacaacgggttcagtggaggacgagcacgctctcatccagcagtattgccagacactgggcggctag

SEQ ID NO: 140237 - DNA, 462 bp, Artificial Sequence
  Description of Artificial Sequence: Synthetic coding sequence
atgtcaggactggcagctactacctttcattggaaaaagtgtcggctggacttacccgggcatgttgctctccaggcatgcaaacggttgcccgatgaacataacgacgttcaaaagaagacgtttacaaagtggatcaatgcgcgcttcagtaagtcgggaaaaccccccatcaatgatatgttcacggacctgaaagacgggcgtaagctcttggacctgctggaaggactgaccggaacatcactgccaaaggaacgcggcagcactcgcgtacacgcacttaataatgtcaatcgtgtcctacaggtgctacatcagaacaacgtcgagctggtgaatatcggaggcactgacatagtcgacggaaatcataaactcactctgggattattgtggtcaatcatcctgcactggcaggtggacgtcatgaaggatgtaatgagcgaccttcaacagtag

SEQ ID NO: 140238 - DNA, 546 bp, Artificial Sequence
  Description of Artificial Sequence: Synthetic coding sequence
atgcatttagaaccccaatccatggtttggttgccagtgcttcacagagtcgccgcagccgaaaccgcaaagcaccaagcaaaatgtaacatttgcaaggagtgccccatagtcggatttagatacagatctctgaaacacttcaattacgacgtgtgccagtcttgcttcttctctggccgcaccgccaaagggcacaagctgcactatccaatggtcgagtactgcattcccacgacttcaggagaagacgttagagactttactaaggttctcaagaataagtttaggtcaaaaaaatatttcgctaaacatccccggcttgggtaccttcccgttcagaccgtgcttgaaggcgataaccttgaaacacccatcactctgatcagcatgtggccagagcattacgaccctagccagagcccacagctgtttcacgacgacacgcatagtagaatcgagcagtatgccacacgacttgctcagatggaacgaaccaatgggagcttccttaccgatagctcttcaactactgggtcagtctag

SEQ ID NO: 140239 - DNA, 144 bp, Artificial Sequence
  Description of Artificial Sequence: Synthetic coding sequence
atggctaaatatggagagcacgaagccagccctgataatgggcagaacgaattttccgacatcataaaatctagatcggatgaacataatgacgtgcaaaagaaaacatttaccaaatggatcaacgctcgctttagcaagtag

SEQ ID NO: 140240 - DNA, 561 bp, Artificial Sequence
  Description of Artificial Sequence: Synthetic coding sequence
atgctagaagaggaggagtggtaccgatccctgaaacatttcaactatgatgtgtgccagagctgctttttttctggaagaactgccaaggggcacaaactccactacccgatggttgaatactgcattccaaccacatccggggaagacgtgcgggacttcaccaaagtgctcaaaaacaagttccgaagtaagaaatacttcgccaagcatccaaggctcgggtacctgcctgttcagactgtgcttgagggagataacctggagaccccttcccaatccccgcagctttttcacgacgatacccatagtcgcatcgagcagtacgccacgagattagcccaaatggaacggaccaacggctcttttctcaccgactcgtccagtactaccggcagcgttgaggacgaacacgcactgattcagcagtattgtcagacactgggcggagagtcaccagtaagccagccccagagcccagcgcagatccttaagagcgtggagcgcgaggagcgcggggaattagagcgaataattgcagatctcgaggaagagcaatag

SEQ ID NO: 140241 - DNA, 201 bp, Artificial Sequence
  Description of Artificial Sequence: Synthetic coding sequence
atgattgggctgaatttcaacctgcgcgagctgctgaccaagtttgaaaaggacatccaggctgagattgatgcacataatgacatcttcaaatctattgacggcaaccgtcagaagatggttaaagccctcgggaattccgaggaagcgacgatgctgcagcacaggctggacgacatgaatcagagatggaacgactag

SEQ ID NO: 140242 - DNA, 555 bp, Artificial Sequence
  Description of Artificial Sequence: Synthetic coding sequence
atgcacctcgaaccacagtccatggtgtggctcccagttttacatagggtggccgccgccgaaacggcaaaacatcaagccaagtgcaacatctgtaaagaatgtcctatagttggctttcgttacagatctttaaaacactttaactatgatgtctgccagtcctgtttcttttctggtcgaaccgccaaagggcataaacttcactacccgatggtggaatattgcatccccactacctccggcgaagatgtccgcgactttaccaaggtacttaaaaataagttcaggagcaaaaagtattttgccaagcacccacggctcggctatcttccagtacagactgttctggagggggataatctggaaacgccttcacagtcccctcagctttttcatgatgatacccattctcgtatcgaacagtacgctacgcggctcgctcagatggagcgaacgaacggaagcttcctgaccgactcctccagcacaaccggatccgtggaggatgaacatgcactgatccaacagtattgtcagacactcggaggatag

SEQ ID NO: 140243 - DNA, 2100 bp, Artificial Sequence
  Description of Artificial Sequence: Synthetic coding sequence
atgtccgcttccgccagtgtaggaggaccagtccctcagccccctcccggccctgcagcagcactgcccccagggtccgccgcccgcgcgcttcacgtggaactgcctagccaacaaagacgtttacggcatttacgcaatattgcagcccggaacatcgtgaacaggaacggccatcagcttctcgatacatactttacacttcacctttgtagtacagaaaaaatttacaaagaattttacagatccgaagtgattaaaaatagcttgaatcccacatggagatctctggatttcggcataatgcctgatcgcctggacacctctgtgtcctgtttcgtggtcaaaatctggggcggtaaggagaacatctaccagctcctgatagaatggaaagtctgcctggacggattaaagtacctgggccagcagatacatgcacgtaaccagaacgaaatcattttcggactcaatgatggctactatggagccccatttgagcacaaaggatattctaatgcacaaaaaactatcttactacaggtcgaccagaattgcgttcggaattcctacgatgtcttcagcctgctcaggctccacagggcacagtgcgccatcaagcagacccaggttactgtacagaagattggtaaggagatcgaggaaaagctgagactgacgagtacatcaaacgagctgaaaaaaaaatccgaatgcttgcagcttaaaattctggtgttgcagaatgagctcgagcgccagaagaaggctttgggccgggaggtggctcttttacacaaacagcaaattgccttgcaggataagggaagcgccttttcggctgagcatctgaagctccagcttcagaaagaaagcctgaatgaattaaggaaagaatgtaccgcgaaacgggagctgttcctcaaaaccaacgcccagctgacaattcgctgtcgtcagctgctctcggagctgtcctacatttacccaatcgacctaaatgagcacaaggactactttgtctgtggggtcaagcttcctaatagcgaggactttcaggcgaaagacgacggctctattgccgtggccttgggatataccgcacacttggtgagtatgatctcctttttcctgcaggtccccctgagataccccataattcataagggaagcaggtctacaattaaggataacattaacgataagctgacggagaaggagagagagtttcccctctaccccaaaggaggcgagaagctccagttcgattatggtgtgtatttattgaataaaaacatagcccagctgcgttatcaacacggattgggaaccccggacctgcgccagaccctgcccaatttgaaaaatttcatggaacacggacttatggtacgttgcgaccgccaccacacctcgtccgcaattcctgttcctaagcgccaaagctcaatctttggcggggccgacgtgggattctccggtggcattccttccccagacaagggccaccggaaaagggcctcttccgagaatgagcgcttgcaatacaagacccctcccccctcctacaattcggccctggctcaacccgtaaccacagttcccagtatgggagagacggagagaaagatcacatccctgtcatctagtttggacacctccttggatttcagcaaggaaaataagaaaaaaggggaggatctggttgggtccctgaacgggggtcacgccaatgttcatccctcacaggaacaaggagaagccctgtctggtcacagggctactgtcaatggtactcttcttccctccgaacaggccggctcggcgagtgttcagcttcccggagaattccatccggtgtccgaggctgagctgtgttgtacagtcgagcaggctgaagagatcatcggacttgaggccaccggattcgcttccggtgaccagctggaggcatttaactgtatcccagtggacagcgcagtcgcggtggaatgcgacgagcaggtccttggcgaatttgaggagttttctcgtcggatatatgctttgaacgaaaacgtcagtagttttagaagacctcgacgatcgtcggataaatag

SEQ ID NO: 140244 - DNA, 768 bp, Artificial Sequence
  Description of Artificial Sequence: Synthetic coding sequence
atgtttatcagtgtagcccagaggcaaagggaaaatgccttcagctgctccacgttcctccgctgcgatcgccaccacacttcgagcgcaattccagtgccgaagcgccagtcatctatcttcggcggcgccgacgttggtttcagcggcggcatccccagtcccgacaagggccaccgaaagcgcgcaagtagcgaaaatgagcgactacagtacaagacaccacctccaagttacaatagcgccctcgcacagcctgtcaccaccgtgccaagcatgggcgaaacagagaggaaaatcacaagtctctctagttccttagacacatcgcttgatttctcaaaggaaaacaaaaagaaaggcgaagacctggttggttcgctgaacggaggacatgccaacgtgcatccaagccaggagcagggtgaggcgctgagcggtcaccgagccactgtgaatgggaccctgctgccctccgagcaggcaggctccgccagcgtgcagcttccaggagagttccatcctgtctccgaggccgaattatgctgcaccgtggaacaggccgaggagattattggccttgaagcaacaggatttgctagcggcgatcagctcgaggctttcaattgtataccagtcgactctgccgtcgccgtcgagtgcgatgagcaagttctgggcgagttcgaagagttcagccgtcgaatttatgcgctcaatgaaaatgtgtcttcgttcagacggcccaggagatcctctgacaaatag

SEQ ID NO: 140245 - DNA, 984 bp, Artificial Sequence
  Description of Artificial Sequence: Synthetic coding sequence
atgatctctttttttctccaggttcctctccgttaccctattatccacaagggatccaggtcaacaattaaggataacataaatgacaagctgacggagaaagaaagggaatttccgctctacccaaaagggggcgagaagctacagtttgattatggcgtgtacctcctaaacaagaatatcgcccagctccgctaccagcacggcctgggcactccggacctcaggcagaccctgcctaatctgaagaacttcatggagcatggtctaatggtgcgctgcgacagacatcacacctcctctgccattccagttcctaaaagacagagctccatctttggaggtgcagatgttggctttagcggcggaatcccatctcccgacaagggacaccgaaaaagggcgtcttccgaaaacgagaggttacaatacaagacacccccgcctagctacaatagtgccctcgcccagcctgtcaccaccgtgccctctatgggagagacggagcgcaaaatcaccagtctcagttcctcactcgacacttcgttggatttttccaaggaaaacaaaaaaaagggcgaagacttagtagggtccctcaatggcggccatgccaatgtacatccaagtcaggaacaaggagaagctctcagcggacaccgcgctacggtgaacggaaccttattacctagtgagcaagccggatctgcttccgtccagctgccgggcgaatttcacccggtcagcgaagctgaactctgttgtacagtggagcaggctgaggaaatcatcggtctcgaggcaacggggtttgcaagcggtgaccagttggaagccttcaattgcattccagtggacagcgctgtggccgtggaatgtgatgagcaggtcctgggcgaattcgaggagtttagccggagaatatatgccctcaatgaaaacgtgagtagttttcggcggccacgaaggagcagtgataaatag

SEQ ID NO: 140246 - DNA, 4251 bp, Artificial Sequence
  Description of Artificial Sequence: Synthetic coding sequence
atgaagtcgctgaaatccaggctgcggagacaggatgtccctggacctgcctcttcaggggcagccgctgctagtgcccacgcagccgattggaacaagtacgacgaccggttgatgaaagccgccgaacgcggagacgtggagaaagtcacctccattctggccaagaaaggagtgaacccaggaaaactagacgtcgaaggcaggagtgtttttcacgtggtgacatccaagggcaatctcgagtgtttgaatgctatcttaattcatggggtcgatatcacaaccagtgatacggctgggagaaacgccttgcacttggcggccaaatacgggcacgccttatgtctgcagaaactactgcagtacaattgtcccaccgagcacgcagacctgcagggacgcaccgctctgcacgacgcggccatggcagattgcccatctagcattcaactgctttgcgaccacggcgccagcgtcaacgcaaaggacgtcgacggacggaccccgttagtgttagcaacgcagatgtcccggcccactatctgtcagctgctgatcgacaggggggctgatgtgaactcaagggataaacagaaccgcacagctctcatgttaggctgcgagtacggttgccgagatgccgtggaggtcctcatcaagaatggagctgacatcagtctcctcgacgccctggggcatgactcaagttactacgcccgcattggcgacaatctggatattttaacacttcttaagacagctagtgagaacaccaataaggggcgggagttatggaaaaaaggtcctagtctgcagcaaagaaacctgacccatatgcaggatgaggtaaacgtgaagtctcaccaaagagaacaccagaacattcaggacctagagattgagaatgaagatttaaaagaacggctcagaaagattcagcaagaacaacggattttactggacaaggtcaacggtctgcaactccagttaaacgaggaagtaatggtggctgacgacctcgagagcgagcgagaaaagctaaaaagtctgctggcggctaaagaaaagcagcatgaggagtcactgaggacgatagaagccttaaagaatagatttaagtatttcgaatccgatcatctgggttctggaagtcatttctcgaacaggaaggaagacatgctgctgaaacagggtcaaatgtacatggctgattcacagtgcaccagccccggaattccagcgcacatgcagtctcgctctatgctcaggccactggagctttccctgccgtctcagacctcatacagcgagaacgagattcttaaaaaggaactggaagctatgaggacattttgcgaatctgctaagcaagatcggttaaagcttcaaaacgagttggcgcacaaggtggcggagtgtaaggccttggccctcgaatgtgagagagtgaaagaggactctgacgagcagattaaacagctggaagacgctctgaaggacgtgcaaaaacggatgtatgagagcgaaggtaaggtcaagcagatgcagacccactttctcgccttgaaggagcaccttactagcgaagctgcaagcggaaatcacagactgacagaagaactgaaggaccaacttaaggatctgaaggtgaagtacgaaggagcctctgcagaggtgggaaagcttcggaatcagataaaacagaatgaaatgatcgtcgaggaatttaagcgtgatgaaggtaagttgatcgaggaaaataagaggctgcagaaggagctcagtatgtgtgagatggagcgagagaaaaaagggagaaaagtaacagagatggaaggacaggctaaggagttaagcgctaaactggcgctgagcatccctgctgagaaatttgagaacatgaaatcttctctgagtaatgaagttaatgaaaaggctaagaaactcgtggaaatggaaagggaacacgagaaatctttgagcgagatcaggcaactgaaacgggaacttgagaatgtaaaagccaaactggcccagcacgtcaagccagaggagcacgagcaggtgaagtcccgactcgagcagaagagcggggaacttgggaaaaagatcaccgaactgaccttaaagaaccagaccctgcagaaggagatcgaaaaagtttacttggataacaagctactcaaagaacaggcgcacaaccttactatagaaatgaaaaatcattatgtccctctgaaggtgagtgaggatatgaaaaagagccacgacgccatcattgatgatctgaatagaaagctactggatgtgacccagaaatacaccgagaaaaagctggagatggagaagctcctgctcgaaaacgatagtctgtctaaggatgtgtctagattggaaacagtgttcgtgccccccgagaaacacgagaaggaaatcatcgcgctcaaaagcaacattgtggagctgaaaaaacagctcagcgaactgaagaaaaaatgtggagaggatcaggagaaaattcacgccttaactagcgaaaataccaatttgaaaaaaatgatgagtaaccaatacgtacctgtgaagacccatgaggaggttaaaatgaccctgaatgatacacttgccaaaaccaaccgcgaattgctggacgttaaaaagaaatttgaagatattaaccaggagttcgtaaagatcaaggataagaatgaaatcctgaaacggaaccttgagaatactcagaatcagatcaaggctgaatacatctcactggcagaacatgaagctaagatgtcctctctgtcacagtctatgagaaaggtccaggactctaatgcagaaatccttgcgaattataggaagggccaggaggagattgtgaccctgcatgcagaaataaaagctcagaaaaaagagttggatacgatccaggagtgtatcaaagtgaagtatgctcccattgtctcatttgaagagtgcgagcggaaatttaaggctacagaaaaggaattgaaagaccaactttcagagcagacgcaaaaatactctgtgagcgaagaagaagttaaaaagaacaaacaggaaaacgacaagctgaaaaaggaaatatttacattacaaaaggatctccgggacaagacagtcttaattgaaaagtcccatgagatggaaagagctcttagccggaaaactgatgagcttaacaagcagctcaaggacctgtcccagaaatatacggaagttaaaaacgtgaaggagaagctggtcgaggagaacgccaagcagacctcagagatacttgccgtccagaacctgcttcagaagcagcacgtcccattggagcaggtcgaggctctgaagaagagtctaaacggcactatcgagaatttgaaggaggagcttaagtctatgcaacgatgttatgagaaggagcaacaaaccgtgacaaagcttcatcagctgctggaaaatcagaagaattcttccgtcccactggcggaacatttgcagattaaagaagccttcgagaaggaagttggaatcatcaaggcttcgcttagggaaaaggaggaggaatctcagaacaagatggaggaagttagcaagttgcaaagcgaggttcagaataccaagcaagctctgaaaaagctggagacacgagaggtcgttgatcttagcaagtacaaagccaccaagtctgaccttgagactcagatcagttctctgaacgaaaagctggccaatctgaaccggaaatatgaagaagtgtgtgaagaggtcttgcatgccaagaaaaaggagatctctgcaaaggatgagaaagaattactccactttagcattgaacaggaaatcaaggatcagaaggagcgttgtgacaagtccctgacgactattacagagctgcagcggcggatccaggaaagcgccaagcagatcgaggctaaggataacaagataaccgagctgcttaacgacgtggagagactcaagcaggctctcaacgggctgagtcaacttacatacacatctgggaatcccacgaaaaggcagagccagctgatcgatacactgcagcatcaagtgaaatccctcgaacagcaactggccgatgctgatcgccagcaccaggaagtgatcgccatttaccgcactcatctgttgagcgccgcccagggacatatggacgaggacgtgcaggaggcactgctgcaaattattcaaatgcgccagggccttgtgtgttag

SEQ ID NO: 140247 - DNA, 4212 bp, Artificial Sequence
  Description of Artificial Sequence: Synthetic coding sequence
atgatgaattgctggttttcttgcaccccaaaaaatcgtcatgcggcggactggaacaagtacgacgatagactgatgaaggcggccgagcgaggggacgtcgagaaagtgacatccatccttgctaagaaaggagtgaatccaggtaaacttgatgtggagggccgaagcgtttttcacgttgtgacatccaaaggaaacctcgagtgtctgaacgcgattctcattcacggggtggacatcactacatctgacacagctggcaggaatgctctgcacttagctgcaaaatacggacatgcactgtgcctacagaagctacttcagtacaactgccctaccgagcacgccgacctccaaggacgaacagctcttcacgacgcagccatggccgactgtccctccagtatacaactgttatgcgatcatggcgccagcgtgaacgctaaggacgtggatggtagaacaccgctcgtgttagcaacacagatgtcccgacccacgatttgtcaactactcatcgaccgaggcgcagatgtcaatagccgcgataagcagaacaggacggcacttatgctcggctgcgagtatggctgtcgagacgcagtggaggtgctgatcaagaacggcgcggatatctccttgctggacgctctggggcacgattccagttactacgctcgcatcggtgacaatctggacatcctgacccttctgaaaactgcctcagaaaacacgaacaaggggagggagctgtggaagaaagggccttccttacagcagaggaatctcacccatatgcaggacgaagtgaacgttaaatctcaccagcgggaacatcagaacattcaggatttagagattgaaaacgaggatctcaaggaaagattgaggaagatccagcaggaacagcggatcctcctggataaggtgaacggtttgcagctgcagttgaatgaggaggtgatggtagccgacgatctggagtccgagcgggaaaagcttaaatctctgctggctgctaaagaaaagcagcatgaggagtcattgcgaacaatagaagctctaaagaatcggttcaaatatttcgagtcagaccatctgggctccggctcacactttagcaatagaaaagaggatatgctcttgaagcaggggcagatgtacatggctgattctcagtgtacctctccgggcatacctgcgcacatgcagtcacgcagcatgcttaggccgctggagctaagcctaccctcccagaccagctactctgaaaatgaaatcctgaaaaaggaactcgaagctatgcgtacattttgcgagagtgcgaagcaagaccgcctgaagcttcagaatgagcttgcacacaaggtcgctgagtgcaaggctttagccctcgagtgcgagcgcgtcaaggaagactcagacgagcagattaagcagctggaagatgcactcaaagacgtccagaagagaatgtatgaatctgaaggcaaggtgaaacagatgcagacacacttcttggcgttgaaagagcacctgacatcagaggccgcctcaggtaatcacagattaacggaggaactcaaagaccagttaaaggatctgaaggtgaaatatgaaggcgccagtgcagaagtgggcaagctgcgcaaccaaataaaacagaatgaaatgatcgtggaggaattcaaaagagatgagggtaagctgattgaggagaataagcgactgcagaaggagctatctatgtgcgaaatggaaagagagaagaaaggccggaaggttaccgaaatggaaggccaggcaaaggagctttcagccaagctcgccctcagcatacccgcagaaaagtttgagaacatgaaatccagccttagcaacgaggtaaatgagaaagctaagaaactggtggaaatggaaagagagcatgagaagtcactgtcagaaatccggcagctgaagcgcgaacttgaaaacgttaaggctaaattggcccagcacgtgaagcccgaagaacacgagcaggtcaagagtaggcttgaacagaagtcaggagaattgggaaaaaaaattacggagctgactctcaagaatcagaccctgcagaaggagatcgagaaggtatatttggacaacaaactgctcaaagagcaagcgcacaatctcacaattgaaatgaagaatcactatgtgcctctgaaggtaagcgaggacatgaagaagtcacatgacgctatcatagatgacttaaaccgaaagctgctggacgtgacacagaaatataccgagaaaaaactcgaaatggagaagttacttcttgagaatgactccctctctaaagatgtgagccgactggaaacagtgttcgtcccccctgaaaaacacgagaaggagatcatcgccctcaagtctaacatcgtggaactgaaaaagcagctttcagaactgaagaaaaagtgcggggaagatcaagaaaaaattcacgctctgactagcgagaatactaaccttaaaaagatgatgtccaaccagtacgtgccagttaagactcacgaagaggtgaagatgaccttaaacgacactttagccaaaacaaatcgggagcttttggacgtgaaaaaaaagtttgaggacatcaaccaggaatttgtgaaaattaaagacaaaaacgaaattttgaagcgcaatctggaaaatacacagaatcagatcaaggcagaatatataagcctggccgagcatgaggctaagatgtcgagtctgtctcagtccatgagaaaggtgcaggactcaaatgccgagattttggccaattaccgaaagggccaagaggagattgtgactctgcatgccgagatcaaagcccagaaaaaagagctggatacgatccaagaatgcatcaaagttaaatatgcgccgatcgtctcctttgaggagtgtgaacggaaattcaaggctaccgaaaaggagctcaaagatcaactgtctgagcagacgcaaaaatactctgttagcgaagaggaagttaagaagaataagcaggaaaacgacaagctcaaaaaggagatcttcacgctgcagaaagacttgcgcgataagacagtccttatcgagaagagccacgagatggagcgggcactttcacgcaagaccgacgagcttaacaagcagcttaaggatctgagtcaaaagtataccgaagtaaaaaatgtcaaggaaaaactggtcgaggagaacgctaaacagacttccgaaattcttgcagtacaaaacctgctgcagaagcaacatgtgcccctggaacaggtcgaagctctcaagaagagcctgaacgggacaatcgaaaatcttaaagaagaactgaaaagcatgcagcgatgttacgagaaggagcagcagaccgtcacaaagttacaccaactcctggagaaccagaagaattcatccgtccctctggcggagcacctccagatcaaggaagcgttcgagaaggaggtgggtatcattaaagcctccctgcgagagaaagaagaggagtcccaaaacaaaatggaggaggtttctaaactgcagagtgaggtgcagaataccaagcaggccctgaagaagttggagacacgagaagtggttgacttgtctaaatacaaagccaccaagagcgacctggagacacaaatttcatccctcaatgaaaaactggctaatttgaatcggaagtacgaagaagtttgcgaagaagtgctacacgctaaaaaaaaagagatctctgccaaggacgagaaggagcttttacatttttctatcgagcaggagatcaaagaccagaaagagcgctgcgataagtctcttactactatcacagagcttcaacgcaggatccaagagagtgcgaaacagatcgaggcaaaagacaacaagattaccgaactcctgaatgacgtcgagcggcttaagcaggccctgaacggactgtcccagctcacgtatacctcagggaaccctaccaagcggcaaagccagctgattgatacacttcagcatcaggtgaaaagcctggaacagcagttggccgacgctgaccggcaacatcaggaggttattgctatttatagaactcacctgttgtctgctgctcagggccacatggacgaggacgtgcaggaggccttgctgcaaataatacagatgcgtcaggggctggtttgctag

SEQ ID NO: 140248 - DNA, 1686 bp, Artificial Sequence
  Description of Artificial Sequence: Synthetic coding sequence
atgatgaactgctggttcagctgtaccccgaaaaacagacatgccgcggactggaataagtacgacgacagactaatgaaagcagccgagcggggggatgtcgagaaggtgacaagcattctggctaaaaaaggagtgaaccccgggaagctggatgtggaggggcgtagcgtttttcacgtcgtgacttcaaagggtaacctcgaatgcctgaacgcaatcttgatccacggtgttgatataacgacctccgatactgcaggcagaaacgccctgcatttggcagcgaaatatgggcatgcactttgtctgcagaaactgctccagtataattgccctaccgagcacgccgacctccagggtcgaactgccctccatgatgcagccatggcagactgcccttcaagcattcagttgctctgcgaccatggggcctccgtgaacgcgaaggacgtagatggccgaacacctctggtcctcgcgacacagatgtcccggcccacaatatgtcagctgctaatcgatagaggagccgacgtaaattccagggacaaacagaatcggacggctctgatgttgggatgcgaatacggctgtcgagatgctgtcgaggtgctcataaaaaacggagccgacatcagtctgctagatgccttgggccacgacagcagttattacgcccgaataggagacaacctggacatcctcactctgcttaagactgcgtccgaaaacacaaacaagggtagggaactctggaaaaaagggccttctctgcagcagaggaatctgacccacatgcaggatgaagtgaacgtgaagtcccatcaacgcgagcaccaaaacatacaggacctggagatagagaatgaagatcttaaagagcgattgcgcaaaattcagcaggaacagcgcatcctgctggacaaggtcaacgggctgcagcttcagctgaatgagcgggaaaagctgaagagcctgctagcagccaaagagaaacaacacgaggaaagcctgcgaactattgaggccctcaagaaccgattcaaatactttgaatcagaccacttagggtccggatcacacttcagtaatcgcaaagaggatatgcttttaaagcagggccaaatgtatatggcggactcccaatgcacgagcccgggcattccagcacatatgcagagcagatctatgttaaggcctcttgagctcagcttgccaagccagacctcttacagcgaaaacgagatcctaaagaaagagctggaggcaatgcgcaccttctgcgagtccgccaaacaagataggctcaaactccagaatgaactggcccacaaggttgccgagtgcaaggcgctggccctggaatgtgagagagtgaaggaagacagtgatgagcagattaagcagctcgaagacgctctgaaggatgtgcagaagagaatgtacgaaagcgaagggaaggtcaagcagatgcagacccattttctggcactgaaggagcacctgacaagcgaagccgctagcggcaatcaccgccttactgaggagttgaaagatcaactgaaagacctaaaagtaaagtacgagggcgcatcggcggaagtcgggaagttgaggaaccagattaaacagaatgagatgattgtggaagagtttaagcgagacgagggcaagttgatctag

SEQ ID NO: 140249 - DNA, 4206 bp, Artificial Sequence
  Description of Artificial Sequence: Synthetic coding sequence
atgatgaactgctggttctcttgcacaccgaagaacaggcacgcggctgactggaacaagtatgacgatcgcttgatgaaggccgcagagcgcggtgacgtggagaaggtgaccagcatcttggccaagaagggagtgaatccagggaagctcgatgtagaaggcagatcagtattccacgtggtaacatccaagggaaatctcgaatgcttgaatgccatactgatccatggtgtggacataactaccagcgacacagccggcagaaatgcactgcacttggctgcgaaatacggacacgctctgtgcctgcaaaaactcttgcagtataactgccccactgaacacgctgatctacaggggcggaccgccttacatgatgctgcaatggctgactgcccctctagcatccaactcctgtgcgatcatggcgctagcgttaacgccaaggacgtggacggccggacaccgttggtcttggccacacagatgtctagacctacgatctgtcagctgctgattgataggggtgcggatgtcaattctagagataagcagaatcggactgccctgatgctcggctgcgaatatggctgtcgcgatgccgtagaagtgctcataaaaaacggggcggacatctctttactcgacgcattgggccatgactcttcctattatgcacgaattggcgataacctagatatcttgacgttgctgaaaacagcttctgagaacacaaataaggggcgcgagctgtggaagaaaggtccatctttgcaacagaggaatctgactcatatgcaggacgaggtcaacgtgaaaagtcatcagagagaacaccaaaacatccaggatctcgagattgaaaatgaagatcttaaagagcgcttgcggaagatccagcaagagcagagaattcttctggataaagtgaacggcctccagcttcagctgaacgaggaagttatggtcgccgacgacctggagagcgaaagggagaagctgaaaagcttgctggccgcaaaggagaagcagcacgaggagtcactcaggacaattgaggcactcaagaatcggttcaaatacttcgagtccgaccacctggggtcaggttctcacttcaggaaggaagatatgttgctgaaacagggtcaaatgtatatggctgactcccagtgcacgagtccaggtataccagctcacatgcagagtaggtcaatgttgagaccattggaactttctctgccctcccagacgtcatatagcgagaacgagatcttgaagaaggagcttgaggccatgagaaccttttgcgaatcggccaaacaagatagacttaaattgcagaacgaactagcacacaaagtggcagagtgcaaagctctcgctctagagtgtgaacgcgttaaggaggactctgatgagcagattaagcaattggaggatgcacttaaggacgttcagaagaggatgtacgaatcagaagggaaggtgaagcaaatgcaaacccacttccttgcactcaaggagcatcttacgagtgaagctgcttccggtaatcacaggctgacagaagaattgaaggatcagctgaaggatctgaaagttaagtatgaaggcgcctccgcagaggtgggcaaattgcggaaccaaataaagcagaacgagatgatcgtggaggagttcaaacgggatgaaggcaaactgatcgaagaaaacaaaagactgcagaaggaactctccatgtgtgaaatggaaagggagaaaaagggcaggaaggtaactgaaatggagggtcaggctaaggaactgagtgccaaactggcactgtcgatccctgctgaaaagttcgaaaacatgaaaagctcactctctaatgaggtgaatgaaaaagccaaaaagctcgtggaaatggagcgtgagcatgaaaaatcactgtctgagatcagacagttgaagcgtgaactggagaatgtcaaggccaagctcgcacagcatgtgaaacctgaggaacatgaacaggtgaagtcgcggttggagcagaaatctggagagctcggaaagaaaattacagaactcaccctgaagaaccagacacttcagaaggaaatcgagaaggtgtatcttgataacaaattacttaaggagcaggctcataacttaactatcgagatgaagaatcattatgtacccctgaaggtgagtgaggacatgaaaaaatcccacgatgctataatcgacgacctcaatcgcaagctccttgacgtcactcagaaatataccgagaaaaaactcgagatggagaagctgttgctggagaacgattcactgtcaaaagatgtctcacgcctagagactgtcttcgtccctccggagaaacacgaaaaagagataatcgcactgaaaagtaacatcgtagagctcaagaagcaattatctgaactgaaaaagaagtgtggcgaagatcaggagaaaatccacgcgctaacctctgaaaacaccaacctgaaaaagatgatgagcaaccagtacgttcccgtgaagacccacgaagaggtgaaaatgacgttgaatgatacactcgcaaaaacgaatagggaattgctggacgtcaagaagaaatttgaagacattaaccaagagttcgtgaaaatcaaggacaagaatgaaatccttaagagaaatctcgagaacacccagaaccagatcaaagcagaatacattagcctggctgagcacgaggcaaagatgagcagcctaagccaatccatgcgcaaggtgcaggacagtaatgccgaaattttggctaactaccgaaaagggcaggaggagattgtgaccttacatgcagagattaaagctcaaaaaaaggagctggacaccatccaggaatgcatcaaagtcaagtacgctccaatagtttccttcgaagaatgtgagaggaaattcaaggctaccgagaaggagctgaaggaccagctgtcagagcagacgcagaagtattccgtttccgaggaggaagtgaagaagaacaaacaggaaaatgacaagctcaaaaaggagatctttacgttgcagaaggacctccgagacaagacggtcctgattgagaagagtcacgagatggagcgcgccctctctaggaagactgacgagctaaataagcagctcaaggacttgtcccaaaagtatacagaggtcaagaacgtgaaagagaaacttgtagaggaaaacgctaagcagaccagtgagatcttggccgttcaaaatctattacagaagcagcatgtccctttagaacaggtggaagctctaaaaaagtccctcaacggcaccatcgaaaatctcaaagaggagctcaaatcaatgcagcggtgttacgaaaaggaacagcaaacagtgaccaaactgcatcagcttctggagaaccaaaaaaacagttctgtgccactggccgagcatctccagattaaggaagccttcgaaaaagaggttgggatcatcaaagcctcactgcgagaaaaagaagaagaatcacagaataaaatggaggaggtttccaagctacagtctgaggtgcagaatactaaacaggcgctgaagaaacttgagactcgggaggtggtggacctcagtaaatataaagctaccaagagcgacctcgagacccagatctcttccctcaacgagaagctggcaaacttgaatcggaagtatgaggaggtgtgtgaggaggtgttgcacgctaaaaagaaagaaatcagcgcaaaggatgagaaagaactcctgcacttcagtatcgaacaggagatcaaggaccagaaagagcgctgcgacaagagccttaccacgataacggagcttcaaaggcggattcaggaatccgccaagcaaattgaggctaaggataataagataacggagttgctgaatgatgtggagagactgaaacaggctcttaatgggctgagtcaactgacttacacctctggaaaccctactaagaggcagtcgcagctgattgataccttgcagcatcaggtgaaaagcctcgaacagcaattggccgacgcggaccgccaacaccaagaggtgatcgctatctatcgtacccaccttctctctgccgcccagggccatatggatgaagacgtgcaggaagcattgctgcaaataattcaaatgcggcaggggctggtctgctag

SEQ ID NO: 140250 - DNA, 3195 bp, Artificial Sequence
  Description of Artificial Sequence: Synthetic coding sequence
atggtgctgggcacagtgctgctaccaccaaatagctacgggagagaccaggacacgagtctgtgctgtctgtgtactgaagcctccgaatcagccctcccagacttgactgatcacttcgcatcttgtgtcgaggatgggtttgagggggataagaccggaggcagtagccctgaggcactgcacagaccctatggctgcgacgtggaacctcaggccctgaacgaagcaataagatggagctctaaggaaaatctgctgggagcaaccgaaagcgacccaaatctgtttgtggcactgtatgactttgtcgcttctggagacaatactctttccatcacaaagggtgagaaactgcgagttcttggatacaaccagaatggagaatggtccgaagtacggagcaaaaacggacagggttgggttcctagtaattatataactcccgtgaactcccttgagaagcattcctggtaccacggcccagtctcaaggtccgctgccgaatacctgctgagctccttaatcaatgggtcctttctggtgagggaatctgaatctagtccaggtcaacttagcatttcactacgatatgagggtcgggtgtatcattatagaattaacacgaccgccgatggcaaggtctacgtcacggcggagtccagattctctacgttagcagaactagtgcaccaccacagcactgtggctgatggcctggtgacaaccctgcattacccggctcctaagtgcaataagcctaccgtatatggagtgtcccccatccacgacaagtgggaaatggagcgtacagacatcacgatgaaacataagctggggggcggtcagtacggggaagtgtacgtgggagtgtggaagaaatacagcctcactgtcgcagtgaagaccctgaaagaggatacaatggaggtagaagaatttctcaaggaggcagctgtgatgaaggaaataaagcaccccaacttggttcaactgttaggtgtgtgcacgctcgagccccctttctatatcgtaacggaatacatgccgtacggtaacctcctggactacctccgagagtgtaacagggaggaagttacagccgtggtgttattgtacatggcgacgcagatcagttccgcgatggagtacttagaaaaaaaaaattttatccacagggatcttgccgcccgaaattgtctggtgggtgaaaatcatgtcgtgaaggtggccgacttcggcctgtctcgcctcatgacaggcgacacttacaccgcccatgctggtgccaagttcccaatcaagtggaccgccccggagagtcttgcatataacactttttctattaagtccgacgtttgggccttcggagtactcctctgggagatagccacttatggaatgtctccctaccccggaatcgatttaagtcaggtttacgacctgttagagaaggggtatcgcatggaacaacctgaaggctgcccccctaaggtgtatgagctgatgcgggcatgttggaagtggtctccagctgatcggccttcattcgccgagacccaccaggcgtttgaaaccatgtttcacgattcatcaatctctgaagaggtcgcagaggaattggggcgcgctgcctcctcatctagcgtagtcccctatctgccccgcctgccgatcctcccttcaaaaactcgtacccttaaaaaacaggtggagaacaaggagaacattgaaggtgcgcaggacgcaacagaaaattcagcctcctcactggctcctggttttatcagaggtgctcaggcctcctctggatcccctgcactcccacgaaaacagcgagacaaaagccctagttcactcctcgaggacgctaaagagacctgctttacaagggacaggaagggggggttcttttcatcatttatgaagaagcgtaatgctccaactcctccgaagcggtcttccagctttcgggaaatggagaatcagccacataagaagtatgaactgaccggcctgcccgagcaggatcgcatggccatgaccttgcccagaaactgtcagaggtcaaagctccagctggagagaactgtgtcaacctctagccaacccgaagagaatgttgatcgggccaatgacatgctccccaaaaagtctgaagagagtgctgctccgtctcgcgagaggcccaaagctaagctgctcccccgtggagcaacagccctcccactacggaccccgtccggcgacctggccattactgagaaagatccaccaggagttggggttgcgggcgtggcagccgcacccaaaggcaaagagaaaaatggaggagcacgcttgggtatggctggagtgcctgaggatggggaacagcctggctggccatcccctgccaaagccgctcccgtcctgcccacaacacacaaccacaaggtgcccgtgcttatctcacccactctcaaacacacaccagctgatgtgcagctcatcggcacggattctcagggtaacaaattcaagttactctcggagcatcaggtcacttcgtctggcgacaaggaccgcccaaggagggtgaagcctaaatgtgcccctccccctccaccagtgatgagactcttgcagcatccctctatctgctccgacccgaccgaggaacccactgcactgaccgcaggccagtccacaagcgagactcaggaggggggaaaaaaggctgccctgggcgccgtgcctatatctggcaaagcaggtaggccagtcatgcctccccctcaggtgcccctgcccacctcctcaataagtcctgccaagatggccaatgggaccgctggtactaaggtcgcgctcagaaagacaaagcaggcagccgaaaaaatatcggctgataaaatctccaaggaggccctgctcgaatgcgctgatcttctttcttctgcacttacagagccagtccctaacagccaactagtggacacagggcaccagcttctggactattgttccggctacgtggactgcatcccccagacacgtaataagtttgcattccgcgaggctgtcagtaaattagagctttctttgcaggaacttcaagttagttcagcggccgcaggggtgccgggaaccaatccagtgttaaacaatctgctgtcttgtgtgcaggagatcagcgatgtggtccaaaggtag

SEQ ID NO: 140251 - DNA, 1629 bp, Artificial Sequence
  Description of Artificial Sequence: Synthetic coding sequence
atggggcagcaggtcggccgggtaggggaggcacccggccttcagcagccccagcctagaggcattcgcgggagcagcgcggcccgtccgagcggccgaagaagggatcccgcgggcagaactacagaaacaggctttaatatcttcacccaacacgaggcactccatcggccttatggctgcgacgtcgaaccccaagccttgaatgaggccattcgttggagtagcaaagaaaacctgttgggcgcgactgagagcgatccgaacctgttcgtcgctctctacgacttcgtggcctccggagacaacaccctgtccatcacaaagggtgagaaacttcgagtgctgggttacaatcagaatggggagtggtccgaagtccgaagcaagaacggtcagggttgggtgcctagtaattatatcacacctgtgaacagccttgagaagcactcttggtaccatgggcccgttagtcgatctgccgctgaatacctgcttagttccctgataaacggctcctttctagtgagagagtccgaatcttctcccggtcagctgagtatcagcttgcgctacgagggtagggtctaccattaccgcatcaatacaaccgcagatggtaaggtgtacgtgaccgccgaatcgagatttagtacactggcagagctcgttcaccatcacagcaccgtcgccgacggcctcgtgacgactctgcattaccctgcacccaaatgcaataaaccaactgtgtatggcgtcagtccaatacacgataaatgggaaatggagagaactgacatcacaatgaagcacaagctggggggggggcagtacggagaagtatacgtgggagtctggaagaaatactccctgacagtggccgttaagactttgaaagaagataccatggaggtcgaggagtttctcaaggaagcggcagtcatgaaggaaatcaagcaccctaacctggtgcaactgttgggtgtgtgcactctggaaccccctttctatattgttaccgagtacatgccatacggcaacttactggattacctgagggaatgcaacagggaagaggtaacggctgttgttctgctctatatggctacccagatatcaagtgctatggagtatctcgagaaaaagaactttatccacagagacctggcagctcgtaattgcctcgtaggcgagaaccatgtcgtgaaggtcgctgactttggcctgagccggctcatgaccggtgatacctataccgcccatgccggggccaagtttccaataaagtggactgcacccgagagtctcgcctataacaccttctctatcaagagcgacgtgtgggccttcggtgtgctactgtgggaaatagccacatacgggatgtccccctaccctggcatcgatctgtcccaggtgtacgatctgttggaaaagggctaccggatggagcagccggagggatgtccccctaaggtctacgagttaatgagggcctgttggaaatggtcccccgccgacaggccaagctttgccgagacccatcaggccttcgaaactatgtttcatgacagttctattagtgaagtgttgctgcactgtgcaaaccagacctgtattaccctttag

SEQ ID NO: 140252 - DNA, 3441 bp, Artificial Sequence
  Description of Artificial Sequence: Synthetic coding sequence
atggtgttgggcaccgttttgttgccaccaaactcatacggcagagatcaagacactagcctgtgctgcctgtgcacggaagcttccgaatctgcactgcccgacctgacagaagctctgcaccgaccctacggctgcgatgtggagccccaggcactgaacgaggccattagatggtctagtaaggagaatttgctgggggcaaccgaatcggatccaaacctgtttgtcgcattatacgatttcgtggccagcggggacaatactctgagcattactaagggcgagaagctcagagtattgggctataatcaaaatggtgaatggagtgaagtccggagtaagaatggacaggggtgggtgccatctaattatattactcctgtgaacagcctagagaagcactcttggtaccacggccctgtgtcgcgtagcgccgccgagtatctgctgagcagcctcatcaacggttccttcctcgtgcgcgaatctgagtcgtctcccgggcagttaagcatctcgcttcgctatgagggccgggtctaccattaccgcataaacactacggcggacggcaaagtctatgtgacagccgagtcccggttcagtaccctagccgagctggtgcaccaccacagcaccgtggccgacgggctcgtgacaacgttgcattaccctgcccccaaatgcaataagcctacagtctacggggtttctccgatccacgataaatgggagatggaaagaacagacattaccatgaagcataaacttggagggggacagtatggagaagtatacgtcggagtttggaaaaagtactcactgacggtggccgttaaaaccttgaaagaagacaccatggaggttgaggagttcctcaaggaggcggccgtcatgaaagagataaaacatcccaatctggtccagctgctgggagtttgcacgctcgaaccccctttctacatagttacagagtatatgccatacggaaatctgttagactacctgcgcgaatgcaacagggaggaagttaccgccgtcgtcctcctgtatatggccacccaaatatcaagcgcaatggagtatttggaaaaaaagaacttcatccatagagatctagcagcacggaactgtctagtgggcgagaaccatgtggttaaagttgccgactttggcctctcccggcttatgaccggggacacatatacagctcatgccggcgccaagtttcccatcaagtggaccgctcccgaatccttggcatacaacacattctcaatcaagagtgatgtctgggcattcggagtgctgttgtgggagatcgcgacgtacggcatgtcaccctacccaggtatcgacctgtctcaggtatacgatctcctggagaaggggtacaggatggagcagccagagggctgcccacccaaagtttacgaactgatgagagcctgttggaaatggagtcctgccgacaggcctagcttcgctgaaactcaccaggcctttgaaaccatgttccatgattcgtccatcagtgaagaggtggccgaggagttgggccgagcagccagctccagctccgtggtcccatatctcccacgcctgcccatactgccaagcaagacacgcaccctgaaaaagcaagtcgaaaacaaggaaaatatcgaaggtgcccaggatgccaccgaaaatagcgctagtagcttggcacccggctttattcgtggggcgcaggcatctagcggctctcccgccctgcctagaaagcagcgtgacaagtctccctctagcctgttggaagacgcaaaagaaacctgctttacaagagatcgaaaaggcggttttttcagctcattcatgaagaaacgaaacgcccccaccccaccaaagcggagttcatcatttcgcgagatggaaaaccaaccacataaaaaatatgagctgactgggaacttcagctctgttgcatctctacaacacgctgatggttttagttttacccctgcccagcaggaggcgaaccttgtcccccctaagtgctatggaggctccttcgctcaaagaaatctatgcaacgacgacgggggcgggggcggtggtagcggaactgctggcgggggatggagcggaatcactggctttttcacacctcgtctgataaagaaaacacttgggctgagagcagggaagcccactgcgtccgatgatacatccaagccatttcctagatcaaacagtacatcttcgatgagtagtggacttcctgagcaggaccgaatggccatgaccctgccgcgcaactgccagagaagtaagctgcaactagaaaggacagtcagcacatcctctcagcccgaagagaacgtggatagagccaacgatatgctcccaaagaagtccgaagaaagtgccgcaccctctcgggagcggcctaaagcaaaacttcttccaaggggcgcaacggctctgccattgaggactccatctggggacctggctattactgaaaaggacccgcctggggtgggcgtggctggcgtggctgccgcgccaaaggggaaagagaaaaacggcggggcaagactgggcatggctggagtgcctgaggacggagagcaacccgggtggccttctcctgccaaagccgcccctgtgttgccaacgacccacaaccataaggtacctgttctgatctccccaacgcttaaacatactccagctgatgtccagttaatcgggactgacagccagggaaataaattcaaactgctgagcgagcaccaggtgacatcatctggggacaaagatagaccacggcgggtaaagcctaagtgtgcaccaccccctccacctgtaatgagactgttacaacatccatcgatctgttccgatcccacagaagagccaacagccctgacagctggccagtccacttccgagacacaggagggggggaaaaaggctgcactcggtgccgtccctatcagtggtaaagcaggacggcctgtgatgccacccccacaggtccctcttcccacatcttcaatttcccctgctaagatggccaatggcaccgccggtaccaaggtggctctgcgaaaaaccaagcaagccgcagaaaagatctcggccgacaaaatcagcaaggaagccctgttggaatgtgccgacctgttgagctcagctttgacggagccagttcccaattcccaattggtggacaccggccaccagttgctggactattgctcgggatatgtggactgtatcccacagacaagaaacaaattcgcctttcgagaggctgtgtccaaactcgagttatccctgcaggaactgcaggtgagcagtgccgccgccggcgtgccaggaaccaatccggtgttgaacaacctactgtcctgcgtccaggagatcagtgatgttgtgcagagatag

SEQ ID NO: 140253 - DNA, 3549 bp, Artificial Sequence
  Description of Artificial Sequence: Synthetic coding sequence
atggggcagcaagtaggccgggtcggcgaggcccccggtctgcaacagccgcagccccgtgggatcagagggagttcggcagcccgaccgagcggacggcgccgcgaccctgccggtcggactaccgagaccggatttaacatttttacgcagcacgaccacttcgcttcctgcgtggaagatggctttgagggtgacaagacaggcgggtcttcacccgaggcgctacaccgcccatatggctgcgatgtcgaaccacaggcattgaacgaggccatccggtggagctctaaggaaaatctcttgggagccaccgaaagtgaccccaatctgttcgttgcactatacgattttgtcgcttctggcgacaacacgttgagcataaccaaaggggagaaactgcgcgtgctaggctataatcagaacggagagtggtctgaggtgcgctctaaaaatggacaggggtgggtcccctcaaactatatcacacctgtcaactccttggaaaaacatagctggtatcatggtccagtgagtcgctccgcagctgaatatctactaagttcactgataaatggaagtttcttggtgcgtgaatctgagtctagcccaggtcagttaagtatttcccttagatatgagggcagagtgtaccattacagaataaatacaacagccgatgggaaggtgtacgtcacagcagaatcacgcttttcgaccctagccgagctggtgcaccatcacagcaccgtcgccgacggacttgtaaccactttgcactacccggccccaaaatgcaacaaacctacagtatatggcgtttctcctattcatgataaatgggaaatggagagaactgatataaccatgaagcacaaactgggagggggtcagtacggagaggtatacgtcggcgtatggaagaagtattccctgactgtcgccgtcaaaaccctgaaagaagataccatggaggtggaagaatttctgaaggaagctgcagtaatgaaggagatcaaacacccgaatctggtccagcttctgggtgtatgcacattagagcctcccttctacatcgttactgagtacatgccatatggtaacctattagactatctcagggagtgcaacagggaggaggtgacagcagtcgtactgctgtacatggctacccaaatctccagcgcaatggaatatctggaaaaaaagaactttatacaccgggacctcgcagccaggaactgtctagtgggtgagaaccacgtggtcaaggtcgccgatttcggtctgtcgagactaatgaccggggacacatataccgcacatgcgggggccaaattccctattaagtggaccgccccagagtctctggcttacaacactttctcaataaagagcgatgtgtgggctttcggcgtcctgctgtgggaaattgcaacatatggcatgtctccttaccccggaattgatctgtcccaggtgtatgatttattggagaaggggtacagaatggagcagccagaggggtgccctcctaaagtgtatgagttgatgcgggcttgctggaagtggtcgcctgccgatcgcccttcattcgcagagacacatcaagcattcgaaaccatgttccatgatagctctatctctgaggaggtggccgaggagctcggccgtgcagcctccagctccagtgtggttccatacttgcctaggctgccaattttgccttccaaaacaagaacgttgaaaaaacaggtcgaaaacaaggagaatatcgagggcgctcaagatgccacggagaatagcgcatcatccctggccccgggttttattaggggggcccaagccagtagcggctctccagcactcccacggaagcagcgggataaatcaccctccagtttactggaggacgccaaggaaacttgctttaccagggatcgcaagggtgggtttttctcaagtttcatgaaaaaaaggaatgccccaaccccgcccaagcgttctagctcgttcagagagatggaaaaccaacctcataagaagtacgaactcactggcaatttttcgagcgtggcaagccttcagcacgctgacggcttcagctttactcctgcacagcaggaagctaacttagtcccacctaagtgttacggcggtagtttcgcacaaagaaacttgtgtaacgatgatggcggcggcggtggcgggtcaggaactgccggtggcggatggtcaggcattactggctttttcacgccacggctgataaagaagacgttagggctacgtgcaggcaaacccacagcttcagatgataccagcaagccctttccacgttctaattctacttccagcatgtcatccggcttacccgaacaggatcgcatggcaatgaccctccctcggaattgccagcgctctaaattacagctggaacgcactgttagtaccagctcacaacccgaggaaaatgtggacagagctaatgacatgttgccaaagaaatctgaggaatccgctgcaccgtctagggagagacccaaggctaaattactccccagaggagcaactgctttgcctctcagaacgccttccggggacctggccatcaccgagaaggacccgcccggtgtgggagtcgctggtgtggctgctgccccgaaagggaaggagaagaatggcggggctagactgggcatggccggagtgcccgaagatggcgaacagccaggttggccttcccccgccaaggctgctcccgtgctgccaactacacacaaccataaagtgccagtcctgatatcccccactttaaaacacactcctgcagacgtgcagctgatagggactgattcccagggaaataaattcaaactgctgtccgagcaccaggtcaccagttcaggcgacaaggaccgtccaagacgggtcaaacctaagtgtgccccacccccaccccccgtaatgagattgcttcagcacccctcaatctgtagcgatccgaccgaagagccgacggccttgactgctggccaaagtacttcagaaacccaggaaggaggtaaaaaagccgcactgggtgctgtacctatcagcgggaaagccggacgccccgtaatgccacctcctcaggtgcccttgcctacaagctcaatctctccagccaaaatggctaacggcacagctgggacaaaagtggccctaagaaaaactaagcaggctgctgaaaagattagcgctgataagatctctaaagaggcgttgctcgaatgcgcagatctcctgtctagtgccctgactgagcccgttcctaacagccagcttgtagacacagggcaccagctcctggattattgttccggatacgtggattgtatcccccagactcggaacaagttcgcattcagagaggcagttagtaaattagagctgagcctgcaagagttgcaggtttcgagcgctgctgctggcgtccccgggactaatccagtgctgaataacttgcttagctgtgttcaggagattagcgacgtcgttcaaaggtag

SEQ ID NO: 140254 - DNA, 3132 bp, Artificial Sequence
  Description of Artificial Sequence: Synthetic coding sequence
atggtcctcggtactgtccttctgccgcctaattcatatggaagggaccaggacacaagtctctgttgtttgtgcactgaggcctcagagagtgccctaccagatctaactgaggctctccacagaccgtacggttgtgacgtggagccgcaggcacttaacgaagccataagatggtctagtaaagagaatctgctgggtgccactgaatctgatcccaacctgtttgttgccctctacgacttcgtggcttctggcgacaataccctgtccatcaccaaaggtgagaaactgagagtcctcggctacaatcagaacggcgagtggtctgaggtcaggagtaagaacggccaggggtgggttccttctaactacattactccagttaacagccttgaaaaacacagctggtaccatgggcctgtatctcgctccgctgccgaatatctgctaagcagcctgatcaatggctcattcctggtgcgggaatcagagtcatcccctggacagctctccattagtctgcgatatgagggccgggtctatcattacagaatcaacaccacggctgacggcaaggtatacgtgacggccgaaagcaggttttccaccctggctgaactggtccatcatcattctaccgttgccgatggcctggttaccactctacattatcccgctccaaagtgtaataagcccacagtctacggcgtgtcacccattcacgacaagtgggagatggaacgaaccgatattaccatgaaacacaagctgggggggggccaatatggggaagtgtatgtgggggtgtggaaaaagtactccctgactgtggctgtcaagactctgaaagaagacactatggaagtcgaggagttcctgaaagaagcagccgtgatgaaggagattaaacaccctaatttagtccagttacttggggtctgcaccttagagccccctttctatatcgtgacagagtacatgccgtacggcaatctgctggattacctgagagaatgcaacagggaagaggtgaccgcagttgtgttgctctatatggcgactcaaatcagttcggccatggagtatctcgagaaaaagaatttcatccatcgcgacctcgccgctcgtaattgtctggtaggcgagaaccacgtcgttaaggtcgcggacttcggtctgtccaggcttatgactggcgacacttacactgcccacgccggcgccaaatttcctataaagtggacagcacctgagagtctggcatacaacacattcagcatcaaatccgacgtttgggcctttggcgtcctgctctgggagattgcgacctatggcatgtcaccatacccagggatcgacctcagccaagtatacgatttgctggagaaaggctaccggatggagcagccagagggatgtcctcctaaagtatacgaactgatgcgggcctgctggaaatggagtcctgccgaccggccatccttcgcggaaacccaccaagcttttgaaaccatgtttcatgattcatccatatccgaggaggtcgctgaggaactcggacgggccgcctcttccagctctgtggtgccttatctgccacgtcttcctattctcccttcaaagactcggacactgaaaaagcaggtcgagaataaggagaatattgaaggcgcccaggacgcaacggaaaacagcgcgtcaagcctcgcacccggattcattcggggagctcaggctagctccggatcgcccgctctccctaggaaacaacgagataagagtcccagctctctcctggaagacgccaaggagacctgctttacccgcgatcggaagggaggctttttcagttctttcatgaagaagagaaacgcccccactcctcccaaaaggagctcctcgttccgtgaaatggaaaatcagcctcataagaagtacgagctaacgggactgccagaacaggatagaatggccatgacactgcctaggaattgtcagaggtcaaagttgcagctggagaggaccgttagcacatcctctcaaccagaagagaatgtggatagagctaatgatatgctgcccaagaagtccgaggagtcagctgccccatctcgggaacgtccaaaagccaaattgctaccaaggggcgccacagctctgcctctgagaactccttctggcgatttggccatcaccgagaaggatccgcccggagtgggagtggccggcgtcgccgcagcccccaaggggaaagagaagaacggcggggcacgcctgggtatggccggggtgcccgaggatggggagcagccaggatggcccagccccgcaaaggccgcaccagtcctgcccaccacccacaatcacaaagtgcccgtactgatttccccgaccttaaaacacacccccgcagatgtccaactaattgggaccgattcccaggggaataaatttaaactgctcagtgagcatcaggtcacttccagtggcgacaaggatagaccacgtcgcgtcaagccaaaatgcgctcctccacctcctccagtgatgaggctcctacaacacccctccatttgcagtgatccgaccgaggagccaaccgcgctgacggccggccagtctacctccgagacacaggagggtgggaagaaggccgctttgggcgcagttccgatctccgggaaagccggccggccagtaatgccacctccccaggtgcctctgcccaccagctccatctctcccgcaaagatggccaatggtacagcaggtactaaagtagccttacggaagacgaaacaggcagctgagaagatctctgcagacaaaatttccaaggaggcccttcttgaatgtgctgacctgctgtcgtccgccctgacagagcccgtgccgaactctcagctggtggacaccgggcatcagctgctggattattgctccggctacgtggactgtataccgcagacacgaaacaagttcgcgttccgcgaggcggtgagtaaactggagctgtcactgcaagagctgcaggtctccagcgcggcagcaggcgtgccgggcaccaaccccgttctgaataacctgctctcctgtgtgcaggaaatatctgatgtggttcagagatag

SEQ ID NO: 140255 - DNA, 3504 bp, Artificial Sequence
  Description of Artificial Sequence: Synthetic coding sequence
atggtcctcggcacagtgttgctaccgcccaactcgtatggcagagaccaggacacctccctgtgttgtctgtgtaccgaggcctctgaaagtgccctccccgatctgaccgaccattttgcctcctgcgtggaagacggttttgaaggcgataagacaggggggagcagccccgaagctttacacaggccatacgggtgcgacgtggagccccaagctctgaacgaggccatccgctggtcaagtaaggaaaatctgctgggggcaaccgaatccgaccccaatctgttcgtggccctctatgacttcgtggcatcaggagacaacaccctcagcataaccaagggggaaaagctccgggtgctgggatataaccaaaacggggagtggagcgaggtgcggtctaaaaacgggcagggatgggtgccttccaattatataaccccagtaaattcactagagaagcattcatggtatcacggaccagtctcaagaagcgcggctgagtatctactctcttccctgatcaatgggtcttttcttgtgcgagagtccgagtccagccccgggcagttgagtatttcactcagatacgaaggccgcgtttaccattatcgcattaacaccactgctgatggaaaggtttatgtaacagcggaatctagatttagcacgctggcagagctcgtgcaccaccattccaccgtggcagatggcctggtaactaccctccactaccccgccccgaaatgcaacaaaccaaccgtttatggcgtgtcccctatccacgacaagtgggagatggaaagaacagatatcactatgaagcacaagctcggtggcggccaatacggtgaggtctatgtcggtgtatggaagaaatactccctgacagttgctgtgaaaacccttaaggaggacacaatggaggtcgaagaattcctcaaggaggccgctgtgatgaaggaaatcaagcatcctaaccttgttcagctccttggagtctgcaccctcgagccacctttttatatagtgaccgagtatatgccctacggcaatctgctggactatttacgagaatgtaatcgcgaggaagtcaccgctgttgtgctgctctatatggccacgcagatctcttccgcaatggagtatctcgaaaagaagaactttatccaccgggaccttgcagcccgaaattgccttgtaggagaaaatcacgtcgtgaaggtagccgactttggactatcgcgcttaatgacaggggacacatatactgctcatgctggcgcaaagttccccattaagtggacagctccggagtccctggcgtacaataccttctccataaaaagcgatgtttgggcatttggtgtgctcctctgggagatcgcgacttatgggatgagtccttaccctgggattgacctctcccaggtatacgacctgctcgagaaggggtacagaatggagcagcctgaaggatgccctcctaaggtgtacgaactgatgcgggcctgctggaagtggtcaccagctgaccgtccaagcttcgcagaaacccatcaggcatttgagaccatgttccatgacagcagcatctctgaggaggtggctgaggaactgggacgtgcagccagtagtagttcagtggtcccatacctgccacggttgcccattttgccctcgaagactagaaccttgaagaaacaagtggagaacaaggagaacatagaaggcgctcaggatgctactgaaaattccgcctcctcattggcacctgggtttatccggggtgcacaggcttcatccgggtcccctgccctgccacggaagcagcgcgacaaatccccctcaagtcttctagaggacgctaaggagacttgcttcacacgggaccggaagggaggctttttttcttcttttatgaaaaagcgcaacgctcctacaccgccaaaacgctccagcagctttcgagaaatggaaaatcaaccccataagaagtatgaactcactggaaattttagctccgtggcctctctgcagcacgccgacgggtttagcttcactcccgcacaacaggaagccaatctcgtgccccccaaatgttacggagggagttttgcccagaggaatctctgtaacgatgacgggggtggaggcggcgggagcggcacagctgggggcggctggtccggaataaccggattttttaccccaaggctcatcaaaaagaccctggggcttagggcaggtaaacccacagcgagcgatgacacgtctaagccattcccccgctctaattctacatctagcatgtcctccggactcccagagcaggacagaatggcaatgacactacctaggaattgccagcggtcaaaactgcagctcgagcgtacagtgtccacttcatctcaacccgaggagaacgttgatagagctaatgacatgctcccgaaaaaatctgaggaatctgcggcccctagcagggagcgtccgaaggctaagttgctgccaagaggcgcgaccgcgctgccgctacgcacaccgtctggagatttagcgatcactgagaaggacccccccggtgtcggggtggccggggttgctgctgctcctaagggcaaagagaagaacggaggggcccggcttggaatggcaggagtgcctgaagacggagaacagccgggttggccctcccccgccaaagccgcgccggtgctgcccacaacgcataaccacaaggtccccgtcttaattagccctaccctcaaacacactccggcagatgtgcaattaattggtactgacagccagggtaataagtttaaactcttgagtgaacatcaggtgaccagtagcggcgataaagaccggcctcgcagagttaagcctaaatgcgccccaccccctcctccagtgatgaggctgctacagcatccgtctatctgttcagatcccactgaagaacccactgccttaactgcagggcagtccacctcagagacacaggaaggtggtaagaaagccgcccttggtgcggttcccatttcaggaaaggcaggcagacccgtcatgccaccaccgcaggttcctctgcccacctcctcaatttctccggctaagatggccaacgggaccgctggcactaaggtggccctgagaaaaacaaaacaagccgctgagaagatttctgccgataaaatcagcaaggaggcgttgctggagtgtgctgatctgctgtcctcagccctgaccgagccagtccctaacagtcagctcgttgataccgggcatcagctgctcgattactgctccgggtacgtcgattgcattccccagacgcgaaataagtttgcattccgggaggctgtttccaagctggaactctcgttgcaggagctccaggtgagttcggctgccgcaggggtaccaggtaccaatccggttctgaataacctgctgagctgtgttcaggagattagtgatgttgttcagcgatag

SEQ ID NO: 140256 - DNA, 3486 bp, Artificial Sequence
  Description of Artificial Sequence: Synthetic coding sequence
atggggcagcaggttggtcgcgtgggggaggcccccggactgcagcagccacagccccgagggatcagaggaagctccgccgctagaccctcgggccgacggcgggatccagcgggacgcacaactgagacaggattcaatatcttcacccagcacgaggcactccaccgcccttatggatgtgatgtagagcctcaagcattgaacgaggccatccgatggtcaagtaaggagaatctgctgggcgcaaccgaaagcgacccaaatcttttcgttgcactgtacgatttcgtcgcttcaggggataacaccctgagcatcactaagggcgaaaagctgcgggtgctcggctacaaccaaaacggcgagtggagcgaagttcgcagtaaaaatggccaaggctgggttccctcaaactacatcacacctgttaattcactggaaaaacatagctggtaccacgggccagtctcccggtcggcagcagagtacttgttgtcaagcctgatcaatggatctttcctggttcgcgaatccgaatcgagcccaggtcagttgtctatttccttaagatacgaaggccgggtgtaccactatcgtattaacaccacagctgacggaaaggtgtacgttaccgctgaatccaggtttagtacactggccgagctggtacatcaccacagcaccgttgcggatggcctcgtcacaactctgcattatccagctcccaagtgtaataagccaacggtctacggtgtctctcccatacacgacaagtgggagatggaaagaacggacataactatgaaacataagttgggtggcgggcaatatggagaggtgtatgttggagtatggaagaaatactccctgaccgtggctgtgaaaacgctcaaagaggatacaatggaggtggaggaattcctgaaagaagccgccgtcatgaaggagatcaagcaccctaacctggtgcagctcctgggtgtatgcactcttgagccccccttttatatcgtgaccgagtatatgccgtatgggaacctcctggattatctccgggagtgtaatagagaagaggtaaccgccgtcgtcctactatatatggctacacagatctcttccgcaatggagtacctggaaaagaagaactttattcatagggacctcgccgccagaaactgcctggtgggcgagaaccatgtggtgaaagtggccgacttcgggctatcccggctgatgactggagatacatacaccgctcatgcaggtgccaaattccccatcaaatggacagccccagaatctctggcatacaatactttcagcatcaaatccgacgtgtgggcctttggtgtgcttctgtgggaaattgccacctatggaatgagcccttacccgggaatcgatctgagtcaggtgtatgacctcctggagaaaggctatcgtatggagcagccagagggctgtcctccaaaggtctacgagttgatgcgcgcatgttggaaatggagccccgcggatcggcctagctttgcggaaacccatcaggcctttgaaacgatgttccatgatagctccattagcgaagaagtggccgaggagctggggagagcggcttcctcatcctccgttgtcccttacctcccacgtctgcccatccttccaagcaagactagaaccctcaaaaagcaggtcgagaacaaggagaatatagagggagcccaggacgcaacagaaaattccgcctcttcactggccccagggttcatcagaggcgcccaggctagctctggctcgcccgcgctgccaagaaagcagcgagataaatcaccttcatccttgctggaggatgcaaaggagacatgcttcacgcgcgatcgaaaaggggggttcttctccagcttcatgaagaagaggaatgcacctaccccacctaagcgctcttccagtttcagggagatggaaaaccagcctcacaagaagtatgagctgacagggaacttttcctcagtggcttctctgcagcacgccgacggatttagcttcacacccgctcagcaggaggctaatctagtgccccccaagtgctacggaggtagcttcgcccagcgaaacctctgtaacgacgacggaggtggggggggcggaagcgggaccgcgggtggagggtggagcggcatcacggggtttttcactccacgtctgatcaaaaagacccttggtctcagggcaggaaagccaacggcatcagatgacacttctaaaccattcccgagatcaaatagtacttcttctatgagctccggccttcctgaacaagaccgaatggcaatgacactcccccggaattgtcagcgctccaaactgcaattggaacgcaccgtgagcacttcatcccagcccgaggagaatgtagatcgtgctaacgatatgcttccgaaaaaatccgaggagagcgcagccccgtcgagggagaggcctaaggcgaaactgctgcccaggggggcgaccgcgctgccactacgaacccccagcggtgacctagctattaccgagaaagatcccccgggagtgggggtggccggagtggctgcggcgcccaagggtaaggagaaaaatgggggcgcacggctgggtatggctggtgtgcctgaggacggcgaacagcctggctggccaagccctgcaaaggccgctccagtcctgccgactacccacaaccacaaggtgcccgtcttgataagtccaactttgaaacacacaccggctgatgtacaattgataggcactgattctcaaggtaataagttcaagctcctgagtgagcatcaggtaacctctagcggagataaggacaggcccaggcgcgtgaaaccaaagtgtgcacctcccccaccgcccgtgatgaggcttctccaacacccctccatctgtagcgaccctactgaggaacctacggccctgacagcgggtcaatctactagtgagacccaagagggagggaagaaagctgctctgggagccgtgccaattagcgggaaggccggtaggccggtcatgccaccaccccaggtgccgctccctacatcttccataagtcccgccaagatggccaacggcactgctggaaccaaagtggcgctgcgcaaaacaaagcaagccgccgaaaagataagcgccgacaaaatcagtaaggaggcactgcttgagtgtgcggacttgttgagctccgccttaaccgaaccggtgccaaactctcagcttgtcgataccggacaccagctgttggattattgtagtggttatgtggattgtattccccaaacccgcaacaaatttgcgtttcgagaagccgtgtccaagttggagctgtcgcttcaggaactccaggtctcatccgccgccgccggagtcccaggaacaaacccagtgcttaataacctcctgagttgtgtacaggaaatctccgatgtagtgcaaagatag

SEQ ID NO: 140257 - DNA, 3177 bp, Artificial Sequence
  Description of Artificial Sequence: Synthetic coding sequence
atggggcagcaggtcgggcgagttggcgaagctccaggtctgcagcaaccacaaccccgtggcattaggggaagctctgctgcccggccaagtggacgcaggagagacccggccggacgaaccaccgagaccgggtttaacatatttacacagcacgaggccctgcaccggccttacggatgcgatgtggagccacaggcactgaacgaggccatcaggtggtctagtaaagaaaaccttctgggtgctacagaaagcgacccaaacttgtttgtagccctgtatgatttcgtcgccagcggagataacacactgtctattactaagggcgagaaactacgagtgttaggctataatcaaaacggagaatggagcgaggtccgtagcaaaaacggccagggatgggttccttccaactatattacccctgttaattccttggagaaacactcgtggtaccacggcccagtgtccaggagcgcggccgagtacctgctcagctccctcatcaacggcagttttctggtccgggagtccgaatcaagtcctggacagctcagtatttccttgcggtatgagggccgcgtctatcattatcggattaatactacagccgatggaaaggtttatgttactgcggagagcagattcagcactctcgctgagctcgtgcatcaccacagcactgtcgctgacgggttagtgaccacactgcactaccctgcccccaagtgtaataagccgaccgtttatggtgtcagtcctatccacgacaagtgggagatggaacgcacagacatcaccatgaagcataaattaggcggcggtcagtacggagaagtgtacgtcggggtttggaagaagtatagcctgacagtggccgtgaagaccttgaaggaggatacgatggaggtcgaagagtttctgaaggaggccgcagtgatgaaagagataaagcacccaaacctggtccagctgctaggagtctgcacccttgagcccccattctatattgttaccgagtatatgccctatggtaatctgctggattatctgagggagtgcaaccgggaggaggtgaccgcagtcgtgttactttacatggcgactcagatttctagcgccatggaatacctagaaaagaaaaattttatccatagagacctcgccgctcggaactgcctggttggcgaaaatcacgtcgttaaggtcgccgattttggcctgagccgcctcatgacaggggatacctatacagctcatgcaggcgccaagttcccaatcaagtggacagctcccgagtccctcgcctacaatacttttagtatcaaatctgatgtatgggcatttggtgtcctcctctgggaaatagcgacgtatggaatgtctccttatccggggatcgatctctcacaagtgtacgatttattggagaaaggctacagaatggagcagcccgaaggttgtcccccaaaagtgtacgaactcatgagggcctgctggaaatggagccctgcggacagaccttcatttgccgagacacatcaggcctttgagaccatgtttcatgactcctcaattagcgaggaggtggcagaggagctgggtagggcagctagtagctcttccgtggtgccctacctgcctcgcctgccaattctcccctccaagacacggacccttaaaaagcaggtggaaaacaaagagaacatagaaggagcacaggacgcaactgaaaattcagcttcaagcttggccccgggctttattagaggcgctcaggcttctagcggaagtccagcactgcccaggaagcagagggataaaagccccagctccctcctagaggacgccaaagagacttgtttcacgcgtgatcgaaaaggaggttttttttcatcctttatgaagaagagaaatgcacccacacctcccaaaaggtccagttcgttccgcgagatggaaaaccaacctcacaaaaaatatgagttaaccggactccccgaacaggaccgaatggctatgactcttcctaggaactgtcagaggtcaaaactgcaactcgaacggaccgttagcacatcctcccagccagaagaaaacgtggatagggccaatgatatgctgcccaaaaaatccgaggagagcgcagcccccagcagagagagacccaaggccaagttactgcctagaggggcgacagctctgccactgcgcacaccttctggcgacttagccataacagaaaaagacccccctggagtcggcgttgccggcgtggcagccgcaccgaaaggtaaagagaagaacggaggcgcacggttgggcatggctggggtccccgaggacggcgaacagcccggttggcctagcccggcaaaggccgctccggtcttgcccaccacacacaatcataaggtgcccgtcctgattagcccaactctgaaacacactcccgctgacgtccagttgattggcactgactcacaaggtaacaaatttaagctgctctcagagcaccaggtgaccagttctggcgacaaggaccggccacgacgggttaagccaaagtgtgccccacctcctccacccgtgatgagattactccagcacccaagtatttgctcagatcccacagaagagcccacagcattaacagccggccaatccacctcagagactcaggaggggggaaagaaagccgctttaggggccgttcccatttcaggtaaggcgggaagacctgtgatgccaccgccacaggtgccactacctacatccagcatctcccccgctaagatggccaatgggacagctggaaccaaggtcgccctgcgcaagaccaagcaggccgctgaaaagatctctgcggacaaaataagtaaagaggcgctcctcgagtgtgccgatctcctttctagtgctctgactgagccagtccctaatagccaactcgttgataccggacaccaacttcttgactactgttcagggtacgttgactgtatcccccagactagaaataagtttgcgtttcgggaagctgtgagtaagctcgaactttcattgcaggaactgcaagtctcatctgctgccgcgggagttccaggaaccaaccccgtgctgaacaatctacttagttgtgtgcaggagatatccgatgtcgtgcaaaggtag

SEQ ID NO: 140258 - DNA, 3240 bp, Artificial Sequence
  Description of Artificial Sequence: Synthetic coding sequence
atgggccagcaagtggggagagtcggagaggctcctgggctgcagcagcctcaacctagaggcatccgcgggtcatctgccgctcgaccctccggtcgacgccgggatccagctgggaggaccacagagaccggctttaacatattcacacaacacgatcactttgcgtcctgcgttgaggacggctttgaaggagacaaaactgggggctcttccccagaggccttacaccggccttacggatgcgacgtcgaacctcaagccctgaatgaagccatccggtggagctccaaagagaacctgcttggagctaccgagagcgacccaaatcttttcgtggctttgtacgatttcgttgcttctggggataacacactcagcatcacgaaaggcgagaaacttcgcgtgctggggtataatcagaatggcgagtggagcgaagtgcgtagtaagaacggacaggggtgggtcccctcaaactatatcaccccagtgaattcactggagaaacactcctggtaccacgggcctgtgagccgctctgcagctgaatatttactatcaagcctgatcaatggctcgtttctggtgcgggaaagtgagagctctccaggccagctgtctatctctctccgctatgaaggtagggtgtatcactatagaatcaacaccactgctgatgggaaggtgtatgtgaccgctgagtcccggttcagcactctcgctgaactggtccaccaccattcgacagtggctgatgggctggtgaccaccttgcactatcctgccccaaagtgcaataagcccacagtttatggagtcagccccatacacgacaagtgggaaatggagcgaacagacattaccatgaaacacaaactgggtggcggtcagtacggggaagtctacgtcggggtgtggaagaagtacagcctcactgtcgccgttaaaacgctgaaggaggacaccatggaggtcgaagaattcctgaaggaggccgcggtcatgaaggagattaagcatcccaatttagtccagctgctcggtgtttgcacactggagccacccttttacatcgtaacagagtacatgccttatggcaatctgctggattacctgagagagtgtaatcgggaggaagtcacagctgtcgtgctgctctacatggccacacagattagtagcgctatggagtatttggaaaaaaaaaatttcatacaccgggacctcgctgcacgcaattgtttagttggcgaaaatcatgtggttaaagttgcagatttcgggctcagccgcttgatgacaggggacacctatactgctcacgccggcgctaaatttcccatcaagtggaccgctcccgaaagcctcgcttacaacacgttttcaattaagtctgatgtttgggcatttggagtgctactctgggagatagccacctacgggatgtccccctatcctggcattgacctgtctcaggtgtacgacctgctcgaaaagggataccggatggagcaacccgagggatgcccccccaaggtttacgagctgatgcgagcctgttggaaatggtctcctgccgatcggccaagttttgctgagactcatcaggcttttgaaacaatgttccacgattccagtatcagcgaagaggtagcggaagaactgggtagggctgcatcctcatcatccgtggtgccttacttaccgcggctgcctatcttgccaagtaagaccaggaccctgaagaagcaggttgagaacaaagaaaacatcgagggcgcccaagacgctaccgaaaactcagcctccagtctggcccccggatttatccgaggcgcacaagcttccagcggtagcccagcattgcctaggaaacagcgcgacaagagccccagctccctcctagaagacgccaaggagacatgttttacccgggacagaaagggtggattcttctcttcttttatgaagaaaagaaatgcaccgacgcccccaaagagatcttctagttttagagaaatggagaatcagccacacaagaaatacgagctaacaggcctgccggagcaggaccgaatggctatgacactcccacgcaactgccagcggagtaagctgcaactcgaacgcacagtgagtacgagttcacagcctgaggaaaatgttgatagggctaatgatatgttacctaaaaagagcgaggagtctgcagctccgtctcgagagaggcccaaagctaagctgctgcctcgcggcgccacagccttgcctctacgcacacccagtggcgacctcgcaattactgaaaaagatccccccggagtgggggttgctggagtggctgctgccccaaaaggcaaggagaagaatggcggggcccgccttgggatggcaggcgtcccggaggacggggagcagccaggctggccctcgccagctaaagctgcccctgtattgccaaccacgcataatcataaggttcccgtgctcattagcccaaccttgaagcacactcccgcagatgttcagttaatcgggaccgacagtcaagggaacaagttcaaactgctgagcgaacatcaggtgactagttcaggggacaaagacagaccaaggcgagtgaaaccaaaatgtgcccccccccctccacccgttatgcggttactgcagcacccgagcatctgcagtgatcctacagaggagcctacagctctgacagccgggcagtccactagcgagacgcaggaaggtggaaaaaaggcagcattgggagcggtgccgatcagcgggaaagccggaaggcccgtgatgcccccaccacaagttccactgccgacctcgagcatctctcccgctaagatggcaaatggcacggcagggacaaaggtcgccctacggaaaaccaaacaggctgccgagaagatctctgccgataaaatctcaaaggaggccctgctggagtgcgctgaccttctgtcgtctgccctaacagagcccgtcccaaacagccagctcgtcgataccgggcaccagcttttagattactgctccggttacgtcgattgcatccctcagactaggaacaaattcgcttttagggaagccgtctcaaagctggagctgtcccttcaggagctccaagtgagttctgccgccgccggcgtgcccggtaccaatcccgtgctcaacaacctgctctcttgcgtccaagagatttctgacgtggtccaacgctag

SEQ ID NO: 140259 - DNA, 2349 bp, Artificial Sequence
  Description of Artificial Sequence: Synthetic coding sequence
atgaatcctgaaaaggactttgcccccctgactcctaacatcgttagagccctgaacgacaagctgtatgaaaagaggaaggttgccgcactagaaattgagaagttagtgagagagtttgtggctcagaacaacaccgtccagattaaacacgtgatccagacactctctcaggaatttgccctgtcacagcatccacacagcaggaaggggggattaatcggccttgctgcttgtagcatcgccctgggcaaggactccggcttgtatcttaaggaacttatcgagccagtgcttacttgcttcaacgatgctgattccagactgcgctattatgcttgcgaggccctgtataacatcgtcaaagtggcccgaggcgctgttcttccacactttaacgtactctttgatggtcttagcaagctcgctgccgaccccgacccaaatgtgaaatcagggagcgaactcttagacaggttgcttaaggacattgtcaccgaatctaataaatttgatttggtcagcttcattcctctattacgagaaagaatatattcgaacaaccaatacgccagacagtttattatttcatggatcttagttctggagagcgtgccggatataaacttgctggattatctgcccgagatattggacggactctttcaaatattgggcgacaatggcaaggagataaggaagatgtgtgaagtcgttctgggagagttcttgaaagaaattaagaagaatccctcatctgtcaaattcgctgagatggcaaatatactggtaatacactgccagaccactgacgatctaattcagttgacagccatgtgttggatgcgggagtttatccagctggccgggcgggtgatgcttccctattctagcggtattttaacagccgtacttccctgtctggcctatgacgaccgaaagaaaagtatcaaggaagtggcgaacgtatgcaatcagagtctcatgaagctggtaacacccgaggacgacgaactcgacgaactacgtccgggacagcggcaggctgaacctacacctgatgacgccctccccaagcaggaaggcaccgcctccggggggccagatgggtcatgcgactcctctttcagcagtggaatctctgtgttcactgctgcctctacggaacgggccccagtgacattgcacctggatggaatcgtgcaagtgctcaattgccaccttagcgatacagctatcggcatgatgactaggatcgccgtacttaagtggctgtaccacttgtacatcaaaactcccagaaagatgttccgacatactgacagcctcttccccatcctgctacaaacactgtctgatgaaagtgatgaagtgattcttaaggatctggaagtcctggcagaaatcgcatcaagtccagcaggtcagaccgacgacccaggcccactcgacgggccagatctgcaggccagccacagcgagcttcaggtgcctactccaggcagagccgggctgttaaatacctccgggaccaaaggcctggaatgttccccgagcacccccaccatgaattcatacttttataagtttatgattaacttattgaaacgcttcagcagtgagcgtaaacttctggaggtgcggggcccttttatcataaggcaactttgcctgcttctaaacgctgagaatatctttcactccatggcggatatcctcctaagagaggaagatcttaagttcgcctccactatggtacatgcgctgaacaccattctcctgacttcgacagagctattccagctgaggaatcagctaaaagacctcaagactcttgaatcacagaacctgttttgctgtctgtatagaagttggtgtcacaaccctgtgaccactgtctctctgtgtttcctcacccagaattatcgccatgcgtatgatctgatccaaaaattcggcgacctcgaggtgactgtcgatttccttgcagaggttgacaagctggtgcaactcatagagtgcccaatcttcacgtatctccggcttcaactgctggacgtcaaaaataacccatatctcattaaggctctgtatggcctgctgatgctattgccacagtcctccgcatttcagttgctctctcaccgcttgcagtgtgtccccaacccggaactgctacagaccgaggacagccttaaggctgcgccaaagagtcagaaggccgatagcccgtccattgactacgccgaattgttacaacatttcgagaaggtccaaaataagcaccttgaagtaagacatcagagatctggtcggggtgaccacctggacagacgcgttgtgctgtag

SEQ ID NO: 140260 - DNA, 645 bp, Artificial Sequence
  Description of Artificial Sequence: Synthetic coding sequence
atggccgacatacttttgagggaagaggacctgaaatttgcaagcacaatggtccacgccctgaacacgatactgctgactagcaccgagctctttcaactgcggaaccaactgaaggacctgaaaaccctggagtcacaaaacttattctgttgcctgtacagatcctggtgccataaccctgtcacaaccgtttcactctgctttttaacccagaactaccgacatgcctacgatttgatacagaagtttggtgaccttgaggtcacggtggacttcctagcggaggtggataagttggtccagctgatagaatgccctattttcacctacctacgactgcaacttctggacgtgaagaataacccttacctaatcaaggccttatacggtctattaatgctccttccccagagtagtgcatttcaactgctttcgcaccgactccagtgcgtgcctaatcccgaactgctgcagaccgaagacagcttgaaggcagctcctaaatcccagaaagctgatagcccttcaattgattatgctgagctgctacagcatttcgagaaggttcagaataagcatctggaagtccgacaccagcggagcggacgcggggatcatctggaccggcgcgttgtgctctag

SEQ ID NO: 140261 - DNA, 1062 bp, Artificial Sequence
  Description of Artificial Sequence: Synthetic coding sequence
atggcctcatcgtggccgccacttgagctgcagagcagcaaccagtctcagctattcccccagaacgccacagcctgcgataacgcacctgaggcctgggacctgctacatcgtgtactgccaacctttatcatcagtatttgtttctttggcttgcttggcaacctttttgtcctcctggtattcctattgcctagaaggcaacttaacgttgccgagatctatttggctaatctcgccgcctctgatctagtgttcgtactggggctacctttttgggccgagaatatctggaatcagttcaattggcccttcggcgccttactttgcagggtgatcaatggcgttataaaggccaacctgtttatctccattttcctggtggtggctatcagtcaggatagataccgcgttctggtccatcccatggctagccgccggcagcagcgcaggagacaggcacgggtgacgtgtgtcctcatttgggtcgtcggaggcctccttagcatccccaccttccttttacgctccatacaggccgttcccgatctgaacatcaccgcgtgcatcctgctcctgcctcacgaggcctggcactttgccagaattgtggagctgaatattctagggttcctgctgccactggccgccatagtgttttttaactaccacatcctggcttctctgagaactagagaggaagtcagtagaactcgatgtggaggtcgcaaagattcaaagactacagcgctgatcttgacccttgtcgttgcgtttcttgtttgctgggctccataccacttcttcgctttcctcgagtttcttttccaggtacaagccgtgagggggtgtttctgggaggatttcatcgatctagggctccaactggcaaatttcttcgcatttaccaactccagtttgaatccggtcatttacgtgtttgtcgggcgcctgttcaggaccaaagtctgggagctgtacaagcaatgcacccccaagtcactagctccaatcagtagctcacatcgaaaggagatttttcagctattttggcgaaactag

SEQ ID NO: 140262 - DNA, 1527 bp, Artificial Sequence
  Description of Artificial Sequence: Synthetic coding sequence
atgcctcccaaaagaaatgagaagtataagctgcctataccttttccagaaggaaaagtcctggatgacatggaaggtaatcagtgggtactgggtaaaaagataggatctggcggcttcggcctcatctatctagcctttccaactaacaagcctgagaaagatgcacgccacgttgtgaaagtagagtatcaagaaaatggccctctgttcagcgagctcaaattttatcaaagagtggccaagaaggactgtatcaaaaaatggatagaacgcaagcagctcgactatttgggtatccctctattttacggtagcgggctcaccgagttcaagggaagaagctaccggtttatggttatggaacgcctggggattgacctccagaagatatctggccagaatgggactttcaagaaatccaccgttctgcagcttggaattaggatgttagacgtcctggaatacattcatgaaaacgagtatgtacacggagatattaaagctgccaacctcctgttagggtacaagaatcccgatcaggtctacctggctgactatggcctctcttaccggtattgtcccaacgggaatcataaacaataccaggagaatccccggaaagggcacaatggcacaattgagttcacatctctcgatgctcacaaaggcgtggctctgagcaggcgtagcgacgtggagattcttggctattgtatgctgcgctggctctgtggcaagctgccgtgggagcagaatcttaaagaccccgtggccgtgcagaccgccaagaccaatctcctcgacgagctgccacagtctgtcctgaagtgggccccttctggaagcagttgttgcgaaatcgcacagttcttggtctgcgcccactctcttgcttatgacgagaagcctaactaccaggcgcttaagaagatcctgaatccccacgggatcccactgggcccactggatttttctaccaaagggcagtcgatcaacgtccacacgcctaacagccagaaggtggatagccagaaagcagcgactaagcaggtcaataaagcccacaatcggttgattgagaagaaagtgcatagcgagcgttccgcggagagttgcgccacatggaaggtacagaaggaggaaaagctgataggactgatgaacaatgaagccgcccaggaaagcacacggcgtcggcagaaataccaggaaagccaggagccactgaatgaggtaaattcttttccacagaaaatcagctacacacagttccctaatagcttctacgagccccaccaagacttcacgtcccctgacatattcaaaaaaagcagaagcccctcttggtataaatatacaagtactgtttctaccggtataacggatctcgaaagttcgacaggcctttggcccactattagtcagttcaccctgagtgaagagaccaatgcagacgtctattactacagaataatcatccccgtgcttctgatgcttgtgtttctagctttgtttttcctgtag

SEQ ID NO: 140263 - DNA, 1203 bp, Artificial Sequence
  Description of Artificial Sequence: Synthetic coding sequence
atgccccctaaacgaaatgagaagtacaaactccccatccctttcccggaaggaaaggtattggatgacatggaaggtaaccagtgggttttgggtaaaaagatcgggagcggaggctttgggctgatctacctggctttccctacaaacaagccagaaaaagacgcccggcatgtggtgaaagtggaataccaggagaatgggccactgttcagcgagcttaagttctatcagcgggtggcgaagaaggactgtatcaagaagtggatcgagaggaaacagctggactatttgggaatcccactcttctacgggagtggccttaccgagtttaaaggccggtcataccgattcatggttatggagcgtcttggtatcgatctccagaagatatctggccagaacggcactttcaagaagagcaccgtgttacagttgggcatacgtatgctggacgtgctggagtacatccatgagaacgaatatgtgcatggggatatcaaggccgcgaaccttctcttaggctacaaaaaccctgaccaggtgtatcttgcagattacggcctttcttatcgctactgtcctaatggcaaccacaaacaatatcaggaaaatcctaggaaggggcataacggtactatcgagtttacttctctggacgctcataaaggtgttgctctgagtaggagatctgatgtcgagattctgggttactgtatgttaagatggctttgcggcaagctgccctgggagcagaatcttaaggaccccgttgcggtgcagacagccaagactaatcttctggacgagttacctcagagcgtgctaaagtgggccccaagcggaagtagttgctgtgaaatcgcccagttccttgtgtgtgcacattccctcgcctatgacgagaaacccaactaccaggctctgaaaaaaatcctgaacccccacggaatcccgctcgggccccttgacttttccacaaaaggccagtctatcaacgtgcacacccccaattcgcaaaaggttgactcacaaaaggcagcaaccaagcaggtaaataaggcccataataggttaatcgaaaagaaggtgcatagtgagcggagcgctgagagctgcgccacctggaaagtgcagaaggaggaaaaactgatcggtctcatgaataacgaagctgctcagatccggcaactgggctattag

SEQ ID NO: 140264 - DNA, 1191 bp, Artificial Sequence
  Description of Artificial Sequence: Synthetic coding sequence
atgcctccaaagcgaaatgaaaaatacaagttgcctattccctttccagagggaaaagtcctggatgatatggagggcaaccaatgggtgctagggaaaaaaatcgggagcggtggcttcggcctcatatacctcgccttcccgacgaacaagccagagaaggacgcccggcacgtggtcaaggtggagtaccaagagaatggcccccttttctcggaattaaagttttatcagcgggtcgccaaaaaagattgcattaagaagtggatcgagcgcaagcagttggactacttggggataccactgttttacggctcagggcttacagaatttaaaggaagaagttacaggttcatggtaatggaacgccttgggatagacctgcagaaaatctccggacagaatgggacctttaagaagtcgacagttctgcagctgggaatcaggatgcttgatgtcttggagtacatacatgaaaacgagtacgtccacggggatatcaaggccgctaacctcctactgggatataagaacccagaccaggtctacctcgccgactacggtctaagctatagatactgccccaatggaaaccacaagcagtatcaggagaatccgagaaagggccataatgggaccatagaatttacctctctcgatgctcataagggtgtggccctttccaggcgctccgatgtagagattctcggctactgtatgttgagatggctctgtggtaagctgccttgggagcagaacctcaaagaccctgtagctgttcagaccgcaaagacaaatttgctcgacgaactgccacagtcagtcttaaagtgggcgcctagcgggtcctcatgctgtgaaatcgcacagtttctggtttgcgcacacagtctggcttacgacgagaaaccaaattatcaggcgttgaagaagattctgaatcctcacggaattccactgggcccgttggatttcagtaccaaaggccagtccatcaatgtgcatactccgaatagtcagaaagtagattcgcaaaaggcagccacgaagcaagtcaacaaggcccataacagactcatcgaaaagaaggttcattccgagaggtccgctgagtcatgcgccacttggaaagtgcaaaaggaggagaaacttatcggccttatgaataacgaggctgcccagtttcggtag

SEQ ID NO: 140265 - DNA, 876 bp, Artificial Sequence
  Description of Artificial Sequence: Synthetic coding sequence
atgccccctaagcgcaacgagaaatacaagctgccaattccattccctgaaggtaaggtcttagatgatatggagggtaaccagtgggttttgggaaaaaagatcggctccggcgggtttggtcttatatacttagccttccccaccaacaagcccgaaaaggacgcccgccacgtggtcaaggtggaataccaggagaacggccccctcttctctgaactgaagttttaccagagagtcgcaaagaaggactgtattgttttcgtggtgaaaaagtggatagagcgcaagcaactggactatctcgggatccccctgttttatggttccggactcacagagtttaagggcaggtcgtaccgattcatggtgatggagaggttaggaattgacctccagaagatttctggccaaaacggaaccttcaagaaaagcacagtactccaactcgggattagaatgctcgacgttttagaatacattcatgagaacgagtacgtgcacggagacatcaaggccgcaaacttactgctcggttataagaatccagaccaggtgtacctggccgactatggcttgtcttataggtactgccccaacggcaatcataagcagtatcaggaaaatccacggaagggacacaacggcaccatagagttcacttctttagatgcccataaaggtgtggcacttagcagaaggtcagacgtcgagatcctcggatactgcatgctgcgttggctttgtggaaagctaccgtgggaacagaatttgaaggatcctgtggctgtccagaccgcaaaaaccaagtacaagttctctagcatctcttcgtgcaccgctccaggactcaagggatatatcaagggtagctag

SEQ ID NO: 140266 - DNA, 1527 bp, Artificial Sequence
  Description of Artificial Sequence: Synthetic coding sequence
atgcccccaaagagaaatgagaaatacaaactcccaatccctttccctgaggggaaagttttagacgatatggaggggaatcagtgggtgctggggaaaaagatcggatcgggaggtttcgggctgatatatctagcgttcccaaccaataagccggaaaaagacgccagacacgtggtaaaggtggaataccaagagaatgggcctctctttagcgagctcaaattctatcagcgggtggccaagaaggactgcataaaaaagtggattgaaagaaaacaattggattatctcgggatccccttgttttacggatccggtttgactgagttcaagggcaggtcctatcgctttatggtgatggaacggcttggaattgatcttcaaaagatttctggacagaatggcacctttaaaaagtctaccgtattacagcttggcattcgcatgctggacgtcctggagtatatacatgagaatgagtatgtgcacggtgacataaaggcagctaaccttttattaggctataaaaaccccgatcaggtatacctagccgactacggcttatcataccggtactgccctaatggcaatcataagcagtaccaggagaaccccagaaagggccataatggtacaattgagttcacctcactggatgcccacaagggtgtggctctgtcgcggaggagcgatgttgaaattcttgggtactgtatgctgaggtggctgtgtgggaagctgccgtgggagcagaacctcaaggacccagtagccgtgcagactgccaaaactaatctgctggacgaattgcctcaatcagtgcttaaatgggccccatccggttcttcatgctgcgaaatcgcccagttcctggtatgcgctcactcccttgcatacgacgagaagcccaattatcaggccttgaagaaaattctgaacccccacggaattcctctgggacccttagatttctccaccaaaggccaatcaataaatgtccacaccccaaactctcagaaagttgacagccaaaaggcagctaccaagcaggtgaacaaagcccataataggctcatagagaagaaagtacatagcgagcggtctgctgaaagctgtgcaacctggaaagtgcagaaggaagaaaagctgattggccttatgaataacgaagccgctcaggagtctaccagaagacgacagaagtaccaagaatcgcaggagcccctcaatgaggtgaactctttcccacagaaaatctcatacacccaattcccaaactccttttatgagcctcatcaagatttcacttccccagacatcttcaaaaagtctcgttccccgagctggtacaagtacacgtcaacagtctcgaccgggataacagacctcgaatcatctacaggtctatggccaaccatctcacagtttacactgtccgaggaaacaaacgcagacgtctactattaccgtatcattataccagtgttgctgatgttagtgttccttgcactgtttttcttatag

SEQ ID NO: 140267 - DNA, 1458 bp, Artificial Sequence
  Description of Artificial Sequence: Synthetic coding sequence
atggagggaaaccagtgggtcctcggcaagaagattggcagcggtggctttggccttatttatctagccttccctaccaacaaaccagagaaagacgctcggcatgtggtcaaggtggagtatcaagagaatggacccctgttttcagaactgaagttttatcagagagtcgcgaagaaggattgtattaaaaaatggattgagagaaagcagctggactacctcggtataccactgttctacggatccgggttgactgagtttaagggtcgttcataccggttcatggtgatggaaagactggggattgatttgcaaaaaatatccggacagaacggcacatttaagaagagtaccgtgctgcagctggggatacggatgctggacgtcctggaatacatccacgagaatgagtatgtgcatggggacattaaggccgctaatttgttactgggctacaaaaaccctgaccaagtgtatctggccgactatggtctgtcgtatcggtactgtccaaatggaaaccataaacagtatcaagagaatccgcgaaagggccataatggaacaatagaattcaccagcctggacgcccacaaaggagtggccctaagccgacggtccgacgtggaaattctgggatattgcatgttgaggtggctgtgtggaaaactgccctgggagcagaatttgaaggacccagtggcagtccagaccgccaagacgaacctcctggacgagctcccccagtcagtgcttaagtgggcacccagtgggagttcatgctgcgagatcgcacagtttctggtgtgtgcccatagccttgcctatgacgaaaagccaaactatcaggcactgaaaaaaatactgaatccccacggcattcccctggggcccctcgatttttcaactaagggccagtccattaatgtccacaccccgaattcccagaaagttgactctcagaaggccgccacgaagcaggtgaataaggctcacaataggctgatagagaaaaaagtgcacagcgaacgctccgcagagagttgtgccacctggaaggtgcaaaaagaagaaaagctgattggactgatgaacaacgaggctgcccaggagtcgacaaggaggagacagaagtaccaggagagccaggaacccctgaacgaggtgaattccttccctcaaaagatttcctacacccagttccctaactctttttacgaaccccatcaggacttcaccagtccagacatcttcaagaaaagcaggtcacctagctggtacaaatatacttccacggtgtcaacaggcataacagacctggaaagtagcacaggactctggcccaccatctcccaattcacactctctgaggagaccaatgcagatgtgtactactaccgaatcattatcccagtgctgctgatgctggtgttcttggctctcttttttttatag

SEQ ID NO: 140268 - DNA, 531 bp, Artificial Sequence
  Description of Artificial Sequence: Synthetic coding sequence
atggctatgtccttcgagtggccatggcagtatcgattccctcctttttttacactccaacctaacgtggatacaagacagaagcagctagctgcctggtgctcacttgtactcagtttttgccggttgcataaacaatcaagcatgactgtgatggaggcccaggagagcccactgttcaacaatgtcaaactgcaacgcaagctacccgtcgagagcattcagattgttttggaggagttgcgcaaaaaaggaaaccttgaatggttagataaatccaagtcctctttcctcataatgtggcgcaggccggaggagtggggaaagttaatttaccagtgggtttctcgatcggggcagaacaactccgtatttaccttatatgagctcaccaacggagaggatacagaagacgaagagtttcacggcttggacgaggcaaccctgctgcgtgctctccaggccctccaacaggagcacaaagccgagatcatcaccgtctccgatggtcggggggtgaaatttttctag

SEQ ID NO: 140269 - DNA, 984 bp, Artificial Sequence
  Description of Artificial Sequence: Synthetic coding sequence
atgtccttcttgggggggttcttcggaccaatatgtgagatcgatatcgtcctcaacgacggagagactaggaagatggcagaaatgaaaaccgaggatggaaaggttgaaaagcattacctgttttacgacggggagtcggtcagcggaaaggtaaacctggctttcaagcagccaggcaagcggctcgagcaccagggaatccgcatcgaattcgtgggccagatcgaattatttaatgacaaatccaatacacacgaattcgtgaaccttgtcaaagaactggctcttccaggggagctcacacagtcgcgctcctacgactttgagtttatgcaagtcgaaaagccgtatgaaagctatattggcgcgaacgtgcgcctacgctacttccttaaggtcacaatagtgcggcgcctaaccgacttggtgaaggagtacgacctgatcgttcaccaactggccacttatcccgacgtgaataattccattaaaatggaggtcgggatagaggactgcctgcatatcgagtttgagtacaataagtcaaagtaccatctgaaagatgttatcgttggaaagatttacttcttactggtgaggattaagattcagcacatggaacttcagttaatcaagaaagagatcacaggaattggaccttcaactaccaccgaaacggagaccatcgctaaatacgagattatggatggcgcccctgtcaagggggagagtattcctatccggttgttcttagccggctacgaccccactcctacaatgcgagacgtgaacaagaagttcagtgtgagatacttcctgaacttggttcttgtggatgaggaggaccggaggtattttaaacagcaggaaattatactgtggcggaaagcccctgaaaaactgcgtaagcaacgtaccaacttccaccagcggttcgagagtccagagtcacaagctagtgctgagcagccggaaatgtag

SEQ ID NO: 140270 - DNA, 984 bp, Artificial Sequence
  Description of Artificial Sequence: Synthetic coding sequence
atgtctttcctgggcggctttttcggaccaatatgcgaaattgatatagtcctcaatgatggcgagacccggaagatggccgagatgaagaccgaggacggaaaagtggagaaacattacctattctatgacggtgaatccgtgtctgggaaggtgaacttggccttcaaacagccaggaaaacgcctggaacatcagggtattagaattgagttcgtggggcaaatagagctgtttaatgacaagagcaacacgcatgagtttgttaatcttgtcaaggagttggcactccccggtgagcttacccagtcaaggagctacgacttcgagttcatgcaggtggagaaaccttacgagtcatacatcggggcgaacgtgcgcctgcgatacttcctcaaggtaactatcgttcgtcgcctgaccgacctcgtcaaggagtatgacctcattgtgcaccaactggccacttatcctgatgtcaataatagcatcaaaatggaagtgggcatagaagactgcctccacatagagtttgagtacaacaagagcaaatatcacctaaaagacgtgattgtgggaaaaatctatttcttactggtccggattaaaatccaacacatggaacttcaactgattaaaaaagagatcaccgggatcggaccaagtaccaccactgaaacggaaacaattgcgaagtacgagattatggatggtgcacccgtcaaaggagagtcaattccaatccgtctgtttctagctgggtatgatcccacccccactatgcgagatgtgaacaaaaagttctctgtgcggtattttcttaatctggtcttagtcgatgaagaagatagacggtactttaagcaacaggagattatcctgtggcgtaaagccccggaaaagctgcgcaaacagagaacgaacttccatcaacggtttgagagcccagaatcccaggcctcagccgagcagcccgagatgtag

SEQ ID NO: 140271 - DNA, 756 bp, Artificial Sequence
  Description of Artificial Sequence: Synthetic coding sequence
atgtctttcttggggggtttttttggcccaatctgtgagattgacatagtgctcaacgacggggagactagaaaaatggccgaaatgaaaaccgaggacggtaaggtggaaaaacactacctgttctacgacggcgaaagcgtctctgggaaggtgaacttggctttcaagcagccaggcaaaaggctggaacatcagggcatccgtattgaattcgttggccagatcgaacttttcaatgacaaatccaacacgcatgaatttgtcaatttggtcaaggagctggcgttacccggtgagttaacccagagtaggtcttacgactttgagttcatgcaagtggagaagccctatgagagctacataggcgctaatgtgagattacggtattttctcaaggttactatcgtccgcagactgaccgacctggtgaaagaatatgatctgattgtgcaccaactcgcaacctatccagacgtgaacaattccatcaagatggaagtggggattgaggactgcttacatatcgaatttgagtataataaatctaagtatcatttgaaggatgtgattgttggtaaaatctacttcctgttggtccgcatcaagatccagcacatggaattacagttgatcaaaaaggagatcacaggcattggtcctagtacaaccaccgagaccgaaaccattgccaagtatgaaatcatggacggcgcccccgtcaagggagacaacttcatggagaagagttcatag

SEQ ID NO: 140272 - DNA, 651 bp, Artificial Sequence
  Description of Artificial Sequence: Synthetic coding sequence
atgcaggtggaaaaaccttatgaaagctacattggagccaacgtgcgtctgcgctattttctgaaggtgacgatagtgagacgactgacagatctcgtgaaggaatatgatcttattgtccatcagctcgctacataccccgatgtcaacaattcgattaagatggaggtcgggatcgaagattgtctgcacatcgagttcgagtataataaatccaagtaccacctaaaggacgtcatcgtgggtaagatttacttcctgctggtccggatcaaaatccaacacatggaactccagctcattaagaaggaaatcaccgggatagggcctagtacgacaacagagaccgagaccatcgccaagtatgagattatggacggcgctccagtcaagggtgagagcataccaatcagattatttctagccggatatgatccgacacctacaatgcgggacgtcaacaagaagttcagcgtacggtactttctgaacttggtcctcgtggacgaggaagataggagatactttaagcagcaggagattattctgtggcggaaggctcctgaaaagttgcgcaaacagcgcactaacttccaccagaggtttgaatccccagagtcacaggcatcagcagagcagcccgaaatgtag

SEQ ID NO: 140273 - DNA, 933 bp, Artificial Sequence
  Description of Artificial Sequence: Synthetic coding sequence
atgaccgagaatccttttcaggaacgttactccgttgaagacctttccacattcggaatgtgtctgtgcatggtccgatacgtgtacgacgcgttctacaaagtgaatctcgcctttaaacagccagggaaacggctggagcaccaaggcattcggatcgagttcgtgggacagatagaattattcaatgacaaatccaatacccacgagttcgtcaatctggtgaaggagttagcattaccaggggaacttacgcagtcgaggagttatgatttcgaatttatgcaggtcgagaaaccttatgaatcctacatcggagccaacgtgaggctgaggtatttcctgaaggtgaccatcgtccgcagattgacagatctggtgaaggagtatgatctgatcgtgcaccagcttgccacttatcccgacgtaaacaattcaataaagatggaggtgggaattgaggactgtcttcatattgagtttgagtataacaagtctaagtatcacctcaaggatgtgatcgtaggcaaaatctattttctgctggtccgcataaagatccagcatatggaattacagctgatcaagaaagaaattactggcattgggccctctactaccacagagaccgagaccatcgccaagtacgaaatcatggatggggctccggtgaagggagagtccatccctatccgcctgtttctggcaggttacgatccaaccccgacaatgcgcgacgtaaataagaagttctcggtccggtacttcctgaatctagtcttggtggatgaggaagacagaagatattttaaacagcaggaaattattctgtggcgtaaggcccctgaaaagcttcggaagcaaaggactaactttcaccagagatttgaaagccccgagtcccaggcttcagctgaacaacctgaaatgtag

SEQ ID NO: 140274 - DNA, 1011 bp, Artificial Sequence
  Description of Artificial Sequence: Synthetic coding sequence
atgtccttttttgggttcggacagtccgtggaagtggaaattttgctgaatgatgccgagtcaaggaaacgtgctgagcacaagaccgaagacggcaagaaagagaagtactttctcttctacgatggcgaaaccgtcagtggtaaggtgagcctggcactcaagaatcctaataaacgcctcgagcaccaggggatcaaaatcgaattcattggacagatagaattgtactacgatcgtgggaatcatcacgaatttgtgtcactagtaaaggaccttgccaggcctggcgagattacccagagccaagcgttcgatttcgagtttacccatgtcgaaaaaccctatgaatcctatactgggcagaacgtcaagttgcgttacttcttgcgggccactatatctaggagacttaacgacgtcgttaaagaaatggacatcgttgtgcacactctctccacgtaccctgagctcaattcctccatcaagatggaggtgggcatagaggactgcttacacattgagtttgaatacaacaagagcaagtatcatcttaaagatgtcatcgtagggaagatatacttcctccttgtcaggattaagattaaacacatggagatcgacattattaagagagaaactaccggaacagggcctaatgtgtaccatgaaaacgatactatcgccaagtacgaaatcatggatggggccccagtgcgcggtgagtctatcccaattaggctgtttctcgccggctacgaacttaccccgactatgagggatatcaacaaaaagttctctgtccggtactacctgaatctggtcctgatagatgaggaggaaaggaggtacttcaagcagcaagaggtcgtattatggcgcaagggcgacattgttagaaaatccatgtcccaccaggcggccattgcatcccagagattcgagggtaccacgagcctgggggaagtccggacaccatcccagctaagtgataataactgtagacaatag

SEQ ID NO: 140275 - DNA, 666 bp, Artificial Sequence
  Description of Artificial Sequence: Synthetic coding sequence
atgttccacggcatcccagccactcctgggatcggcgccccagggaacaagcccgagttatatgaggaagttaagctttataagaacgctcgtgagcgcgagaagtatgacaacatggcagaactgtttgcggtggtgaagaccatgcaggctctcgagaaggcctacattaaggattgtgtcagccccagtgaatatacagccgcctgcagtaggctcttggtccaatacaaggctgctttcagacaggttcagggcagcgagatatcttccattgatgagttctgtcggaaatttcgcttagactgtcccctggctatggaacgcatcaaggaagacaggccaatcactattaaggatgataaaggcaatcttaatcgctgtatcgccgatgtggtttccttgtttatcacagtgatggacaagctgcgcctggagatccgagcgatggatgagatccagccagatcttcgtgagttaatggagacaatgcacagaatgtctcacctgcccccggactttgaaggcagacagacagtgagtcaatggctccagactctaagcggaatgagcgcctcggatgagcttgacgacagccaggtgaggcagatgttattcgacctcgagagcgcgtacaacgcatttaacaggttcctgcacgcgtag

SEQ ID NO: 140276 - DNA, 702 bp, Artificial Sequence
  Description of Artificial Sequence: Synthetic coding sequence
atgtttcatgggatacctgcgacgcccggcatcggcgctcccgggaacaagccagagctgtatgaagaggtcaaactgtataaaaatgctagagaacgagaaaagtacgacaatatggcagagttattcgcagtagtgaagaccatgcaagccctggagaaagcatatattaaggattgcgtgtctccttcggagtacaccgccgcctgttctcggctgttggtgcagtataaggctgccttcaggcaggtgcaggggagtgagatatcatctatcgacgagttttgtcgtaagttccgccttgactgtcccctcgccatggaacgaattaaagaagatagaccgattacaatcaaagacgataaggggaaccttaaccgatgtattgctgatgtggtgtcactgtttataacagtcatggataaactccggctggagatacgagcaatggatgaaatacaacccgacctcagagaactgatggagacaatgcatcggatgtctcacctgcccccagattttgagggacgacagacagtgtcacagtggtgggtaagtcttccagctcgtcagagtcctgccgtgcctgaaaccctgcccgcccggagaagccctgccgtcccactgcgccctagtgcacccacgtgcccagtgttgcacagccaggcagccgatcccgaaaggcacgtgggggttcgttag

SEQ ID NO: 140277 - DNA, 666 bp, Artificial Sequence
  Description of Artificial Sequence: Synthetic coding sequence
atgttccatggaattccggcaaccccggggattggtgcccccgggaataagcccgagctctacgaagaagtcaaactgtataaaaacgccagggaacgcgaaaagtatgataacatggccgagctgtttgccgtggtgaaaaccatgcaagcactggagaaagcctacatcaaagactgcgtgagtccctcagagtacacggctgcatgcagtcgcttgttggtccagtataaagctgcattcagacaggtccaggggagtgagatctctagcatagacgaattctgcaggaagttcagactggattgccccttggctatggagcggatcaaagaggacaggcctatcacaataaaggacgataaaggaaatctcaaccgctgcatcgccgatgtcgtgagtctcttcataaccgttatggataagctccggcttgagatcagggccatggatgagatccaacctgatctcagagagcttatggaaaccatgcatcgaatgtcacacctccctccagactttgagggtcggcagacagtgtcccagtggttgcaaaccctcagcggcatgtccgcatcagatgaactggatgacagccaagtgcggcagatgttgttcgatttagagtccgcatataacgctttcaaccgcttcctacacgcatag

SEQ ID NO: 140278 - DNA, 1791 bp, Artificial Sequence
  Description of Artificial Sequence: Synthetic coding sequence
atggccgcacatctttcatacggaagggtcaacttgaatgttctaagggaagccgttcgccgagagctgcgggagttcttggataagtgtgccggcagtaaagccatcgtgtgggacgagtacctcacgggtccatttgggcttatcgcccaatattcacttctgaaagagcacgaggtagaaaaaatgttcacactgaaagggaacaggctccccgctgccgacgtgaaaaacatcatcttttttgttaggcctagactggagcttatggatattatcgcagagaatgttctgagtgaggatcgacgggggcccactcgtgactttcacatcctgttcgtgcctcggcggtcccttctgtgtgagcagcggcttaaagacctgggcgtgctcgggtcattcattcacagagaggaatactcgctggatctgatcccttttgacggtgacctgctttcaatggagtcagagggagcctttaaggagtgttatttagagggggatcagacttctctttaccacgccgccaaaggtttaatgactctccaggctctctacgggactattccccagatcttcgggaagggggagtgtgcccgacaggtggctaacatgatgattcgtatgaagagggagttcacagggtcccagaattctatatttccagtgttcgataacttgctcctgttggatagaaacgtggacctgttgaccccgctggcaacccagctgacttacgaaggactgatagacgagatctatggcattcagaattcctacgtgaaactgcctcccgagaagtttgctcccaaaaagcaaggtgacggcggcaaggacctaccaacagaggccaagaagcttcagcttaattccgccgaagaattgtatgcagagatcagagataagaattttaacgccgtggggagcgtgttgtccaagaaagctaaaatcattagcgccgcgttcgaagagcgccacaatgccaaaaccgtcggagagatcaagcaattcgtgagccagttgccccatatgcaggctgcgagaggctctctggctaatcacacctccatcgccgaactgatcaaagacgtgaccacctcggaagatttctttgataagttgaccgtagagcaggaatttatgtccggcatcgacaccgataaggtgaacaattacatcgaagattgcatcgcacagaagcacagtctgatcaaggtacttagattggtgtgcttgcagtcggtttgcaactccggtttgaaacagaaggtgctggactattacaagagggagatccttcagacgtacgggtacgaacatatccttacactgcacaaccttgagaaagcagggttgctcaagccacagacaggtgggcggaacaattaccctacgattagaaaaacattgagactctggatggacgacgtgaacgagcaaaatccaaccgacatcagctacgtgtactctggttacgcccccctctctgtcaggctcgctcaactgcttagccggcccggttggcggagcattgaggaggtgttgcggatcctgccgggcccacatttcgaagagcgacagccactgccgaccgggcttcaaaagaaacgccagccaggagagaatcgtgttaccctaatctttttcctcgggggagtcacctttgcagagatagccgctctccgattccttagccagctggaggatgggggtacagagtatgttattgctacgaccaaactaatgaatgggacctcctggatcgaagcactgatggagaagccattctag

SEQ ID NO: 140279 - DNA, 1854 bp, Artificial Sequence
  Description of Artificial Sequence: Synthetic coding sequence
atggcattcccccatcgacccgacgccccggaactccccgatttctcaatgctgaaaaggctcgccagagaccaactgatctacctgctggagcagctcccaggcaagaaagacttgttcattgaggctgatctgatgagccctctggatcggatagctaatgtgtctattctgaagcagcacgaagtcgacaaactctataaggtcgagaacaaacctgccctgtcatctaacgagcagctgtgttttctcgtgagaccccgaatcaagaatatgcgttacattgctagcctcgtcaatgccgataaacttgccggaaggacaagaaaatataaggtcatcttttcgcctcagaaattctacgcgtgcgagatggtcctcgaggaggagggcatctacggtgacgtgtcctgcgacgagtgggcgttctcactgcttccactcgatgtcgacctgctgtcaatggagctcccagaattttttcgggactactttttggaaggtgatcagaggtggataaatacggtcgcccaagccctgcacttattgtctacactttacggccctttcccaaactgttatggaattggccggtgtgccaaaatggcctacgaactatggcgcaacctggaggaagaagaggacggggaaaccaaagggcgccgccccgaaatcggccatatattcctgttagaccgcgacgtcgatttcgttacagctctgtgctcccaagtggtatatgaaggcctggtggatgacacttttcgcataaagtgcggatcggtggacttcggcccagaggtcacctcttctgataaatctttgaaggtcttgcttaacgcggaagataaggtctttaacgagatccgcaacgagcattttagtaatgtgtttggttttttatcacagaaggcgaggaacctccaagcgcagtatgacaggagaagggggatggacatcaagcagatgaagaatttcgtctcacaggaattaaaggggttgaagcaggaacatagattgctctccctgcacatcggcgcctgcgagagcattatgaagaaaaagacgaaacaggacttccaggaactgatcaagacagagcacgccctgctcgaggggtttaacatcagggagagcactagttatattgaagagcatatcgatcgacaggtatctccgatcgaatctttgcggctcatgtgtctgctgagcatcactgagaacgggctcatcccaaaggactaccggtcacttaaaacacagtacctgcagtcctacggcccggaacacctgctcactttcagtaatctgagacgggcgggcctccttaccgagcaggcgcccggcgatactttgactgccgttgagtcgaaggtgtccaagctggtcaccgacaaagcagccggtaagatcactgacgccttcagctcccttgccaaaaggtccaacttcagggccattagtaagaagctgaatctgattcctagggtggatggtgaatacgatctgaaggtccctagagatatggcatacgtgttcggcggggcctacgtgccgttgtcatgcagaattattgagcaggtccttgagcgacggtcttggcagggcctcgatgaggttgtccgcctgttgaactgctccgacttcgcctttactgacatgaccaaggaggacaaggccagttcagaatctttgcgactcattctggtcgtgttcctgggcgggtgtacattctctgagatctctgccttacgattccttggcagggagaagggatatcgcttcatttttttgaccactgcggtcaccaattctgctcggctgatggaggccatgagcgaggtaaaggcctag

SEQ ID NO: 140280 - DNA, 1719 bp, Artificial Sequence
  Description of Artificial Sequence: Synthetic coding sequence
atgtcacccctggaccgtatcgccaacgtgagtattttaaagcagcacgaggtggacaagctttataaggtcgagaacaaacctgcgctgtcctccaatgagcagctctgcttcctggtaaggcctcggatcaagaacatgcggtacatcgccagcctagtaaacgctgacaaactcgccgggagaacccgtaagtataaagtcatcttctccccacaaaaattttacgcttgtgaaatggtacttgaagaagaagggatttacggagatgtgtcttgcgacgaatgggcgttctcgctgctccctttggatgtggacctcttgagcatggaattgccagagtttttcagggactattttttggaaggcgatcagagatggatcaataccgtagctcaggccctgcatttactcagtacactgtacggaccttttcctaattgctacggcatcgggaggtgtgctaagatggcctacgagctctggaggaacctggaggaagaggaggacggagagacaaaaggccggagaccagaaattggccacattttcctcctcgaccgtgacgtggatttcgtcacagccctgtgtagccaggttgtgtatgagggactcgttgatgacacattcagaattaagtgcggttccgtggacttcggaccggaggtgacatcttctgataaatctctgaaagtcctcttaaacgccgaggataaagtctttaatgagatacgaaacgagcatttcagtaatgtgttcggctttctgtcccagaaggccagaaacctgcaggcccaatatgatagacggagggggatggatattaagcaaatgaagaattttgtctcccaagaattaaaagggctgaaacaggaacatagacttctatccttgcacataggggcgtgcgaatcaatcatgaagaagaaaacaaagcaggactttcaggaattgattaagaccgagcatgcactgctcgaagggtttaatatcagggagagcaccagctacattgaagagcacatcgatcggcaggtgtcccctattgaatccctacgattaatgtgcctactatcaattacggaaaatggcctcatccctaaagactatagatcgctgaaaacccagtatctacagagctacggtcctgagcaccttctcaccttcagcaatctgcgacgcgcagggctgttgactgaacaagcacccggcgacacattaaccgccgttgaaagtaaagtttcaaaattggtgacggacaaggcagccggaaaaatcacagatgcttttagctccctggctaagagaagcaattttcgcgcaatctcaaagaagctgaacctgattccccgagtagacggtgagtatgatcttaaagttccgcgggatatggcatacgtcttcggcggtgcgtacgtgcccctatcttgtcggatcatagagcaggtgctggaaaggagaagctggcaagggctggacgaggttgtccgcttattgaactgtagtgacttcgcattcacagatatgacaaaggaggacaaggccagctcagaatctctccgattaatcctggtggtctttctgggcgggtgcactttcagcgaaatatcagccctgcggtttctcggacgcgaaaaggggtaccggttcatcttcctcaccacggcagttacaaattcagctaggttaatggaagccatgagcgaggtgaaagcgtag

SEQ ID NO: 140281 - DNA, 2391 bp, Artificial Sequence
  Description of Artificial Sequence: Synthetic coding sequence
atgccaacgacacaacagtcaccccaagatgaacaagagaagctcctcgacgaagctatccaggccgtcaaggttcaatcgttccagatgaaaaggtgcctggataaaaacaagctaatggacgctctgaagcatgccagcaacatgcttggagagctcagaaccagtatgctgtcccctaagtcatattatgaattgtatatggcaattagtgacgagctacattacttggaggtgtacctcaccgatgaatttgctaagggccgcaaggtagcagatctctacgagctggtgcaatatgcaggcaacattattcctcgcctgtacctgttgataacagttggcgtagtgtacgtcaagagttttccccagtcccgaaaagacattctcaaagatttagtggagatgtgccggggtgtgcagcaccccctgcggggcctttttcttcgcaactatctgctgcagtgtacccgaaatatcctgcccgatgagggagagcctactgacgaggagaccaccggcgacatctccgactccatggatttcgtccttctcaattttgccgagatgaacaagctctgggtgcgaatgcaacaccagggacactcccgagatcgcgaaaaacgcgaacgcgaaagacaggagctgagaatcctcgtgggcaccaacttagtgagactatcacagctagagggcgtgaatgtggagaggtacaaacaaattgtgcttacaggaattctcgagcaggtggtgaattgccgggatgccctagcccaggaataccttatggaatgtatcatccaggtgtttccagatgaattccaccttcagactctgaacccatttcttcgagcctgcgccgagctgcaccaaaacgttaacgtaaagaacatcattatcgctttgattgatcgtcttgccctgttcgcccaccgcgaagacggccccgggatccccgccgatatcaagctcttcgatatcttcagccagcaggtggctacagtgattcagtcaagacaggatatgcccagcgaggacgtcgtgtcactccaagtgagcctgataaacctcgcaatgaagtgctatcccgacagggttgactatgtggacaaagttctcgaaacgaccgtcgagatctttaataagctgaaccttgagcatattgccaccagtagtgccgtgagtaaagagctgacccgactacttaaaattccggtggacacttacaacaatatcctaacagtactgaagttgaaacactttcatccactatttgaatattttgattacgaatcccgcaaaagcatgtcctgctatgtcctgagtaacgtgcttgattacaatactgagatcgtttcccaagatcaggtggattccataatgaacctagttagtacactgatccaggaccaaccagaccagcccgtggaggacccagatccagaggacttcgccgacgaacaaagcctagtaggccgcttcatacatctgctgcgcagtgaagaccccgaccaacagtacctgatcctcaacacggccaggaagcatttcggagcgggagggaaccagaggatcagattcacattaccacccctcgtcttcgcagcatatcagcttgcattccgctacaaggaaaactcaaaggtggatgacaagtgggagaaaaagtgccaaaagattttcagtttcgcccatcagaccatatcagcactgattaaggcggaattggcagaactgccccttcgcttgtttttgcagggcgccctcgcagccggagagattggctttgaaaaccacgagacagttgcgtatgaatttatgagccaggcttttagcctgtatgaagacgaaatttcagattccaaggcacagctggccgctattacattgatcattgggacctttgagagaatgaaatgcttctcagaggagaaccacgagccactccgcacccagtgtgcactggcagccagtaaattgttgaaaaagcctgatcagggacgtgctgtttccacctgcgcgcaccttttctggtccggacggaacactgacaagaatggcgaggagctccacgggggaaaacgcgttatggaatgcctgaaaaaggctctgaaaatagctaaccagtgcatggacccctctctccaggtgcaattgttcatcgaaatactcaaccgatacatctacttctatgaaaaggagaacgatgctgtgaccattcaggtactgaaccagctgattcagaagatccgggaagacctgcctaatttagaaagctctgaagagacggagcagatcaacaagcatttccataacacactcgaacacctccgattgcgccgggaatctcccgaatctgagggacctatctacgaagggttaattctgtag

SEQ ID NO: 140282 - DNA, 1989 bp, Artificial Sequence
  Description of Artificial Sequence: Synthetic coding sequence
atgtgtaggggagtgcagcatccgctccggggcctgtttcttcggaattatctcttacaatgcactcggaatatcctgcccgacgagggggagccgaccgacgaagagacgactggggatatttccgactctatggactttgtcctgctgaattttgctgaaatgaacaaactttgggtgagaatgcagcaccagggtcacagtcgtgatagagagaagagggaacgcgagcgacaggaactgaggattctcgtgggcacgaacctcgtgcgcctgagtcagctggagggggtgaatgtggagagatacaagcagatagtgctcaccggcattctcgagcaagtggtaaactgccgtgacgccttggcgcaggaatatctcatggaatgcattatccaagtattccctgatgaattccacctgcaaaccctgaatccattcctacgcgcctgcgcggaactccaccagaatgtgaacgtgaaaaatattatcatcgcacttattgaccgtctggctcttttcgcccatcgcgaagacgggccgggcatacctgccgacatcaaactgttcgacatctttagtcagcaggtagcaaccgtcatccagagccgccaggacatgccttcagaggacgttgtgagtctccaggtgtccctgattaaccttgcgatgaaatgctatcctgatagagtggattacgtggataaggtgctagaaacaacagtcgagatttttaacaaattaaacctagagcacatcgctacctcctcagccgtttccaaggagctaacgcgtctgctgaagatccctgtagatacatataacaatatcttgaccgtattgaagttaaagcatttccaccccctcttcgagtattttgattacgagagtcgaaaaagtatgtcctgttatgtgctgtcaaacgtgctggattataataccgagattgtttcccaggatcaagtggactcaattatgaacttagtcagcacactgattcaggaccagcccgaccagcccgtagaagacccagatcccgaagattttgcagacgagcaatctttagtcggtcggtttattcatctcctaagaagcgaggatcccgatcagcaatatctgatccttaataccgctaggaagcatttcggggccggcggtaaccagagaatacggtttacactgcccccactggtgtttgcagcttatcagctggcattcaggtacaaggagaattcaaaggtggacgataagtgggaaaagaagtgtcagaaaattttctcttttgcccatcaaactattagcgccctcataaaggccgagctcgccgaactgccacttagacttttcctccagggcgcactagcggctggcgagatcggttttgagaatcacgaaacggtggcttatgagttcatgagtcaggcgttttctctgtatgaagacgaaatctcggatagtaaggcgcaactggccgcgatcactctgattattggaaccttcgagcggatgaagtgcttttctgaagaaaatcacgagcctttaaggacacagtgcgccctggcggccagcaaactgctgaagaagcctgaccagggcagggcggtgagtacgtgtgctcacctgttttggagcggacgaaacactgataagaatggggaggaattacatggtgggaagcgagtgatggaatgcttgaagaaggccctcaagattgctaatcaatgcatggacccttctctccaggtgcagctttttatcgagattctgaatcggtacatttatttctatgaaaaggagaacgacgccatcgtcactatccaggtgttaaaccagctgatacagaagatcagagaggacctccccaacctagagtcaagtgaggagaccgagcagatcaataagcactttcacaatacactcgagcacctccgcttacgccgcgagtcacccgagtccgagggcccaatctacgaagggttaatactgtag

SEQ ID NO: 140283 - DNA, 1161 bp, Artificial Sequence
  Description of Artificial Sequence: Synthetic coding sequence
atggacagatttgtctggactagcggattgctggagatcaatgaaacgttagtgatccagcagaggggggtgagaatatacgacggcgaggagaagattaaatttgacgctggtaccctgttgctgagtactcaccggctcatttggcgcgatcagaaaaatcacgaatgttgcatggctatactgcttagccagatcgtgtttatcgaagagcaggctgctggtattgggaagtctgcaaaaattgtcgtacatttgcatccagccccacccaacaaggagccaggcccctttcagtcctcgaagaattcctacattaagctctcctttaaggagcacggccagatcgagttttacaggagattgagcgaggagatgacccaacgcagatgggagaacatgcctgtgtcccaatctttacagacaaacagaggcccgcagccagggaggatccgggccgttgggattgtgggtatcgagcgaaagctggaggaaaaaagaaaggagactgacaaaaatataagcgaggcgttcgaggatctatctaagttgatgataaaagctaaggaaatggttgaactctctaaaagcatcgcgaataagattaaggacaagcagggagatataaccgaagacgagacaattaggttcaagtcttacctgttatctatggggattgcgaatccagtgacacgcgaaacctacggtagcggaacacagtaccacatgcagttagctaaacaactggctgggatcctgcaagtaccacttgaggaacgaggtgggatcatgtcactaactgaggtgtattgtctggtgaacagagccagaggcatggaattgttgtctcccgaagacctggtgaatgcctgcaaaatgctggaagcgctcaaactgccactccgattgcgcgtattcgattctggtgtcatggttattgagctgcagtcacacaaagaagaagagatggtggcatccgccctggagaccgtatccgagaaagggagcctgacctccgaagagttcgccaagctcgtggggatgagcgtcctgttggcaaaggagaggcttttactcgctgaaaaaatgggtcacctctgccgagacgacagcgtcgaaggcctgcgattctaccccaacctgttcatgactcaaagctag

SEQ ID NO: 140284 - DNA, 558 bp, Artificial Sequence
  Description of Artificial Sequence: Synthetic coding sequence
atgtcctggctgtttcctctcactaagagcgcctcgagttctgctgcaggtagcccaggcggtctcacctcactgcaacagcagaagcagcgcctgatcgagagtctgagaaacagccatagctccattgccgagatacagaaggacgttgagtaccgacttcccttcacgatcaataatctaactattaatattaatattctgctgccccctcagtttccccaagaaaagcccgtaatatctgtgtacccccctatccgacatcatctcatggacaaacagggggtctatgtgacctccccactggtgaacaattttaccatgcacagcgatctgggcaaaatcatccagagtttgttggatgaattttggaaaaatccacctgtgctagcccccacttccaccgccttcccgtatcagttagaaattagatggcaccacccccactgcctggagatctccctggcacgatcaagcaatagtcttggtttctctattagtagcagtatctcgtctacaagatccaagcaggagtaccactttttcatatgctgctag

SEQ ID NO: 140285 - DNA, 1194 bp, Artificial Sequence
  Description of Artificial Sequence: Synthetic coding sequence
atgtcctggctgtttccattgacaaagtccgcctcgtctagcgccgccgggagccccggagggttgacgtcgcttcagcagcagaagcaacggttgatagagagtctgcgcaatagccactcctccatcgccgaaattcagaaagatgtggaatacagactgccttttacaattaataatcttacaatcaacatcaacatcttgctccctcctcagtttcctcaagagaaacccgtaattagcgtctatcccccgatcaggcatcacctgatggacaagcagggcgtgtacgtcaccagcccgctggttaacaattttactatgcattccgatttgggaaaaattattcagagcttactggatgaattttggaagaatccccctgtgttggccccgacctcgaccgcgtttccctacttgtattccaatccgagtggcatgtcaccttacgcttcacagggatttccgtttttgccgccataccccccacaagaagctaatcgctccattactagtttaagcgtggctgacacggtgagtagcagtaccacatcacacactacagctaagccagctgcgccttcctttggcgtattaagcaatctccccctgcctatacccactgtggacgcaagtattccaactagccaaaatggattcggatacaagatgcccgacgtgcccgatgccttccccgaattaagtgagctgagcgtgagtcagcttactgatatgaatgaacaagaagaggtgttattagaacaatttctgactctgccacagctgaaacaaattatcacagacaaagatgacttggttaagtcaatagaggagctcgcgagaaaaaatcttctcctcgagccctcgctggaggccaagaggcagaccgtcctcgataaatatgaattgctcacacagatgaagtcgacctttgagaagaaaatgcaacggcaacacgaattaagcgaatcatgtagtgcttccgccttgcaggcccggctcaaagtggctgctcatgaggcggaggaggagtcggataatatcgcagaagatttcctcgagggaaagatggagattgacgactttctgagtagcttcatggagaaaaggaccatttgccactgtcggagggctaaggaagagaaacttcagcaggccattgctatgcacagccagtttcatgcacctctttag

SEQ ID NO: 140286 - DNA, 1119 bp, Artificial Sequence
  Description of Artificial Sequence: Synthetic coding sequence
atgtcctggctatttcctctcactaagtctgctagctcatcagcggcagggtccccaggcggcctaacctcactgcagcagcagaagcagcgcctgattgagagcttgaggaattctcactctcgtctgctgccaccacagtttcctcaagagaaacccgtgatcagcgtttatcctcctatcagacatcatctcatggacaaacagggtgtctatgtgacttcccccctcgttaataattttactatgcactctgatcttggaaagatcatccagagcttgctggatgaattctggaaaaacccacccgtccttgcaccgacatctacggctttcccctatttgtacagtaatccctcaggcatgtctccatatgcatcccagggctttcctttcttgcccccctaccccccccaggaagccaataggtctattacctcattaagcgttgccgataccgtgtccagttccactaccagccatactactgcgaagcctgccgcaccttcatttggagtgctttcgaatcttccccttcccatccctaccgtggacgcatccatccccacctctcagaatgggttcgggtataagatgcccgatgtacctgatgcttttcccgagctgtcggagctgagtgtcagccaattgactgacatgaacgagcaggaagaagtgctgctcgaacagttcctgactctgccccaactcaaacagataatcacggataaagacgatttggtgaaaagcatcgaggagcttgctaggaagaatctcctgctggagccgtcactcgaagcaaagcgtcagacggttcttgataagtacgagctgctgacacagatgaaatcaacatttgagaagaaaatgcaacgacagcacgaacttagcgagtcctgcagtgcaagtgccctgcaagcgagacttaaggtggccgcccacgaagctgaggaagaatcagataacatcgcagaggactttctggaaggaaagatggagatcgacgattttctgagctctttcatggagaaaagaacgatttgccattgccgacgcgctaaggaagagaagctgcagcaggcaatcgccatgcactcacaattccatgcccctctgtag

SEQ ID NO: 140287 - DNA, 858 bp, Artificial Sequence
  Description of Artificial Sequence: Synthetic coding sequence
atggctggcgcggggagtgaagcacgcttcgccggtctgtccttggtgcaattgaatgaactgttagaggacgagggtcagctgacagagatggttcaaaagatggaagagactcagaacgttcagctcaacaaggagatgacactggcttcaaacagaagcctggcagaggggaacttactctaccagccccagctcgacactctgaaagcacgactgacacaaaaataccaggagctccaagttctattcgaggcctaccaaataaagaaaaccaagctcgaccggcagtcatccagtgcaagtttggaaacacttctcgcgctcctgcaggcagagggcgccaagatcgaggaggacacggaaaatatggccgagaagttcctggacggtgagctgccattggattcttttatcgacgtctaccaaagcaagcgcaagttggcacacatgcgccgagttaaaatagaaaagttgcaggaaatggtgctgaaagggcagcggttaccacaagccctggctcctctccccccacgactgcctgagctcgcccctacagccccgttgccataccccgcccctgaggcttccgggccaccagcggtggccccacgtcggattcctcccccccctcctccggtacccgctgggagactagccaccccatttaccgctgccatgagttccggccaggcagtgccctatcccggattgcaatgcccacccctccctcctagggtaggtctacctacccagcaaggcttctctagtcaattcgtgagtccatacccccctcctttaccccaaaggcctcccccaagactccccccccatcaaccaggcttcatactgcagtag

SEQ ID NO: 140288 - DNA, 1068 bp, Artificial Sequence
  Description of Artificial Sequence: Synthetic coding sequence
atggagactctgaaggacaaaacattgcaagagttagaggaactccagaacgattctgaagcaatcgatcagctggccctggagtcccctgaggttcaggacttacagctcgaacgcgaaatggcgctggccactaataggtctctggccgagcgcaatcttgagtttcaaggccctctggaaatctcccggtctaaccttagtgataggtatcaggaactgcggaagctggtcgagaggtgccaggaacagaaagccaagctggaaaagttctcaagcgcgttgcagcctggtacacttctagacctgctgcaagtggagggaatgaagatagaggaagaatcagaggcgatggccgagaagttccttgagggagaggtgcctctagagaccttcctcgagaatttctctagtatgagaatgttgagccacctgcggagagtgcgggtcgaaaagctgcaagaggtggtcagaaaacctcgagcatcccaggagttagccggagatgcaccaccaccacggcctccaccccctgtgagacctgtaccccaaggcacacctcctgttgtcgaagaacagcctcagccccccctagccatgcctccataccccttaccctatagcccatctccgtctctgcctgttggccctaccgctcacggagccctcccccctgcaccgttccctgtcgtgagccaaccctccttctactccggtccccttggccctacgtacccagctgcacaactcggcccaaggggagccgctggatattcctggagcccacagcgatcgatgccaccccggcctggttacccgggcacacccatgggggcttcaggccccgggtacccccttcgcggcgggcgggctccctcaccgggttacccccagcagagcccatatccagctaccggggggaagcccccatacccaattcagccccagctaccctcctttcccggacagccccagccctcagtgcccctgcagcctccatacccccccgggccagccccaccatacggcttccctcctccgccaggtcctgcatggcccggatactag

SEQ ID NO: 140289 - DNA, 447 bp, Artificial Sequence
  Description of Artificial Sequence: Synthetic coding sequence
atggaaacccttaaagataagactctgcaagaactggaagaactacaaaatgacagcgaggccatagatcagctggccctggagtcgccagaggtgcaggatctgcagttggaaagggaaatggccctggcaactaatagatcacttgctgagcggaacctggaatttcaaggccctctggaaatctctaggagtaatttaagcgacagataccaggagctgagaaaactggttgagcgctgccaggagcagaaggctaaactcgagaaattctcctctgccctgcaacccggtaccttactcgatttactccaggtggagggcatgaagattgaagaggaatctgaggccatggctgaaaagttcctggagggtgaagtccctctcgagacgtttcttgaaaatttttcatccatgcggatgctttcccaccttcggcgagtgtag

SEQ ID NO: 140290 - DNA, 969 bp, Artificial Sequence
  Description of Artificial Sequence: Synthetic coding sequence
atggaaactctgaaagataagacgctgcaggaattggaagaacttcagaacgacagcgaggctatcgaccagctcgctctcgaatctcctgaggttcaggacctgcagctggaacgggaaatggccttggctacaaacaggtcactcgccgaacgtaacctggaattccagggaccccttgagattagtcgaagcaatttgagtgaccggtatcaggaactccggaagctagtggagcgctgccaggaacagaaggccaaactggagaagttctcctccgcccttcagccaggcactctactggatctcctccaggtcgaggggatgaaaattgaagaagaatcggaggcaatggcggaaaagttccttgaaggcgaggttcccttagaaacatttttggaaaacttttcttcaatgcggatgctcagccatctgcgacgggtacgcgtggaaaaactacaggaagtcgtgagaaagccaagagcatcccaggaactcgctggagacgccccgccaccccgaccaccgccccccgtgagaccagtaccccaggggactcctccagtagtggaagaacagccccaaccacctttagccatgcctccttaccctttaccctactcccccagtccatctctgccagtcggccccacggctcacggagcgctgccaccggcaccctttcctgtagtctctcagccttccttttattcaggtccattggggcctacctatccagctgcccagctgggaccccgcggcgcggccggatacagctggtcaccacaaaggtctatgcctccaagaccagggtatcccgggacaccaatgggggcaagcgggccgggctacccactgcgtggcggaagggctccttcaccagggtatccccagcagtccccttaccccgcgaccggcggaaaacccccttatcctatacaaccccaactacccttttccctgtgctag

SEQ ID NO: 140291 - DNA, 756 bp, Artificial Sequence
  Description of Artificial Sequence: Synthetic coding sequence
atgtatagagctcgagccgccagggcgggtccagaacccggcagccctggacgatttggcatcctctccacaggtcagctccgagacctattgcaggatgagccaaagcttgacagaattgtcagactaagccgcaagttccaggggctgcagttggaacgagaggcgtgtctggctagcaattacgccctggcaaaggaaaatcttgccctccgaccacggttagaaatgggacgggccgcacttgcgatcaaatatcaggagttgagggaagtggcagagaattgcgccgataagctgcagagactggaggaaagcatgcaccgatggagtccccactgtgctctgggatggctccaggccgagctcgaggaagcggaacaagaagccgaggagcagatggagcagctgctacttggcgaacagagcctagaagcctttctgcctgctttccagcgagggagagcactagctcacctccgccgcacccaggccgagaaactccaggagcttttgagaaggagagagaggtccgctcagcctgctccaacctcggccgcggatccccctaaaagcttcccagccgcagcagtgcttcccaccggagcagcccgcgggcctcctgctgttccccgctcactgcctcccctggattccagaccagtccctcccctcaagggcagcccagggtgtccacttggccccgcccctctcctgagtccacgcccttcccagcccgagccacctcatcgctag

SEQ ID NO: 140292 - DNA, 2628 bp, Artificial Sequence
  Description of Artificial Sequence: Synthetic coding sequence
atgcatgatgctttcgaaccagtcccaatcctcgaaaaactgcccctccagatcgactgtctggctgcctgggaagagtggttactggtcgggaccaaacaaggacacctgcttctgtaccgcatacgcaaggacgtgggctgtaaccgcttcgaggtgaccctcgaaaagtcaaacaaaaacttctcaaagaagattcaacaaatccatgtcgtctcacagtttaaaattctagtctcactcctcgaaaacaatatctatgttcatgacctgctgactttccaacagatcacaacagtgtctaaggcaaaaggcgccagtctgtttacttgtgacttacaacatacagagactggagaggaggtcttacgcatgtgcgtggctgttaaaaaaaaactgcagctgtacttctggaaggatagagaattccatgaactgcagggagactttagtgtcccagacgtcccgaaaagtatggcctggtgcgagaattctatttgcgtgggttttaaaagggattactaccttattagagtcgacggcaagggatcaatcaaagaactctttccaacaggtaagcagctcgagcccctggttgcccctttggccgacggtaaggtggccgttggccaggatgatttgacggtggttctgaatgaggaggggatctgcacccagaaatgtgcgttgaactggaccgacattcctgtcgccatggagcatcagcctccatacatcatcgccgtgctccccagatacgtggaaattcggaccttcgagccacgcctactcgtgcaatccattgaattgcaacgcccgcggtttatcacaagtggaggcagtaacataatatacgtcgcatccaatcactttgtttggagactcatcccagtaccgatggctacacaaatccagcagctgcttcaagacaagcagtttgaactggcccttcagctggctgagatgaaagacgattctgactctgagaagcagcagcaaatccaccatattaagaacctttacgcattcaacttgttttgccagaaaagattcgatgagtccatgcaggtgttcgccaaactcggcacagatccaacacacgtgatgggtctctacccggacctgttaccgacagactataggaaacagttgcagtatccgaatccactgccggtgctgtccggcgctgagttggagaaagcccatcttgccctgatagattatctgacccagaagcgctcccaactcgtcaaaaaactgaacgactccgaccatcagagcagcacttcaccattaatggagggaacacctactatcaaatcaaaaaaaaaacttttgcagattatcgataccaccctgctgaaatgctatttacacacaaacgtggctctggtcgcacctctcttgcggttagagaataaccactgccacattgaagaaagtgagcatgttttgaaaaaagcacacaaatactcggaactcatcattctctatgaaaagaaggggttacacgagaaggccctgcaggtgctcgtggaccagagtaagaaagcaaattcacccttgaaaggtcatgaacgaactgtccaatatctgcagcacttaggtacagagaatctgcatctcattttttcatactccgtgtgggtgctcagagactttcccgaggacggcctgaaaattttcactgaggacttacctgaagtggagtcccttccacgggatcgcgtcctgggcttcctcattgaaaacttcaagggtctcgccattccatatctggagcatatcattcacgtgtgggaagagactggctcaagattccacaactgtctgattcagttgtactgcgagaaagtccaagggctgatgaaggaatatctgctcagctttccagctggtaagacccctgtcccagccggggaagaggagggggagctcggcgagtacagacagaagctccttatgtttctcgaaattagcagctactacgacccaggcagattaatttgcgatttcccatttgatgggctgcttgaagagagagcccttctccttgggcgtatgggaaagcacgagcaggccctttttatttatgtgcatatcctaaaagacacaagaatggcggaggagtattgccataagcattatgatcgaaataaggatggcaacaaagacgtatacttgtcattactccgcatgtacctctcaccgccaagtattcactgtctcggacccattaaactcgaacttctggaacctaaagctaacctccaggctgccctacaagtattggagttgcaccatagcaaattggatacgacaaaagctcttaaccttctgccggctaacactcaaataaatgacattaggattttcctggaaaaagtactggaggagaacgcacagaagaaacgatttaatcaggtgctgaagaatctactccacgccgaatttcttcgagtccaggaggagaggatcctccatcagcaggtcaagtgcatcattaccgaggagaaagtgtgcatggtgtgtaagaaaaaaatcggaaacagcgccttcgctagatatcctaacggtgtggttgttcactacttttgttccaaagaagtcaaccctgcagacacctag

SEQ ID NO: 140293 - DNA, 2661 bp, Artificial Sequence
  Description of Artificial Sequence: Synthetic coding sequence
atgcatgacgcatttgagcccgtccctatcctggaaaagctgccactccagattgactgtcttgcagcatgggaggaatggctcctggttgggactaagcaggggcatctgctgctttacagaattaggaaagatgtcgtgcctgctgatgtcgccagcccagaatctggctcctgcaaccgcttcgaggtcacactggagaaaagcaataagaacttcagcaaaaagatccagcaaatccacgtggtttcccaattcaaaattctggtcagcctgcttgaaaataacatttacgtccatgacctgctcacattccaacagatcacgactgttagcaaggccaagggggctagcctctttacatgtgatctccagcatactgagacgggtgaggaggtgctcagaatgtgtgtggccgtaaagaaaaagttgcaactgtacttttggaaggatagagagttccacgagctccaaggcgattttagtgtccctgacgtgcccaagagcatggcttggtgcgagaactcgatatgcgtgggctttaaaagagactactacctcattcgcgtagacggaaaaggatcgatcaaggagctctttcctaccggaaaacagctggaacccctggtagcccccttagcagacggcaaggtggctgtgggccaagacgatctgactgtggtgctcaacgaggaaggcatctgcactcaaaaatgcgcgcttaattggacagatatcccagtggcaatggagcaccagccaccatatataatagcagtcctacccaggtatgtagagatccgaacttttgaacctaggcttctcgtgcagagtatcgagcttcagagaccccgcttcatcacctccggtggatctaatatcatatacgtagctagtaaccactttgtgtggcgtctcattccggtgcctatggcaacccagatccagcagcttctgcaggataagcagtttgaactcgcgcttcagcttgccgagatgaaggacgattctgattctgaaaagcaacagcagattcaccacattaagaacctctacgccttcaatctattctgccaaaagaggttcgacgagagtatgcaggtatttgccaagctcggtacagaccccactcatgtgatgggactgtaccctgaccttttgcccaccgactatcgcaaacaacttcaatatcctaatcctctccccgtactgagcggggcagaacttgaaaaggctcatctcgccttgattgactaccttacacaaaaaagatctcagctagtgaagaaactaaatgattccgaccatcagtcatctactagtccactaatggagggaacaccgactatcaagtccaaaaaaaaacttctgcagattatcgatacgacactactaaaatgttatttacacacaaacgtggctctcgtagctccgctcctgaggctggagaacaaccattgccacatagaggaaagcgagcacgttctcaaaaaggctcacaaatactctgagctgattattctctacgagaagaaaggcctgcacgagaaagctctgcaggtactagttgaccagtcgaaaaaggcaaactctccactgaagggccatgaacggactgtgcagtatttgcagcacctaggcaccgaaaatctgcatttaatttttagttactcagtgtgggtgctcagggacttccctgaagacggtctaaaaatctttaccgaagacctccccgaggtggaatctctgccgagggaccgcgtgctgggctttctcattgagaatttcaaaggcctcgcgatcccttacttagagcatataatacacgtgtgggaggagactggtagtagatttcataattgcttgatccagctatattgcgagaaagttcagggcctaatgaaagaatacttactgtcatttccggctggcaagacaccggttccagccggcgaggaggaaggcgagctaggtgaatacagacagaagctgctaatgtttctggagatctcatcatattacgacccgggccggctgatctgtgactttccatttgacggcctactggaggagagagcgttgctcttaggccggatgggcaagcacgaacaggccctctttatctacgtgcatattctgaaggatactcggatggctgaggagtattgccataagcattatgatcgcaataaggacgggaataaagatgtttacctgtctttgctgaggatgtatttgtctcctccaagcatacactgccttgggcctatcaaacttgagctgctggagcccaaagccaatctgcaggccgctctccaggtgttggagctgcaccacagtaaacttgacactactaaggcattaaaccttctgcccgcaaatacccaaattaatgatatccgaatatttctggagaaggtactcgaggaaaatgcacagaaaaagcgatttaatcaggtgctcaagaatttgctccatgcagagttcctgagggtgcaggaagagcggattcttcaccaacaggtcaagtgtataatcactgaggagaaggtgtgtatggtgtgtaagaagaagatcggcaattctgcctttgcaagataccctaatggggtagtcgtacactacttttgctccaaggaggtgaatcctgccgacacatag

SEQ ID NO: 140294 - DNA, 1314 bp, Artificial Sequence
  Description of Artificial Sequence: Synthetic coding sequence
atgacaacatcaaccctgcagaaggcgatagacctggtcaccaaggccaccgaggaggataaagccaaaaattacgaggaagctctaagactgtaccagcatgccgttgagtactttctgcatgctattaaatacgaggcgcacagcgacaaggccaaggaatccatccgcgcaaagtgcgttcagtatctggatcgggccgaaaaactgaaggattatctccgttctaaggagaaacacggaaaaaagcccgttaaagaaaaccaatcagaaggaaagggaagtgatagtgactccgagggtgataaccctgaaaaaaaaaaactccaggaacagctcatgggcgctgtggttatggaaaagcctaatattcgttggaatgacgtggccgggctcgaaggcgctaaagaggctctgaaggaggcagttattctgcccatcaaatttccccatctatttacgggcaagcgcaccccctggagaggcatattactgttcggaccaccaggcacgggaaaatcctatttggccaaggctgtcgcaaccgaggctaataattcgaccttctttagcgttagctcctctgacctcatgtccaaatggcttggggaaagcgagaaactggtgaaaaacctttttgagctggcgcgacaacacaaaccgtccattatcttcatcgacgaggtggactcgttgtgcggatcaaggaacgagaacgagagcgaggctgcccggcgaataaagactgagtttctggtccagatgcaaggagtcggcaacaacaatgacggcacactggtcctgggagccacaaacataccctgggtcctagattccgcaatccgcaggcgctttgaaaagcgtatatacatccccctccctgaagaagcggcaagagctcaaatgtttcgtctgcatctgggctccactccccataaccttaccgatgctaacatccacgaattagccaggaaaacagaaggctattccggtgctgatatctctataatcgtgagagattcgcttatgcagccggtgaggaaggtgcaatctgcgacacactttaagaaggtgtgcgggcctagtaggacgaatccctccatgatgatcgacgatctgctcactccctgctcacctggcgatcctggagccatggagatgacctggatggacgtgcctggggataagctgctcgagccggtcgtctgcatgtccgacatgcttcggagtttggccacaacgcgccctacagtgaatgccgacgatcttctgaaagtgaaaaaattctccgaagactttggtcaagaaagttag

SEQ ID NO: 140295 - DNA, 1335 bp, Artificial Sequence
  Description of Artificial Sequence: Synthetic coding sequence
atgtcatcaactagccctaatctgcagaaggctatcgacctggccagcaaggccgcacaggaagacaaagcaggtaattacgaagaggctttacagttgtaccagcacgccgtgcagtatttccttcacgtcgtgaaatacgaggctcagggtgacaaggccaaacagtcaatccgggcgaaatgcactgagtaccttgacagagctgaaaaactcaaagagtaccttaaaaataaggaaaagaaggcacagaagcctgtgaaggagggccagccgtcccctgccgacgagaaaggcaatgatagcgatggcgagggggagtcggatgaccccgagaagaagaaactgcagaaccagcttcagggtgcaatcgtgatagagagacctaatgtcaagtggtccgatgtggccggactcgagggcgcaaaggaggcccttaaagaggccgtaatcctcccgattaagtttccacatctttttactgggaagcggactccttggcgcgggatacttctgttcggtccccctggtaccgggaagtcatacctggctaaggctgtggctacggaagccaataatagtaccttcttctccatctccagctccgatctcgtaagcaagtggctgggagaatcagaaaaactggtgaagaatctattccagttggcccgcgagaacaagcctagcatcatcttcatcgacgaaattgattctctgtgcggatctcggagcgaaaacgaaagcgaggctgctcggcgaatcaagaccgagtttttggtacaaatgcagggcgtcggagtggataatgatggtattttggtgctgggggcaacgaatatcccctgggtcctggactctgcaattagacgtagattcgaaaagcggatatacatccctcttcctgagcctcacgcacgcgccgccatgttcaagctgcacctgggcacgacacaaaattctttaactgaggcagacttccgcgaactggggcgtaaaacagatggctattcaggcgccgacatctcaataatcgtgcgcgatgccctgatgcagcctgtgcgtaaagtccagtctgcaacacattttaaaaaggtgcgtggcccatcgagggcagatcccaatcacctggtggacgatctgctaaccccctgctcaccaggcgaccctggtgcaattgagatgacttggatggatgtccccggagacaagttgcttgaaccggtggtgagcatgagcgacatgctgcggtccctcagcaacactaaacccaccgtcaatgaacatgacttgctgaagcttaagaagttcacagaggatttcggccaggaaggatag

SEQ ID NO: 140296 - DNA, 630 bp, Artificial Sequence
  Description of Artificial Sequence: Synthetic coding sequence
atggctgaagccgaagagcaggaaacgggatccctcgaggagtctactgacgagagcgaggaagaagagtccgaggaagaacccaaactgaaatacgaaagactctcgaacggggtgaccgagatccttcaaaaggacgcggcctcatgtatgaccgtacacgataagtttctcgcactgggcactcactatggtaaagtatatctccttgacgtgcagggaaatatcactcaaaaatttgatgtgtcaccagtaaaaatcaatcagattagtcttgatgaaagcggcgagcacatgggcgtttgttcagaggacggcaaggttcaggtatttggattgtactcgggcgaagagttccatgagacgttcgattgtcctattaagataattgccgtgcatccacactttgtgaggagctcatgtaagcaatttgtcactggggggaagaaactgctcctattcgagaggtcctggatgaacagatggaaatcggcagttttgcatgagggtgaggggaacatacgatctgtgaaatggcgtggccacttgatagcatgggctaacaacatgagcaagaagcccgaagcttggcgagtggctaagaagatgaagtcatatctaaacaactag

SEQ ID NO: 140297 - DNA, 2565 bp, Artificial Sequence
  Description of Artificial Sequence: Synthetic coding sequence
atggcagaggcggaggagcaggaaaccggtagtctggaggagagtacggacgagtcagaagaggaggaatccgaggaggagcctaagctgaaatatgagcgcttgagtaatggcgtgacagagatacttcagaaggatgctgcatcttgtatgacggtccatgataagttcctggcactcggcacacactatggcaaggtctacctattggacgtccagggcaacattacccaaaagttcgacgtatccccagtcaagataaatcagatttcgctagatgagtctggcgagcatatgggcgtctgctccgaggatggcaaggtgcaggtttttgggctctacagcggagaagaattccacgaaacattcgattgcccaataaagataatagccgtccatcctcacttcgtgcgcagcagctgcaaacagttcgttactggaggcaagaagctgctcctctttgagcgtagctggatgaaccgatggaaatccgccgtattgcatgagggggaaggcaatattcgatccgtaaaatggagaggacacctaattgcatgggccaacaatatgggggtcaagatattcgacattatttctaagcaacgaattaccaatgtccccagagatgacatctcccttcgtccagacatgtatccatgcagtctgtgttggaaagataatgtgacactaatcatagggtggggcacttcggtcaaggtgtgcagcgtgaaggagaggcatgcgagtgaaatgcgggatctcccatcacgttacgtagaaatcgttagccagttcgagacggaattctatatctctggccttgctccactctgtgatcagttggtggtgctctcatatgtcaaggaaatatctgagaaaacagagcgagagtattgcgcgagaccacgactagacattattcaaccgctctctgagacgtgcgaagaaatcagctccgatgccctgacagtgaggggattccaggaaaacgagtgccgcgattatcacctggaatacagcgaaggtgagagcctcttctacatcgtctcacctcgcgacgtggtggtcgcgaaggagagagaccaggacgatcacatagactggcttttagagaaaaagaaatatgaagaagcactgatggcagccgaaatctctcagaaaaacattaagaggcacaagatcctggatatcggcttggcctacattaaccatctcgttgaacgaggagactacgatatagctgctagaaagtgtcagaagatcctaggcaagaacgctgctctgtgggaatacgaggtatacaaatttaaggagatcggccagctcaaggctattagtccgtatctgcctcggggggatccagtcctgaaaccgttgatctatgaaatgattctccacgagtttctggaatccgattacgaaggcttcgccacgcttatcagggaatggcctggagacctgtataataattcagtgatagtccaagctgtccgggaccacctcaagaaggactctcagaataaaactctgcttaaaacccttgccgagctttatacctacgataagaactatggcaatgccctagagatttatctaacactccgacataaggacgtgttccagcttatccacaagcacaacttgttctcctctataaaagataagatcgtgctgctcatggatttcgactctgagaaggccgtggacatgctactggataacgaggataagattagtattaaaaaggtggtggaggagctggaggatcggcccgagttacagcacgtctacctgcacaaactgttcaagcgtgatcaccataaggggcagcgatatcacgaaaaacagattagcctctacgccgagtatgaccggcctaatctgctaccttttctgagggacagtactcattgtcccctggagaaggcactggagatctgtcaacagaggaacttcgtggaagaaaccgtgtacctactatcacgcatggggaactcaagatctgcactcaaaatgataatggaggaattacacgatgtcgacaaagcgatagaattcgcaaaggagcaggacgacggggaattgtgggaggacctgatcctttactctattgacaagcccccgtttattacaggccttctgaataacataggaacacacgtggaccctatcctcctcatccaccggattaaagaaggtatggagatcccgaacttacgggactctttagtaaaaatccttcaagattataacctgcagatactgttgcgggaaggttgtaagaagattctagtggccgactcccttagcttactcaagaaaatgcatcgaactcagatgaaaggcgtattagtggatgaagagaacatttgcgagagttgtttgtctcctatcctgccgtctgacgcagctaaaccattcagtgtggtggtatttcactgtcgacacatgtttcacaaggagtgtcttccgatgccctcaatgaattcggcagcccaattctgtaatatttgcagcgccaaaaacagaggacccggctcagccatacttgaaatgaagaagtag

SEQ ID NO: 140298 - DNA, 2490 bp, Artificial Sequence
  Description of Artificial Sequence: Synthetic coding sequence
atggcagaagccgaagagcaagaaacaggttcattggaggaatccaccgatgagagtgaggaggaagaatccgaagaggagcctaagctgaagtatgaacgcctgagcaacggcgtcacagagattctccagaaggatgcagccagttgcatgaccgtgcatgataagttcttggccctggggactcattatgggaaagtgtacctcctggacgtgcaggggaatataacacagaagttcgatgttgtgcaagtctttgggttgtactcaggtgaagagttccacgagacattcgactgtcccataaagattattgcagttcaccctcactttgtgaggagtagctgtaagcagttcgtcactgggggaaaaaagcttcttttatttgaacggtcctggatgaaccggtggaagagtgcggtgttgcatgaaggcgagggaaacatcaggagcgtgaagtggagggggcacttaatcgcgtgggcaaacaatatgggagttaaaatcttcgatattattagcaaacagaggataaccaatgtcccgcgggacgatatttccctaaggccagatatgtacccctgttctctttgctggaaagacaatgtgacattgataattgggtggggaacctcagtgaaagtctgcagcgtcaaggagaggcatgccagcgagatgagagatctgccctctagatacgtggagattgtgtcacagtttgaaacagagttttacatatctgggctggcccccctatgcgatcagctggtggttttgagctacgtcaaggagattagcgaaaaaacagagagagaatattgtgctcgacctaggctggacattatacagccactgtccgagacttgcgaagagatctctagtgacgccctgacagtgcgcgggtttcaggagaatgagtgtagagattaccaccttgagtactcagagggtgagtccctgttctacatcgtgtcaccccgtgatgtggtcgtggctaaggaacgagaccaagacgatcacattgactggttgttggagaaaaagaagtatgaagaagccttgatggccgcggagatctcgcagaagaacatcaagaggcacaagattctcgatataggtctcgcatacattaaccacttggtcgagaggggcgactacgatatagctgccagaaagtgtcagaagatcctcggcaaaaatgctgccctctgggagtacgaagtgtataagtttaaggaaatcgggcagctgaaagcaatttccccatacctccctagaggagacccggttcttaagccccttatttatgaaatgattctacatgagttcctcgagtctgattacgagggcttcgccaccctgataagagaatggcccggcgacctgtacaacaactctgtgattgtgcaggccgtcagagatcatctcaaaaaagatagccagaacaagacattgctgaaaacgctggctgagctgtatacatacgataagaattacgggaacgccttagagatctatctaaccctgagacacaaggacgtgttccaactgattcacaaacacaacctattctcttcaattaaagacaaaatcgtgctgctaatggacttcgattccgaaaaagctgttgacatgctgctagataacgaggacaaaattagcatcaagaaggtggtggaggaacttgaagacagaccggaattacaacacgtatatcttcataaattgttcaagcgagatcaccacaagggacagagataccatgagaagcagatctctctatacgccgaatatgatcgcccaaatttacttcctttcctgagggattctacacactgcccactcgagaaggcattagaaatctgccagcagagaaacttcgtggaagagaccgtgtacctactgtccaggatgggcaatagtcggagcgctctgaagatgatcatggaagagcttcacgatgtcgacaaagcaatcgaatttgccaaggaacaggatgacggtgagctttgggaagatctcatcctgtacagtatagataaaccgcctttcatcacaggactcctgaataatattggtacacacgtggaccccatcttgttaatacaccgcatcaaggaagggatggagatccccaacttgagggatagcctggtgaaaatcctacaagattacaatttgcagatcttgctcagggaagggtgcaagaagatcctggtcgcggattccctgtctctgctaaagaagatgcaccgcacacagatgaaaggcgtcttggtggacgaggagaatatttgcgaaagttgtctctccccaatcctccctagcgatgcagccaaaccgttttcagtggttgtcttccattgcaggcacatgttccacaaagagtgtcttcccatgccttcaatgaacagtgccgcgcaattttgtaacatatgttccgccaaaaatcgcgggcccggtagtgccattctggagatgaagaagtag

SEQ ID NO: 140299 - DNA, 1617 bp, Artificial Sequence
  Description of Artificial Sequence: Synthetic coding sequence
atggtttacacacagtcagagatcttgcagaaagaagtgtacctcttcgaacggatagatagccagaatcgggaaatcatgaagcacttgaaagctatatgtttcctccggcctactaaagagaatgtggactatatcatacaggagctgcgacgacccaagtacacgatatactttatctatttctccaatgtgataagtaagtcagatgtgaaatccctcgcagaagccgatgaacaggaagttgtcgcagaagtgcaacaagtgataactaaggaatacgaactgtttgaatttaggcggacagaggtgcctcccttgctactgatcttggataggtgtgacgatgccatcacgccactgttaaaccaatggacttaccaagccatggtgcatgaactcctaggcatcaacaataaccggatcgacctatcacgtgtgcctggaatttctaaagacttacgggaggtggttctgagtgccgaaaatgacgaattttacgctaacaatatgtatctgaactttgccgagattggaagtaatatcaaaaacctgatggaagactttcagaagaagaagccgaaggaacaacagaagcttgaatccatcgcagatatgaaggccttcgttgaaaactatccacagttcaaaaaaatgagtgggactgtctcgaagcacgtgacagtggtaggcgaactctctcgtctggtttctgagaggaacctcctggaggttagtgaagtggaacaggagttggcatgccagaacgatcattcctcggctttgcaaaacatcaagcggctgctccaaaacccaaaagtcacggaattcgatgcggcacgcctggtaatgctatatgcactgcattacgagcgacacagcagcaactccctgcccggacttatgatggacttgcggaacaagggcgttagtgagaagtatcggaagctggtttcagccgttgttgagtacggcggcaagagggttaggggttcggatctattctcacccaaggacgctgtggccatcacgaaacagtttttgaaaggcctcaaaggggttgagaacgtgtacacgcaacaccagccgttcttgcacgagactctggaccatttaatcaaaggaaggctgaaggaaaacttgtacccttacctaggcccttcaactctgagagacaggccccaggacattattgtgttcgtgatcggaggcgccacttacgaggaggcccttaccgtttataatctcaaccggacgacaccaggggtaaggatcgtgctcggcggtaccacggtgcataatactaagcgggatggcgtttctctgtgtagccctgcttggttcaggaccccagggcttaagcgttccacccgccttagcctgccgaagtgttgggactactcgtttcccagaggctcttctggattttggaccgctcagccaaaacagggagaactctcatcccatattaaagtgtccgagcagaagatgaagcgctggctcggggagggccattcatttctttcatgccctcactatcgcttctctctgctcaacaaaggagtgggtgaacaactctgggttctctgttggctattggagcttatctctaggtag

SEQ ID NO: 140300 - DNA, 1713 bp, Artificial Sequence
  Description of Artificial Sequence: Synthetic coding sequence
atgaacgtcgtgtttgccgtgaagcagtacatttctaaaatgattgaggactccggccctggcatgaaagtactactgatggataaggagaccactggcatagtgtccatggtgtatacccagtcagaaattctgcagaaagaagtctatctcttcgaaaggatagactctcaaaatagagagataatgaagcacttgaaggccatctgttttctcagacccaccaaggagaatgtcgactatatcatacaggaactgagacggcctaaatacacgatctattttatctatttttccaacgtgatatctaagtcagatgttaagtctctggcggaggccgatgaacaggaggttgtggccgaagtccaggaattctacggggactacattgcagtgaaccctcatctgttctcacttaatattcttgggtgttgccagggccgaaattgggaccccgcacagctgtctagaacaacacaaggcctgactgccttgctactgagtctaaagaagtgcccgatgataagatatcaactctctagtgaggctgcaaaacgtttggccgagtgtgtcaagcaagtcatcacaaaggaatatgagctgtttgaatttcgaagaactgaagtgccacccttgctcctgattcttgaccggtgcgatgatgccataactccactgctgaaccaatggacctatcaggctatggtgcacgaactgctgggtataaataacaaccggatcgatctgtccagggtccctggcatatcaaaggacttgcgggaggtcgtgcttagtgctgaaaacgacgaattctacgccaataatatgtaccttaatttcgccgaaattgggtctaatatcaaaaacctaatggaagactttcagaaaaaaaagcccaaggagcagcaaaaactggagtctatcgccgatatgaaagccttcgtggagaattacccacagtttaagaagatgagcggaaccgtctcaaagcatgttactgtggtgggcgagttgtctagacttgtctccgagagaaacttacttgaggtctccgaggtggaacaagaactggcttgtcaaaatgatcacagcagtgcgctgcaaaacatcaagaggttgcttcaaaaccccaaagttactgagtttgacgcagcaagattggtgatgctttatgcactgcactacgagcggcacagctccaactccttaccggggctgatgatggatcttagaaacaagggtgtcagcgagaagtaccgaaagctggtgagcgccgttgtggagtatgggggaaagagggtgcggggatctgatctgttttccccgaaggacgcagtggccatcactaaacagttcctgaaaggactgaagggtgtggagaatgtgtacacccagcaccaaccgtttctacacgagacccttgaccacctaatcaagggtcgcctcaaggagaacctgtacccttatctgggtcctagtaccctccgggaccggccacaggatattatcgtgttcgtcatcggtggcgcgacttacgaagaagcacttaccgtctacaacctgaatcggaccacccccggcgtcaggattgtcttaggtggcacgactgtccacaatacaaaatcattccttgaggaggtactcgcatcagggttgcattctagaagtaaggaatcatctcaggtgacaagccgctccgcatctcgacggtag

SEQ ID NO: 140301 - DNA, 951 bp, Artificial Sequence
  Description of Artificial Sequence: Synthetic coding sequence
atgaacgttgtcttcgccgtaaaacaatatatcagcaagatgatcgaggacagtggtcctggaatgaaagtcctcttaatggataaggagacaactgggatcgtgtcaatggtgtatactcagtctgaaatcttgcaaaaagaggtgtacttgtttgaaagaattgattctcagaatagggaaatcatgaaacacctgaaggcaatatgcttcctgaggcccacgaaagaaaacgtggactatatcatccaagaactccgcagaccgaagtacacaatttattttatctatttctccaacgtgatcagtaagtctgacgtgaagagcttagctgaggccgatgaacaggaagtggtggctgaggttcaacaggttatcaccaaggagtatgaattgtttgaattcaggaggaccgaagtgccaccactgctgctcattctggacaggtgcgatgatgccattactccattgctgaatcagtggacataccaggctatggtgcatgagctgctggggatcaataataacaggatcgacctgagccgtgtgccaggcatttcaaaggacttacgcgaggtggtactgtccgctgaaaatgatgagttctatgccaacaatatgtacctgaatttcgccgaaatcggcagcaacattaagaacctgatggaggattttcagaagaagaagccaaaggagcagcaaaaactcgagagtatagcagatatgaaagcctttgtggagaactatcctcagttcaagaaaatgagtggcaccgtgtctaaacacgtaacggtagtcggcgagctaagtagactcgtttctgagcggaacctgctggaggtgagcgaagttgagcaagaattggcttgccaaaacgatcatagcagtgccctacagaatatcaaaaggctgctgcagaatccaaaagtcaccgagttcgatgccgcgtag

SEQ ID NO: 140302 - DNA, 1305 bp, Artificial Sequence
  Description of Artificial Sequence: Synthetic coding sequence
atgaatgttgtctttgcagtaaagcaatacatttctaagatgatagaagatagtggcccgggaatgaaagtccttctcatggataaagagactaccggaatagtcagcatggtatacacacagtcagagattctccaaaaggaggtttacctctttgagagaatcgattcccagaaccgcgaaatcatgaagcacctaaaagccatttgctttctgaggcccacaaaagagaatgtcgattacataatacaggagctccggcgacccaagtatacgatctactttatttacttcagtaacgtgattagtaaaagtgatgtgaaaagtttggcagaagcagatgagcaggaggtggtcgcagaagtccagcaagtgatcaccaaagagtacgagctttttgaattccgccggacagaagttcctcctctgctgctgatactggatagatgcgatgacgctattacgccactcttgaaccagtggacctatcaggccatggtgcacgaactgctcggaataaataataatcgcattgatctcagcagagttcccggcattagcaaggaccttcgcgaagttgtgctgagcgcagagaacgacgagttttacgcgaataacatgtacctgaactttgccgagattgggtcgaatataaagaacctaatggaggacttccagaagaagaaacccaaagagcagcaaaagctggagtctatcgctgacatgaaagctttcgttgagaactatcctcagtttaaaaagatgtctgggacggtttccaagcatgttacagtggtgggcgagctctctcgactggtgagtgaaaggaacctgctggaggtatcagaggtcgagcaggagctagcttgccagaatgaccattctagcgctctgcaaaatattaagagattactgcagaaccctaaagttacagagtttgacgccgctcggctggtgatgctctatgcgctgcactatgagcggcattccagcaattcgctgccgggcctcatgatggaccttagaaacaaaggtgtatctgagaagtatcggaagcttgttagcgctgtggtcgagtacggcggaaagagggttaggggcagcgatttattctccccaaaggacgcagtcgccatcaccaagcagtttcttaaagggctgaagggtgtggagaacgtgtatacacaacatcagcccttccttcatgagaccctcgatcatctgatcaagggtcggctcaaagagaatctctacccctatctgggtcccagtacattacgggatagaatagctagctgcctgtag

SEQ ID NO: 140303 - DNA, 1338 bp, Artificial Sequence
  Description of Artificial Sequence: Synthetic coding sequence
atgaatgtcgtgttcgccgtgaatccccacctgttttctctgaacatcctcggctgttgccaagggagaaactgggatccagcccagctgagccggacaactcagggactgacagcattgttgctgtctttgaagaagtgccccatgataagatatcagctgtcctctgaggccgccaagcggctggctgaatgtgtgaaacaagttatcacaaaagaatacgagctcttcgagttcaggcggacagaggtgccacctctactgctgatcttggacaggtgcgacgatgcaattacacctttactcaatcagtggacctaccaagcaatggttcatgagctgctgggaatcaataacaatcggatcgacctttctcgcgtgcccggaatctctaaggatctacgagaagtagtgctcagtgccgaaaatgatgaattctacgctaataacatgtaccttaattttgccgagattggaagcaacatcaagaacctgatggaagacttccaaaagaagaagcctaaggaacaacagaagctcgagtcaattgcggatatgaaggccttcgtcgagaactatccccagttcaagaaaatgtcaggcactgtgagcaaacatgtgacggtggtaggcgaactgagccggttggtttctgagaggaacctccttgaggtatctgaggtagagcaggagttggcttgtcagaatgaccactctagcgccttacaaaacatcaaaagattattgcagaatcctaaggtgaccgagttcgatgccgcaagactcgttatgctgtatgctttacactatgaaagacacagctccaatagcctgcctggactcatgatggacctccggaacaagggggtgtctgaaaaataccgcaagttagtgtcagctgtcgtggagtacggcggtaaacgcgtcagaggcagcgatctgtttagtcccaaggatgcagtggcgatcaccaagcagtttctcaaaggcctgaagggggtcgagaacgtgtacactcagcaccagccgtttctgcacgagactctggatcatctgataaaaggccgtttgaaagagaacctctacccatacctcggtccaagcaccctccgggatcgcccccaggacatcatcgtttttgtcatcggcggagcaacttacgaggaggccttaaccgtctataatctcaaccgaacaacccccggcgtacgcattgtgctgggcggaactacagtccacaataccaaaagcttcctcgaagaggtgctggccagcggcctccactcccgcagcaaagaatcctcacaagtaacgagcagatccgccagtcggaggtag

SEQ ID NO: 140304 - DNA, 1128 bp, Artificial Sequence
  Description of Artificial Sequence: Synthetic coding sequence
atgagccttgcggggggaagggctccccggaaaaccgccggaaatcgtctttcaggtctgctggaagcggaggaagaggatgagttctatcaaaccacctatggtggttttacagaagaatcaggtgacgacgagtaccagggggaccagtccgacaccgaggatgaagtcgacagtgactttgacatcgatgaaggagacgagcccagttctgacggagaggcagaagagcccagacggaagaggcgtgtggtgaccaaagcttataaggagccactgaaatctctgaggccccgcaaggtcaataccccagccggcagttctcaaaaggcccgggaggagaaagccctgttaccgctggagctccaagacgacgggagcgactctaggaaatccatgcgccaaagtacagctgagcatacaagacaaacctttctgcgtgtccaggaacgccagggccagtcccgacgccgcaagggcccacattgcgaaagaccgctgacccaagaggaactgctgagagaagccaagataaccgaggagctgaatctcaggtccctcgagacatacgagagactcgaagccgacaaaaagaagcaggtgcacaagaaaagaaagtgtccaggaccgattataacataccactccgtgaccgtacccttagtcggcgagcccggccccaaagaagaaaacgtggatatcgagggtagcttatgcttctccctgtctttcgtgctccggttggacccagccccctctgttagcgctcttacccctcatgctgggaccgggcccgtgaatcccccggccagatgctccaggaccttcatcacatttagcgacgacgctacgtttgaggaatggtttcctcagggtagacccccaaaggttccagtaagggaagtttgccccgtaactcaccggccggccctctaccgagatccagttacagacattccctatgctaccgctcgcgccttcaaaattattcgcgaagcatataagaagtacataactgctcacgggctgccacccactgccagtgctctgggaccgggtcctccaccacccgagcccctgccaggatccggcccccgggccttgcgccagaagatagttattaaatag

SEQ ID NO: 140305 - DNA, 1095 bp, Artificial Sequence
  Description of Artificial Sequence: Synthetic coding sequence
atgagtctggcgggaggcagggccccacgtaagaccgccggcaacagactgtccgggctcctggaggcggaggaggaggacgagttctatcaaactacctatggcggcttcactgaggaatccggagacgatgaataccaaggtgaccagtcggacaccgaggatgaggtggacagcgacttcgacatcgacgaaggcgatgagcccagcagtgatggcgaggccgaagagcctaggcgtaaacgtcgagtggtgactaaagcgtacaaggagcctcttaaatccttacgcccccggaaagtaaatacccccgcgggctcttcccaaaaagccagagaggagaaagccctgctgcctctcgagctccaagacgacggtagcgattctaggaagtccatgagacagagcacagcagagcacacccggcagactttccttcgggtgcaagagaggcagggacagtcccgacgccgaaagggaccacactgcgaacggcccctcacccaggaagagctgctgcgggaggcaaagattaccgaggaactcaatttgcgcagtctcgagacctatgaacggctggaggcggacaagaagaaacaggtccataagaagcgaaaatgtcccgggcccattatcacctatcatagtgtcactgtgccgctggtcggcgaacccgggcctaaggaggagaacgttgatatagagggcctggatcccgcccctagtgtgtctgctcttacacctcacgccggcacgggaccagtgaatccccccgcccgatgttcaaggacctttatcacattcagcgatgacgctacattcgaagagtggttcccacagggtcggcctccaaaagtgccggtgcgggaagtgtgtcctgtcactcaccgcccggccctataccgagaccctgtcaccgatattccatacgcaacagctagagcgtttaaaataattagagaagcatacaaaaagtacatcacggctcacggtcttccgccaacggccagtgccctcggcccagggcctcctcctccagagccactgccaggatctggcccccgcgccctgcgacagaagattgtaatcaagtag

SEQ ID NO: 140306 - DNA, 1221 bp, Artificial Sequence
  Description of Artificial Sequence: Synthetic coding sequence
atggccgaaaatggaaaaaactgcgatcagcgaagagtggccatgaataaggagcaccacaatggaaattttaccgaccccagtagcgtgaacgagaaaaaaagaagagaacgcgaggaacgccagaacatcgttctgtggcgccagccattaattactctccaatatttctctctggagatcctggtgatcctgaaagagtggacttccaaactctggcaccgccagagtatcgtggtcagctttctgctcctgctagctgtgttaatcgctacttattacgtcgagggggttcaccaacagtacgtgcagcggattgaaaagcaattcttgctgtatgcctactggatcggactggggatcctctcaagtgtaggactaggaacgggactgcatacattcctgctttatctggggccccacatagcttcagtcacacttgcagcctacgagtgtaatagcgtaaacttccccgagcccccctatccagatcagatcatatgtcccgatgaagagggcacagaggggacaatttccctgtggtctattatttccaaggtgcggatagaggcgtgcatgtggggcatcgggaccgcgattggtgagctgcctccctactttatggcaagagccgcccgactgagcggggctgaaccagatgatgaggagtatcaggaattcgaggagatgctggaacatgcagaaagtgcccaagacttcgcctcccgggccaaactggccgttcaaaagttggtacagaaagttgggttcttcggcattctggcctgtgcctccatcccaaatcccctctttgaccttgcaggcatcacttgtgggcattttctggttccattttggaccttttttggcgccacactgatcggcaaggccataattaaaatgcatatccagaagatatttgtgattattacgttttccaaacacatcgttgagcaaatggtcgcattcatcggcgccgtgccaggcatcggcccttcccttcagaaaccattccaggagtacctggaagcccagcggcagaagctgcaccataaatctgagatgggaactcctcagggtgagaattggctgtcatggatgtttgaaaaactggtagttgtgatggtgtgttacttcattttatcaatcatcaactcaatggcccagagctatgcaaaacgaattcagcagagacttaacagcgaggagaaaactaagtag

SEQ ID NO: 140307 - DNA, 930 bp, Artificial Sequence
  Description of Artificial Sequence: Synthetic coding sequence
atggatctgaagtatgtgcagagaatcgagaagcagtttctcctctacgcttactggattggcctcggaatcctctcgagtgtcgggctcggcacaggccttcacacgtttctgctgtatctcggaccacacatcgccagtgtgactctcgccgcctatgagtgcaattccgtgaactttcccgagcctccctatcctgatcagatcatttgccctgatgaggaagggactgagggcactatttcgctgtggagcatcatttccaaagttcgcatcgaagcatgtatgtgggggatcggaacagctattggggagctacccccttattttatggctcgggccgcgcggctctcgggtgctgagccagacgatgaagagtaccaggagttcgaagaaatgctggagcacgccgagtctgctcaagactttgcgtcccgagctaagctggcagtccagaagctcgtacagaaggtggggtttttcggtatcttggcttgcgcatcaatcccaaatcctctgtttgacctggccggtatcacttgtgggcacttcctggtccccttttggacttttttcggggccaccctcatagggaaggctattattaagatgcatatccagaaaatattcgttataatcacattctccaaacacattgtagaacagatggttgcattcatcggcgccgttccgggtatcggaccgagcttacaaaagccgtttcaggaatatcttgaggcacagcggcaaaaattgcatcacaagtctgagatgggcactccccagggggagaactggctgagttggatgttcgaaaagctcgtggtggtcatggtgtgctatttcattctgtctattatcaacagcatggcgcagtcttacgctaagcgcatccagcagcgtctgaattctgaggaaaaaactaagtag

SEQ ID NO: 140308 - DNA, 819 bp, Artificial Sequence
  Description of Artificial Sequence: Synthetic coding sequence
atggatctgaagggacctcatatcgccagtgtgaccctcgctgcctacgagtgcaactcagtgaacttccctgaacctccttatcctgatcagataatttgccctgacgaagaggggactgaaggtaccatctcattatggagcattatctcaaaggtgcgtattgaggcttgcatgtggggaatagggacagctattggcgagttgccaccctatttcatggcgcgagccgccagactgtctggggcggagccagacgacgaagaatatcaggagtttgaggaaatgttggaacatgctgagtccgctcaagattttgcttcccgcgcaaagcttgccgtccagaagctggtgcagaaggtgggcttctttggaatcttagcatgtgctagcatcccaaaccctctgttcgatctggctggaataacgtgcggacacttcctggtgccgttttggacgttcttcggggccacgctgatcggcaaggccataattaaaatgcatatccagaaaatcttcgtcattatcacctttagcaaacatatcgtcgagcagatggtagcatttataggggccgtacccgggataggaccctctctgcagaaaccattccaggaatacctagaggcccaacgccagaaacttcatcataaatccgagatgggcaccccgcaaggggagaattggctgagctggatgtttgaaaagttggtcgtggtaatggtctgctacttcattttgagcataatcaatagcatggcccagtcatacgctaagcggatccagcagcgactgaactctgaagaaaaaacaaaatag

SEQ ID NO: 140309 - DNA, 645 bp, Artificial Sequence
  Description of Artificial Sequence: Synthetic coding sequence
atgtggggtatcggaacagcgattggcgagctacctccatattttatggcacgcgccgcccgccttagcggtgctgagcctgatgacgaagaataccaggagttcgaagagatgctcgaacacgccgagtcagctcaggactttgcaagcagggccaagctggccgtgcagaaactcgtccagaaagtaggcttttttgggatactggcatgcgcttccattcccaatccattgtttgatttagcaggaataacctgtggtcattttctggtgcccttttggactttcttcggagccacactgatcggcaaggccattatcaagatgcacatccaaaagattttcgtgattatcactttttccaagcacattgtcgaacaaatggtggcctttataggtgctgtacctggaatcggtccctccctgcagaaacctttccaggagtacctggaggcacagaggcagaagctgcaccacaagtccgagatggggacaccacaaggcgaaaactggttgtcttggatgtttgagaagcttgtcgttgtcatggtttgctacttcatcttgtccatcattaactccatggcccaatcctatgctaaacggatacagcaaagactaaattctgaggaaaagactaagtag

SEQ ID NO: 140310 - DNA, 1053 bp, Artificial Sequence
  Description of Artificial Sequence: Synthetic coding sequence
atggctgaaaacggaaaaaattgcgatcagcgccgcgttgctatgaacaaggaacatcacaatggaaattttactgatccatcatctgtgaacgaaaaaaagaggcgcgagcgcgaggaacggcaaaacattgttctgtggcggcagccactgataaccctccagtactttagccttgagatccttgttatactgaaggagtggacatccaagctgtggcacagacagagcatcgtggtctcttttctcctcctgcttgccgttttgatcgcgacctattacgtggagggtgtgcaccaacagtatgtccagagaattgagaagcagttcttattgtacgcatactggatcggcctcggcattttgtcttccgttggactgggcaccggactccacacattcctgctatacctcggaatcggcaccgctattggagaactaccaccatactttatggcccgcgcagcaaggctgtctggagccgagccggacgatgaggaatatcaggaatttgaggaaatgctagaacatgccgagtcagctcaggactttgcttcaagggcaaaactcgccgtccagaaactggtgcagaaagtaggcttcttcgggattctagcttgcgctagtatcccaaatcccctcttcgatctggcgggaattacttgcggacattttctggtgccattctggaccttctttggagctactttaatcggaaaagctataatcaagatgcacatacaaaaaatttttgtcattataaccttctctaagcacatagtcgaacagatggtggccttcatcggagccgtgccgggcatcggcccttcactgcagaagccttttcaggaatacctcgaggctcagcgacagaaactgcaccataagtctgagatgggcaccccacagggtgagaactggttaagctggatgttcgaaaagctggtcgtcgtaatggtgtgttacttcatactgtctataatcaatagcatggcgcagtcgtacgctaagagaatccagcagcgtttaaattcagaggagaagaccaagtag

SEQ ID NO: 140311 - DNA, 1443 bp, Artificial Sequence
  Description of Artificial Sequence: Synthetic coding sequence
atgtctgacgtggctatcgtgaaggaagggtggctgcataagagaggggagtacattaagacctggcggccacggtacttcctcctgaaaaacgacggtacctttataggctataaggagcgaccacaggacgtggatcagagagaagctccgctcaacaacttctccgtagcccaatgccaactgatgaagactgagagacctagacctaatactttcattatccgatgtctgcagtggacaacggtgatcgaacgaactttccatgtggaaacccctgaggaacgcgaggaatggaccacagcaatccaaacagttgccgacggcctcaagaaacaggaggaagaggagatggacttccgtagcggctcccctagtgataactcaggcgccgaggagatggaagtttcactcgccaaaccaaagcacagagtcaccatgaatgagttcgaatatctcaaactcttgggtaagggcacgttcggcaaggtcatcctggtgaaagagaaagctaccggtcggtactatgccatgaagatacttaaaaaagaagtgatcgtcgctaaggacgaggtggcccacaccctcactgagaatcgggtcttgcagaatagccggcacccttttctaacagcattgaaatattcattccagactcatgaccgattatgttttgtcatggagtatgccaatgggggagaattgttttttcacctgagtcgagaacgagtttttagcgaagatcgtgcaagattctatggagctgaaattgtttccgctctggattacctgcactccgagaaaaatgtagtgtacagggatctgaaattggaaaaccttatgttggataaggatgggcacatcaagatcaccgacttcggactctgcaaggaggggattaaagacggtgcgactatgaaaaccttttgcggtactcccgagtacctcgccccggaggtgttagaagacaatgattacggtcgagctgtggactggtggggcttgggcgtagttatgtatgaaatgatgtgcggaaggctccccttttataaccaggatcacgaaaaactcttcgagctgatcttaatggaagagattcgctttccccgtacccttgggcccgaggctaaatccctgctgagcggtctcctgaagaaggatccaaagcaaagactgggtggcgggtcggaggatgccaaggaaattatgcagcacagattttttgccggcatcgtgtggcagcatgtctacgagaagaagttgtctccccccttcaagccccaggtcacctccgaaacagacacaaggtattttgatgaagagttcactgcccaaatgatcactattacaccacctgatcaagacgactctatggaatgcgtggactctgaacggaggcctcattttccacagttctcatatagtgcgtcaggaacagcatag

SEQ ID NO: 140312 - DNA, 1443 bp, Artificial Sequence
  Description of Artificial Sequence: Synthetic coding sequence
atgtccgatgtggcaattgtcaaggagggatggctgcataaaaggggtgaatatattaaaacatggcgtcctagatacttcctgttgaaaaatgacggtaccttcataggctataaagaaagaccgcaagatgtggaccagagggaagcgcccttgaacaatttttccgtcgcccaatgtcaactcatgaagaccgagaggccaagacctaacacctttatcatacgctgtctgcagtggactacagtaattgagcgaacatttcatgttgagacacccgaagaacgcgaggagtggactactgccatccagacagtagcggacggtcttaagaagcaagaggaggaagagatggatttcaggagtggcagtccaagtgataatagcggtgctgaagaaatggaggttagtttggccaagcccaaacaccgagtgaccatgaatgagtttgagtatctcaagttactgggcaaaggtactttcgggaaggtcattctggtcaaggagaaagctacagggcgttactacgccatgaaaatcctgaagaaagaagtaatcgtggctaaggacgaagtcgcccataccttgaccgagaaccgtgtgctgcagaactcaagacatccatttctcacagccctcaaatactcattccagacccacgataggctctgctttgtcatggaatacgctaatggaggcgaacttttttttcatctgtcccgagaaagagtgtttagcgaggatagagctagattctatggggctgagatcgtgagcgctttggactatctacacagcgaaaaaaatgttgtgtaccgcgacctgaaattggagaatctgatgctggataaggacggccacatcaagattacagactttggtctgtgcaaagagggcatcaaggatggcgcaacaatgaaaacattttgcgggacacctgagtatctggcccctgaggtgcttgaggacaatgattatggcagggctgtcgattggtggggtctgggcgtggtcatgtacgaaatgatgtgtgggcggctcccgttctacaatcaggatcacgagaaactgtttgagttgattctgatggaggaaatccgttttccgcggactctgggaccagaagcaaaatctctcctatccgggcttcttaagaaagatcccaagcagaggttgggtggcgggtccgaggacgcaaaggagattatgcagcacaggttttttgcaggaattgtgtggcagcacgtttacgaaaaaaaactcagtccaccctttaaaccccaggtgacctctgaaacagatacacgatatttcgacgaggagtttacagcccagatgatcaccattacccctcctgaccaggatgactcaatggaatgcgtcgactctgaaaggcggccccattttccacagttttcttacagcgccagcggcactgcttag

SEQ ID NO: 140313 - DNA, 1257 bp, Artificial Sequence
  Description of Artificial Sequence: Synthetic coding sequence
atgaagaccgagagacctcggcccaacacgtttatcattcgctgtctgcagtggactactgtcattgagaggacctttcacgtcgaaactcctgaggagagggaggagtggaccacggccatccagactgtagcggatgggctgaaaaaacaagaagaggaggagatggacttcagatccggcagccccagtgacaacagcggggccgaggagatggaggtgtctttggccaagcctaaacaccgcgttacgatgaacgagttcgagtacttaaagttgctgggcaaaggcaccttcgggaaagtcattctggtcaaagagaaggctaccggccgctattatgcaatgaaaatcttgaagaaggaggtcatagtggcgaaggatgaggtggcacacaccttaaccgaaaaccgagtgttacagaatagccgacacccatttctgacagcactgaagtacagctttcagactcatgacagactctgttttgtgatggagtacgccaacggcggggagctgttttttcacctcagtagagagagagtgtttagtgaggatagagcgaggttctatggagctgagatcgtctcagcattagattatcttcacagcgagaaaaacgtagtctaccgcgatcttaagctggagaacctgatgctagacaaagacgggcatatcaaaatcactgactttggactgtgtaaggagggcatcaaggatggcgccacaatgaaaaccttctgcggcacccctgagtatttggcgccagaggtcctggaggacaacgactatggacgtgccgtagactggtggggcctcggggttgtaatgtacgagatgatgtgcggtaggctgcctttctataaccaggaccacgagaaactgtttgagctgatcctgatggaagaaatccggtttcctagaacactcggaccagaggccaaatcgcttcttagcggcctcctgaaaaaggacccaaaacagcgcctgggaggaggctctgaggacgctaaagaaattatgcagcacagattttttgccggcattgtgtggcagcacgtgtacgaaaagaaactcagcccacctttcaagccccaggtcacctctgagacagacacccgctacttcgacgaggagtttaccgctcaaatgattaccataactccacccgaccaggatgattctatggaatgcgtcgatagcgagcggcgaccccacttccctcagttcagctactctgcttcaggcacagcttag

SEQ ID NO: 140314 - DNA, 1443 bp, Artificial Sequence
  Description of Artificial Sequence: Synthetic coding sequence
atgtccgatgtagcaatcgtgaaggagggttggctgcacaagaggggcgaatatatcaagacttggcgccccagatacttcctgttgaagaatgacggaacttttatcggttacaaggagagacctcaggatgtggaccagcgcgaggcccccttaaacaacttcagtgtggcccagtgccaactgatgaaaacagagaggcctcggcccaacacttttattatacgatgtctccagtggacgaccgttatcgagcggacctttcatgtcgagacgcctgaagagagggaagaatggaccacagccatccaaacggtcgccgacggtctgaagaaacaagaggaggaagagatggatttccggagcggaagtccttccgataatagtggggctgaggagatggaagtcagcctggcgaaacctaagcaccgggtgaccatgaatgagttcgaatatcttaaattactcgggaagggaacttttggcaaagtgattctggtcaaagaaaaggcaactgggaggtactacgctatgaagattttgaaaaaagaagtcatcgtcgcgaaagacgaagtcgcccatacgctgaccgagaaccgggtgctgcagaatagccggcatccatttttgacggccctcaagtattcctttcagacccatgaccgattgtgtttcgtaatggaatatgccaatggcggcgaactgtttttccatctctcacgcgagagggtgttttccgaggatcgcgcacgtttctacggcgccgaaatcgtctcggctctcgattatctacattctgagaagaatgtggtatacagagatctgaaattggagaaccttatgctggacaaggacggacatattaaaatcacagacttcgggttgtgcaaggaaggtattaaggacggcgccacgatgaagaccttctgtggcacgcctgaatatctggcacctgaggtcctcgaggacaacgactatgggcgggctgttgattggtggggtcttggagtagtcatgtacgaaatgatgtgcggtagattacctttctataaccaggatcacgaaaaactttttgagttgatattaatggaggagattcggtttccccggaccttgggtcctgaggcaaagtcgctactgtctgggctgctgaaaaaagatcccaagcagaggctcggggggggcagcgaggatgctaaggagatcatgcaacacagattcttcgctgggattgtctggcagcacgtctacgagaagaaactctccccgccattcaagccacaggtcacgtccgagacggacactaggtactttgatgaggaattcacagcacagatgattaccataaccccgcccgatcaggacgactccatggaatgtgtcgattccgagcgtcggccccacttcccacaattcagttactccgcatctggcactgcttag

SEQ ID NO: 140315 - DNA, 1443 bp, Artificial Sequence
  Description of Artificial Sequence: Synthetic coding sequence
atgtcggacgtcgctattgtgaaagaagggtggctgcacaagcgcggcgagtatataaagacttggaggccaagatattttctgcttaagaacgacggcacgttcattgggtataaagagagaccccaggacgttgatcagagagaggcacctcttaacaactttagcgtcgcgcagtgtcagcttatgaaaacagaaagacccaggccaaatacgtttattattcggtgcctgcaatggacaaccgtgatcgaacggaccttccacgttgagactccggaggaacgggaggaatggactactgccattcagacagtggcagacgggctgaagaaacaggaagaagaagagatggatttccggtctggctcaccaagtgataactcaggcgccgaagagatggaggtgagcctggccaaaccgaaacaccgggtgaccatgaacgaattcgaatacctcaaacttctcggcaaagggacgttcggtaaagtgattcttgtaaaagagaaagctaccgggcgatactacgctatgaagatccttaagaaagaagttatcgttgctaaggacgaggttgcccacactctgaccgagaaccgcgtgttacagaattctcggcaccccttcctgactgctctgaaatacagtttccaaacccatgaccggctctgctttgtaatggaatacgccaacggaggggagctgttctttcatctgagtagagaaagagttttttccgaagaccgcgccagattctacggggcagaaattgtaagtgctttggactacctccattcagagaagaatgtagtatatcgagacctcaaactagaaaatcttatgctggacaaggacggacatatcaagatcaccgatttcgggctgtgcaaagaggggatcaaggatggcgccactatgaaaaccttctgtgggacaccagagtaccttgctcctgaggtcttggaagacaacgactatggtcgggcagtcgactggtggggcctgggcgtagtcatgtacgagatgatgtgtggccggctccctttctacaatcaggaccacgagaagctgttcgaacttatcttgatggaggagattaggttccctagaacactgggccccgaagccaagagcttgctgagtggcctactgaagaaggatcccaaacagaggttgggtggaggaagcgaggatgctaaggaaattatgcagcatagattttttgcaggaattgtttggcaacacgtgtatgaaaaaaaacttagcccgccattcaaaccccaagtgacttctgagactgacacaaggtacttcgatgaagagttcacggcccagatgatcacaattacacctcctgatcaggacgactcaatggaatgcgtggattcagagcgtaggccacactttccacagtttagctactcagcctcaggaactgcgtag

SEQ ID NO: 140316 - DNA, 1443 bp, Artificial Sequence
  Description of Artificial Sequence: Synthetic coding sequence
atgtctgacgtggctatcgtcaaggaaggttggctgcataagcgaggtgagtacattaaaacttggcgcccaaggtacttcctgctcaagaacgacgggactttcatagggtataaggagagaccccaggatgtggatcagagagaggcaccactaaacaacttttccgtggcacagtgtcaactcatgaagactgaacgcccacgaccaaacaccttcataattagatgcttgcaatggaccaccgtaattgagcgaacattccacgtggagactcctgaggaaagggaggaatggaccacggctatccagacagtggcggatggattgaagaaacaggaggaggaggagatggactttaggtcaggctccccctcggataacagtggggcagaagagatggaagtctctttagcaaaaccgaagcatcgtgttacaatgaatgaattcgagtacctcaagctcttaggaaaaggaacctttggaaaggtgatcttagttaaagagaaggccaccgggagatattacgcaatgaaaatcctcaagaaggaggtgatcgtggctaaggatgaagtggctcacaccctcactgaaaatcgcgttctgcagaacagtcggcaccctttcctgacagctctgaagtactcttttcagacccacgatagactgtgctttgtgatggagtacgcaaacggaggtgagttgtttttccacctgtctcgcgaaagagtgttcagtgaagatcgcgctaggttttacggcgcggaaatagtgtcagcactggattacttgcattcagagaagaatgtggtttatcgcgacctgaagttggaaaaccttatgcttgataaagacggacacatcaaaatcaccgattttggcctgtgcaaggagggaatcaaggacggagctaccatgaagaccttttgtgggacccctgaatatctcgctcccgaagtacttgaggacaatgattacggccgagccgtggactggtgggggctcggggtcgtcatgtacgagatgatgtgcgggcgcttaccattttataaccaagatcacgagaagctgttcgaattgatccttatggaagaaatccggttcccgcgcacactgggacccgaggccaagagtttgctctctggacttttgaaaaaagatcctaaacagagactcggtggcggctccgaagatgcgaaggagatcatgcagcaccggttcttcgccggaatagtttggcagcatgtgtatgagaagaagcttagccccccctttaaaccgcaggtgacatcagagactgacacccggtactttgacgaggagttcacagcccagatgattacaattacgcctcctgaccaagacgatagcatggagtgtgtcgatagcgagcgccgcccacacttcccacaattttcctattcagccagtggcacagcgtag

SEQ ID NO: 140317 - DNA, 279 bp, Artificial Sequence
  Description of Artificial Sequence: Synthetic coding sequence
atgagcgacgtcgcaatcgtcaaagagggctggctgcacaaaaggggggaatatattaagacctggaggccacgatactttctattgaagaacgacggcacctttattggctataaagagcgcccccaggacgttgaccagagggaggctccattaaacaatttctctgtcgctcagtgtcagctcatgaagacagagcgccctcggcccaacacctttatcatccggtgccttcaatggacaactgtcatcgagagaaccttccatgtcgaaacctag

SEQ ID NO: 140318 - DNA, 2421 bp, Artificial Sequence
  Description of Artificial Sequence: Synthetic coding sequence
atggcgagcggagcggatagcaagggcgacgacctgtcgacggccatcctaaagcagaaaaacagacctaacagattaattgtagatgaagccattaacgaggacaatagcgtggtgagcctgtcccagcccaaaatggacgagctgcagcttttccggggagatacggtgttgctgaagggtaagaagagacgtgaagccgtctgcatcgtgctctccgatgacacgtgttccgacgaaaagataaggatgaaccgcgttgtaaggaataatctcagagttaggttgggcgacgttatctcgattcagccgtgcccagatgtgaaatacgggaagcgaattcacgtcctgccaatcgacgatactgttgagggtatcactggcaacctctttgaagtgtacctaaaaccctactttctggaggcgtatagacccattagaaaaggggatatttttctggtgcggggggggatgcgcgcggtggaattcaaggtggtggagactgacccaagcccttattgcatcgtggcaccagatacagtgatccattgtgagggtgagcctatcaagcgagaggacgaagaagagagcttgaacgaggtcggctatgatgatatcggaggatgcaggaaacaactcgctcagatcaaagaaatggtagaactgccactcaggcatccagccttgttcaaggccataggagtgaagccccccaggggaattctgctttacggacccccaggtactggtaagaccctgatcgcgcgagcagtcgctaacgagacaggcgcgttcttcttcctcatcaatgggcctgaaatcatgagcaagctggccggcgagagtgaatctaacttacgcaaagcctttgaggaagcagagaagaatgcacctgccataatattcatcgacgaactcgacgcaatagcccccaaacgcgagaaaacgcatggcgaggttgaacggagaatcgtgagccagctcttgacactcatggacggcctaaaacagagggcacacgtgattgtgatggcagccactaatcgaccaaactctattgacccagccttgcgcaggtttgggagatttgaccgcgaggtggatattgggattccagatgccacaggcaggctggaaatcctgcagatccacactaaaaatatgaagctggccgatgatgtggacttagagcaggtggccaatgaaacacatggacacgttggcgcagacctggccgcattgtgtagcgaagcagcccttcaggcaatccgaaaaaaaatggacctgattgacctcgaggacgagacgatcgacgccgaggtaatgaatagtcttgcagtaacgatggatgacttcaggtgggcactcagccagtcgaatccctctgcattgcgcgagaccgtggtggaggtgccgcaggtcacgtgggaagacattggaggtctggaagacgtgaaaagggaactgcaggaactagttcagtatcccgtcgagcacccagacaaattcttgaagtttggcatgacccccagcaagggagtgctcttctacggccctcccggctgcggcaagaccttactcgccaaggcgatcgccaacgaatgccaggcaaactttatctcaatcaagggccctgagcttctgaccatgtggttcggtgaatccgaagccaatgtgagggagatcttcgataaggcccgtcaggctgcgccttgcgtgttgttttttgacgagctggattctatcgccaaggctagagggggaaatataggcgacggcgggggtgccgccgatcgagtgataaatcagatccttacagagatggatgggatgtccacaaaaaagaatgtctttatcatcggcgctactaatcgtcccgacatcatagacccagcaattttgagacccggtcggctcgatcagctaatctatattccgctcccggacgagaaatcacgggtcgcaatactgaaagccaacctccggaagagcccggtcgcaaaggacgttgacctagaatttctggcaaaaatgaccaatggatttagcggagccgacctgacagagatctgccagagggcatgcaaactcgccattagagagagcatcgagtcagaaatacgacgcgaaagggaaagacaaacaaacccttccgcaatggaagtagaagaagatgatcccgtacctgaaattagacgggatcacttcgaagaagcaatgagattcgcaagaagatcagtttccgataatgatatacgtaagtacgaaatgtttgcccaaaccctccagcagtcacgcggcttcggaagttttcggttcccctctggtaatcaggggggagccggtccatcccagggtagcggcggggggaccggtggctctgtttatacggaagacaacgatgatgacttgtacgggtag

SEQ ID NO: 140319 - DNA, 3669 bp, Artificial Sequence
  Description of Artificial Sequence: Synthetic coding sequence
atgtctcaacctcccccccctcccccgccccttcccccaccccccccgcctcccgaggctccacagactcccagtagtctggcaagcgccgctgccagcggaggcctgttaaagcgaagggacaggcgcatcctctcaggcagttgtccagaccctaagtgtcaggcacgactgttttttcctgctagcggctctgttagcatcgagtgcacggagtgcggccagcggcatgaacagcaacaactgttaggcgtcgaagaggtgaccgaccctgacgtggttcttcataatctgctccggaacgcccttctgggggtgacaggtgcccctaagaaaaatacggaattagttaaagtgatgggtctctccaactaccattgcaagctgctgtcaccaatcctggcacggtatggcatggataagcaaactggtcgtgctaagctgttgagggacatgaaccaaggagaactctttgattgcgcgcttctgggtgatcgggctttcctgatagaaccggaacatgtgaacaccgtcggttacggcaaagaccggtctggttctctgctttacctccacgatacccttgaggatattaagagggcgaacaagagccaggagtgtcttatccccgtccatgtggatggggatgggcactgtctcgtgcacgctgtctcccgagcactggtcgggcgagagcttttttggcacgccttgagggagaacctaaaacagcatttccagcaacatctggctcggtatcaggcactgtttcatgactttatcgacgcagcggagtgggaggatatcataaacgagtgtgatcccctattcgttcccccagagggagtgccacttggattaagaaacattcacatattcggcctggcgaatgtgcttcatcgccctataatcttactggacagccttagcggtatgaggtccagtggcgactactccgcaacctttctcccaggcctcataccggctgaaaaatgcaccggaaaggatggacatttaaataagccgatttgtatcgcctggagtagctcgggccggaaccattacatccccctcgtgggtataaagggagccgccctgcccaagctaccaatgaatctgctaccgaaagcctggggagttccccaggacctgattaagaagtatattaaattagaagaggatggagggtgcgtgataggtggcgacaggtcacttcaggacaaataccttctgaggctcgtggctgcaatggaggaggtgttcatggacaaacacgggatccatccctctttggtagcggacgtgcaccagtatttctaccggagaacgggagtgatcggtgtgcagcctgaggaggtcaccgctgctgcaaagaaggccgtgatggataatcgactgcataagtgcttgctctgcggagctttatccgagttgcacgttcctcccgaatggctggctccaggcgggaaactctataatctcgccaagagcactcacggacagctgcggacagacaagaactattcatttcccctcaacaacctggtctgcagctacgatagcgttaaggacgtcctcgtaccggactacggcatgtccaacttgaccgcttgtaattggtgccacgggacctccgtgcgaaaagtaagaggggatggctcaatcgtctatctagatggcgaccggaccaactccagaagcacgggcgggaagtgtggctgtggattcaaacacttttgggacggcaaagaatatgataatctgccagaagcttttcccatcacgctcgaatggggaggtcgcgtggttagagaaacggtatattggtttcagtacgagtctgatagctcattgaattcaaatgtgtatgacgtggcaatgaaactcgtcactaaacacttcccgggtgaattcgggtcagaaatcttggtgcagaaggtagtgcacaccatcctgcaccagaccgcgaagaaaaaccctgatgattacacccccgtcaacatcgatggggcccatgctcagagagtaggagatgtccaaggacaggaaagcgaatcccaattgcctacaaagattatcctgaccgggcagaagactaagaccctgcacaaggaagagctgaacatgtctaaaactgaaaggacaattcagcagaatatcactgagcaggcaagcgttatgcagaaaagaaagacggagaagctgaaacaggagcagaaaggtcagccacggacagtttccccctcaaccatccgtgatggccctagctccgcccccgccacgcccaccaaggcgccctattctccaaccacgagcaaggagaagaaaatccgcataacgaccaacgacggcagacagtcgatggtgacactgaagtctagtacaaccttctttgagctgcaggagagcatcgcaagggagtttaatatccctccctacctgcaatgcatccgctacgggtttccgccaaaggagttaatgcccccccaggcagggatggagaaagaaccggtgcctttacagcatggggatagaatcacaattgagattctgaaaagtaaagccgaaggcggccagagcgccgcggcacactccgcccatactgtgaagcaagaggacatcgcagtcactggcaagctcagtagtaaagaactgcaggaacaggctgagaaggagatgtacagcttatgtctgctagcaacccttatgggagaggacgtctggtcatatgcaaaaggattaccccatatgtttcagcagggaggagttttttattctattatgaaaaagacaatggggatggccgatggaaagcactgtacgtttccccatctacctgggaagacattcgtgtacaatgctagtgaggatcgcctagagttatgcgtagacgcggctggacactttcccatcgggccagatgtggaagacctggtcaaggaggccgtgtctcaggtcagagcggaggcaactacaagatcaagggagtcatctcccagtcacggcctgttaaagttaggctctggcggggtagtgaagaaaaagtccgaacagttacataatgttactgccttccagggcaagggtcactcattggggaccgcctccggcaatccccacctggaccccagagccagggagacaagcgtcgtgcgaaagcacaacaccggtaccgatttctcaaacagttcgacaaagacggaaccttctgtcttcactgccagcagcagcaacagcgagctgatcaggatcgcgcctggcgttgtcaccatgcgcgatggacgccagctggatcctgatctggtggaagcccagaggaaaaaactgcaagagatggtgagttcgatccaggcctcaatggaccggcacctcagagaccaaagcaccgaacagagtcctagcgacctgcctcagcgaaagactgaagttgtcagtagctcagccaagtccggatccctgcaaaccggcttgccagaaagttttcccctgaccggaggcacagagaatctgaacacggaaaccactgacggctgcgtcgccgacgctcttggcgcagcttttgcaactcgttccaaagcgcagcggggcaattcagtcgaggaactcgaagagatggactctcaggatgccgagatgacaaatactaccgaacctatggaccatagctag

SEQ ID NO: 140320 - DNA, 3381 bp, Artificial Sequence
  Description of Artificial Sequence: Synthetic coding sequence
atggagccgaatgattctacatcaacagccgtggaggaaccagacagcctggaggtgctggtgaagaccctggacagccagactcgaactttcatagtgggcgcccagatgaacgttaaagagttcaaggagcacattgccgctagcgtttccataccatctgaaaaacagcggctcatttaccaaggcagagtcctacaagacgataagaagctgcaggagtacaacgtgggcggtaaggttatccacctggtggagcgtgctccgcctcaaacacatttacccagtggggccagctccgggaccggaagtgccagcgctactcatggcggtggaagccctccaggaacacgggggcctggagcctctgtacacgacaggaatgctaatagctatgttatggtgggcacatttaacctcccttcagacggatccgcggtggacgtacacatcaacatggaacaagcaccgattcagagcgaaccacgagtgcggctggtcatggcgcagcacatgatcagggatatacagaccctgctgtcgcggatggagtgcagagggggtccgcagccacagcacagccagccaccgcctcaacccccagcagttacacctgagcccgtggcactgtctagccagaccagcgaacctgtcgagtccgaggctcccccccgtgaacccatggaggcagaggaggtcgaggaacgagcccctgcacagaatcctgagcttacaccggggccggcccccgccgggcctacaccagcccctgagacaaacgcacctaaccacccaagccccgcagaatacgtcgaggtcctccaggagctgcagagactcgaatcgaggcttcagcccttcctccagagatactacgaagtgctgggcgcggcagctaccacagattataataacaaccatgagggccgcgaggaggaccagcgactcatcaatttagtcggtgagagtctgagattgcttggcaacacatttgtcgctttgtctgacctgagatgtaacttggcttgcactccgcctcgtcatttgcacgtcgtccgaccaatgtcgcactatacaacccctatggtactgcaacaagcagcaattcccatccagattaacgtcgggaccaccgtcactatgacgggtaacggaacacggccgcctccaacgcccaacgctgaggctccccctcccggtcccggacaggcctcttcagtggccccatcgagtacaaatgtggagtctagcgctgaaggcgcccctcctcctgggcccgcgcctccgcctgccactagccacccgcgagtgataaggatctcacatcagagcgtagagcccgtagtgatgatgcatatgaatatccaggactcaggcacgcagccaggcggcgtcccatccgccccaactggcccattggggccgcctggacatggccagacattaggtcaacaggtaccaggcttcccaacagctcctacaagggtggtcatcgcccgacctactccaccccaggcaaggcccagtcaccccggcggccctcccgtgtccggtaccttacagggggcgggtttaggaaccaatgcatccctagcccagatggtcagtggcctggtcggccagttgttaatgcaacctgtcctggtagcacagggcactcccgggatggctcctccccctgcccctgctacagctagcgctagtgccgggaccaccaatacagccaccactgctgggccagctccagggggtcctgcacagccgcctcccaccccgcagccctcaatggcagacttgcagttctctcagctgctgggcaatctccttggtcccgcaggtcctggagccgggggctcgggggtggcgagcccaaccatcacagtggccatgcccggcgtcccagcgtttctgcaggggatgactgatttcctccaagctacccaaaccgcacccccaccgccaccccccccaccgccgccaccgcccgcgcctgagcagcagacgatgcctccccccgggagtcctagtggtggggctggatcgccaggaggactggggctggagagcctctcacccgagttcttcacgagcgtcgtgcagggtgtgctcagcagcctgctgggcagcttaggcgctcgggcaggtagcagcgagtccattgcggccttcatacagcggttgtcgggctcctctaacatctttgagcccggggccgacggggccctcggcttctttggagcactgctgtccctgctttgccaaaatttttcgatggtcgatgtggtcatgctgctgcacgggcattttcagcccctgcagaggctccagcctcagctccggtcattttttcaccaacactatctcggcgggcaggaaccgacccctagcaacattagaatggcaacacatacactaatcacaggactggaggaatacgttagggagagcttcagtcttgtccaggtgcagcctggagttgacattatacggaccaacctggagtttctgcaagagcagttcaactctatcgccgcgcatgtgctccactgtaccgattccggattcggcgcaaggcttctcgaactgtgtaatcaggggctctttgaatgcctggccctcaaccttcactgcctgggcgggcaacaaatggagcttgctgccgtgattaacggtcggatcaggagaatgagccgtggggtgaacccatcattagtgagctggctcacgaccatgatgggcttgagactacaggtggtgctcgaacatatgccagtaggtcccgatgccattctccgctatgtaaggagggtcggcgacccccctcaacccctgccggaagagccaatggaagtgcaaggagctgagcgtgcatcccctgagccacaacgcgagaatgcgtcccccgctcccggaacaaccgcagaggaggctatgtcacgcggtccaccccctgcgcctgaaggagggtccagagacgagcaagacggggcctccgcagaaaccgaaccctgggcagcagcggtgccacctgagtgggtccctattatccagcaggacatccagtcccagcgtaaggttaaacctcagccaccactgagtgacgcctatttatcgggtatgccggccaaacggcggaagacgatgcagggagaaggaccccagctcttactgtcagaagcggtctcgcgcgccgctaaagcggcaggggctaggcctctcacatcccctgagagtctctcgagagacctggaggcccctgaagtccaggaaagctatcggcaacaactgcgctcagatatacaaaaacgattgcaggaagacccaaactattcaccccaacgttttccaaacgcacagagggcttttgcagatgacccatag

SEQ ID NO: 140321 - DNA, 3795 bp, Artificial Sequence
  Description of Artificial Sequence: Synthetic coding sequence
atgtctacactgtatgtatctcctcaccccgacgccttcccatctcttcgcgccctcatagcagcccggtatggcgaagccggggaaggcccaggatggggcggagcccacccacgaatttgcctgcagccccctcccaccagcaggacaccttttccccctcccagacttcccgccttagaacagggtccgggcggtctgtgggtgtggggggctacggctgtggcgcagctcctgtggcctgccggcctgggaggtcctggcggatcccgggcggctgtactcgtgcagcaatgggtgtcttatgcagataccgaactgatccctgccgcctgcggtgctacactgcctgccttgggccttagaagcagtgcgcaagacccacaggcagtcctgggcgctctcggacgagctctgtccccactcgaagaatggctacgtctccacacataccttgccggtgaagctcccactctggctgacttggcagctgtaactgcccttttgctgccttttcgctacgtactggatcctcccgcccgaagaatttggaataacgtcacaagatggttcgtcacctgcgtgcggcaaccagaatttcgcgctgtgctgggtgaagtcgttctttactctggcgcccgccccctctcccaccagcctggccctgaagcaccagccttacctaagaccgcggcacagctgaaaaaggaagctaaaaaacgcgaaaaactagaaaagttccagcaaaagcagaaaattcagcagcagcaaccgccccccggtgagaaaaagcctaagcctgagaagcgcgagaagcgcgaccccggagtgattacctatgacctgccaacgcctcctggtgagaagaaagacgtgtcaggaccaatgcccgacagctattccccccggtatgtggaggctgcttggtacccatggtgggagcagcagggattttttaagcccgaatatggcagacctaacgtgagtgcagcaaacccaagaggcgtgtttatgatgtgcatcccacctcctaatgtaacagggtccctacacttaggacacgcgttgaccaacgcaattcaggattccctcactaggtggcacaggatgcggggcgagacaactctctggaatcctggttgtgatcacgccggaatcgccacacaagtcgtagtcgaaaaaaagctgtggagggagcagggacttagcagacatcaactgggtagagaagccttcctccaggaggtatggaagtggaaagaggagaagggggaccggatctaccaccaacttaagaaactgggatcttcactggattgggatagagcatgttttaccatggatcccaagctgtccgctgctgtgaccgaggctttcgtgagactgcacgaggagggcatcatataccggtccacgagattggtcaactggtcctgtaccctgaacagcgccatctcagatatcgaagttgataaaaaggaactgacgggacggaccctgctgtctgttccagggtataaagagaaagtcgagtttggtgttctggtgtcgttcgcttataaggtgcagggatcggattctgatgaggaagtggttgtagctaccactcggatcgaaaccatgctcggggatgtggcagtcgcagtccatcccaaggacacacgttatcagcatctgaaaggcaagaatgtgatacacccattcctctctcgaagcctgcccatagtcttcgatgaattcgtggacatggatttcggtacaggggccgtgaagatcactccagcccacgaccagaatgactatgaagtcggccagcgtcatgggctggaagccatttcaatcatggacagccgaggcgccctgattaatgtgccaccgccttttttgggtttaccaaggttcgaggccaggaaggcagtgctggtggctctgaaggaaaggggtctattccgcggaatcgaggacaacccaatggtggtcccactttgtaaccgctctaaagacgtcgtggaacccctcctgaggccacagtggtatgtccggtgcggagaaatggcccaggccgctagtgctgccgttacccgcggagacctgcgtattctgcccgaagctcaccagcggacttggcatgcttggatggacaatattcgcgagtggtgcatttctcgtcagctatggtggggacacaggattccagcctatttcgtcacggtgagcgatccagctgtacctcccggagaggatcctgacggccggtattgggttagcggcagaaatgaggcggaagctcgcgaaaaggctgcaaaggagtttggggtttcaccagacaagatttcactccagcaggatgaagatgtactcgacacctggttctcttccggattgttccccctctccatcctgggttggcctaatcagtcagaagacctgagcgtgttttatcctggaaccctcctggaaaccggtcacgatatcctgtttttttgggtggctcggatggtcatgctggggttaaagctgaccgggcggttgccattcagagaagtttatctgcacgccatcgttcgcgatgctcacggaagaaaaatgtctaagtcgctcggaaacgttatcgaccctttagacgtaatctatggcatcagtcttcagggcttgcacaatcagctgctgaactctaacctggacccaagtgaagtggagaaggcaaaggaggggcaaaaggccgactttcctgctggcataccagagtgtggaacagacgcccttcgtttcggcctctgcgcctatatgtcccagggaagggacattaacctcgacgtgaaccggatcctgggctatagacatttttgcaacaaactgtggaatgccactaagtttgcactgcgcgggctggggaagggcttcgtcccctctcccacctcacagcctggaggccacgagagcctcgttgaccgctggattaggtcccggctgactgaggcagttcgactctcaaatcaagggttccaggcttatgatttccccgccgtgacaactgcacagtatagtttttggctatatgaactctgcgatgtttatctggagtgtttaaagcccgtgcttaacggggtggatcaggtggcagccgaatgcgctcggcagacactctacacatgcctggacgtgggactcaggcttctgtctccttttatgcccttcgtcaccgaggagctattccagagattgccaaggcgaatgccccaggcacctccaagtctgtgtgtgactccataccctgaaccttctgaatgctcatggaaagaccctgaggctgaagctgcgctcgaactcgcactgtccatcactcgcgccgtgagatcgctcagggccgactacaatttaacaaggattcgccctgattgctttcttgaagtggctgatgaagccactggagcactagcgagtgctgtgtccggctacgtgcaggctcttgcctctgctggcgtcgtggcggtgctggcactgggggctcccgcaccccagggctgtgctgttgctctagccagtgaccgatgttccattcatctacagctccagggattagtggacccggcgcgagagctgggtaagctgcaggctaagcgagtcgaggcccaacggcaggctcagaggttacgcgagcgacgcgcagcttcaggttaccccgtgaaagtacctctcgaggttcaggaagcagatgaagcgaagctacagcagacagaagctgagctccgcaaggtggacgaggctatagcgctgttccagaaaatgctgtag

SEQ ID NO: 140322 - DNA, 525 bp, Artificial Sequence
  Description of Artificial Sequence: Synthetic coding sequence
atgtctaccttatacgtctccccccatccagacgccttcccctcactgcgagccctaatcgctgccagatacggcgaagccggcgagggcccgggttggggcggagcccaccccagaatctgtctccagcctccgccaactagccgcaccagctttcccccccctcgcctgccagccctggagcaggggcccgggggcctctgggtctggggggcaaccgcggtcgcccagctgctgtggcctgcgggcctcggcgggcccgggggatcccgcgctgccgtgctggtgcaacaatgggtcagctatgctgataccgagttgattcccgcagcatgcggagcaaccctgcctgccctgggcctccgctctagcgcccaagaccctcaggcagtcctgggcgccttgggaagggcattgtcccctttggaagaatggctcaggcttcacacctacctggcaggggaggcaccaaccctggcggatttagcagccgtaacagctttgctcctgccgttccgctattag

SEQ ID NO: 140323 - DNA, 525 bp, Artificial Sequence
  Description of Artificial Sequence: Synthetic coding sequence
atgagcacactttacgtgtccccccatcctgatgctttccctagcttgcgtgctctgatagccgcccggtatggagaggcgggggaagggccaggatggggcggcgcgcacccccggatttgcctgcagcctccaccaactagccgaacttctttccctccgcctcgcctgccagctctggaacagggtcctggcggcctttgggtttggggagcgaccgccgtcgcccaactcctctggcctgctggcctaggcggcccgggaggctcccgggccgcagttcttgtccagcagtgggtaagctacgctgacacagagctaatcccggcagcctgcggtgccaccttgccggcactcgggctgagaagttctgctcaggacccccaggccgtgctgggcgccctgggccgggccctctccccactcgaggaatggttgcgcttgcacacgtacctagctggagaggcgccaacactcgccgacctcgctgcagtgaccgcactcctgctcccttttcgttattag

SEQ ID NO: 140324 - DNA, 867 bp, Artificial Sequence
  Description of Artificial Sequence: Synthetic coding sequence
tgaaaggagagaggtctgtttagaggcattgaggacaaccccatggtggttcccctgtgcaacagatccaaagacgtcgtggagccactcctcaggccccaatgggagtggtgcattagtcgccagctatggtggggacatcgcattccagcctacttcgtgacagtcagtgatcccgccgtgccacccggcgaggaccctgatggccgatactgggtgtccgggcggaacgaggccgaagctagagagaaggccgcaaaggagttcggcgtgagcccagataagatcagcttgcaacaagatgaggatgtgctcgacacctggttctctagtggcctcttcccactttcaattttgggatggcctaaccagagtgaagatctctccgtattctatcccggaacactgctagagactgggcacgatattctatttttctgggtagctagaatggtgatgctaggtctcaagttaaccgggcgactacccttccgtgaagtctatctacacgccatcgtgagggatgctcatgggcgaaagatgtctaagagcctgggaaatgtaatcgatcctctggacgttatttacgggattagccttcaagggctgcacaaccaattactgaacagtaacttagacccttccgaggttgaaaaggccaaagaggggcagaaggccgacttccccgctggcattcccgagtgcgggaccgacgcactgagattcggtctctgtgcctacatgagccaaggccgagatattaatttagacgtgaatcgtatactgggttacagacatttttgcaataaactgtggaacgccacaaaattcgccctcagaggtttgggtaaaggctttgtcccgtag

SEQ ID NO: 140325 - DNA, 3795 bp, Artificial Sequence
  Description of Artificial Sequence: Synthetic coding sequence
atgagcactttgtatgttagtcctcatccggatgcttttcccagcctgagggccctcattgccgcaagatacggcgaggccggcgagggacccggatggggcggtgctcaccccagaatctgccttcagccaccacccacctcccgcacctcatttccgccccccaggctacccgcactggagcagggtccgggcgggctctgggtctggggcgccacagcagtggcccagcttctctggccagctggtctcggaggccccggcgggtccagggctgctgttttagtgcagcaatgggtcagctacgctgataccgagctaattcctgctgcctgcggtgcaacactgcccgccctaggcttgagaagttccgcccaggacccacaggcagtcctgggcgccttaggccgggcattatcaccgttggaggaatggctgaggcttcacacgtatctcgccggggaggcccctacactcgctgacctcgcagccgtgaccgcactcctgctgccctttcgctacgtccttgaccctcctgcccgccgtatatggaacaacgttacccgctggttcgtgacgtgtgtgagacagccggagttccgagcggtactgggcgaggtggtgttgtacagcggagctcgccccctctcccaccagcccgggcctgaggccccggccctgcccaaaaccgcagcgcaactcaagaaagaggccaaaaagagggagaaactggagaagttccagcagaagcaaaaaatccagcagcagcagccacctcctggggagaagaaacccaaacctgagaagcgagagaaaagggatcccggggtgatcacctatgatttacccacaccaccaggtgagaagaaagacgtctctggacctatgcccgactcctattctccaagatacgtcgaggctgcttggtatccctggtgggagcagcaaggcttcttcaaaccagaatacgggcgccccaatgtctccgcagctaatccccgtggcgtttttatgatgtgcatccctcctcctaacgtaaccggctcacttcacctaggacacgctcttactaatgctatccaagactccctaacacggtggcatcgaatgcggggagaaaccacactgtggaatcctggttgtgatcatgccggcatcgccacgcaagtcgtagtggagaaaaaactgtggagagagcaaggcctctcccgccatcagcttgggcgcgaggctttcctgcaagaggtatggaagtggaaggaggagaagggagataggatttatcatcagctcaagaaactgggaagttctcttgattgggatcgcgcatgttttaccatggacccaaagctgtcagctgcggtgactgaagctttcgtcagactacatgaagagggtataatatacagatccactcggttggtcaattggtcatgtacgttaaatagcgcaatctctgatattgaagtggataagaaggagttgactggtcgcacactgttaagtgttccaggctacaaggaaaaggtagagtttggtgtcctcgtgtccttcgcttacaaagtgcaggggagtgattcggacgaggaggtggtcgtggctactacgcgcatcgaaaccatgttgggtgacgttgcagtcgccgtccacccaaaggatactcggtaccagcacctgaaaggtaagaatgttatccatcccttcctgagcagatccctacctatcgtttttgatgaattcgtggacatggactttggcaccggagccgtcaaaataacacctgcccacgatcagaatgactatgaagtgggccagcgtcatggtttagaggcaatctcaatcatggattcacgaggcgccttaatcaacgtcccaccaccatttttggggctaccacggtttgaagctcggaaagccgtacttgtggctctcaaggagagaggcctctttcgtgggatagaagacaatccgatggtggtgccattgtgtaatagatccaaagacgtggtggaacctctcctgcggccacagtggtatgttagatgtggagagatggcccaagcagcgtcagcagctgtgacacgcggggatctgcggatcctccccgaagcccaccaaagaacttggcatgcatggatggacaacattagagagtggtgtatctctcgccagctttggtggggacatagaatccctgcatattttgtaacggtgagtgaccccgcagtgcccccaggagaggatcctgacggtcgatactgggtcagcggcaggaacgaggctgaggcccgcgagaaggcagccaaagagtttggggtgagtccagataaaatttccttacaacaggacgaggacgtccttgacacatggtttagttctggccttttcccacttagtatcctgggctggccaaaccagagcgaggacctgtccgtgttttatccaggaaccttgttagaaaccggccacgatatcctattcttctgggtggcccgaatggtaatgttggggctgaagcttacagggcgcctgccattcagggaggtgtacctccatgcgatcgtaagggatgcacatgggagaaagatgtccaaatccctaggcaacgttattgacccactggatgtaatctacgggatttctctccagggtctgcataaccagctgctgaactctaacctggacccctcagaagtcgagaaggctaaagaaggccagaaggccgactttcctgctggaatcccagagtgcgggactgacgctctcagattcggcctgtgcgcttacatgagccagggacgggacatcaacctcgatgttaataggattctcgggtatcggcacttttgtaacaagctgtggaatgcgaccaagttcgctcttagaggcctgggcaaggggttcgtgccttcgccgaccagtcagccaggcggccacgagtccctggtggatcgctggattcgatcacgattaactgaggcggtgcggctgagtaaccaagggtttcaagcatacgactttccggctgtcacaactgcccagtatagcttttggctgtacgagctctgtgatgtttacctcgagtgcctgaaaccggttcttaacggggtggatcaggtggctgctgagtgtgccagacaaacactgtacacctgcctagacgtggggctgcgcttactctctcccttcatgccattcgttactgaggagctgttccaacggttgcccaggcgaatgccacaggcccctccgagcttatgcgttaccccatatcctgagccttcagagtgttcctggaaggatcctgaggccgaagcagcactggaactggccctatcaataacccgtgcggtgcggtctctccgggctgactacaatctgacccggatccgccctgactgtttcctggaagttgccgatgaggcgaccggggccctcgcgtctgcagtttctgggtatgttcaggctctcgcatcagcaggcgtggtcgctgtgcttgccctcggcgcccccgccccacagggatgcgccgtcgcacttgcctccgaccgctgttcaattcacctgcaacttcagggtttagtcgaccccgcccgggagctaggtaagctgcaggcaaaacgagtcgaagcccaaagacaggcccagaggctgagggagcggcgcgctgcttccggctatcccgtcaaggtaccactcgaggtgcaagaagccgacgaggctaagttacagcagaccgaggctgaacttcgaaaagtcgatgaagccatagccctgttccagaaaatgttgtag

SEQ ID NO: 140326 - DNA, 1101 bp, Artificial Sequence
  Description of Artificial Sequence: Synthetic coding sequence
atgtcgactctctatgtttctccgcaccctgacgcattcccttcgctgagggcactcatcgcggcacggtacggtgaggctggtgaaggccccggatggggcggcgcccaccctaggatatgccttcagccccccccaactagtagaacaccctttccgcctccccggctgccagccctcgaacagggccctggtggcctctgggtttggggagccaccgctgttgcccagctgctgtggcctgccggcctcggcggcccaggaggcagtagggcagccgtgctcgtgcagcagtgggtgagctatgctgacactgagctaattcccgctgcatgtggcgcaaccctccccgccctcgggctgagatctagtgcacaggacccgcaagcagtgctgggcgcgctgggaagagccctgtcacccctggaagaatggttgcgactccatacttacctcgcaggtgaggcgcccacattagccgacctcgccgcggtcactgcgctcctgctccccttccgttacgtgctcgacccccctgcacggcgcatttggaataacgtgacacggtggttcgtgacctgcgtgcgccagccggaattccgcgctgtccttggagaagtagtgttatactctggggctagacctctctcccaccagcctggcccagaggcgcctgccctccctaaaacagctgctcaactgaaaaaggaggctaagaagcgcgaaaaactcgagaaattccagcaaaagcagaagatacagcagcagcaacccccccccggcgaaaaaaagcccaagcccgagaaacgtgagaaaagggacccaggtgttatcacttatgatctccccacccccccaggggagaagaaggacgtaagcgggcccatgccggactcatacagccccagatacgtggaggccgcctggtacccctggtgggagcagcagggcttctttaagcctgaatacggtcgcccaaatgtatctgccgccaatcctcgtggtgtcttcatgatgtgcatacccccacccaatgttacagggagtttgcacctggggcatgccctgacaaacgctatccaggactcgctgacccgatag

SEQ ID NO: 140327 - DNA, 525 bp, Artificial Sequence
  Description of Artificial Sequence: Synthetic coding sequence
atgtctacactttacgtatccccacaccctgacgcctttcctagcctcagagccctgattgcagctagatacggagaggccggggaaggtcccggttggggcggggcccacccaaggatctgcctacagcctccccccacatctaggactccttttcctccgcccaggttgcccgcgttagagcagggccccggaggactgtgggtatggggagctacagctgtcgctcagttattgtggccggccgggctcggaggccctggaggctctcgggccgcggtgctagttcagcagtgggtatcgtacgccgacactgagctgatacctgctgcgtgcggtgccaccttgcccgcccttgggctaagaagtagcgcacaggatccacaggctgtgctgggagcactgggtagagcccttagccctttggaagagtggctacgattgcacacctacctcgccggcgaggccccaacactggctgatctggcggctgtgactgccttgctgcttccgttccgctattag

SEQ ID NO: 140328 - DNA, 3552 bp, Artificial Sequence
  Description of Artificial Sequence: Synthetic coding sequence
tgagggctcggaggtcccggaggctcaagggcggctgtactggtacagcaatgggtctcgtatgctgatacagaattgatacccgccgcttgcggggccactctccccgcacttggcctgcggagctccgctcaggaccctcaggcagtactgggcgctttggggcgggcactgagcccgttggaagagtggttgcgcctgcatacctacttagcaggagaggcaccaacattagctgatctggcagctgtgaccgccctgcttcttccgttccgatacgtgctggacccacctgcacgccgcatttggaacaacgtaacccgttggttcgtgacatgtgtgcggcagcccgagtttcgcgccgtcctaggcgaagtcgtgctctactctggcgctcgccctctgtcccatcagcccggacctgaagcacctgcattgcctaagactgccgcccagctgaagaaagaggccaaaaaaagggagaaattagaaaaatttcagcaaaagcagaagatccaacaacagcagcccccaccaggcgaaaaaaagcccaagcccgagaagagggagaagcgcgatcccggcgtgattacatacgacctgccaacacccccaggtgagaagaaggacgtgagcggaccaatgcctgattcatactcaccacgctatgtcgaagccgcatggtatccatggtgggagcaacagggcttctttaagcctgagtatgggaggccaaacgtctccgctgcaaaccctagaggagtgtttatgatgtgtatccccccccctaatgtcactggctctctccacttaggacacgcgctaacaaacgccatacaggacagcctcactaggtggcacagaatgaggggggagaccacgctctggaaccccgggtgtgatcatgccggcattgctactcaggttgtcgtggaaaaaaagctctggcgcgaacaggggttgagcaggcaccagctgggcagggaggctttcctccaggaggtgtggaagtggaaagaggagaagggagacagaatctaccaccaactgaaaaagctggggtcaagcctggattgggatagggcatgttttaccatggaccctaaacttagcgcggctgtgactgaagcgttcgtccggttgcacgaggaagggataatctatcgatcgacccgccttgtgaattggagttgcactttgaacagcgctatctcagatatagaagtggacaaaaaagagctcacaggcagaacccttctgtccgtccctggctataaagagaaggtggaattcggggtgttggtttcatttgcatataaggtccaaggctctgattctgacgaggaagtggtggttgcaactacgcgcatcgaaacgatgttgggagatgtcgccgtggcagtacacccaaaggatactagataccagcacctcaaagggaaaaacgtgatccatccctttctgtcccggagcctgccaatcgtgtttgatgaatttgtagacatggacttcggtacaggtgctgtgaaaatcactcctgcgcatgaccagaacgactatgaggtgggacagagacatgggctcgaagccatctcaattatggacagtcgaggggccctcatcaacgtcccccccccctttctggggctgccccgcttcgaggctcgcaaagccgtgctggtcgccctgaaagaaagaggactgttccggggaatagaggataatcctatggtcgtccccctctgtaacagatcgaaggatgtggtagagcccctcttgagaccgcagtggtacgtacgatgcggagagatggcacaggctgctagcgccgccgtgacacgtggggacctacgcatcctccccgaggcccatcagagaacatggcatgcatggatggataacattcgggaatggtgcatctctcgccaactatggtgggggcaccgcatcccggcatacttcgtgacagtctccgatccagccgtgccccccggggaagatccagacgggcgctattgggtttctggccgcaacgaagctgaagcccgggaaaaggcggctaaggagttcggcgtttcccctgataagatatccctgcagcaagacgaagacgtgctcgatacctggtttagcagcggcctgttccccctctcaatcctcggctggcctaatcagagtgaggacctgtccgtcttctaccccgggaccctgttggaaacaggccatgatattctctttttctgggtggccagaatggtgatgttagggctgaaactgactggccgcctgcctttccgcgaagtgtatctgcacgcaatagttagagatgcacatggtaggaaaatgagtaagtcattagggaatgtgatcgaccccctcgacgtcatttatgggatctctttacagggactgcacaaccagctccttaactcaaacttagatccttctgaagtggaaaaggccaaagaggggcagaaggccgacttccccgccggtattcctgagtgtggtactgatgcactgaggtttgggctctgcgcctatatgtcacaggggcgcgacatcaacctcgacgtaaatcgcatcctgggataccgacatttctgtaacaaactgtggaacgctaccaagttcgccttgcgcgggctgggtaagggattcgtgccatcccccacttctcagcccggggggcatgaatcactggtggatcgatggatacgttcaagactaactgaagccgtgcggctgtccaatcagggctttcaggcttacgacttccctgccgtgacgacagcccagtacagcttctggctctacgagctatgcgatgtatacctggaatgcttaaagccagtgctcaatggcgtcgatcaggtggcggccgaatgcgcccgacaaactttgtacacctgtctggacgttggactgaggctgctgagccctttcatgccttttgtgacagaggaactctttcagagactgccaagacgaatgccgcaggcccccccttcactgtgcgtgaccccgtatccagaaccctccgagtgttcttggaaggacccagaggctgaggccgcattagaactggccctttcaattacacgcgctgttaggtctctgagggccgactataatctgacaaggattcgacccgactgctttcttgaagtagccgacgaagccactggggccctagccagcgccgtgtcaggttacgtgcaggcactggctagcgccggcgttgtggccgtcctggcgctgggagcaccggccccgcaggggtgcgctgtggcgctagcttccgatagatgtagtatacatctacagttgcagggcctggttgatccagctagagagctgggcaagctacaggccaagagggtggaagcccaacgccaggcgcagaggctgagagagcgcagggcagcctccggatatccggtgaaagttcctctggaggtgcaggaggcggatgaagcaaagttgcagcaaactgaagcggaactgcgcaaggttgatgaggccatcgccctatttcagaagatgttgtag

SEQ ID NO: 140329 - DNA, 525 bp, Artificial Sequence
  Description of Artificial Sequence: Synthetic coding sequence
atgtctacactctatgtctccccccatccagatgccttcccgtcactgagggctcttatcgccgcacggtacggggaggctggggagggacctggctggggtggcgcacatcctaggatctgtttacagcctccccccacgagtcgtacgccctttcccccacctcgcctgccagccctcgagcagggtcccggggggctgtgggtgtggggagcaaccgccgtggcccagctgctgtggccagctggcctgggcgggccaggaggttctagagccgcagtgcttgttcaacagtgggtctcttacgccgatactgagctgattcctgctgcttgcggggcgactcttccagcacttggcctgcgcagctcggctcaggatcctcaggccgtactcggggccctcggccgggccctgtcccccttagaagagtggcttaggctgcacacctatctggcaggagaggcccccaccctcgctgatctcgccgccgtgacagcactgctcctccctttccgatactag

SEQ ID NO: 140330 - DNA, 867 bp, Artificial Sequence
  Description of Artificial Sequence: Synthetic coding sequence
tgaaaagaacgcgggttatttcgcgggattgaggataaccctatggttgtgccactatgtaataggagcaaagatgtggttgaacctttacttcggccgcagtgggagtggtgcatcagtaggcagctctggtggggacatcgaattcctgcttattttgtcaccgtctcggaccccgccgtgccccctggagaggatcctgacggaaggtattgggtgtctggcaggaacgaggctgaagcaagagaaaaggcagccaaggaattcggtgttagtccagacaagatctcattacagcaagatgaagacgtgttagatacatggttctcctccggtctcttccctctctctatccttggctggcctaatcaaagcgaagatcttagcgttttttatccaggcacactgctggaaacagggcacgacatcttgttcttctgggtcgcgcggatggtcatgttggggctgaagctaacgggacgactcccgtttcgggaagtctatttgcatgccattgtcagggacgctcacgggcggaagatgagcaaaagcctggggaatgtgattgaccctctggacgtgatttacggaatctcgttacagggtctacataatcaattgcttaacagcaatctggacccttccgaggtagaaaaagccaaagagggccagaaggctgattttcccgccggaattccagagtgtggaacggacgcgctgcgattcggcctgtgcgcctacatgtcgcaggggcgggatatcaatctggatgtgaaccgaatactgggatatcgccacttctgcaacaagctgtggaatgccactaagttcgcactgcggggactggggaaaggctttgtgccctag

SEQ ID NO: 140331 - DNA, 525 bp, Artificial Sequence
  Description of Artificial Sequence: Synthetic coding sequence
atgtctactctttatgtatctcctcatccagacgcgtttcctagtttgagagctctgatagcagcccggtatggggaagccggcgagggacccgggtggggaggggctcatccacgcatctgtttacaaccacccccaacatcacgcacccccttcccccccccgaggctacctgctctggagcagggaccaggcggcttgtgggtctggggggccactgcagtggcccagctgctgtggccagccggtctgggggggccgggagggtcacgggccgcagtgctcgtgcagcaatgggtaagctacgcagacaccgaactcattcccgcggcatgcggtgccacacttcccgcacttgggctgcgatccagcgcgcaagacccacaggctgtgctgggagccctgggccgggcactgagcccccttgaggagtggttgcgcctccacacttacctggcaggtgaagcaccaacccttgcggacctggcagccgttactgctcttttgcttccctttagatattag

SEQ ID NO: 140332 - DNA, 867 bp, Artificial Sequence
  Description of Artificial Sequence: Synthetic coding sequence
taaaaggagcggggccttttccgtgggatcgaagataacccgatggtagttcctttatgtaaccggtccaaggacgttgttgagcctttgttgcgccctcaatgggagtggtgtatttccagacagctttggtgggggcaccgcattcctgcctatttcgtgaccgtatccgaccctgctgtaccccccggcgaggatccggatggcagatactgggtttccgggcggaacgaagccgaagctagagaaaaggccgctaaggaattcggcgtgagtccagataaaatcagcttgcagcaggacgaggacgtgctcgatacctggttctccagtgggctgttccccctgagcatacttggttggccaaatcagagcgaagatctctccgttttttatccaggcaccctgttggaaacagggcacgacattctgtttttttgggttgcccggatggtaatgttaggcttgaagctgaccggccgattacctttccgggaagtttatctgcatgccattgtgcgagacgctcatggcagaaagatgtctaaatcgcttggcaacgttattgatcctctagacgtgatttatggcatctctctgcaaggcctgcataatcagctgctgaactctaatttggatccatctgaggtggaaaaagctaaggagggacagaaagctgactttcccgccggcattccagaatgtggcacggatgcccttcgattcggcctgtgtgcttacatgagccagggacgggacatcaatcttgatgtgaaccgaattttgggctataggcatttctgtaataagctctggaacgctacaaaatttgctctgcggggcctgggaaaaggcttcgtgccgtag

SEQ ID NO: 140333 - DNA, 867 bp, Artificial Sequence
  Description of Artificial Sequence: Synthetic coding sequence
tagaaggagcgggggctatttagaggcatagaagataatcctatggtggtgcccttgtgtaataggagcaaggacgttgtcgaacctctcctccggccccagtgggagtggtgtattagccgccagctgtggtggggacaccggattcccgcatacttcgtgactgtttcagacccagccgtgcctccaggagaagaccccgatgggagatactgggtgtccggtagaaacgaggccgaggctcgcgagaaggcagccaaagaattcggcgtgtctccggataagattagcctgcagcaagatgaggacgtgctggacacctggtttagctccgggttattcccactctctatactgggttggccaaatcagagtgaggacctgagtgtgttttatccgggaactctgcttgagacaggccacgatattcttttcttttgggtggcacgtatggtaatgctcggcctgaagctgacgggccgcctgccgttcagagaggtctatctgcatgccatcgtgagggacgcgcacggaaggaagatgagtaagagtctgggaaatgtgatcgacccgctggatgttatctatggtatatccttacagggtttacataatcaattgctgaacagtaacctggatccaagtgaagtagaaaaggcaaaagaggggcagaaagcagactttcccgctggcatccccgagtgtggaaccgacgctctgagattcggtctctgtgcctacatgtcacaggggcgagatattaatcttgatgtcaatcgaatattagggtaccgtcatttctgtaataagctatggaacgccaccaagtttgcactacgcggcctcggcaagggattcgtgccttag

SEQ ID NO: 140334 - DNA, 3795 bp, Artificial Sequence
  Description of Artificial Sequence: Synthetic coding sequence
atgtctacactgtacgtatcgcctcatcccgatgcattcccaagtctgagggcactgatcgcagctcgctatggtgaagccggggaaggccctgggtgggggggcgcccacccacgcatctgtttacagcctccaccgacttcccgtacaagcttccctcctcctaggctacctgctcttgagcaggggcctgggggcttgtgggtctggggcgccaccgcggtggcgcaactgctgtggccggccgggctgggggggccaggaggaagtcgcgcagcagtgctggttcagcagtgggtgtcatacgccgataccgagctcattcccgctgcctgtggtgctaccttaccagccctaggactgcgttcatctgcccaagacccacaggccgtcctcggcgctttgggacgtgccctcagccccttggaagaatggctgagactccatacctatctcgccggggaggctccgactctggctgacctggccgccgtcactgcactgctactgccgtttcgctacgtgttggacccacctgcgcgtcgaatctggaataatgtgacaagatggttcgtgacctgtgtgcggcagccggagtttcgtgcagtgttgggcgaggttgttctatactcaggtgctcgtcccctgtctcaccagcccggccctgaggcgccagcactgcctaagacagccgcccaactgaagaaagaggcaaagaaacgggaaaaactcgagaaattccagcaaaagcagaaaattcagcagcagcaaccaccccctggtgagaaaaaacccaagccagaaaagagggaaaaaagggaccctggggtaataacatatgacctgcccacgccacctggcgagaagaaggatgtgagcggccccatgcccgattcctattccccccggtatgtcgaggctgcctggtacccctggtgggaacaacagggattcttcaagccagaatatgggcgccccaatgtctcagctgctaatccaaggggggtcttcatgatgtgcattcctccaccgaatgtcacagggtctctccacttgggacatgctctgaccaatgctatccaagattcattgacacgatggcataggatgcgtggcgaaaccaccctgtggaacccaggctgcgaccatgctgggatagctactcaggtcgtggtggagaaaaaattatggcgtgagcagggcctttctcgccaccagctcggccgggaagccttcctccaagaagtctggaagtggaaagaggaaaaaggagaccgcatctaccaccaattaaagaagctggggagctctttggactgggaccgcgcctgttttacgatggatcccaagctctctgctgccgtaactgaggccttcgtgcgcctccatgaagaaggtattatttatcgctctactagactggtgaattggtcctgcaccctgaattcagcaatctctgatattgaagtggacaaaaaggagcttaccggtcgtacccttctgagcgttccaggatataaggagaaggtagagtttggcgtcctcgtgagctttgcttacaaggtgcaggggtccgactcagatgaggaagtcgtggtggctaccacccggattgagactatgttaggcgatgtcgcagtggccgtacaccccaaggacaccaggtatcagcacctcaagggtaagaacgtcattcaccccttcctgagcagaagcctccctatcgtgtttgacgagtttgtggacatggacttcggcaccggtgccgtgaagattactccggcacatgatcaaaatgactacgaggtgggtcaacgccatggactggaagcaatttcaatcatggacagtaggggggcgttgataaacgtgcctccgccgtttctgggccttccccgatttgaggcacggaaggccgtactggtcgccctcaaggagaggggtcttttcagaggtattgaggacaatcccatggttgttcccctgtgcaatcgttcaaaggacgtggtcgagccactgttgagaccgcagtggtatgtccggtgcggtgaaatggctcaggcggccagtgcagccgtcacaagaggggacttacggatactgcccgaggcccaccaacgtacatggcatgcctggatggacaatatccgagagtggtgcatctcccgccagctatggtggggtcatcgtattccggcctactttgtgacagtatccgatccagcagtcccgccaggcgaggatcctgacggtaggtattgggtcagtggtagaaacgaggccgaggcccgcgaaaaagccgccaaggagttcggggtctcacccgacaagatcagcctccaacaggacgaggacgtgctggacacctggttttcttctggtctgtttcccttatctatacttggttggccaaaccagtccgaggacttgagtgtgttttaccccgggacactcttggagaccggccatgacatactttttttctgggttgctaggatggtgatgctgggactgaaacttaccgggcgcctcccctttcgggaggtgtatttgcacgcaatcgtaagggacgcccacggccgcaaaatgtccaagtctctcggaaacgtgattgaccccctggatgtgatctatggcatttccctgcagggactgcacaaccagctgctcaacagcaatctcgatccatccgaagtggagaaagccaaggaaggtcagaaagctgacttcccggcaggcatccctgagtgcggaacagacgcactgcgcttcggactgtgcgcctatatgagccagggtagagacattaacctggatgttaatagaattctcggctatcgccacttctgtaacaaattatggaacgcaactaaatttgcactgcggggcttgggaaaaggattcgtccccagccctaccagccaacccggtggacacgaaagtttggtggataggtggatccgctcaaggttgactgaggccgtgaggctgtcaaatcagggcttccaggcatacgacttccccgctgtgactaccgcgcagtatagtttttggttgtacgagctgtgcgacgtatacctggagtgtttgaaaccagtgttgaatggcgttgaccaggttgcggccgagtgtgcgcggcagactctctacacctgcctagacgtagggttgaggctgttgtccccattcatgcctttcgtgaccgaagaactgttccagcgccttcctagaaggatgccccaggccccgccctcattatgtgtaacaccctatcccgaaccctctgagtgctcctggaaagatccagaagctgaggccgctcttgaactagccctcagcattactagagctgtgaggtcactgcgcgctgactacaacctcacaaggatcagacccgactgcttcctggaagtcgccgacgaagccaccggcgcacttgcaagcgccgtgagtgggtatgtccaggcattagcttctgccggagtggtcgctgtcctagcactcggagcccccgccccccaaggatgcgccgtggcccttgcttcagataggtgttctattcatttgcagctgcagggcctcgttgaccccgccagggagttgggcaaactgcaggctaaacgagtagaagcccaaaggcaggcacagagactccgagaaaggcgggccgcctctggttacccagtcaaagtgccgctggaggttcaagaggccgacgaggctaagctgcaacaaactgaggcggaattgaggaaggtggatgaggcaatcgccctctttcagaagatgctgtag

SEQ ID NO: 140335 - DNA, 525 bp, Artificial Sequence
  Description of Artificial Sequence: Synthetic coding sequence
atgtctaccctgtacgtttctcctcaccctgacgccttcccaagtcttcgtgccttaattgccgctcggtatggggaggctggggaaggccccggctggggcggagcacacccacgcatctgtcttcagcccccaccgacctcacgaaccccgtttccccctccaagattgccagctctggagcaaggcccaggcggcctgtgggtgtggggcgctaccgctgtagcccagcttctgtggccagccgggctgggggggcctggcggcagcagggccgcagtactcgtacagcagtgggtttcgtacgccgacactgagctgataccagccgcctgtggagcaacgttaccggcattgggacttcgtagttccgcccaggatccccaggcagtcttaggtgctctcgggagggccctctcccctctggaagagtggttacgccttcatacctatctggccggtgaggcccctacgctggccgacctcgcggctgtgacggcactactccttccttttcgatattag

SEQ ID NO: 140336 - DNA, 894 bp, Artificial Sequence
  Description of Artificial Sequence: Synthetic coding sequence
atgcccgattcttatagcccacgttatgtggaggctgcctggtatccctggtgggagcagcagggcttttttaagccggaatatggtaggcccaatgtaagcgctgctaacccgcgtggagtgtttatgatgtgtatcccaccacccaacgtgacaggctcactacatctcggccacgcactaactaacgccatacaagattctctgaccaggtggcatcggatgcggggggagacaactctatggaaccctggctgcgaccacgccggtatcgctacgcaggttgtggtcgagaaaaagctctggcgagaacagggcctgagcagacaccagttagggcgcgaagcgtttttgcaggaggtttggaagtggaaggaggagaagggagataggatttaccatcagttgaagaaactcggcagcagtctcgactgggatagggcgtgtttcaccatggaccccaagttgtccgcagctgtgacagaggccttcgtgagactgcacgaggaaggaattatttacaggtcgacacggcttgtaaactggagctgtactctcaactctgccatctccgatatcgaggttgacaagaaagagctgactgggcggaccttgctgtccgtcccagggtataaagagaaagtggagttcggagttctcgtgagttttgcctacaaagtccaggggtccgattcagatgaagaagtagtagttgccacaacacgcattgaaactatgcttggtgatgtggccgttgctgttcaccccaaggatacaagatatcagcatctgaaggggaagaatgtcattcacccttttctgagcaggagcctcccgatcgttttcgacgaatttgtcgatatggactttggcaccgggcccgcccaggtatag

SEQ ID NO: 140337 - DNA, 867 bp, Artificial Sequence
  Description of Artificial Sequence: Synthetic coding sequence
tgaaaggaacggggacttttcaggggtattgaggataaccccatggtcgtgccactgtgtaaccgatccaaagacgtcgtcgagccattgctgcggcctcagtgggaatggtgtataagtaggcagctttggtggggccataggattcccgcatactttgtgacagtctctgacccggcggtccctccaggagaagacccagacggtcgatattgggtgagcggcaggaacgaagccgaagccagagagaaggccgcgaaagagttcggagtgtcccctgacaagatctcattacaacaggatgaagatgtgctggacacttggttctccagcggtctgtttcctcttagcatcctgggctggcctaatcagtcagaagatttgtccgtgttttaccccggtaccctgcttgaaacaggtcacgacatactgttcttctgggttgcccggatggtcatgctgggcctgaagctgaccggacgcctcccattccgagaggtgtacttgcacgctatcgtgagggatgcccacggcaggaaaatgagcaagagcttgggtaatgtgatagatcccttggacgtcatatatggcatctccctccagggtctgcacaatcaacttcttaactccaacctggaccctagtgaggtggagaaagccaaagagggacagaaagccgatttcccagcagggattccagaatgcggaacagatgcattgcggtttggcctgtgcgcgtatatgtctcaaggaagggacatcaatctggacgtcaatcgaattctcggctacagacatttttgtaataaattatggaatgcaacaaaatttgccctgagggggttagggaagggctttgtgccgtag

SEQ ID NO: 140338 - DNA, 867 bp, Artificial Sequence
  Description of Artificial Sequence: Synthetic coding sequence
tagaaggaacgtggcctattcagaggcattgaagataaccccatggtcgtgcccctgtgtaaccgctccaaagacgtggtagagccattacttagaccccagtgggagtggtgtattagccgccagttgtggtggggccaccggattcccgcatatttcgttaccgtctctgatcccgccgtgcctcctggagaagacccagacggaaggtattgggtcagcggacgaaacgaggcggaagccagagaaaaagcggccaaagaatttggggtcagcccggataaaatctccctgcagcaggacgaggacgtgctagatacctggttttcttccggcctcttcccgttgtcgatcctcggctggccgaatcagtccgaagacctcagtgttttctaccccggcactctgttagagactggtcacgacatcctctttttctgggtggctagaatggtgatgcttgggcttaagctgacgggacggctgccattccgagaagtctacctgcacgccattgtgcgggatgcacatgggagaaaaatgtccaagtcgcttgggaatgtgattgatcccctggacgttatttacggtatttctctgcagggcctgcataaccagctgctgaactcaaacctcgacccatctgaagtggagaaggccaaagaaggccagaaggcggacttccctgccggcatcccggagtgcggtaccgatgcactccgtttcggactgtgcgcatacatgtcacaggggcgcgacattaatctggacgtgaacaggatccttggctacaggcacttctgtaacaaactctggaatgctaccaagttcgcgctcagaggcttgggcaaaggcttcgtgccctag

SEQ ID NO: 140339 - DNA, 288 bp, Artificial Sequence
  Description of Artificial Sequence: Synthetic coding sequence
tagccagcaggtcttggcgggccagggggctctcgtgccgccgttctcgtccagcagtgggtctcatacgctgatactgaactaattcccgctgcctgtggcgctaccctcccggcgctaggccttaggtccagcgcgcaggacccgcaggccgtgctgggggccctaggcagagccctaagtcctttggaggagtggttacggctccacacatatctagcgggcgaggctccgactctcgccgaccttgcagcggtgacagcgcttctgctcccctttaggtattag

SEQ ID NO: 140340 - DNA, 3795 bp, Artificial Sequence
  Description of Artificial Sequence: Synthetic coding sequence
atgtccactctatatgtgagtcctcaccccgacgcattccccagtctacgggctctgatcgctgcacggtatggcgaagcaggagaaggaccgggttggggtggagcccatccacgaatctgccttcagcccccccccactagtaggaccccgttccctccaccgcgcttgcctgctctggaacagggcccaggaggcctgtgggtatggggggcaacagcggtagctcagctactgtggccggcagggctagggggccctggcggctccagagctgcagtcctcgtgcagcagtgggttagctatgctgacacggagctcatcccggcagcatgcggagcaaccctgcccgccttagggttgaggtccagtgcacaggaccctcaggccgttctgggcgctcttggcagggctttgagcccgttggaggaatggctgcgtcttcacacctatctggccggtgaagctccaacgctcgccgatcttgctgccgtcacagccttgttgctacctttcaggtatgtcctggaccctcctgcgaggcgcatctggaacaatgtgactcgctggttcgtgacttgtgtgaggcagcccgagttccgagcagtcctcggagaagtggtgctctattcaggggcccgcccgctgagccatcagcccggccccgaagcaccggccctgccaaagacagccgcacagctgaagaaggaagccaaaaagagagaaaagctggaaaagttccaacagaaacagaagatacagcagcagcagcctcctcctggagaaaagaaacctaagcccgaaaaacgggagaaacgggaccctggtgtgattacgtatgacctcccaacccccccaggcgagaaaaaggacgtgagcgggcccatgccagactcctatagtccccggtatgtagaagccgcatggtacccttggtgggagcagcaggggttttttaagcccgaatatgggaggcctaacgtgtcagcggctaacccccgcggggtctttatgatgtgtattccacccccaaacgtgacaggtagcctgcatctgggtcatgctctgaccaacgccatccaggacagtttgactcgctggcatagaatgaggggcgagacaactctttggaatccggggtgtgatcacgccgggatcgcaacacaggtggttgtggaaaagaagctgtggagagagcaaggtctcagcaggcaccagctaggaagagaagcatttctgcaggaagtgtggaaatggaaagaggaaaaaggtgataggatctaccatcaactcaagaaacttggctcctctctggattgggaccgcgcttgcttcaccatggatcctaaattgtccgccgcggtcaccgaggcgtttgttcgccttcacgaagagggaattatatatcgatcaacaaggctggtcaactggtcctgtaccctcaacagtgctatcagtgacatcgaagtagacaaaaaggaacttaccggacggaccctgctctccgtgcccggatataaggaaaaagtcgagtttggagtgcttgtgagtttcgcctacaaagttcagggctccgattctgacgaagaggtggtggttgccaccacgagaatagaaacaatgctcggtgacgttgctgtggctgtccatcccaaggatacgcgttatcagcacctgaaaggcaaaaacgttatacatccgttcttgtctagaagcctgcctattgtgttcgacgaatttgtagacatggactttggaaccggggccgtcaagattacgcccgctcacgatcagaacgactacgaggtgggacagcgtcatggacttgaagctatctccataatggatagccgtggggcacttatcaacgtcccaccaccttttctcggtctgccccggttcgaggctcgtaaagcagttctcgtcgctcttaaggagcggggcctatttagaggcatcgaagacaatccgatggtggttccactgtgcaacagatcaaaggacgtggtggagcctctgctgcgtcctcagtggtatgttcggtgcggcgagatggctcaagccgcatccgcagccgtgactcgcggtgaccttcgtatcctgcccgaggcccatcaaaggacctggcacgcgtggatggataatattagggaatggtgcatcagcaggcagctgtggtggggacaccggatccccgcatatttcgtcacagtgtctgaccctgccgtgcctcctggagaggatcccgacggaaggtattgggtttcagggagaaacgaggcggaggctagagaaaaagccgcgaaggaattcggagtctctccagacaaaatcagtctgcaacaggatgaagacgttctggatacgtggttctcttcaggcctttttccactgtccatcctcggctggcccaaccagtccgaggatctgagcgtcttctatcccggcactctcctggagactggacatgatatcctgttcttctgggtggcaaggatggtgatgctcggtctaaagctgactgggagactgccctttagagaggtgtaccttcatgccatcgttagagatgcccatggtcgaaagatgtctaaatctctagggaatgtgattgaccccctggacgttatttacggcatcagtctgcagggcctccacaaccagctgctgaattctaacttggaccccagtgaggtcgaaaaggcaaaagaaggccagaaggccgactttccggccggaattcctgaatgcggcacagatgcgctccgcttcggcctgtgcgcctatatgtcccaaggacgcgacattaacctggatgtgaaccgtattttagggtatcgccatttttgtaacaagctctggaacgcaaccaagttcgcgttgcgggggctggggaaagggttcgtgccttcgccaacttcccaacctggcggccacgaatcactggtggaccggtggatcagaagccgtctgacagaggcagtccggctgtcaaaccaggggttccaggcgtatgactttcccgccgttacaactgctcagtacagcttctggttatacgagctatgcgatgtgtatctggagtgcctgaaacccgtacttaatggagtcgaccaggtcgcagccgaatgtgcaagacagaccctgtacacctgcctggatgtggggttgaggctgttaagccccttcatgccttttgtgactgaggagctgtttcagcgtctgccccgtcgaatgcctcaggctcctcctagtttgtgcgttactccgtaccctgaaccctccgaatgcagctggaaggacccagaagctgaggccgccctggagctggccctttctattacccgcgccgttcgatcattgagggctgattataatctcactaggataaggcccgattgctttctggaggtcgccgatgaggctactggagcacttgcatcagctgtgtccggctatgtgcaggcactcgcgagcgctggggttgtggcagtgctggccttaggcgcacctgctccccaaggttgtgcagtagctttagcttcagaccggtgttcaatccacctccagctgcagggactggttgacccagcaagggaacttgggaagttgcaggccaaacgcgtggaggcccaaaggcaggcccaaaggctgagagagaggcgagccgcatctggctaccctgtgaaggtgccactcgaggtccaggaagccgatgaagctaaattacagcagacagaagctgagctccgcaaagtggatgaagctatcgccctgttccagaagatgttatag

SEQ ID NO: 140341 - DNA, 2031 bp, Artificial Sequence
  Description of Artificial Sequence: Synthetic coding sequence
atgagcactttatacgtgagcccacaccccgacgcattccccagcttgcgggccctcatagccgctcgctatggcgaggccggcgaaggccccggctggggaggggcacaccctcgcatttgccgcctaccccggttcgaagcacgtaaggctgtcctggtggctctgaaagagcgcggcttgtttaggggaatcgaggataatcctatggttgtgccactgtgcaatcgcagtaaggacgttgtggagcccctgctgcgtccccagtggtacgtaaggtgcggggagatggcacaggctgccagtgctgccgtcaccagaggggatctgagaattctccccgaggcacatcaaagaacctggcacgcgtggatggacaacatccgcgaatggtgcataagccgtcagttgtggtggggacaccggattccagcttatttcgtgaccgtttctgatcccgctgtgccccccggagaagaccccgacggccgctattgggtgtccggtaggaacgaggccgaagcgcgcgagaaggccgcgaaggagttcggagtctctcctgacaagatcagcctgcaacaggacgaagatgttctcgatacctggttctcttccgggctttttcctctcagcatcttaggatggcctaaccaaagtgaagatctcagcgtcttctacccaggcaccctattggagacaggacatgatattttgtttttttgggtggctcgaatggtcatgctaggcctgaaattaactggtcggcttcctttccgtgaggtttacctacacgcaattgttcgggatgctcatggcagaaagatgtccaagtctctgggcaatgtgatcgatccgttggatgtgatctacgggattagtctgcagggtcttcacaaccagcttttgaattctaatttggacccatcggaagtggagaaggctaaggaggggcagaaggccgattttccagctggcattcccgaatgcggcaccgatgcactccgcttcggcctctgcgcatatatgtcgcagggacgcgatatcaacctagacgtgaacagaatcctaggctacaggcatttctgcaataagctgtggaacgctacaaagtttgctctgcgcggtctcgggaagggcttcgttccatcccccacttcacaacctgggggacacgagagtctggtcgatcgctggattaggtctcgactaactgaagctgtgcgcctgtctaatcaaggtttccaggcatatgattttcctgctgtaaccaccgcacaatacagtttttggttgtacgaactttgtgacgtctacctggagtgtctgaagcccgttctcaacggggtcgatcaggtggctgcggagtgcgcacgccagaccctgtatacttgcctggacgtaggattgcggctcctctccccttttatgccgttcgttacagaggagctgttccaaaggttgccgaggaggatgccacaagcccctccttcactgtgtgtgactccatacccggagccatccgagtgcagctggaaagacccagaggccgaggcggcattggagctggccctgtccattacccgtgcagtgcggtcgctgagagctgactacaacttgaccagaatccgccctgactgttttctggaagtggccgatgaagccacgggggccttagccagcgccgtgagcggctacgtccaggcgttagcaagcgctggcgtggtagcagtactggctctgggcgcgcccgccccccagggctgtgcagtggccctggccagtgacagatgttccatccacctacaattgcagggattggtggatcctgccagagagcttggtaaactgcaggcaaaacgagtggaggcacagagacaagcacagagactgagggagaggagggccgcttctggctacccggttaaggtgcccctcgaggtgcaggaggccgacgaggccaagttgcagcagacagaggccgagctgcggaaagtcgatgaagccatcgccctctttcagaaaatgctatag

SEQ ID NO: 140342 - DNA, 2031 bp, Artificial Sequence
  Description of Artificial Sequence: Synthetic coding sequence
atgagcacactctatgtgagccctcaccctgacgctttcccctctctgagagccctgattgccgccaggtatggggaggccggagaaggcccgggttggggcggggcccatccaagaatttgtcggcttccacgcttcgaggctcggaaggcggttttggtggcattgaaggagagaggactttttcggggaatcgaggataaccctatggtggtccccttatgtaatcgctctaaagacgttgttgagcccctactgcggccgcagtggtacgtacggtgcggggaaatggcccaggcagcaagcgcagccgtgacccgaggggatctcagaatcctccctgaagcccatcagcgcacctggcatgcttggatggataatatcagagagtggtgtatttctcgccagttgtggtgggggcatcggatccccgcgtactttgtgactgtttctgacccagcggtaccaccaggtgaagaccccgacggccggtactgggtgagcggacgaaacgaagctgaggctagggagaaggctgctaaggagttcggtgtgagccccgataaaatctccctgcagcaagacgaggacgtgctggatacttggtttagtagcggtctgttcccactcagcatcctgggctggcccaaccagtctgaggacctcagtgtattctaccctggcaccctactagaaacaggacatgatatactatttttttgggtcgcgcgaatggtgatgctagggctgaagctaaccgggcgtctccctttccgcgaggtctacctgcacgccatcgtgcgtgatgcacatggtcgtaagatgtctaaatcgcttggaaacgttatcgatcctctggatgtgatttatggcatttcactgcaggggctgcacaaccagctcttgaacagcaatctggacccctctgaagtggagaaagcgaaagagggccaaaaagcagactttcctgccggcatacctgagtgcggcacagacgccctcagattcggcctgtgtgcatatatgtcgcagggtcgcgacattaatcttgatgtgaacaggatccttggctatagacacttctgcaataagctctggaacgccaccaaatttgctctccgagggctcggtaagggcttcgtgccaagccctaccagccagccaggcggacacgagtcccttgtcgaccgctggatccgttcccggcttactgaagcagtccgactcagcaatcagggcttccaggcctatgattttcccgctgtcaccactgcccagtactcattctggctttatgagctttgtgatgtctacttggagtgccttaaaccagtattgaacggagtggaccaggtggcggccgagtgtgccagacagaccctgtacacctgcctggatgttggcctaaggttattatctcccttcatgcccttcgtgactgaggaactctttcagcgtttgcctcgccggatgccacaggccccaccatcactgtgcgtgaccccatatcccgaacctagtgagtgttcgtggaaggatccagaggctgaggcggccttagagctggccctgagcattacccgcgccgtccgcagtctgcgcgccgattacaatctgacccgcataaggcccgactgcttcctggaggtagcagacgaagctacaggcgctctggcgtcggcggtctccgggtatgttcaggcgttagcatccgcaggcgtcgtcgccgtgctggccctgggggcccccgcccctcagggctgtgcagtcgcacttgctagcgatcggtgttccattcacctccagttgcaggggttggtcgatcccgccagggaacttggaaagctccaggccaagcgggtggaggcccaacgccaggcacagagactccgggaacggcgagcagcatctggttatcccgtgaaagtgccccttgaggtgcaggaggccgacgaagccaaattacagcagactgaggctgaattgaggaaggttgatgaagctatcgcactgttccagaaaatgctgtag

SEQ ID NO: 140343 - DNA, 894 bp, Artificial Sequence
  Description of Artificial Sequence: Synthetic coding sequence
atgcctgattcctatagtccccgatatgtcgaggcagcttggtacccgtggtgggagcaacagggcttttttaagccggaatacggcagaccgaacgtgagcgcagctaatccacgaggagtgttcatgatgtgcattcccccccctaatgtcacaggttccctacatcttggccatgcactcactaacgcaatacaggatagcctgacacgctggcacagaatgaggggcgaaacgactctgtggaacccagggtgcgatcacgcgggcatcgcaacacaagtagtcgttgaaaagaagctctggcgcgagcaggggctgagtcggcaccagctcggtagagaggctttcctccaggaggtttggaagtggaaggaagagaaaggagatcgaatctaccaccagctgaagaaactaggctcttccctggactgggacagagcttgttttactatggatcccaaactttcagcagctgttaccgaggcatttgtacggctacacgaggaggggatcatctacagaagcacgagactggtcaactggagctgtacactgaattctgccattagtgacattgaggtggataaaaaggaactcacaggcagaacgctcctgtccgtgccagggtacaaagagaaagttgaattcggagtgctggtttctttcgcttacaaagtgcaggggtcggactccgatgaagaagtcgtggtggccaccaccagaattgagaccatgctgggagacgtggcagtcgccgttcatcctaaggacacccggtaccagcacttgaaagggaagaacgtcatccacccgtttctgagtagatccctccctatagtgttcgacgagttcgtagacatggactttggcacagggccggcgcaggtctag

SEQ ID NO: 140344 - DNA, 894 bp, Artificial Sequence
  Description of Artificial Sequence: Synthetic coding sequence
atgcctgattcctacagtcctaggtatgtggaagccgcatggtacccgtggtgggaacagcagggcttttttaagcctgaatacggacgacctaacgtgagcgccgccaatccaagaggagtgttcatgatgtgcattccaccaccaaacgtcacagggtcactgcaccttgggcatgctcttacaaacgccatacaagactctttgacccgctggcaccgtatgcgaggcgagacaacactctggaaccctgggtgcgatcatgctgggatcgccacccaggtggttgtcgagaagaaactctggcgggagcaaggactgtcaagacatcaacttgggagggaggctttcttacaagaggtctggaaatggaaggaagaaaagggcgaccgtatttatcatcaactaaagaaactgggttcaagcctagactgggatagggcgtgttttactatggatccgaagctcagtgccgccgttactgaggcctttgtgaggttacatgaggaggggatcatctaccgtagcacccgcctcgttaattggtcatgcaccctgaacagtgccatctcggatatcgaggttgataagaaagaactcactggtagaacgctcctttctgtccccggctataaagaaaaggtggaattcggagtccttgtatcgtttgcttataaggtgcaggggtctgactccgacgaagaggttgtggtcgccacgactagaatagagaccatgctcggggacgttgccgtggcggttcatccaaaggacacgcgataccagcacctgaaaggaaaaaacgtgattcacccctttctgagcaggtcactgcccattgtcttcgacgaattcgtcgatatggattttgggacagggcccgcccaggtgtag

SEQ ID NO: 140345 - DNA, 894 bp, Artificial Sequence
  Description of Artificial Sequence: Synthetic coding sequence
atgcccgacagctactctccccggtatgtcgaggctgcatggtatccttggtgggaacaacaagggttctttaagccggagtacgggcgcccaaatgtatcggcagccaatccacgcggcgtgtttatgatgtgcatacccccccctaatgtgaccggcagcttacaccttggacacgcgctgactaacgcgattcaggactccttgacaagatggcatagaatgagaggcgagacgaccctgtggaaccccggatgtgaccacgcaggcatcgctacccaggtcgttgtggagaaaaagctctggcgggagcagggactgagtaggcatcagctaggccgagaagcttttctgcaggaggtttggaaatggaaggaagaaaagggggatagaatataccaccagttaaagaagttgggtagtagcctggactgggatcgggcctgcttcacaatggacccgaaactcagtgctgctgtgactgaagctttcgtaaggctacatgaggaaggcattatttaccgctctactagattggtgaattggagctgcacactcaacagcgcaatctccgatattgaggtcgataagaaagaactgacagggcggacactcttaagcgttccgggctacaaggaaaaagttgagtttggagtcctagtctctttcgcctataaggtgcaggggtctgacagcgacgaggaagttgtagttgccaccactcgcattgaaactatgctcggtgacgtggctgtggctgtgcatcctaaagatactaggtaccagcacttgaaaggtaaaaacgtcattcatcctttcctcagccgtagtctgcccatcgtcttcgatgagttcgtggacatggactttggaacgggcccagcccaggtgtag

SEQ ID NO: 140346 - DNA, 2031 bp, Artificial Sequence
  Description of Artificial Sequence: Synthetic coding sequence
atgagtacgttgtacgtgagtccccatccggacgcattccctagcctgagagcgctcatagccgctcggtatggcgaggctggagaggggcccggttggggaggtgctcaccctaggatctgtcgactgcctcgtttcgaggctaggaaagccgtattagttgccctcaaagagaggggactgttccgcggcattgaagacaacccaatggttgtgccactctgcaacagatccaaggatgtcgttgagccgcttctccgccctcagtggtacgtgagatgcggagagatggctcaggcagcatcagcagctgtcacccggggtgacctgagaattcttcccgaggctcatcagagaacctggcacgcctggatggataacattcgcgagtggtgtatctcaagacagttgtggtggggacacagaatcccggcatattttgtcacagtatccgaccccgcagtaccaccgggggaggacccggacgggcgatactgggttagtggcaggaatgaagcagaagcccgcgaaaaggccgctaaagagttcggcgtgagtccagataaaatctcattacaacaggacgaagatgtgctcgacacctggttcagctctggcttgttcccactctcaattctggggtggcctaatcagagcgaagacctgagcgtcttctatccaggtactctgctcgagacaggccacgacattctctttttctgggtggcaaggatggtcatgctgggactgaaactgaccggaagactcccatttagggaagtgtaccttcatgccattgtgcgcgatgcgcacggtaggaagatgtccaagtcccttggcaacgtcatcgatcctttggacgtgatttatggaatttcactgcagggactacacaaccagctgctaaactctaacctggacccatccgaagtcgaaaaggccaaggaagggcagaaggccgacttccctgctgggattcccgaatgcggcactgacgcactgagattcggactgtgcgcttatatgtcgcagggacgcgacatcaatctggatgtgaaccgaatactaggatatcggcacttctgtaataaactttggaacgctacgaaattcgctcttagagggttggggaagggtttcgtgccatcccctaccagccagccaggcggacatgagagtctcgtggacagatggattagatcaaggctcacagaggccgtgaggctaagcaatcaagggtttcaggcatatgactttcccgcagtgaccacagctcagtacagcttctggctgtacgagctttgtgatgtgtatctggagtgcctgaagccagtcctgaacggcgtggaccaggtggccgcagagtgtgctaggcaaacgctttacacctgtctggacgtgggcctgaggcttttatctccatttatgccatttgttactgaagaactctttcagaggctgccccgacggatgccccaggccccaccaagtctgtgcgttacaccgtatcccgagccgagcgagtgctcctggaaggaccctgaggcagaagccgccctcgaacttgcactaagcattaccagagccgtccggagcctgagggcagattacaatcttactaggatcagacctgactgttttctggaagtggccgacgaagctactggggcactcgcgtccgccgtctccgggtatgtgcaggctcttgcttcagccggcgtggtcgcagtgctcgcacttggggcccctgcaccccaggggtgcgcggtcgccctcgcaagtgatcgctgctccatccacctgcagctacaaggattagtggaccccgcaagagagctcggcaaactccaggctaaacgcgtggaagcccaacgccaggcacagagactccgagaacggcgcgccgcctccggttatcctgtcaaggtgcccctggaagttcaggaagcggacgaggccaagctgcagcagaccgaagccgagttgcgcaaagtagatgaagctattgccctttttcaaaagatgctttag

SEQ ID NO: 140347 - DNA, 2031 bp, Artificial Sequence
  Description of Artificial Sequence: Synthetic coding sequence
atgtcaacactatacgtgagccctcatcccgacgctttcccctctctacgtgccttgatcgcagctagatatggagaggcgggagagggtccgggctgggggggcgcacatccccgcatctgccgcctgccacgtttcgaggcccggaaagctgtgttagtggccttgaaagagaggggcctgtttagaggtatcgaggacaaccctatggttgttcctctgtgcaatcggtccaaggacgttgttgagccccttctaagaccccagtggtacgttcggtgcggagaaatggcccaagccgctagtgctgccgtgacgcggggtgaccttcggatcctgcctgaagctcatcagagaacatggcatgcttggatggataatattagagagtggtgtattagcaggcagttgtggtgggggcatcgcatccccgcctactttgtcacggtaagtgaccctgccgtgccaccgggcgaagaccccgacgggcggtactgggtgagtggacggaatgaagcagaggcccgggagaaggctgcgaaagagtttggagtctcaccggacaagattagcctgcagcaagacgaggatgtgcttgacacctggtttagttccggcctctttcctctgtctatcctaggatggccaaaccaaagcgaagacctgtcagttttctatccggggaccttactcgagaccggccatgatatactttttttctgggtggcccggatggtaatgttgggcctgaaactgactggccgtctgccttttagggaggtgtatcttcatgccatagtaagggacgcacatggcaggaaaatgagcaaaagccttggcaatgtaatcgaccccctggacgtcatttatggtatttctttacagggcctgcataaccagctgttgaattcaaacctggatcctagtgaagtcgagaaggctaaggagggacagaaagctgactttccagccggcattcctgagtgtggcacagacgccctgaggttcggactgtgtgcatacatgtcacaagggcgcgatatcaacctcgacgtgaataggatccttggctatcgccacttttgcaataaactgtggaacgcaacaaagtttgcacttcgaggcctggggaaaggatttgtgccaagccccacttcacagccggggggacacgagtctcttgtggatcgatggattagatccagattaaccgaagccgttcggctcagcaatcaaggtttccaagcgtacgattttcccgccgttacaactgcccaatacagcttctggctgtacgagctctgcgatgtgtacctcgaatgcctcaaaccagtgttgaacggtgtggatcaagtggctgcggaatgcgcacgccaaactctgtacacttgcctagatgttgggttgagactgctgtcgccctttatgcctttcgtaacagaggagctctttcaaagactccctagacggatgccccaagctccccccagtctgtgcgtgactccatacccagagccatctgaatgtagctggaaggacccggaggcagaagcggctttggagttggccctgagcataacgcgggccgtgaggtcactccgggccgactataatttaacaaggataagaccagactgtttcctggaagttgccgatgaggcaacgggcgccctggcctcggctgtctctggctatgtgcaggcactcgcgtctgcaggtgtagtcgccgtcctagctcttggagcacccgctcctcagggctgtgccgttgccttggcaagtgatagatgctcaatccacttgcagcttcagggcctggtcgaccctgctcgagaactggggaaattgcaggctaagcgggtcgaagcacagcgccaggcccagcggctgcgggagcgaagggccgcatcaggttaccccgtcaaggtgccactcgaggtccaggaggctgacgaagccaaactgcaacaaacagaggccgaattgaggaaggtagatgaagcaattgccctgttccagaaaatgctctag

SEQ ID NO: 140348 - DNA, 894 bp, Artificial Sequence
  Description of Artificial Sequence: Synthetic coding sequence
atgcccgattcctattcaccacggtacgtggaggccgcttggtacccatggtgggaacaacaaggcttctttaagcccgagtatggtcggcccaacgttagcgccgccaacccaagaggcgttttcatgatgtgcattcccccccccaatgtgaccggcagcttgcacctgggccacgcactcaccaacgcgatacaggattctctcacacgctggcacagaatgcggggcgaaactactctttggaacccaggctgtgaccacgccggtattgccacccaggttgtggtggaaaaaaaactgtggagagagcagggcctttctagacaccagctgggtagagaagctttcctgcaggaggtctggaagtggaaggaagagaagggagatcggatttaccatcagctgaagaaactggggagttcactcgattgggaccgagcctgtttcaccatggatcctaagcttagtgcagccgttacagaggccttcgtcaggctacacgaggaagggattatctaccgttctactaggctggttaattggtcctgcaccttgaatagcgctatcagcgatattgaggtggacaaaaaagagctgacgggacggacgctgctcagcgtgcctggctataaagagaaggttgaattcggtgtactcgtctcgttcgcttataaggtccagggctccgactccgacgaggaggtcgtcgtagccaccactcgtatcgaaactatgctgggggacgtggccgttgccgtgcacccaaaggataccaggtaccagcacctgaagggcaaaaacgtaattcacccatttctgtctcgaagcctcccaattgtgttcgacgagttcgtcgacatggattttgggacagggcctgcgcaggtatag

SEQ ID NO: 140349 - DNA, 3192 bp, Artificial Sequence
  Description of Artificial Sequence: Synthetic coding sequence
atgccgcatcttcctttagccagcttcagaccccctttttggggattaaggcactctcgcgggttaccacgcttccatagtgtgtccacgcagtcagaaccccatggcagccctatcagtagacggaaccgtgaggccaaacaaaaacggcttagagaaaagcaggcaaccctcgaggccgaaatcgccggggagagcaagtctcccgcagaaagcatcaaagcgtggcgtccaaaggagttagtcttatatgagattcctacaaagccaggagagaagaaagacgtctccggacctctccctcccgcctatagtcccagatatgtggaagccgcgtggtatccttggtgggtgcgcgagggtttttttaagcctgaatatcaggcccgactgccacaggccactggagaaaccttttccatgtgtatccccccaccgaatgtgacaggttcactgcacattgggcacgcactgactgtggcgatccaagacgccctagtgcggtggcatcgaatgcggggtgaccaggtgctctgggtgcctggatctgaccacgctggaatagcaactcaagccgtcgtggagaagcaactctggaaggaaagaggagtgagacgtcacgagttgtcccgggaggcctttctgcgagaagtatggcagtggaaggaggctaaggggggcgagatctgtgagcaactccgcgcgctgggagcttccctggactgggatagagaatgtttcaccatggatgtggggagctctgtggcagtgacagaggccttcgtgcggctatacaaagctgggctcctgtacagaaaccatcaactcgtaaactggtcctgcgctctccgctcagccatctcggatatcgaagtcgaaaacaggcccctgccgggccatactcagttaagactgcccggctgtccgactccggtgtcattcgggttactgttttcagtggcctttcctgtggacggagagcccgatgccgaggtagttgtgggaactactcgacctgaaacactccccggtgacgtggccgtcgccgtccaccccgatgacagtcgctacacgcatttgcatggcagacagttgaggcaccctttgatgggccagcctctccccctgattacagactacgctgtccagccccatgtgggtacaggggccgtgaaggtgaccccagcgcactcccctgcagatgccgagatgggagccagacacggattatccccgcttaatgtgatagcagaggacggaactatgaccagcctctgcggggattggctgcaaggcctgcaccggttcgttgctcgcgaaaaaatcatgtcggtgctgagcgagtggggtctgttccgtggtcttcaaaatcatcccatggttctacctatatgttccaggtctggggacgtgatagagtatctattaaaaaaccagtggttcgtgcgctgtcaggagatgggagcccgtgccgctaaggccgttgaatctggggccctagagttgagtccctcgtttcatcagaaaaactggcaacactggttctctcacattggtgattggtgtgtgagcaggcaactgtggtggggccaccagatccccgcgtatctggtggtggaagatcatgcacagggtgaggaggactgttgggtggtgggcagatcggaagccgaggccagagaagtcgcggccgagctgactgggagaccaggggctgagctgacactggaaagagaccccgacgtacttgacacttggttttcttccgccttgtttcctttcagcgccctaggatggccccaggagacaccagaccttgcaagattctatccgctttccctcctggaaacaggaagcgatctgctactgttttgggtcggacgcatggtcatgttgggcacccagttaaccgggcaactgccgttctctaaggtgctgctgcaccccatggttcgggacaggcagggcaggaagatgtcaaaaagtctgggcaacgtgctggacccgagggacattatcagtggcgtagagatgcaggttctgcaggagaaactgaggagcggcaacttggatcccgcagaactggctatcgtggccgccgctcaaaaaaaggacttcccccacggcattccggaatgcggaaccgacgcccttaggtttactctttgcagccacggggttcaggccggcgacctccacctttctgtcagcgaagtgcagtcctgtcgccacttctgcaataagatttggaatgctcttagattcatcttaaacgcattgggagaaaagttcgttcctcaaccagctgaggagctctccccatctagccccatggacgcatggattttatcacgtctcgcactggccgcccaagagtgcgaacggggattcctcacgagagaactcagcttggtgacgcatgcactgcaccacttctggctccacaacctgtgtgatgtgtatctggaggccgtcaagccagtgctgtggcatagccccaggcctctggggcccccacaggtccttttcagttgcgccgatctgggattgcgactccttgcaccattgatgccctttttggccgaggaactatggcagcgacttccaccccggcccggatgccctccagctcccagtatctccgttgccccatatccctccgcctgttcactcgaacactggcggcagccagagcttgagagacgctttagcagggttcaggaggtggtacaggtgctgcgggcactacgtgctacatatcagttaaccaaggcccgccccagggtccttcttcagtcatccgaacccggggaccagggactgttcgaggcattcctcgaacctctcggaaccttgggttactgcggagctgttggactgttgccgcctggagctgcagcccctagtgggtgggcccaagcacctctcagcgatacagcccaggtgtatatggagctgcaaggactggtcgatccacagattcagttgccccttctggcagcacgacgctataagcttcagaaacagctagactctctcacagcccgaacgccgtctgagggcgaagcgggcacacagaggcagcagaaattgtcctccctccaactagaactgagtaagcttgacaaagccgcgtcacacctgaggcagctgatggacgagccgccagcccccggatctccagaactgtag

SEQ ID NO: 140350 - DNA, 774 bp, Artificial Sequence
  Description of Artificial Sequence: Synthetic coding sequence
atgccccatttaccattggcctcctttaggccaccattctggggattgaggcattctcgtggtttgccacgatttcactccgtgtctactcagagtgagcctcacggtagccctatcagtcggcgcaatcgtgaggcaaaacagaaaagactccgagagaagcaggctactctggaggccgagatagccggggaatctaaatcaccagccgaatctatcaaagcctggcgccctaaagagctcgtgctgtatgaaattcccacgaagcctggggaaaaaaaagatgtgtcaggcccattgcccccggcttactctccacgctacgtcgaagctgcctggtacccatggtgggtccgcgaaggttttttcaaaccggagtatcaggctaggctcccacaagctacaggagagacattcagcatgtgcattccaccccccaacgtcactggaagcctgcacattgggcatgcgctcacggtggccatccaggacgctctggtgcgttggcatcgcatgaggggagatcaagtgctctgggtacccggctctgatcacgccggcatcgcaacacaggcagtggtagagaagcaactctggaaggagcgtggagtccgtagacacgaactgtcacgcgaggcctttctgcgtgaggtctggcagtggaaagaagccaaggggggagaaatatgtgagcagctcagagctctcggagccagccttgactgggaccgagttttctaccacggctgttggctgttatccggatgcgattag

SEQ ID NO: 140351 - DNA, 3192 bp, Artificial Sequence
  Description of Artificial Sequence: Synthetic coding sequence
atgccacacctgcccctggcatctttcagacctccattctggggactgagacatagtcgcgggctgccaaggtttcatagcgttagcacacaaagcgagccccacggcagtcccatttctaggaggaacagagaggctaaacagaagcgactcagagagaagcaagcgacgctggaagctgaaattgctggggagtccaaatcacctgctgaatctattaaggcctggcgaccgaaagaattggtcttgtacgaaattcccaccaagcccggcgaaaaaaaggacgtgtcgggtcccctgccccctgcttattctccccgatacgtagaggctgcgtggtacccttggtgggtgcgggagggattctttaaaccggagtaccaggcccgcctgccacaggctacaggcgagaccttttccatgtgcattcccccaccgaacgttaccggctccttacacattggccatgccctcacagtggccatccaagatgctcttgttagatggcatagaatgcgaggggatcaagtgctatgggtgcctggtagcgaccatgccggcattgccacccaggctgttgtggaaaaacaactctggaaagaaaggggagttagacgtcatgaactgtcaagagaggcatttctgagggaggtgtggcagtggaaggaagctaagggaggggaaatttgtgagcagctgagggctctgggagcctccctggattgggatagggagtgttttaccatggatgtcggtagtagcgtggccgtaactgaagccttcgtgagactgtacaaggcgggcctcctgtacaggaatcaccaactggtaaattggtcctgcgccctgcgctctgccattagtgacatcgaagtggagaaccggcccctccccgggcacacacagctccgccttcctgggtgccccacaccggtgagctttggcctcctcttctccgtcgccttccccgttgacggggaaccggatgcagaagtagttgttgggaccacaaggcctgagaccctgcctggtgatgttgccgtggcggttcaccccgacgattctcgatatactcacctgcacggcagacagctacgccatccattaatggggcaacccctcccattgattacagattacgcagttcaaccccacgtcgggaccggtgcagtaaaagtcacccccgcccacagtcccgctgacgctgaaatgggcgctagacacggcctgtccccgttgaatgttattgccgaggacgggactatgactagtttgtgtggggactggttgcaggggctgcacagattcgtggcacgagaaaagatcatgtctgtcttgagcgaatggggcttattcaggggcctccaaaatcaccccatggtattgcctatatgctccagatcaggcgacgtgatcgaatatttgcttaaaaatcaatggttcgttaggtgccaggagatgggagccagggctgcaaaagccgtcgaatctggcgcactggagttgtcaccttcctttcatcaaaagaattggcagcactggttcagtcacattggtgactggtgcgtgtctcgccagctctggtggggccatcagatccccgcttatctggtggtggaggaccatgcccagggggaagaggactgctgggtcgtgggaaggtctgaagccgaggcccgggaggttgcagccgagctcactggccgaccgggtgcagaacttacgctcgagcgggacccagacgtcttagatacatggttttcatctgccctgtttccattttcagcgctgggctggccccaggagaccccagatctcgcacgtttttaccctctgtctcttttagaaacggggtcagacctgctgctgttctgggtggggcggatggttatgttgggtactcagctgactggccagctccctttctccaaggtcctcctccatcccatggtccgagataggcagggacggaagatgagtaaatcactgggcaacgtgctggatccccgggatatcatcagcggagtggagatgcaggtgctgcaggagaagttaagatcaggcaacttagatcctgcggaactcgcaatcgtcgcagccgcccaaaaaaaggatttcccacatggcatacctgagtgtggaacagacgccttgcgattcaccctgtgctcacacggcgtccaggcgggagatctccacctaagcgtgtctgaagtgcagtcctgtaggcatttttgtaacaagatctggaatgcactccggttcattctcaacgccttgggtgagaaatttgtgcctcagccggcagaggaattgagtccaagttcgccaatggatgcatggattctctccaggctcgcactggccgcccaggagtgtgagcgtggctttcttacccgtgagcttagcttggtgactcacgccctgcaccacttctggctgcacaatttatgtgatgtgtacctggaagccgtgaagccggttctgtggcactctccgcgtcccctcggtcctcctcaagttctctttagttgcgcggacctgggtctcagactgctggcccccctcatgccatttcttgccgaagagttatggcagagacttcccccccgaccaggatgccccccagccccctcaatcagtgttgctccataccctagcgcctgtagcctcgaacactggagacaacccgaactagagcgaaggttctcaagagtgcaggaagtagtgcaagtgttacgagctctgcgagctacctaccagctgactaaggcccgcccccgtgtcctgctccagagtagtgaacctggggaccaggggctctttgaggccttcttggagccgctaggcacattaggatactgtggcgccgtggggctgctccctcccggtgccgccgcaccaagcggatgggcccaggctcctttgtccgacactgctcaggtgtatatggaattgcaaggacttgtcgacccccagatacagctccctctgttagccgcccgcagatataagctacaaaagcagctcgacagcctcaccgccagaacgcccagtgaaggggaagccggtacccagagacagcagaagctgtcctcacttcagctggagctttctaaactggataaggccgcttcccatctgagacaacttatggatgaacctccagccccagggagccctgaactctag

SEQ ID NO: 140352 - DNA, 348 bp, Artificial Sequence
  Description of Artificial Sequence: Synthetic coding sequence
atgccacatctgcccctggcttccttccgtccccctttttggggcctgcggcacagtcgaggcctgccccgcttccatagcgtcagcactcagtctgaaccacatggttctcccatcagccgaagaaaccgggaagctaagcaaaagcggctgcgggagaagcaagccacactggaagcagagatcgccggggagtccaagtcacctgcagagtctattaaggcttggcggcctaaggaactagtgctatatgagattccaaccaagcctggcgagaagaaggatgtcagtggaccactcccgccagcgtattccccccgatacgtggaagccgcttggtatccatag

SEQ ID NO: 140353 - DNA, 981 bp, Artificial Sequence
  Description of Artificial Sequence: Synthetic coding sequence
atgcctcatctgccgctcgctagtttccgcccccctttttggggtctgaggcactccagaggccttccccggttccactccgtgagtacccagtctgagcctcacggaagccccatcagcaggcggaatcgggaagcaaagcagaagaggctgagggaaaaacaggctactctggaggcggaaatcgctggcgagtcaaagtcacccgcggagtcgattaaagcctggaggcctaaggaacttgtgctgtacgaaatcccaacgaagcccggagagaagaaggacgtctccggcccccttccccccgcctattctcccagatacgtggaggcagcatggtacccatggtgggtccgcgagggttttttcaagcccgaataccaggcccgcctgcctcaggccacaggagagacttttagtatgtgtattcctcctccaaacgttaccgggagtctgcacatcggacatgccctgactgtggctattcaggatgctctggtgcggtggcatcgcatgaggggagaccaggtgttatgggtcccgggttctgatcacgccgggattgccacgcaagctgtcgttgaaaaacagctgtggaaggagcgaggggtacgcaggcacgaactgagcagagaggcattcctaagggaagtttggcagtggaaggaagctaaagggggcgagatatgcgagcagctgcgtgcgctgggtgctagtttggattgggacagagagtgtttcaccatggacgttggcagttctgtggctgttacagaagcattcgtccgactctataaagccgggctgttgtaccgtaaccatcagctcgtgaattggagctgcgcgttgcgctcggcaatcagtgacatcgaggtggaaaatagaccgcttcccggtcacactcagcttaggcttccaggatgcccaacaccagtatcctttggactgctctttagcgtagcgtttcctgtggacgggtag

SEQ ID NO: 140354 - DNA, 3282 bp, Artificial Sequence
  Description of Artificial Sequence: Synthetic coding sequence
atgggcgggaaagcttggccaaggcgcgctgtaggcacagctgggggcccgtgtgcagagcagatatcagctccattccagactctgctgatgcctcatctgcccctcgcgagtttccggccccctttttggggcctgcgccactcaagaggtctccctcgttttcatagtgtaagtacccagtccgagcctcacgggtcacctatctctcgccgcaaccgagaggccaagcagaagcggctgcgcgagaaacaggccactctcgaagctgagatcgccggggaatcaaaatcccccgcggagtctattaaggcttggaggccaaaggaactagtgctgtacgaaattcccactaagcccggcgaaaagaaggacgtttcgggcccgctacctcccgcctatagccctagatacgttgaagccgcatggtacccctggtgggtgcgcgagggctttttcaaacccgaataccaggcaagattgccgcaagctactggtgaaacctttagcatgtgtatccctccccccaacgtcacgggaagcctgcatatcggccatgctttgacggttgcgattcaagacgccctggtgaggtggcatcgaatgcggggggatcaggttctttgggtaccaggcagcgatcacgctgggattgcgacccaggctgtggtcgagaagcaactttggaaggaacgcggggtcagacgccacgaactgagtcgcgaagcctttctccgcgaggtgtggcagtggaaggaggccaaaggcggcgagatctgcgaacagcttagagccctgggggcttccctggactgggatagagaatgctttacaatggacgtggggtcctccgtggccgtcaccgaagcttttgtcaggctgtacaaggctgggctgctttacaggaatcatcagttagtcaactggtcctgtgccctgcgcagcgccatttccgacatcgaagtggagaaccgccctcttcccggccacacccagctccgattaccaggatgcccaactccggtttcttttggtctcctgttttcagtggcatttcctgtagacggagagcccgacgctgaggtggtagtgggaactacacggccagagacattgcccggagatgtggctgtggccgtccaccccgacgatagtcggtatacccacttacacggtcgtcaactgcgccaccctttaatgggacagccactgccattgatcacggactacgccgtgcagccacacgtcggaacgggggccgtcaaagtgacgccagcccactctccagcagatgcggaaatgggtgccagacatggcttaagcccactgaatgtgatcgcagaggatggcaccatgaccagcttgtgtggcgattggctgcagggcctccacaggtttgtcgccagagagaagatcatgtcagtgctgtccgaatgggggttgttcaggggcctgcagaatcatcctatggtgctgcccatatgctccaggtctggcgacgttatcgaatacctgctgaaaaaccagtggtttgtacgttgccaggagatgggtgccagagctgctaaggctgtggaaagcggcgctttagagctaagcccctccttccaccagaagaattggcagcactggttctcccatatcggagactggtgcgttagccggcagctttggtggggccaccagattcctgcctatctggtagtcgaagaccacgcacagggggaagaagactgctgggttgtgggtagaagcgaagctgaggcgagagaagttgccgccgagctaaccggccgccccggggccgaactgaccctcgagagggatcccgatgttctcgatacttggttcagtagcgccttgttccccttcagtgcgctggggtggcctcaggagacgccagatcttgcccgcttttatcccctgtctctcttggagactggctccgacttgttacttttctgggtgggaagaatggttatgctcggaacccaactgaccggtcagttaccatttagtaaggtgctgcttcatccaatggttcgcgataggcaagggagaaaaatgtctaagagcctgggaaacgtgctcgatccacgcgacatcatttccggagtggaaatgcaggtgctgcaggagaaactccgatcaggcaacctcgatcccgctgagttggcaatcgttgccgccgcccagaaaaaggactttccccatggcattcctgaatgtggaacagacgccctccggttcaccctctgcagccacggtgtacaggcaggggatcttcatctgtcagtctcagaagtgcaatcttgcaggcatttctgcaataaaatttggaacgctttgcgatttattctgaacgccctaggtgagaaatttgttccccagcccgccgaagaactgtccccctcatctcccatggatgcttggatcctgtcacgccttgctctggcggcacaggaatgtgagcggggctttctcactagggaactgagtctggtgactcatgctctacaccacttctggctgcacaatctctgtgatgtgtatttggaggctgtaaaaccagtcctttggcacagtccgagacccttaggaccaccccaagtactgttctcctgcgcagacctgggtttgcgactcttagcacccctcatgccctttttggctgaagagctgtggcaacggctgccccctaggcccggatgcccacctgccccttctatctccgtggctccataccccagcgcatgcagcctcgagcactggagacagccagagcttgaaaggagatttagccgcgtacaagaagtcgtgcaggtccttcgcgcattacgcgccacctatcagctgacgaaagctcgaccgagggtgcttttacagtcctcagaacccggcgaccagggactgttcgaggcattcctcgaacccttgggaacactggggtactgcggagccgtgggcctcctcccaccgggtgccgcggccccttcaggctgggctcaggcccctctgtctgacacagctcaagtgtacatggagctgcagggactggtcgatccacagatccagctacctctgcttgccgctaggagatataaactacaaaagcaactggatagcttaacagcgcgaactccgtccgagggcgaagctggcacgcagcgtcaacagaaactttcgagcttacaacttgagttatcaaaactcgacaaagccgcctctcacttaagacagctgatggatgagccgccagcacccggcagtcctgagctctag

SEQ ID NO: 140355 - DNA, 2772 bp, Artificial Sequence
  Description of Artificial Sequence: Synthetic coding sequence
atgtgcattccgcctccaaatgttacaggttcacttcacatcggccacgccctaacagtggcgattcaggacgcccttgtccgctggcatcgtatgagaggtgatcaggtgctctgggtgccgggaagcgatcacgcagggatcgccacccaggccgttgtcgaaaaacagctgtggaaagaacgcggtgtccgtcgccatgaactctccagggaagcgtttctgagggaagtgtggcaatggaaagaggccaagggcggggagatctgtgagcaattaagagcactcggtgcgagcttggactgggacagagaatgtttcacaatggatgtcgggagctccgttgctgtcactgaggccttcgttcgtttgtataaagcaggactgctctatcgaaatcaccagctggtaaattggtcttgcgcccttcggtctgcgatatcagatatagaggtagagaaccggccacttcccggccacacacagctgcggctgccaggctgccctactccagtgagcttcggccttctgttctcagtagcctttcctgtagacggggagcccgacgccgaagtcgtggtaggaacgacacggcccgaaacattgcccggagatgtggctgtggctgtccatcccgacgactcaagatacacccacctccatgggaggcagctcagacacccacttatggggcaacctttgcccctgattacggactacgccgtccaaccccacgtcggaactggagccgtgaaagttacaccagcacacagtccggccgatgctgagatgggcgccaggcatggcttaagtccactgaacgtaatcgcggaagacgggaccatgacatcactctgtggggactggctgcagggactccaccgatttgtcgcgcgtgaaaaaatcatgtctgtgttaagtgagtggggactcttccgcgggttgcaaaaccatcctatggtgctccccatatgctctaggtcgggggatgtgattgaatatcttctgaagaatcagtggttcgtgcggtgccaggagatgggtgctcgggccgctaaagctgtcgaatccggagccctggagctgtcacccagctttcatcagaaaaactggcaacattggttttcgcacatcggtgattggtgcgtgtctaggcagttgtggtggggccatcagatcccagcctacctggtggtagaggatcacgctcagggggaggaggactgttgggttgtcggaagatctgaggcagaagccagagaagtcgctgccgagctaacgggtcgacccggagcagaattgacccttgaaagagaccccgacgtgttggatacctggttctcctccgcgctgttccccttctctgccctgggatggccgcaggaaaccccggacctggcccggttttatcctctgtcgcttcttgaaacaggttcagatctgcttttattttgggttggtcgcatggtgatgttgggcacacagctaacggggcagctgccttttagtaaggtactgctgcatccaatggtcagagaccggcaaggccgcaagatgagcaagtcattgggcaatgtcttggatccccgcgatatcatcagcggcgtagagatgcaagtgctgcaggaaaagctaaggagcggaaacctcgatcccgccgaacttgccatcgtcgctgccgcccaaaaaaaggacttcccgcatgggattcccgaatgcggcactgatgccctcagatttaccctgtgttcacatggtgttcaggccggagacctgcacctcagtgtcagcgaggtacagagctgccgacatttctgtaacaaaatatggaatgcattacgatttatactgaatgcactgggtgagaagttcgtgccacaaccagctgaggagctaagtccctcctcacctatggacgcatggatcctgtcccgcctcgctcttgctgcgcaggaatgcgaaagaggattcctgacaagagagctctctctggtcacacatgctctgcatcacttctggctgcacaatctgtgcgacgtgtaccttgaagcagtaaagccagtgctctggcatagcccaagacccctcggtcccccgcaggttcttttttcatgtgccgatctcggcctccgtctgctggccccattgatgcctttcctggcagaggaactgtggcaacgcctgccacctaggccagggtgcccaccagctcctagcatctccgtagccccgtatccctccgcttgttcgctggagcattggagacaacccgaacttgagaggagattctctcgtgtccaggaagttgtgcaagtgctccgcgcactcagggccacttaccagctcaccaaagctcgaccaagagtcctgctgcaatcatccgagccgggtgaccaggggctattcgaagcttttttagaaccactgggtaccctgggatactgtggcgccgtgggactcctcccacccggagcagctgcgcctagcggatgggcccaggcccccctgagcgatactgcgcaggtatacatggagctgcaggggttagttgatccccagatccagcttccacttctggccgcccggcgctacaaacttcagaagcagctggatagccttaccgcccggactcctagcgaaggcgaggctggaacacagcggcagcagaagctgagttctttacagctggagctgtcgaagctggataaggctgcttcccacttacggcagctgatggatgagcctcccgcacctggcagccccgagctgtag

SEQ ID NO: 140356 - DNA, 885 bp, Artificial Sequence
  Description of Artificial Sequence: Synthetic coding sequence
atggcctcagctagtggcgcaatggcaaagcatgagcaaatcctagtcttggacccgccaactgacttgaagttcaaaggaccttttactgatgtcgttactaccaacctgaagctccggaacccgtcagataggaaagtgtgctttaaggtgaaaaccacggctccaagacggtactgtgtcaggcccaactctggcatcattgaccctggcagtacagtgactgttagcgtgatgctacagcccttcgattatgaccccaatgagaaatctaagcacaaattcatggtgcagaccatcttcgcacctccaaacacgagtgacatggaagccgtgtggaaggaggctaaacccgacgaactgatggatagcaaactccggtgcgtatttgagatgcctaatgagaacgacaaactgggaatcactccacctggaaatgctcctaccgtcacaagtatgtcgagtattaacaacacagtggcgacccccgcttcttaccataccaaggatgatccccggggactgagtgttcttaagcaggagaaacaaaagaacgatatggagccttccaaggctgtccctctgaatgcctcaaagcaggacggacctatgcccaaaccacacagtgtgagcctaaatgacaccgagacacgcaagctgatggaggaatgtaaaagactgcaaggagagatgatgaaactgtccgaggagaacaggcacctcagagatgaaggccttcggctccggaaagtcgcgcactcagacaagccaggctccacgtcgaccgccagcttcagagataacgtcacctcccctcttcccagccttctggtggttatcgcagccatcttcattggcttttttctcggcaaattcattttatag

SEQ ID NO: 140357 - DNA, 750 bp, Artificial Sequence
  Description of Artificial Sequence: Synthetic coding sequence
atggcgtccgcctccggcgccatggcaaaacatgagcagatactggtcctggatcctcccactgatctgaaatttaagggaccctttactgacgtagtgactactaacctgaaacttcggaatccctctgataggaaagtgtgctttaaagtgaaaactacggccccacgtagatactgtgttaggcccaattcgggtatcattgatcctggttccacagtgactgtgagtgtaatgctgcagcccttcgattacgaccctaacgagaagagcaagcacaagtttatggtgcagacaatattcgcccctcccaatacgagtgacatggaggctgtctggaaggaagcaaaacccgatgaactaatggactctaaacttcgttgcgtttttgagatgcccaacgagaacgacaagttaaatgatatggagcctagcaaagccgtgcccttaaacgcttctaagcaggatggtccaatgcctaagcctcactcagtgtccctgaacgatacagagacccgcaagttaatggaagagtgcaaacggctacaaggagaaatgatgaaactgtcagaggagaatcggcatcttcgagacgagggtctgcgtctcaggaaggtcgcccacagtgacaaacctggctctacctctaccgccagtttccgcgataacgtgacgtcccctctgccaagcctgctcgtcgttattgccgctattttcattgggtttttccttggcaaattcattttgtag

SEQ ID NO: 140358 - DNA, 300 bp, Artificial Sequence
  Description of Artificial Sequence: Synthetic coding sequence
atggcaaaggtggagcaggtgctctcgcttgagccacagcacgagctgaagtttcggggcccatttaccgatgttgtgaccaccaacctgaaattagggaatcccactgatcgaaatgtctgcttcaaggtgaagactactgcaccccggcggtattgcgtacggcccaattcgggaataattgatgcgggggcaagtataaatgtctctggaagacgctggacagccgacgaggaggactctgccgaacagcagcctcatttttccatctcacctaactgggagggacgccgcccttag

SEQ ID NO: 140359 - DNA, 732 bp, Artificial Sequence
  Description of Artificial Sequence: Synthetic coding sequence
atggccaaggtggagcaggttcttagcctggaacctcagcacgaactgaaatttaggggaccctttacagacgtggtaaccactaacttaaagctgggaaaccccacagataggaacgtctgcttcaaagtaaagactaccgcaccccgacgatactgcgtccgtcccaactcgggaattatcgatgccggcgcaagcattaatgtcagtgtcatgctgcagccttttgactacgatccaaatgaaaagtcgaaacacaagtttatggtgcaatctatgttcgctccaaccgacacaagcgatatggaggccgtctggaaggaagcgaaacctgaggatctgatggatagcaagctccggtgtgtgttcgagttacctgcagagaacgataaaccgcacgacgtggaaataaacaagatcataagtaccacagcatccaagacagagactccaattgtctccaagtcactctcttccagcctggacgatacagaagtgaagaaagtgatggaagagtgcaagaggctgcagggggaggttcagcggctccgggaagaaaacaaacagtttaaagaagaggacgggctgcgcatgaggaagacggttcagagcaacagtccaatctctgctctggcccctactggtaaggaggagggcctgtccaccagattgctcgccctcgtggtgctcttttttatagtaggggtaattattggcaagatcgctctttag

SEQ ID NO: 140360 - DNA, 1575 bp, Artificial Sequence
  Description of Artificial Sequence: Synthetic coding sequence
atggataccgaatctacatattcaggatactcctattacagcagccactccaagaagtctcaccggcagggcgagcgaacacgggagaggcacaagtccccccgtaataaggatggccggggttccgagaagtctgtcacaattcagcctcccaccggggagccacttctgggaaacgattccactagaacagaagaagtccaggacgataactggggggaaacaactaccgcaattaccggaacaagcgagcacagcatcagccaggaagatatcgcaaggatatccaaggatatggaggactccgtgggcctggattgtaagagatacctgggtcttacagtggcaagcttcttgggtctgctggtgttcttgactccaatcgcatttatccttctgccccctattttatggagagacgagctagagccatgcggcaccatatgtgaggggctatttatttcaatggcttttaaactgcttatcctgctgattgggacctgggcacttttcttccgtaaaagaagagccgatatgcctcgagtttttgtattccgtgctttgttactggtactgatttttctgttcgtcgttagttattggctcttttatggtgtgcggatccttgactcccgtgatagaaattatcagggcattgtgcagtacgctgtgtctctcgtagatgcgcttctctttatacactatctcgcgattgtgctactggagctcagacagctccaacctatgtttaccctgcaggtcgttaggtccacagacggcgagagccgtttctacagtcttggacacctcagtatacagagagcagcacttgtggtgttagaaaattactacaaggactttacaatctataatcctaatttgttgaccgcctccaagtttcgggctgcaaagcacatggcaggcctcaaggtatacaacgtagatggtccttctaataacgctacgggccagagccgagccatgattgcggcagctgcccggcgtcgggattcctcacataacgagctctactatgaggaagctgagcatgagcgacgggtaaaaaaaagaaaagctagattagttgtcgctgtcgaggaggcctttattcacatccagcggctccaggccgaggagcagcagaaggcccctggggaggtgatggacccgcgagaggctgcccaagccatatttccgagcatggcccgggccctgcagaagtatctgaggattacaaggcagcagaattaccattctatggaatccattctccagcaccttgccttctgcatcactaacgggatgacaccaaaagccttcctcgagagataccttagcgcgggaccaacacttcagtatgacaaggatcggtggctttctacacagtggcgccttgtgagcgatgaagccgtcactaacgggcttagagatggaatcgtctttgtgcttaaatgcctggatttctctctggtggtgaacgtaaagaagattcccttcatcattctgagcgaggagttcattgatccaaaatcccataagttcgtcctgcggctgcagagcgaaacgtctgtatag

SEQ ID NO: 140361 - DNA, 1575 bp, Artificial Sequence
  Description of Artificial Sequence: Synthetic coding sequence
atggacacagagtctacttattccggctattcttattacagctcacacagcaagaaaagccacagacaaggggagaggacacgggagaggcacaagagccctagaaataaagatggaagaggaagcgaaaaatcagtgacgattcagcctccaacaggcgagccactactaggtaatgattctacacggacagaagaggttcaggatgataattggggtgaaacaacaacagctattactgggacatccgaacactctatatcccaggaagatatagctaggatctcaaaagatatggaggactctgttgggcttgactgcaagcgttatttaggcctaacagtggcttcatttctcggactcctcgtgtttctcacccccatcgcttttatcctgctgccccctatattatggcgtgacgaactcgagccttgtgggactatttgcgaaggtttgttcattagcatggctttcaaactgctgatcttgcttatcgggacatgggcgctcttcttccggaagcgcagggcagatatgcctcgggtatttgtattccgcgccctgcttctggttctcatcttcctgtttgttgttagctattggttgttctatggagtgcgaattctggattcacgagatcgtaactaccagggtatcgtgcagtacgcagtgagccttgtagatgctcttcttttcatccattacctggccatcgtcttattagagctgcgtcagttacagcctatgtttacactgcaggtcgtaagaagtaccgacggggagagccgtttttacagcctaggccatctgtcaattcagcgggctgccttagtcgtgctagagaattactataaggactttaccatctacaacccaaatctgctgacggcctcaaaattccgcgccgcaaagcatatggcgggtctgaaagtctacaacgtggacggcccctcaaacaacgccaccgggcaatctcgggccatgatagcagctgccgctcggcgccgggactcctctcacaacgagctatattatgaagaggcggaacacgaaagacgggtaaaaaaaagaaaggcaagattggtagtggccgttgaggaggccttcatccatattcagaggttgcaggcggaggaacagcaaaaagctcccggtgaagtgatggatcctcgcgaagccgcacaggctatattccctagcatggcaagagccctgcagaaatacttgcgtatcacgcgtcagcagaactatcacagtatggaaagtatcctgcaacatctcgccttttgcatcactaacggcatgactcctaaagcttttcttgagagatatctgagtgctgggcccacactgcagtatgataaggatcgatggttgtccacgcaatggagactggtgtctgacgaggcagtcaccaatgggctgagggacggcattgtgtttgttctgaagtgcctagacttctcgctggtcgtcaatgtgaaaaagattccattcatcatactgagcgaagagtttatagaccccaaaagtcacaagtttgtcttgcgattgcagtcggagacctctgtttag

SEQ ID NO: 140362 - DNA, 1575 bp, Artificial Sequence
  Description of Artificial Sequence: Synthetic coding sequence
atggatacagagagtacgtactctggctactcatattattcatcccactctaagaagagccaccggcagggagaaagaaccagagaacgccacaagagtcctcgcaataaggacgggcgaggctcagaaaagagtgtcaccatccagccacccacgggggagccacttctgggtaatgattccaccagaacagaggaagtccaggacgataattggggagaaactacaactgcaatcacggggacaagtgagcatagcattagccaagaagacattgctcgaatttcaaaggacatggaagattccgtgggcctggactgcaagcggtatttgggactgactgtggcctctttcctgggactgctcgtgttcctgacaccaatcgcctttatccttcttccgcccatcctttggcgggacgagcttgagccgtgcggtaccatctgtgagggactctttatatctatggccttcaagctcctgattctcctcatagggacatgggccctttttttccgcaagcggcgcgccgatatgccaagagtgttcgtgttccgggccctgctgctggtgctgatctttctgtttgttgtttcgtactggctgttttatggagtgcgcatactagacagccgggacagaaactaccagggcattgtgcagtacgccgtctcactggtagatgctttgctgtttattcattatctggccatcgtgcttctcgagctccgtcaactccagcctatgttcacactccaagtcgtccggagtacggacggggagtctcgattctattcacttgggcatctaagcatccagagggccgcccttgtcgtcctggagaattattacaaggattttaccatctataacccgaaccttttgacggctagtaagtttagagcggccaaacatatggccggtcttaaagtctataacgtcgacgggccatcgaataatgccaccggacagagtcgagctatgattgccgctgcagcccgccgccgtgactccagtcacaatgaactgtactatgaagaagccgagcatgaaagacgcgtgaagaaaagaaaagcgaggcttgtggtggcagtcgaggaggcgttcatccacatccagcgcttacaggctgaggagcagcagaaagccccgggggaggttatggaccccagggaggcggcacaggcaatctttcccagtatggctcgtgcactgcagaagtatcttcgcatcaccagacagcagaactatcattctatggaaagtatactgcagcacttagccttttgtattacgaatgggatgacccccaaagcctttctcgaaagatatctgagcgctggtcctaccctgcagtacgataaggaccgatggttatctacccagtggaggctggtgtcagacgaagccgtgacaaacggactgagagacggcattgtcttcgtgctaaagtgtttagatttctccctagtcgttaacgtgaagaagattccattcatcatcctttcggaagagttcatcgatcctaagagccacaagttcgttctgaggctccagtctgagacttctgtgtag

SEQ ID NO: 140363 - DNA, 1569 bp, Artificial Sequence
  Description of Artificial Sequence: Synthetic coding sequence
atggacactgagagcacttattctggctactcctattattcgtctcattccaagaagtcgcataggcaaggcgagcgtacacgtgaacggcacaaatcccctaggaataaggatggtcggggatcagaaaaaagcgtgacaatccagccgcccactggcgaacctctgctggggaatgacagtactcggaccgaggaagacgacaattggggtgagactactaccgccattacgggcaccagtgaacatagtatctcacaggaggacatagctaggattagtaaagacatggaggacagcgtgggacttgattgcaagcggtatttgggtctcaccgtggcctccttcttgggtttactggtgttcctaaccccaattgccttcattcttctcccacccattctgtggcgcgatgagctggaaccttgtggcactatctgcgagggattgtttatctcgatggcattcaaactgctcattttattgataggtacttgggcgcttttttttagaaaaagaagggctgatatgccgcgagtatttgtatttcgcgcactgctgttagtcttaatttttctcttcgttgtctcctattggctcttttacggcgtgcggatactggactcgagagataggaactaccaaggaattgtccagtatgccgtatctctggtggacgctctgctgttcattcactatttggccattgtcttgctcgagttgaggcagcttcagcccatgttcaccctacaagttgtaagatcgacagatggggaatctcgcttctacagtctcgggcacctgagcatccagagggctgcactggtggtactcgagaactactacaaggactttacaatttataatcctaacctcctaacagcctcgaaattcagggccgcaaagcatatggcaggtctcaaagtatacaacgtggacggtccttccaataacgccaccggacagagcagggccatgatagcagccgccgcaaggcgccgtgactcttctcacaatgagctctactatgaggaggcggaacacgagagaagggtgaagaagcgtaaggccaggcttgtcgtggccgtcgaggaggcctttattcatattcaaagacttcaggccgaggaacagcagaaggccccgggtgaagtcatggacccacgggaagctgcacaggctatctttccttccatggctcgcgcgttgcaaaaatacctgagaattacgcgtcagcagaactatcactctatggagagcatcttacaacatctcgccttttgtattaccaacggtatgacacctaaggcctttttggagagatatctgagtgcagggccgacacttcaatacgacaaagaccggtggctgtccacacagtggcgcctcgtctctgacgaggctgttacaaatgggctccgcgatggaattgttttcgtgctgaaatgtctggatttcagccttgttgtgaacgtgaagaagatccccttcattatcctatcagaggagttcatcgaccccaaatcccacaagtttgtcctgcggttgcagtccgagactagtgtgtag

SEQ ID NO: 140364 - DNA, 1566 bp, Artificial Sequence
  Description of Artificial Sequence: Synthetic coding sequence
atggatactgagagccagtattctggatactcctacaagtccggtcactcacgatcttctcgcaaacaccgcgatcgaagggatcgccaccggtcgaagtcacgtgacggcggccggggagataagagcgtgacgattcaagcacctggagagccactcctcgataatgagagcacccgcggggatgagagagatgataattggggtgagactacaacggttgttactggcacttctgagcatagcatcagtcatgatgatctgactaggattgccaaagacatggaggattcagtgcccctggattgcagtagacatctcggcgttgccgccggagctacactcgcactcctgtcctttctgaccccactcgcattcctattgttaccccccctgctgtggcgggaagaactggagccttgcggtactgcatgcgaggggctttttatatctgtcgctttcaaattgcttatcctgttgctcggtagttgggcacttttttttagacgccctaaggctagcctgccaagagttttcgtgctcagggcactgttgatggtgctagtgtttctgcttgtggtttcgtattggttgttctacggagtgaggatcttggatgcaagggaacggtcttaccagggagtggtgcagtttgcagtgagtttggttgacgctctgctgttcgtccactacttagcagtagtgctgttagagctcagacagctgcagcctcagttcacattgaaggtggttcggtcgaccgacggcgccagccgattctataatgttgggcaccttagtattcagcgcgtagccgtatggatattggagaagtattatcacgacttccccgtgtacaaccccgctctccttaacctgcccaagtctgttttggcgaagaaggtgtcaggctttaaggtctattctctcggggaggaaaattcaaccaataattccacgggtcaaagccgggccgtgatcgccgctgctgcccgccgacgggacaactcccacaacgaatattattatgaagaagccgaacacgagagacgtgttaggaagcgtcgcgcccggctggtcgtagccgttgaagaagcattcacacacataaagcgcttgcaggaagaggaacagaagaatcctagagaagtcatggatcccagagaggccgctcaggcgattttcgcatctatggctagagcgatgcagaagtatttgagaaccaccaaacagcagccttatcatacaatggagtccattctgcagcatctggagttttgtataacacatgacatgacaccaaaggcattcctggaaaggtacctagccgcaggtcccacaattcagtaccataaggagcgctggctcgccaagcagtggacactcgtctcggaggagcccgtgaccaacggtttaaaggacggcatcgtcttcctgctcaagcgtcaggacttcagtctggtagtgtcgacaaaaaaggtgcccttctttaaacttagcgaagagttcgttgacccgaagtcgcacaaattcgtgatgcggctccagtcagaaacatcagtgtag

SEQ ID NO: 140365 - DNA, 1542 bp, Artificial Sequence
  Description of Artificial Sequence: Synthetic coding sequence
atgaccacccaactgcccgcctacgtggcgatcctgctgttttatgtgtccagagcaagttgtcaggacacttttaccgctgccgtttatgagcatgcggcgattctccctaacgccacgttaacccccgtgtcgcgggaggaagctctggccttgatgaacaggaatttagatattctggagggggctatcacgtctgctgccgatcaaggagctcatatcattgtgacccctgaggacgccatctacggatggaatttcaatcgggattcgttgtacccttatttggaggacattccggaccccgaggtcaactggatcccatgcaataaccggaaccggtttgggcaaactcctgtccaggaaaggctgtcctgtctggccaagaataacagcatctatgtcgttgctaacatcggagataaaaaaccttgcgatacatccgacccccagtgccctccggatgggaggtatcaatacaataccgacgtggtcttcgacagccagggaaagctggtggcccggtatcacaagcagaaccttttcatgggcgaaaaccagttcaacgtgccgaaggagcctgagattgttaccttcaataccactttcggcagtttcggcattttcacctgctttgacatactgttccacgatcccgccgtgacactggtcaaagattttcatgtggacacaatagttttccctactgcctggatgaacgtgctcccacacctcagcgcagttgaatttcacagcgcctgggcaatgggcatgcgggtaaatttcctggcctctaacattcactaccctagtaagaagatgactggatctggaatttatgccccaaattcaagcagagcctttcactatgatatgaagactgaggaaggtaagctcctactgtcccaactggatagccatccatcccatagtgccgtggtcaattggacatcttatgcttcatccatcgaggccctgtcctctgggaacaaagaattcaagggaaccgtcttctttgatgaatttacatttgtcaaactcacaggcgttgctggcaactatacagtatgtcagaaagacctctgctgtcacctttcttataagatgtcagagaacattcctaacgaagtatatgctctgggtgcattcgatgggttacacacagtggagggacggtattacctgcagatctgcaccttgcttaagtgcaaaactacaaacttaaatacctgtggcgatagtgcagaaactgcttcaacaaggtttgagatgttttccctctcaggcacctttggcactcaatacgtgttcccagaggttctcctgtcagaaaaccagctcgcccctggtgaatttcaggttagtactgacgggcggttattttccctcaaacctacctctggacccgtcctcactgtcactctgtttgggcgcctatacgaaaaagactgggcatctaatgcttcttccggtctgacggcacaggcccgaatcataatgttaatcgtgatcgctcccatagtctgtagtctgagctggtag

SEQ ID NO: 140366 - DNA, 1563 bp, Artificial Sequence
  Description of Artificial Sequence: Synthetic coding sequence
atggtcaccagtagctttcctatctcagtggccgtcttcgcactgattacactccaggttggtacccaagattcgttcatagccgctgtttatgagcacgctgtcatccttccaaacaagaccgagactccagtaagccaggaggatgccttgaaccttatgaatgaaaatatagacatcctagagacggctatcaaacaagcagccgaacagggagcacgcatcatagtcactcctgaagatgctctgtacgggtggaaatttactagggaaactgtgtttccctatctcgaagatatcccagacccgcaggtgaattggattccttgccaggatccacacagattcggccacacccccgttcaggcccgactgagctgtctagcaaaagacaacagtatttacgtcctagctaacctgggcgataagaaaccatgcaacagtcgcgacagcacatgcccccccaacggctattttcagtataacaccaacgtggtgtataacaccgaagggaagctggtggcccgctatcacaagtatcacctgtactccgaacctcagtttaacgtgcctgagaagcctgaactcgtgaccttcaacactgctttcggcaggttcggcatctttacgtgctttgacatttttttctacgacccaggcgtgactctcgtgaaggactttcacgttgacacaattctgtttccgacagcttggatgaacgttcttcccctgctgacagccattgagtttcattccgcctgggccatgggcatgggggtgaatctgctggtggccaatacccatcatgtctcattgaatatgaccgggagtggtatctacgcgcctaatggtcctaaggtgtaccactacgatatgaagactgagctcggaaagctccttctgagcgaagtggactcgcatcctctcagtagtctggcatatcccacggcggttaactggaacgcctacgccacaactatcaagcccttcccagtccagaagaatacgttccgcggcttcatttctagagacggttttaatttcaccgaattgttcgagaacgctggcaacctaactgtgtgccagaaggagttgtgttgtcacctgagttaccgcatgcttcagaaggaagagaatgaggtatatgtgctcggtgcattcaccggactccacgggagacgaagacgagaatattggcaagtgtgcactttgctcaagtgtaagacgacaaatctgaccacgtgtggcagacctgtggagacggcaagcacacgttttgagatgtttagcctgtcagggacatttgggacggagtacgtgttcccagaggtcctactgacagagattcacctgtcccctggaaaatttgaggtgttgaaagacgggcgtctggttaataaaaatggttcatctggacccatcctcacagtatctttatttgggaggtggtacacaaaagactcactctactcttcatgtgggacctcgaacagcgccatcacttatttgttaatctttatcctccttatgataattgccctgcagaacatcgtgatgctctag

SEQ ID NO: 140367 - DNA, 501 bp, Artificial Sequence
  Description of Artificial Sequence: Synthetic coding sequence
atggtgactagctcttttcctataagcgtcgccgtgttcgccctgattactctccaggtcggcactcaggattcctttatcgccgctgtatacgaacatgctgttattctgcccaataagacggaaacaccagtgtcccaggaagacgcattaaatctcatgaacgagaacatcgacatattagaaaccgccatcaaacaggctgccgaacagggggctcgtatcatcgtgactccagaggacgcattgtacggttggaagtttacacgcgaaacagtgtttccctatctggaggacatcccagatccccaggtaaactggattccatgtcaggatccccaccgtttcggtcacactcctgtccaggcccggctctcctgtctcgcaaaggacaatagcatatatgtcctagctaatctcggggacaagaaaccctgcaattccagggactcaacctgtccaccaaacgggtactttcagtataatacgaatgtagtatag

SEQ ID NO: 140368 - DNA, 1404 bp, Artificial Sequence
  Description of Artificial Sequence: Synthetic coding sequence
atgaatgaaaacatcgacatcctggagacggccataaaacaggctgccgagcagggggcacggattatcgtgacccccgaggacgctctgtacggatggaagttcacccgagagacagtcttcccttacctcgaggacatcccggacccccaagtcaactggattccttgccaagacccacaccgttttggtcacacccccgtgcaggcccggctgagctgcctagccaaggacaatagcatctatgtgttggccaacctgggtgacaagaagccgtgcaacagtagggattctacctgccccccaaacggctactttcagtacaatactaatgttgtttataacaccgaggggaaactggtggcccgctatcacaaatatcacctatactcggaaccgcagtttaacgtgccggagaaaccagaactggtgactttcaacactgcttttgggcgttttgggatcttcacatgctttgacattttcttttacgatccaggcgtgacgctggtgaaagatttccatgttgacacaatccttttccccactgcctggatgaatgttctgcccctgctgacagcgattgaatttcattccgcatgggccatgggcatgggagtgaacctgttggtggccaacacccatcacgtgtctcttaacatgactggttctgggatttacgcgcctaatggccctaaggtgtaccactacgacatgaagacagaactggggaagctgttactgtcggaggtagattctcaccccttaagctcgcttgcataccccacagccgtgaattggaacgcttacgcaacgacaattaaaccgttccccgtgcagaaaaatactttcaggggctttatctcaagggatgggttcaattttactgagttattcgagaacgccggtaatttaactgtctgccagaaagagttgtgctgccacctcagctacagaatgctccagaaggaagagaatgaagtgtacgtacttggggcctttacagggttgcacggccgccggcggagagagtactggcaagtttgtaccctgttgaaatgcaagacaacaaatctgactacgtgcggacgcccagtcgagaccgcatctactcggttcgagatgttctcactgtccggcacattcggcacagaatacgtgttccccgaggtgttacttactgagatccatctgtccccgggcaagttcgaagtcttaaaggatggacgactcgtcaataagaatggatcaagtggcccaatcctgactgtaagcctgttcggcagatggtataccaaggatagcttatatagctcttgcggcacctccaatagcgcgattacttatctcctgatctttattctgctcatgattatagccctgcagaatattgtgatgctgtag

SEQ ID NO: 140369 - DNA, 309 bp, Artificial Sequence
  Description of Artificial Sequence: Synthetic coding sequence
atgaatgagaacatcgatatccttgaaacagccatcaaacaggccgccgagcagggggccaggattatcgtgaccccggaggatgccctttacgggtggaaattcactagagaaaccgtttttccttacctggaagacatacccgacccccaggtaaactggatcccttgccaggatcctcaccgttttggacatactccagtgcaagctcggctatcttgcttagccaaggataactctatctatgtgttagcgaatctcggcgacaaaaagccatgcaattcaagggattccacctgtccaccttag

SEQ ID NO: 140370 - DNA, 306 bp, Artificial Sequence
  Description of Artificial Sequence: Synthetic coding sequence
atggtcacatcctctttccctatctctgtcgcagtgttcgctctcataacccttcaggtgggtacccaagacagttttattgcagcagtgtatgagcacgctgtgattcttcccaataaaaccgaaacacctgtttcacaggaggacgccctgaatctgatgaatgaaaacattgacattctcgagaccgctattaaacaggcagctgagcaaggcgcgcgaatcatcgttactcctgaggatgccctgtacggatggaaattcacacgggaaacagtgttcccctacctggaagacatcccctag

SEQ ID NO: 140371 - DNA, 2931 bp, Artificial Sequence
  Description of Artificial Sequence: Synthetic coding sequence
atggaggagaggaagcatgagacaatgaatcctgctcacgtccttttcgacaggtttgttcaggcaaccacatgtaaaggtaccctgaaggcctttcaggagctctgtgatcatctggagctgaaacccaaagattacagatccttctaccataaattaaagagcaagctcaactactggaaagcaaaagctctgtgggcaaaactcgataaacggggaagccacaaggactacaagaagggaaaggcctgtactaacacgaagtgtctaatcatcggagccggtccctgcggcttgcggacagcaatcgatttgtccctgctgggggctaaagtggttgtgatcgagaagcgcgacgcatttagtcgtaacaatgtcctgcacctctggccattcactattcacgatttaagaggcctaggagcgaagaaattctatgggaagttctgtgcaggagcaatcgaccacatttccattcggcagctgcagttgatcttgctgaaagtggctttaattctgggcatcgagatccatgtcaacgtcgagtttcagggcctgatccagccaccagaggaccaagaaaacgagagaatagggtggagagcgctcgtgcatccaaagactcatcccgtctcagagtacgagtttgaggttataatcggaggcgacggaagaagaaacaccctcgaaggcttcagaaggaaagaattccgggggaagctggccattgcgatcaccgccaattttatcaacagaaacacaactgcagaagctaaagtggaggagatctccggtgtcgctttcatttttaaccagaaattcttccaagagcttcgcgaggcgaccggcatagacctcgaaaacatcgtttactacaaggacgacacgcactattttgtgatgaccgccaaaaagcagtcactgctggacaaaggggttattctgcacgactacgccgatacggagctgttgctcagtagagagaatgtggatcaagaggctttgctatcatatgcacgagaagccgccgatttcagtacccaacagcagctccccagtctcgattttgcgattaatcactatggccaacctgacgtggcaatgttcgacttcacctgcatgtacgcctctgagaacgccgccctggtgagagaacagaatggtcatcagctgctcgtggcgcttgtgggcgactcattacttgaacctttttggccaatgggcacaggtatagctcgaggctttcttgctgccatggactctgcatggatggtcaggtcgtggtctctgggaacatcaccactggaggttctcgccgagcgagaatcaatctaccgcttgttaccacaaacaacccccgaaaacgttagcaagaactttagtcagtactccattgatcccgtaaccagatacccaaatatcaacgtcaactttttaaggcccagccaggtgcggcacttatacgacaccggggagaccaaggatatccacctagagatggaatctcttgtgaactcaagaactacacccaaactgactcgaaacgagagcgtggctcgctcgtccaagttgttaggctggtgccagcggcagactgatggctacgccggggtgaacgtaacagacctgaccatgtcttggaaatctggactggccctgtgtgccataattcatcgttaccgccccgatctcatcgacttcgactctctagatgagcagaacgttgaaaaaaacaaccaactggcatttgatatcgcagagaaagaattaggcattagccctatcatgaccggcaaagaaatggcaagcgttggcgagcctgacaaactgtcaatggtgatgtatttgacccagttctatgaaatgttcaaggacagccttccatctagcgacacactggatttgaatgccgaggaaaaggcagtgctgatagccagcacccgatctccaatctcgttcttgagtaaactgggccagacaatcagtaggaaaaggtcccccaaagataaaaaagaaaaagacctggatggagccggaaagcgccggaagacatcccagtccgaggaagaagaggcgcctcggggacaccggggggaaagaccgaccctggtctcgaccttgacagatcgacgaatggatgttgcagtcgggaaccagaataaggtcaagtacatggccacccagctgctagcaaaatttgaagagaatgcacctgcacaaagcatcggcatccgtcgccagctgacacaagagcggggcgcttcacagccttcatgttgcttgcctggtcaggtgcgccctgcacctacaccccgctggaaacagggaagcatgaagaaagaattccctcagaacctgggcggcagcgacacatgttacttttgccagaaaagggtgtacgtgatggaaagactgtccgctgaagggaagtttttccaccgctcttgctttaagtgtgagtactgtgccactaccctgcgcctctctgcctatgcatatgacatcgaggacgggaagttttactgcaagccacactactgctaccggctgagtggctacgctcagagaaagcggccagcagttgcccccttatccggaaaagaagccaaaggacccctacaagacggcgccaccaccgatgcaaatggccgggcgaacgctgtggcatcttctaccgaacgaactccagggagcggcgtgaacggtttagaggagccttctatcgccaagagacttcgtggaactcccgagaggatcgaactcgagaactacaggctgagtttacggcaagcagaggccctgcaggaggtcccagaagaaactcaggctgaacataacctgtcaagtgtgttggataccggggctgaggaggatgttgctagcagatctgcccgcagggctgccggcaggccaccggcaaccagaccctag

SEQ ID NO: 140372 - DNA, 825 bp, Artificial Sequence
  Description of Artificial Sequence: Synthetic coding sequence
atgatcattagccactttcccaaatgcgtggccgtgtttgcacttctcgctctttctgtgggcgctctggacactttcatcgccgccgtctatgagcatgctgtgatactgccgaataggactgagaccccggtctctaaggaggaggcactcttgcttatgaacaagaatatagatgtgctggagaaggcagtgaaattggccgcaaagcagggagcgcatatcatcgtgacacctgaggacggcatatatggctggatctttacaagagagtccatctacccatacctggaggatattccagacccaggggtcaattggattccttgtcgggacccctggaggttcggtaacactcctgttcagcagcgtctgagttgcctggcgaaggataactccatatacgtggtcgcgaacatcggcgataaaaagccctgcaatgcttctgacagccaatgtccaccagacggtagatatcaatataacacagacgtggtcttcgatagccagggcaaacttctagccaggtatcacaagtacaacctgtttgcaccagaaatacagttcgactttcccaaggactcagagctggttacgttcgacaccccctttgggaagtttggcatttttacatgttttgacatcttcagtcacgaccccgccgtggtggtcgttgacgaattccagctgactgcctttagcactccccagcatggtaccactaggtgccccagctcaaggttgttccctagtattcaacatggaccacggccctgggagtccatctaccttctgcagatccccactacaccagcctgtacttag

SEQ ID NO: 140373 - DNA, 444 bp, Artificial Sequence
  Description of Artificial Sequence: Synthetic coding sequence
atgatcatcagccactttcccaagtgtgtcgctgtgttcgccctgctggccctaagcgtgggcgccttggacactttcatagccgctgtgtatgagcacgccgtcatccttcctaaccggaccgaaacaccagtctctaaggaggaagctctgttgctcatgaacaagaatattgacgtcctggagaaggccgtgaagctggctgccaagcagggggcccacattatcgtcacacccgaggacggtatctacgggtggatcttcactagggagagcatatacccttatctcgaggatatccccgatcccggtgttaactggattccctgtcgtgatccttggagaaagagtaaaaaaatgaacgaacccgtgagtaaagagctgtgttaccactgtcattccgaatgtaatcagtacggccagtggaagctttacaggacttag

SEQ ID NO: 140374 - DNA, 624 bp, Artificial Sequence
  Description of Artificial Sequence: Synthetic coding sequence
atgatcatcagccattttccaaaatgcgttgcagtgtttgccctcctggctctcagcgtcggcgcactggacaccttcatcgcagcagtgtacgagcacgcagtcatccttccaaaccgaacagaaactcccgtttctaaggaagaagcccttctgctgatgaataagaatattgatgtcctggagaaggccgtgaaacttgccgcgaagcagggggctcatatcatcgttacaccggaggacggaatatatgggtggatctttaccagagagagcatttatccgtatctggaggatatcccagacccaggagtcaactggataccgtgcagggacccttggcgatttggcaatactccagtgcagcagcgcctgagctgtcttgctaaagacaacagcatttacgtcgtagccaacattggtgacaagaaaccctgcaacgccagtgattcacagtgccccccagatggacggtaccaatacaacaccgatgtcgtctttgacagccagggtaagcttctggcccgttaccataagggtgttgaaagcaccccccagaaacagagtaggtgcacgactatgacttggaaacagagagtggtgtcatgctgctaccagaactag

SEQ ID NO: 140375 - DNA, 561 bp, Artificial Sequence
  Description of Artificial Sequence: Synthetic coding sequence
atgagtcctaaacccagggcctccggtcccccagctaaggccaccgaggcaggtaagcggaagtctagcagccaacctagcccctccgatccaaaaaagaagactacgaaggttgcaaaaaaggggaaagctgtccggaggggtaggcgggggaagaagggcgctgccactaagatggcggctgtgactgccccagaggctgaatccgctcccgccgcccctggcccttccgaccagccttcccaggagctgccccagcacgagttgcccccagaagaaccggtttctgagggtactcagcacgatcctctgagtcaggaagccgagctggaggaaccactgagtcaagaatctgaagtggaggagcctctgtcacaggaaagccaggtggaagagccgttgtcacaagagtccgaagtggaagagccgctctcccaagagagtcaggtagaggagccacttagtcaggagtccgagatggaagagccactgtctcaagagagccaggttgaagagccaccttcccaagaatctgagatggaggaactcccgtccgtgtag

SEQ ID NO: 140376 - DNA, 621 bp, Artificial Sequence
  Description of Artificial Sequence: Synthetic coding sequence
atgagtccaaagccccgggcatcaggccctccagctaaagcaaccgaggcaggaaagagaaagagctccagtcagccctcacccagcgaccctaagaagaagacaaccaaggttgctaaaaagggaaaagccgtgcgccgcggacggcgaggcaagaaaggcgcggcaacaaaaatggcagccgttactgcccctgaagccgaaagtgccccagcagcccccggcccaagcgatcagccaagccaggagttaccccagcatgaactgccgccagaagagcctgtctctgagggaacccagcatgatcctttgagtcaagaagcggagttggaagagccgctttcacaggagtctgaggtggaggagccactgtctcaggagtcacaagtcgaagagcccctctcccaggagtcggaggtggaagagccactcagccaagagagtcaggttgaagagccactgtctcaagaatccgaagtggaagaacccctgagccaggaatcccaagtagaggaaccactgtcacaagagtccgaaatggaggaacccctgtcccaagaaagccaagtggaagaaccaccctcccaggagagcgaaatggaggagctgcctagtgtctag

SEQ ID NO: 140377 - DNA, 420 bp, Artificial Sequence
  Description of Artificial Sequence: Synthetic coding sequence
atgagcccaaagcccagggcaagtggtccccctgccaaagcaactgaggcaggaaagaggaagagctctagccaacccagcccaagtgacccaaagaaaaagaccacaaaagtggccaagaaaggaaaagccgtgaggaggggtaggagggggaagaaaggggctgcgaccaagatggcagctgttactgcccctgaagcggagtccgctccggcagcaccaggcccaagcgaccagcctagtcaggagcttccccaacacgagctcccccccgaagaacccgtgtccgaaggaactcagcacgatcccctaagtcaggagagcgaagtggaggaacccctcagtcaagagagtgaggttgaagaaccactgacagtttggatggcgagcttcagtcctgtttctgaatcgacagattag

SEQ ID NO: 140378 - DNA, 561 bp, Artificial Sequence
  Description of Artificial Sequence: Synthetic coding sequence
atgtccccaaaaccacgggcttccggcccccctgccaaggcgaccgaggcaggaaagcgcaaatcctcaagccagccctcccctagcgacccaaagaaaaagacaaccaaagtcgcaaagaaaggcaaggcagtgaggcgcggtcgaagaggcaagaagggggctgcaactaagatggccgcagttacagcaccggaggccgaatccggcccagccgctccgggaccctcggatcagccgtcccaggagctgcctcagcacgaactgcccccagaggagccagtttctgagggcacccagcacgatcccctatcacaggaatcagagctcgaggaaccgctgagtcaggaaagtgaagtcgaagagccactgtcacaggagagtcaggttgaggagcctctaagtcaggagagcgaggtcgaggagcccttaagccaggaatcacaggtcgaagaacccttgagccaggaatccgaggtggaagagccactaagccaagaatctcaagtggaggagcctttaagccaggagagtgagatggaagagctgccctcagtctag

SEQ ID NO: 140379 - DNA, 501 bp, Artificial Sequence
  Description of Artificial Sequence: Synthetic coding sequence
atgagcccaaagccgcgggcttccgggccccctgccaaagccactgaagccggcaagagaaagtcatcgtcacagccctctccaagcgatcccaaaaagaagactacgaaagtggcgaagaagggcaaggccgtcaggcggggcagacgggggaaaaagggagctgccactaaaatggctgctgtgaccgccccggaagctgaatcaggcccagcagctccgggaccaagcgatcaaccatcacaagagctgcctcagcatgagctcccccccgaggagcccgtctcagagggaacacagcatgatcctctctcacaggaatccgaactcgaggaacctctgtcacaggagagtgaagttgaggaaccattaagccaggagtcccaggtcgaagaaccactgtcgcaggagtcagaggttgaggagcccctgagtcaggagtcccaggtagaggagccattgtctcaagagtcagaaatggaggaattgccttcggtgtag

SEQ ID NO: 140380 - DNA, 378 bp, Artificial Sequence
  Description of Artificial Sequence: Synthetic coding sequence
atgtcccctaaacctagggccagcgggccccccgcaaaagcgactgaggccggaaaaaggaagagctcgagtcagccatctcccagtgatcctaagaagaaaaccactaaagtagccaagaagggcaaggccgtgcgccgaggtagacgtggcaagaagggggctgccacaaaaatggctgcagtgaccgctcctgaggctgaatctggcccagccgcccccgggccttctgaccagccttctcaagagctgccacaacatgaattgccccctgaagagcctgtcagcgaggggacccagcacgaccccctgtctcaggagtccgaactagaagaaccactgagccaggagaggcccgccactccactttcgccctag

SEQ ID NO: 140381 - DNA, 378 bp, Artificial Sequence
  Description of Artificial Sequence: Synthetic coding sequence
atgtctcccaagccccgggcatctgggcctccagccaaagcgaaagaaacaggcaaaagaaagtcctcctcccagccttcaccttccggccccaagaagaagactacgaaagtggccgagaaaggggaagccgtccgcggcggcagaaggggtaaaaagggcgccgctactaaaatggcagcagtgacagcccctgaagccgagtccggccccgcagcccccggcccctccgatcagcctagtcaggagctgccccagcacgaactgccacccgaggaaccggtcagtgaaggaacgcaacacgatcctctcagccaggagagcgagctggaagagcccctctctaagggccgcccaagcacaccgttgtctccctag

SEQ ID NO: 140382 - DNA, 2220 bp, Artificial Sequence
  Description of Artificial Sequence: Synthetic coding sequence
atgcctggaaaaatggtcgtcattctcggagctagtaacatcctctggatcatgtttgcagccagccaggccttcaaaatagagactacaccagagagccgctacctggctcagatcggtgactctgtctccctcacgtgctcaactacgggatgtgaaagcccttttttctcttggcgcactcagatcgacagtcccctcaatgggaaagtcactaatgagggtacaactagcacccttactatgaatcccgtgtcatttggcaacgagcattcgtacctgtgcaccgctacatgtgaaagtaggaagctggagaaaggtattcaggtcgaaatttatagctttcccaaggatcccgagattcatctaagcggcccactggaggccggaaaacccataactgtcaagtgtagcgtggctgatgtctacccattcgatcgcctggaaatcgatctgctgaagggtgaccacttaatgaaatcccaggaattcctcgaagatgccgatagaaagagtctggagacaaagtcactggaagtgactttcacacccgtcatcgaagatataggcaaagtgctggtgtgtcgggccaagttgcatattgatgagatggactccgtccccactgttcgacaggccgtcaaggagctgcaagtgtacatttccccgaaaaataccgtcatctctgtgaatccatcaacaaagctacaggaggggggcagcgtcactatgacgtgcagttctgagggcctgccagccccggagatcttttggtctaagaagctcgataatggaaatcttcagcatctgagcggcaatgctactctcacattaattgccatgaggatggaggatagcggtatttatgtgtgcgagggcgtgaatctcatcgggaaaaaccgcaaagaagtggagcttatagtgcaagaaaaacccttcacagtggagatttctcccggtcccaggattgcagcacagatcggcgattccgttatgcttacttgctcagttatgggatgcgaatctccatctttctcttggcggactcagattgattctcccctgtctggaaaggtaaggtctgaaggaacgaacagcacacttaccctgtcccccgtttcttttgaaaatgagcattcttatttgtgtactgtaacatgcgggcataagaaactggagaagggcatccaggtggaactctattctttccctagggatccagagatcgaaatgtcaggtggactggtcaacggctcctctgtgactgtttcctgcaaagttccgagcgtgtaccctctcgacagactggaaatagagctcctgaagggtgagacaatactggaaaacatcgaattcctcgaagatacagatatgaagagccttgagaataaatcccttgagatgaccttcatacccacaatagaagacacaggtaaggctctcgtgtgtcaggccaaactgcacatcgacgatatggagtttgagccaaaacagcggcagtcaacacaaacattatacgtcaatgtagccccacgcgacaccaccgttctcgtttctccctcttccatattggaggaaggcagtagcgtcaatatgacatgcctgtctcaaggcttcccggcgcctaaaattctgtggagtcggcagctgccaaatggggagttgcagcctctaagcgagaatgctacattaacgcttatcagtaccaagatggaagacagcggagtgtacctatgtgaggggataaatcaggctggtaggtctcgtaaagaagtggagctcatcatccaagttacccctaaggacataaagttaacggctttcccatcagaatcagtcaaagaaggcgataccgtgataatttcttgtacatgtggcaatgtcccggaaacatggattattttgaagaaaaaggccgagaccggagacaccgtcttgaagagtatcgacggtgcatacaccatccgcaaagcccagctgaaagacgccggggtgtacgaatgcgagagtaaaaataaggtaggatctcagctgcgctcactcacactggatgtccaggggcgggagaataacaaggactatttctcgcctgagctattggttctgtactttgctagttctctcatcatacctgccattggcatgatcatctattttgcccgtaaggctaatatgaaagggtcatacagcctggtggaagcacagaagtctaaggtgtag

SEQ ID NO: 140383 - DNA, 1944 bp, Artificial Sequence
  Description of Artificial Sequence: Synthetic coding sequence
atgcctggcaagatggtggtcatcctgggcgcaagcaatatactgtggatcatgtttgcagctagtcaagccttcaagattgagaccacacctgaatctaggtatctggcacagatcggggacagtgtgtctcttacatgtagtacaacaggatgcgaaagtcccttttttagctggcggacacaaatcgacagtccacttaacggaaaggtgactaacgaaggtaccacttctactttaaccatgaatccggtgtcctttggtaatgagcacagctatctctgcaccgcaacgtgcgaatcccggaagttagaaaaaggcatccaggtggagatatactctttccccaaggaccccgaaattcacctcagtggacccttggaggcagggaagccaattaccgtgaaatgcagcgtggccgatgtatatcccttcgatcggctggagatcgacctgctaaagggagatcacctgatgaagagtcaggagttcctggaggatgccgaccggaagtctctcgaaacaaaatctctcgaagtcactttcaccccagtaattgaagatattggcaaagtgctagtgtgcagagctaagctccacattgacgaaatggacagcgtccccaccgtgaggcaggcggttaaagagctgcaggtttacatctcaccaaaaaataccgtcatcagcgtgaacccttctaccaaactgcaggagggtgggtcagtgacgatgacctgtagttcagagggactgcccgccccagagattttctggtcaaagaaactcgacaatggaaacctccagcacctcagcggaaacgcaactttgacactcattgccatgcgcatggaagactccgggatctatgtttgtgagggcgtgaatttgatcggtaagaatcggaaggaggttgagctaattgtgcaggcctttccacgagatcctgaaatagagatgtccggcggcctcgttaatggcagcagcgtgacagttagctgtaaggtccccagtgtataccccctggacaggctggaaatcgaactgcttaaaggagagaccatcctggaaaacatcgagtttctggaggacactgatatgaagtccctggaaaacaagagcctggaaatgacatttataccgacgatcgaagacaccggaaaggctctggtgtgccaggccaaactgcatattgacgacatggagttcgaacccaaacagagacagagtacccaaacactctacgttaacgttgctccaagagacacaactgtcctggtgtccccatcaagtatcctcgaggagggaagcagcgtcaatatgacatgtctctcacaggggttccctgctccaaaaatcctctggagtagacagctacctaacggagagctgcagccattgtctgagaacgctactctgacactgatctctacaaagatggaggactcaggcgtatacctgtgtgaaggcatcaatcaggctggacgtagcagaaaggaggtggagctaattattcaggttacacctaaagacataaagctgacagcttttccaagcgagagtgttaaggaaggcgacacagtcatcatttcttgtacttgtgggaacgtccccgagacttggattatccttaaaaagaaggcagagacaggggacactgtgctgaagagcatcgacggggcctacactataaggaaggcccagctcaaggatgcgggcgtctacgaatgcgagtcaaaaaacaaagtgggatcacagctgagatccctgactctcgatgtgcaggggcgtgagaacaacaaagattacttttccccagaactgttagtgttatacttcgcgagtagtctgattatccctgctattggtatgataatttacttcgctaggaaagcaaatatgaagggctcatattccctggtggaggcgcagaagtccaaggtatag

SEQ ID NO: 140384 - DNA, 1623 bp, Artificial Sequence
  Description of Artificial Sequence: Synthetic coding sequence
atgcccggcaagatggtggtgattctgggagccagcaacattctgtggattatgtttgctgcctctcaagccttcaagatcgagaccactcctgaatcacgttatctggcccagatcggtgactcggtcagcttaacatgctccaccaccggatgcgagtcaccgtttttttcttggcgcacccagattgacagccccctcaacggaaaggtcacgaacgagggcaccacaagtactctaaccatgaacccggtcagtttcggaaatgaacactcgtacctttgtaccgcaacatgtgaatcaaggaaattagagaagggcattcaggtggagatctactcatttcctaaggaccctgagattcacctgtcaggacccctcgaagccgggaaacctataacagtcaaatgctctgtggctgacgtatacccttttgataggctggaaatcgacctgctaaagggcgaccacctgatgaaatcccaagaattcctagaggatgccgacaggaagagcctagagaccaaatcgttggaggtgacatttacgccagtgatcgaggatatcgggaaggtgctggtatgtagagcaaagctccacatcgacgagatggactccgtccctacggtcaggcaagcagtgaaggaattgcaagtgtacatctcaccaaagaacaccgtgatttctgtcaatcccagcacaaagctccaggagggtggcagtgtcactatgacctgtagctcagaagggctgcccgctcctgagattttctggtctaaaaagctcgacaatggcaacctccaacatctgtcaggtaatgctacattgacactcatcgcgatgcggatggaagatagcggcatttatgtttgtgagggcgtgaacttgattggcaagaacagaaaggaagttgaattgatcgtacaggtcgccccacgagatacgaccgtactggtatcgccgagctctattttggaagaaggatcttccgtgaatatgacctgcctgagccaggggttcccagcccccaaaatactctggtccagacagctacctaacggagaacttcagcctctcagcgaaaatgcgacactgaccctgataagcacaaagatggaggactccggggtctatctttgcgaaggtattaaccaagccgggcgctccaggaaggaggtggaactaattatccaagttactccgaaggacattaagctaacggcattcccaagcgagagcgttaaagagggcgacaccgtcatcattagctgtacatgcggaaatgtgccagagacatggataatcctgaaaaaaaaagcggagacaggcgatacagttttaaagtccatcgacggggcctacaccatacgaaaggcacaattgaaggatgctggcgtgtatgagtgtgagagcaaaaacaaagtggggtcgcagctacgctcccttacgttggatgttcaaggccgtgaaaataacaaggactacttctcgccagaactgctggtactgtactttgctagcagtctgataatccctgctataggcatgattatctactttgcccggaaagccaacatgaaagggagctattccttggttgaggcccagaagagcaaggtgtag

SEQ ID NO: 140385 - DNA, 2034 bp, Artificial Sequence
  Description of Artificial Sequence: Synthetic coding sequence
atgccgggaaaaatggtggtaatcctcggtgccagcaatattctctggatcatgtttgccgcctcccaggcctttaaaattgagaccacacccgaatcaagatacctcgcccagatcggagattctgtctctctcacatgcagcacgaccgggagctttccgaaggatccggagatccacctgtccggccccctggaggctggcaagcctattaccgtgaagtgctctgtcgctgacgtttatccattcgatagactggagattgatttactgaagggggaccacctcatgaagtctcaagagttccttgaggacgcggataggaaatctctggaaactaaatctctagaggtgacattcactccagtgatcgaagatatcggaaaggtgttggtgtgtagggcaaagttgcacatcgatgagatggattcggtgcccaccgtacgccaagcggtcaaggaacttcaggtttatatcagccccaaaaataccgtgattagcgtcaatccttccactaagctccaggaaggcggtagcgttaccatgacgtgttccagtgagggcctgccagcacctgaaatcttttggagcaaaaagttggataacgggaatttacaacatctctctgggaatgcaacccttaccctaatcgctatgcgaatggaagacagcggtatttatgtgtgcgagggagttaacctcattggcaagaaccggaaggaagttgagctgatagtccaggagaagccgttcactgttgagatatcccccgggccaagaatcgctgcccagataggcgacagtgtcatgttaacctgtagcgttatgggctgcgagtctccctccttctcttggcggacacagatcgattccccactgagcgggaaagtcaggtcagagggcaccaattccaccctgaccctgtctccggtatcttttgaaaacgagcatagctatttgtgtacggtgacttgcgggcacaagaagcttgagaagggaattcaggtggaactttattcattccccagagacccagaaattgaaatgagtggaggcctggtgaatgggtcatctgtgaccgtgagctgtaaggtaccatccgtgtatcccttagaccgtcttgagatagagctgctcaaaggcgaaacgatcctggagaacatcgagttcttggaggacaccgacatgaagagtcttgaaaacaaaagccttgagatgactttcatacctaccattgaagataccggcaaagccctcgtgtgtcaggctaaactgcacattgacgacatggaattcgagcccaagcagaggcagtccacccagactctgtacgttaacgtcgcccctcgggacacaaccgtccttgtctctccctcctcaatactagaggagggatcatctgtaaacatgacatgtttgtcacagggcttcccagctcctaaaatcctatggagtagacagctcccaaatggagagctccagcctctgtcagagaacgccacactgacattgatttccacaaagatggaggatagtggagtatacttgtgtgaaggcatcaaccaggcgggaaggtctcgcaaggaagtggaactgatcatccaggtgacgcccaaggacatcaagctcaccgcattcccgtcagaatctgttaaggagggggacacggtgatcattagctgcacttgtggcaacgtgcctgaaacttggatcattttaaaaaaaaaggccgagaccggcgacaccgttttgaagagcatcgacggcgcttatacaattcggaaggctcagttgaaggatgctggggtgtacgagtgtgagagcaagaataaggtggggagccagttgcgcagcttgaccctggacgtgcagggcagagaaaacaataaggactatttcagcccagagcttctggtgttgtatttcgctagcagcctcataatcccagctatcggtatgatcatctatttcgccaggaaggcaaatatgaagggatcctactctctagtagaggctcagaagtccaaggtgtag

SEQ ID NO: 140386 - DNA, 1566 bp, Artificial Sequence
  Description of Artificial Sequence: Synthetic coding sequence
atggaggcaaactggacagccttcttatttcaggcacatgaagcaagtcatcatcagcagcaggccgcgcaaaactctcttcttccgctgttgagctcagccgtggagccaccagatcagaagccattactgcctatccccatcacacagaagccacagggggctcccgagactctgaaggacgcgatagggatcaaaaaggagaagccaaagaccagctttgtgtgcacttattgctctaaggccttcagagatagttaccacctccgtagacacgagtcttgccatactggtattaagctggtctcgcggcctaaaaagaccccaacaaccgtggtacctctgattagcacaattgccggcgactcatcacggacttccttagtttccaccattgccgggattctgagcactgtgacaacatcaagcagtggcacaaatccctcctcctcagcctccacgaccgctatgcccgtcactcaatcagtcaagaagcctagtaaacccgtaaagaagaaccatgcgtgcgagatgtgcggaaaggcattcagggatgtgtaccatctcaacagacacaagttaagccacagcgacgagaagccattcgagtgccccatctgcaaccagcggttcaaacgaaaggatcggatgacataccacgtcagatctcacgaagggggtattactaagccttatacctgcagcgtctgtgggaagggatttagcaggcctgaccacctctcatgtcacgttaaacacgtgcattcaactgagcggccatttaagtgtcagacctgcacggcggctttcgccacaaaggatcggctgaggactcacatggtcagacatgagggtaaagtatcatgcaacatatgcggcaagctcctgtccgcggcctatatcacctcccacctaaagactcacggacaatcacaatcaattaactgcaacacctgcaaacagggaatttccaagacgtgtatgtcagaggaaacgtctaatcagaagcaacagcagcaacagcagcagcagcagcaacagcagcagcaacagcagcagcagcacgtgacctcttggcccggtaagcaggtcgagactctccggctgtgggaggaagccgtgaaagcccgcaagaaggaagcggccaacctgtgtcagacgtcaaccgccgccaccacacccgtgacacttacaacgcccttttctataacgagttccgtgagttcgggcacaatgtctaatccagttacagtggccgcagctatgtccatgcgcagccctgtgaatgtgtcttctgccgtgaatattaccagtccaatgaatataggccatcccgtcaccatcaccagcccattgagtatgacctcccccctgaccctgacgaccccagtcaacttgcctactcctgttacagctcctgttaatatagcacaccccgttactatcactagtccaatgaacctgcccactcccatgaccttggccgcacctctgaatatcgcgatgaggccagtggagtctatgccctttttacctcaggcactgccaacatccccgccatggtag

SEQ ID NO: 140387 - DNA, 1566 bp, Artificial Sequence
  Description of Artificial Sequence: Synthetic coding sequence
atggaagcgaattggaccgctttcctctttcaggctcacgaggcttctcaccaccagcagcaagccgctcagaactctctcctccctctgctgtcgagtgcagtggagccacctgaccagaaacctcttcttcctatacccataactcaaaagccacagggcgcacctgagacgctaaaggatgcaattggcatcaagaaggagaagccgaaaacatcattcgtgtgtacctactgtagcaaagcctttcgcgactcgtaccatctcagaagacatgaatcctgccacacgggcattaaactagtgtctcgtccaaagaaaacccctacaactgtcgttccgctgattagcaccatcgctggagactcctccaggacctccctagtatcgactatcgctgggatcctatccaccgtgacgactagctcttccggcaccaacccttcctctagtgcctcaaccactgccatgcctgtgacccaaagtgtgaaaaagccatccaaaccagtgaagaaaaaccatgcatgtgaaatgtgcggaaaagcatttcgggatgtgtaccatttaaataggcataaactgtcacacagcgatgaaaaaccatttgagtgtcctatttgtaatcagcggtttaaaaggaaggaccgcatgacttaccatgtgcgctcccacgaaggtgggattacaaagccctacacttgttctgtatgtggaaagggtttctcccggcccgatcatttaagttgtcacgtaaagcacgtgcactcaactgaaaggccatttaagtgccagacatgcactgccgcctttgctacgaaagataggttgcgcacacacatggtgcggcacgaaggtaaggtatcttgcaatatctgtggaaagctgttgtctgccgcctatatcacgagtcacttgaaaacccacggacagtcacaatcaattaactgtaatacctgtaaacagggaatctcgaagacctgcatgtccgaagaaacctcaaaccagaagcagcagcagcagcagcagcagcagcagcagcaacagcaacaacagcagcagcagcatgtgacgtcttggcccggcaagcaagtcgagacactgcgcctgtgggaggaggctgtgaaggctcggaagaaggaagcagctaacctttgccagacatcgactgcagccactactccagtgaccctgacgacacccttcagcatcacctcttctgtgtcaagtggaacgatgtccaatcccgtgacagtcgcagctgccatgtccatgagatctcccgtcaacgtgagcagcgccgtgaatattacttctcccatgaacatcggacacccagtgacaatcacatcaccgctgtcaatgacttcgccactcacgctgacaaccccagtgaatttaccgaccccagtgaccgctcctgtcaacatagctcacccagtgacaatcacatctccgatgaatctgcccactcctatgaccctggccgctcccttgaacattgctatgagacccgtggagagcatgcccttcttaccccaggccctgcctacctcaccaccctggtag

SEQ ID NO: 140388 - DNA, 1374 bp, Artificial Sequence
  Description of Artificial Sequence: Synthetic coding sequence
atgcggcccccatcgccccttccagcgcggtggctctgtgttttggccggtgctttggcctgggcgttagggcccgcaggcggtcaagcggccaggctacaagaggaatgcgattacgtacagatgatcgaggtacagcacaaacagtgcctggaggaggcacaactggagaacgaaactatcggctgcagcaagatgtgggacaatttgacttgctggcccgccacacctcgcggccaggtcgtggtccttgcctgtccgctcatttttaagcttttttcgagcatccagggacggaacgtttctcgtagctgtactgatgagggttggacacatctggagccaggcccttaccctatcgcttgtggactggatgacaaggctgcttcgttggacgaacagcaaaccatgttttatggttcagtgaagacaggctacaccatcgggtacggtctgtcactcgccacgctgctggtggccaccgcaattctgagtctctttagaaagctacactgcacccggaattatatacacatgcacctcttcatttccttcatcctgcgcgccgcagctgtcttcattaaagacctggccttattcgattctggcgaatcggatcagtgcagtgaagggagcgtgggctgcaaagctgctatggtgttcttccagtattgtgtcatggctaattttttttggcttttggtggagggcctctatctgtacacccttcttgcagttagcttctttagcgagcgcaagtacttctggggatacattctgattggatggggcgtgccgtcaacattcacaatggtgtggactatcgctcggatccattttgaggactatgggtgttgggatactataaattccagtctctggtggatcatcaagggtccaatcctgacgagtatccttgtgaacttcatcctgttcatatgtataattaggattcttctgcagaaactgcgtcctcccgacatccgcaaaagcgactcttccccatactctcggctggcacgcagcaccctgctcttaatcccactcttcggtgttcactatatcatgttcgccttcttccctgacaatttcaagcctgaggtaaagatggtgtttgagctggtggtgggttcctttcaaggatttgtggtggccattctgtactgttttctaaatggagaggtccaggctgagctgcgtaggaagtggcgacgatggcacctgcaaggtgttctcggctggaaccctaagtatcggcaccctagcggcgggtctaatggggccacttgtagcactcaggtgagtatgctgaccagagtgtccccaggagcgcgccgcagtagctccttccaggcagaagtatccctggtgtag

SEQ ID NO: 140389 - DNA, 1251 bp, Artificial Sequence
  Description of Artificial Sequence: Synthetic coding sequence
atgatagaggtgcaacataaacaatgcctggaagaggcccaactcgagaatgaaactattggctgctccaaaatgtgggacaatcttacctgttggcctgcaactccaagagggcaggttgttgtgttggcatgccctctgatcttcaaactcttcagctctattcagggcagaaatgtgagccgcagctgtaccgacgaaggatggacacatctggagcctggaccataccctattgcctgtgggctcgacgataaggccgcatcactggatgagcagcaaactatgttctacggctctgttaaaacagggtacaccattggatatggcttgagccttgcgacgcttctggtagccactgcaatcctgtccttgttcagaaaactgcattgcaccagaaattacatccacatgcacctgttcatctccttcatcctgagagctgccgccgtgtttatcaaagacttggccctgttcgactcaggagagagcgatcagtgcagcgagggctccgtgggatgtaaagccgccatggtgttcttccagtactgtgtgatggccaacttcttctggctgttagttgagggcctctatctgtacaccctgctggccgtctcattttttagtgaacggaagtacttttggggttacatactgattgggtggggagtaccgtcaactttcactatggtctggaccatagcccgcatccatttcgaagactatgggtgctgggacaccatcaacagctcattgtggtggatcattaaaggtccaatcctgactagtatcctcgttaattttatactttttatttgcataatccggatcctgctgcagaaactccggccacctgacatacgtaagtctgactcaagtccttactccaggctggcgcgatctactttactgttaattcccctgttcggtgtgcactacataatgtttgccttctttcccgataactttaagccagaggtgaagatggtgtttgagctagtggtcggttcattccaggggttcgtggtcgccattctgtattgtttcttgaacggagaggtgcaggccgagctccgacgaaagtggagaagatggcacttgcagggagtgctcggctggaatccaaaataccgacaccccagtgggggatccaatggagcaacctgctctacacaggtgagtatgctgacgcgcgtgtccccaggagccaggaggtcaagctcctttcaggcagaggtgtctctggtatag

SEQ ID NO: 140390 - DNA, 744 bp, Artificial Sequence
  Description of Artificial Sequence: Synthetic coding sequence
atgacaagacagcgggtatggatgcggtgggctgtgcgacagccatggagctttagcaacattgtgagctggttgacaagctccggctgctggtggcgtgctagtacatgcacaccgtgcttgccctcaccatcttcactgtcaggatctacctcagggggagtgccaagcacatttacaatggtgtggaccattgccaggatccactttgaagattacgggtgctgggacacgatcaatagcagtctttggtggatcataaagggccccattctgacctctatcctggtcaacttcatcttattcatttgcattattcgaatcctcctccagaagctccgaccccctgacattaggaagtccgattcctcaccatattcccggctggctagaagtacactgctgctgattcccctttttggcgtacactatatcatgtttgccttcttccctgataactttaagccggaggtgaaaatggtgttcgaacttgtcgttgggtcattccagggatttgttgttgcaattctgtattgttttttaaatggtgaggtgcaagcagaattgagacgcaaatggcggcgttggcatttgcagggtgtcctgggatggaatccaaaatatcgacatccatccggcggctcgaacggagccacctgctcaacccaggtgtcaatgctaacccgcgtgtctccgggcgcccggaggtcatcctcttttcaggccgaggtgtcactggtgtag

SEQ ID NO: 140391 - DNA, 1230 bp, Artificial Sequence
  Description of Artificial Sequence: Synthetic coding sequence
atgcgtgccggtagacggccaagactggggccgtgggccggcgggtgctcgaagatgtgggacaacctcacgtgctggcctgccacgccccgggggcaggtggtggtactcgcctgccccttgatcttcaagctcttcagtagtatccaaggaaggaacgtctcaagatcgtgtacagatgaaggctggacgcaccttgaaccaggtccttaccccattgcctgcggattggacgacaaggccgcctccctggacgagcaaacaatgttttacggcagtgtcaaaacgggatacaccatcggatatggtctctcactggctaccttactggtggcgactgccatattatccctgtttaggaagctgcattgtacaagaaattatatccacatgcacctgtttatttcttttatcctgagggccgccgccgtgtttatcaaggatctcgcactgttcgactccggtgaaagcgaccagtgcagcgaaggatcggtgggatgtaaggccgctatggtttttttccagtactgtgttatggcgaactttttttggcttttggttgagggtttatatctgtacactctcttggctgtctcctttttttccgagaggaagtacttctggggctatatcctgatcggctggggggtgccttctacgtttacgatggtatggaccatcgccagaatacacttcgaagactatggctgttgggatacaataaatagtagcctgtggtggattatcaagggtccaatccttacaagcatactggtcaatttcatcttgtttatctgcataatcagaattctcttgcagaagttgcggccccccgacatcagaaaatcggactccagtccttattcgcggctggcacgttcaacgctcctgctgattcctctgtttggcgtacattatatcatgttcgccttctttcctgataactttaaacccgaagtaaaaatggtatttgagttggtggttggttccttccagggcttcgtggtcgccattctctactgcttcctcaacggtgaagtgcaggctgaactccgacgtaagtggcgccggtggcacctccagggcgtgctgggctggaatccaaagtatcgtcatccgagcggaggcagtaacggggccacttgctcaacccaagtttctatgttaacccgcgtatcacctggtgccagaagatcatccagtttccaggccgaggtgagcttggtttag

SEQ ID NO: 140392 - DNA, 1317 bp, Artificial Sequence
  Description of Artificial Sequence: Synthetic coding sequence
atgagaaccttgcttccacctgcactgctgacctgctggctgctcgccccagtgaactctatccatccggaatgtcggtttcacctggagatacaagaagaggaaaccaagtgcgcagaactgctgcggagccaaacagaaaagcataaagcgtgttctggcgtgtgggataatatcacatgttggcgacctgccaatgtcggggaaacggttactgtaccctgtccaaaagtcttctcaaacttctattctaaagctggcaatatatccaagaactgtaccagtgacgggtggtctgaaactttcccggacttcgttgacgcctgtgggtatagcgacccagaagatgagagtaagatcacattctatattctggtcaaagctatttacactctggggtatagtgtgagtttgatgtcattagctaccggctccatcatcctttgccttttccggaaacttcactgtactagaaattatatccatcttaacttgttcctaagctttatcctacgtgccatttctgtactggttaaggacgacgtgctgtactcctcttcaggcactctccattgccccgaccaaccctcctcctgggtggggtgcaagttatctctggtgttcctgcagtattgcattatggctaacttcttctggttgttggtggagggactttacttgcacacactactggtggctatgttgcctcctagacgctgcttcctagcctacctcctcatcggctggggtctacccacagtctgtatcggtgcttggaccgcagctaggctttaccttgaggatacgggctgttgggacaccaacgatcacagcgttccttggtgggtcatcaggatcccaattctcattagcattattgtgaatttcgtgctattcatatccattatacgcatacttctacagaagctcaccagccccgacgtgggcgggaacgaccagtcccaatataagaggcttgcaaagagcacacttctgctcatacctctgtttggcgtccactatatggtgttcgcggtgtttccgatcagcatttcttctaaatatcagatcctgtttgaactctgtttgggatcgtttcagggccttgtggtggccgtgctgtattgcttccttaactcagaagtgcagtgcgagttgaagcgcaagtggaggagtaggtgtcccaccccatctgccagtcgggactatcgagtgtgtggttcttcattcagccgcaacggaagtgaaggagctctgcaatttcaccgcggaagtcgggcacagtcgtttttacagaccgaaacgtcagtgatctag

SEQ ID NO: 140393 - DNA, 1269 bp, Artificial Sequence
  Description of Artificial Sequence: Synthetic coding sequence
atgcctctgtgggaagccccaagcgatcaccccgctaacccacctgctacactacagggccataccagcttgcctggctgccaagaagagcccgcccgtgatccacagagcggcctgccccaaataacctcagaatcctcatccttctccgagggtagtctgccgtcctggtcctcgggcccagctggggctaaattaaatgccagccacgagggtatagggtcttcctcagatggtaatggcgacagtaaggccgcaactgaacgggttgtgagtgcgatggataccgtccggcgcaaacaccctgagatcacattttacatcctcgtcaaagccatctacaccctgggctattcagtgtccctgatgagccttgcaacaggaagcattattctgtgtttgtttaggaagctccactgcaccaggaactacattcacctcaacctgttcctcagcttcattttacgagcaatcagcgtgttggtcaaagatgacgtgttatattctagttccgggactctgcactgccctgaccagcccagcagctgggtcggatgcaagttgtccctggtgttcttgcagtactgcatcatggccaacttcttttggctgctggtagagggtctatacctccacacattgttagtcgccatgttaccaccacggcgttgttttctggcctaccttctcatcggttggggactgcccacggtttgtattggcgcgtggacagcagcacgtctctacctggaggacaccggctgctgggacacaaatgatcattctgtgccatggtgggtcatacgaatacccatcctgatctctataattgtcaacttcgtcctgttcatcagtattatcagaattttactccagaagctgacgtctccagatgtcggagggaacgatcagtctcagtacaaacggctcgcaaaaagtacgctgctgttaatccccctcttcggcgtccactatatggtgtttgctgttttcccaataagcatcagctctaagtaccagattctctttgagctatgtctaggctctttccaggggttggttgtggccgttctgtactgcttcctgaactctgaggtccagtgcgaactcaagagaaagtggagaagcaggtgtcctacaccgtcagcttcaagagactaccgtgtttgcgggagtagtttcagccgcaatggatccgaaggtgccctccagtttcaccgaggcagcagggcccaatccttccttcagacagaaacttcagtcatctag

SEQ ID NO: 140394 - DNA, 234 bp, Artificial Sequence
  Description of Artificial Sequence: Synthetic coding sequence
atgaggacattgctcccacccgcactgctaacctgctggttgctcgctccggtgaactcgatacaccccgagtgtagatttcatctcgagattcaggaggaagagactaagtgcgctgaattgctcaggtcacagacagaaaaacacaaggggcacaccaaagggtttattttgatccacgccggtgggttaaagagaattctggacccccacacatatcctctagcgccctag

SEQ ID NO: 140395 - DNA, 2022 bp, Artificial Sequence
  Description of Artificial Sequence: Synthetic coding sequence
atgtgttcacgggtgcccctgctgcttccgctgcttctgcttttggcactcggacctggtgttcaggggtgtccttccggctgccaatgtagccagccccagacagtgttttgcacagcacgccagggaaccacggtacctcgggatgtgcccccagacacagtggggttatatgtgttcgagaatggaattactatgttggatgccggaagttttgctgggctaccgggcctccagcttctcgatctctcccaaaatcagattgccagcttaccgagcggagtcttccagccacttgccaatctgtccaatttggacttaacggccaaccgactgcatgaaatcactaacgagactttccggggcctgaggagacttgaaaggctataccttgggaagaacagaatacggcacatccaacctggggcttttgatactctggataggctattggaactgaaacttcaggacaatgagttgagggcgttgccacccctccggttaccgaggctcctgctactggatctgagtcacaattccctgctggcgctggaacccggaatccttgacacggcaaatgtggaggcgctgcggcttgctgggctgggtctgcagcaacttgacgagggccttttcagtaggcttcggaatctgcacgacctggatgtcagcgacaatcagctggagcgagtcccacctgtgatcagagggttacgtggcctgacccgtttgcgcctggctggcaatactagaatcgctcagttgcgacctgaggatcttgctggtctcgcagccttgcaggagttggacgtctccaacctctcgctacaggccctgccgggggatttaagcggacttttcccacgtctgaggctattagccgcagccagaaatccgtttaattgcgtttgcccccttagttggttcggcccttgggtgagggagtcccacgtgacccttgccagccctgaggagactagatgccattttcctcctaaaaacgccggaagattgttactagagctcgactatgctgatttcggatgtccggccactaccaccacagcaacagtacctaccactcgtcctgttgtccgagaaccgacggccctgagctcctcactggcacccacgtggcttagccccaccgaaccagcgactgaggccccttcacccccctctaccgccccccctacagtggggcccgttcctcagcctcaggattgtccacctagcacgtgtcttaacgggggaacctgtcacctgggcacacgccaccacctggcctgcttgtgtccggagggctttacaggtctgtactgtgagtcccagatgggccaggggaccaggcctagtcccacgcctgtgacgccccgaccacctcgcagccttaccttggggatcgaaccagtttcaccaacatcactgcgggtgggactgcagcgatatcttcagggctcttccgtccaattaaggtcactccggttgacatacagaaatctctctggaccagacaagagactggtcactctgcgccttcccgcaagcttagctgaatacacggttacacaactgcgccctaacgcaacatattcagtctgcgtgatgccgctcggacccggtagggtgccggaaggcgaggaggcatgcggagaagcacatactcctcctgctgtgcatagcaatcatgctccagtgacacaggccagggagggtaacctgcccctgctgatagcccctgcgctggctgcagtactcctggcggcactggcggcggtgggggcagcctattgtgtacggaggggtcgcgccatggccgcagccgcacaagataaaggccaggtgggccccggcgcaggaccactggagttagagggggtgaaggtgccgttggagcccgggcctaaggccacagaaggcggcggggaagcactccctagtggttccgaatgtgaagtgccactaatgggatttcctggcccaggtctgcagagccccctgcacgccaagccttacatttag

SEQ ID NO: 140396 - DNA, 2538 bp, Artificial Sequence
  Description of Artificial Sequence: Synthetic coding sequence
atggaattgtggcgtcagtgcacacattggctcattcagtgtcgcgtcctgcccccatcacacagggttacctgggatggagcacaagtctgtgaactcgcccaggccctgagggacggcgtgttgctgtgtcagttgctgaataacctgctgccacacgccatcaatctgcgggaagtgaacctgagaccacagatgagccagttcctttgcctgaagaacatccgcacattcctgagcacatgctgcgagaagttcgggctgaagagatctgagctctttgaggccttcgacctgtttgacgtgcaagacttcggaaaggtcatctataccctgagcgccctgagctggaccccaattgctcagaaccgggggattatgccattcccaacggaggaggagtcggtgggagatgaggacatctacagcggtttgtccgatcagatagacgatactgtggaggaagatgaagatttgtacgactgcgtcgaaaacgaggaggctgaaggcgatgagatatacgaggatcttatgagatcagagcctgtcagtatgcctcctaaaatgacagaatacgacaagaggtgctgttgtctgcgagaaatccagcagaccgaagagaaatacaccgataccctggggagtattcagcagcattttctgaaacccttgcagcgatttctaaagccacaggatatcgaaatcatcttcatcaacattgaagacttactgcgtgtacacactcatttcctgaaggagatgaaggaagctttggggacaccaggtgctgccaacttataccaggtgtttatcaagtataaggagaggtttctagtgtatgggagatactgttcccaggtggaatccgcttctaaacaccttgaccgcgtggcagcagctcgcgaagatgtgcagatgaagctggaagaatgctcacaaagggcaaacaatgggcgctttacacttcgggacttattgatggtccctatgcagagagtacttaaatatcaccttctgcttcaggaactggttaagcacacacaggaagccatggaaaaggagaacctgaggctggccctcgacgccatgagggatttagcacagtgtgtcaatgaagttaagagggataatgaaaccttacggcagatcacgaacttccagctgagtatcgagaacctagaccagtctctggcacactatggcaggccaaagattgacggcgaactcaaaattactagcgttgaacgacggagtaagatggaccgttacgcttttctgctggacaaggccctgctgatctgtaagcgccggggggactcatacgacctgaaagactttgtcaacctccactcctttcaagttagggatgacagtagcggagatcgggataataagaagtggtcgcatatgtttctgctgatagaggatcagggcgcacaaggctatgaactgttcttcaagactcgagagctgaagaagaagtggatggaacagtttgaaatggccatttcaaatatatatcctgaaaatgccacagccaacggtcatgattttcagatgttctccttcgaggaaaccacctcctgtaaggcctgccagatgcttttgaggggcacattctatcagggataccgctgtcacagatgtagagcctctgcccacaaagaatgtctgggacgggttcccccctgtgggcggcacgggcaggatttccccggaactatgaagaaggataagttgcaccggcgcgcacaggacaaaaaacgtaacgagctgggcctgccaaagatggaagtgttccaggagtactacggcctgccgccccctcctggtgctatcgggccctttctgcggctgaaccccggtgacatcgtcgaactgacaaaagccgaggcggaacagaactggtgggagggaagaaatacatcaaccaatgaaattggctggtttccctgtaaccgcgtaaagccatatgtccacggacccccgcaggacctttctgtgcacctgtggtatgccgggcccatggagcgggccggcgccgagtccattctggctaaccgcagcgacgggaccttcttagtgcggcagcgggtcaaggatgccgctgagttcgctatatcaatcaaatataacgtggaagttaagcacattaagattatgactgctgagggcctctatcggatcacagagaaaaaggcatttcgagggttaactgaattggtagagttttaccagcagaatagtttgaaagattgtttcaaaagcctggacacaaccttgcagtttccgttcaaggagcccgaaaagaggaccatctcaagacctgccgtgggttcgactaaatatttcggcaccgcgaaggcaagatacgatttttgcgcaagggacaggtcagagctgtctctaaaagaaggcgacatcattaaaattctgaacaaaaagggacagcagggctggtggcgaggcgaaatctatgggagggtgggctggttccctgcaaactacgtggaagaagattacagcgagtactgctag

SEQ ID NO: 140397 - DNA, 2247 bp, Artificial Sequence
  Description of Artificial Sequence: Synthetic coding sequence
atgtcacagtttctttgtctaaagaatattcggactttcttgagtacttgttgtgagaagtttggtctgaaaaggtctgagctgttcgaagccttcgacctcttcgacgttcaagacttcgggaaggtgatttataccctgtcggccctctcatggacccccattgcacagaacaggggcatcatgccgtttcccacggaggaagagagcgtcggagacgaagatatttactctggactgagcgatcaaatcgatgacacggtagaggaagacgaggatctgtacgactgcgtggagaacgaagaagccgagggagatgagatttacgaagatctgatgaggagcgagccagtcagcatgccccacttcctgaagcctctgcagcgcttcctaaagccccaggatatagaaattattttcattaacatagaggatctgttgagggtgcacactcatttcctgaaggagatgaaggaagcgctgggaacgcctggagccgccaacctgtaccaagtgtttataaaatacaaggagcggttccttgtctacggcagatactgcagccaagtggaatctgcgtcaaaacatttagatcgggtcgcagcagcccgggaggatgtacagatgaaactcgaggagtgttctcagagagctaataacggccgctttacattgcgagacttactcatggtccccatgcagcgtgtgttaaagtatcatctgcttttacaagaattggttaagcatacccaggaggccatggagaaggaaaatttgaggctcgccctcgatgctatgagagacctggcgcagtgcgtgaacgaggtaaaacgagacaacgaaacccttcgccagataaccaatttccagctcagcattgagaacctcgatcagagcttggcgcattatgggcgccccaagatcgacggggagctcaaaattacctccgtggagagaagatcaaagatggatagatacgcattcctactagacaaagccctcttgatttgtaaacgaagaggcgattcctacgatcttaaggactttgtgaatttgcactcctttcaggtcagagacgacagttcaggcgatcgcgataacaaaaagtggtcccatatgttcctgctcattgaagaccagggagcccaaggatacgagcttttttttaagactagagaactgaaaaagaaatggatggagcagttcgaaatggccatatccaatatctatcctgagaatgctacagctaatggtcacgatttccagatgttcagctttgaggaaacgacaagctgcaaggcatgtcagatgctgctgagaggaacattctaccaaggctatagatgtcacaggtgtcgggccagtgcacacaaggagtgtctgggacgggtgcccccatgcggccgtcacggtcaggacttccccggaaccatgaagaaggacaagttgcaccggcgcgcccaggataaaaaacgcaacgagttagggttaccgaagatggaggtattccaggagtattatggcctcccgccacccccgggagctatcggccccttcctccgcctgaaccccggggatattgtggagcttactaaagcggaagccgaacagaactggtgggaggggcgcaataccagcaccaacgaaatagggtggttcccttgcaaccgcgttaaaccgtacgttcatgggcccccccaggacctctctgttcacttgtggtatgctggcccgatggaacgtgcaggtgctgaaagtatcctggctaacaggtccgacggcacatttctggtccggcagagagtgaaggacgcggcagagtttgctatcagcattaagtacaatgtggaggtcaagcatatcaagattatgactgcagaggggctatacagaatcacagagaagaaggcttttcggggattgacagaactggtggaattctatcagcagaacagtttgaaggattgttttaaatccctggatactaccctgcagttcccgtttaaggagccggagaagcgtaccatttctaggccagccgtggggtcgacaaagtactttgggacagcaaaggcacgttatgatttttgtgcacgtgaccggtcagaactttctctgaaggaaggtgacattatcaagatacttaacaagaaagggcaacagggctggtggcgtggagagatctacggacgtgttggctggtttccagcaaattatgtggaggaggactattcagaatactgttag

SEQ ID NO: 140398 - DNA, 2442 bp, Artificial Sequence
  Description of Artificial Sequence: Synthetic coding sequence
atggaactgtggaggcagtgtacccactggctaattcagtgccgcgttctgcccccttcccatcgcgtgacttgggacggcgcccaagtgtgtgagttagcgcaggcattgcgggatggcgttctactgtgccaactccttaacaatctgttacctcacgccatcaacctgagggaagtcaaccttagaccccaaatgagccagttcttgtgtctcaagaacattagaacctttctttctacatgctgtgagaagtttggcctcaaacgatcagagttgttcgaagccttcgacctctttgatgtgcaggactttggaaaagtgatctacacactgtccgcgctctcttggaccccaatcgcgcagaatagaggaataatgccatttcccactgaagaggaatccgtgggtgatgaggatatttatagcggtttatctgatcagattgacgataccgtggaggaggacgaagacctgtacgattgtgtggagaatgaagaagcggagggtgatgaaatctacgaagaccttatgcggtccgagccagtttcgatgccacatttcctcaaaccgctccagaggttcctaaaacctcaggatatagaaatcatctttattaatatagaggaccttctgcgcgtgcatacacacttcctgaaggagatgaaagaggccctggggacccctggggccgcaaacctctatcaggtctttatcaagtataaggagaggtttttggtttacggcagatactgctcacaggttgaaagtgcatccaaacatttagatcgcgtggcggcggcacgtgaagacgtgcagatgaagcttgaggaatgctctcagagggctaacaatggtagatttactctacgggatttgctgatggttcccatgcaaagagtgctgaagtaccatctcttactccaggaattggtgaagcatactcaggaagcaatggagaaagagaatctacgcctggcattggacgccatgcgggatcttgctcagtgcgtgaacgaggttaaacgcgacaatgagaccttgcgccagataaccaactttcagctcagcatcgaaaatctggatcagtccctggcccactacggcagacctaagattgatggagagctgaaaatcacgtccgtggaaagacgatcaaagatggatagatacgcctttctgcttgacaaagcgctgttaatatgcaagaggaggggcgacagctacgacctaaaagatttcgtgaacctgcattctttccaggtacgcgatgacagctcaggcgacagggataataagaaatggagtcacatgttcttactaattgaggaccagggcgcgcaaggctacgaattgttttttaagaccagggaactaaaaaagaagtggatggagcaattcgagatggccattagtaatatctatccagagaatgctactgctaatggccatgatttccagatgtttagctttgaggaaaccacaagctgcaaggcatgccagatgctgcttagggggaccttctaccagggataccgctgtcacaggtgccgggcaagcgctcacaaggagtgcctggggcgtgtgcccccatgcgggagacatgggcaggatttcccgggaacaatgaaaaaggataaactgcaccggagggcccaagacaagaaacgcaacgagcttgggcttcctaaaatggaggtatttcaggaatactacggcctcccgcctccaccaggggctattggcccgtttctgcgcttgaaccccggagatattgttgaattgactaaagcagaggcagagcaaaactggtgggaaggaaggaatacatccacaaacgagattggatggttcccatgtaatcgggtgaagccctacgtccatgggcccccccaggatctgagtgtccacctgtggtatgccggccccatggagcgcgccggcgcagagtccattctggctaacaggagtgatggcacttttctcgttcgacagagagtaaaggacgctgcggaatttgccattagcattaaatacaatgtggaggtcaagcatatcaaaataatgacagccgaaggcctgtataggattaccgagaaaaaagcatttcgcggcttaacagagctggtggaattctaccagcaaaattcactgaaggattgtttcaagagcctcgacaccactctgcaattcccttttaaggaacccgagaagcggacgataagtcgcccagcggtggggagcacaaaatacttcggcaccgctaaggcccgatatgacttttgcgcccgggatagaagcgaattgagcctgaaggaaggtgatattattaaaattctgaacaaaaaggggcagcagggctggtggcgtggggaaatttatggacgagtggggtggtttcctgccaattatgtagaggaagattactctgagtattgctag

SEQ ID NO: 140399 - DNA, 2538 bp, Artificial Sequence
  Description of Artificial Sequence: Synthetic coding sequence
atggaactatggaggcagtgtacccattggcttattcagtgcagagtgctccctccgagccaccgggtaacctgggatggggcccaagtctgcgaactggcccaagccctgcgggacggggttttgctgtgccagttgcttaataatctccttccccacgccattaatttgagggaggtaaacctccgaccacagatgtcccaatttctttgcctgaaaaacatccgaaccttcctgtccacctgttgtgaaaaatttggcctgaaaaggagtgaacttttcgaagcattcgatcttttcgacgtgcaagattttggcaaagtgatatacaccctctcagcgctctcctggactcccattgctcagaatcgtggtattatgcctttccccaccgaagaggagagtgtgggggacgaagacatctacagcggcctttctgaccagattgatgacactgtcgaagaagacgaggatctatacgattgtgtcgagaacgaagaagctgaaggggacgagatatatgaagacctcatgaggtctgaacccgtgagtatgcctccaaagatgactgagtatgataaacgctgctgctgcctacgcgagatccaacagaccgaggaaaagtatacagacacgcttgggtcgatccaacagcattttctcaagccactgcagagattcctcaagccacaagacatcgagattatttttataaacattgaagacttgttgcgtgtgcacacccactttctgaaagagatgaaagaagctctcgggacaccgggcgcagctaacctataccaggtctttataaagtataaagagcggttcctagtctatggtcgttattgctcccaggtagagtcggcctctaagcatctggaccgagtcgccgctgcccgcgaagatgtccagatgaagctcgaagaatgcagccaacgggctaacaatggcagatttacccttcgagatcttctgatggttcctatgcagcgggtgctcaaataccatctgcttctccaagagcttgtgaaacatacgcaggaagcaatggaaaaagaaaaccttaggctggcactcgatgccatgagagacctcgctcagtgtgtgaacgaagttaagcgggacaacgagacattgagacagatcactaactttcagctgtcaattgagaatctggaccagtcccttgcgcactacggtaggccgaaaatagatggagaactgaaaattacatctgtggagaggcggtccaaaatggatagatacgctttcctactggataaggccctactgatttgcaagcgtcgcggcgatagctacgatctcaaggacttcgtgaaccttcactcctttcaggtgagggacgactccagcggcgacagagacaataaaaaatggagccacatgtttctgctgattgaggaccaaggggctcaaggctacgaattattcttcaagaccagggagctgaagaagaagtggatggagcagttcgagatggctatttctaatatttatcccgaaaacgctacagctaacgggcatgactttcaaatgtttagtttcgaagaaacaacctcgtgcaaagcgtgccagatgctcctgaggggtacgttctatcaaggctaccgctgccacaggtgcagagcctcggcacacaaggagtgcctgggacgggtgccaccttgcggacgacacggccaagactttcctgggactatgaaaaaagacaagcttcataggcgagcccaggacaagaaaagaaatgagctggggctcccaaaaatggaggtgtttcaagagtactatggcctgcccccaccgcccggcgccatcggtccttttctcaggctgaaccctggcgacatagtggaactgactaaggctgaagccgagcagaactggtgggagggtaggaatacatcgactaatgagatagggtggtttccgtgtaaccgagttaaaccctacgtccacggtccaccacaagacctctcagttcacctatggtatgctggacccatggagcgggccggagctgaatctatactggctaacagaagtgacggaacattcctggtgagacagcgcgtgaaagacgctgccgagttcgccatcagcataaagtataatgtcgaggtcaagcatataaaaataatgaccgcagaagggttataccggattactgagaagaaggcattccgcggccttacagagctcgttgagttttatcagcagaacagtcttaaggattgttttaagtctctggatactacactgcagtttccttttaaagagcccgagaagcgcaccatatccaggcccgctgtgggctccactaagtatttcgggacggcgaaagctcgttatgacttttgcgctcgggacagaagcgaattgtccctgaaggagggggacatcataaagatcctgaacaagaaagggcagcagggctggtggaggggggaaatatatggacgagtcggctggtttcccgcaaattacgtagaagaagactattctgagtattgttag

SEQ ID NO: 140400 - DNA, 2607 bp, Artificial Sequence
  Description of Artificial Sequence: Synthetic coding sequence
atggagcaatggcgccaatgcggcagatggcttatcgattgcaaggtacttccacctaatcacagggtcgtgtggccttccgcggttgtcttcgacctggcccaagcgttaagagacggagtgctcctgtgtcagttgttgcacaatctgtctcccgggagcatagacctcaaagacattaatttccggccccagatgtcccagtttttatgccttaaaaatattcgcacttttctcaaagtctgtcatgacaaatttggcctcaggaatagcgagctcttcgacccatttgacctgttcgacgtgcgggacttcggtaaagttatctctgccgtctcacgcctgtccctccatagcattgcccaaaacaagggaatcagaccttttcctagcgaagaaaccacggagaatgacgacgacgtgtatagatcacttgaggagcttgctgatgaacatgatctcggcgaggatatttatgactgtgtgccctgtgaggatggcggcgacgacatttatgaggatatcattaaggtcgaagtgcagcaacctatgaagatggggatgactgaggacgacaagcgcaattgttgccttctcgaaatacaagagacggaggcaaaatactacaggactttggaggatattgaaaagaactacatgtccccattgagactggtcctcagtcccgccgacatggccgccgtgtttatcaacctggaagatctcatcaaggtccaccacagttttctgcgcgccatcgatgtgagcgtcatggtggggggaagtacgcttgctaaagtttttttagatttcaaagaacgcctactcatctacggagaatattgctctcacatggaacacgctcagaatacactcaatcagcttttggcctctagagaagactttcgacagaaggtagaggaatgcaccctcaaggttcaggatgggaagtttaagctgcaggatcttctcgtggtccctatgcaaagagtactgaagtatcaccttctactgaaagaactgctgtcacacagcgcagaacgaccagagcggcaacagctcaaggaggcactggaagctatgcaggacctcgcgatgtacatcaatgaagtgaagagggacaaggagaccctcaggaagatttcagaattccagtcctccattgagaacctccaagtgaagctggaagagttcggccggcccaaaattgatggcgaactcaaagttcgatcaatcgtgaaccacacaaaacaggaccgatatttattcttatttgataaagtggtgattgtgtgcaaacgcaagggctactcctatgagcttaaagaaatcattgagttactcttccacaaaatgaccgatgaccctatgaataataaggatgtgaagaaatggagctatggcttttatctgatacatctccaggggaaacaaggcttccagtttttctgtaagacagaagacatgaaaaggaagtggatggagcagtttgagatggcgatgtctaatatcaaacctgataaggcaaatgcaaaccatcactccttccagatgtatactttcgacaagaccaccaactgcaaggcatgtaagatgtttctgagaggcacgttttaccagggatacatgtgcactaagtgcggcgtgggggcgcataaggagtgcctggaggtgattccaccttgcaagtttaggacgagtggcgatcgggacgcctccggagccgggcctgggcctaagatggtggctatgcaaaactaccacgggaaccccgctcctcccggtaagccagtcctcacatttcagaccggggatgtgctcgagttgctccggggtgatcccgagagtccatggtgggaagggcgacttgttcagacccgtaagagcggctacttcccaagctccagcgtcaagccttgtcctgtggatgggaggcctcccattagccggcctccttcccgggagattgactataccgcctacccctggttcgcaggcaacatggagcgccaacagaccgacaacttgctgaagtcacatgcctctgggacctatttaatccgcgagcgccctgctgaagccgagcggtttgcaatatccattaagtttaatgacgaagttaagcacattaaggttgtggagaaagacaattggattcacataacagaagctaaaaagtttgactctctgctagaactggtcgaatactatcaatgtcatagtcttaaggaatccttcaagcagttagatactacactgaagtatccttataaatccagggagcgtagcgcaagtcgggcctcaagtaggtccccggcttcatgcgcctcttacaatttctcctttttaagtccccagggactgtcattcgcctcccaaggcccttccgcacctttttggagcgtttttacaccacgcgttatcggaacagcagtggcccgatacaatttcgcagctcgggacatgcgggaactgagtcttcgggagggtgatgtagtaagaatctattctcgaatcggtggagaccaaggatggtggaaaggggagaccaacgggaggattgggtggtttccctccacttatgtagaagaggaggggattcagtag

SEQ ID NO: 140401 - DNA, 2637 bp, Artificial Sequence
  Description of Artificial Sequence: Synthetic coding sequence
atggaacaatggaggcagtgcggacggtggctgattgactgtaaggtcctcccaccgaatcatcgggtggtttggccttctgcagtcgtgtttgacttggcacaggccctgagagacggagtccttctgtgccagctacttcataacttgtctcctgggtccattgaccttaaggatataaactttagaccacaaatgagtcagtttttatgtctgaagaacatccgcacgtttctgaaggtatgccacgataagtttggccttcgaaactcagagctgttcgatccatttgatctattcgatgtgcgggatttcggaaaggttatttctgctgtgtcccggctgtcgctccatagcattgcccaaaacaaaggaatccgtcccttcccttccgaggaaaccaccgaaaatgacgatgacgtgtatcgaagtttagaggaactggctgacgaacatgacctgggtgaggatatctatgactgcgttccatgcgaggatggcggcgacgatatctacgaggatatcatcaaggttgaggtgcaacagcctatgattcggtatatgcagaaaatgggcatgactgaggacgacaagaggaattgttgcctccttgaaattcaagagaccgaggcaaagtattataggacactcgaggacatcgaaaaaaattatatgtctcctctgaggctggtgttatcgcccgcagacatggccgcagtgtttattaaccttgaagacctaattaaggtgcaccacagctttttacgggcaattgacgtgtccgtgatggtggggggatctacattggcgaaggtcttccttgacttcaaggaaaggttgctgatttatggtgaatactgcagccacatggaacacgcccagaataccctgaatcaacttctggcctcccgggaggattttcgacagaaggtggaggagtgcaccctgaaagttcaggatggaaaatttaagctgcaggatctgctcgtggtacccatgcagagggtccttaagtaccatctgctgctcaaagaactgctgtcacattcagccgaaaggccagaaagacagcaactaaaggaagcgcttgaggcaatgcaggacctcgctatgtatatcaacgaggtgaaacgagacaaagaaacactgcggaagatctcggagttccagtctagtattgagaatctccaggtgaagctggaggagttcggcagaccaaaaatagacggggagctgaaggtgcggagtatcgttaaccacacaaaacaggaccgttacttgttcctcttcgacaaggtagtgatcgtctgtaaaaggaaggggtattcatacgaactcaaggaaatcattgagcttctctttcacaagatgactgacgatccaatgaacaataaagacgtcaagaagtcccacggcaaaatgtggtcttacgggttttatctcatacacctgcagggaaaacaaggcttccagtttttttgcaaaactgaagatatgaagcgcaagtggatggagcagttcgagatggctatgtctaacattaaacctgataaggccaacgctaatcaccactccttccagatgtacacgttcgataaaacgacgaattgcaaggcgtgtaagatgtttctgcgcggcactttttaccaaggctacatgtgtaccaaatgcggagtcggtgcacacaaagaatgcctggaagtaattcctccctgcaaatttacttctccagcggacctggatgcatcaggtgccggcccaggaccaaagatggttgcaatgcagaattaccatggaaatcccgcccccccaggcaaacccgtgctaacctttcagactggcgatgtcctggaactgctgcgcggcgatccggagtcgccatggtgggagggtagactggtgcaaacacgaaaaagcggatatttccccagttcctctgtgaagccttgtcccgtggacggcagaccccctatctccagaccgccatccagggagatagactatacagcctatccgtggtttgcgggcaatatggaacgacagcaaaccgacaatctgctcaagtcacatgcatccggaacatatctgatcagggaaagaccagccgaagccgaaaggtttgcaatatcaatcaagtttaacgatgaggtgaagcacatcaaggtggtggaaaaggataactggattcacattaccgaggcgaagaagtttgactcattgttagagctggttgagtactatcaatgccatagcctgaaagagagcttcaagcagctggacaccaccttaaaatatccttataaatcacgcgagcgaagcgccagccgggcctccagtagaagcccagctagttgcgccagctataatttctcttttctctccccccagggactttcatttgcaagtcagggacccagcgcacctttctggagtgtcttcacaccacgtgtgattggcacagcggttgcaaggtataacttcgccgctcgtgacatgagagaactatctctccgagagggggatgtcgtgagaatctactctaggataggcggggaccagggatggtggaagggtgaaacgaatggccgcattggctggtttccctcaacatatgtggaggaggaagggattcagtag

SEQ ID NO: 140402 - DNA, 2607 bp, Artificial Sequence
  Description of Artificial Sequence: Synthetic coding sequence
atggagcagtggaggcagtgcggaaggtggctcattgactgcaaggtgctgccccctaatcatcgcgtagtctggccgtcggctgtggtgttcgatctcgcacaggccttacgggacggcgtcctgctgtgtcagctcttgcacaaccttagtccgggtagtatcgacctcaaggatattaatttccggcctcaaatgtcacagtttctttgcctcaagaatatccgcacctttctcaaggtgtgtcacgataaattcggtctgcggaattctgagttgttcgaccctttcgatctgttcgacgtacgcgattttggcaaggtgatttccgccgtcagccggttaagcttgcactcaatcgcacagaacaagggcatcagacctttccctagcgaggagacaaccgagaacgatgatgacgtgtataggtctctggaggagctggccgacgaacacgatcttggagaggatatctatgattgtgttccttgtgaagatggtggcgacgacatatacgaagacataatcaaagtggaggtgcagcagccgatgaagatgggaatgaccgaggacgacaagagaaattgttgtttgctcgagattcaggaaacagaagccaaatactaccggacattagaagatatcgagaaaaattacatgtctccacttcgccttgtactttccccggcggatatggctgcagtttttatcaaccttgaggatctgataaaagtgcaccatagttttttgagggctattgacgtaagtgtgatggtaggtgggtccacgctcgccaaagtgtttctcgatttcaaggaacgtttactgatctacggtgagtattgttcgcacatggagcatgcccaaaacacattaaaccagctgctggcctcaagagaggatttccggcagaaagtggaagaatgtactcttaaagtccaggatggcaagttcaaattacaggatctgctcgtagtgcccatgcagcgtgtcctgaagtaccacctactgctgaaagaacttctctcccactccgccgaacgccctgagcgacagcagctgaaggaagctctcgaagccatgcaggatttggcgatgtatataaacgaggtgaaacgcgacaaagaaactctgcgaaagatctctgagttccagagtagcatcgagaatctgcaggtgaaactggaggaatttggaagacctaaaatcgacggcgagcttaaagtccgtagcatcgtgaaccatactaagcaagacagatatctgtttctgtttgacaaggtggtgattgtatgcaaacgcaagggctatagctatgagctcaaagagatcatagagctgctatttcacaaaatgacagatgaccctatgaataacaaggatgtgaaaaagtggtcctatggcttttatcttatccacctgcagggcaagcaggggttccagttcttttgtaaaacggaggatatgaaaaggaaatggatggaacagtttgagatggccatgagtaatatcaaacccgataaggccaacgcgaaccatcattcatttcagatgtacacctttgataagactacaaactgtaaggcttgtaagatgtttctccgcggaactttttaccagggttatatgtgcacaaagtgtggtgttggagctcacaaggaatgcctggaggtgatcccaccctgtaagttcacctctcctgcagacctggacgcctcaggggcaggtccagggcccaaaatggttgcaatgcaaaattatcacggcaacccagctcccccagggaaacccgtgctcacattccagacaggagatgtcctggagcttttacgcggagatcccgagtccccatggtgggaaggaaggctagtgcaaactcgaaaatccgggtatttccctagcagttctgtgaaaccttgcccagtagatgggaggccccctatatctcgccccccgtctcgggaaatcgactacacggcctacccgtggtttgcgggaaacatggaacgacagcagacagataaccttctgaaaagtcacgccagcgggacctatctgattagagagcggcctgccgaggcagaaaggttcgccatttccataaaatttaacgatgaggttaagcacattaaagtcgtcgaaaaagacaactggatacatatcacagaagcgaaaaagttcgattccctcctcgaattagtggagtactaccagtgtcacagtctgaaggagtcgtttaaacagttagataccacactcaagtacccttacaagtctcgagaacggtccgcctctcgcgcctccagcagatctccagcatcatgtgcttcgtacaacttcagttttctctccccacagggactgagctttgcttcccaaggcccttcagcccccttctggagcgtcttcacaccacgagttatcggcacggccgtagcaaggtataacttcgcagcccgggacatgagagaactcagcctgagagagggcgacgttgtgagaatctactctcgcataggaggagaccaaggatggtggaagggagaaactaatggacgaatcggttggttcccatccacctatgtggaggaggagggcattcagtag

SEQ ID NO: 140403 - DNA, 2520 bp, Artificial Sequence
  Description of Artificial Sequence: Synthetic coding sequence
atggaacagtggaggcagtgcggccggtggctgatagattgtaaagtcctgccaccaaaccatcgagtggtttggccctctgccgtcgtgtttgacctggctcaggcattgcgtgatggtgtgctcttgtgccagctgcttcacaatctgtccccgggctccattgatctgaaggacatcaattttcggccgcaaatgtctcagtttttgtgccttaagaacataaggacctttttgaaggtatgtcacgataagttcggcctgagaaattcagagttgtttgatcccttcgatttattcgatgtgagagatttcgggaaggtgatctccgccgtttcccgcctctccctgcactcaattgcgcaaaataaggggatccgcccattcccctctgaagaaacaactgagaacgatgatgacgtttaccgctctctggaggagttggctgacgaacacgatttgggggaggatatatacgattgcgtaccttgcgaggacgggggggacgacatctacgaggacataatcaaggtagaggttcagcagcctatgaagatgggcatgacagaagatgacaagcgcaattgctgtctgctggagattcaggaaacagaggccaaatactacaggaccctcgaagacattgaaaagaactatatgagcccgcttagactggttttgtcacccgcagacatggctgccgtgttcatcaacctggaggatctgatcaaggttcaccactctttcttaagggcaattgatgtctccgtgatggttgggggcagtactctggcaaaggtgtttttggacttcaaggagcgccttctcatttacggtgagtactgttctcatatggagcacgctcagaatactctaaatcagctgttggcatcacgtgaggacttccgccaaaaggtcgaagagtgtaccttaaaggtccaagatggcaagttcaagctccaagacttactggtcgtccctatgcagcgagtgcttaaatatcacctgctgctaaaagagctgctcagtcactctgctgaacgccctgagaggcagcaactcaaggaagcattagaggcaatgcaagacctggctatgtacattaacgaggtgaaacgcgacaaggaaacgctcagaaaaatctcagaatttcagagctctatcgagaatctacaggtgaagcttgaggaatttggccgtccaaagattgatggggagttgaaggtgcgaagtatcgttaatcacaccaaacaggacagatacttattcctgtttgacaaagtagtgattgtttgcaagaggaaggggtatagttacgaactcaaggaaatcatagagctgcttttccataagatgacggatgaccctatgaataacaaggatgtcaaaaagtggtcctacgggttctatctgatccacctccaaggcaaacaagggtttcagttcttttgtaaaacagaagacatgaagagaaagtggatggaacagttcgaaatggctatgtctaatattaaacctgacaaagctaatgctaatcaccacagcttccaaatgtacaccttcgacaaaactactaattgcaaagcatgcaagatgtttctgcggggaactttctaccaagggtacatgtgcacaaaatgcggggtgggagctcataaggagtgtttagaagtgatacctccttgtaagttcacttcccctgccgatttggatgctagtggcgccggccccggaccaaagatggtcgcaatgcaaaattaccatggaaacccggccccccctggcaagcctgtactaacctttcagacaggggacgtcttggagcttctccggggtgatcctgagagcccttggtgggagggccgattggtccagactagaaagagcggttactttccatcatcatcagtgaaaccctgccccgtcgacggaaggccgcctatcagcagacctccgagccgggagattgactacactgcttacccgtggttcgcaggaaatatggagcgtcagcagacagacaatctactcaagtctcacgcttcaggcacatacttaatcagggagcgccccgccgaggcagaacgctttgctatctctatcaaattcaacgacgaggtgaagcacattaaagtggtggagaaagacaactggatccacattaccgaagctaaaaagttcgactctcttctagaactcgtcgaatactatcaatgtcattcgctgaaggagagcttcaagcaacttgacaccacattaaaatatccctacaagtccagggagagatccgcttcgcgcgccagctccagatcacccgtgttcacaccacgggtgattggaaccgctgtggctaggtataactttgccgctagagatatgagggagctaagccttagagaaggggacgtggttcgcatttattcacggattggtggggaccagggctggtggaagggggagacgaatgggcgaatcggatggttcccatccacatatgttgaggaagagggcattcagtag

SEQ ID NO: 140404 - DNA, 2544 bp, Artificial Sequence
  Description of Artificial Sequence: Synthetic coding sequence
atggagccttggaaacaatgcgctcaatggcttattcactgcaaggtgctgcccacaaatcaccgggtgacttgggacagcgcgcaggtcttcgacctggcccagacgctgcgagacggagtactactgtgtcaactgctcaacaacttgcgagcccattccatcaatctgaaagagatcaatctgcgccctcagatgtctcagtttctatgcctcaagaacattcggacatttctcaccgcgtgttgtgaaaccttcggcatgcggaagtccgagcttttcgaagcttttgatctctttgatgtccgcgactttggcaaggtaatcgaaactctctcaaggctcagtaggacacccattgctctcgctaccggcatccgccccttcccaacagaggaatccattaatgacgaggatatctacaaggggctgccagacctgattgatgagacattggttgaagacgaggaggacctttatgactgtgtgtacggcgaggatgaaggaggcgaggtctatgaggacctcatgaaggccgaggaggctcatcagcctaaatgtccagaaaatgatatcaggagttgttgtcttgctgaaataaagcagaccgaagaaaagtacacggagacactggagtcaatcgagaaatatttcatggcccccttaaagcggttcctgacagcagccgagttcgatagtgtgttcattaacattccagaactcgttaaactgcaccgaaacctaatgcaggagattcacgatagcattgtgaataaaaatgatcagaacttgtaccaggtcttcatcaattataaggaacgactggtgatctacggccaatactgctccggagttgaatcagctatctcctccctggattacatctcgaagacaaaggaagatgtgaaactaaaactcgaggaatgcagcaagagagccaataacggaaaattcaccttgagggatctgttagttgtacccatgcagcgtgttttaaaatatcatctactgttacaggagttagttaaacataccaccgatccgacggagaaggctaatcttaaactcgctctggacgcaatgaaggacttggctcagtatgtaaacgaagtaaagcgcgataatgagacactgagggagatcaaacagttccagctgagtatcgagaacctgaaccagcctgttctgctcttcggaagaccccagggcgatggagaaatacgtattactacactcgataagcatactaaacaggaacgccatatctttctgtttgacctggcagtgatcgtctgtaagagaaagggcgacaattatgaaatgaaagagataatagacctgcagcaatataagattgccaataacccaaccacggataaggaaaataaaaagtggagctacggcttttatctgatccacacccaagggcaaaatggcctggaattttactgcaagaccaaagatctgaagaaaaagtggctcgaacaattcgagatggcactgtccaatattaggcccgactatgctgattctaactttcatgacttcaaaatgcatacattcacccgcgttacttcttgtaaagtgtgccaaatgcttctgcggggcacattttaccagggctatctgtgcttcaagtgcggggcacgcgcacacaaggaatgccttggaagggtggataactgcggcagagtcaactcaggtgaacaagggacactgaagctgcccgagaaacgcaccaacggcctgcggagaactcctaagcaagtggaccccggcctgcccaaaatgcaggtaattcggaattactccggaacaccgcctcccgctctgcatgagggacctccactacagctgcaggcaggagatacggtcgagcttctcaagggagacgcccactccctgttttggcaggggcgtaatctggcctccggtgaagtgggattttttccaagcgacgctgtgaagccctgcccgtgtgtccctaaacctgtggactactcatgccagccatggtatgctggtgcaatggaacgattgcaagccgagaccgagctgattaatcgggtcaattccacctacctagttaggcacagaactaaggaatctggagaatacgctatttcaatcaaatacaacaatgaagctaaacacattaagatactcacgagggatggttttttccacatcgccgagaatcggaagtttaagtctctgatggagctagtcgaatactataaacatcattccctgaaagaaggcttccgcacattggacacaactctccaattcccctacaaagagccagaacactctgcaggacagcggggtaatagagccggaaatagcctgctgtcaccaaaggttctgggtattgcaatcgcacgatacgatttttgtgcccgggacatgagagaactgtccctgctgaaaggcgacgtagtgaagatctacaccaagatgagtgcaaatggatggtggcgaggcgaggtaaatggccgcgtcggctggtttccttcgacctatgttgaggaggatgagtag

SEQ ID NO: 140405 - DNA, 1671 bp, Artificial Sequence
  Description of Artificial Sequence: Synthetic coding sequence
atgtctcagttcctgtgtctcaaaaacatacgcacatttctcaccgcgtgctgtgagacatttgggatgagaaagagcgagctgtttgaggcctttgatttattcgacgtccgggatttcgggaaagtgatagaaactttgtcacggctttctaggactcccatcgccctggccaccgggatccgacctttccctacagaggagagtatcaatgatgaggatatttataaaggtcttccggatctgatcgacgaaacgctcgtcgaagatgaagaagatctgtatgactgtgtgtacggggaggacgagggcggtgaagtttacgaggacctgatgaaagctgaggaggctcaccaacccaagtgcccggagaacgatattcgttcttgctgtctggcagagatcaaacagaccgaggagaaatataccgaaacactggagagtattgagaagtattttatggctcctttgaaacgttttctcacagccgccgagtttgactcagtgtttattaatattcccgaactggtgaaactccacaggaacttaatgcaggaaatacatgattccatcgtgaataaaaacgaccagaatctgtaccaagtgtttatcaattacaaggagaggttggtgatctatggacagtactgttccggggtcgagtctgcgatttccagtctggattatatttctaagacaaaagaggatgtgaaattgaagctggaggagtgctctaagcgcgccaataacggcaagttcactctgcgggacctgctagtggtgcctatgcagcgggtcctgaagtatcacctgctactccaggagttagtgaaacataccaccgaccctactgaaaaggctaacctcaaactggcgttagacgctatgaaagatttagcccagtacgttaatgaggttaagagagataatgagaccttacgcgagattaaacagttccagctgagcatcgagaacctgaaccagccggttctcctctttggtcggccacaaggcgatggcgagatccgaattacgactctggacaagcacacgaagcaggagcgccacatttttctcttcgatttggcagtgattgtgtgcaaaaggaagggtgataattacgagatgaaggaaataatcgatctgcagcagtacaaaatcgccaataaccccaccaccgataaggagaataagaagtggagttacgggttctatctgatccatactcagggtcagaacggtcttgaattttactgtaagactaaagaccttaaaaaaaagtggctggagcaattcgagatggcactgagcaatatacgccctgattacgctgatagtaatttccacgattttaaaatgcacacctttactagagtgacttcttgcaaggtgtgtcagatgctcctgcgaggcactttctaccaggggtacctctgttttaaatgtggagcccgtgcccacaaagaatgtctgggacgggtggacaactgcggacgtgtcaactctggcgagcaggggaccctgaagctgcccgagaagcgaaccaacggactgcgtaggacacccaagcaggtggatcccgacgtgccatgtctgctgcatttctttattagtatggcacccgccactcgttcaattgtcaaaagtcaaaaaaagaacaagaagttctag

SEQ ID NO: 140406 - DNA, 864 bp, Artificial Sequence
  Description of Artificial Sequence: Synthetic coding sequence
atgccaatttttacgtttctttcagagcaagggacactgaaactgccggaaaaacgaaccaatggattgagaagaactcccaaacaggttgatcctgggttgcctaaaatgcaggtgattcgcaactacagcggcacaccgccaccggcactgcacgaaggtccgcctttgcagctgcaggctggagacacagtcgaactgctaaagggggatgctcactccctgttttggcagggcagaaatctggcatccggtgaggtcggtttcttcccttccgatgcagtaaagccatgcccctgtgtaccaaagcctgttgactattcttgtcagccatggtacgctggcgcgatggagaggttgcaggcagaaaccgaactgatcaatcgggtgaactccacatacctcgtacggcacaggacaaaggaaagtggagaatatgctatctcaataaaatataataacgaggcaaagcacatcaaaatcctgactcgggacggcttttttcacattgccgaaaacagaaagtttaaaagtctgatggaacttgtagagtattataaacatcacagcctgaaagaaggctttagaacgcttgataccacgctgcagtttccatacaaggagccagagcatagtgcaggtcagcgcgggaatagggccggcaactccctgctgtctcctaaagtcctgggtattgctatcgctagatacgatttttgcgccagagatatgagggaattaagtcttctaaagggagatgtggtgaagatctacacaaaaatgtcggccaacgggtggtggcgaggtgaggtgaatggccgcgtgggctggtttccatcaacatacgtggaggaagatgaatag

SEQ ID NO: 140407 - DNA, 2628 bp, Artificial Sequence
  Description of Artificial Sequence: Synthetic coding sequence
atggagccctggaaacagtgtgcccagtggttgattcattgtaaggtactacctaccaatcatagggtgacatgggacagtgctcaagtgtttgacttagcccagacactccgagacggggtgctcctgtgccagttactcaataatctgcgagctcactctatcaatctgaaagagatcaacctgaggcctcagatgtcccagttcctgtgtctgaaaaatattaggacgtttctgaccgcatgttgtgaaacatttggcatgcgtaagtccgagttatttgaagcctttgatctgtttgacgtaagggattttggaaaagtcatcgagacactgtcgcggttatcccggactcccatcgcgcttgctaccggcattaggcccttccccaccgaagaatcaatcaatgacgaagatatatacaaaggattgcccgatctcatcgatgaaacgctggtggaggacgaagaagatctatatgactgcgtttacggcgaggacgagggaggtgaggtctacgaggacctgatgaaagccgaggaggctcaccagcccaagtgtccggaaaacgacattcgcagttgctgtctggctgaaatcaaacagactgaggagaaatacaccgagaccttagaatctatcgaaaagtattttatggcacctctgaaaagatttctgacagccgcagagttcgattcggtgttcataaacatcccggagcttgtgaagcttcacaggaatctgatgcaggaaatccatgatagcattgtgaacaagaacgaccagaacttatatcaggtgttcatcaattacaaagaaaggctggttatatatggccaatattgcagcggagtggaatctgcaatcagttctctggattatatcagtaagacaaaagaggatgtgaaacttaaactggaggaatgctccaaacgcgcaaataatgggaagttcacccttcgcgacctcctggttgtgcccatgcagcgagtcctgaagtatcacctgctgctccaagagctcgtaaaacatactacagatccaacagagaaggccaacctgaagttggcacttgacgctatgaaggacctggctcagtatgtcaatgaggtgaaaagggacaacgagacacttagagaaattaaacagttccagctttcaatcgaaaatctgaaccaacctgtcctcctgtttgggcggccccagggggacggagagattaggatcactaccttagacaagcacactaaacaggaaagacacatctttttgttcgatctggccgtaatcgtgtgtaaacgcaagggagacaactatgagatgaaggaaatcattgatctgcagcagtacaagatcgctaataaccccacaacggacaaggaaaacaagaagtggtcctacggattctacctgatacacacacaggggcagaacggtctcgagttctactgcaagactaaggatctcaaaaagaagtggctcgagcagttcgagatggctctgtctaatattcggccagactacgcagacagcaatttccacgacttcaaaatgcacacttttacccgggtgacttcctgcaaggtttgccagatgctcctccgcggcacattctaccagggctacttgtgcttcaaatgtggggccagagcacacaaggagtgcctgggcagagtggacaactgtgggagagtgaattccggagaacagggcaccctgaagctgcccgaaaaacgaactaacggactcaggagaacccccaaacaggtggacccaggcctgcccaaaatgcaagtaattcggaactactccggtacaccacctcctgcccttcatgagggaccgccgcttcaattgcaagcgggagataccgtggagctcctgaagggcgacgctcacagtctgttctggcagggcaggaatctcgcaagcggcgaggttggctttttccctagtgatgctgttaaaccatgtccgtgtgtacccaagccagttgactactcttgccaaccatggtacgctggcgccatggaacggctgcaggcagagacagagttgatcaacagggtgaatagtacttacttggtgcgacacaggaccaaggagtcaggagagtacgccattagcatcaagtacaataacgaggctaaacatattaagattctcacccgcgacggtttcttccatatcgctgaaaatcgaaaattcaaaagtctgatggagctggtcgaatactacaagcaccattccctaaaggaaggcttcaggaccttagatacgacacttcagtttccttacaaagagcccgagcattctgctggacagcgaggcaaccgagccggaaacagctctccttccctgttctgcggcttttccttcgtgacaccgcccgactactcattcgtgcctccttcttccacacccttctggagtgtgttgtccccaaaagttttggggatagcgatcgccagatacgacttttgcgcccgtgacatgcgggaactctcactcctcaagggtgacgtcgtgaagatctataccaaaatgtccgccaatgggtggtggcggggagaagtcaacggtcgcgtgggttggttcccatccacttatgtggaggaggatgagtag

SEQ ID NO: 140408 - DNA, 756 bp, Artificial Sequence
  Description of Artificial Sequence: Synthetic coding sequence
atgcaggtgatacggaactactctggtacccctcctcccgctctgcacgagggaccccccctccagctccaggccggggataccgtagagcttcttaagggcgatgcacatagcctgttctggcaggggcggaatctggcctccggagaggttggattcttccctagcgatgcagtgaagccctgtccctgtgtcccaaagccagtcgactattcgtgccaaccctggtatgcaggtgccatggagcggctgcaggcagagacagagctgattaatcgcgttaactcaacctatctcgttcgtcatcgaaccaaagagtcaggtgaatatgcaatttctatcaagtacaacaacgaggcaaagcatataaaaattttgactcgggacgggttcttccacatagcagagaacagaaagttcaaaagtctgatggagcttgttgaatattataagcatcattcccttaaggagggcttccggacattagataccacactgcagtttccctacaaggagccagaacattcggctggtcagagaggcaatcgcgcgggcaatagccttctgtcacccaaggttctgggtatcgcaattgcccggtacgacttctgtgcacgcgacatgcgggagctatcgctgctgaaaggcgacgtggtaaagatctacactaagatgtccgccaacggatggtggcgcggtgaggtgaatggccgagtcgggtggtttccatctacttatgtcgaagaggatgaatag

SEQ ID NO: 140409 - DNA, 912 bp, Artificial Sequence
  Description of Artificial Sequence: Synthetic coding sequence
atgtctagcgccaggtttgattcctctgatcgtagtgcctggtatatgggccccgtgagccggcaggaggcgcaaactcgactgcaaggtcagcgacacgggatgtttctggtacgcgattccagcacttgtcctggcgactatgtgctctctgtctctgagaatagtcgcgtttcccactatatcattaactccctgcctaatcgccgtttcaaaattggagatcaggagtttgatcacctccctgccctgctcgagttctataaaatccattaccttgatacaacgactctgatcgaacccgcacctcggtatccttctccacccatgggatctgtatcagcaccgaacctgcctacggcagaagataatctggagtatgtacgcaccctatatgacttcccagggaacgatgcagaggatttgccttttaagaagggcgagattctcgtgatcattgaaaagcctgaagagcaatggtggtctgcgagaaacaaagacggccgagtgggcatgattcccgtgccttacgtggagaagctggtccgctcaagccctcacggcaagcatggcaacagaaactccaattcttacggcatcccagaacctgcccacgcctacgctcagccacagacgacaactccactacccgctgttagcggatcaccaggagctgcaattactccgctgcctagtacccagaacggacccgtcttcgcaaaggcaatccagaagagggtgccatgtgcttacgataagaccgcgttggcacttgaggtcggggacattgttaaggttaccaggatgaatatcaacggtcaatgggagggggaagtgaacggtcggaaaggcctcttcccttttacccacgtgaagatctttgatccccagaacccagatgagaacgaatag

SEQ ID NO: 140410 - DNA, 912 bp, Artificial Sequence
  Description of Artificial Sequence: Synthetic coding sequence
atgtcaagtgccagatttgacagcagtgaccgcagcgcatggtacatgggtcccgtttctagacaagaggctcaaacgcggctccagggacagcgccacgggatgtttctcgtgcgcgacagctccacctgtcccggagactacgtgctctcagtctcagaaaatagcagggtgagtcattacatcattaactctctgccaaaccgtaggtttaaaattggagatcaggaatttgaccaccttccagcgctccttgagttctataagatccactacctggatacaactacgttgatcgagcctgccccgcgataccctagtccacctatgggatcagtgagtgcaccgaacctacctacagccgaagataatctagaatacgtgagaacgctctacgattttcccggtaacgatgccgaggatctgccttttaagaagggtgaaattctggtcataatcgaaaaacctgaagagcaatggtggtcggcgaggaataaggacggaagagtgggaatgatccctgtaccttatgttgaaaagctggtgcgatcgagcccccatgggaagcacggaaatcggaattcaaactcttatgggatccccgaacctgctcatgcatatgctcagccccaaacgaccacacctctgccagccgtgtcaggctccccgggggccgcaatcacccctttgccatccacacagaatggacccgtgttcgcaaaggcaattcagaagcgcgtgccatgtgcatacgacaagacggcactcgctttggaggtaggtgatatcgtgaaggtgacgcgcatgaatatcaatggccagtgggaaggtgaagtgaacggccgcaagggcctgttcccttttactcacgtcaagatattcgaccctcaaaatccagacgagaatgaatag

SEQ ID NO: 140411 - DNA, 3132 bp, Artificial Sequence
  Description of Artificial Sequence: Synthetic coding sequence
atggaatttgtccgggccctttggctaggtttagcgctggccttgggccctggttctgcgggtgggcacccccagccatgcggcgtactggcacggttgggtgggtctgtgcgcttaggagctctgttaccaagagcgcccctcgcgagggctagagcccgcgcagcgctggcaagagcagctctcgcacctcgcctgcctcacaatctctcattggagctggtcgtggccgctcctccagcacgcgatcctgcctcacttacgagggggctgtgtcaggcactggtcccgcctggagtggccgccctgttagcgttcccagaggccagacccgaactgctgcagctccactttctcgctgcagccaccgaaactccggttctgagcctcttacgccgggaggcccgggcgcccctgggggcgcccaatccttttcacctgcagctgcattgggcatcacccctggaaacactgctcgatgtgctcgttgccgtgctgcaggcccatgcctgggaggatgtaggcctggctctttgtaggactcaggaccctggggggctagtcgctctgtggacgtctagggcggggaggcctccacagctagtgctggacctttctcgaagggataccggcgatgccgggctgagggcacgcctggcacccatggctgctcccgtcgggggggaggcacccgttcccgctgcagtgctgctgggctgcgacatagcacgcgcgagaagggttctggaagcagtaccacctggacctcattggctgctggggactccgctcccaccgaaagccctgcctacagcaggcctcccgcccggtctccttgcacttggtgaagttgcacgtccccccctggaggctgctatccacgacatagtgcagttggttgcaagggccctcggatctgcagcccaagtgcaacctaagcgggccttgcttcctgcccccgttaattgcggagatctccaaccagcagggccagagtctcccggtcgcttcctggcaaggttcttagcaaacacgtcctttcagggccgcacggggccagtttgggtgaccggcagtagtcaagttcatatgagtagacacttcaaagtgtggtcgctgcggcgcgaccctagaggggcccctgcctgggcaacggtcgggtcatggagagacggtcaattggatttagagcccgggggcgcctccgccagacccccccccccccaaggcgctcaggtctggcctaagttgagggtcgtcaccttactagaacacccattcgtgtttgcaagagatcctgacgaggacggacaatgtcccgcaggccagctctgtttggaccctgggactaatgatagtgcaaccctagatgccctctttgccgccctggccaatggatccgctccgcgggcgttgaggaagtgctgctacggatattgcatagacctactggagagattggccgaggacactccatttgactttgagctttacctggttggtgacggaaagtacggggccctcagggatggccggtggaccggattagttggagacttattggctggacgagctcacatggcggtgacaagttttagcattaactccgccaggtcacaggtggttgatttcactagcccctttttttccacgtccctaggaattatggtgcgcgcccgggacacagcaagccccatcggtgcatttatgtggccccttcattggtccacctggctcggagtctttgccgccctacatttaactgccctcttcttgactgtatacgagtggcgcagcccctatggactgactcccagagggagaaatagatcgacggtgttctcctattctagtgcactcaacctgtgttatgccatcctgttccgccgcaccgtgtcttccaagacgcccaaatgcccaacaggacgcctcctgatgaatctttgggctatcttctgtctgctggttctttctagttacacggctaatctggccgctgtcatggtcggagataagacgttcgaagaattgtctggcatccacgaccccaagctgcaccacccggcccagggtttccggtttggaacagtctgggagtcatccgctgaagcttacataaagaaaagctttccagacatgcatgctcacatgaggaggcactcagcaccaacaacaccccgcggcgtggcaatgctgactagcgatccaccaaagctcaatgctttcatcatggataaatctctcctggactacgaggtctcgatcgacgccgactgtaaactgctgacggtcggaaaacccttcgcaatagaaggctatggcattggtttaccgcagaattctccactcacatccaacctgagtgagttcatctctcggtataagagtagtggctttatcgacctacttcacgataaatggtataagatggtcccctgcgggaagcgagtgtttgcggttaccgagactctgcagatgtcaatctaccactttgccggcttatttgtgctgctgtgtctgggactgggttcagcccttctttcttcactgggcgagcacgcctttttccgcctggccttgcccagaattcgcaaaggatcaagactgcagtactggctgcatacaagtcagaaaatccaccgtgccttgaacactgaacccccagaaggatcaaaggaagagaccgccgaggccgagccatctggtcctgaggtcgaacagcagcagcaacagcaggatcaacctactgccccagaaggctggaagcgtgctcgtagagctgtcgacaaagaacggagagtgcgctttctgttggaacctgcagtggtcgtggctcccgaggctgatgccgaagctgaggcagctcccagagaggggcctgtgtggttatgttcttatggaagaccacccgcggcccggcctaccggggctccccagcccggggagctacaagagctggagcgtcgcattgaggtggctcgagaacggctgaggcaggccttggtccgcaggggccagttgctcgcccagcttggggatagtgcccgccatcgtcctagaagactgctacaagcccgcgctgctcccgctgaggcgcctccacacagtggacggccgggaagtcaagagtag

SEQ ID NO: 140412 - DNA, 2502 bp, Artificial Sequence
  Description of Artificial Sequence: Synthetic coding sequence
atgcaccaactcttcagactcgtactgggtcagaaagatctcagtcgcgccggcgaccttttctcccttgacgattcagagatcgaggacagcctgaccgaggcactggaacagattaaaataattagcagctcgtctgactaccagaccaataataacgatcaagccgtcgtggagatttgtatcacacgaattaccacggcaattagagaaactgaatctatcgaaaagcatgctaaggctctcgttggtttgtgggattcttgtctcgaacataatttgaggccattcggcaaggatgaggacacgccacacgccaagatcgcttccgacatcatgagctgtatcctccagaattataaccggcctcccgttatggcgctggcgatccccattgccgtcaagtttctgcacagagggaataaggaactctgccggaacatgtctaactacctaagcttagcagccatcaccaaggccgatctgctggccgaccacaccgaggttatcgttaaatccatattacagggtaatacaatgcttttacgggtactgccagcggtgtacgaaaagcagccacagccaataaatagacacttgaccgagctcctggcactgatgtcccaactggaacagccggagcaatatcacttgctcaggctgctgcatgtggccgccaagaagaaacagctggaggtcgtgcagaagtgtattccctttctgatcgggcatttgaaggacagcactcacaacgatataattctcaacatcttgattgagatagctgtgtacgagcctgtcgccctgaattcatttctacccatgctcaaggaaatcggcgaacgattcccctatctcaccggacagatggcccggatctatggcgccgtcggacacgttgatgaggagcgtgcacggtcttgccttacctacttggtatctcagctggccaacatggaacatagctttcatcatatcttgctcctagagatcaagagcataacagataccttttccagtatattgggccctcagtctcgtgacatcttcaggatgagcaatagtttcactgccatcgcaaagctacttaccaggcagctagagaacacaaaggccggttccggaaggagaaagatttccactgaaatcgagttccctgaaaaactcgaagagacaaaattgatcgtcactgagaacgaagatcatgagaaactgcaggttaaaatacaggccttcgaggacaaaatcaatgcaggttcaaacactcccggctccattagaagatattcgctgggacaggtctctaaggaggagcgcaaaaacattagatttaaccgatctaaatctttagcctttcatacaatgttaacgaaaggcgtaggctctgatgacggagaagatgagaacaggggagatatccccgccagtatttccctcagtgagatcgatcctctgggacagggcaatgataagctcccgttcaagacagatacggagcgttcccagttgggtgagtcctccgttagttaccctaacataatccatattgactcagaaaatttgagcgagacagttaaagagaatagtcaggaggagacacctgaaactacagccagccccatcgagtaccaggacaaactctacctgcacctaaaaaaaaacctttctaaggtcaaagcttacgccatggagattggaaagaaaattcccgtacctgaccaatgtaccatagaggacacggtgcgtagttgtgtcgcgaaactcttctttacatgtagcttgaaaggccactactgcctgtattccaaaagtagcttcatcctcattagccaggagccacagccttggattcagatcatgttcctcttccagcagagcctgttccctgagcctctgtcaatacagagccacagcgtgcagttcttgagagctttatgggagaaaacccaggctggaggcgcccactccttcgagactgcaatgatggagtcaacatttcctcaacagaaggatctggatcaagttcagctgcacttagaagaggtgagatttttcgatgtgttcggcttttctgaaaccgcgggagcgtggcagtgtttcatgtgtaataaccccgagaaagccacggtcgtcaaccaggacggtcagccattgattgagggcaaattgaaagagaaacaggtacgatggaagtttattaagaggtggaagactcggtattttacccttgccgggaaccagttgttgttccagaaggggaagagcaaggatgaccccgacgactgccccatagaactctcaaaggttcagtccgttaaggctgtggccaagaaacgcagagaccggtcgctgcccagagcgtttgagatttttacggataataaaacgtacgtatttaaggcgaaagacgaaaaaaacgcagaggagtggctacaatgcatcaacgtcgcggtcgcacaagctaaggagcgcgagtcaagagaggtgactacctacctctag

SEQ ID NO: 140413 - DNA, 2502 bp, Artificial Sequence
  Description of Artificial Sequence: Synthetic coding sequence
atgcatcagttattcaggctcgtactcggccagaaggacttgtcgcgggcgggggacctcttcagccttgacgactccgagatcgaagactcactcaccgaagcactggagcagataaagataatctcatcatcttccgattaccagaccaataacaacgaccaggccgtggtggagatctgtatcactaggataaccaccgcgatacgcgaaacagaaagtatcgagaagcacgccaaggctctggtcgggctgtgggattcttgtctggagcacaatctcagaccctttgggaaggatgaggatacacctcacgcgaagatcgcgagcgacataatgtcatgcatcctccagaattacaatagaccgccagtcatggctctcgcaatccctattgccgtgaaatttcttcaccgcgggaataaagagctgtgcagaaacatgagcaactacctcagcctcgctgcgatcaccaaagccgatctgctcgctgatcacacagaggtgattgtgaaatccatccttcaaggaaacaccatgctgttgagagtcctgccagctgtgtatgaaaagcagccacagcctattaatcgtcacctgacagaactcctggcacttatgtctcaactggagcaacccgaacagtaccatctcctgcggcttctgcacgtggcggccaagaaaaaacagctggaagtggtgcagaagtgcatcccttttctgatcggccatctgaaagactcaacccacaatgatatcatccttaacatcctgatcgaaattgccgtgtatgagcctgtggcacttaattcttttctccctatgcttaaagagatcggcgaacgctttccctaccttaccgggcagatggccagaatttatggggccgtggggcacgtcgatgaggagagagccagatcttgcctgacctacctggtgtcccaactcgctaatatggaacactccttccaccacatcctcctgctggaaattaagagtattacggataccttcagtagcattctcggaccccagtcccgcgatatcttccgaatgtcaaattcattcacagctatcgctaagttgctaacacgacaactagagaacaccaaagcgggatctggccgccgcaagataagcacggaaatcgagtttccggagaagctcgaagagaccaagcttattgtaacagaaaatgaagaccatgaaaaattgcaggttaagatccaggcattcgaagacaagatcaatgctgggtccaacactcctggcagtataagacgatactccctgggccaggtttccaaagaagagcgtaaaaatatcagatttaatcggagcaaaagcctggcctttcacacaatgttaacaaagggcgtggggtccgatgatggcgaggacgagaaccgcggagacatccccgcatccattagcttgtccgagatcgatcccctggggcagggaaacgataagctgccattcaaaaccgatacagaaagatcccaattgggtgaatcaagtgtgagttaccctaacatcattcatattgattcggaaaacctctctgagaccgttaaggaaaattcccaggaggagacccctgaaactactgcatctcccattgagtatcaagataaactctatctgcacctgaaaaaaaatctgtccaaagtcaaagcttacgcaatggaaattggcaagaagatcccagtcccagatcagtgcacgatcgaagatactgtacgttcctgcgtagccaaactgtttttcacctgttcccttaagggtcattactgcctctattctaagtcttccttcatactcatttcgcaggagccgcagccatggattcaaattatgttcctatttcagcagtcactctttcccgagcccttgtcaatccaaagtcacagtgtccagtttttacgcgccctgtgggagaagacccaggcggggggcgcccatagctttgaaaccgcaatgatggagtccacttttccacagcagaaggacctcgatcaggtgcagctccacctagaggaagtgcgcttcttcgacgtgtttggcttttcggaaaccgcaggggcgtggcagtgtttcatgtgtaacaatcccgaaaaggcaacggtggttaaccaggacggtcagccgctgatcgaaggaaagctgaaggagaagcaggtgcgatggaaattcatcaaaagatggaaaacaaggtactttacacttgcggggaatcagctgctgttccaaaaaggaaaatccaaagacgacccagatgactgcccgatcgaattgtccaaagtccagagcgtcaaagccgtggctaagaaacgaagagaccgatcgctgccaagggccttcgagatatttacagataataagacgtacgtctttaaggcaaaggatgagaagaacgctgaggagtggctgcaatgcataaatgtcgcagttgcccaagcgaaggaaagagaatcgagggaagtgactacttacctgtag

SEQ ID NO: 140414 - DNA, 2367 bp, Artificial Sequence
  Description of Artificial Sequence: Synthetic coding sequence
atgcatcagctgttccggctggtgctggggcaaaaagatctcagtcgcgcaggagatctgttcagtctggatgatagcgagattgaggatagcctgacagaagccctggaacagattaagatcatcagctcttcttctgattatcagacaaacaacaacgaccaggctgtcgttgagatttgcatcacccgtattacaactgctatccgagagaccgaatctatagaaaagcatgccaaggctctagtcgggctgtgggatagttgcctggagcacaacctgcgacctttcggcaaggatgaagacactcctcacgctaaaattgccagcgacataatgtcttgcatccttcagaattataatcggcctcctgttatggcactagcaattccgatcgctgtgaaattcctacacaggggaaataaggaactctgtcggaatatgtcaaattacttatcgcttgcagcaatcactaaggctgacctcctagcagatcatacagaagtcatcgtgaagtctatcttgcagggaaacactatgcttctgcgcgtgttgcctgccgtgtacgagaaacagccgcagccaattaacagacacctgaccgaactcctggcgttgatgtcccagttggagcagcccgagcaatatcacctcctaagattgctccacgtggcagccaagaagaagcagctggaggtggtgcagaagtgcatcccatttctgattgggcatctcaaagacagtacacacaacgatattatattgaatatcttaatagagatcgcggtatacgagccagtcgccctcaattcgtttctgcccatgcttaaggaaataggagaacgatttccttaccttacggggcagatggcccgtatctacggagctgttggccacgtggacgaggagagggcgagatcctgtctgacatatcttgttagtcagcttgccaatatggaacacagctttcatcacatcctcttgctcgaaattaagtcaattactgacaccttttcgagtatcctagggcctcaatcccgcgatatctttagaatgagtaatagtttcactgcaatcgcaaaactcctcaccaggcaactggagaatactaaagccgggtctggcaggaggaaaatctccaccgaaatagaatttcccgagaaactcgaagagacgaagcttatagtcacagaaaacgaagaccacgagaaacttcaggtgaaaatacaggcctttgaggacaagattaatgccggctctaatacaccaggaagcatccgtaggtatagtcttgggcaagtctccaaagaggagcgtaaaaatatccggtttaacaggtccaaaagtcttgcctttcatactatgcttactaaaggcgtgggctcagacgacggagaagatgagaacaggggagatatcccggcatcaataagcctttctgaaatcgatccactcgggcagggcaacgacaagttgcccttcaaaactgacactgaaagatcccagctcggcgagtcatcagtgtcatatcctaacatcattcacatcgatagcgagaacctgtccgagactgttaaggagaactcccaggaagaaactcccgaaaccaccgccagtcccatcgagtatcaagacaagttgtatctgcacttaaaaaaaaatctctccaaggtaaaagcgtacgcaatggaaatcggcaagaagattcccgtgcctgaccagtgtacaatcgaagacacggttcgatcatgtgtggctaaacttttcttcacttgctccttaaaagggcattactgcctctacagtaagagttccttcatcctgataagtcaggagccccagccctggatccagatcatgttcctctttcagcaggacttggaccaggttcaattacatttggaagaagtgcggttctttgatgtgttcggcttctcggagaccgccggtgcctggcaatgcttcatgtgcaacaatccggagaaggccactgtggtgaaccaggacggacaaccattaattgagggaaagctcaaagagaagcaagtccggtggaagttcattaagaggtggaagacgagatactttactcttgcaggaaatcagttgcttttccaaaaaggtaaaagcaaggatgaccctgacgactgtcctattgaacttagcaaagttcaatcggtaaaggcggtggcgaagaagcgccgggatagatcacttccacgggcctttgagatctttacagacaacaagacttacgtgttcaaagccaaagacgaaaagaatgcagaggaatggctgcagtgtataaacgtcgccgtggcgcaggccaaagagagggaaagccgggaagtgactacctacttatag

SEQ ID NO: 140415 - DNA, 192 bp, Artificial Sequence
  Description of Artificial Sequence: Synthetic coding sequence
atgcatcaactttttcggctggtgcttggccagaaggatctgagtagggcaggggacctgttcagcctggatgatagcgaaatcgaggacagtctgaccgaggcactagagcagatcaagattatatcctccagctctgattatcagaccaacaataatgaccaggccgtcgtcgaaatctgcatcacgtag

SEQ ID NO: 140416 - DNA, 642 bp, Artificial Sequence
  Description of Artificial Sequence: Synthetic coding sequence
atgcaccagctgtttcgcttagtgttgggacaaaaagatcttagccgggccggagacctgttttctcttgatgactccgagattgaggattccctgaccgaggctctggagcaaataaaaattatttcatctagcagtgactatcagactaacaacaatgatcaggcagttgtggagatctgtatcactaggatcactacagccatcagggaaacagagtctatcgagaagcatgccaaggccttggtggggctgtgggatagctgcctcgaacacaacttaaggccattcggaaaagatgaggataccccccacgctaaaattgcctccgacatcatgtcgtgtattttacagaactataacaggccgcccgtaatggctctggcaatcccaatagccgtcaaatttctgcataggggtaacaaggagctttgtaggaacatgtccaactacctctccttggctgcgataaccaaggccgacctcctggctgaccataccgaagttattgtcaagtccattctgcaaggtatggtcaggaagcttagtctcgggacgtgctttgggaggtatctcaaagtgttcagctcaagcatttacggcctgtgggaggcaagaccaagagtcttggaagccaactag

SEQ ID NO: 140417 - DNA, 498 bp, Artificial Sequence
  Description of Artificial Sequence: Synthetic coding sequence
atgcatcagctatttcgcctcgtcctgggccagaaggatctttctcgcgctggagacctattttcgctcgacgacagcgagatagaagactccttaaccgaggcactcgagcagattaaaatcattagttcgtcctccgattaccaaacaaacaataatgaccaagccgtcgtggagatttgcattacgcggatcaccaccgcaatcagggaaactgagagcatcgagaagcacgctaaggccttggttggcttatgggatagctgcctcgagcataatttacgcccatttggaaaagacgaggacacacctcacgccaaaatagccagcgacattatgtcatgcatcctccagaactataaccggcccccagtaatggcactagccatcccaattgccgtgaaattcctacacagaggcaacaaggagctgtgtaggaacatgtccaactatcttagcctcgcagccatcaccaaggccgatcttctggcagactag

SEQ ID NO: 140418 - DNA, 168 bp, Artificial Sequence
  Description of Artificial Sequence: Synthetic coding sequence
atgcatcaattgttcagactggtcttgggacaaaaggacctgagccgagccggggatctgttttcactcgacgacagtgagattgaagactcactcaccgaggcacttgagcaaatcaaaattattagttcatcttcagactaccagacgaataataacgaccaatag

SEQ ID NO: 140419 - DNA, 642 bp, Artificial Sequence
  Description of Artificial Sequence: Synthetic coding sequence
atgcatcaactctttcggcttgtcctgggacagaaagatctgtctagggccggcgacctgttttccctcgatgactctgaaatagaggattctttaacggaagccctggagcaaatcaaaattatcagcagtagctcagactaccagactaacaacaacgatcaagcagtagttgaaatttgcatcaccaggattacaactgctattagggaaacagagtccatcgagaagcacgccaaggcccttgtaggactctgggattcatgcttggaacataatctccggccctttggaaaagacgaagatacgccacatgccaaaatcgccagcgacattatgtcatgcatcctgcaaaactacaaccgtcccccggtgatggccctcgctattcccattgccgtcaaattcctgcataggggcaataaggaactgtgtaggaatatgtctaactacctgtctctagcggctattactaaagcagacctgttggctgatcacaccgaggtgatcgtgaagtccatcctgcagggcatggtccgcaagctctctctgggcacatgttttggccgctatctgaaagttttctcaagtagtatctacggcttatgggaggcgcgtcccagggtgcttgaagccaactag

SEQ ID NO: 140420 - DNA, 534 bp, Artificial Sequence
  Description of Artificial Sequence: Synthetic coding sequence
atgcatcagttgtttcggctggtgctggggcagaaagatctgagccgcgccggggatctgttcagcctcgacgacagcgaaattgaagacagtttgaccgaagctctggagcagatcaagatcatctcctccagtagtgattaccagaccaataacaatgatcaggccgtcgttgaaatctgtattacgcgaatcaccactgcgattcgcgaaacagagagcatagaaaagcacgctaaggcccttgtaggactctgggactcgtgcctagagcacaacctgagacctttcggcaaggatgaagataccccccacgccaagatcgcctctgacatcatgtcatgcattctccaaaattacaatcgtccacctgttatggccctcgctattcctatcgctgttaaatttctgcacagagggaacaaagaactgtgccgaaatatgtctaattatttgagcttggcagccattaccaaggctgacctgctggccgaccatacagaggtgatagtcaaatctatactccaagtgtag

SEQ ID NO: 140421 - DNA, 2367 bp, Artificial Sequence
  Description of Artificial Sequence: Synthetic coding sequence
atgcaccaactgttccggttagtcctaggtcagaaggaccttagtagagccggagacctgttctctctggacgactctgaaatcgaggactccctgacagaggccctggagcagattaagattattagttcctctagcgactaccagaccaataataatgaccaggccgtggtggaaatttgtatcacccgcattacaactgcaatcagggagacagaaagtattgagaagcacgctaaagccctcgttggtttgtgggattcctgcctcgagcataatctcagaccgtttggcaaagacgaggatacaccccatgcgaaaatcgcatccgatatcatgtcgtgcatcctgcagaactacaacagaccaccagtgatggcgctcgccatcccgattgcagtcaagtttttacaccgaggaaacaaagagctgtgtcgaaacatgtctaactacttgagcctcgcagcaatcactaaagcagatctattggccgatcatactgaggtaattgtgaagtcaattttgcagggaaacactatgctgctgagagtcctgcccgccgtttacgaaaaacagccccagcccatcaatcgccatctgacggagcttctggcactgatgtctcagctggaacagccagagcaataccatctcctgagactcctgcatgtagctgctaagaaaaagcagctggaagttgtgcagaagtgtatccccttcttaatcggccatctgaaagatagcacacacaatgacatcatcctgaacatcctgattgagatagctgtctacgagccagttgcactcaatagctttctccccatgcttaaagaaattggggagagattcccatacctcacaggccaaatggcccggatatacggagccgttggacacgtcgacgaggagagagccagatcctgcctgacatacttggtgtcacaactggccaatatggagcactcttttcaccatatactcctgctggagatcaagagcataactgatacattctcttccatccttggtccccagagtagggatatctttagaatgtccaacagcttcactgcgatcgcgaagttgctaactcgtcaacttgaaaatacaaaggcaggcagtgggaggcggaagatttctaccgaaattgaatttccagaaaaacttgaagagactaagctgattgtcaccgagaacgaggatcacgagaaacttcaggtaaagattcaagcctttgaagataaaattaatgccggtagcaacacacccggctcaatccgaaggtacagcttagggcaggtgagcaaagaggaacgcaagaacattagattcaaccgctccaaatccttagcatttcacaccatgcttacaaagggggtggggagcgacgatggggaggatgaaaacaggggagatatccccgcatcaatatccctgagcgaaattgatccactgggccagggtaacgacaaactgccctttaaaacagacacagagaggagtcagctgggggagtcttccgtgtcgtaccctaacattatccatattgactccgagaatctgtccgagacagtcaaagaaaattcacaggaggagaccccagaaacaacagcgtctccgatagagtaccaggataaactatacctccacctgaagaaaaacctctccaaggtgaaggcttatgccatggagatcgggaagaaaatacccgtcccagatcagtgtacgatcgaagacaccgtgcggagttgtgtggctaagctcttcttcacctgttccttgaagggtcattactgtctgtatagtaagagcagcttcatcttgatctctcaagagccacagccgtggatccagatcatgttcctgttccagcaggacctggatcaggtgcagctgcacttagaagaggtgcgttttttcgacgtctttggttttagcgaaacggccggtgcatggcagtgcttcatgtgcaacaatccagaaaaggccacggtggtcaaccaggatggccaacctctcatcgagggcaagttgaaagagaaacaggttcgatggaaattcattaaaagatggaaaactcgctatttcacactggccggaaaccagcttctatttcagaaagggaagtccaaagatgatcccgatgattgtccaatcgagctgagcaaagtccagtcagtcaaggccgtagctaaaaagcgacgcgaccgcagtctccccagggccttcgagatattcaccgacaacaagacctacgtttttaaagctaaggatgagaagaatgccgaggaatggctgcagtgcattaacgttgccgttgcccaggccaaagaacgggaatctcgtgaggtcaccacttatctgtag

SEQ ID NO: 140422 - DNA, 3768 bp, Artificial Sequence
  Description of Artificial Sequence: Synthetic coding sequence
atggaactggctgcattatgcaggtggggcctgctcctggcactcttgcccccaggcgctgcctctacacaggtctgtaccgggaccgatatgaaattaaggctgccagcttcgccagagacgcacctggatatgctgcgacacctgtaccagggatgccaggtggtgcaaggcaacctggagcttacgtatttacccaccaacgctagtttgtctttcttgcaagatatccaagaggttcagggctacgtgctcatcgcccacaaccaggtgcggcaggtaccactgcagcgacttcgaatcgtccggggtacacaattgtttgaggacaactatgccctggcagtgttagataacggcgaccctctgaacaatacaactcctgtcaccggtgcatcccccggtggtttaagggagctccagctgagatccctgaccgagattttaaagggtggagtgctgattcagaggaacccccagctttgctaccaagatacaatcctttggaaggacattttccataagaacaaccagctagcgctgacattaatcgacactaacaggtcccgggcttgtcacccgtgctcacctatgtgtaaggggtcccgctgctggggtgagtcgagtgaggactgccagtctttgactcgcaccgtctgcgcgggtgggtgtgctagatgcaagggcccattgccaacagactgctgccatgaacaatgtgcggccggctgcacaggcccaaagcacagtgattgcttagcctgcctgcatttcaaccattccggcatctgcgaacttcattgtccagcgctggtgacctacaacacagatactttcgaatctatgcctaacccggaagggaggtatacctttggagcgagctgcgttacagcgtgtccctataactacctgagcaccgacgtgggcagttgtaccttggtctgccccttacacaatcaagaggttactgcagaggacggaacccaaagatgtgagaagtgttctaaaccctgcgctagggtttgttacggcctcggcatggagcatctgcgcgaagttcgggccgtgaccagtgcaaatatccaggaatttgccggctgcaaaaagatcttcgggagcctggcctttctccctgaatcttttgacggagatccagcgagcaacacagcacctctgcagcccgaacaacttcaagtattcgagactctggaggagatcaccggatacctgtatatttccgcctggcccgactccctacctgatctgagtgtgtttcagaacctccaggtaatccgcggacgcattctgcacaacggtgcctacagtctgactttgcagggactgggcatctcatggctcggtctgagatctctccgcgaactgggttcaggcctggccctgattcatcataacacccatctatgcttcgtccacactgtgccctgggatcagctgtttaggaacccccatcaggccctgctgcacacagcaaacagaccggaggatgagtgtgttggcgaagggcttgcctgtcaccaattatgcgctcgcggacattgctggggccccggaccaacacagtgcgtcaattgcagccagtttcttcgggggcaggagtgtgtggaggaatgcagagtcttgcaaggactccctagggagtatgtcaatgcgaggcattgcctcccctgtcacccagagtgccagcctcagaatgggagtgtgacatgttttgggccagaggccgaccagtgcgtagcctgtgcacactataaagatcccccattttgtgtggcgcggtgcccctctggcgtgaaacccgatctttcctatatgccaatctggaagttcccagacgaagaaggggcatgtcagccctgccctatcaactgcacacatagttgcgtggacttggacgataaaggatgccctgcagagcaaagagcatcacctctgacttccatcatcagtgccgtggtcggcattctacttgtcgtggtactcggggtggtgttcggcattctgatcaaacgacgccagcaaaaaataagaaagtatactatgagaagactcttgcaagagacggaactagtcgagccactcaccccgagtggggccatgcctaaccaagcgcaaatgcggattctcaaagagaccgagctccgaaaggtcaaagtgctgggctcgggggcattcggtaccgtgtataaaggaatttggattcccgacggcgagaacgtgaaaattcccgtggcgattaaggtacttcgggagaacacatccccgaaggcaaacaaggaaatactcgatgaggcgtacgtcatggcaggggtcggcagtccctacgtgtcacgtctgctaggcatctgccttacctcaacagtgcagctcgtcacacagctcatgccttacgggtgtttgctcgaccatgtccgtgaaaacagggggcggctcggatcccaggatctccttaattggtgtatgcaaattgctaagggtatgtcctacctggaagatgttcgcctagtgcatcgggatctagccgcaagaaacgtcctggtcaagagcccaaatcacgttaaaataaccgactttggactggccaggctgcttgatatcgacgaaacagagtatcatgctgatggggggaaagttcctattaagtggatggcactagaatcgatccttcgcagaagatttacccatcagtctgatgtgtggtcttacggggtaacagtgtgggagctgatgacattcggcgccaaaccatacgacggcattcctgctagggagataccagacctgctggaaaagggagagcgtctgccgcagcccccgatttgcaccatcgatgtctatatgatcatggtcaaatgttggatgatagatagtgaatgtaggccacggtttcgcgagcttgtgtccgagttttcccggatggccagggatccccagagatttgtcgtgatacagaacgaagacctggggccagcgtctccgctagactctactttttatagaagcctgctggaagacgatgacatgggggatctggtggacgcggaagaatacctggtcccacagcaaggttttttctgtcctgacccggcacctggcgccggcggaatggttcaccatagacaccgcagctcctctactaggtcaggcggaggggatctcactttggggttggagccttccgaagaggaggcgcctcgatcccccctcgccccttccgagggagcaggcagcgatgtgtttgacggcgacctgggcatgggggcagctaagggtcttcagtccctgcctacccatgacccaagcccactccagcgctattcagaggaccctactgtgcccctgccttcggagaccgacgggtatgtggccccacttacatgttcaccacagccagaatatgtgaaccagcccgacgtgcggccccagccaccgtctccaagagaggggccactcccagccgcccgaccggccggcgcgaccctggagcgcccgaaaacattgtcccccggcaagaatggtgtggtgaaagacgtctttgcctttggcggggcagtggagaaccccgagtatttgaccccacagggtggagccgccccgcaacctcacccacctcctgcattcagtccggcattcgacaacctgtattattgggaccaagatccaccggagcgcggggcccccccctctactttcaagggtactccaactgccgagaatcccgagtatcttggtctcgacgtccccgtgtag

SEQ ID NO: 140423 - DNA, 3678 bp, Artificial Sequence
  Description of Artificial Sequence: Synthetic coding sequence
atgaagctgcggctgcccgcaagtccagagacacatctggatatgcttcggcatctgtaccaggggtgccaggttgtgcagggcaatctggaactaacgtacctcccgaccaacgcaagtctgagttttttgcaagacattcaggaggtccaggggtacgtccttattgctcacaaccaggtgaggcaggtgcctctgcagagactcaggatcgtgcgcggcactcagctgttcgaggacaactacgcacttgccgtccttgataatggtgaccctttgaacaacactaccccggttactggggctagcccagggggactccgggaattgcagcttcgtagcctcactgagattctaaagggcggtgttttgattcagcgtaacccccagctctgctaccaggacaccatcttgtggaaagatatctttcacaagaataaccagctggccctaaccctcattgacactaaccgttctcgagcttgccacccgtgctcacccatgtgcaaaggtagccggtgctggggggagtcatccgaggactgccagagcctgacccggactgtgtgtgccggcggctgcgcccggtgtaagggccccttgcctaccgactgttgtcacgaacaatgtgccgccggctgcactggacctaaacactctgattgcctggcatgcctccactttaaccacagtggtatctgtgaattgcactgtcctgccctggtgacatataacaccgataccttcgaatccatgcctaaccctgaagggcgctacaccttcggtgccagttgcgtgactgcttgtccgtacaattacctgtcaaccgacgtggggtcatgtacgctcgtatgccccctgcacaatcaggaggtgacggccgaagacggaacccagaggtgcgagaagtgctcaaaaccctgcgctagggtgtgttatggacttggcatggagcacctgagggaggtgcgagcagttacttccgccaacatccaagagtttgcaggctgtaaaaagatttttgggtcattggcttttcttcctgaaagtttcgacggggatccagcttccaacactgccccattgcagccggaacagttgcaagtcttcgaaactcttgaagagatcaccggatatttgtacattagtgcctggccggattctctccccgacctgtctgtgttccagaacttgcaggtcatcagaggtcgcatccttcataatggcgcctattctctgacccttcagggcctggggatctcgtggttggggctaagatcactgcgggagctgggctctggcctggctctaatccaccacaatacgcacctctgctttgtacatacggtgccgtgggaccagctgtttcgtaacccacatcaggctcttctgcataccgccaatcgtcccgaagacgaatgcgtaggagaaggcctggcctgccaccagctctgcgcacgtggccactgttggggccctgggccaacgcaatgtgtcaattgtagtcaatttctcagaggacaggagtgtgtcgaagaatgcagagtgctgcaaggcctgccaagagagtacgtcaatgcaaggcactgtctcccttgtcatcctgagtgccagccacagaatggttcagttacctgtttcggtcccgaggccgaccagtgcgtagcctgcgctcactataaagaccctcctttctgcgtggctcgttgcccgtcgggcgtgaagccagatctgagctacatgcccatctggaagttccccgacgaggagggggcttgtcaaccatgccctatcaactgtacacactcttgtgtggacttggatgataagggatgcccggctgagcagcgcgcctcgcctcttacctccataattagtgctgtggttggcattctgctggtcgtcgtgttgggcgtggtgttcggcatccttatcaagcgacgccagcagaagattcgtaaatacacgatgcgaaggttgctacaggagacagagctggttgaacctctgactccttccggcgcaatgccgaatcaagcccagatgcgtattctgaaagaaaccgaactgcgcaaggtgaaagttctgggatcaggcgcttttggcaccgtgtacaaaggtatctggatcccggatggagagaatgtgaagatcccggtggctatcaaagtgttaagagagaacactagccctaaggccaacaaagagattctggatgaagcctacgtgatggccggtgttggatctccctatgtaagccgcctccttggaatctgcttaactagcacagttcagctggtgactcaactgatgccatatggctgccttctggaccacgtcagagaaaaccggggacgtctgggatctcaagaccttctaaattggtgtatgcagattgccaagggaatgtcctatctggaagacgtacgcttggtgcatagagacttggcagcccggaacgtgctggttaagagccccaatcatgtgaaaataaccgactttgggctcgcccgcttactggacatcgacgagaccgagtaccatgcggacggcggaaaggttccaatcaaatggatggcattagaaagtatcctgaggcgacggttcacacaccagtctgatgtgtggtcttatggggtgacagtgtgggagctcatgaccttcggcgctaagccctacgacggaatccccgcccgggagatacccgacctgctggaaaaaggagaaagacttccccagccccctatttgcaccattgacgtgtacatgatcatggtgaaatgctggatgatcgactctgaatgccggcctcgatttcgcgagctggtgtccgagttctccaggatggccagggatccacagcggttcgtggtgatccaaaacgaggaccttgggcccgcctctcccctcgatagcaccttttacaggagcctgcttgaggatgacgatatgggagacctagtggatgcagaggaatacctggttccccaacagggtttcttctgcccggaccctgcgcccggcgccggcggcatggttcatcatcgccacagatcgtcttccactcgctccgggggcggggacttaacactaggtctggagccctctgaagaagaagccccacgatcaccactggcgccctcagaaggagcaggcagcgacgtatttgacggtgatctggggatgggagctgccaagggcctgcaaagcctaccgactcatgacccctcaccacttcagcgctattcagaggatcctacggtccccctgcccagcgaaacggacgggtacgtagcgcccctgacttgcagccctcagcctgagtatgtgaatcaaccagacgtgagaccccagccccctagcccccgggagggcccactgcctgccgcacgccctgctggtgcgactctggagaggcctaaaacactttcacctggtaagaacggggtggtgaaggacgtctttgccttcgggggggccgtggaaaatccagagtaccttacacctcaggggggcgcggccccacagccccatccacctccagctttttcccccgccttcgacaacctgtactattgggaccaggacccgcctgagcgtggggcccccccctcaacattcaaaggcacacccacggccgagaatcccgaatatcttggtttagacgtgccagtatag

SEQ ID NO: 140424 - DNA, 2940 bp, Artificial Sequence
  Description of Artificial Sequence: Synthetic coding sequence
atggagttagcagccctgtgcaggtgggggctcctgctggccctcctcccccctggagctgcaagcacgcaggataattatctgagtactgatgtgggctcctgtacattggtctgtcctttgcataaccaggaagttacagctgaagatggtacccagcgttgcgagaaatgttcaaagccatgtgcacgtgtttgctacgggctcgggatggagcacctgcgcgaggtgcgggctgtaaccagtgctaatattcaggagttcgcaggctgcaagaaaatctttgggagtctggctttcctgccagagtctttcgacggcgatcccgccagtaacacagctccgttacagcccgagcaactgcaggtattcgagactctggaagaaattacagggtacctatatatcagcgcatggccagactccctgccggacttgtctgtgttccagaacctccaggtgattcgagggcggattctgcacaacggcgcatactcactcactcttcaggggctgggaatcagttggctcggcctgaggagcttaagggaactggggagtggactggctctgattcatcacaatacacacctctgctttgtccacaccgtgccttgggatcaactgtttagaaacccacatcaggctctgctccacacggctaacagaccagaagatgagtgtgtcggggaagggttggcttgtcatcaactgtgtgcacgtggccattgttggggaccaggccctacccagtgcgtcaactgcagccagtttctccggggacaggagtgtgtggaggagtgcagagtcctgcagggcttaccccgcgagtatgtcaatgccaggcactgcctcccctgccatccagaatgtcagccacagaacggctctgtgacttgcttcggccctgaagctgatcagtgcgtggcctgcgcccactataaggacccgcctttttgcgtggcccgctgtccttccggggttaaacccgacctgtcttatatgcctatatggaagttcccagacgaggaaggggcgtgtcagccatgcccaataaactgtacccattcctgtgtcgacctggacgacaagggatgccccgcagaacaacgcgcttcacccttgacaagtatcatttccgccgtggtgggtatcctgctggtggtggtacttggagtggtcttcggtatactaatcaaacgcagacagcaaaaaataaggaaatatactatgagacggctgctgcaggagactgagttggtggaaccccttactccaagcggggctatgccgaatcaggcgcaaatgagaatactgaaggagacggaactgcgaaaggttaaggtactgggatctggggcgtttggaaccgtgtataaaggtatctggataccagacggggagaacgtgaaaattccagtggccattaaggtattacgggagaatactagccctaaagcaaataaggagatcctagacgaggcttatgtgatggccggtgtcggcagtccttatgttagtagactgctgggcatctgcctcaccagcacagttcagctagtcacccagctgatgccttacggttgccttctggatcatgtccgagaaaataggggacgtctgggctcacaagacttattgaactggtgcatgcagatagctaaaggcatgtcttacctggaggatgtgcgtctagttcacagggatctagcagcccggaatgtgctggtaaagtctccaaaccatgtgaagatcactgacttcggcctcgctaggcttcttgacatcgacgagactgagtaccatgctgacggtggcaaagtgcccattaaatggatggccctggaatcaatcctcaggaggaggttcactcaccagagtgatgtgtggagctatggagtgacagtgtgggaactcatgaccttcggggccaagccctatgatggaatccccgcccgcgagatacccgatctcctagagaaaggagagcggcttccccagcctcccatctgcactatcgacgtgtacatgatcatggtcaagtgctggatgatcgactccgagtgtcggccccggttcagagagctcgttagcgaattctcgaggatggcacgcgatccacagagattcgtcgtaattcagaatgaggatttaggccccgccagccctctggattccactttttaccggagcttactggaggatgatgatatgggcgatctcgtcgacgcggaagagtatctggtgccccagcaggggttcttctgccccgatccagcacccggtgctggaggcatggttcaccaccgccacaggagttctagcacgagaagcggtgggggggatttgactctgggcctcgaaccaagcgaggaggaagcccccagaagcccactcgcacccagtgaaggagccggcagtgacgtgtttgacggtgatttagggatgggcgctgctaaggggttgcagtctctgccaacacatgaccctagcccactccagagatacagtgaggatccaactgtcccccttccatcggaaacggatgggtatgttgcaccattaacatgttctccgcagcccgagtacgtgaaccagccagatgtcagaccacagccaccgtccccgagggaaggacccctccccgccgcccggcccgccggcgcaaccttggagcggccgaaaaccctctccccaggaaaaaatggagtggtcaaggacgtgttcgcctttggtggtgcagttgaaaacccagaatatctgacgcctcaagggggggctgccccccagcctcacccacctcctgctttctccccagctttcgacaatttgtactattgggaccaggacccgcccgagcggggggcccccccatctacttttaagggcactcctactgcagagaatccagaatatctgggcttagacgttccggtctag

SEQ ID NO: 140425 - DNA, 1812 bp, Artificial Sequence
  Description of Artificial Sequence: Synthetic coding sequence
atgaaactcagactgcctgcaagccccgagactcatttggatatgctgcgccacctgtaccaaggatgtcaggtggttcaggggaacctggagttgacctacttgcccaccaacgccagcctgagtttccttcaggacattcaggaagtccagggctatgtgcttatagcccacaaccaggtcagacaagtgcccttgcagcgactgaggattgtgaggggaacccagctctttgaggacaactacgcactggctgtccttgacaacggcgacccgctcaacaataccacccccgttaccggagcatcaccaggtggcctacgggagctccagctgcgcagcctgactgaaatcctcaaaggcggggttctgattcaacggaacccccagctgtgttatcaggatacgatactgtggaaggacatctttcataagaataaccaacttgcactgacattgattgatactaatcggtcaagggcctgtcatccttgctctccaatgtgcaagggctccaggtgctggggcgagtcctcagaagattgtcagtcactgacccggaccgtctgtgccggtggctgtgcccggtgcaagggcccactgcccacagattgctgccatgagcagtgcgcagctggttgtacggggccgaaacactctgactgtctcgcgtgcctgcatttcaaccatagcgggatatgtgagctacactgcccagctttggttacatataataccgacaccttcgagagcatgcccaacccagagggccggtataccttcggcgcaagttgtgtcacagcatgtccatacaattacctgtccacagacgtaggctcctgcaccttagtttgcccccttcacaatcaggaggttacggcggaagacggaactcagcggtgtgaaaagtgctccaaaccctgtgctagggtctgttatggactgggcatggagcacttacgggaggtacgggccgtcacaagcgcaaacattcaggaatttgcaggttgtaagaaaatcttcggatcccttgcatttttgcctgagtccttcgatggggaccctgctagtaatactgccccgctccaacctgaacaacttcaagtattcgaaaccctcgaggagattacaggctatctgtatatctctgcttggccagacagcttgcctgacctgagcgtgttccagaacttgcaggtaatccggggccgtatcctgcataatggcgcctattcgttgacactgcaagggctcggcatcagctggctgggcctgagaagcctcagagagctaggatccggcttggccctgattcatcataacactcacctgtgttttgtccataccgtgccatgggaccagctattccgaaatccgcatcaggcattgctccatacagcaaaccgacccgaagatgaatgcgttggcgagggcctggcttgtcaccaactctgtgctaggggtcactgttgggggcccggccctactcagtgtgtgaactgtagtcaatttctgaggggccaggaatgtgtagaggaatgcagagtgcttcagggactacctcgggaatatgtaaacgcccggcattgcctcccttgtcaccctgagtgccagcctcagaacgggtctgtgacatgtttcgggcctgaagcagatcagtgcgtagcttgtgctcactataaagaccctccattttgtgtggcaaggtgtcctagcggggtgaaacccgacctgagttatatgcccatctggaagtttccggatgaggaaggggcatgtcaaccctgtcctataaactgtactcactcttag

SEQ ID NO: 140426 - DNA, 3678 bp, Artificial Sequence
  Description of Artificial Sequence: Synthetic coding sequence
atgaaactgagactgcctgctagccctgagacacacttggatatgctgaggcacttgtatcagggttgccaagtggtgcagggcaaccttgagttgacttacttacctaccaacgccagcctgtccttcctccaggacatccaggaggttcaggggtatgtgctaatcgcccacaatcaggtgcgacaggttccccttcaaagacttcgtatagttcggggaacacagctgtttgaagataattacgctttagcagtccttgacaacggagacccactgaataacaccactcccgttactggggcttcgcctggaggcctcagggaactgcagcttcggagcctcaccgaaatcctcaaaggcggagtgctcatccagagaaacccgcaactttgctaccaggacaccatcctctggaaggacatattccacaagaacaaccagctcgctctgacattgatcgacactaatagaagtcgcgcctgtcatccctgtagtccgatgtgcaaaggctcccgctgttggggcgagtccagcgaggactgccagtccctcactaggaccgtctgtgcaggcggctgcgcccgatgtaaaggccctcttcccactgactgctgccacgagcagtgtgccgcaggatgcaccgggccaaagcacagcgactgcctggcctgtttgcatttcaatcactctgggatctgcgaacttcattgtcctgccctggtcacctacaataccgataccttcgaatcaatgccgaatcccgagggtcgatacactttcggcgcgagctgtgtgactgcctgcccctataattacctctccacagatgtgggtagctgtacgcttgtgtgccccctgcacaatcaagaagtgacggccgaggacgggactcaacggtgcgagaagtgttccaaaccgtgcgcacgcgtttgttatggcctcgggatggagcacttgcgcgaggtgagagctgtgacttctgccaacatacaggagttcgcgggctgtaagaagatcttcgggtccctggcttttctgcccgagagctttgacggtgaccctgcatcaaataccgcccccctgcagcctgagcagttgcaggtctttgaaacacttgaggaaattaccggatatttgtacatttcagcctggccagactctttgcctgacctgtccgtgtttcagaatttacaggtgatcagaggtagaatactgcacaatggggcatattctttaaccctacagggacttggaatctcctggctgggactaagaagtctcagggaactgggatctgggttggcccttatccaccacaacacccatctttgctttgtgcacactgtgccttgggatcagctgttcagaaatccccaccaggccctccttcacacggcgaaccgcccggaggacgagtgcgtcggcgagggcttggcatgccaccagctgtgtgctaggggacattgctggggaccaggacccacccagtgtgtgaattgttcacagtttttgagaggccaggaatgcgtagaggaatgtcgagtcctccagggactgccccgtgagtacgtcaacgcacgccactgcctcccttgtcatccagagtgccagccccaaaacgggagcgtgacctgttttgggccagaagcagaccagtgtgttgcgtgcgcccactacaaagatccacctttttgcgtcgcgagatgcccctccggtgtgaaacctgatctatcatatatgcccatttggaagtttcctgatgaggagggcgcttgccagccctgccccattaattgtacccacagctgtgtcgacctggacgacaaggggtgccccgccgaacaacgggcaagccccctgaccagcattatctcagctgtcgtaggcattcttctagtggtggtgctgggggtggtttttggaattctgatcaaacggcggcaacagaagatcaggaaatacaccatgcgaagactgctgcaggagaccgaactggtggagcccttgacgcccagcggagctatgcctaaccaagctcaaatgcgcatcctcaaggaaaccgagcttaggaaggtaaaggtgctgggctctggggcatttggaacagtctataaggggatctggatccctgacggcgagaatgtgaagatccccgttgccatcaaggtccttcgtgagaacacctctccaaaggcaaataaagagatcctggatgaggcatacgtgatggccggagtggggtctccgtatgtcagccgactactcgggatctgtctgacatccaccgtccagctggtcactcagctcatgccctacgggtgcctgctggatcacgtgcgagagaaccgaggcaggttgggctctcaggacttactgaactggtgcatgcagatcgccaagggcatgagctatttagaggacgtgaggctggtgcatagggacctcgcggcaagaaatgttctggtaaagagtcctaaccatgtgaaaataaccgactttggacttgcacgactgctggacattgacgaaactgaatatcacgccgacggaggcaaggttcccattaagtggatggccctggaatctatccttcggcgtagattcacacaccagagcgacgtctggtcatatggagttactgtgtgggagttgatgacgttcggcgcaaaaccttatgacggcattcccgctagagagatccctgacctgcttgaaaagggcgaacgtctgccacagcctcccatttgcaccatagacgtttacatgattatggttaaatgctggatgattgactccgagtgccgtcctcgtttcagggagttagtgagcgaatttagccgtatggccagagacccgcaaaggtttgtggtaatccagaacgaggatctcggtcctgcatcccctctggactctactttttataggtccctcttggaggatgacgatatgggggaccttgttgacgccgaggaatacctggtcccacaacagggcttcttctgccctgaccctgcccccggtgcaggagggatggtgcatcacagacatcgtagctcctctacaagatcagggggaggtgacctgacactgggactcgagccttctgaagaagaggctccgcggtctcctctcgcgccgtcggaaggggcggggtctgacgtgttcgacggcgaccttggtatgggggcggccaaagggttacaaagtctgccaacacatgatcccagcccccttcagcgctactcagaagacccaacagtgccactgccctctgagaccgatgggtacgtagctccgctcacctgctccccacaacctgaatacgtgaatcagcccgacgtgaggcctcagccgccctcacccagagaaggtcctcttcctgccgcccgaccagcgggcgctacactcgaacgtcctaagaccctttcccctggtaaaaacggcgtggtgaaggacgttttcgccttcggcggggcagtggagaaccccgagtaccttacaccccaaggaggcgccgctccccaacctcacccaccacccgcattcagtcccgcatttgacaacttatactattgggatcaggatccccccgagagaggagcgcccccaagcacattcaaggggacgcctaccgccgagaatcccgagtatctagggctggacgtccccgtgtag

SEQ ID NO: 140427 - DNA, 3723 bp, Artificial Sequence
  Description of Artificial Sequence: Synthetic coding sequence
atgccaaggggcagctggaagcctcaagtctgcactggcactgacatgaaactgcggttgccagcctccccggagacccatctggatatgttgcgccatttataccagggctgccaggtggtgcagggaaacctagagttgacttacctccccactaacgcttccttaagcttcctgcaggacatacaagaggtgcagggatacgtgctcattgctcacaatcaggtcagacaggttccgctccaaaggttacggatcgttagaggaacccagcttttcgaggataactatgccttggccgttctggacaatggggatccattgaataataccactcctgtcaccggcgcttccccgggtggtctgcgtgaattgcagctgcggagtctgactgaaatacttaagggaggcgtgctgatccagagaaatccacagctctgctaccaagataccatcctgtggaaagacatcttccacaagaacaaccaactcgccctgaccctaatcgacaccaaccgctcccgagcttgtcatccctgctcccctatgtgcaaaggctccaggtgctggggagagtccagcgaagattgtcaaagcctgacgcgcactgtgtgcgcaggtggatgcgcacgctgcaagggaccactgccaacagactgctgccacgaacaatgcgccgccggctgcaccggacccaaacactctgactgtttggcctgcctacacttcaaccacagcggcatttgcgagttacattgcccagcattggtgacgtataacactgacacttttgaaagcatgcccaatcctgagggtcggtacactttcggggcatcctgtgtaacggcgtgtccttataactacctgtctacagacgttggttcctgcacacttgtctgtccactccacaaccaggaagtcaccgctgaggatggaactcagcgctgcgagaaatgcagcaagccctgcgcaagagtctgttatggcctcggcatggagcatttacgcgaagtgcgagcagtcacgtccgctaacattcaggagtttgctgggtgtaagaagatctttggctcgctagctttcctgcctgagtccttcgacggggatccagcgagcaatactgccccgctccagcccgagcaactgcaggtgttcgagacgctggaggaaatcaccggctatctgtatatctctgcatggcccgactctctgcccgacctgtcggtgttccagaatttgcaagtgattcgaggaagaatactgcataacggcgcctattcattgacgcttcagggtttgggcatctcgtggctcggcctcagaagtcttcgcgaattaggaagcggactcgcccttattcaccacaatactcatctctgcttcgtgcacaccgtgccttgggatcagttgtttaggaatcctcaccaggctctgttgcatacagctaataggccagaggatgagtgcgttggggagggtttagcctgtcatcagctctgcgcccgcggccactgttgggggcccggccccactcagtgtgtgaattgttctcaattccttaggggccaggagtgcgtggaggaatgtagggtcctccagggactacctcgggagtacgtgaatgcaaggcactgtcttccttgccaccctgagtgtcagccacagaacggctctgtcacatgctttggaccggaagctgatcagtgtgtggcctgcgcgcactataaggaccccccattctgtgtggcccggtgcccaagcggcgttaagccagatctgtcctatatgccaatttggaagtttcctgatgaggagggtgcttgccagccatgccctatcaattgtactcacagttgtgtggacctagatgataagggctgccccgccgaacagagagccagtccgctgacatcaatcatttccgcagtggtgggtattctgttggtggtggtactaggagttgtgtttggaattctgattaaacgtaggcagcagaaaataagaaagtacacaatgcgaagattgctgcaggaaacggaattggtggagccacttacaccttctggcgccatgcctaaccaggcccaaatgagaatcttaaaagaaactgaactgcggaaggtgaaagtgctgggctccggagcctttggcacagtatataaaggcatatggatcccagatggggaaaacgttaagattcccgttgcaataaaagtgttaagagaaaatacaagtcctaaagctaataaggaaatcctcgatgaggcctacgtgatggcaggcgtgggaagcccttatgtgtctcggctgttggggatctgtcttacttctactgtgcagctcgtgacccaactgatgccctatggatgtctgctggaccacgtgcgcgagaacagaggccgcctcggatctcaggatctgctcaactggtgtatgcagatcgcaaaggggatgtcgtacctggaggacgtccggctcgtgcatagggacctcgctgcaaggaatgttctggtgaagtctcccaatcacgtgaagatcaccgattttggcctggcgcgtctactggatattgatgaaaccgaatatcacgctgacggtgggaaggtgcctattaaatggatggccctggagagcattttgagaagacgttttacgcaccagtcagatgtgtggagctacggagtgacggtctgggaattgatgacttttggagctaagccttatgatgggatcccagcacgggagattcccgacctgctagaaaaaggagagcgtctgccccagccccctatctgtacgatagacgtgtacatgattatggtgaagtgttggatgatcgattctgagtgtaggccccgcttcagagaacttgtgagcgagtttagtagaatggccagggatccccagagattcgtggtcatccaaaacgaagaccttgggcctgcctccccacttgactccaccttttaccgttcactcctggaagatgatgacatgggtgacctcgtcgacgccgaagagtatcttgttcctcaacagggctttttctgccccgaccccgcccccggtgccggggggatggtgcaccacagacatagatcgtcttctacaagaagcggcggcggggaccttacactgggactggagccttcagaggaggaagcaccaaggtctccgctcgcaccttcagaaggagccgggagcgatgtattcgacggggatctagggatgggcgctgccaagggactccagagcctaccgacccacgatccatccccattgcagaggtacagtgaggaccccacagtgcccctgccctccgaaacagatgggtacgtggcccctctgacctgtagccctcaaccagagtacgtgaatcaacccgacgtgaggcctcaaccacctagccctcgggagggccctctgccagcagcgagaccggccggcgctactctggaaagacctaagacgctctctccgggaaaaaacggggtggtgaaggatgtgttcgcattcggaggggcggtggagaaccccgagtatttgacgcctcaaggcggagcggccccacagcctcatcctccacccgcattttcccctgcatttgacaatctgtattattgggaccaggatcctccggagaggggagccccgccttcaacgtttaagggcaccccaactgcagagaatcctgagtatctgggcctggatgtgcccgtctag

SEQ ID NO: 140428 - DNA, 2259 bp, Artificial Sequence
  Description of Artificial Sequence: Synthetic coding sequence
atgggcacatcggcgctatgggctttgtggctgctcttggccctatgttgggccccacgcgaatctggtgctactgggactggtaggaaggcgaaatgtgaaccctcacagtttcaatgcaccaacggacgttgtatcacactgctatggaaatgcgacggggacgaagattgcgttgatggatctgacgaacttgactgtgcgccacccacctgcggagcccacgagttccagtgcagtacatcaagttgtatccccatcagctgggtgtgtgacgatgacgcagattgttctgatcagagcgacgaatcactcgagcagtgcggccgtcagccagtaatccatacgaagtgtcccgcctccgagattcagtgtggaagcggtgagtgtatacataagaaatggcggtgcgacggcgaccccgactgcaaagatggtagcgatgaagtgaactgcccctccagaacttgtcggccagaccagttcgaatgcgaggacggatcttgtattcatggatcacgacaatgtaatggcattcgggattgcgtcgacggcagcgacgaggtgaactgcaaaaatgtgaaccagtgtctgggaccaggtaagtttaagtgcaggtcaggtgaatgtatcgacatttctaaagtctgcaatcaagaacaggattgccgtgactggagcgacgagcccctcaaggagtgtcatattaatgagtgcctggtcaataacggcggctgcagtcatatatgtaaagatttggtgatcggttatgagtgtgactgcgcagctggcttcgagttgatagacaggaaaacatgcggcgatattgatgaatgccagaaccccgggatttgttcccagatttgcatcaacctcaaggggggctacaagtgtgaatgtagtcggggttatcagatggatctggcgacaggagtatgtaaagctgttggtaaggagcctagcttgatctttaccaataggagagacatccgaaaaataggacttgagagaaaagagtacatccagctagtagaacagctgagaaataccgtcgcccttgatgccgacatcgcagcacagaaattattctgggccgacctttcccagaaagcgatttttagcgccagcattgacgacaaggttggccggcacgtcaaaatgatagacaatgtctacaaccctgctgccattgctgtggattgggtgtataaaaccatctactggaccgatgccgcatctaagacgatctcagttgccacactggacgggaccaaaaggaagttcttgttcaattctgacctgagggaacctgcttcaatcgcggtcgacccgttgtccggttttgtctactggagtgattggggagagcctgctaagatcgagaaggccggcatgaatggattcgaccggagaccactcgtgactgcagacattcagtggcccaatggcatcacgcttgatttaatcaaatcacgcctgtactggctcgactccaaattgcacatgctgtccagcgttgatcttaacgggcaagaccgccgcattgtgctgaagagtctggaatttctggcgcatcctttggccctgaccatcttcgaagatcgcgtgtattggatcgatggtgagaacgaggccgtgtacggtgcaaataagttcactgggagcgagctggccaccctcgtgaataatcttaacgacgcacaggacatcatcgtctatcatgaactcgtgcagccctcaggcaaaaactggtgtgaagaggacatggagaatggcggttgcgagtacctctgtttacccgctccccagattaatgaccacagccctaagtatacttgctcatgcccttcgggatataatgttgaggagaatggaagggattgtcagtctaccgcgacgaccgtcacttatagtgagactaaggatacgaacaccactgaaatcagcgctacatctggactggtccctggagggatcaatgtaacgaccgctgtgtccgaagtgtcagtcccgcctaagggaacatccgctgcgtgggccattctgcccctgttgcttctggtcatggcagcagtcggaggctacttgatgtggcgaaactggcagcataagaacatgaaaagcatgaatttcgacaatcccgtctacctgaaaaccaccgaagaagatctttccatcgacataggtagacattccgcatcagtgggccacacttatccagctatcagcgtggtgtccaccgatgacgatctggcctag

SEQ ID NO: 140429 - DNA, 522 bp, Artificial Sequence
  Description of Artificial Sequence: Synthetic coding sequence
atgggaacgtctgctttgtgggccctttggttgcttctggccttatgctgggctcctcgcgagagcggggccactggcaccggcagaaaagcaaaatgcgagccctcccagttccagtgtaccaacgggaggtgcatcactttactgtggaaatgcgacggggacgaggactgtgtagacggcagtgacgagaagaactgcgtaaagaagacttgcgcagagagcgacttcgtatgtaataatggtcagtgcgttccatctcgctggaagtgtgatggggatcctgattgtgaggacggaagcgacgagtcccctgaacagtgcagaaatatcacctgcagccccgacgaatttacttgctcttcaggacgctgtatttcgcggaacttcgtgtgcaacgggcaggacgattgcagtgacggctctgacgagttggattgcgcaccccccacctgtggtgcccacgaattccaatgctctacctcaagttgtatccccatttcctgggtctgtgacgactag

SEQ ID NO: 140430 - DNA, 2538 bp, Artificial Sequence
  Description of Artificial Sequence: Synthetic coding sequence
atgggaaccagcgccctttgggccctctggctgctcttagccctctgctgggcccctcgcgaaagcggagcgacaggtactgggcgcaaggccaagtgcgaacccagtcagttccagtgcacaaacggacggtgcattaccttgctgtggaaatgtgatggcgacgaagactgtgtggatgggtctgatgagaaaaactgtgtgaaaaagacatgcgcagaaagcgacttcgtctgcaacaatggacagtgtgtcccgtcgagatggaaatgtgacggggacccggattgtgaggacggcagcgacgagagcccagagcagtgccacatgagaacatgtcggattcacgaaattagctgtggggcacacagcacacaatgcatcccagtgagctggagatgcgatggagaaaatgattgtgactcaggcgaagacgaagaaaactgtgggaatattacctgttcaccagacgaatttacatgcagttccgggaggtgtatcagccgcaacttcgtgtgcaacggacaggatgactgcagcgatggatccgatgagctggactgcgcaccaccgacttgcggtgcgcacgagtttcagtgcagtacctcaagctgtattcctatctcgtgggtgtgcgacgacgacgccgactgcagcgatcagtccgacgagtcactcgaacagtgcgggagacagccagttattcacaccaagtgtcccgcgtctgagatccagtgcgggtccggggagtgcatccacaaaaaatggcgttgcgatggtgaccccgattgcaaagacggaagtgacgaggtcaactgcccgtccaggacctgtaggcccgaccagtttgaatgcgaggacggatcgtgcattcacggatcccgacagtgcaatggcatccgggactgtgtggacggatccgatgaggtgaactgtaaaaatgtgaaccaatgcctggggcctggcaagtttaaatgtagaagcggggaatgcattgatatttccaaagtgtgcaatcaggaacaagactgtcgcgattggagtgacgaaccccttaaggaatgtcatatcaatgaatgtctggtgaacaatggcggatgtagccacatctgtaaagacctggtgatcgggtatgagtgcgactgcgctgccggtttcgagcttatagaccgaaagacttgtggagatatagatgaatgccaaaaccctggcatttgttcccagatctgtatcaatttgaagggcggctataagtgcgaatgctcgaggggctaccagatggacctggccaccggagtatgcaaggcagtcggcaaggaaccctctctcatttttacgaaccgcagagacatccgaaaaatcgggctcgagagaaaggaatatatccagcttgtggagcagctgagaaacactgtcgctctggacgccgatattgccgcccagaaactgttctgggcagatctgtcccaaaaagctattttctccgcctctatcgatgataaagttggcaggcacgtgaagatgatagataacgtatacaatcctgctgcaattgccgtggactgggtttacaagacaatctactggaccgacgcagcaagtaagaccatatcagtggccacattggatggaacaaaacgcaaatttctattcaactccgatttacgtgagccagcatcaatcgcagtagatccattgagtgggttcgtctactggagtgattggggggaaccagcaaaaattgaaaaagccggcatgaacgggtttgataggagaccactggtgaccgccgatatccagtggcctaacgggatcactctcgacctcatcaagtcgcggctgtactggttggactctaaactgcacatgttgtcctcagtcgacctgaacggccaggatagacgcatcgtacttaaaagtcttgaatttcttgcccatccgttggcccttactatttttgaggaccgagtctattggattgacggagaaaacgaggccgtgtacggtgcgaacaaattcaccggaagcgagcttgccactttagtaaataacctcaacgacgcccaggacatcatcgtgtatcacgaacttgtccagccctctggtaagaattggtgtgaagaggacatggaaaatggcgggtgtgaatacttatgcctgcccgctcctcagatcaacgaccactcccccaagtacacgtgctcatgtccaagcgggtacaacgtagaggaaaacggaagggattgtcagcgaataaacgtgacgacggcagtgagtgaagtgtcggttccaccaaaggggaccagtgctgcctgggctattttacccttactcctcttggtcatggccgccgttggtgggtacctcatgtggcgaaactggcagcacaagaacatgaagtcaatgaatttcgataatcctgtctatctcaaaacaacagaggaagatctgtcgatcgatataggtagacatagtgcctcagtaggccacacttaccctgctatttccgttgttagtaccgacgacgacctggcctag

SEQ ID NO: 140431 - DNA, 2622 bp, Artificial Sequence
  Description of Artificial Sequence: Synthetic coding sequence
atggggaccagtgccttgtgggccttatggctgctccttgctctgtgttgggcaccacgcgagagcggcgcaaccgggacagggagaaaggccaagtgcgagccatcacaattccagtgcacaaacggccgttgtattactttgctatggaaatgcgacggcgacgaggattgtgtggacggctctgacgaaaagaattgtgtgaaaaaaacctgtgctgagtcagacttcgtgtgcaacaacggacagtgtgtccctagccgctggaagtgcgatggcgacccagattgcgaggacggctctgacgaatctcccgagcaatgccatatgaggacgtgccgaatccacgagatctcctgtggagctcacagtacccaatgtatccctgtgtcatggcgatgtgacggagagaatgactgcgatagcggcgaagatgaggagaattgcggaaatataacttgttcccccgacgagttcacgtgtagttctgggcgctgcatttcacggaactttgtgtgtaacggccaagacgactgtagcgatggctccgacgaactggattgcgcgccccccacttgtggagcacacgaattccagtgtagcacctcctcatgcatacctatctcatgggtgtgtgacgatgatgccgattgcagcgatcaatcagatgaaagtctcgaacagtgcgggcgccagcctgtgattcacactaagtgccctgcaagcgagattcagtgcgggtccggtgagtgcatccacaaaaaatggcggtgtgatggggaccctgactgcaaggacgggtccgacgaggtgaactgccctagtagaacatgtagaccggatcagtttgaatgtgaggatgggtcctgtattcacgggagtagacagtgtaatggcatccgggactgtgtggacggatctgatgaagtcaactgtaaaaacgttaatcagtgcctagggccgggcaagtttaagtgcaggagcggtgagtgcatcgatatttctaaggtgtgcaaccaggagcaagattgccgcgattggtccgatgagccacttaaagagtgccacatcaacgaatgcctcgtgaataatgggggatgcagtcatatttgcaaagacctggtgattggttacgaatgtgactgtgccgccgggttcgaattaattgatcggaagacatgcggagatatcgacgaatgccaaaatcccgggatatgcagccagatttgtattaatctcaagggggggtataagtgtgagtgctctagagggtatcagatggatctggccaccggcgtttgtaaggccgtcggtaaagagccatctctcatcttcacaaatcgacgggatattagaaaaatcggtctggagcgcaaagaatacatccagctggtggagcaacttcgtaatactgtggcccttgacgccgatatcgcagcccagaaactattctgggcggaccttagtcaaaaggccattttctcagcctcgatcgacgataaggtgggcagacacgttaaaatgatcgataatgtctacaaccccgccgcaatagctgtggactgggtctacaagacgatctactggaccgatgcggcttcaaagactatttctgttgccaccctggatggtaccaagcgcaagttcctgtttaattccgatctgcgggaaccagcctccatcgccgtggaccctctgagcggatttgtctattggtccgattggggagagccagccaagatcgagaaggcaggcatgaatggcttcgataggagacccctggtgaccgcagacattcagtggcctaacgggattactctcgatctgattaaatctcggctgtactggctggattcaaagctgcacatgttgagctccgtggatttgaacgggcaggatcggagaatcgtgctgaagtccctggaatttttggcccaccccctcgccctgacaattttcgaggatcgtgtgtactggatagatggcgaaaatgaagctgtgtatggtgccaacaagtttaccggcagcgaacttgccacactggttaacaatctaaatgacgcacaggacatcattgtgtaccatgaactggtccagccctctggcaagaactggtgcgaggaagatatggagaacggggggtgcgaatatctgtgcctccccgctccgcaaataaatgaccacagccctaagtatacttgcagctgcccctccgggtataacgtggaggaaaacgggagggattgccagagcactgcaactaccgtaacatattccgaaactaaagacaccaataccacagaaatatccgccacatcaggcctcgttcccggagggatcaacgtcaccacagcggtgtccgaagtcagcgtgcctcccaaaggaacaagtgctgcctgggctatcctgcctctgctgctcttggtcatggccgcagtgggagggtatctgatgtggcgcaactggcaacataaaaacatgaaatctatgaatttcgataaccccgtgtacctcaagacgaccgaggaagatctgtccatcgacatcggccggcactctgccagtgtgggccatacctaccctgccatttcggtcgtgagtacagatgatgatctggcatag

SEQ ID NO: 140432 - DNA, 729 bp, Artificial Sequence
  Description of Artificial Sequence: Synthetic coding sequence
atgtcagatgagagagaggttgcggaggctgcaacaggcgaagacgctagcagcccgccacccaaaaccgaggccgcctcagatccccaacatccggctgcttccgagggtgcagccgccgccgcagcatcgccacctctgttgcgatgtcttgttctcacgggctttggtggctacgacaaagtcaagctgcagagccgccccgctgccccgccagcaccaggcccagggcagctgaccttacggttacgcgcttgcggcctgaacttcgccgatctgatggctagacagggactctacgaccgcctgccaccactcccagtgacgccaggtatggaaggcgccggtgtcgtaattgcagtgggagaaggggtcagcgatcggaaggccggtgatcgggttatggtactgaaccgatcaggcatgtggcaggaggaggtgacagtcccgtctgtgcaaacattcctgattcccgaagccatgactttcgaagaagctgccgccctcctggttaattacatcactgcttacatggtattgtttgactttggaaatctgcagccaggccacagtgtgctggtgcatatggctgcaggcggggttggaatggccgcagtgcagctgccgtacagtggagagtgcgacagtgtgaggaatggattaggtcaacaggcacggggcaccgagggagagtggggtcacacctcccacaggttgtcacacgattag

SEQ ID NO: 140433 - DNA, 1182 bp, Artificial Sequence
  Description of Artificial Sequence: Synthetic coding sequence
atgtctgatgagagagaggtcgcagaagcagccaccggcgaggacgcctcaagccccccacctaaaaccgaggccgcgagcgacccacagcatcccgcggcctccgagggcgccgccgcagccgccgccagccccccactactccggtgcttggtgctgacggggttcggaggctatgataaagtcaagttacagtcgagaccggcggccccacccgctcctggacctggacaactgaccctccgtctacgtgcttgcggtcttaatttcgccgacctcatggcgcgccaaggtttgtatgacagactgccacctctgcctgtgacacccggcatggaaggagccggagttgtcatagctgtcggcgagggggtgtcggaccgaaaggccggcgatcgcgtgatggtacttaatcgatcaggtatgtggcaggaggaagtgaccgtgccatctgtacagacattcctgattccggaggcaatgacattcgaggaagcggcagcacttctcgttaattacattaccgcttacatggtgctctttgatttcggcaacttgcagcctggccacagtgtgctcgtgcacatggcagctgggggcgtgggcatggcagctgttcaattgtgtcggactgttgagaacgtaaccgtgtttggcacggcctccgcttctaaacacgaggccctcaaggaaaacggcgtgacgcatcccattgattatcatactaccgattacgtagacgagatcaagaagatctcacccaagggcgtggacatcgtgatggatccgcttggggggtccgatacagccaaggggtataatctgctgaaaccaatggggaaggtcgtgacctatgggatggccaacctgttaaccggccccaaacgcaacttgatggcccttgctaggacatggtggaaccagttcagcgtcacggccctccaactattacaagcaaacagagcagtgtgtggcttccatttggggtacctggacggtgaagtggaattagtttcaggcgttgttgcaaggctgctagccctttacaatcaaggacacatcaagccccatatcgatagcgtgtggcccttcgaaaaggttgctgatgctatgaaacagatgcaggagaaaaagaatgtcggaaaggttctactggtccccggaccagagaaggagaattag

SEQ ID NO: 140434 - DNA, 780 bp, Artificial Sequence
  Description of Artificial Sequence: Synthetic coding sequence
atggttctcaatagatccgggatgtggcaggaggaagtcacggtaccttctgttcagactttccttatccccgaagccatgacgttcgaggaggctgccgctttactcgtaaattatatcacagcctacatggtcctattcgattttggtaatctccagcccggtcactctgtccttgtgcacatggctgcgggcggagtggggatggccgccgtgcaactctgtcggacggtggagaatgtgacagtatttgggactgccagtgcctcgaaacatgaggccttgaaggagaatggcgtgactcatccgattgactatcacactaccgactatgtagacgaaattaaaaagatctcacccaagggagtggatatcgtgatggatcccctcggtgggtcagatacagcaaaaggatataacctattaaaaccgatgggcaaagtcgtcacttacggaatggcaaatctcctgaccggcccaaaaaggaatctgatggctctggcgcggacgtggtggaaccaattttctgtcacagccctccagttgctgcaggcgaatagagccgtgtgcggattccacctgggttatctagacggggaggtggagctggtctctggagtggtcgccaggctgttagctctgtataaccagggccacataaaacctcacatagattctgtgtggcccttcgagaaagtcgcggatgctatgaagcaaatgcaggagaagaaaaacgtggggaaagtcctcctggtcccaggtccggagaaggagaattag

SEQ ID NO: 140435 - DNA, 903 bp, Artificial Sequence
  Description of Artificial Sequence: Synthetic coding sequence
atggcccgacaggggctttacgatcggttaccaccgctcccggtgacacccgggatggaaggcgctggagtcgtaatcgcggtgggggagggggtctccgatagaaaagccggggacagagtgatggtcctgaatcggtccggcatgtggcaggaggaggtgactgtgcccagcgtccagacattccttatcccagaagccatgacattcgaagaagcggctgccctgttggtcaactatataacagcttatatggttctgttcgattttggtaatctacagcctggacactctgtgcttgtgcacatggcggctggcggcgtcgggatggccgcagtgcagctctgcaggaccgtggagaacgtgaccgtttttggtaccgcgtctgcatcaaagcacgaagccttgaaggaaaacggagtgacccaccctattgattatcacactactgattatgttgacgagataaaaaagatctctcctaagggcgtggatattgtgatggatccgctgggagggtctgataccgcaaaagggtacaatttactgaaacctatgggcaaggtcgttacatatggcatggctaacttgttgacaggtcccaaacggaatctgatggccttagctaggacttggtggaatcagttctcggttacggctctccagttgctccaggccaatagagccgtgtgcggctttcatcttggatacctggatggcgaggtcgagctcgtgtccggggtggtggccaggctgctcgcattgtataatcaggggcatatcaagccccacattgattccgtctggccattcgaaaaggtggcagatgccatgaagcagatgcaggaaaaaaagaatgttgggaaggttctcctggtgcctggacccgagaaggagaactag

SEQ ID NO: 140436 - DNA, 654 bp, Artificial Sequence
  Description of Artificial Sequence: Synthetic coding sequence
atgagctctgacttcgagggatacgaacaggatttcgcagtgctcaccgcagaaatcactagcaagatcgccagagtcccgcgactgcctcctgatgaaaagaaacagatggtggctaacgtcgaaaaacagctcgaggaggccaaggaactgctagagcagatggacctggaggtgcgcgaaatacctcctcagtccaggggtatgtattctaaccgtatgcggagctacaagcaggaaatggggaaactggagacagattttaaaagatcacgaattgcctattccgacgaggtcagaaatgagctgttgggggacgacgggaacagctcagagaaccagagagctcacctccttgataatacggaacgactggaacgcagtagcagacggctagaggccgggtatcagattgctgtcgagaccgaacagattggtcaggagatgctggaaaacttatcacacgaccgtgaaaagatccagagggcaagagagagactgcgagaaacagatgctaacctgggcaaatcgagtcgcatcttgactggcatgctgcgccgcataattcagaataggattctgttagtgattctcggtatcatcgttgtcattacaatcctgatggccataacctttagtgttagacgacattag

SEQ ID NO: 140437 - DNA, 612 bp, Artificial Sequence
  Description of Artificial Sequence: Synthetic coding sequence
atgagcagcgactttgagggttacgaacaggacttcgctgtgttgaccgccgagatcacctccaagattgccagagtgcctaggctgcctcccgatgaaaagaagcagatggtggctaacgttgaaaagcagctggaggaggctaaggaactgttggaacaaatggatctcgaagtccgcgagataccgccgcagagtcgcggaatgtattccaacaggatgaggtcttataagcaggaaatggggaagttagagacggacttcaagagatctagaattgcttattctgacgaagtccgtaatgaactgctgggcgacgacggtaacagctcagaaaatcagagggcccatttactggacaatactgagagactcgagcgctcatccagacggctcgaagcaggttatcagattgctgtggaaactgagcagataggccaggagatgctggagaatctgagccatgaccgcgaaaagatacaaagagcacgcgagcgcttgagagagactgacgcaaatctgggtaagagctcacggattcttacgggcatgttgagacgggggtgctccgtgaagaaacagtgcaatttgtccttggcacccaaagcttag

SEQ ID NO: 140438 - DNA, 432 bp, Artificial Sequence
  Description of Artificial Sequence: Synthetic coding sequence
atgtcggcccccgcacagcccccagctgagggaaccgagggcacagccccagggggcggccccccgggaccccctcccaatatgacatctaacaggcggttgcagcaaacccaggcgcaagtcgaggaagtggtggacattatacgcgttaatgtggacaaggtattagaaagagaccagaagctatctgagttggacgacagggctgacgcccttcaagccggcgccagccaattcgaaagttctgccgccaagctgaaaagaaagtactggtggaagaattgtaagatgatgatcatgttgggccggtggcaactgacccaatattgtttggtaatgtggagctttcccagctggaccaggcctgaggaagggccaggtgggggccccaagtccaacttagtgtctgtccagtacccatttcggaaatag

SEQ ID NO: 140439 - DNA, 354 bp, Artificial Sequence
  Description of Artificial Sequence: Synthetic coding sequence
atgagcgccccagctcaaccgccagcagagggcactgagggcactgcccctggaggcggaccccctggcccccctcctaacatgacctcaaacagaagactccagcagacccaggcacaggtcgaggaagttgttgacattatcagggtaaatgtggataaggttctggaacgagatcagaagctgagtgaactggacgatagggctgatgctttacaggcaggtgcctctcagtttgaatcaagcgcagccaagttgaagagaaaatattggtggaaaaattgtaaaatgatgattatgctgggagcgatttgtgccatcatcgtagtagtaatcgtgtctaaatacagatag

SEQ ID NO: 140440 - DNA, 357 bp, Artificial Sequence
  Description of Artificial Sequence: Synthetic coding sequence
atgagtgcaccagcccagccccctgcggaagggacagagggaaccgctcccggtggggggcctcccgggccaccccctaatatgacttctaatagacgcctccagcagactcaggcccaagtagaggaggttgtcgatattatcagggttaatgtcgacaaagttttagagcgtgatcagaaactgagcgagttggatgaccgtgccgatgccctgcaagccggcgcctcgcagtttgaatcaagcgctgcgaagctgaagcgcaaatactggtggaagaattgtaagatgatgatcatgctaggtgcaatttgtgcgatcattgtggtggtgatagtgatttatttttttacctag

SEQ ID NO: 140441 - DNA, 744 bp, Artificial Sequence
  Description of Artificial Sequence: Synthetic coding sequence
atgtccgctcccgcacagcctcccgcagaggggaccgaggggacggcccccggaggaggaccaccaggacccccccccaatatgaccagcaacagacggttgcagcagacacaggcccaagttgaggaagttgttgatattattagagtgaacgtagacaaagttcttgagcgggatcagaagctgtcagagctcgacgatagggcagatgcgcttcaggccggagccagccagtttgaaagtagtgccgccaagctaaagcggaaatactggtggaaaaactgcaagatgatgataatgcttggcgctatctgtgccataattgtggtcgtaatcgtaatttacttttacctccgtatgtaccacccctttcctgtggttcattgccacccccacagttgtcccttgccaagcgtgtgttctctcaacacgctcccacacccaccctccagtattcccgcccaagcaagcccaagccccatccccccattttccctccgcagcttcgccttgtgcccgtctaccttggaaatgctgttggtggctcagtctaaatccctccctgaagagcaacaacttgccccgccaccatgtctgctcttcctctattcacaggtgccgccaaaaccccagcgtgttggcggccaggggaagggccaaggcggggagtggctgcgaaggtctacacacgaggcagcgcagacgtgggaggaaaaatccattggcgcgcatggtgacttttag

SEQ ID NO: 140442 - DNA, 351 bp, Artificial Sequence
  Description of Artificial Sequence: Synthetic coding sequence
atgtccgcacccgcacaaccgcctgccgaaggcactgagggtactgcccccggcggtggacctcctgggcctcctcccaacatgaccagcaatcggaggctccagcagactcaggcacaggtcgaggaagtggtcgatattattcgcgtaaatgtcgacaaggttcttgagagggatcagaaactcagcgaactggacgacagggccgacgcacttcaggctggcgcctcacagttcgaatcgtccgcggcaaagttaaaacggaagtattggtggaaaaactgtaagatgatgattatgcttggtgctatttgcgccatcatcgtcgtggtgatcgtccgacgcgactag

SEQ ID NO: 140443 - DNA, 351 bp, Artificial Sequence
  Description of Artificial Sequence: Synthetic coding sequence
atgtcagccacagcagccaccgctccgcccgcagcccccgccggtgaaggaggcccaccagcccccccaccaaacttgaccagcaatcggaggctgcagcagactcaggctcaggtggacgaagtggttgatatcatgcgagtcaatgtggacaaggtgctggaacgagaccaaaagctgtcagagttggatgatcgcgctgatgctctgcaggccggggcttctcagttcgaaacgtcagcggctaagctgaagagaaagtactggtggaaaaaccttaagatgatgatcattctcggagtaatctgcgccattattttaataattattatcgtgtatttctcaacatag

SEQ ID NO: 140444 - DNA, 303 bp, Artificial Sequence
  Description of Artificial Sequence: Synthetic coding sequence
atgtctactgggcccactgccgccacagggtcgaatagaagattgcagcagactcaaaaccaggtggatgaagtagtcgacattatgcgggtgaacgtggacaaggttcttgagcgggatcagaaactgagcgagttggacgatagggccgatgctttgcaggcgggggcctcgcagttcgagacatccgccgcaaagctgaaacggaagtattggtggaagaattgcaagatgtgggctatagggatcacagtactagtcattttcattattattataatagtgtgggtcgtcagcagctag

SEQ ID NO: 140445 - DNA, 351 bp, Artificial Sequence
  Description of Artificial Sequence: Synthetic coding sequence
atggccggtatcgaactagagcggtgtcagcagcaggccaatgaggtaaccgagattatgaggaataactttggcaaagttctggagcggggcgtcaaactggccgaactgcagcaaagaagtgaccaactcctagacatgtcgtccaccttcaataagacgacacagaacctcgcacagaagaagtgttgggagaacatccgctacagaatctgcgtgggtctggtggtggtgggggtactgttgatcatcctcatcgttttattggtggtcttcctgccccagagttcagactcctcttctgctccccgaactcaagacgcaggcatagcatctgggcccggcaactag

SEQ ID NO: 140446 - DNA, 783 bp, Artificial Sequence
  Description of Artificial Sequence: Synthetic coding sequence
atggccattttatttgccgtcgtcgcccgggggacgactatcttagctaagcacgcgtggtgcggcgggaatttccttgaggtgaccgagcagattctcgccaagataccctccgagaacaataagttaacttattcgcacggcaactatctcttccattacatatgtcaggacaggattgtgtatctatgcataaccgatgatgactttgagaggtcccgcgcgttcaactttttaaatgaaataaaaaaacgctttcagactacttacgggagccgggcacagactgctttaccatacgctatgaacagcgagttttcatctgttttagcagcacaactgaagcatcatagcgagaacaaaggcctggataaggtgatggagacacaggcgcaggtagatgagctgaagggaattatggtgagaaacattgtgtgtcacctccagaactatcagcaaaagtcctgcagtagtcatgtgtatgaagaaccccaggcacattattatcaccatcatcgcatcaactgtgtccatctttatcattgcttcacatctctgtggtggatttatatggccaagctgtgtgaggaaattggtaagaaaaagctgcccttgacgaaagatatgcgagaacagggtgtcaagagcaacccgtgtgactcaagcctatcgcacaccgacagatggtatcttcccgtgagctccaccctgttctctttatttaagatcctttttcacgcatcaaggtttattttcgtgctcagcaccagcctctttctatag

SEQ ID NO: 140447 - DNA, 663 bp, Artificial Sequence
  Description of Artificial Sequence: Synthetic coding sequence
atggcaattctgtttgcagtggtggcccgcgggaccaccatcctggccaaacacgcatggtgcggcgggaattttcttgaggtgacagagcagattctcgccaaaattccatccgagaacaacaagctcacatatagccacgggaattacctgtttcactatatttgtcaggataggatcgtctacttgtgtatcacagatgatgacttcgaaagaagccgggcttttaattttttgaatgagattaagaaacgctttcagactacctatggctctagagctcagaccgcactgccatatgcgatgaacagcgaattttcttccgtcctggccgctcagctcaagcaccattctgaaaataaaggactcgacaaggtgatggagactcaggcccaggtggacgagctgaagggaatcatggtgaggaacattgatctcgtggctcagaggggggaacgcctggagctgttgattgacaagaccgagaatttggtcgatagttccgtgacttttaaaacaacctcacggaatctcgccagggcaatgtgtatgaagaacctcaagctaaccattattatcattatcgttagtattgtgtttatttacatcatcgtttctccgctttgcggggggtttacatggccaagttgtgttaagaagtag

SEQ ID NO: 140448 - DNA, 540 bp, Artificial Sequence
  Description of Artificial Sequence: Synthetic coding sequence
atggcaatcctgttcgccgtggttgccaggggcaccaccattctggccaagcatgcttggtgcggtggtaatttcttggaagactttgaacgaagccgggcttttaatttcctcaacgagatcaagaagaggttccagaccacttatggatcgcgagctcagactgctctgccttacgctatgaattccgaattctcgtctgtgcttgcagctcagctcaagcaccattccgagaataaggggctcgataaagtgatggaaacccaagcccaggtagatgaactgaagggcattatggtgcgcaatatcgacctggtcgcccagcggggcgagagacttgagctcctgattgataagacagagaatctggtggattcatctgtcactttcaagacaacatctcgcaacctggcgcgcgcgatgtgcatgaaaaatttgaagttaactattatcattataattgtctctatcgtatttatttacattattgttagcccactctgcggcggttttacctggccttcttgtgttaaaaagtag

SEQ ID NO: 140449 - DNA, 303 bp, Artificial Sequence
  Description of Artificial Sequence: Synthetic coding sequence
atggaggaagctagtgaggggggcgggaacgatagagtgaggaacctacagtctgaggtggagggcgtaaaaaacatcatgacgcagaatgttgaaagaattctagcccggggggaaaacttggagcacctgcgcaacaagactgaggacctcgaagccacttccgaacacttcaagacgacgtcccagaaggtggccaggaaattctggtggaaaaatgtgaaaatgatagtgctgatctgtgtcattgtgtttatcatcatactgtttatagtgcttttcgctaccggggccttttcctag

SEQ ID NO: 140450 - DNA, 777 bp, Artificial Sequence
  Description of Artificial Sequence: Synthetic coding sequence
atggaagagatgaagaagaccgctattaggctgccaaagggaaagcagaagcccattaaaaccgagtggaactcacgatgtgtcttattcacctattttcagggcgacatcagcagcgtcgtggatgagcacttttctcgcgccctgagtaacataaagtccccacaggaactgaccccatcctcccagtccgaaggcgtcatgttgaagaacgatgattctatgtcacctaatcagtggcgttattcatctccatggaccaaacctcagcccgaagtgcctgtgactaatcgggcggctaattgcaacctgcacgtgccggggcctatggccgtgaatcagttcagcccctccctggcccgacgcgcctcagtgcgccccggcgaactttggcactttagttccttggccggtaccagctcacttgagccaggctattcacatccgttccccgcaaggcacctcgttcccgaacctcagcccgatggcaagagagagcctctcctttctttgctgcagcaggatcggtgcttggctaggccacaggagagtgccgctagggagaacggtaaccccggccagatagccggatcaaccggtttactgtttaacctcccacctgggtcagtgcattacaagaagctctatgtgtcccgcggctctgccagtacctccctgccaaatgaaaccctgagtgagttggaaacccccggcaagtacagccttactccgccaaatcattggggccatccacacaggtatcttcagcatttgtag

SEQ ID NO: 140451 - DNA, 348 bp, Artificial Sequence
  Description of Artificial Sequence: Synthetic coding sequence
atgaagaagaccgctataagactgccaaaaggcaagcagaaacctatcaaaacagaatggaacagccggtgtgtgctgttcacctattttcagggcgatataagcagcgtcgtcgacgagcatttttcacgggcattaagtaatataaagtccccccaggaactcacgccttcctcacagtccgaaggagtgatgctgaagaatgataagaaactgtatgtctctcgaggaagcgcaagtacctctctacccaatgagaccctgagcgagctggagacaccaggaaaatactcactgacacctcccaaccattggggccatcctcatcgctatcttcagcacctctag

SEQ ID NO: 140452 - DNA, 492 bp, Artificial Sequence
  Description of Artificial Sequence: Synthetic coding sequence
tgaatcagcagtgtcgtggacgagcatttctctcgggcattgtccaatatcaaaagccctcaagaactgacgcccagttcccagagtgaaggtgtaatgctaaagaatgacgactccatgagccccaaccagtggcgatacagctctccatggactaagccccagcctgaagtgcctgtcactaatcgggcagctaactgtaaccttcacgtgcccgggcctatggcggtcaaccagttctctccctccttggcgcgccgtgcaagcgtacggcccggggagctttggcattttagcagcttagccggtactagcagcctcgaacccgggtactcacacccattccccgcccgccacctggtgcctgagccacagcctgacggcaaacacaaaaaattatacgtttctcgtggatctgcctccacatctctgccgaatgaaaccctgagtgaactggagactcctggcaagtactcactaactccgccgtag

SEQ ID NO: 140453 - DNA, 183 bp, Artificial Sequence
  Description of Artificial Sequence: Synthetic coding sequence
acaccgtcctcacagtccgagggcgtgatgctgaaaaatgacaaaaaactctatgtatcaaggggatcagcctctacttcccttcctaacgaaaccctcagcgagctggagacacctggaaaatactccctcacacctccaaatcattggggtcacccccatcgatacctgcagcatctgtag

SEQ ID NO: 140454 - DNA, 954 bp, Artificial Sequence
  Description of Artificial Sequence: Synthetic coding sequence
atgagctgcctggatgtgatgtaccaagtctatggtccgccacagccctattttgccgcagcctacacaccatatcaccaaaagctcgcgtactattcaaagatgcaggaggcccaggagtgcaatgcgtcccctagctcgagcgggtccggctcaagctccttctcatcgcagactcctgcctcgatcaaggaggaggagggttcacctgaaaaggagcggccacctgaagctgagtatatcaacagcaggtgcgttttgttcacctactttcagggtgacatatctagcgtagtagacgagcatttctcccgggcactctctcaaccttctagttattcgcctagttgcacctcgtctaaggccccccgaagctcaggaccatggcgagactgcagcttcccaatgtcccagcgtagtttcccagcctccttctggaactcagcctatcaggcccccgttccacctcccttgggaagcccactggctactgctcattctgaactgcctttcgcggcagccgacccctattcccccgcagccctgcatggccatttgcaccaaggcgctactgaaccctggcaccacgcacaccctcatcacgcccatcctcaccatccatacgctcttgggggggccctgggcgctcaagctgcaccttaccctcggcctgctgctgttcacgaggtgtacgcaccacacttcgacccccgatacgggcccttactcatgcctgcagcgtctggcagaccggcccgtctggcaacggcacctgcccccgcccctggctcccccccctgcgagttgagcgggaagggagagccagctggcgccgcctgggcaggtccagggggcccgttcgcttctccttcaggggatgtggcccaggggctaggtctgtccgtagacagcgcccgacggtacagcctctgcggggcttctctgttgtcctag

SEQ ID NO: 140455 - DNA, 432 bp, Artificial Sequence
  Description of Artificial Sequence: Synthetic coding sequence
atgagttgtttggacgttatgtaccaggtctacgggcctccacaaccttacttcgcggcagcctatacaccttatcaccagaaactggcatactatagcaaaatgcaggaggcacaggagtgtaatgcttcaccatcttcctctggttctggcagctcttcatttagttctcaaactccggcctctattaaagaggaagagggaagtcccgagaaagagcggccacccgaggctgagtatatcaactcaagatgcgtgctttttacctatttccagggagatatcagttctgtcgtggatgagcacttctctcgcgcgctgtcacaacctagtagctacagcccaagctgtacctcttctaaagcccctaggtcaagcgggccttggcgggcccggcggtattccctgtgtggagcgtcactgctgtcctag

SEQ ID NO: 140456 - DNA, 963 bp, Artificial Sequence
  Description of Artificial Sequence: Synthetic coding sequence
atgagttgtgccgaggtgatgtaccacccacagccttacggcgcgtcccagtacttgccaaaccccatggctgccacaacctgtccgactgcctactatcagcctgctcctcagcctggccaacagaagaagcttgctgtattcagtaagatgcaggatagtctggaggttacactcccatctaaacaagaggaggaggatgaggaggaagaggaggaggaaaaggatcagcccgccgaaatggaatatctcaactcccgctgcgttctgtttacatactttcagggcgacattggatctgtagtggacgagcatttttcgagggccctaggccaggcaataaccttgcatccagaatccgccatcagtaagagtaagatggggcttacacctctttggcgggattcttccgccttgagctctcagaggaatagctttcctaccagcttctggacaagctcctaccagccccctcctgctccttgcctaggcggcgtccatccggacttccaggtgaccgggccacctgggacattttctgctgcagatccgtccccctggccgggacataatctgcaccagactggcccagcgccacctccggctgtcagcgagtcctggccatatccactgacttcacaagtgtcacctagctattcccatatgcatgatgtgtatatgcggcatcatcatcctcacgcccatatgcaccataggcaccgtcaccatcaccatcaccaccaccccccagcaggatccgcacttgatccttcttatgggcctctgctcatgcctagcgtgcatgctgctcggatacccgctccgcagtgcgatattacaaagaccgaacccaccaccgtgacatcggcaacctcagcgtgggcgggagcctttcatggaaccgtggatattgtgcccagcgtgggcttcgataccggatggagcgctatggcccggtcctag

SEQ ID NO: 140457 - DNA, 981 bp, Artificial Sequence
  Description of Artificial Sequence: Synthetic coding sequence
atgtcctgtgccgaagtgatgtaccaccctcagccatacggggcatctcagtacctgccaaatcctatggccgcgaccacatgccctactgcatactatcaacctgccccgcagccagggcagcaaaaaaaactggcggtgttctcaaaaatgcaggatagtctggaggtgacgctgccgtctaagcaagaagaggaggacgaggaggaagaagaagaggagaaagatcagccagctgagatggagtacctgaacagcagatgtgtgctttttacctactttcagggcgatatcggctccgtggttgacgaacacttttcacgagccttgggacaggcaatcacactgcatccagagtccgctataagcaagtcaaagatgggcctaacacctttatggagggacagctcagctctttctagccagcgcaattctttcccaacctcattttggacaagcagctatcaacctccacctgctccctgtttggggggcgttcacccagattttcaggtcacaggcccccctggcacattctcagctgctgacccttcaccttggccgggacataacctgcaccagaccggaccagcccctccacctgcagtttcagagagttggccgtacccgttgacctcgcaggtaagtcccagttactcgcacatgcacgatgtctacatgcgccaccaccatccccacgctcacatgcatcaccggcaccgccaccatcatcaccatcatcacccccccgccgggtccgccctggacccttcatacggacccttgcttatgccttctgtccatgcggcccggatcccagcacctcagtgcgacattacgaaaaccgaaccaactactgtaacctccgccacatctgcttgggctggcgcatttcacgggacagtagacatcgtcccttccgttggcttcgacaccggattgcaacaccaagacaaatccaaagagtctccttggtactag

SEQ ID NO: 140458 - DNA, 1326 bp, Artificial Sequence
  Description of Artificial Sequence: Synthetic coding sequence
atgaaggcagccgtcgatctcaaaccgaccctgactatcatcaagacagaaaaggttgacctggagctctttccctctcccgatatggagtgcgccgatgtgccacttctcacaccgagtagtaaggagatgatgagccaggcactgaaagctaccttttccggctttaccaaagagcagcagaggctaggtataccaaaggaccctcgacagtggactgagacgcacgtgcgggactgggtgatgtgggccgtcaacgagttctcactgaagggcgttgattttcagaaattttgcatgaacggcgcggccctttgtgcccttggtaaggactgtttcctggaactcgcccccgacttcgttggcgacatcctctgggaacatctggagatcttgcagaaagaggacgtgaagccgtatcaagtgaatggtgtgaaccctgcctacccagaatctcgttacacatccgattatttcatcagttacggcatcgagcacgctcaatgtgtcccaccatccgagttctctgaaccttcttttattacagagtcatatcagaccctccatcctatctcctcggaagagctgctaagcctgaagtacgagaacgactacccatctgtcatactccgggatccattgcagaccgacacccttcagaatgactacttcgctatcaaacaggaagtcgtcacccccgacaacatgtgtatggggcgcacgagcagaggcaaacttggtgggcaggattcttttgagagtatcgaatcatatgattcatgtgatcgtctcactcaaagttggtcttctcagagtagctttaactctttgcaacgcgtgcctagttatgactccttcgactccgaagattaccctgctgccctgccgaaccataagcctaaggggactttcaaggactacgtaagggaccgggccgacctgaataaagacaaacctgtgatacccgcggctgccctcgccggatacacaggctcaggcccgatccagctctggcagttcttactagaattgttgacagacaagagctgccaatcgttcatctcatggaccggagatggctgggagttcaagctgagcgatccggacgaggtagcccgtcgctggggtaaaaggaaaaacaaacccaagatgaactatgagaaactctccaggggcttacggtactattacgacaaaaacatcattcacaaaacagcaggtaaacgctatgtgtatcggtttgtgtgcgatctccagtctctgctaggctataccccagaggaattacatgcgatgctggacgtgaagcctgacgcggacgaatag

SEQ ID NO: 140459 - DNA, 1065 bp, Artificial Sequence
  Description of Artificial Sequence: Synthetic coding sequence
atgaaagcagcggtcgacctgaagcctaccctcaccatcattaagaccgaaaaggtcgatctggaactctttccatcccccgacatggaatgtgccgacgttccattgcttactcccagcagcaaggaaatgatgtcccaggcactcaaagctacttttagtgggtttaccaaggaacagcagcgcctaggcatccccaaagatccaaggcagtggaccgagacccatgttagggactgggtcatgtgggccgtgaatgagttttcactgaagggggtggactttcaaaagttttgcatgaacggtgcagcactctgcgcccttgggaaggattgcttcctggaactcgctccagacttcgtcggagatattctctgggagcacctcgaaatccttcaaaaagaggacgtgaaaccgtaccaagtcaatggagtgaatcccgcataccccgagagccgatatacgtccgactactttatcagctatggaatagagcacgcacagtgtgtgccacctagcgaattcagtgaaccttcgtttataactgaatcttatcagacattacatccaatctctagcgaggagttgctgagcctaaaatatgaaaacgactatccgtccgtgattctacgggatcctttgcagactgacacccttcagaatgactacttcgccattaaacaggaagtggttacacccgataatatgtgcatgggtagaacctcccgggggagcggaccaatccagctttggcagttcctcttggagctgctcaccgataaatcctgtcagagcttcatctcttggacaggggacggctgggaattcaaactttcagatcccgatgaagtcgcgcggaggtggggaaaacgaaagaacaagcctaaaatgaattatgaaaagctcagtcggggattgcgctactattatgacaagaatattattcataaaactgcaggtaaaagatatgtatatcgcttcgtctgtgatctgcagagcctcttaggctacacacccgaagaactgcacgcaatgctggatgtgaagcctgatgctgatgaatag

SEQ ID NO: 140460 - DNA, 1458 bp, Artificial Sequence
  Description of Artificial Sequence: Synthetic coding sequence
atgtcctacttcgtggacagcgcaggatcttcaccagtcccctactccgccccaaggcctgccgtagtgcgccaggggccttccaatacttatgaggaccccaggatgaattgcgggttccagagtaattatcatcagcagagaccctgttatccattctgggacgaaatggctacacaggaagtaccgaccggactggaacattgtgtgagtgacatggaatgcgccgacgttcccttgctgaccccttcctccaaggaaatgatgtctcaggcccttaaggccaccttctcgggtttcaccaaggagcaacagagattgggcatacctaaagacccacggcaatggactgagactcacgtgcgtgattgggtgatgtgggcagtcaatgaattcagtctgaaaggagtggacttccagaagttctgcatgaatggggccgcactgtgcgcgctgggcaaggactgtttcctcgaattagcgccagatttcgttggggacattctatgggagcacctcgagattctgcagaaagaggacgttaaaccttatcaggttaacggcgtaaacccagcctaccctgagtcgcggtatacctctgattactttatctcttacggaatagagcatgcccagtgtgtcccaccatcggaattttcagagccgtcattcattacagagagctatcagacccttcatcccatttcctcagaggagctgctatccttgaaatacgagaacgactacccgagcgtgattctccgcgatccactccagacagataccttgcagaacgattactttgctatcaagcaagaggtggtcaccccagacaacatgtgcatgggaaggacatctagaggaaagttaggtggccaagattctttcgagtcaatagagagttacgactcttgtgatcggttgacccagtcctggtctagccaaagttcctttaacagcctgcagagagtgccaagctatgacagttttgactccgaggactacccagccgccctccccaaccacaaacccaaaggcacatttaaggattatgtaagagacagggccgatttgaacaaggataagcctgtcattccagctgcagcattagccggctatacgggatccgggcctatccaattgtggcagttcctgttagagcttctcacagacaaatcctgccagtcctttatcagctggaccggtgatggatgggaattcaagctcagcgaccccgatgaggtggcacgacgttggggaaagaggaagaataagcccaaaatgaactacgaaaagctgtctaggggcctgcgctattattatgacaagaacatcatccataagactgctggcaaaagatatgtttataggttcgtgtgcgacctgcagtctctcctcggctacacccccgaagagctgcatgccatgctggacgtcaagcccgacgccgacgagtag

SEQ ID NO: 140461 - DNA, 1065 bp, Artificial Sequence
  Description of Artificial Sequence: Synthetic coding sequence
atgaaggcagctgtggatctaaagcccactctcaccataatcaagacagagaaagtggatcttgaattgttccctagccccgatatggaatgcgcggatgtgccactccttacaccttcaagtaaggagatgatgagtcaagcattgaaagctactttttctgggtttaccaaggaacagcagcgtcttggcatacctaaagatcccagacagtggactgagacccatgtgagagactgggtaatgtgggcagtgaatgagttctctttgaaaggggtcgatttccaaaagttttgcatgaacggcgccgctctgtgcgccttaggaaaggactgttttttggaactggctcctgacttcgtgggcgacattctgtgggaacatctggagattcttcagaaagaggacgtgaagccataccaggttaacggagttaatccggcctatccagagagccgatatacaagcgactacttcattagctatggcattgaacatgcccaatgtgtcccaccatctgagttctctgagccaagctttataaccgagtcataccaaaccctacacccgatctcgagcgaagaactgcttagtctcaagtacgagaatgattacccaagcgtgatacttcgggatcccctgcagacggacactctccaaaacgactattttgctattaagcaggaggtcgtgactcccgacaacatgtgcatggggagaacaagcagaggttcgggtccaatccagttgtggcagttcctgctcgaactattgacagacaagtcctgccagtccttcatatcctggactggagacggctgggagtttaaactctcggatccggacgaagttgcccgacgatggggaaagcggaagaataaacccaagatgaactatgaaaagttgtcacggggcttgagatactattacgataagaatatcatccataagactgccgggaaaagatatgtgtaccggtttgtttgtgacttgcagagtctcttgggttatacacccgaagaactccatgccatgttggacgttaagcccgacgccgatgagtag

SEQ ID NO: 140462 - DNA, 819 bp, Artificial Sequence
  Description of Artificial Sequence: Synthetic coding sequence
atgaaggccgccgtggacctcaagcctacattgaccatcattaagactgaaaaggtcgatctggagctctttccttccccagacatggagtgtgccgacgtgccgctcctcaccccatcctccaaagagatgatgagtcaggcgctcaaggcgacgttttccggctttaccaaagaacagcagcgtttgggcatccccaaagacccccgccagtggaccgagactcacgtgcgggattgggtcatgtgggcagtcaacgagttctctcttaaaggagtcgactttcagaagttctgtatgaacggtgctgcattgtgtgcgctgggtaaggattgttttcttgaacttgccccagatttcgtaggtgacatactgtgggagcacctggaaatactccagaaagaggacgtaaagccctaccaagtaaatggggttaatcctgcctatccagagagtcgctacacatctgactattttattagctatggcatcgaacatgctcagtgtgttccccccagtgagttctccgaaccctcatttatcaccgaatcttatcaaaccctccacccgatttcctctgaggaattactctccctgaaatatgaaaacgattaccctagtgtcattctgcgcgaccccttacaaacagacaccctgcagaatgactactttgcaattaaacaagaggttgtaacgcctgacaatatgtgcatggggcgaactagtcgcggcaagttgggaggtcaggacagtttcgaatccatcgaatcatatgattcctgcggccaggagatggggaaagaagagaaacaaacatag

SEQ ID NO: 140463 - DNA, 678 bp, Artificial Sequence
  Description of Artificial Sequence: Synthetic coding sequence
atgaaagccgcagtggatctcaagcctacactgaccattatcaagacggagaaggtcgacttggaactctttccctccccggggaagctggggggacaggacagtttcgagtccattgagagctatgactcttgtgaccgcttaacacagagttggtcatcacagtcttcttttaactctttacaaagagttccctcctacgattcattcgacagcgaggactacccggcggccttgcctaatcataagccaaagggtacattcaaggactacgtgagggacagggcagacttgaacaaagacaagccagtcatccctgctgccgctctggccggctatactggcagcggaccaattcagctttggcagtttttattagagttgttgacagacaagtcatgccagagtttcattagttggaccggtgacggctgggagttcaaactgtctgaccctgacgaggttgctaggaggtggggaaaacgcaaaaacaaacccaagatgaattatgagaagctctcccgcggcctgaggtattactacgacaaaaatataattcacaaaaccgcaggaaagaggtatgtctaccgattcgtgtgtgacctgcaatctctccttgggtacaccccagaagaacttcatgctatgctggatgtgaaaccagatgccgacgagtag

SEQ ID NO: 140464 - DNA, 1848 bp, Artificial Sequence
  Description of Artificial Sequence: Synthetic coding sequence
atgaaggctctccgcctcagtgcctcagcgctgttctgtcttttgctaattaacggactgggcgcagcaccaccggggcgaccagaagcccagccacctccactatcttccgaacacaaggaaccagttgctggcgatgcggttcctgggccaaaggatggcagcgccccagaagtacgaggagcacggaattccgaaccacaggacgagggcgagttgttccagggtgtggatcccagagctctcgcagctgtgcttctgcaggctcttgacaggccagcaagtcctcctgcaccaagcggaagccagcaaggtcccgaggaggaggctgccgaagcgctattaacagagaccgtgcggtcacagacccacagtttgccagcgccagagagtcctgaacctgctgccccccctaggccacagactcctgaaaatggaccagaagcatccgacccatctgaagaattagaggcccttgcttccttgctgcaggagctcagagatttttctcccagctccgcaaaaaggcaacaggaaacagctgccgcagagacagaaactagaactcacacattgacacgggtgaatttggaaagcccaggtccagagagagtgtggcgagcgagttggggtgaatttcaggcccgcgtacccgagagagctcccttacccccccccgcccccagccagttccaggcacgcatgcccgactctggcccactgccagagacccacaagttcggggaaggcgtcagctcgcctaaaacacatttgggggaggccttagcccctctgtctaaagcttaccagggcgtggccgccccttttccaaaggcacgcaggccagagtccgccctactgggcggatccgaagcaggagagcggttgctccaacaaggattggcccaggtggaggctggccggcgccaagcagaggcaacccgacaggccgcggcccaggaagagcgactcgcagacttagcatccgacctcctgctccagtatttactccaggggggcgcccgccagcggggcctgggcgggcgggggctgcaggaggctgctgaagagcgcgaaagcgcccgtgaagaagaggaggccgagcaggagaggagagggggagaggagcgggtgggagaggaagacgaggaagccgccgaagccgaggctgaagccgaagaagcagagcgcgctcggcagaacgcgttgctgtttgccgaggaggaagatggcgaggcaggtgctgaagacaagcgctcgcaggaggagacaccgggtcatcgccggaaggaagctgaggggacagaggaaggcggagaagaagaggacgatgaagagatggacccccagacgatagacagtttgatagaactaagtactaaactccatttgccggccgacgacgtagtgtccatcattgaagaggtggaggagaagcgcaaaaggaagaaaaatgctcccccagaacccgtgccgccgcctcgggcggcacccgccccaacacatgtgaggagcccgcagcctccacccccagcgcctgccccagcacgtgacgaactccccgattggaatgaggtcctgcctccatgggatcgcgaggaagacgaggtctatccccccggtccataccaccccttcccaaactatatacgacctcggaccctgcagccccccagcgcgcttagacggcgtcactaccatcacgcgctgccgccgagcagacactacccaggacgcgaagcgcaggccaggagggctcaggaagaggccgaagccgaagagaggaggctgcaggaacaggaggaactcgagaattatattgagcacgtgctgcttagaaggccatag

SEQ ID NO: 140465 - DNA, 1848 bp, Artificial Sequence
  Description of Artificial Sequence: Synthetic coding sequence
atgaaggccctgcgattgagcgctagcgcattgttttgcttgctgctgattaacggcctcggagccgctccacctggccggccagaagcccagcccccccccctgtcgagtgaacacaaagagccagtagcaggagatgctgtgcccggcccaaaagacggcagtgcacccgaagtgcggggggcaagaaatagcgaaccacaggatgaaggcgagctgtttcaaggtgttgatccgagggcactcgctgctgtcctgctgcaggcactcgaccgtccggcaagccctcccgcaccttccgggtcccagcagggcccagaagaagaggcggccgaggcactgctgacagaaacagtgcggagccagacccacagcctcccagctcctgaaagccccgagccagccgcaccccctcggccgcaaacccccgaaaacggccctgaggcgtccgacccgtctgaagagctagaagctctggccagcctactccaggagctaagagatttctcgccatctagcgctaaaagacagcaggagacagccgccgcggaaactgagacgcgcacccatacactcacccgggttaatctggaatcccccggccccgagcgcgtctggcgagccagctggggtgaatttcaggcccgggtgcctgagagggcccctctgccccctcccgccccctctcagttccaggcaagaatgcccgacagcggccccctgccggagacccacaaattcggcgagggagtgtccagtccaaagactcacctcggggaagccttggccccgttaagtaaagcataccagggcgtcgccgcccccttcccaaaagccagacgaccagagagcgccttacttgggggaagcgaagctggtgagcgactgttgcagcaaggcttggcccaggtcgaggccggaagacggcaagctgaggccactcgccaagccgccgcccaggaggaacggctcgcggatttagctagcgacctgctcctccagtacctgctgcagggtggcgcacgccagcgcggcctcggagggcgaggcctgcaagaagcagccgaagaacgtgaatctgcaagggaggaggaggaggcagagcaggagagaagggggggagaagaaagggtcggagaggaagatgaagaggctgccgaggctgaggctgaagctgaggaagccgagagggctagacagaacgcgctacttttcgccgaagaggaggacggtgaggccggtgccgaagacaagaggagtcaagaagagacgccagggcacagaaggaaggaggctgaagggaccgaggagggtggggaagaagaggatgacgaggaaatggaccctcagaccatcgattccttgattgagctgagcacaaaattgcatctgcctgccgatgacgtggtgtcaataattgaggaagttgaagagaaacggaagaggaagaagaacgcaccacccgaaccggtccctccccctagggccgcaccagccccaacacacgtgagatccccacaacccccccctccagcaccagctccggcgcgagacgagctccccgactggaatgaagtgttgcctccatgggaccgggaagaggacgaggtgtatccacccggaccttatcaccccttccccaattatattcgtccacgtaccctgcagccccctagtgcccttcggcggaggcactaccaccatgctctacctccatcacgacattatcctggccgcgaggcacaggccagacgcgcacaggaggaagcagaggctgaagagcgacggttgcaggagcaggaggagctggaaaactacatagaacatgtcctactgaggaggccctag

SEQ ID NO: 140466 - DNA, 1134 bp, Artificial Sequence
  Description of Artificial Sequence: Synthetic coding sequence
atgaaagcccttagattgtccgcgtcggccctgttctgcctgctactaatcaatggcctgggggctgcaccccccggtcggcctgaggctcaacccccccctttatcatccgaacacaaggagcctgttgccggggacgctgtgcctgggcccaaagatgggtctgcacctgaagtgagaggcgctaggaattcagagccacaagacgagggggaattatttcagggcgttgaccctcgtgcgcttgccgcggtcctgctgcaggcactggataggccagcatcgccacccgctccttctggctcccagcagggaccagaagaagaggctgccgaagctctgctgactgagactgtgaggtcgcagacccattccctcccagcgccagagtcccctgaaccagcagctcccccccggccacagacccccgagaacggccctgaagccagcgatcctagtgaggagttggaggcactggctagtctcctgcaggagctgcgcgacttctccccttcgtctgcaaaaagacagcaggaaacagcagccgccgaaacggaaacaagaacccacactctaacaagggtcaacctagaatcaccaggaccggagagagtctggcgggcctcttggggagaattccaagcccgcgtccccgaaagagctcccctcccccctcccgccccctcccagtttcaggcacggatgcccgactccggccctttgccagaaactcataaattcggagagggggtgtcctccccaaaaacccatctgggagaagctctcgcacccctgtccaaggcataccagggagttgctgctccattccccaaagccagaagacccgagtctgcccttctcggaggatcagaagctggggagaggttactgcaacagggcctcgcccaggttgaggccggccgcaggcaggccgaagctaccagacaggctgccgcacaagaggagagacttgcggatctcgcctccgacttgttgctgcagtttgctgccgggcgcggcccagctgcgcggccgtgtcctctggccctccccctttccccaggttgtgtcggaacctgtcaaaccccactgcccggccctgagcccgagcttcctgagctgactaggggatag

SEQ ID NO: 140467 - DNA, 2484 bp, Artificial Sequence
  Description of Artificial Sequence: Synthetic coding sequence
atgacaaaattgtctgcacaggtgaaaggctctctgaacatcaccaccccgggcctgcagatctggcgaatcgaagctatgcagatggtgccagtgccaagcagcactttcgggagtttcttcgacggcgattgttacatcatcttggcgatccacaagacagcttcatctctgtcatacgatatccattattggatcgggcaggacagtagcctagatgaacagggcgctgctgctatttatacgactcagatggacgactttctgaaagggcgggccgtgcagcatcgggaagtgcaaggaaacgaatccgaagcctttcgtggatactttaagcaggggctggtgattaggaaaggtggcgttgcatccgggatgaagcacgttgagacgaatagctacgacgtccaaaggttgctgcatgtgaagggaaaaaggaacgtcgtggccggcgaagtggagatgtcttggaaatcatttaatcgaggcgacgtcttcctccttgacttaggcaagttgattatccagtggaacgggcctgaaagcacaagaatggaacgcctgcgtggaatgaccctggcgaaggagattagagaccaggagagggggggccgtacctatgtaggagtggtcgacggagagaacgagctggcatcacccaagctaatggaggtcatgaaccatgtcctcggaaagcggagagaactgaaagctgcggtgccagataccgtggtagaaccagctctaaaagccgccctgaaactgtatcatgttagtgacagtgaaggaaatttagtggtccgggaggtggccaccagaccccttacacaggatctcctgagccacgaagattgctatattcttgaccagggaggccttaagatctacgtttggaaggggaagaaagcgaacgagcaggagaagaaaggggccatgtcccatgctctgaactttatcaaagccaagcagtatccaccatcaacccaagttgaggtccagaacgacggggctgagtctgccgtgttccagcagctatttcagaaatggaccgcaagtaatcgaacctccggcctcggaaagacgcatacagttggatctgtagctaaggttgaacaagtaaaattcgacgcaaccagtatgcatgtgaagccacaagtggctgctcaacaaaagatggtagatgacggctcaggggaagtgcaggtgtggagaatcgagaatctggaattggtgccagtggacagcaaatggttagggcacttttacgggggggactgttatctcctactctatacgtacttaattggggagaagcagcactatctcctatacgtgtggcagggttctcaggcatcacaagacgagattaccgcctccgcctaccaggcagtgattctggatcagaagtacaatggcgaaccagtccagattcgtgtcccaatgggtaaagagcctcctcacctaatgagtatctttaaaggcagaatggtcgtttatcagggaggaacatcgcggaccaacaatctggagaccggccctagtacaagactcttccaggtccaaggcacaggagctaacaacactaaagcatttgaggtgcctgcccgcgcaaatttccttaactctaacgatgtatttgtcttaaaaactcagagctgctgttatctgtggtgtggtaagggttgctccggggatgaaagggaaatggcaaaaatggtggccgacacaatcagcagaaccgagaagcaggtggtggtggaaggccaagaaccggctaatttttggatggccctcggaggtaaggccccctacgcgaacacgaaaaggctccaagaggagaacctggtcatcacacctcgcctcttcgaatgttcaaacaagacgggcagattcctagcaaccgagattcccgactttaatcaggatgatctggaagaggacgatgtttttctcctggacgtctgggaccaggtgttcttctggatcggcaagcatgccaacgaggaagagaagaaggcagctgccaccaccgcccaagagtacctgaagacacatcctagtgggagagatccagaaacaccaatcatcgttgttaaacaggggcatgagccgcccaccttcaccgggtggttcctcgcatgggatcccttcaaatggagcaacacaaaaagctatgaggacctgaaggctgagctgggtaattcccgggactggtcgcagatcacagccgaggtgactagcccgaaggtagacgtgttcaacgccaatagtaatctgtcttctggtcctttgcctatctttcccctggagcagctggtaaacaagccagttgaagagttacctgagggcgtggatccgtcccgtaaggaggagcacctgagtatagaagattttacccaggcatttggaatgactccggctgcattttccgcgctgccccgctggaagcaacagaatttgaaaaaggagaaagggcttttctag

SEQ ID NO: 140468 - DNA, 1551 bp, Artificial Sequence
  Description of Artificial Sequence: Synthetic coding sequence
atgtcccacgccttgaatttcattaaagcaaagcagtaccccccctcgacccaggtagaggtgcagaacgatggtgccgagtccgcagtttttcagcaactgtttcaaaaatggacagccagcaaccgaacgagcgggctgggcaagacacacacagttgggtctgttgcaaaggtcgaacaggtgaagtttgatgctacgtccatgcacgtgaagccccaggtggccgcgcagcagaagatggtggacgacgggagtggggaggttcaggtttggaggatcgagaatttggaactcgtgccagtcgacagcaagtggttgggccatttttacggaggcgactgttatttactattgtatacatacctcattggggagaagcagcattacctgctgtatgtttggcagggtagtcaggcttcgcaggatgaaatcacggcctcagcctatcaagccgttatcctagaccagaagtacaatggtgaacccgtgcagatcagggttcccatggggaaggagccccctcatctgatgtccatcttcaaggggcggatggtggtgtaccaagggggaaccagccgcacaaataacctcgagaccgggcctagtactagactgtttcaggtccagggaacgggcgccaataataccaaggcatttgaagtgcctgccagggccaattttctaaactccaatgacgtgttcgtgctcaagacccagtcctgctgttatctctggtgtggcaaggggtgctccggcgacgaaagagagatggctaagatggtggccgacactatatctagaacagagaaacaggtcgttgttgagggtcaggagccagctaatttctggatggccctggggggtaaggccccctacgctaatacaaagcgattgcaggaggagaacctagttataactccccggttattcgagtgcagtaataagacgggccggttcctagctaccgagatcccagatttcaatcaggatgatctcgaagaagacgacgtctttctgcttgacgtgtgggaccaggtgttcttctggatcggcaagcacgcaaacgaagaggagaagaaggctgcagccactacagcacaggaatacctgaaaacacatccttccggacgggacccagagacacctataatcgtggtgaaacaaggacacgaacctcctacctttaccggctggtttcttgcctgggatcctttcaaatggtccaataccaaaagctatgaggatctgaaagctgagctcggcaactctcgcgattggtcacagattactgccgaggtaacctcccctaaggtggacgtgtttaacgcgaatagcaacctctcttctggccccctgccaatattccccttggaacagctggtcaacaagcctgtggaggaacttcctgagggcgtcgatccatcccgaaaagaggagcacctgagcatagaggatttcacccaggcgtttggaatgacaccggccgctttcagtgcccttccgagatggaaacagcagaatctaaaaaaagagaagggtttattctag

SEQ ID NO: 140469 - DNA, 1266 bp, Artificial Sequence
  Description of Artificial Sequence: Synthetic coding sequence
atgacaaaactgtccgctcaggtcaagggatccctcaacattacgactcccggactgcagatctggaggatcgaggccatgcagatggtgcccgtgcctagttctacttttggttctttcttcgacggcgactgctacattatattagctatccacaagactgccagttctctgagctatgacattcactactggattgggcaggactcctcactcgacgagcaaggcgcggccgctatatacaccactcagatggatgacttcctgaaagggcgggcagtgcagcaccgcgaagtgcaggggaacgagagtgaggcctttcgggggtactttaagcaggggctcgttattcgcaagggtggtgtcgctagcggcatgaaacatgttgagaccaacagctatgatgtgcagagattgctgcacgtaaaaggaaagcgtaatgttgtcgccggcgaggtggaaatgtcatggaagagcttcaacaggggggacgtgtttctattggacctggggaaattaatcatacaatggaacggcccagagagtacaaggatggaacgcctgagaggaatgaccctggcaaaggagatccgggatcaggagaggggtggccgcacttacgtgggggtcgtagatggcgagaacgagttggcttcaccgaaactcatggaagtcatgaaccacgttctgggcaagcgccgcgagctaaaggcagcggtgcctgacacggtagtggagcccgccctgaaggccgctctgaaactctaccacgtgtccgactcagaggggaacttagtagtcagagaagtggcaacaagacccttgacgcaggacctcctgtctcacgaggattgttacatcctggatcagggcggactcaagatctacgtttggaaaggtaaaaaggctaacgaacaggagaaaaagggcgccatgtcccacgccctcaatttcattaaagcaaagcagtatcctcctagtacacaggtggaagtgcaaaacgatggtgccgagtcagctgtgtttcaacaattgtttcaaaaatggactgcctccaatcggacttcaggactgggcaagacacacacagtaggcagtgttggggagggccaggccggagccgtacgggagccggggagccgatcatgggcaaggagggctacttggagtactacccaccccccatctctgacttgtatctttaatgaggacttttatgccggatccggtcttgtgttagctgatggagatgtggataagctgtag

SEQ ID NO: 140470 - DNA, 576 bp, Artificial Sequence
  Description of Artificial Sequence: Synthetic coding sequence
atgggaaagcagaattccaaactggcccctgaagtgatggaagatcttgtgaagtctacagagttcaacgagcacgagcttaaacagtggtacaaaggcttcctgaaggattgccccagtgggcgcctgaacctcgaggagttccaacaactgtatgtgaagttcttcccatatggggacgcctcgaagtttgcccagcacgcatttcggactttcgataagaacggcgacggtacgattgacttcagagagttcatttgcgctctttcgataacatctcggggctctttcgagcagaagctcaactgggcattcaacatgtatgacttggatggtgacggaaagataacacgtgttgagatgttggagattatcgaggcgatttataaaatggtcggcacggttatcatgatgaaaatgaatgaggatggcctaaccccagaacagagagtggataagatcttctccaagatggataagaataaggacgatcagatcaccctcgacgaattcaaggaggcagccaagagcgatccgagcatcgtcctgctgctgcaatgcgacattcagaaatag

SEQ ID NO: 140471 - DNA, 576 bp, Artificial Sequence
  Description of Artificial Sequence: Synthetic coding sequence
atgggaaagcagaatagcaagctggcccccgaagtgatggaggatctggtaaagtctacagaattcaacgagcacgagctgaagcagtggtataagggtttcctgaaagattgcccaagcggaaggctgaatttggaagaattccagcagctgtacgtcaaattcttcccttacggcgacgcctccaagtttgcacagcatgcgttccggacttttgataagaacggcgacggcacaattgactttagggagttcatatgtgccctcagcataacctcaaggggctctttcgagcagaaattgaactgggccttcaatatgtatgaccttgatggggatggcaagatcacccgcgtcgaaatgctcgaaattatcgaggcaatatataagatggtgggcaccgtaatcatgatgaaaatgaatgaggatgggctgactcccgaacagagagtcgataaaattttttccaaaatggataagaataaagacgaccagattactctcgacgaatttaaagaagccgccaagtcagaccccagcatcgtgctgttgcttcaatgcgacatccagaagtag

SEQ ID NO: 140472 - DNA, 576 bp, Artificial Sequence
  Description of Artificial Sequence: Synthetic coding sequence
atggggaaacaaaactctaagctggcgcctgaagtaatggaagacctggttaagtccactgagttcaatgaacatgaacttaaacagtggtataaaggattcctcaaagactgtccctcaggcaggctgaatttggaagagttccagcagctctacgtcaagttttttccatatggggacgccagcaaattcgcccagcacgctttcaggacgtttgacaagaatggcgatggaactattgacttccgggagttcatctgcgcactcagtattacgtcccgtggtagctttgaacagaaactaaattgggcctttaacatgtatgacttggacggggacggcaagatcacccgcgtggaaatgttagagataattgaagcaatttacaaaatggtgggtacagtgattatgatgaaaatgaatgaggatgggttaactcccgagcagagagtcgataagattttctctaaaatggataaaaataaggatgatcaaatcacactggatgagttcaaggaagccgcgaagtccgaccccagcatcgtgctgctgctccaatgcgatatccagaaatag

SEQ ID NO: 140473 - DNA, 315 bp, Artificial Sequence
  Description of Artificial Sequence: Synthetic coding sequence
atgggaaagcagaattcaaagctggctcctgaggtgatggaggaccttgttaagagcacagaattcaacgagcacgagctcaagcagtggtacaaagggttcctcaaggactgcccctcaggaagactgaacttggaggaattccagcagctctacgtgaaatttttcccttatggcgacgcttctaagttcgcccagcacgcttttcgcacattcgataaaaacggtgacggcacaattgactttagggagttcatctgtgccttatccatcacctcccgtggaagttttgagcaaaagttgaattgggcttag

SEQ ID NO: 140474 - DNA, 357 bp, Artificial Sequence
  Description of Artificial Sequence: Synthetic coding sequence
atgggaaagcaaaattctaaactagctccagaggtcatggaggacttagtaaagtcaactgaattcaacgaacatgagttgaagcagtggtataaaggatttctgaaagattgtccgtccgggcggctaaacctcgaagagtttcagcaattgtacgttaagtttttcccatacggagatgcaagcaagttcgcgcagcacgctttccgtacttttgacaagaacggcgacgggacaatagatttccgggagttcatctgcgctctgagcataaccagcagaggttctttcgaacagaagcttaattgggccttcaacatgtatgatctcgacggcgatggcaagattactagatag

SEQ ID NO: 140475 - DNA, 720 bp, Artificial Sequence
  Description of Artificial Sequence: Synthetic coding sequence
atgaccggccgggatagcctctctgacggccgaacatcatctagagccctggtcccaggcggatccccacgcggttcacggccaaggggatttgcaataacagacctcctggggctggaggccgagctccctgcacccgctggtcccgggcaggggtctggttgtgagggtcccgcagtggctccatgccccggccccgggttagacggatccagtctcgctcggggcgccttgccactgggccttggcttgctctgtgggtttggaacgcagcccccggcagcggccagggctccctgcctcctgctcgctgacgtgcctttcttaccacctaggggacctgaaccggccgcccctcttgccccctcgagaccccccccagccttaggccggcagaagaggagtgatagcgtgtccacatccgatgaggattcccagtctgaggacagaaacgatttaaaagcttccccaactctagggaagcgcaaaaaacggagacaccgcaccgtatttacagctcaccagttagaggaacttgaaaaggccttcagtgaggcccactaccccgatgtgtatgcccgcgaaatgctggctgtaaagacggagctaccagaagacaggattcaggtgagtggagtaccatttctgcgcagtaaggataccacagaaaatgtatcttttcctcactcagtgagtcagagcgccgttccttccctgtag

SEQ ID NO: 140476 - DNA, 1098 bp, Artificial Sequence
  Description of Artificial Sequence: Synthetic coding sequence
atgacaggccgcgactctttgtcagacggcagaaccagttcccgcgccctcgttccaggcggatctcctagaggtagcagacccaggggttttgccatcaccgacctcttgggattggaggccgaattacctgcccccgcgggcccaggtcagggttctggctgcgagggacccgctgtagctccttgccctggcccaggactcgatggttctagcttggcccgaggcgccctgccccttggcctgggtctactctgtggatttgggacacagccccctgccgccgcccgagccccttgcttattactggccgacgttccattccttccacccaggggaccagagccagcagcaccattggcaccatctcgaccaccacccgccctcggaagacagaaacgctccgacagtgtatcgacctctgacgaagattcacagtctgaggatcggaacgacctcaaggccagcccgactttgggtaagaggaagaagcggaggcatcgcactgtgtttaccgcgcaccaactagaagagcttgagaaggctttcagtgaagcacactatccagatgtgtacgctagagagatgctggcagtaaagacagagttgccagaggaccgaattcaggtctggttccagaacaggagggccaaatggagaaagcgcgaaaagcggtggggaggatcgagcgtcatggccgagtatggtctttacggcgcgatggtacgccattgtatacccctgcccgattccgttctcaattcagcagaaggaggcctccttgggtcgtgcgctccctggctcttgggaatgcacaaaaaaagtatgggtatgatcaggaagcctggcagtgaggacaaactggccggactgtggggctcagatcatttcaaggaaggctcttcccagtccgaaagcggctctcagcgagggagcgacaaagtctccccagagaatggactcgaagatgtggctatagacctctcaagtagcgcccggcaggagacaaagaaagtccaccctggggcgggagcacaaggagggagcaactctacagctctcgaagggccacagccaggaaaagtgggagctacttag

SEQ ID NO: 140477 - DNA, 432 bp, Artificial Sequence
  Description of Artificial Sequence: Synthetic coding sequence
atgacaggacgggactctctgtcagacggccgcacctcaagccgcgctctggtgcctggcggatcacccaggggaagtcggcccaggggattcgcgatcactgaccttttggggctcgaggctgagctgcctgcccccgccggtccaggtcaggggtcaggctgcgagggtccagcggtagcgccctgcccaggccccggcttagacggatcctccctcgctcgcggagcactcccactgggccttgggctcctctgcggatttgggacccaaccaccagcggcggcaagggcgccatgcttactattagccgacgtgccattcctgccaccacggggaccagagcccgctgcccctctggcgccctcaagaccaccgccagccctgggcaggcagaagcggagtgatagcgtctcaacatctgcgatgtag

SEQ ID NO: 140478 - DNA, 843 bp, Artificial Sequence
  Description of Artificial Sequence: Synthetic coding sequence
atgactggccgagacagtctgtccgatggacggacatcatctcgggccttggttcctggaggctcacccagaggcagcagaccaagaggtttcgcaatcaccgatctgctggggctggaagccgagcttcctgcacctgccgggccgggacagggctcagggtgtgaaggacccgcggtcgctccctgtcctgggccaggcctggatggatcctctttggctagaggggcactgccattgggacttggcctcctgtgtggattcggaacacagccaccagctgctgcccgcgccccttgcctgctcctggccgatgtgccctttttgccacctcgcggaccagagcctgctgcaccccttgcacctagccggccacctccagccctcggacgccaaaagagatcggattctgtgtccacatctgatgaagatagccagtctgaagatcgcaacgacctcaaggccagtcctaccctggggaaacggaagaagagacgacatcgcactgtctttactgctcaccagctagaggaacttgaaaaggcttttagcgaggcgcactacccagacgtttacgctagagaaatgctcgcagtcaagactgaactgcccgaggatcgcatccaggtatggttccagaatcggagggccaagtggcgtaaaagagagaaacgctggggagggtcatccgtgatggctgaatatggcctctatggggccatggttaggcactgcatcccccttcccgatagtgtgctcaactccgctgaagggggtctgcttggatcgtgcgctccttggctgttagagggtgagaccctggggtgccgggagatgaagtag

SEQ ID NO: 140479 - DNA, 657 bp, Artificial Sequence
  Description of Artificial Sequence: Synthetic coding sequence
atgacaggcagagattccctttccgacggacggacgagcagcagggcccttgtccctggaggttccccaagggggtcccggccgagggggtttgccatcactgacctcctcggccttgaggccgagcttcccgcgccagcagggccaggtcagggaagtggttgtgaaggcccggctgtggccccttgcccaggacctggattggatggaagctcccttgctcggggggcgctgcccctcggcctgggcctgttgtgcggattcggcacccagccccccgcagcagcccgagctccctgcctgcttctcgccgatgtcccgttcctgccaccaagaggacctgaacccgcggcacctctggccccttcacgtccaccaccagcgctgggcaggcagaagaggagcgatagcgtatccacctctgacgaggatagccaatccgaggaccgcaatgacctgaaggctagcccaaccctcggcaaacgcaagaagagacgacatcgcaccgtcttcacggcacaccagctggaagagctggagaaggctttctcagaggctcactaccccgacgtgtatgcccgcgaaatgctcgccgtaaaaacggaattgccagaagataggatacagcgggtccgtcactgggcggccgagaaatag

SEQ ID NO: 140480 - DNA, 906 bp, Artificial Sequence
  Description of Artificial Sequence: Synthetic coding sequence
atgactggccgcgactctctctcagatgggcgaactagcagccgcgcattagtgcccggcggatctcctcggggatctaggccccgcggttttgccattaccgatcttctgggattagaggcagaactgcccgcccctgccggtcctgggcaggggtccggatgtgaagggcccgcagtggccccatgccccggccctggactcgatggatccagtcttgcaaggggcgctcttccccttgggctaggcttgttgtgtggattcggcacacagccacccgctgccgctcgagccccatgcctcctcctcgcagatgtgccttttctgcctccgcggggccctgagcccgccgcacctctggcaccgtcgaggcccccacctgccctgggcaggcagaagagatctgactcagtaagcacatctgacgaggatagtcagtcagaggatcgcaacgatcttaaagcgtctcccacacttggcaaaaggaagaagaggaggcacagaacggtgttcacagcgcatcagcttgaagagctcgagaaggccttttccgaggcccattaccccgacgtgtacgccagagaaatgttggctgttaagaccgagctacccgaagatcggattcaggtgtggtttcagaaccggagggcgaaatggagaaagagggaaaagcgctggggaggctcatctgtgatggcagagtatggactttatggggctatggtgaggcactgtattcctttgcccgattccgtgcttaattccgccgagggtggactgctcgggtcctgtgctccctggctgttggtccagacatccgcccctggcggctctcgcagcctagacttcgcaggggatacgcaggctccgcagaccccctggtggtgtctcatgacattctcttag

SEQ ID NO: 140481 - DNA, 711 bp, Artificial Sequence
  Description of Artificial Sequence: Synthetic coding sequence
atgacggggagggattcactttctgatggtcgaacttccagcagggccttggttccagggggatctcctaggggatcacgccctcgaggcttcgccataacagatttgttgggcttagaagcagagttgcccgcaccagccggccctggacaaggcagcggctgtgaagggccagccgtggccccctgtccaggtcctggtctagatgggtctagccttgcaaggggcgccctgcctctcggcttaggcctgctctgtggatttggcacgcagcccccggccgcggcccgcgccccatgcctcttactggctgacgtccctttcctaccccccagggggcccgagccggccgcccctcttgctccgagtcgtcctccacccgccttagggcggcagaaaagatctgactctgtgagcacctctgatgaggattcccagtctgaagatcgcaacgacctgaaagcctcccctaccctgggcaagagaaagaagcgcagacatcgcaccgtgtttactgcacatcaactagaggaacttgagaaagcattttctgaggcccactaccccgacgtgtacgctcgcgaaatgctggctgtgaaaactgagctacctgaagataggatccagtgtaaactgcttctgctggaagcccctgtgcactggacactccaggagacgcacaggctgccccggcctcgggggggcgcatag

SEQ ID NO: 140482 - DNA, 1110 bp, Artificial Sequence
  Description of Artificial Sequence: Synthetic coding sequence
atgagggcatgtatcagcctcgtattggcagtgctctgtgggctcgcatgggccgaagatcacaaggagagcgaaccacttcctcagctggaggaggaaaccgaggaagcactggcgagcaacctgtattctgcccccacttcatgtcaagggcggtgctacgaggctttcgataagcaccatcagtgtcattgtaacgcacgatgtcaggagtttgggaattgctgtaaggactttgagagcttatgtagcgatcacgaagtgagccattcttcggacgctataaccaaagaagaaatccagtccatcagtgaaaagatttaccgggccgatactaataaagcccaaaaggaagacatagtcctgaactcacagaactgtatctctcccagcgagaccagaaatcaggttgaccgctgtccaaagccactcttcacatacgtcaatgaaaaactattttccaaacctacctacgctgcgttcattaatctcctcaacaactaccaacgggcgactggacatggcgaacacttctccgcacaggaattggccgaacaggatgctttccttagagaaataatgaaaacggcagtcatgaaagagctttactctttcttgcaccaccagaataggtacggttctgaacaggaatttgttgacgacctgaagaacatgtggtttggactgtactccaggggtaacgaggagggcgattcttccgggtttgaacacgtgttcagcggcgaggtaaaaaagggcaaggtgaccgggtttcacaattggattcgtttttaccttgaggaaaaggaaggtcttgtcgactactattcccacatctacgacgggccctgggatagttacccagacgttctggctatgcagttcaactgggacggttactataaagaggtaggatctgcattcattgggagctccccagaattcgaatttgctctatacagcttatgttttatagcccgaccagggaaggtttgtcagctgagcttgggggggtatccactagctgtccgtacctacacctgggacaaatctacatatgggaacggaaaaaagtacattgctaccgcgtatattgtgtcatctacctag

SEQ ID NO: 140483 - DNA, 1284 bp, Artificial Sequence
  Description of Artificial Sequence: Synthetic coding sequence
atggaggccatggccgcctcaacctccctccccgaccccggggactttgatagaaacgtgccacggatctgtggggtatgtggagatagggcaaccggctttcactttaacgccatgacttgtgaagggtgtaaaggtttcttccgaagaagtatgaaacgaaaggcactgtttacctgtccctttaatggcgactgcagaattactaaggacaaccgccgccactgtcaggcttgtcggttaaaacgctgtgttgatattggtatgatgaaggaattcatactgacagacgaagaagtacagcgtaaacgtgagatgattctgaaacgcaaggaagaggaagcattgaaagactctctgagaccgaaactcagcgaggaacagcagagaattatagccatcctcctcgatgcccatcacaaaacctacgatcccacttactccgatttctgtcaattcagacctccggtcagagtgaatgatggaggcggctcccaccctagcagacccaactcaagacacacaccctcctttagcggagactctagcagcagctgctctgaccactgcattaccagctctgatatgatggactcttccagcttctctaacctggatctttcagaagaagattctgatgatcctagtgttaccttagagttgtcgcagcttagcatgctcccacacctggcagaccttgtgagctacagcatccagaaggttatcggctttgcgaagatgatccctggattcagggatctgacctcagaagaccagatagtgttactgaagtcatccgcaattgaagtaatcatgctgcgcagtaacgaatcattcacgatggacgatatgagctggacctgcgggaaccaggactacaagtatcgcgtcagtgatgttacaaaggcagggcacagcctcgagctcatcgagcctttgattaagtttcaagtggggttaaagaaattgaatctccacgaggaagagcatgtcctgctcatggctatctgtatcgtatcgcctgacaggcctggagtgcaggacgcggcactaattgaagcaatccaggatcggctgagcaacacattgcagacatacatccggtgtaggcaccccccccccggaagccacctactatatgctaagatgatacagaagctggccgacttgcgaagcctcaatgaagagcatagcaagcaatataggtgcttgagcttccagcccgagtgtagcatgaagctgactccgttggtcttggaagtatttggcaacgagataagttag

SEQ ID NO: 140484 - DNA, 1188 bp, Artificial Sequence
  Description of Artificial Sequence: Synthetic coding sequence
atgtcaatggagcatgctgctctaaccgctacgggagcaggcggttcttggcgtagcatgaagaggaaggccttatttacctgcccattcaacggggactgccgcatcactaaagataatcggcggcactgccaggcctgccgcctaaaaagatgcgttgatataggcatgatgaaggaattcattctcactgatgaggaggtgcagaggaagagagagatgatcctgaaaagaaaggaggaggaagccttgaaggactccctgcggccaaagctctccgaagagcagcagcgcattatcgcgattctgttagacgctcatcacaagacttatgatccaacatactcagatttctgtcagtttcggccacctgtcagagtcaatgatggaggcggaagtcaccctagtaggccaaacagtcgccacactccaagtttctccggtgattccagtagcagttgctcggaccactgcataactagcagtgacatgatggactcttcaagcttttcaaacctcgatctgtccgaggaggattccgatgatccctcagtcactctggaattgtcgcagctcagtatgctgccgcatctggccgaccttgtttcctactccatccagaaggtgatcgggtttgccaagatgatcccgggctttagagatctgacctcagaagatcaaatagtgctcctgaagagcagcgctatcgaggtgattatgttacgcagtaacgagtcttttaccatggacgacatgtcgtggacttgtggaaaccaggactataagtatagggtgtcagatgttacaaaagcaggccattctctagagctgatcgaacccttgatcaagttccaggtgggacttaaaaagcttaacctccacgaggaggagcatgttcttcttatggcgatttgcatcgtgagtcccgatagacccggcgtccaggatgctgccctgattgaagccatccaggatcggctatctaacacactgcaaacctatatcagatgtcgccatcccccgcctggttcccatttactctacgcgaagatgatacaaaaactggcagaccttcgtagtctgaatgaagaacactccaaacagtaccgatgcttgtcatttcaacctgagtgcagtatgaaactgactccactggttcttgaagtcttcggcaacgagatctcatag

SEQ ID NO: 140485 - DNA, 753 bp, Artificial Sequence
  Description of Artificial Sequence: Synthetic coding sequence
atggaagcaatggcggcttccaccagtctgccagaccccggagacttcgataggaacgttccgaggatctgtggggtctgtggcgacagagctacggggttccacttcaatgctatgacatgtgaagggtgcaaaggattcttccggcgcagcatgaaacggaaagctttgtttacctgccccttcaatggggactgtcggattacaaaggataaccgtcgccattgccaggcatgccgtctgaagcgatgtgtcgatatagggatgatgaaagagtttatactcactgacgaagaggttcagcgcaaaagggagatgatactaaagaggaaagaggaagaagcattgaaagactcccttcgcccaaaactgagcgaggagcaacaacggataatcgccattttgctggatgctcaccataaaacctatgatccgacttattcagacttttgccagtttagaccaccagtcagggtgaacgatggcggcggatcgcacccttcgcgtcctaattcccggcacactccaagtttctccggtgactccagtagcagctgctcagatcactgcatcacatcctcagatatgatggacagttcaagtttttcaaatctagatctgtccgaagaagattcagacgacccctctgtgactttggagctcagccaactctcaatgcttccacacctagccgatctggtttcctacagcatccaaaaggtaataggattcgccaagatgatccctgggtag

SEQ ID NO: 140486 - DNA, 306 bp, Artificial Sequence
  Description of Artificial Sequence: Synthetic coding sequence
atggaagccatggccgcaagcacctccctccctgaccccggagactttgaccggaatgtccctaggatctgcggagtttgcggcgatcgggctaccggcttccatttcaacgcaatgacgtgtgaaggctgtaagggctttttcagaaggtccatgaagagaaaggcgttattcacatgtccattcaatggcgactgcaggatcaccaaggacaatcgccgacactgtcaagcctgtagattgaagaggtgtgtggatattggcatgatgaaagaatttatcttaactgacgaggaggtacaatag

SEQ ID NO: 140487 - DNA, 1284 bp, Artificial Sequence
  Description of Artificial Sequence: Synthetic coding sequence
atggaggccatggccgcctccaccagcctgccagaccccggcgacttcgaccgtaacgtcccgaggatttgcggtgtttgcggcgaccgggcaacgggatttcacttcaatgccatgacctgcgagggatgtaaaggctttttccgaaggagcatgaaaagaaaagccctgttcacttgcccgtttaacggggattgtaggatcacaaaagataatcgtaggcattgtcaggcatgccgccttaaacggtgcgtcgacatagggatgatgaaggaatttatactgaccgatgaagaggtgcagagaaagagggagatgatcctgaagcgcaaagaggaggaggccttaaaagactccctgaggcctaagctgagtgaagaacagcagagaattatcgccatccttctggatgcccaccacaagacctatgacccaacttattccgatttttgccagttccgcccgcctgttagggtgaatgatggaggcgggagtcacccatcacgacccaatagccgacatactcctagcttttctggggattcctccagctcttgctcagaccattgtattacgtcctcagatatgatggattcctcctctttcagcaatctggatttgtctgaggaagattccgacgatccatcagtaacccttgagctctcccagctcagcatgctgcctcacctcgccgacctcgtgagttattcaatccagaaagtgatcggctttgccaaaatgatccccggttttagggatctgacgtctgaggatcagattgttctgcttaagtcttctgctattgaagtcatcatgttgcgcagtaatgaatctttcaccatggatgatatgagctggacatgcggtaaccaggattacaaataccgagtgtccgatgttaccaaagctggacacagccttgagctcatcgagccgctgattaagtttcaggttggactcaagaaactcaatttacacgaggaagagcacgtgctgctgatggcgatatgcatcgtgtctcctgataggcctggcgtgcaggacgccgctctcattgaagccatacaggacagactgtctaacacactacagacatacattcgctgccgacatccacctcctggatctcatctgctgtacgcgaagatgatccagaaactggcagacctgaggtcgctgaatgaggagcatagcaagcaatatcggtgtctgtcattccagcctgaatgctccatgaaacttactcctttggttcttgaggtgtttggtaatgagatcagttag

SEQ ID NO: 140488 - DNA, 321 bp, Artificial Sequence
  Description of Artificial Sequence: Synthetic coding sequence
atggaagcaatggccgcatccactagtctccctgaccccggcgactttgatcggaatgttcctagaatctgtggtgtgtgtggagacagagccacaggtttccatttcaatgcaatgacgtgcgaaggatgcaaggggttctttcgacgctctatgaaaagaaaggcgctgttcacttgcccttttaatggcgactgcagaattaccaaggataatcgtcgccattgtcaggcttgccggctgaagcgttgcgttgacatcgggatgatgaaggagttcattctgacagatgaagaggttcaacgtaagcgtgagatgtag

SEQ ID NO: 140489 - DNA, 1434 bp, Artificial Sequence
  Description of Artificial Sequence: Synthetic coding sequence
atggaatggaggaacaagaagcgtagcgattggctaagcatggtgctaagaacggcaggcgtggaggaggccttcgggagcgaagtgtccgttaggccacatcgtagagccccattggggagtacatacctccctcctgccccgagcgggatggaggcaatggccgccagcacatctctccccgaccccggggactttgaccggaacgtgcctcgcatttgcggggtgtgcggcgacagagcaaccgggttccacttcaatgccatgacctgcgaggggtgcaaaggtttcttccggagatccatgaaacgaaaggcgttgttcacctgccccttcaacggagactgtaggataacgaaagacaacagacgccattgccaggcatgccggctcaagcgctgtgtggacattggaatgatgaaggagtttatcctgactgacgaggaggtccagcggaagcgggagatgattctgaaacggaaagaggaggaagcacttaaagatagcttacgccccaagctgagtgaagagcagcagaggatcatcgccatcctgttggacgctcaccacaagacctatgaccccacatattcagatttctgccaattcaggcctcctgtccgggtcaacgatggcgggggatcccatccctcccgccctaatagccggcacactccttcattctcaggcgacagcagcagttcctgctcagaccactgtattacctcctctgatatgatggactcgtcatccttctcaaacttggatcttagtgaagaagattccgatgatccatcagttactttagagttgtcccagttgtctatgctaccgcacttggccgacctggtgtcctactccattcaaaaagtgattggcttcgccaagatgattcccggcttccgggacctgacgagcgaggatcagatcgtactgctaaagtcatcagctattgaagtgatcatgctgaggagcaacgaaagtttcacaatggatgacatgtcttggacatgtggaaatcaggattacaaatatcgcgtgtcagacgtaaccaaagctgggcattctctagaactgatcgagcccctgatcaagttccaagtgggattgaaaaagctgaacctgcacgaggaagaacatgtactgttgatggccatttgtatcgtcagtcccgatcggcctggagtgcaggatgctgccctgattgaagcaattcaggaccggctgtcaaataccctgcaaacctacattcgctgtcgacaccctccacccggaagtcacctgctctacgcgaagatgatccagaagctggccgatctccggtccctgaatgaagagcatagcaaacagtaccgatgtctgagcttccagcctgagtgtagcatgaagctgacacctttggttctggaggtatttggcaatgaaatcagctag

SEQ ID NO: 140490 - DNA, 279 bp, Artificial Sequence
  Description of Artificial Sequence: Synthetic coding sequence
atgggtagcacgtgggggagccctggctgggttcgactggcactgtgcctcactggcttggttctctcactctatgcactccacgtgaaggcggcccgcgcacgagatcgcgattaccgcgccctgtgtgacgtagggacagccattagttgctcccgcgtcttttcgagcagattgcccgccgacacgctaggactttgccccgacgccgccgagctgcccggggtttcgagatggttctgtctgcctggactggatcctgtcctccgggctctgtag

SEQ ID NO: 140491 - DNA, 492 bp, Artificial Sequence
  Description of Artificial Sequence: Synthetic coding sequence
atgggctctacctggggcagtccaggttgggttcgactggccttatgcctgaccggactggtactgagtttgtacgctctccacgtcaaggcagccagagccagagacagagactaccgggccttgtgcgacgtaggaactgcaattagctgttcacgggtattcagttccagatggggacgtggtttcggcttagtcgagcatgtgctcgggcaggattctatcctcaaccagagtaactctattttcgggtgtatcttctacaccctgcaattgctgctggggtgtcttcggacgcggtgggcaagtgtactcatgctcctgtcctctctcgttagcctagcaggctccgtatatctcgcatggattttgttctttgtcctttacgacttctgcatcgtttgtatcaccacctacgccatcaatgtgagcctaatgtggttatccttccgaaaagttcaggagccacagggcaaggctaaaaggcactag

SEQ ID NO: 140492 - DNA, 5823 bp, Artificial Sequence
  Description of Artificial Sequence: Synthetic coding sequence
atgagtagcgacactgaaatggaggtgttcggcatagccgccccattcctcagaaagtcggagaaagaacgtatcgaagcccaaaatcagcccttcgacgctaaaacttattgtttcgtagtggattcgaaggaggagtacgcgaaaggaaagatcaagtctagccaagacggcaaggtaactgttgaaacggaagacaacaggactctggttgtgaagcccgaagatgtttacgccatgaatcccccaaagtttgaccgaattgaggacatggcaatgcttacccacctgaatgagccagccgtgctttataacctgaaagaccgctatactagctggatgatctacacgtactccggacttttctgtgtgacagttaatccctataagtggctgcctgtctacaatccggaggttgtcgaagggtatagaggaaagaaacggcaggaggcccctccccatattttcagtatttcggataacgcctaccagtttatgctgacggaccgtgagaaccagtccattctgattaccggcgagagtggggcggggaaaaccgtaaacaccaagcgagtcatacagtactttgccaccattgccgctaccggtgaccttgcaaaaaagaaggatagcaaaatgaagggaaccctcgaggatcagattatctccgctaaccctctgctcgaggcgttcggcaatgccaaaacagtgcgcaatgacaactcctcccggtttgggaagtttatccgcatccacttcggtaccacaggaaagcttgcatctgccgacattgaaacctatcttcttgagaaatcgagagtgacctttcagctgaaggcagaacgatcctatcacatattctaccagattttgtctaataagaaacctgaacttatcgagctgctcctgatcaccaccaatccttacgattatccattcatttctcaaggcgaaatcctggtcgcgtcaattgatgacgccgaggaactactggcgactgatagtgccattgacatcctggggttcactcccgaagagaaatccgggctctataaattaactggagctgtcatgcactacggaaatatgaagtttaagcagaagcagagggaggagcaggcggaacctgacggcaccgaggtggcagacaaaacggcttacttaatgggattgaattcttccgatctgctgaaggcattatgttttccacgcgtcaaggttggtaacgagtatgtcactaagggccagacagtagatcaggtgcatcatgctgtgaacgccctgtcaaaatccgtctacgaaaagctctttttgtggatggtgacccgcattaatcaacagctggatacaaagctccctcggcagcattttatcggggtgctggacattgccgggttcgaaatttttgagtacaattctctcgaacaattatgcatcaatttcactaatgaaaaacttcaacaattttttaaccaccacatgttcgtactcgaacaggaagagtataaaaaagaggggatcgagtggacttttattgactttggcatggacttggccgcttgtattgaacttattgaaaaaccaatgggaatattctcgattttggaggaggagtgcatgtttccaaaggccacagatacttcctttaaaaacaagctctatgatcagcatttgggaaaatcaaacaacttccagaaaccaaaggtcgtgaaagggcgggcagaagctcacttttcactaattcactatgctgggactgtcgattactccgtatcggggtggctggaaaagaacaaggatccgctgaatgaaacagttgtcggattgtatcaaaaaagttcaaaccgcttgctggcccacctttatgcaacatttgcaactgcagacgcagattccggcaagaaaaaggtggccaagaaaaagggctcctcgtttcaaactgttagcgccctatttcgggagaatctcaacaagctgatgagcaatctgaggaccacccatcctcactttgtgcgatgcattattccaaatgagaccaaaaccccgggcgctatggagcatagtttggtgttacaccaactcagatgtaacggcgtcttggagggcatcagaatttgcaggaaaggtttccccaataggatcttatacggcgactttaagcagcgctatcgggttcttaatgcttccgccattccagaaggtcagttcatagactctaagaaagcttgcgaaaagctgctggcctcaatcgacatcgatcacactcaatataaattcgggcacaccaaagtatttttcaaagctgggctgctgggtaccctggaagagatgagagatgaccgccttgccaagctgatcaccagaacccaggccgtgtgcaggggattcctcatgcgcgtggagttccagaagatggtccagcggcgcgagtctattttctgtattcagtacaatatcagaagtttcatgaatgtcaaacattggccttggatgaaactattttttaagattaagccacttttgaagtccgcggaaaccgaaaaggagatggcgacaatgaaagaagagtttcaaaaaactaaagacgaattggcaaagagcgaagccaaacgaaaggaactggaagagaaactggtgactctggtgcaggaaaagaatgatctgcagcttcaggtccaggccgagtctgagaatctgctagatgccgaggaacggtgcgaccagcttattaaggctaaattccagctggaggcaaagataaaggaggttactgaaagggctgaggatgaggaggagatcaatgcagagctcacggctaagaaaagaaagctggaagatgaatgcagcgaacttaagaaggatattgacgatttggagctgacattagcaaaagtggagaaagaaaagcacgcaacagagaacaaagtaaaaaatcttacagaggaactgagcggactggacgagaccatcgctaagcttacccgggagaagaaggctctccaggaagcccaccagcaggctctggacgatctgcaggccgaagaggacaaggtgaacagcctgaataaaacgaagtcgaagctggagcagcaggtggaggatcttgaatcttccctggaacaggaaaaaaagctccgggttgatttagagcgcaataaaaggaaactggagggcgatcttaaacttgcccaggagtctattctagacctggagaatgacaaacaacagttggacgagcgcttgaaaaagaaagacttcgagtactgccagctgcaatcaaaagtcgaagatgagcagacccttggcctacagttccagaaaaaaataaaggagttgcaggcacgcatcgaggagttggaggaggagatcgaggctgagcgcgctacacgcgccaaaaccgagaaacaacgatctgattacgccagagagctggaggaactgtccgaaagactggaagaagccggaggcgtgacatctacgcagatcgagctgaataagaaacgggaagccgagttcctgaagttgagacgggatcttgaggaagcaaccctccagcatgaggcaatggtggccgcgctgagaaagaagcacgccgatagtgtggctgagctgggcgaacagatcgacaatctgcagcgagtgaaacagaaactcgaaaaggaaaagtccgaattcaagctagaaatcgatgatctgtcctccagcatggagagtgtgtccaagtcaaaagctaacctcgagaagatctgccgaactctagaagaccaactgagtgaagcacggggcaagaacgaggagatacaacgcagtctgtcagagctaacaacccagaaaagtcgcttgcaaacggaggccggggaactgagtcggcaactggaagaaaaggaatcgatcgtgagccagctttccaggtcaaaacaagcattcactcaacagacagaagagctgaagaggcagcttgaggaggagaataaagctaaaaacgccctggcccatgcactgcaaagctccagacacgactgtgatctgctcagggagcagtatgaggaggaacaagaaggaaaggcggagctccagcgggccttatcaaaagcgaacagtgaagttgcccagtggcggactaagtacgaaaccgacgctatccagcgtaccgaggagttggaagaggccaagaagaagttagcacagagactgcaggatagcgaggaacaggtggaagcagtgaacgccaaatgcgccagcctggagaaaactaagcagcgtctacagggagaagtggaggaccttatggtggacgtggagcgcgctaatagccttgctgctgcgctggataagaaacagcgcaattttgacaaagtcttggccgaatggaaaacgaagtgcgaggaatctcaagccgagcttgaggccagcctcaaagaaagcagatctctgtctacagaattattcaaactgaagaacgcatacgaagaagcactggatcaacttgaaacagttaaacgcgagaacaaaaacctcgagcaggaaattgctgacctcacagagcagatcgctgagaatggcaaaaccatccacgagctggagaagtcccgcaagcagattgaactggaaaaagccgacattcagctggccctggaagaggccgaggcagctttggagcatgaagaagccaagatcctgcgtatacagctcgagctaactcaggttaaatcagaaattgatcgcaagatcgctgagaaagacgaggaaatcgagcagctgaaacgtaactatcagcgcactgttgaaaccatgcagtctgctttggatgctgaggtgcgctcacggaacgaggccatcagactgaaaaagaagatggagggcgatttaaacgagattgaaattcagctgagccatgcaaacagacaggccgctgaaactctcaaacatctgagaagcgtgcagggtcagctgaaagacactcagctgcaccttgacgatgccctgcgcggacaggaggacctcaaggagcagctcgccatcgttgagagacgggccaaccttctacaagctgaggtggaggagctgagggccaccctggaacaaactgaaagagcccgaaaactggcggagcaggaactgcttgattccaatgagcgggtgcagctgctgcacacccagaacacaagcctcatccataccaagaagaaattagagacagacctgatgcagctgcagtccgaagtggaggacgcaagcagggacgcccgtaatgccgaggagaaggcaaagaaggctattactgatgccgctatgatggctgaggagctcaaaaaggaacaggatacctcagcgcacctcgaaagaatgaaaaaaaacctggagcagactgttaaggacttgcaacaccgcttagacgaggcagagcaacttgccttaaaagggggcaagaagcagattcaaaagttggagactagaattagggagcttgagtttgagctcgaaggcgagcagaagaaaaatactgagtcagtgaaaggtctgcgcaagtacgaaagacgagtaaaggaactgacttaccagagcgaggaggaccgaaaaaatgtgctcaggttgcaggatctagtagataagctgcaggtcaaggtgaagtcgtacaaacggcaagccgaggaagccgacgagcaggctaacgctcacctgaccaagttcaggaaagcccagcatgagctggaggaggcggaggaaagggccgatatcgccgaaagtcaggtgaacaagctcagggcaaagaccagagacttcacctcctcgaggatggtagtccacgagagcgaagagtag

SEQ ID NO: 140493 - DNA, 357 bp, Artificial Sequence
  Description of Artificial Sequence: Synthetic coding sequence
atggccccgttgcgaccactcctgatactcgccctcctggcatgggtggcccttgctgatcaggaatcctgtaaaggcagatgcacagaggggtttaacgtcgacaaaaaatgccagtgcgatgaactctgttcctactatcaatcttgttgtactgattataccgccgagtgcaaaccacaggtcaccagaggcgacgtgtttacgatgccagaggatgagtataccgtgtacgacgatggagaagaaaagaataacgctactgttcatgagcaggtcgggggaccctctctgacaagtgatttacaggctcagagcaaggggaaccctgaacagacccctgtcctcaaaccctag

SEQ ID NO: 140494 - DNA, 495 bp, Artificial Sequence
  Description of Artificial Sequence: Synthetic coding sequence
atgagtgtggacccactctcctctaaggcattaaagatcaaaagggagctttctgagaatactccacacctatccgacgaagcactgatggggctctccgtgagagaactgaatcggcacctccgcgggttatcggcagaagaagtgacaagactgaagcagcgtcgacgcacgctcaagaatcgaggttacgcagcttcctgcagagtgaagagggtctgccagaaagaagaattacagaagcagaaatccgaacttgaaagagaggtcgacaagctggctagagagaacgctgcgatgcggctggaactggatgcgctgagagggaagtgtgaggcacttcagggcttcgccagatcggtcgctgcagcccgcgggcccgccactctggtcgctcctgcttctgtaatcactattgttaaatccactcctggcagtggatctgggccagcgcatggtcccgacccagcacatgggcctgctagctgctcgtag

SEQ ID NO: 140495 - DNA, 495 bp, Artificial Sequence
  Description of Artificial Sequence: Synthetic coding sequence
atgtctgtggaccctttaagcagtaaggctctaaagataaaacgcgagctgtcagagaacaccccccatttgtctgatgaagctctgatgggcctgtcagttcgggaactcaatcgacacttgagagggcttagcgccgaagaggtgactagattaaaacagcgccggaggacgttaaagaatagaggatatgcggcgtcctgtagagtcaaaagagtttgtcagaaggaagaactgcagaagcagaagtctgaattagagcgagaagtggacaagctggctagggaaaatgcagccatgcgcttagagctggacgctttgcgcggcaagtgtgaggcccttcaggggttcgcgcggtctgtggctgcggccagaggccctgccaccctggtggccccagccagcgtgatcacgatcgtaaagagcaccccgggaagcggctccggtccggcccacgggcccgaccccgctcatggtcctgcatcttgtagttag

SEQ ID NO: 140496 - DNA, 381 bp, Artificial Sequence
  Description of Artificial Sequence: Synthetic coding sequence
atgtccgtggacccactgagcagtaaggccttgaaaataaaacgcgaactcagtgagaatactcctcatctgagtgatgaagccctgatgggcctgtccgtacgagaactgaatcgacacttgagagggttatccgccgaagaggtgacacgcctcaagcagcggaggcgcaccctgaagaacagggggtatgctgccagctgccgcgtgaaacgtgtgtgtcagaaagaggaacttcagaaacaaaagtcggagctggaaagggaagtggacaagcttgctagagagaatgccgccatgcgcctagaactggacgccctgcggggcaaatgtgaggctctccagggctttgctcgaagcgtcgccgctgctagaggatag

SEQ ID NO: 140497 - DNA, 495 bp, Artificial Sequence
  Description of Artificial Sequence: Synthetic coding sequence
atgtcagtcgatccgctttcatctaaggcgttgaagataaagcgagaattgtctgagaatactccacacctgtctgacgaggccctgatggggctgagcgttagagaactaaaccggcacctacgaggacttagcgctgaggaggttacgaggttgaaacaacggcgtagaacactcaaaaataggggctatgcagcatcctgtcgagtgaagagggtgtgccagaaggaggaattacagaaacagaaaagcgagctggaaagggaggtggacaagctggccagggaaaatgccgcgatgaggctggagctggacgcattgcgagggaagtgtgaagcactgcagggatttgcccgatcagttgccgccgcgcgcgggccggcaaccctggttgctcccgcctccgtgattacaattgtgaaaagtacgcctggcagtggatccggtcccgcccatggacccgaccccgctcatgggcccgctagctgcagttag

SEQ ID NO: 140498 - DNA, 282 bp, Artificial Sequence
  Description of Artificial Sequence: Synthetic coding sequence
atgggtctaagcgtccgggaactgaacaggcacttgcgcggcctatctgcggaggaagtcactaggctgaagcagaggcgtagaactctcaaaaaccgggggtatgccgcaagttgtcgcgtgaaacgagtgtgccaaaaagaagagctgcaaaaacaaaagtccgagctcgaacgtgaagtcgacaagttagccagggagaacgctgccatgcgactcgagctggacgcactacgcgggaagtgcgaagcacttcagggcttcgccagatcagttgcatag

SEQ ID NO: 140499 - DNA, 495 bp, Artificial Sequence
  Description of Artificial Sequence: Synthetic coding sequence
atgtctgttgacccactcagcagcaaggctctcaagattaagagggagctgagcgaaaacacaccacacctgtccgacgaagcccttatgggccttagcgttagggaactcaacagacatctcagaggtctgtccgcggaagaagtcactaggctcaaacagcgtcgacgaaccctgaaaaaccgaggctatgcggcgtcttgtcgagtcaaaagggtctgccagaaggaagaactgcagaagcagaagtccgaacttgagcgcgaggtggataaactcgctcgcgagaatgctgccatgaggttggagctcgacgcgcttcgaggaaagtgcgaagccctgcagggtttcgcccggtccgtggctgctgctagggggcccgcaactctggtggcgcccgccagtgtcatcaccatcgtgaaatccactccaggttcgggtagcggccccgcccacggacccgatccagcgcacgggcctgcttcctgctcttag

SEQ ID NO: 140500 - DNA, 408 bp, Artificial Sequence
  Description of Artificial Sequence: Synthetic coding sequence
atgggcctctctgtgagagaactaaatcgacacttgaggggcctctcggcagaggaggtgacgcgcctgaaacagagacgccggacccttaaaaatcgtgggtacgccgcgtcatgtagggtcaaaagggtttgccagaaagaggagcttcagaaacagaaatctgaactggagcgtgaagtcgacaaactcgcgcgggaaaacgcggcaatgagactggaattggatgctctccggggaaagtgcgaagcgctgcaggggtttgcaagatccgtggccgccgcacggggacccgccactctcgtcgctcccgcttctgtgatcacaatcgtcaagagcacccctggaagcggctccggccctgctcacggtcccgatcctgctcatggccctgcctcatgctcatag

SEQ ID NO: 140501 - DNA, 489 bp, Artificial Sequence
  Description of Artificial Sequence: Synthetic coding sequence
atgactacaccaaacaaaggaaacaaagcgcttaaggtgaaaagagaaccaggtgagaacgggacgagtctgactgatgaagagttggtgaccatgtccgtgcgcgaactcaatcagcacctgcgggggctgagcaaagaggaaatcgtccaactgaagcaaaggcggcggaccctgaagaatcgcggctatgccgcctcctgtagggtcaagagagtcacccagaaggaggagctggagaaacaaaaggctgaactgcagcaggaagtggagaagctggcgtccgagaacgcatccatgaaactggagctggatgccctgagatccaaatacgaagctctgcagacatttgctaggaccgtcgccaggagccccgtagcgccggcacgtggacctctggccgctggattggggccactggtgccaggtaaggtggccgcgacaagtgtgatcacgatcgttaaatccaagaccgatgcccgcagctag

SEQ ID NO: 140502 - DNA, 489 bp, Artificial Sequence
  Description of Artificial Sequence: Synthetic coding sequence
atgaccaccccaaacaaaggcaacaaggctctgaaggtgaagcgcgagccaggcgaaaacggcacgtctctgaccgatgaagaactggtaaccatgagtgtccgcgagctgaatcagcatctgcgcggcctgagcaaggaggagatcgttcagctcaagcagaggagaaggactctcaagaatcgcggttacgctgcatcgtgcagagtgaagagagttactcaaaaggaggagctcgagaaacagaaggccgagcttcagcaggaggtcgaaaaactggccagtgagaatgcttccatgaagctggaattagatgctttgcgaagcaaatatgaagccttacaaaccttcgcccgtacagttgcccgatcccccgtcgctcccgccagagggcccctggcggccggcctggggccgctcgtccctggaaaagtcgcagcaactagcgtaatcacaatcgtcaaatcgaaaactgacgcgcgttcgtag

SEQ ID NO: 140503 - DNA, 471 bp, Artificial Sequence
  Description of Artificial Sequence: Synthetic coding sequence
atgaccactaatccgaaacctaacaaagcactcaaagtgaaaaaggaagcaggcgagaacgcgccagtgctatcagatgacgagcttgtgtccatgtcagttcgagaactgaaccagcaccttcgagggcttacaaaggaggaggtcacccgtttgaagcagcgcagacgaactctgaagaaccgtggctacgcagcttcctgtaggattaagagggtgactcaaaaggaggagctcgaaaggcaacgcgtggaactgcagcaggaggtcgaaaagctggcaagggagaatagtagcatgcggctcgagctggatgctcttaggtctaagtatgaagctctccagactttcgcaagaaccgtggcacggggcccagttgccccttcgaaagtcgctacaacaagtgttattacgattgtgaaatccacagaattaagtagcacatcagtccctttcagtgcggcatcctag

SEQ ID NO: 140504 - DNA, 471 bp, Artificial Sequence
  Description of Artificial Sequence: Synthetic coding sequence
atgaccaccaatcccaagcccaataaggcgctgaaggtgaagaaggaagcaggggaaaacgctcctgtcctctcggacgacgaattggtgtctatgtcggttagggagctgaaccagcacctgcgcggattaaccaaggaagaggtgacacgtttaaaacagcgccggaggactctgaagaacagaggttacgccgcttcatgcaggataaaacgggtgactcagaaagaggagctggaacgtcaacgggtggaactgcagcaggaagttgaaaagctcgcacgggaaaacagttcaatgcgccttgagctggatgcactacgctccaagtacgaagccctccagacatttgcaaggactgttgcccggggcccggttgccccaagcaaagtcgcgacaacttcagtgataactattgtcaagagtacggagctttcttcaacctccgtcccttttagcgctgcgagctag

SEQ ID NO: 140505 - DNA, 471 bp, Artificial Sequence
  Description of Artificial Sequence: Synthetic coding sequence
atgacaaccaatcccaaacccaataaggctttgaaagtcaaaaaggaggccggcgagaacgcccctgtgctgtcagacgacgagctggtgtccatgagtgtccgcgaactaaaccagcacctgagggggctcacaaaagaagaagttactcgcttaaaacagcggaggaggaccctaaagaatcgcggctatgctgctagttgccgaattaagcgcgtaacccaaaaagaagaactggagcgccagcgcgtagaactgcagcaggaagtggagaagctggcacgagaaaatagtagcatgcgacttgaactggacgctttacgctctaagtatgaggccctgcagaccttcgctagaactgttgctcggggtcccgttgcaccctccaaggtggctactacctctgtgatcactattgtcaaaagcacagagctcagctccaccagtgtgccattctccgccgcctcctag

SEQ ID NO: 140506 - DNA, 1041 bp, Artificial Sequence
  Description of Artificial Sequence: Synthetic coding sequence
atgccctctccacttgccctccgaccttacctccgcagcgagtttagccccagtgttgatgcgcggccttgctcttccccatctgaactaccggccaaacttttactcggcgctactctgccaagagcccctcgtctccctcgcaggctcgcatggtgcagcatcgattgggagcaggtttgtctcctccagcggttgggggccggtggattcggctcggtgtacaaggcaacataccgcggtgtccccgtggctatcaaacaagtaaataaatgcaccaagaaccggctggccagcagaaggagcttttgggctgagcttaacgttgccagattgaggcatgacaatattgtaagggtggtcgccgcgtccacacggactcccgcaggaagcaactccctcggcacaattataatggagtttggaggaaatgttacacttcatcaagtgatttacggtgccgctggccatccggagggcgatgcaggggaaccccattgcagaactggaggccagctgtcattagggaagtgtctgaaatattccttagacgtcgtcaatggcctgctgtttctccactcgcaaagcatcgttcatctggacttaaagcctgcaaacattttaatcagtgagcaggatgtatgcaaaatctctgactttgggtgcagtgagaagctggaagacctgctgtgttttcaaactccgagttacccactcgggggcacatatacacacagggcacccgaactgctgaaaggagagggggtgacacccaaggccgacatctatagtttcgctattactttatggcaaatgactaccaaacaggcgccttactccggcgaacgacagcatatcctgtacgctgtagttgcctatgatttacggcccagtctctctgccgcagtgttcgaagatagtcttcccggacagaggctaggggatgtgattcaaaggtgttggcgcccatctgcagcacagagaccttccgctcggctgctgttggtagacctcacgtcccttaaagcagaacttggttag

SEQ ID NO: 140507 - DNA, 1839 bp, Artificial Sequence
  Description of Artificial Sequence: Synthetic coding sequence
atggcgcggcggccccgacattctatctatagttctgatgaggacgacgaggattttgagatgtgcgaccatgattacgacgggctgctccctaagtccggaaaacggcacctgggcaaaactcgctggaccagggaagaagacgaaaagttgaagaagcttgtggagcagaatggcacggacgattggaaggtgatcgccaactacctgccaaatagaacagacgtacagtgccagcaccgttggcaaaaggtcctcaaccctgaactgattaaagggccatggactaaagaagaggatcagcgagtgatcgagcttgtccaaaagtatggtccaaaacgctggtccgttatcgccaagcatttaaagggccgcatcggcaagcagtgcagggagaggtggcacaatcacctgaaccccgaggttaagaaaacgtcttggaccgaggaagaggaccgcataatttatcaggcacataagcgcctcggtaacagatgggcagagatcgctaagttgctgccaggcagaactgacaatgccatcaagaaccactggaactccactatgcgcagaaaagtggagcaggaaggatatctgcaagaaagttccaaggcttctcagcccgccgttgccacttcctttcaaaagaactcacatttaatgggcttcgcccaggctcccccgacggcacaattaccagctaccgggcagcctacggttaacaatgattattcctactaccacataagcgaggctcaaaatgtgtcctcacatgtgccctacccagtagctctgcacgtgaacatagtcaatgtcccacagccagccgccgctgccatccagcggcactataatgacgaagacccagagaaagagaaacggatcaaagagctggagctgctactcatgagcacagagaacgagctgaagggccaacaggtcctccccacccagaaccatacttgtagttaccctgggtggcactccactacaatagccgaccatacgcgacctcatggcgatagcgcccctgtgtcatgtcttggcgagcaccacagcactccctcacttccagctgaccccggatcactgccagaagaaagtgcgagccctgcccggtgtatgattgtccaccaggggacaatcttggacaacgtgaagaacctgctcgagttcgcagagactttgcagttcatcgactcttttctgaatacatcctctaaccacgagaacagtgaccttgaaatgccttcgctaacctccacacctctcatagggcataagctgactgtgaccactccattccacagggatcagaccgtgaagactcaaaaagaaaacactgtgttccggacccctgctatcaaacgtagcattctggagtcctctccgcggactccaacccctttcaaacacgcactcgcagctcaggagataaagtatgggccgctgaaaatgctgcctcagactccttcccatctggtggaggatctgcaggatgtcatcaaacaggagagcgacgagagcggaatcgtcgctgagtttcaggagaatggtcctcctctgttgaaaaaaataaagcaggaagttgaatcccccacagataagtcgggcaatttcttttgttctcatcactgggagggggatagccttaatacacagctttttacccaaacctcccctgtcgccgacgcccccaatatattgacttcctctgtgctgatggcccctgcatcagaagatgaagataacgtgcttaaggcgttcacagttccaaagaatcggtccctcgcatctcctctgcaggctaccaaagcacaaaggctgtttcagttttag

SEQ ID NO: 140508 - DNA, 2181 bp, Artificial Sequence
  Description of Artificial Sequence: Synthetic coding sequence
atggccagacgccccaggcattctatctactcttccgatgaggacgacgaggacttcgagatgtgtgaccatgattatgacggcttgttgccaaaaagtggaaagcggcacttggggaagaccaggtggaccagggaggaggatgaaaaacttaagaagctcgtcgaacagaacgggactgatgattggaaggtgatcgctaattatctgccaaacagaaccgacgttcaatgtcagcacagatggcagaaggtactcaaccccgaactcattaagggcccctggacaaaagaagaagatcaacgcgttattgagctcgttcaaaaatacgggccaaagagatggagtgtgattgcaaaacacctgaaaggtcgcatcggcaagcaatgccgcgagcgatggcataatcatctcaaccctgaggtgaagaaaaccagctggactgaagaagaagaccgaataatttatcaggcccataagaggctaggcaatagatgggccgaaatcgcaaaactgctgccagggcggactgataatgccattaagaatcattggaactctacaatgcggcgcaaagtggagcaggagggttacttacaggaatctagtaaagcaagccaacccgcagtcgcgaccagtttccaaaagaatagccatttaatgggcttcgcccaagctccccccacagcgcaactccctgctactggccagccaactgtaaataacgattatagttattaccacatctcagaggcccagaatgtcagctcacacgtgccctacccagtggctctacatgttaatatcgtcaatgtgcctcagccagccgcagcagccatccagcgccactataacgacgaagatcctgaaaaagagaaaaggatcaaggagctggaactcctcctcatgtccaccgagaatgagctgaagggccagcaggtgctaccaacacagaaccatacgtgctcctacccaggttggcactccacaactattgcagatcacacccggccacacggggacagcgcccccgtgagctgtctgggagagcaccacagtacacccagtcttccggcagaccccggcagtctgcccgaggaatccgcatccccggcccggtgtatgatagtgcatcaggggaccatcttggataatgtgaagaaccttcttgagttcgccgagacattgcagttcatagacagcttcctgaacactagtagcaaccatgagaattccgacctggagatgcccagcctgaccagcacaccgctgatcggacataagctgaccgttactacccccttccatcgggatcagacagtcaagacccagaaagagaatactgtatttcggactccagctattaagcgaagcattcttgaatcctcccccaggacacccaccccctttaaacatgcgctcgctgcgcaagaaattaaatatggcccccttaagatgctacctcaaaccccctctcacctggtggaggacctgcaggatgtcatcaagcaggagagcgatgagtccggaattgtggctgagttccaggagaatggaccacccttactgaaaaagatcaagcaggaggtggagagtccgacagataagtccggaaactttttctgctcacaccattgggagggtgactccctcaacacccaactttttacgcagacatcccccgtggctgatgccccgaccggcgtgcagtggcatgactttgggagcttgcaaccgctgcccccggggttcaagcgcttctcctgcctgtccctcccgcggtcctgggattacaggcaccctccaccgcggcctgctaatttcgaattcctcgttgagacagggttcctccatgttggtcaggccggcctggagctgctgacttccggcgacctgccggcgtccgcctcccaatctgcgagaatcactggtgtaagccatagggcgagacccgataacattctaaccagctccgtgcttatggctccagcgtccgaggatgaggacaatgtcctaaaggccttcaccgtccctaagaacagaagcctcgcaagccccctgcagccctgctctagcacctgggagccagcgtcctgcgggaagatggaggagcagatgactagttcttcccaggcacggaagtatgttaacgcctttagcgcacggactctcgttatgtag

SEQ ID NO: 140509 - DNA, 2286 bp, Artificial Sequence
  Description of Artificial Sequence: Synthetic coding sequence
atggcgagacgaccacgtcattcaatttattccagtgacgaagacgacgaagacttcgaaatgtgcgatcatgactatgacggcttgctgccgaaaagcgggaagagacatctgggaaaaaccaggtggactcgcgaagaagacgagaagctcaagaaactcgtggaacagaatggaacagatgattggaaagtgatcgccaattatctcccaaaccgcacagatgtgcagtgccaacatagatggcagaaggttctgaacccagagctcattaaaggaccttggactaaagaggaggaccagcgggtgattgagctggtgcagaagtatggccccaaacgatggagcgtcatcgctaagcatctaaagggcaggattggaaagcagtgcagggagcgctggcacaatcaccttaacccggaagtaaagaaaacttcctggaccgaggaggaagaccggattatctatcaggctcataagaggctaggtaaccgctgggctgaaattgccaaattgctgcccggccgcacagataacgcaattaagaaccactggaatagtacgatgcgccgtaaagtggaacaggagggctatctgcaagagagctcaaaggcgtcacaaccagccgtggccacctctttccagaaaaacagtcacctcatgggctttgctcaggcacctcctactgcacagctgccggccacagggcagcccacagtaaacaatgattactcctattatcatatatccgaagcacagaacgtgtcctcacatgtcccgtatccagtggcactgcacgtgaatattgtaaatgtccctcagccggctgcagctgccatacagcgacattacaacgatgaggacccggaaaaggaaaaacgcatcaaagaactggaacttttgttgatgagcacagagaatgaactgaaaggccagcaggtgctgcccacccagaatcacacctgtagctatccaggctggcattctacaaccattgctgaccatactcgaccccacggggacagcgctcccgtcagttgccttggcgagcaccactcaaccccaagtctgcctgccgatccaggatccctgccggaagagagtgccagtccagctcgatgtatgattgtgcaccagggcactatcctggataacgtgaaaaatttactggagtttgcagaaactcttcagttcatcgatagcgactcctcaagctggtgtgatctctcatctttcgaattcttcgaggaggctgacttcagcccgtctcagcatcacaccggcaaagctctgcagctgcagcagcgggagggtaacgggactaaaccagcaggtgaaccgagccctcgtgtgaataaacgcatgctctcagagtcttcactggacccgcccaaggttcttccgcccgctcggcactctactataccattggtcattcttaggaagaagaggggccaggcctcaccacttgccactggggactgcagctccttcatcttcgctgatgtcagtagcagcacacccaagcgatcgcccgtgaagagtctccctttctctcccagccaattcctgaacacttcttccaaccacgagaactctgatctcgagatgccttctctaacatccacacctcttatcggccacaaactcactgttactacaccctttcaccgagaccagacagtgaagacacagaaagagaatacagttttccgaactccagccatcaagcggtctatcctcgaatccagtccccgcactccaactccctttaagcatgccctggctgcacaggaaattaagtatgggccgctaaagatgttacctcagacacctagccatctggtggaggatctgcaggatgtgatcaaacaggagtcagacgagagtggcattgtcgcggagttccaggaaaacgggccccctctcctcaaaaagatcaagcaggaagtggagtcccctactgataaaagcggcaactttttctgttcccaccactgggaaggagactctctgaatactcagctctttacccagactagtcccgtggccgacgctccaaatatcctgacctctagtgtcttgatggcgcctgcttccgaggacgaggataacgtgctcaaagctttcacggtgccgaaaaacaggagcctggctagtcctctccagccttgctcttctacttgggaacccgcatcctgtggaaagatggaggaacagatgactagctctagccaggcccgaaaatatgtcaacgcgttctctgcccgcactcttgtaatgtag

SEQ ID NO: 140510 - DNA, 1923 bp, Artificial Sequence
  Description of Artificial Sequence: Synthetic coding sequence
atggcacgaaggccaaggcactccatctatagttccgatgaggacgacgaggacttcgagatgtgcgaccatgattacgatggcttgcttcccaagtccggtaagcggcatttaggaaaaaccaggtggactcgggaagaggacgagaagttgaaaaaacttgtggagcagaatgggactgacgactggaaggtgatcgcgaactatcttcctaacagaacagatgtacaatgccagcatagatggcagaaggttttgaacccagagctcattaaggggccttggaccaaggaggaggatcaacgggttatcgaactcgtccagaagtatggtccaaagaggtggagcgtcattgctaagcatctgaaaggccgcattggaaagcagtgccgggagcggtggcataatcatctgaatccagaggtgaagaagacatcctggactgaggaggaagaccgtataatctaccaggcacacaaacggcttgggaaccgctgggctgaaattgccaaactccttcctggaaggaccgataatgctatcaagaaccattggaactcaaccatgcgcagaaaggtggagcaggagggctacttgcaggaaagtagcaaggcttcgcagcccgccgtagctacaagttttcagaagaattcacacctgatggggtttgcacaggccccaccaactgcccaactccctgcgaccgggcagccaactgtaaataacgactactcatattatcacatcagtgaggctcaaaacgtgagctcccacgtgccctatccagtcgccctgcacgtaaatatcgtgaacgtgccccaacctgcagcagctgccatccaacgacattataatgacgaagatcctgaaaaggagaagcggatcaaggaactggagctactgcttatgagcaccgagaatgagttaaagggtcagcaggttttgccaactcaaaatcacacatgctcgtaccccggctggcactccacgacaatcgcagatcacacccgcccacacggggatagtgctcctgtgagctgcctgggagaacaccacagtaccccctccctccccgccgatcctggctcattacctgaagagagcgcaagtcccgctcgctgtatgatagtgcaccagggaacgattcttgataatgtgaagaacctcctggagttcgctgagacacttcagttcattgattcgtttctgaatacctcatccaatcacgagaactccgatctggaaatgccaagcctaacttccacacccctgatcggccacaaactcaccgttacaactccatttcaccgcgaccagactgtcaaaacccagaaggagaacaccgttttcagaaccccagcaattaaacgttctattctagagtctagcccgcgcaccccgactccattcaagcatgccctcgccgcccaagaaataaaatacgggcccctgaagatgctgcctcaaacgcccagtcatcttgttgaagacctgcaagacgttatcaaacaagagtctgatgaaagcggcatcgttgcggagttccaagaaaacggaccacctctgctgaagaaaatcaaacaagaagtggagtcgccaaccgataaatcaggaaactttttctgcagccatcattgggagggtgattctcttaacacccagctattcacccagactagcccggtggctgacgcaccaaacatcctgacttcgtccgtgcttatggcgcctgcctcagaggacgaggacaatgtacttaaggctttcaccgtacccaagaaccggtctctggcatctcccttacaaccgtgttcgtctacatgggagcctgcctcgtgtgggaagatggaagagcagatgacctcctcaagccaggcccgcaagtatgtaaatgcatttagcgctaggacccttgtgatgtag

SEQ ID NO: 140511 - DNA, 1914 bp, Artificial Sequence
  Description of Artificial Sequence: Synthetic coding sequence
atggccaggcgccctaggcatagtatatatagttcagatgaggacgacgaagacttcgaaatgtgcgatcacgactatgatggactcctgccaaagtccggaaaacgtcacctaggcaagacacgctggacaagagaagaggacgaaaagctgaagaagctggttgagcagaacgggaccgacgattggaaggtaattgccaattacctgccgaacagaaccgatgtccagtgtcagcaccggtggcagaaggtgctgaaccccgagttaattaaagggccctggactaaggaggaggatcagcgggtgatagaattggtccaaaaatacgggcccaaacgctggtcagtcatcgctaaacacctgaagggtcggatcggtaaacagtgtagggaacgatggcacaatcatcttaatccggaggtgaagaagacctcctggactgaggaagaagatagaataatataccaagcccacaagagacttggtaaccgctgggccgaaatcgctaagctgctacctggtcggacagataatgctatcaaaaaccactggaactccacgatgcgccgaaaggtggagcaggagggctacctgcaggaatcatcgaaggcttcccagcccgcagttgctactagcttccagaaaaactcacatctgatgggttttgcccaggccccaccaaccgctcagctgccggctactggtcagccaactgttaataatgactactcttactaccacatctccgaagcccagaatgtctctagccacgtgccataccccgtcgcgctgcatgttaacatagtcaacgttcctcagccagcagcagccgctatccagcgccattacaacgatgaggacccagagaaggaaaagcgtatcaaagagctggagctcttgcttatgtctacggagaacgaactgaaaggacagcagacccaaaatcacacctgctcttaccccgggtggcacagcacaacaattgctgaccacacaaggcctcatggtgatagcgcacccgtatcctgccttggagagcatcattctaccccgagccttccagcagacccaggtagcctccctgaggagtccgcaagccctgctcgatgcatgatcgttcaccaggggaccattctcgataatgtaaaaaaccttttagagtttgccgagactcttcagtttatcgattcctttcttaacacatcctccaaccacgagaattctgatcttgaaatgccttctctgacatctacaccactcattggtcacaaattgacggttaccactcccttccatcgtgatcagaccgtaaaaacacagaaggaaaataccgtctttagaacccctgcaatcaagcgctcaattctggagagcagcccccggaccccaacaccctttaagcacgcgctcgctgctcaggaaattaagtacggacctctgaaaatgctcccgcagacgccctcccatctcgtggaggacctccaggatgtgatcaaacaagagagcgatgaaagcgggatcgttgcagaatttcaagaaaacggacctccactactgaagaagatcaagcaggaggttgagagtcccaccgataaatcaggcaacttcttctgttcccatcattgggagggcgactctcttaatacacagttattcacacaaacttccccagtcgcggacgcgcccaatatactgaccagtagcgtgctgatggctcctgcaagcgaagacgaggacaatgtccttaaggctttcactgtgcccaagaatagaagtctcgcgtcccccttacagccctgcagttctacttgggagcctgcgtcatgtgggaagatggaggaacagatgacaagcagctctcaggcaagaaagtacgttaatgctttttctgcgcgcacccttgtgatgtag

SEQ ID NO: 140512 - DNA, 240 bp, Artificial Sequence
  Description of Artificial Sequence: Synthetic coding sequence
atggcacgacgccctcgtcactctatttatagtagcgatgaggatgacgaagactttgaaatgtgtgatcacgactacgacgggcttctccctaagagcggcaaacggcacctgggtaaaacaagatggaccagggaggagaatcgcacagacgtccaatgtcagcatcggtggcaaaaagtgctcaaccccgaactgatcaagggcccttggaccaaagaagaggaccaacggaactag

SEQ ID NO: 140513 - DNA, 312 bp, Artificial Sequence
  Description of Artificial Sequence: Synthetic coding sequence
atggcccggcgccctcgacactcgatttactcaagcgatgaggatgatgaggactttgaaatgtgtgatcacgactatgatggactgttacccaaatccggaaaaaggcatcttggcaagactaggtggacacgcgaagaagatgagaaactcaagaagctggtggaacagaatggaaccgatgattggaaagtaatagcgaattacttacccaacaggacagacgtccagtgccaacaccggtggcaaaaagttcttaaccctgagttaatcaaaggcccctggacaaaagaagaagaccagcggaattag

SEQ ID NO: 140514 - DNA, 1818 bp, Artificial Sequence
  Description of Artificial Sequence: Synthetic coding sequence
atggcacgacgcccaaggcacagcatttatagctctgatgaggacgacgaagatttcgaaatgtgcgatcacgactatgacggtttgctcccaaaatcgggcaaacggcatctggggaagacaagatggacacgagaggaagacgaaaagttaaaaaaactggtagaacagaatggaaccgatgattggaaggttattgcaaattaccttccaaaccgaaccgacgtgcagtgccagcacagatggcagaaggttctgaatcctgagctcatcaagggtccatggacgaaggaggaggatcagagggtgatcgagctggtgcagaagtatgggcccaagaggtggtccgtaatagccaaacacctcaaaggacgcatcggcaagcagtgtcgcgagaggtggcacaaccacctgaaccccgaggttaaaaagacatcttggacggaggaagaggatcggataatctaccaggcacacaaaagactggggaatcggtgggcagaaatcgctaaactcctgccaggcaggacggacaatgctatcaaaaatcactggaactcaacaatgcgaagaaaggtggagcaggagggatacttgcaggagagtagtaaggcctctcagcctgcagtggccaccagctttcaaaagaattcacacctcatggggttcgcccaggcaccacctacagcacagctacctgccactggacagcctacagttaacaatgattattcttattatcacatctctgaagcccagaacgtgtccagtcacgttccataccccgtggctttacacgtaaacattgtgaatgtgccccagcccgccgccgccgctattcaaactcagaaccacacttgcagttatccgggctggcattccaccaccatcgccgatcatactcggccccatggcgactctgcccccgtatcatgtctcggtgaacatcatagcactccatctctgccggcggatccaggctcgttgccagaagaaagcgctagtcccgccaggtgtatgatagtgcatcaggggaccatattagacaacgtcaagaatctcctcgagttcgccgagactttgcagtttatagacagctttttgaacacgagctcaaatcatgagaattccgacctggagatgccatctctaacctccaccccactgatcggccacaagttaacggtaacgacaccctttcacagagaccagacagttaaaacacaaaaagagaacacagtctttcggacacctgcaattaaaagaagcatccttgagagcagtcctcgaaccccaactccttttaagcacgcccttgctgcacaagaaatcaagtatgggcccctgaagatgttgcctcagacaccatcacacctcgtggaggacctgcaggacgtgatcaagcaggaatccgacgagtctggaatcgtggctgaatttcaggaaaatggccctcccctcctgaaaaaaataaagcaggaggtggagtctccgactgacaaatctggcaattttttttgctctcaccattgggaaggggatagtcttaatactcagctgttcacacagacctcacccgtggccgacgctcccaacattctcacctcaagtgtgcttatggcccccgcatctgaagatgaagataatgtgctcaaagcctttaccgttccaaagaatcgatccctggcatcacctctacaaccatgttcaagtacctgggaaccagctagttgtggaaaaatggaggaacagatgacctccagctcccaggccaggaaatacgtgaacgctttctctgcacgcaccctagtgatgtag

SEQ ID NO: 140515 - DNA, 717 bp, Artificial Sequence
  Description of Artificial Sequence: Synthetic coding sequence
atgctgactactctactgcctatactgctgctgtctggctgggccttctgttcgcaggacgcctccgatggcctacagcgcttacacatgctgcagatctcttatttccgcgatccctaccatgtctggtatcagggcaacgctagcctcggggggcatcttactcacgtgctggaggggccagacacaaatactacaatcatacagcttcagccactgcaggagcccgaaagctgggcccgtacacagtccgggctgcaaagttatctgttgcaatttcatggtctggtgagattggttcaccaggagagaacactggcatttcccttgacaatcaggtgctttcttgggtgtgagctcccccccgagggaagccgcgctcatgtgttctttgaagtggctgtcaatgggtcatccttcgtgtcttttagacctgaaagggccctgtggcaggccgatacacaagtgacgagtggtgtggtgacgttcactctgcagcagttaaatgcttataatagaactcgatatgagttgcgcgagttcctggaagatacttgtgtgcagtacgtccagaaacacatcagcgctgaaaacacaaagggctcgcagaccagccgttcctacacttctctcgtgctgggcgtgttggttgggtcttttattattgcgggagtggctgtgggaattttcctctgtacagggggccggcggtgctag

SEQ ID NO: 140516 - DNA, 2031 bp, Artificial Sequence
  Description of Artificial Sequence: Synthetic coding sequence
atgtccagaagaactcgatgcgaggacctggatgagttacattaccaggatacggatagcgacgtccccgagcagagggattcgaaatgcaaggtcaagtggacccatgaagagaatcggactgatcagcagtgccagtaccgctggctgcgagtgctcaatcctgacctggtgaaggggccgtggactaaagaagaggatcaaaaggtgattgagctggtcaagaaatacggaactaagcaatggacgctcatcgctaagcacttgaagggtagactcggcaaacagtgccgggaaagatggcataatcatctgaacccagaagtaaaaaagtcatgttggaccgaagaagaagacagaatcatctgtgaggcccataaggtgctgggcaacaggtgggccgagatagccaagatgctgccaggcagaaccgacaacgccgtgaaaaaccactggaactctacgataaaaaggaaagtcgacaccggagggtttctgagcgaatctaaggattgcaagccacccgtatacctcctgttagagcttgaagataaggacgggctccagtcagcccagcccacagaggggcaaggctctctgctaacaaattggccaagtgtaccacccaccataaaggaggaggagaacagcgaagaagagctggccgcagcgacaacatctaaggagcaagagcctattggcaccgatcttgacgctgtcaggacccccgagccattggaagagtttcctaaaagagaagaccaggaaggcagtccacctgagaccagtctgccttacaaatgggtcgtggaagctgccaatctgcttattcccgcagttggtagctccttgtccgaggctctcgacctgatcgaatccgaccctgatgcatggtgtgatctgtctaaattcgatttgcctgaagagcccagcgccgaggattctattaacaacagtctggtgcagctgcaggctagtcaccagcagcaggtcttacccccccgacaacccagtgccctggtgccctcagtcacagaataccgccttgacggacacaccatttccgacctcagtagaagttcaaggggcgaattgatccccatcagtcccagcacagaagtgggcgggagcgggattggcacacctccaagcgttttaaagcgccagagaaagcgacgggtagcactaagccctgtgacagagaactcaacctctctttcttttctcgactcctgtaattcactaactcccaagtccactcccgtaaagactcttccgttctcaccctcccagttccttaacttttggaacaagcaagataccctggaactggagtcgccatctttaactagtacgccagtctgttctcaaaaagtggtggtcactacacctctgcatagggataagacacctctccatcaaaagcatgccgcttttgtgacccctgaccagaaatacagcatggataatactcctcatactccaaccccgttcaaaaacgccttggaaaaatatggacctctcaagcctcttccccagacgcctcacctagaagaagacctaaaggaggtgttacgatccgaggccggaatcgaattgattattgaagacgacattcgcccagagaaacaaaagcgaaagccaggcctcagacgctcgcccatcaagaaggtgcgtaaaagtttagcccttgacatcgttgacgaagacgtcaagctgatgatgagcacactacccaagtccctaagcctacctaccaccgctccctctaactccagctccctgaccctgtccgggattaaggaggacaactctttgcttaaccagggttttctccaggctaaaccagagaaagccgccgtggcgcaaaagcctaggtcacacttcactaccccagcgcccatgtccagcgcgtggaagacagttgcgtgtggtggtacccgggatcagctgttcatgcaggagaaggccaggcagctgctaggccgcctgaagccgtcacacacctctcgtacgcttatcctgtcctag

SEQ ID NO: 140517 - DNA, 1395 bp, Artificial Sequence
  Description of Artificial Sequence: Synthetic coding sequence
atgccatcatgttccaccagtacgatgcctggtatgatatgcaaaaaccccgatctggaattcgactcgctacaaccctgcttttaccctgatgaagatgacttctacttcggaggtccagattctacaccccccggggaggatatctggaagaagtttgaacttctgccaaccccaccactgagtccatctagggggttcgctgagcattcctcggagcctccaagttgggtaacagagatgttgctcgagaacgagctatggggatctcccgccgaagaagatgcctttgggttgggtggtctcggtgggttgactcccaatcctgtgattctacaggattgcatgtggtcaggtttttccgccagagaaaaactggagcgagcagtctcagaaaagttgcagcacggtagggggcctcccacggctgggagtacggcacagtctcccggcgccggtgccgcttcaccggccggtaggggccatggaggagccgccggtgcaggacgcgcaggcgctgccctgcctgccgagctggcccacccagccgcagagtgtgttgaccccgccgtagtattcccatttcccgtgaacaagagagaacccgccccggtacccgcggcccctgcctctgctcccgctgcgggccctgccgtggctagcggtgcagggatagctgcaccggctggagcaccaggcgtggctcccccccgccccggcggcaggcagacctccggcggtgaccacaaggcattgagtactagcggcgaggatactctctccgattctgatgatgaggacgatgaggaggaagatgaggaagaggagatcgacgtggtgactgttgaaaagcggagatcttcgagcaacacaaaggccgtcacaacatttactattaccgtcaggccaaagaacgccgctttaggccctggccgcgcacagtctagcgagctcatcttaaaacgatgcctgccaattcaccagcaacacaattacgccgccccgagcccatacgtcgagagtgaagacgctcccccccagaagaaaataaagagcgaagccagccccaggcccctcaagagcgtcatacctccgaaggccaagagcttgagtcccaggaatagcgatagcgaggatagcgaaaggcgacggaaccataatattctcgagcggcagcgcaggaatgatttgaggtcaagttttctcaccttacgcgaccatgtgccagagttagtgaagaatgaaaaagccgcgaaggtcgtgatccttaagaaagcaacagagtatgtacactccttgcaggctgaggaacaccagctgctgctggaaaaggaaaagctgcaagctcggcagcagcagctgctaaagaaaattgaacatgcacggacatgctag

SEQ ID NO: 140518 - DNA, 1149 bp, Artificial Sequence
  Description of Artificial Sequence: Synthetic coding sequence
atgccttcatgttccactagcaccatgccgggcatgatttgtaagaaccccgacctcgagtttgattcactacagccatgtttctatcccgatgaggatgatttctatttcggtggacccgactctacacctcccggggaggacatttggaagaaattcgagcttcttccaacccctcccctgtcaccgtctcggggatttgccgagcattctagcgaacccccgtcttgggttactgaaatgcttcttgagaacgagttatggggatcccccgctgaggaggatgcgttcggcctgggaggtctcgggggtttgacaccaaatcctgtgatcctgcaagactgcatgtggtcaggtttctccgcaagagaaaagctggagagagcggtgagtgagaagctgcaacatggacgtggccctcccactgctgggtccaccgcacaaagtccgggtgtcgctccccctaggcccggtggccgacagacttccggaggcgaccataaagccctatcaacgtcaggagaggataccctgtcagatagtgatgatgaggacgatgaggaagaagatgaggaagaggagattgatgtggtgacagtggaaaagcggaggtcctcttccaacactaaggcagtaaccacctttacaatcaccgtgcgtcctaagaatgccgccctcgggcctggtagagctcaatccagcgaactcattctgaaaagatgtctacccattcaccagcagcataactatgcagccccctcgccctatgtggaaagcgaagacgcccccccacagaagaaaattaaatctgaagcctcgccgagacccctcaagagcgtgattcccccgaaagctaaaagcctgtccccacgtaatagtgatagtgaagatagtgagaggcgtcgaaatcataatatcctggaacgacagaggaggaatgacctgcggagtagttttctaaccctgagagatcacgttcccgaacttgtcaagaacgaaaaagccgccaaggtggtcattctcaagaaggccacagagtacgtccactcactgcaggccgaggaacatcagctgctattggagaaggagaagctgcaggctcgccaacagcagttgctaaaaaagatcgagcacgcgaggacgtgctag

SEQ ID NO: 140519 - DNA, 852 bp, Artificial Sequence
  Description of Artificial Sequence: Synthetic coding sequence
atggctgtgccaccaacctacgcagatcttggcaaatccgcaagggacgtgtttacaaaaggatacgggttcggactgatcaaacttgacttaaaaaccaagtccgagaatgggctcgagttcaccagttccggatccgctaatacagagaccacgaaagtgactggatctttggaaaccaagtaccgatggactgagtatggtttgaccttcactgagaagtggaataccgataacactctgggaacagaaattaccgtcgaggatcagcttgctagagggctgaagttgacattcgactctagtttttcaccaaatactggcaagaagaacgcaaagatcaaaaccggttacaaacgcgaacatatcaaccttggctgtgacatggattttgacattgcagggccatctattcgtggcgccctggttctgggatacgagggatggctggccggttatcagatgaattttgagacagccaagagtcgagttacacaatccaacttcgctgtcgggtacaagaccgacgagtttcagctgcatacaaacgtcaatgatggtaccgaatttggcggttctatctatcagaaagttaataagaagctggaaaccgcagtgaatttggcctggacagcaggaaacagtaatacaaggtttgggattgcggctaaatatcagatagacccggatgcctgcttttctgcaaaagtgaataattccagcctgattggactgggctacacccaaacgctaaagccaggcatcaagctcaccctttcggctctgctcgatggtaagaacgtcaatgccggcgggcataaacttggactcggcctggagttccaggcctag

SEQ ID NO: 140520 - DNA, 852 bp, Artificial Sequence
  Description of Artificial Sequence: Synthetic coding sequence
atggctgtgcctcccacatacgctgaccttggcaagagtgcacgggacgtattcaccaaagggtatggctttgggctcataaagctcgacctaaaaactaagtccgaaaatggcctagaattcacgagctcaggatctgccaacacggagacaacaaaggtaacggggagtctggagacaaaatacagatggaccgagtatggcttgaccttcaccgaaaaatggaacaccgataacaccctgggcacagaaattacagtcgaggatcagctcgcccgaggtttgaagctgacctttgactcttcgttttccccgaacacaggaaaaaaaaatgcgaaaattaaaacgggatacaaacgcgaacatataaatctgggatgtgatatggacttcgacatcgccggccccagtatccggggagcattggttttgggctatgaagggtggctcgctgggtaccagatgaacttcgagacagctaagagtagggttactcagtcgaatttcgcagtgggatataaaactgacgaattccagctgcacactaatgtaaatgacggtacagagtttggcgggagcatatatcagaaagtgaataaaaagctcgagacagccgttaatctcgcctggactgctggtaacagcaacacaagattcggcatcgccgctaagtatcagattgacccggatgcatgtttttctgcaaaagtgaacaactctagcctcatcggtctgggctacacacagaccctcaaaccaggaatcaagctcacgctgtcggcactgctggacggaaagaatgttaacgccggggggcataaactgggcctcggcctggaattccaggcctag

SEQ ID NO: 140521 - DNA, 852 bp, Artificial Sequence
  Description of Artificial Sequence: Synthetic coding sequence
atggccgtgcctccaacatatgctgacctggggaagtcggcaagagatgtgtttactaagggttatggcttcggcctgattaagctggatttaaagaccaagagtgagaatggcctggaattcaccagcagtggaagtgctaataccgagaccaccaaggtgactggatcattagaaactaaatacaggtggaccgagtatggtctgacttttactgaaaaatggaacacagataatactctggggacagagattacggtcgaggatcaattggctcgcggattgaaactgactttcgactcttccttcagcccaaacactggcaagaagaacgcgaagataaagaccgggtacaaacgcgagcacatcaacctgggctgcgacatggacttcgatatcgccggcccgtccatcaggggggctctggtgctggggtacgaaggatggttagccggctatcaaatgaactttgagacagctaaaagcagagtcacgcagtccaatttcgcggtgggctacaaaaccgatgaattccagttgcacactaacgtcaacgatggtacagagttcggtggctctatctaccagaaggtgaacaaaaaacttgaaactgcagtaaacctagcttggactgccggcaattcaaatacgcgcttcgggatcgccgcaaagtatcaaatcgatccagacgcctgctttagcgcaaaagttaacaactccagtctcatcggactgggctacactcaaacactaaagcccgggatcaagttaactctctctgccctgctcgacgggaaaaatgtcaatgcaggggggcacaagcttggcctggggctcgagttccaggcatag

SEQ ID NO: 140522 - DNA, 849 bp, Artificial Sequence
  Description of Artificial Sequence: Synthetic coding sequence
atggccactcatggccagacctgtgcacgacccatgtgtattccaccctcctacgcggatctagggaaggcagcccgtgatattttcaataaggggttcggctttggtctagttaaactggatgtcaagaccaagtcctgctctggggtggaattttcgaccagcggatcatccaacaccgatacaggcaaagtgaccggcaccctggaaaccaagtacaagtggtgtgaatacggactgacttttaccgagaaatggaacacagataatacgctgggaaccgagatcgctatcgaggaccaaatctgccagggtctcaaactcacattcgacacgacattctctcctaatactgggaagaagtcaggcaaaatcaagagcagctataagcgagaatgtatcaatcttggctgcgatgtggacttcgattttgccggcccagctatccatggttctgccgttttcggctacgagggttggctggctgggtatcagatgacgtttgacagcgccaagtccaaactcaccaggaacaattttgccgtgggatacagaaccggtgattttcagcttcatactaatgttaacgacggtaccgagtttgggggttctatctaccaaaaggtttgcgaagatctcgatacaagtgtgaatctggcgtggacaagcggcacgaactgcaccaggtttggcattgcagccaaataccagctggaccctaccgcatcaatctccgccaaagtgaataactctagcctgataggcgtcggttatacacagacgctgcgaccaggcgtgaaactaaccctgtctgctctggtggatgggaagagtattaacgccggatag

SEQ ID NO: 140523 - DNA, 930 bp, Artificial Sequence
  Description of Artificial Sequence: Synthetic coding sequence
atgagctggtgcaacgagttgagattgccggcccttaaacaacacagcatcgggcgcgggctggaatcccacattactatgtgcatcccccctagttatgctgacctagggaaggctgctcgggacatttttaataaggggtttggattcggcttggtcaaattagacgtgaagacgaaatcgtgcagcggtgtagaattctctactagtggctcctctaataccgacactggaaaggtgaccggcactctggaaaccaaatacaagtggtgtgaatacggactgaccttcacagaaaagtggaatacagacaatacactaggaacggagatcgcaatcgaagatcagatttgccaggggctcaagttgacatttgacaccactttcagcccaaatacaggtaaaaagtccgggaagattaagagcagctacaagcgtgagtgtatcaacttagggtgcgatgtggattttgactttgccggtccagctatacatggctccgcagtgtttgggtatgaaggttggctcgctggatatcagatgaccttcgactcagccaaaagcaaactcactcggaacaattttgcagttgggtatcggaccggggacttccagctccacactaacgtgaacgatggcaccgagtttggcggctccatttaccagaaggtgtgtgaggatctcgacacttccgtgaatttggcttggacatcaggcactaactgtactcgtttcggaatcgccgcgaagtaccaattggaccccaccgcctctatctccgcaaaggtgaataactcatctttgatcggtgtgggttacacacagaccctgaggcccggcgtcaagctcactctcagcgctcttgtggacggcaagtcaatcaacgctggcggacataaagtaggcctggcactcgaactcgaagcctag

SEQ ID NO: 140524 - DNA, 885 bp, Artificial Sequence
  Description of Artificial Sequence: Synthetic coding sequence
atggccacccacggtcagacatgcgccagacccatgtgtatcccccccagctacgctgaccttggtaaggcggccagggacattttcaataaggggtttggcttcgggcttgtcaagctagatgtcaagactaagagttgcagtggcgtggaattttccacttctgggtctagtaatactgacaccggcaaagtgacaggcacactggagacaaagtacaagtggtgcgagtatgggttgactttcacagagaagtggaacacagacaatacactgggaacagaaatcgccatagaagaccagatctgccaggggctgaagctgactttcgacacaaccttctctccgaacacagggaagaagtccggaaaaattaagagctcctataagcgcgagtgcattaacctcggatgtgacgtcgattttgatttcgccggcccagccatccacgggagcgctgtctttgggtacgagggctggcttgcgggctaccagatgacgtttgatagcgcaaagtcaaaattaacccgcaataactttgctgttggatataggactggggattttcagttgcacaccaacgtaaatgatggaaccgagtttggcggaagcatttaccagaaagtatgcgaagatttggacactagcgtaaacctggcatggacctcaggcacgaactgcacccggtttggaatcgccgctaaatatcagctagaccccaccgcaagcatatctgctaaggtcaacaattcatccttgattggcgtcggctacactcagacattacggccaggagttaaattgactttgtccgctctagtggacggtaagtcaataaacgccgggggtcataaagttggactggctctcgaactggaagcctag

SEQ ID NO: 140525 - DNA, 588 bp, Artificial Sequence
  Description of Artificial Sequence: Synthetic coding sequence
atggcgactcacggacaaacctgcgccaggcccatgtgtatcccgccatcctacgccgacttaggcaaagccgcaagagatatcttcaataagggcttcgggtttggcctggtgaaactggacgtcaagaccaagtcctgctccggggttgagttcagcacctccggctcctcaaatactgataccgggaaagtgacaggaaccctggaaacaaagtacaagtggtgtgagtatggtctcaccttcacagagaaatggaatacggataacactctgggaaccgaaattgctattgaggatcagatttgccagggattgaagctgaccttcgatactaccttctccccaaacactgggaaaaaatccgggaaaataaaaagctcatataagcgagaatgtattaaccttggatgtgacgtcgacttcgactttgcaggccctgcaattcatggtagcgctgtgttcgggtacgaaggctggttggctggataccagatgacttttgactcagccaagagcaagcttactcggaataattttgccgtagggtatcggacaggcgatttccagctgcacaccaacgtctag

SEQ ID NO: 140526 - DNA, 330 bp, Artificial Sequence
  Description of Artificial Sequence: Synthetic coding sequence
atgagttggtgcaacgaattgaggctgcccgctctcaaacagcacagcatcggccgcggcctggagagtcacattacaatgtgtatcccaccctcttacgctgacctgggtaaggccgcccgtgacatatttaataagggctttggatttgggctggtgaagttggacgtaaagaccaagagctgcagcggagttgaattttccacttcaggcagttcaaacacagataccggtaaagtcactggcactcttgaaaccaagtacaagtggtgtgagtacgggttgacctttacagagaaatggaacactgataacaccctcggcacctag

SEQ ID NO: 140527 - DNA, 615 bp, Artificial Sequence
  Description of Artificial Sequence: Synthetic coding sequence
atggccacccacggccaaacttgtgctcgccccatgtgtatccctccctcttatgcagacttggggaaggcagcaagagacatcttcaacaagggcttcggctttggcctagtgaagcttgacgttaaaaccaaatcctgttccggcgtagagttcagtacatccggttccagcaacacagacacgggaaaagtcactggcacactggaaaccaagtacaagtggtgcgaatacggcctgacgttcacagaaaaatggaatacagataacacgcttggcacagaaattgctatcgaagatcagatttgccagggccttaagctaacgtttgacacgacctttagtcctaacactggcaagaagtcggggaaaattaagtcctcttacaagagagaatgcataaacctaggttgcgacgtggactttgacttcgctgggccagccatccatgggtctgcagtcttcggatacgaagggtggttggccggctatcaaatgacatttgactccgctaagtccaagctgaccagaaacaattttgcagtggggtaccgcaccggtgatttccagctacacaccaacgtaaatgatggcaccgaatttggcggatcctag

SEQ ID NO: 140528 - DNA, 768 bp, Artificial Sequence
  Description of Artificial Sequence: Synthetic coding sequence
atgttggtaatccccgccacccaggaggctgaggagttttcaacctcgggctctagtaatactgacacgggcaaagtgacaggaacgctggaaacaaagtacaagtggtgcgaatacgggctgacgtttactgaaaagtggaatacagacaacactctgggcacagagatcgccattgaagatcagatctgccagggtctgaaactgacttttgatactacgttctcccctaataccggcaaaaaatcggggaaaatcaaatcttcatacaagcgcgaatgcatcaacctgggctgtgatgtagactttgattttgccggcccagccatacatggaagcgctgtcttcggctatgaaggatggctggccggctatcagatgacttttgattcagccaaatcgaagctgactagaaacaactttgcagtcgggtatagaaccggggatttccagctgcacacgaatgtgaacgacggcactgagttcggaggtagcatataccagaaagtctgcgaggatctagacacatcagtgaacctggcttggacttccggcactaattgcacccggtttggtatagctgcaaagtatcaactggaccctacggccagcattagcgcaaaggtcaataactcttcactgattggggtcggatacacacagaccctgaggcctggggtgaaactgacgttgtctgctttggtggatggaaaaagtatcaacgctgggggccacaaggtaggcctggctctggaactggaggcgtag

SEQ ID NO: 140529 - DNA, 885 bp, Artificial Sequence
  Description of Artificial Sequence: Synthetic coding sequence
atggccactcacggccaaacctgcgctcggccaatgtgtataccgccatcttatgccgacctgggtaaagctgcacgggatattttcaacaagggcttcgggtttggcctggttaaactcgatgtcaaaacaaaatcttgtagcggtgtggagtttagcaccagtgggtcatccaatacagacactgggaaagtcactggtactctggagactaagtacaaatggtgcgagtacgggctgacctttacggaaaagtggaacacagataacacattgggcaccgaaatcgccatagaggatcaaatttgccagggcctaaagctgacattcgataccacattctccccaaacaccggaaagaagtctggtaaaattaagtcctcctataaacgcgagtgcattaacctaggttgtgatgttgacttcgattttgctggacccgctattcacggatcagcggtctttgggtacgaggggtggctggctggataccagatgacttttgactcagccaaatcgaagctgactaggaacaactttgcagtgggatataggaccggcgattttcaattgcatacaaatgttaacgacggcactgagtttggaggatccatctatcagaaagtatgtgaggatctcgataccagcgtgaatttagcatggacttctgggactaactgtaccagatttggaatagctgccaagtaccagctcgacccaactgcatctattagtgccaaagtcaacaattccagcctcatcggagtcgggtacacccagactctgaggcctggagtgaagctgacactgagcgcccttgtggacggtaaatctattaatgctgggggacacaaagtagggttggctctcgaacttgaggcatag

SEQ ID NO: 140530 - DNA, 852 bp, Artificial Sequence
  Description of Artificial Sequence: Synthetic coding sequence
atgtgtaacactccaacctattgcgaccttggcaaggccgccaaagacgtcttcaataagggctacgggtttgggatggtgaaaatagacctgaaaactaagtcatgttcaggtgttgaattctctacgtcaggtcacgcttacacagacaccggcaaggcctccggtaatttggagacaaagtacaaggtctgtaattacgggctgaccttcacgcaaaagtggaataccgacaatacgctcggcacagagattagctgggagaacaagttggcagaagggctcaaactaaccctggacaccattttcgtcccaaatacgggcaagaagagtggtaaactgaaagcctcttacaagcgcgactgcttctcagtgggatctaacgttgatattgacttctccgggccaactatctatggctgggcggtcctggcatttgagggttggcttgcaggctatcaaatgagctttgacaccgccaaatccaagcttagccagaacaattttgccctggggtacaaagcagctgatttccagctgcacacacacgtgaatgacggaactgagttcggaggatctatttatcagaaagtaaacgagaaaattgagacaagtatcaatcttgcttggactgcaggctccaataacacaagattcggcattgcagccaagtatatgctggactgccgcactagtctaagcgccaaagttaataatgctagcctgattggcctgggctacacacagacgctgagaccaggagtgaaactgacccttagtgccttaattgatggaaagaacttttccgcgggcggccacaaagttggattgggattcgagctggaggcatag

SEQ ID NO: 140531 - DNA, 855 bp, Artificial Sequence
  Description of Artificial Sequence: Synthetic coding sequence
atgtgtaataccccgacttactgcgacctgggcaaggccgctaaggatgtattcaataaaggctatgggttcggcatggtcaagatcgatcttaaaactaagtcttgttctggtgttgtggagtttagcacgagcggccatgcatatacagacaccggtaaggctagtgggaatctggaaactaagtataaagtctgcaattacggactgacctttacgcagaagtggaacactgacaacaccttggggaccgaaatttcctgggaaaataagttggctgaggggcttaaactgaccttagacactatcttcgttccaaacacgggaaagaaatcaggaaagctaaaggctagctacaaacgagattgctttagcgtgggttctaatgtggacattgacttctccgggcccacaatttacggctgggccgtactggcctttgaaggctggttagccggttaccagatgtctttcgataccgccaaaagtaagctctcgcagaacaactttgccctggggtacaaagcagctgattttcaactgcacacacacgtaaacgacggtactgaatttggtggaagtatttatcagaaggttaatgaaaagattgaaacatcaattaatttggcctggacagcgggaagcaataacaccagattcggtattgcggcaaagtacatgttagattgccgaactagtctgtcagccaaggttaacaatgcatcgctcatcggcctgggctacacgcaaaccctgcggcctggcgtgaagctcaccctgtccgctttgatcgacggcaaaaatttcagcgccggtgggcacaaggtcggattggggttcgaacttgaggcctag

SEQ ID NO: 140532 - DNA, 498 bp, Artificial Sequence
  Description of Artificial Sequence: Synthetic coding sequence
atgtgtaatacccctacatactgtgatttaggaaaggccgctaaagacgtatttaacaaaggttacgggttcggtatggtgaaaatcgatctcaaaacaaaaagttgttccggtgtggaattttctacttcagggcatgcctatacggataccggaaaggcttctggcaaccttgaaacgaaatataaggtctgtaattacggactgacattcacgcagaaatggaatacggataacaccctaggaacagagatctcttgggagaacaaattggcagagggactaaaacttaccctggatactatttttgtccctaacactggaaagaaatccggaaagttgaaggctagctacaaacgcgattgcttcagcgtaggaagcaatgtcgacattgatttcagcggtcctacaatatatggatgggctgtcctcgccttcgagggctggcttgccgggtaccaaatgagctttgacaccgccaagtcaaagctgagctag

SEQ ID NO: 140533 - DNA, 855 bp, Artificial Sequence
  Description of Artificial Sequence: Synthetic coding sequence
atgtgtaacactcctacttactgcgatctggggaaggctgcaaaagacgttttcaataagggctacggcttcggaatggtcaagatcgatctgaagactaagtcttgcagcggtgtgatggagttttcaacgtccggacacgcatacacggacaccggcaaagcttctggcaatttagagacgaaatataaggtgtgcaattacggcctaacattcacccagaaatggaacaccgacaacacccttggaaccgaaattagctgggagaacaaattagccgagggcctgaagttgacgctcgatactatttttgtgccaaatactggaaagaagtccggaaagctgaaggcttcctataaacgcgattgcttctccgtaggcagtaatgtggatattgacttcagcgggcccaccatatacgggtgggctgtgttggcttttgaggggtggctggcagggtatcagatgtccttcgatacggctaagtcaaagctcagtcagaataactttgctctcgggtataaggcagctgattttcagctacacacccatgtcaatgacggcaccgagtttgggggctccatataccagaaagtgaacgaaaagatcgaaacctccattaacctggcatggacggcaggtagcaataacaccagattcggcatcgccgctaagtatatgttggattgtagaacgagtctatctgccaaggttaacaatgcctctctcattgggctgggatatactcaaacactgaggccgggagtgaagcttacgctcagtgctcttatcgatgggaagaactttagcgccggcggacataaggtgggactcggttttgagttggaagcctag

SEQ ID NO: 140534 - DNA, 480 bp, Artificial Sequence
  Description of Artificial Sequence: Synthetic coding sequence
atgtgtaacacccccacatactgcgatttaggcaaggcagctaaggacgtcttcaataagggatatggttttgggatggtaaaaattgatctcaagaccaaatcttgtagtggtgttgagttcagtacatccgggcatgcatacacagacacaggcaaggcgagcggaaaccttgaaactaaatacaaggtttgtaattacggcttgactttcactcaaaaatggaataccgacaacaccctcggcaccgagatttcttgggagaataagttggcggaggggctcaaactcacacttgacactatcttcgtgcccaatacaggaaagaaatccggcaagctgaaggcgtcatataagagagactgcttttcagtagggagcaatgtcgacatagacttttctggccccactatttacgggtgggctgtgctggcgtttgaggggtggttggccggatatcagatgagtttcgacacctag

SEQ ID NO: 140535 - DNA, 1062 bp, Artificial Sequence
  Description of Artificial Sequence: Synthetic coding sequence
atggttggtgatacgctgaaattgttgagcccattaatgacacgctacttttttttgttgttctattcaaccgactcttccgacctgaacgagaatcagcatccattggacttcgacgaaatggcctttggcaaggtgaaatccggaatttcctttctgatccaaactggggtgggcatactggggaactcttttctcctgtgtttttataatctgatacttttcacaggtcataaactgcgccccaccgacctgatcctgtcacaactcgcgctggctaactccatggttctattctttaagggtatcccccaaacaatggctgccttcgggctcaagtacctactgaatgatactggatgtaagttcgttttctactatcacagggtgggtactagggtgtccctgtctacaatttgtcttctcaacggattccaagccatcaaactgaatcccagcatctgtaggtggatggaaattaaaattaggagtccacgatttatcgatttctgctgtttgctgtgctgggccccacatgtcctcatgaacgcgtccgtccttctgcttgtgaacgggcctttgaacagcaaaaactcctcagctaaaaataattacggctactgttcatataaggctagtaagaggttctcttccttgcatgccgttttgtacttctcaccagacttcatgtctctgggattcatggtctgggccagcggcagcatggtcttctttctgtacagacataagcagcaagtccagcataaccacagtaaccgtctctcttgtaggcctagccaagaggcacgagctacccacacaatcatggtcctggtttccagctttttcgtcttttactcagtgcactcattcctaactatttggaccaccgtggtggccaatcctggacagtggattgttaccaactccgtgctggtcgcaagttgttttccagccagatccccatttgtgcttatcatgtctgatacccacatttcccagttctgtttcgcttgtagaacacgtaaaacattatttccgaatctggtggtgatgccttag

SEQ ID NO: 140536 - DNA, 594 bp, Artificial Sequence
  Description of Artificial Sequence: Synthetic coding sequence
atggcagccgtcaaggacagctgcgggaagggcgagatggcaactggaaacggcaggcgcctccacttaggaatccccgaggctgtgtttgttgaagatgtagactccttcatgaagcagccaggtaacgaaaccgccgacactgtcttaaagaaattagacgagcagtatcagaagtacaaatttatggagctgaacctggctcagaagaagagaagacttaaggggcagattcctgagattaagcagacactggagatcctgaaatacatgcagaagaagaaagagtctacaaatagtatggaaacgaggtttttgctcgccgacaacttgtattgcaaagcttcggtccctccaacagacaagatgtgtctgtggttgggcgcgaatgtgatgttggagtacgatatcgacgaggcccaggctttgctcgaaaagaacctctccacggccactaagaatctggacagcctagaagaagatctggactttctgcgggatcagttcaccactactgaggtcaatatggccagggtctataattgggacgtcaaacggcggaacaaggatgactccacgaagaacaaggcgtag

SEQ ID NO: 140537 - DNA, 579 bp, Artificial Sequence
  Description of Artificial Sequence: Synthetic coding sequence
atggcgccacagccaatgatccatacacagcagggtctgcgaaccagctccccctcaacaccgagcccagagcaccaggaggacgttgatagcttcatgaagcaacctggaaatgaaactgctgatacagtcctcaaaaagctggatgagcagtatcagaagtacaaattcatggagcttaatctagcccagaaaaagcggcgtctaaagggtcagattcccgaaatcaagcagacgcttgagatcctgaagtacatgcaaaagaaaaaggaatcaaccaacagcatggagacccgctttctcctggctgataatctatattgcaaggcatctgtgcccccaacagataaaatgtgcctgtggctgggcgctaatgtgatgttggagtacgatattgatgaggcccaggcccttctcgaaaaaaatttgagtactgccacaaaaaacctcgattcactcgaggaggaccttgattttttgcgggaccagttcacgacgaccgaggtgaacatggctagggtatacaactgggacgtgaagagacgcaacaaagacgattctaccaagaacaaggcatag

SEQ ID NO: 140538 - DNA, 702 bp, Artificial Sequence
  Description of Artificial Sequence: Synthetic coding sequence
atgcggccacagcagctgcacgcgactgagatcacaagcagtggttttaggctcgcctggcctcctctgctcacagctgattctggctattatgttctggaattggtgccgagtgcgcagcctggggcagcacgacgccagcagttgccaggtaacgccaccgattggatctgggccggtctcgatcctgacaccgattacgatgtggctctggtgccagagtccaacgtgcggctgttgcgcccccaaatactgcgcgtgcgaacccggccaggcgaagccggccccggggcttcggggcctgaatcaggggccggtccggctcccactcagcttgccgcccttccagcaccagaggaagccggacccgaacgaatagtgatttcacatgcccgccctagaagcctgagagtgagttgggcccctgcgctcgggagtgccgccgcgcttggctaccacgtgcagttcgggccgctgagagggggggaagctcagagggtggaggtcccagccggaagaaactgcacgactctacagggcctggctcccgggaccgcgtacttggtcaccgtcaccgcagcatttcgttcgggccgcgagtccgccttgtctgccaaagcctgcacacccgacggaccacgacctcgcccaagaccagttccgagggcacccacacccgggaccgcttctagagaaccgtag

SEQ ID NO: 140539 - DNA, 1338 bp, Artificial Sequence
  Description of Artificial Sequence: Synthetic coding sequence
atgttaccatggacagctctggggttggcactgagcctgcggctggccctggcccgcagtggcgctgaaaggggccctccagctagcgcccctaggggggatctgatgtttctgctggactctagcgctagtgtgtctcattacgaattttcacgcgtgagggaattcgtgggacagctcgtagctccgctccccctgggcacgggagctctgagagcctccctggtgcacgtcgggagcaggccctatacagagtttccttttggtcaacattcatccggagaagccgctcaagacgcagttcgggcttctgcccagagaatgggagacactcacaccggcctagccctcgtgtatgccaaagagcagcttttcgcagaagctagtggcgctagaccgggtgttcccaaggtgctcgtgtgggtgaccgatgggggtagtagtgatccggtgggcccgccaatgcaagagctgaaggacctaggcgtgactgttttcatagtctccacaggacgaggcaactttctggaactgagcgcagccgccagcgcccccgcagagaagcacctgcacttcgtggacgtggatgacctgcacattatagtacaggaactacggggaagcatcctggatgctatgcgtcctcagcagctgcatgcaacagaaatcacctctagcggcttccggcttgcatggcctccactcctcacagcggactccggttattatgttcttgagcttgtacccagcgcacagcctggagctgccaggagacagcagttaccaggcaatgctacagactggatttgggccggtctggaccctgataccgattacgacgttgctctggtccctgaaagcaacgtccggttacttaggcctcagatcctgagggtccggacacgaccgggggaggcggggccaggtgcctccggccctgaatcgggcgcaggcccggcgccgactcagcttgccgcgctgccggcccccgaggaagcggggcccgaacggattgttatcagccacgcccgtccccgctctcttcgggtgtcttgggcccccgcattggggtctgcggccgctctgggctatcatgtacaatttggtcccttgcgggggggagaggcccagcgcgttgaagtgcctgccggaaggaactgtactacgctgcaaggacttgcaccgggcaccgcctatctggtgaccgtaaccgcagcttttcgctccggcagagagagcgctctctcagcgaaggcatgcactccggacgggccccgccccagacccagaccggtgccaagggcccccacgcccggaaccgctagtagggagccatag

SEQ ID NO: 140540 - DNA, 195 bp, Artificial Sequence
  Description of Artificial Sequence: Synthetic coding sequence
atgttgccttggaccgccttaggtcttgccctcagtctacgcttggctctcgccaggtccggagctgaacgtggggcacagggcccagggaggcatagggtccactgtcaacaccgcccacggcagctgcccggggccgtcagtaggtgtctatctccgtgccgtgaggcgccagctctgtgtggacggggatag

SEQ ID NO: 140541 - DNA, 978 bp, Artificial Sequence
  Description of Artificial Sequence: Synthetic coding sequence
atgcccagctcaacagcaatggctgtgggcgctctatccagcagcctccttgttacttgttgcctgatggtggccctctgcagcccctccatcccccttgagaaacttgctcaggcaccagaacagccaggccaagaaaaacgggaacatgcttctcgagatgggcctggacgggttaatgaactgggtcgcccagctagagacgagggcggtagcggcagagactggaaaagtaaatcgggacgtggcttggccggtcgcgagccctggtcaaaactgaagcaggcatgggtgtctcaaggaggcggggccaaggcaggcgatctgcaggtgcggccgcgcggggacacaccacaggctgaggccctggccgcggccgctcaagacgcgatcggtccagagttggcacctacaccagagccacctgaagagtacgtatatcctgactaccgggggaaagggtgcgttgacgagagtggtttcgtgtatgccattggcgagaagttcgcacccgggccatccgcatgcccctgtctgtgcacagaggaaggccccctctgtgctcagcctgagtgcccaaggctccacccgaggtgcattcacgttgacaccagtcagtgctgccctcagtgcaaggagaggaagaattactgcgaattcagaggaaagacttatcagacactggaagaatttgttgtgagcccgtgcgagaggtgccggtgtgaggctaatggggaagtcctctgtaccgtatccgcttgcccccagaccgagtgtgtcgacccggtctacgagccagaccaatgctgccccatctgtaaaaatggccccaactgcttcgctgagacagcagttattccggccgggcgcgaggtgaagactgacgagtgcactatctgccactgcacatacgaagaggggacctggcgcattgagcggcaagctatgtgcaccaggcacgaatgtagacagatgtag

SEQ ID NO: 140542 - DNA, 750 bp, Artificial Sequence
  Description of Artificial Sequence: Synthetic coding sequence
atgacatctgaaactctgtggtggctcattaccttaaagaagcagctgggggataacgaggccattacacaggaaatcgtggggtgcgctcacttggagaattacgctctgaagatgtttctgtatgcggacaacgaagatagggcaggtaggtttcacaaaaatatgatcaagagcttctacacagcctcactcctgatcgacgtcattactgttttcggcgagttgaccgacgaaaacgttaaacaccgcaaatacgcccggtggaaagcgacatacatccataattgcttaaagaatggcgaaactccccaagccgggcctgtcgggatcgaggaagataacgatattgaagagaacgaggatgcgggtgcagcctcactgcccacccagccaacccagccttcttcttcctccacttatgacccttcaaacatgcccagtgggaattacacaggcattcagatcccccctggcgcccacgcgcccgctaatacccctgccgaagtacctcactcaacgggagtcgcctccaataccatacaacccacaccccaaaccatccctgcaattgaccccgccctgttcaataccatcagccagggagacgtgcggcttactccggaagactttgctagggcccagaagtactgtaagtacgccggcagcgcactgcagtatgaagacgtcagcacagctgtccagaatttacaaaaggccctcaaattgttgactacgggccgcgagtag

SEQ ID NO: 140543 - DNA, 924 bp, Artificial Sequence
  Description of Artificial Sequence: Synthetic coding sequence
atggctgcacttgccccacttcctcccctgccagcccagtttaagtcgatccaacaccacctgaggaccgcccaagagcacgataagcgcgatccagtggtggcctactactgcagactatacgccatgcagaccggcatgaaaatcgactctaagacaccggagtgtcggaagtttctcagcaagctgatggaccagctagaggcgttgaaaaaacagctgggcgacaacgaggccatcactcaggagatcgtggggtgtgcccacctagagaactacgccctcaaaatgtttctatatgccgacaacgaggatagggccggccgctttcataagaacatgattaagtctttttacacagcctctctcctgatagacgtcatcacagtgtttggggagctaaccgacgagaacgtcaagcaccgaaagtacgcacgctggaaggcgacatacattcacaactgcctgaagaacggagaaacgccgcaggccggcccagtgggcatagaggaagataatgacattgaggagaacgaggacgctggcgccgctagcctccctactcagccaactcaacctagcagctcgtccacctatgacccctccaacatgccatccgggaactacactggaattcagatcccccccggcgctcatgcccctgccaacaccccagccgaggtgccgcacagcaccggcgtcgctagcaacaccatccagccaacccctcaaaccatcccagcaatcgaccccgctctttttaacacgattagtcagggcgatgttcggttaactcctgaggatttcgctagagctcagaagtactgcaaatacgctgggtctgcgctgcagtacgaggacgtcagcacagcagtccagaacttgcagaaggctcttaaacttctcacaaccggtcgagaatag

SEQ ID NO: 140544 - DNA, 663 bp, Artificial Sequence
  Description of Artificial Sequence: Synthetic coding sequence
gaaatggccgccctggcacccctcccccctctgcccgctcagttcaaaagtattcagcatcacctgcgaacagctcaggagcacgacaaacgtgatcctgtcgtggcttattactgccgcttgtacgctatgcaaactgggatgaaaatcgattctaagaccccagagtgcaggaagttcttaagcaaactgatggaccagttagaggccctgaagaagcagctgggagataacgaggcgatcactcaggagatcgttggttgcgctcatctggagaactacgctttgaaaatgttcctctacgcggacaacgaagaccgggcagggcgctttcataaaaatatgattaaatccttctacacggcctctttgctgattgacgtcataactgtgtttggagagctcaccgacgaaaatgtcaaacaccggaaatacgcccgctggaaagctacatacattcacaactgtaaggaatggggcgacagctcttccaggccatgctggctgaagaaaattatgatcctcaaaaagatgaaaatgttggagcagcccctatgccccttgagtcaactgtcccaccatcacctccagctaatgactcagcacgccattcggcagctgtattggaacaccgactcatccggctgtaccagatcaagttag

SEQ ID NO: 140545 - DNA, 669 bp, Artificial Sequence
  Description of Artificial Sequence: Synthetic coding sequence
atgacttccgaaacactatggtggctgattacccttaaaaagcagttgggggacaatgaagccataacgcaggagatcgttggatgtgcacacctggagaactatgcactgaagatgtttctctatgccgataacgaagacagggccggaaggtttcacaagaatatgataaaaagcttttatactgcgtcccttttgattgatgtcattacggtgttcggagaactgaccgacgaaaatgtgaagcaccggaagtacgctcggtggaaggctacctatattcacaactgtctgaagaatggtgagactccacaggccgggcctgttggtattgaagaggacaatgacatagaagagaacgaagacgctggcgccgccagcctgccaacacagccaacacagcctagcagttctagcacatacgatccgtctaatatgccttctgggaattacactggtattcagatcccccccggtgcccacgcccctgctaatacacccgctgaggtgccccatagcacaggggatgtgcgactgacacccgaggatttcgctcgggcgcagaagtattgcaagtatgcaggtagcgcactgcaatacgaagacgtgtctaccgccgtccagaacctgcagaaggcgcttaagctcctcacaacgggtcgcgagtag

SEQ ID NO: 140546 - DNA, 621 bp, Artificial Sequence
  Description of Artificial Sequence: Synthetic coding sequence
atggctgccaataaacctaaagggcagaattctttggcactccataaagtcattatggtaggaagtggcggcgtgggcaagtcagccttgactctccagttcatgtacgatgagttcgtagaagactatgaacccacaaaggcggactcctaccgtaagaaggtggtgctagacggcgaagaggtccaaatagatatcttggacacggcggggcaggaggattatgctgctatcagggataactactttaggtccggtgagggatttttgtgcgtgttttccatcacagaaatggaatctttcgccgctaccgccgattttcgcgagcagattctgcgagtgaaagaagatgagaacgtgcccttcttactggtgggcaacaagagtgatctggaggacaagaggcaggtgtctgtcgaagaagcgaagaatcgagccgagcagtggaacgtgaattacgtggagactagcgccaaaactcgcgccaatgttgataaagtgttttttgacctgatgagggaaattagggctcgaaagatggaagactccaaagagaagaatgggaaaaaaaaacggaaaagtctagccaagcgtatacgggagaggtgttgcattctgtag

SEQ ID NO: 140547 - DNA, 306 bp, Artificial Sequence
  Description of Artificial Sequence: Synthetic coding sequence
atggccgctaacaagccaaagggccagaactcactcgcgctccacaaggtgattatggtaggctctgggggcgtggggaagagtgcattgaccctgcagttcatgtatgatgagttcgtggaggactacgaacccactaaagccgactcttacagaaagaaggtggtgctggacggggaggaagtccaaatcgatatcctagacactgccggccaggaggactatgcagctataagggacaattatttccgctctggtgaaggcttcttgtgcgtgttctccatcaccgagatggagtccttttag

SEQ ID NO: 140548 - DNA, 621 bp, Artificial Sequence
  Description of Artificial Sequence: Synthetic coding sequence
atggcagcaaataagtcaaagggccagagcagcctggctcttcacaaggtgatcatggtggggagcggaggagtgggaaaaagcgcccttacgcttcaattcatgtacgacgagtttgtagaggattacgagccgacaaaggccgattcatatcgtaaaaaggtggtcctggacggcgaagaggtgcagatcgatatccttgatactgccggccaagaagactatgctgctattcgcgataattatttcagatccggcgagggatttctgctagtattcagtattacggaacatgagagtttcacagcgaccgctgagttccgcgaacagattctcagagtgaaagccgaagaggacaaaattcctctactggtggtcggcaacaagtccgacttagaagaacgtaggcaagtgcctgttgaagaggccagatctaaagccgaagagtggggagttcagtacgtggagacttcagctaagacccgcgccaacgttgacaaagtgttctttgacctcatgcgcgaaattagaaccaagaaaatgtcagagaacaaagacaagaacggcaagaagagtagcaagaacaagaagtcattcaaggagcggtgttgcttattgtag

SEQ ID NO: 140549 - DNA, 684 bp, Artificial Sequence
  Description of Artificial Sequence: Synthetic coding sequence
atggctgcaaacaagtccaagggacagtctagtcttgcactgcacaaagtcatcatggtaggtagtggtggtgttggaaagtctgcactcactcttcagtttatgaacgtgtctaaatctttagcctacgacaagaagaaatatactgcaaataagaaggtggaaggcatcctggaattcgtggaagactacgaacccaccaaagccgactcttaccggaagaaggttgtgctggatggggaagaggtccagatagacatcctcgacactgccggccaggaggattacgccgcgattcgtgataattactttcgtagcggggaagggttccttctggtgttcagcattactgaacatgaatctttcactgccacagctgaatttcgcgagcaaatcctgagagtaaaggctgaagaagacaaaataccattgcttgtagtaggaaataagagcgaccttgaggagcgtaggcaggtgcctgtcgaggaggcaaggtctaaagcagaagagtggggcgtgcaatacgtggaaacatccgctaagacccgcgccaacgtggacaaggtcttcttcgaccttatgagagaaataaggacgaagaaaatgtccgagaataaggacaaaaacggaaagaaatcttcaaagaacaagaaaagcttcaaggagcgctgttgcttgctctag

SEQ ID NO: 140550 - DNA, 504 bp, Artificial Sequence
  Description of Artificial Sequence: Synthetic coding sequence
atggctgcaaacaaatctaaagggcagtcatcattggccttgcataaagtgatcatggtcggtagtggtggcgtagggaagtcagccctcactctgcagttcatgtatgacgaattcgtggaggattacgagcccacaaaggcggacagctatagaaaaaaggtggttctcgatggagaggaggtgcaaattgacatcctggatactgccggacaagaggactacgccgcaatcagggataactactttcgctccggcgaaggatttttacttgttttcagtatcacagagcatgaaagttttaccgcgacggctgagtttcgggagcaaatcctgcgagtgaaggcagaagaggacaaaatccccctgctggtggtggggaataaaagcgacctggaggagcgacggcaagtgcctgtcgaagaagcccgctccaaggctgaagagtggggcgttcagtacgtggagacatctgcgaagacgagggcaaacgtggacaaatag

SEQ ID NO: 140551 - DNA, 621 bp, Artificial Sequence
  Description of Artificial Sequence: Synthetic coding sequence
atggcagccaacaagagtaagggccagtcctctcttgcgctccacaaagtcattatggtcgggagcgggggcgtaggcaaaagtgccctgactctgcaatttatgtacgacgagttcgtagaggattatgaaccaacaaaggccgatagctataggaaaaaagtggtgctggatggggaggaagtgcagatcgacattctcgataccgccggccaggaggattacgctgccattagagacaactacttccggagtggggaaggctttcttctggtgttctccatcaccgaacatgagtcctttaccgccaccgctgagtttagggaacagatcttgcgcgtgaaagccgaggaggataagattccgcttctggtggtgggtaataagtccgatttggaggaaaggagacaagtgcctgttgaagaggcccgcagcaaggccgaggaatggggcgtgcagtatgtggaaactagtgcgaagaccagagccaatgtggataaagtgttcttcgacctgatgagagagattcgcacaaagaagatgagcgaaaataaggataagaatggaaaaaagagcagcaagaacaaaaaatcttttaaggagcgatgctgcttattatag

SEQ ID NO: 140552 - DNA, 687 bp, Artificial Sequence
  Description of Artificial Sequence: Synthetic coding sequence
atgaaacagcgccagagcgcgctgcagtgggttatttgtgtgtcacaaccccagaaaacatctgagatggccgcgaacaaaagtaaaggccaatccagtctggctctacataaagtaatcatggtcgggtctggcggtgtgggcaaatctgccttgactcttcagttcatgtacgacgagtttgtcgaggattatgagccaacgaaagctgacagctacaggaagaaggtggttcttgatggcgaggaggtgcagattgacatcctggatacagctggccaggaagattacgccgccatccgagataactatttccgctccggggaggggttcttgctggtgttctctattaccgagcatgagagcttcactgcaaccgcggagttcagagagcaaatattgcgcgtgaaggcagaggaagacaagatccccctcctcgtggtcgggaacaagagcgatctggaagagcggcgtcaagtgccggttgaagaggctcgttccaaagccgaagaatggggagttcagtacgtggagacctccgccaagactagggccaacgttgataaagtgtttttcgatctgatgagggaaatccggacaaaaaagatgagtgagaacaaagacaagaatgggaagaaatcttctaaaaataagaagtcctttaaagagcggtgctgcttgctgtag

SEQ ID NO: 140553 - DNA, 1860 bp, Artificial Sequence
  Description of Artificial Sequence: Synthetic coding sequence
atggcaagcggtgcttacaacccctacatcgaaatcattgagcagccccgccagcggggaatgcggtttcggtataagtgtgaggggcgatctgcgggctccatacctggcgagcatagtaccgataacaataggacctacccatcaatccaaatcatgaattactatgggaaaggcaaggtccgtattacattggttaccaagaatgacccatataagcctcatcctcacgatctagtgggtaaggactgtcgcgacggatactacgaggctgagttcggccaagaaaggcgacctctgttttttcaaaacttaggcattcgctgtgtaaagaaaaaagaggtgaaagaagcaattatcactcggatcaaggccggaattaaccctttcaatgtcccggagaagcagttgaatgatattgaagactgtgatttaaatgtcgtgagattgtgctttcaggtttttctgccggatgagcatggcaatctgacgactgctctgcctccagtggtgagtaatccaatctacgacaatagggcacctaataccgcagagttgagaatctgtcgggtgaataagaattgtggctcggtgaggggcggtgatgaaatctttcttctgtgtgacaaagtgcagaaagatgacatcgaagtgaggtttgttctgaacgattgggaagctaaaggaattttctcgcaggcagacgtgcatcggcaggttgcgatagtctttaagacaccaccctattgcaaagctattaccgagcccgtgacagtgaaaatgcaactcagaaggccatctgatcaggaggtgtctgagagcatggactttagatatctgcccgatgaaaaggacacttatggcaacaaagcgaaaaaacagaagacgactctcctttttcagaaattgtgccaagaccacgtggaaactggttttagacacgtggatcaggacggattggaactcctaacctctggagatcctcctacactggctagccagtccgccggaattacagtgaactttccagagaggccccgacccggactgcttggttccatcggcgaaggccgctatttcaagaaagaacctaacctgttcagtcacgatgcggtcgttcgcgagatgcctactggtgtgtcctctcaggccgaaagctattacccgtcgcccggccctatttcctccggtctcagccatcatgctagtatggccccgctgccctcatcatcttggtcttctgtggcacaccctaccccgagatctggaaataccaacccattatcaagctttagtacccggacgttgccctcaaactcccagggcattccacccttcctccgcattccggtgggcaacgacctaaacgccagcaacgcgtgcatttacaacaatgcagatgatatcgtcggaatggaagcctcatctatgccgtctgccgatctctatggaatcagcgatccaaacatgctgtctaactgcagtgtgaatatgatgacgacctcatctgactcaatgggcgagacggataatccaaggctcttgtcaatgaatcttgagaaccccagctgcaacagtgtcctagatcccagagatctacgtcagctgcaccagatgtcatccagctccatgtcagctggggctaattcaaatactaccgtgtttgtttcccagtccgacgcttttgaaggcagcgatttttcttgcgctgacaattcaatgatcaatgagtcgggaccttcaaactctaccaatcccaactcccacggatttgtacaagatagccaatactccggtatcggtagtatgcagaacgaacaactctctgattctttcccttacgaatttttccaagtttag

SEQ ID NO: 140554 - DNA, 1764 bp, Artificial Sequence
  Description of Artificial Sequence: Synthetic coding sequence
atggctagcggtgcttataacccttatatcgagatcatcgagcagccaaggcagcgcggaatgcggtttcgatacaagtgtgaggggaggagcgccggcagtatcccgggtgagcactcgacagataacaatcggacttatccttccatccagatcatgaattattacgggaaaggcaaggttagaatcactctggtcaccaagaatgacccgtataagcctcaccctcacgatttggtcggcaaagattgtcgtgacgggtactatgaggctgagttcggtcaggaaagacggcccttatttttccagaatctcggcatccgctgcgtgaagaaaaaagaagtgaaagaagcaattatcactcggatcaaagcaggcataaatccattcaacgtccccgagaagcaattaaatgacattgaggactgcgacctgaatgtcgttaggctctgcttccaggtatttcttccagatgagcacggaaatctaaccaccgcattacctcctgtcgtgtcaaatcctatctacgataatcgagccccaaacactgcggaactgcgtatttgccgagtaaataagaactgcggcagcgtcaggggaggagacgagatatttctcctctgtgataaagttcagaaagatgatattgaagtacggtttgtgcttaacgactgggaggccaaggggatctttagtcaggcagatgtgcataggcaggttgccatagttttcaaaacccccccgtattgtaaggcaatcacagaacctgtcacagttaagatgcagttgcgtcggcccagcgaccaggaagtgtcagagtctatggacttccggtatttacccgatgaaaaagatacatacggcaataaagccaagaaacagaagacgactcttctatttcagaagctgtgccaggaccatgtgaattttccggagcgccctaggcccggtcttttgggatcaataggtgagggtcgatactttaagaaagagccgaatctcttcagccacgacgctgttgttcgcgagatgcccaccggcgtgagcagccaggccgagtcttattaccctagccctggccccatcagtagcggtctgtcccatcacgcatcgatggccccgttgccttccagttcttggtcgagcgtggctcaccccactccacgctcaggtaacacaaacccactcagcagcttctcgacaaggactctgccatccaacagccagggaatcccacctttcctcaggatacctgtgggtaacgatctcaacgcatcaaatgcttgcatttacaacaatgctgacgacattgttgggatggaggcttctagcatgccttccgccgatctgtacggcatatccgaccctaacatgctgagcaattgctctgtgaacatgatgacgacttctagtgattctatgggagagacggataaccccaggcttctttcaatgaacctcgagaaccccagttgcaattcagtgcttgatcctagggacttacggcagcttcatcagatgagttcatcttctatgagcgcaggcgcgaactctaacacaaccgtattcgttagtcagagcgacgcatttgagggctcagatttctcttgtgctgacaatagcatgattaatgaatccgggccctccaacagcaccaatcctaactcccacgggtttgtgcaggactctcagtattcgggaattgggagtatgcaaaatgagcagctgagcgacagcttcccatacgagtttttccaggtttag

SEQ ID NO: 140555 - DNA, 1647 bp, Artificial Sequence
  Description of Artificial Sequence: Synthetic coding sequence
atggacgaattatttccactgatattccccgcagagccggcacaggcctcagggccatacgtcgaaattatcgagcagccaaaacagcgggggatgagatttcggtataaatgtgagggaaggtctgccggctcgatccccggtgagcgctcaactgatacaacgaagacccaccctactattaaaatcaatggatacaccggcccaggcaccgtcagaatatcactcgtaacgaaagaccctccacatagaccccacccacatgagctggtaggtaaagattgccgggatgggttctacgaagccgaactgtgcccagaccggtgtattcactctttccagaatctgggcatccagtgcgtgaagaagagagacttggaacaagccatatcccagaggatccagactaataataatccattccaagaggaacaacggggggactatgacctgaacgctgtgaggctgtgctttcaggtgaccgttagggatccctctggcaggccactgaggctcccaccagtcttgtctcatcccattttcgacaacagagctccaaatactgccgagcttaagatatgccgagtgaatcgcaacagtggctcatgcctggggggggacgagattttcctgctgtgtgataaagtacagaaggaggatatagaggtgtacttcacaggacccggctgggaggccagaggatccttttctcaagctgatgtgcatcgccaggttgccatagtgtttagaacgcctccctacgctgatccgtctcttcaggcaccagtgcgagtgtccatgcagttgaggaggccgagcgatagagagctgagtgagccaatggagttccagtatctgcctgatactgatgaccgtcacagaatcgaggagaagcgtaaaagaacgtatgaaacatttaagagtataatgaagaagagcccatttagcggacctaccgatcctcggcctccccctcgccgaatcgctgtgccttcaagaagtagcgcatctgtccccaaacccgctccacagccatacccgttcacttccagtctctcaactataaactacgatgaattcccaacaatggtctttccttccggccagatttcgcaggcgagcgcactcgctcccgcccctcctcaggtgctgccacaggcgcctgcccccgcccccgcccccgccatggtaagcgcactcgcccaggcccctgctccagtacccgtactcgcccctggaccaccccaggcggtggctcccccagctcccaagcctacacaggccggggagggcactctcagcgaagcgctgctgcaactccagtttgacgatgaggatttgggagcactactgggcaactctaccgacccagccgtgtttaccgacctggcaagtgtcgacaacagcgagtttcagcagctgttgaatcaggggattccggtggcccctcacacaacggagccaatgctgatggagtatccagaagccataaccaggctggtcaccggagctcaaagaccccctgaccctgcacctgcccccctcggtgcacccggcctgccaaacggccttcttagcggcgatgaggacttcagtagtatcgccgacatggactttagcgctcttctgtctcagatatcaagctag

SEQ ID NO: 140556 - DNA, 1656 bp, Artificial Sequence
  Description of Artificial Sequence: Synthetic coding sequence
atggacgagctctttcctctgatttttcctgctgagcctgcacaagctagtggtccttacgtggagatcattgaacaacccaaacagcgtgggatgagattcagatataaatgcgaggggcgatctgcaggctctataccaggggagcggtctactgataccaccaagactcatccaaccatcaagataaatgggtacaccgggcctggaacagtccgaatatctctggtcacaaaggacccgccgcatcgacctcatcctcatgagttggtgggcaaagattgtcgtgatggcttctacgaagccgaattatgcccagatagatgtatccacagcttccagaatctgggcatccagtgcgtaaagaaacgcgatttggaacaggcgatatctcaacggatccagacaaataataatccatttcaggttcctatcgaggaacagaggggggattatgacctcaacgctgtcagactatgtttccaagtgacagtgcgcgatccatctgggcgacctctaaggctcccgccggtgttaagtcatcccattttcgataatcgggcaccaaacactgctgagctgaagatttgcagggtgaacaggaactcaggctcttgcctcggtggggacgagatttttctgctctgcgataaggtgcagaaagaggatatcgaggtgtactttacaggccccggttgggaagcgcgcgggagctttagtcaggccgatgtgcatagacaggtggcaatcgtgttccgtacacccccctatgctgatccaagcctgcaggccccagtaagagtgagcatgcaacttcggaggccctcggacagagagttatctgaaccgatggagttccaatacctccctgataccgacgatagacaccgcatagaggagaagcgaaaaagaacctatgaaacttttaagtctatcatgaagaaaagtccatttagcggtccgaccgatcccagacctccaccaagaagaattgcagttccatccagatcttcagcctctgtgcctaaacccgccccccagccctatcctttcacctcaagcctttcaaccattaattatgacgagttccctacaatggtattcccctctggccagataagtcaagccagtgccctggcgcccgctccaccccaggtgctcccacaggctccagcccctgcaccagcacccgctatggtctctgccctagctcaggcgcccgcgcccgtgccagttcttgcccctgggcctccccaagccgttgccccccccgcgcccaagcctacccaggcgggcgaaggaacgctttccgaagcactgctgcagctacagttcgacgacgaggacctgggcgccttgctagggaactcgacagatcccgccgttttcacagatctggcatccgtggataactccgagttccaacagctgctgaaccaaggaatcccagtagcacctcataccactgagcccatgctaatggaatatcctgaagcaatcacacgcctggtaactggagcccagcgcccacccgacccagcccctgctcctctgggcgcccccggtctgcccaacggcctactatcaggcgacgaggatttcagcagtatcgcggacatggatttttccgctctgttaagtcagatctcatcctag

SEQ ID NO: 140557 - DNA, 741 bp, Artificial Sequence
  Description of Artificial Sequence: Synthetic coding sequence
atggatgagctgttcccccttatttttccagcagaaccagcccaggcttccgggccttacgtagagatcatcgaacagcctaagcagcgcggcatgcgcttccgttataaatgcgaaggcagatctgcggggagtatcccaggcgagcgctctactgacactactaagacgcatcctaccatcaagattaatgggtacaccgggcccgggaccgtgcgcatcagtttggtgaccaaggatcccccacacagaccacaccctcacgagcttgtcggcaaggactgtagggacggattttacgaagccgaactttgcccagaccggtgtatccacagtttccaaaacctgggaatccaatgcgtgaagaaaagagacctcgaacaagccatctcccagcgcatacaaacaaataacaatccgttccaggtgccgatcgaagaacaaaggggtgactacgacttgaacgcggtgcgcctgtgttttcaagtaactgtgagagacccgagtggtagacccctgcgactgccgcctgtgctgagccatccgatctttgacaaccgggcaccaaatacagctgaattgaagatctgtcgggtaaaccgcaacagcggatcctgcttgggcggagatgagatctttctgctttgcgataaagtgcagaaagaggatatcgaagtgtgtccccaggcctccaccccagctctgagcctatatgttattcctgagcaccatcaactgtag

SEQ ID NO: 140558 - DNA, 1134 bp, Artificial Sequence
  Description of Artificial Sequence: Synthetic coding sequence
atggatgaactgttccctctgatattccccgcagaacctgctcaggcctctggtccctacgtggaaattattgaacagcccaagcagcgcggtatgagatttcgctataaatgcgaaggtcgctccgccgggtcgatccccggagagagaagcacagataccacaaaaacgcatcccactatcaagattaacgggtacaccgggcccggcaccgtgcgcatctcccttgtgacaaaggaccctccccatcgcccgcacccgcatgagctggtcggcaaggattgccgggatggtttttacgaggctgagttatgtccagacaggtgtattcactcatttcagaacttgggtatacagtgtgtgaaaaagagggacctagaacaggccataagccagagaatacagactaataacaacccatttcaggttcccatagaggagcaacgtggagactacgacctaaacgcagtccgattgtgcttccaggtcaccgtacgagacccaagcgggaggcccttgaggttaccccccgtgctgagtcatcccatttttgataaccgcgcgccgaataccgccgagctgaaaatatgcagagtgaataggaactcaggctcatgccttggcggtgatgagatctttttattatgtgataaagtgcagaaagaggacatcgaggtgtattttaccggcccgggatgggaggcccgtgggagtttctctcaggctgacgtgcatcgtcaagttgctattgtgttccgcaccccaccttacgctgacccctctcttcaagctcccgtgagagtttcgatgcagctcaggaggccgagtgacagggaactgagcgaacccatggaattccagtatctccctgacaccgacgatcgacaccggattgaagaaaagcggaaaagaacatacgagacattcaagtccattatgaagaagagtccttttagtggccccaccgatcctaggccaccccctagaagaatcgcggtcccttcacggtcctccgcaagcgtccccaaacccggtaaggattttctcctttcacactggaacgataggttcagcagtgtgcaactgcggtcttccggcgatgaggacagctgggctcctttgcaaacatattag

SEQ ID NO: 140559 - DNA, 714 bp, Artificial Sequence
  Description of Artificial Sequence: Synthetic coding sequence
atggacgagttgtttccactgatctttccagcagagcccgcccaagcatcaggtccatatgttgagattatcgagcagccaaaacagcggggtatgagatttagatacaaatgcgagggccggtccgcaggatctatacccggtgaacgctctaccgacaccactaagacccatccaacaattaaaatcaatggctacacagggccaggcactgtaaggatcagcctggtaacaaaagatcctccccatcgccctcatccacacgagttggtggggaaagactgtcgcgacggattctatgaggccgaattatgcccagataggtgtatccactcatttcagaatctaggcatccagtgtgtgaagaaaagagatctggagcaagccatttcccagagaatacaaactaataataacccttttcaagtgcccattgaggaacaacgaggcgattatgacctgaatgccgtgcggttgtgttttcaggtcaccgttcgggatcctagtggacggccactgcggttacctcctgtcttatcacaccctattttcgacaatcgagctcccaatacagctgaactgaaaatttgtcgcgtcaaccggaattcagggtcgtgcctggggggcgatgagattttcctcttgtgtgacaaagtccagaaggcgcacggaattccggttccggccaggtacaggaggtcctcccccgactag

SEQ ID NO: 140560 - DNA, 1278 bp, Artificial Sequence
  Description of Artificial Sequence: Synthetic coding sequence
atggacgagctctttcctctcattttccccgcagaaccggctcaagcatctgggccctacgtggagatcatagaacaacctaaacagcgcggaatgagattcaggtataagtgtgagggcagatcggctggctcgattcctggagaaaggagcaccgacaccacgaagacccaccctactatcaaggtttggatgtcagggcctctctacttcgggcaaatcaatgggtacacagggcccgggactgtacgaatttcactcgtcaccaaagatcccccacatcgacctcaccctcatgagttggtaggtaaggattgccgggacggtttttacgaagccgagctgtgccccgataggtgcattcacagttttcagaacctcggaatacagtgtgtgaaaaagagagaccttgagcaggctatctcccagcgcattcagactaacaataacccattccaggtaccaatcgaggagcaaaggggggattatgatctgaacgcggtccggctctgttttcaggtgaccgtgcgggatcccagcgggcgccccctgcggctgccccccgtgttgagccacccaatttttgacaatcgggctcctaatacagcagagctgaaaatatgcagggtgaacagaaactccggctcgtgcctgggcggggacgagatattcctgctttgtgataaggtccagaaggaggacatagaggtctattttactgggccaggctgggaggctaggggttccttctcacaggctgacgttcataggcaggtggccatcgtttttaggacgcccccatacgctgatccctctttacaggcccctgtcagggtgagcatgcagctccgacgcccgtcagaccgggaactaagcgagcccatggaattccagtacctgcctgatactgacgaccgccaccgcatcgaggagaaaagaaaaaggacttatgagacttttaaatcaataatgaagaaatcgccatttagcggtcctacggatccccgtccgccaccgcggaggatcgctgtcccatctcgctcgagtgccagtgtcccaaaacctgcgccacagccttatccgttcacctcgagtctttccactatcaattacgacgagttcccaacaatggtgttcccttcaggccagattagtcaggcctcagcgctcgccccagcgccgccacaggttctgccccaggcacccgcgcctgcaccagccccggccatggtatccgcactggcccaggctcctgagcactgggtggcgggcgactag

SEQ ID NO: 140561 - DNA, 1314 bp, Artificial Sequence
  Description of Artificial Sequence: Synthetic coding sequence
atgacacagttcttgcccccaaacctgttggctctttttgctccacgcgatcctattccatatctgccccccttagagaagttaccacacgagaaacatcacaatcagccgtattgtggcatagccccgtacatcagggagttcgaagatccccgagacgctccacctcccacacgggccgaaactcgagaagagagaatggagaggaagcggcgcgagaagatcgaaagaaggcaacaggaagtggaaacggagctcaaaatgtgggaccctcacaacgaccctaatgcccaaggcgatgcttttaagacactgtttgtggctagggtgaactatgacaccacagagagtaaactgcggcgagaattcgaagtgtacggacctatcaaaagaatccatatggtctattcaaagcgctcaggcaagcctcgaggctacgcgtttatcgagtacgagcatgaacgcgatatgcattctgcatataaacatgcagacggaaaaaagatagacgggcgcagggttttggtagatgtggaaagaggacggactgtgaaaggctggagaccccgccggctcggtgggggtttaggcggcaccaggcggggtggggccgacgtaaacataaggcactcaggtcgggacgatacatctaggtacgacgagagaccaggccccagtccactgccccatcgggacagagatcgcgaccgggagcgggaaagacgcgagagatctcgtgagagggataaggaacgagaacgaaggcggagtagatccagggatcgacggcggaggtcgcgctctcgtgacaaggaggaaaggagaagatcacgcgaaaggtccaaggacaaggaccgtgatagaaagcgacggagcagtagaagccgtgaaagggccaggagagagagggaacgaaaggaggaacttcgcggaggcggaggcgatatggccgaacctagcgaagctggggatgctccacccgatgatggtcctcctggagagcttgggcccgatggacctgatggcccagaggaaaagggacgcgatagggaccgcgaacggcgaagatcacacagaagtgagagggagcgcaggcgggacagagaccgggatcgcgatagggaccgcgagcacaagcggggagagagaggatcagaacggggacgcgacgaggctcgtggcggcggcggcggccaagataatggactggagggtcttggaaatgattctagagacatgtatatggagagcgaaggcggggatggatacctggccccagagaacggctaccttatggaggctgctcccgagtag

SEQ ID NO: 140562 - DNA, 1731 bp, Artificial Sequence
  Description of Artificial Sequence: Synthetic coding sequence
atgcttcgctcggggcccgcctccgggcccagcgtgcctacaggtagagctatgccatcccgtcgggtcgcccggccaccagcagcccccgaactcggagcccttggatccccagatctgagcagcttgagcctggccgtgtctaggtctactgagataattgacgaatacatcaaggagaacggcttcggtctcgatggagggcagcctggtccaggcgaagggttgccccggttagtgtcccggggggcagcatccttgtctacagtcactctcggccctgtcgctccccctgcgacaccacccccttggggctgtccccttggacgcttggtatcccccgctcctggccccgggccccagccacaccttgtgataacagaacagccaaagcaaagggggatgagattccgctatgagtgtgagggcagatcagcaggctccatactgggcgaatccagcaccgaggcgtctaagacactgcctgcaattgagctgcgcgattgcggaggattaagagaggtcgaggtaaccgcctgcctggtgtggaaggattggccccaccgagtccacccccattccttggttggaaaggactgtacggatggtatttgcagggttagattgaggccacacgtgtcaccgagacattctttcaacaacttaggtatacaatgcgtacgaaaaaaagagatagaggcagccattgaacggaaaatccagctaggcatcgacccctataacgcaggcagtcttaaaaatcatcaagaagtggacatgaatgtcgtgaggatctgtttccaggcgagctaccgcgaccagcagggacagatgcggcgtatggaccccgtgttatctgagccggtgtacgataaaaagagcacaaatacgagtgagttgagaatatgccgcatcaataaggagtcagggccttgcaccggcggtgaagaactgtatctcctctgtgataaagtacaaaaagaagacattagcgtggtgttcagcagggcctcctgggaaggccgcgctgacttctcgcaagccgacgttcacagacaaatagccatcgtgtttaaaacccccccctatgaagacttagagatcgtcgagcccgttactgtgaatgtctttctgcagagactgacggacggagtctgttcggagcccctgccatttacgtatttgccacgcgatcacgacagctatggggtggacaagaagaggaagcgcggtatgccagacgtgctgggcgaactgaactctagtgacccccacggcatagaaagcaaacggcgcaagaagaagccggccatcttagaccacttcctgcccaatcacgggtccgggcccttcttacctccctccgccctcctccccgatcccgacttttttagcggcaccgtttccctgcccggtctcgagcccccagggggcccagatctgctcgacgatgggtttgcctacgatcccactgcccccaccttgtttactatgctcgacctgctgccgcccgccccccctcacgcatcagctgtggtgtgcagtggaggggccggcgcggtggtaggggagacgcccggcccggaacccttaacattggactcgtaccaggcaccgggacccggtgatgggggaactgctagtttggtgggaagcaatatgtttcctaatcactacagggaggccgccttcggcggtggcctcctttccccaggacctgaggccacctag

SEQ ID NO: 140563 - DNA, 1740 bp, Artificial Sequence
  Description of Artificial Sequence: Synthetic coding sequence
atgctgcgatccggccccgcgtccggaccctctgtacctaccggccgcgccatgccttccagacgggtcgcgcgcccgccagccgctcccgaactcggagccctgggaagcccagacctgtcttctctgagcttggcagtgtcccgttctactgatgaactggagataattgatgaatacatcaaagaaaacgggttcggcctggatggagggcagcctggacccggagaaggcctaccacgactggtgtcacggggggcagcgtccttaagcactgtcacactggggcccgtagcccctccggccactccaccaccctggggctgtcccttaggtcgtctggtaagtccagcccccggccccggtccacaaccccacctagtcattactgagcagccaaaacagcggggaatgaggttccggtacgagtgcgagggacgttccgcagggtctatcctaggggagtctagcacagaggcctctaaaacgctaccagccattgaactacgcgactgcgggggtctgcgggaggttgaggtaaccgcatgtcttgtatggaaggactggccacatagagttcatccccactcccttgtggggaaggactgcaccgacggcatctgcagggtacgcttgcggccgcacgtctctccgcgccactcctttaataacttaggcatccaatgtgtgcggaagaaggaaattgaggctgctattgagaggaagatacagttagggatagacccctacaacgcaggaagccttaagaatcatcaggaggtggacatgaacgttgtgcgcatctgctttcaggctagctaccgtgaccagcagggtcagatgaggcgaatggaccccgtgctctcggaacctgtatatgataaaaaaagtactaacacctctgagttacgcatctgccggattaacaaggaaagcggtccctgcacaggaggggaagaattatatttgttgtgcgataaagtgcagaaagaggacatatcagttgtattctccagagctagttgggagggaagggctgattttagccaggcagacgtacacagacagatcgccattgtgttcaaaaccccaccatacgaagacctggaaatagtcgaacctgtaacagtgaacgtgtttctgcagagactgacggatggcgtgtgcagcgagcccctgccgtttacctacctgccccgtgaccatgatagctacggcgttgataagaaacgcaagaggggaatgcctgacgtgcttggcgagctcaattcctcagacccccatggcattgagtccaaaaggcggaaaaagaagcccgcgattctggaccacttcctgccgaaccatggctccggtccctttctcccaccgtccgcactcctccctgatccagattttttctccggcacagtgagtctgcccggcctggagccccccggaggacctgacctcttggacgatggtttcgcatacgatcccaccgcgccaaccttgttcaccatgctagatttgctccctcctgccccaccgcacgcctccgccgtcgtgtgctccgggggagccggagcggttgtgggcgagacacctggccccgagccgttaacacttgacagttaccaggcccctggcccaggtgacggaggtacagcttctctggtcggcagtaacatgttccctaaccactatcgcgaagccgccttcggcggaggactcctgagccccggccctgaggcgacgtag

SEQ ID NO: 140564 - DNA, 2187 bp, Artificial Sequence
  Description of Artificial Sequence: Synthetic coding sequence
atggaagccgccgcaggaggccgcgggtgtttccagccacatccagggctgcagaagacacttgagcagttccacttgagttccatgtcttcactcggcgggccagctgccttttccgcgagatgggcacaggaggcctacaagaaggagtccgcaaaggaagccggagccgctgccgtacctgcacccgtgccagctgctactgaacctccccccgttctgcacttgcccgctatccagccgccacctcctgtgctgcccggcccattttttatgccaagcgataggtcaacggaaaggtgcgaaacagtgctggagggggagaccatatcttgtttcgtggtgggcggtgagaagaggctgtgcctcccccagatattaaattcggttttgcgtgacttctcgcttcaacaaattaacgccgtatgcgacgagctccacatttactgcagccggtgcactgctgaccaattagagattctgaaggtcatgggaatcttgccattcagtgctccgtcctgcggcttaattaccaagacggacgccgagagactctgcaatgcgctactgtatggcggcgcctacccccccccatgtaaaaaagaattggcggcgtctctggctctgggcctggaactgtccgagagatctgtccgcgtgtatcatgaatgttttggcaaatgcaaaggcctgttagtgccagagctctacagcagccccagcgcagcgtgcattcagtgcctagactgtaggctgatgtatcctccacacaagtttgtggtccacagtcataaggccttggagaaccgaacgtgtcactgggggttcgacagcgcaaattggagagcctacattctactgtcccaggactacacaggcaaggaagagcaggctaggctaggcaggtgcctcgatgatgtgaaggagaagtttgattacggaaacaagtacaagagacgagtcccaagggtgagcagcgaaccaccagcctctatacgccctaagactgatgatacgtcttcccagtcccccgccccttcagagaaggacaaaccttccagttggttgagaacactggcaggtagctcaaataagtcccttggctgcgttcacccccgccagcggctttcagcctttcggccctggagccctgcggtgtcagccagtgagaaggaattatcaccccacctaccagctctcatccgggattcattctactcttacaagtcattcgagactgcagtcgcccctaacgtcgccctggcgccccctgcccagcagaaagtcgtgagtagtccgccgtgtgcagcagctgtgagtcgcgcaccagaacccctcgctacctgtacacagccacggaaaagaaagcttaccgtggatacgcctggagcacccgagaccctggctccagttgccgcccctgaggaggataaggattccgaggccgaagtcgaggtcgaatcccgagaggaatttacctcaagcctgtcgtccctgagctcccccagttttacatcctcatctagcgctaaggacctcggctctcccggcgctcgagccctcccgagcgctgttccagacgccgcagccccagcagatgcaccatccggactcgaggccgaactggagcacctgaggcaggctctggaaggcggcctggacactaaagaggccaaggagaagtttctgcatgaagtggtgaaaatgcgggtcaaacaggaagaaaaactaagtgccgctttacaagccaaacgatctctgcaccaggaactggagttcctcagggttgctaaaaaggaaaaattgagggaggctaccgaggctaagaggaatttgcggaaggaaatagagagactccgcgcagagaatgagaagaaaatgaaggaggccaatgaaagtagattacgactgaagagggagttagagcaggcccgacaagcccgcgtgtgcgacaaggggtgtgaggctggcaggctacgggcgaagtatagtgcccagatcgaggatcttcaagtgaaactgcagcacgctgaggccgatcgggagcaacttagggctgacttgctgagagagcgcgaggctagagagcacttggagaaggtagtaaaggagctgcaggagcagctatggcccagggcccggcccgaggcggccggaagcgaaggcgcggccgagctagagccctag

SEQ ID NO: 140565 - DNA, 1632 bp, Artificial Sequence
  Description of Artificial Sequence: Synthetic coding sequence
atgggatgtatcaagtctaaagaaaacaaatccccagccattaagtatcgcccggagaacacaccggaaccagtgagcaccagcgtcagccattacggcgcggagcctacaaccgtgagcccatgcccttcctctagcgcgaaggggacagcagtgaactttagctccctctcaatgacaccttttgggggctctagtggggttacaccgttcgggggagcttcctcctctttcagtgtggtgccctctagctaccccgccggcctcaccggaggcgtgacaatttttgtcgccctgtacgattacgaagcccggactaccgaggatttgagcttcaaaaaaggcgaacgctttcagatcatcaacaacacagagggtgattggtgggaagcacgttccatcgctaccggcaagaacggatatattccatccaattacgtggcccccgcagacagcatccaggctgaggagtggtactttggcaaaatgggaagaaaagacgccgaacggctgttactcaatcccggcaatcagagagggatttttttggtaagggagtccgagacgacaaaaggagcctatagtctctcaatccgggactgggatgagatcaggggcgacaacgttaaacactacaaaatcagaaaactggacaatggtgggtattacatcacaacgcgagctcagtttgacactctccagaaactggttaagcattatactgagcacgctgacggtctgtgtcataagctgactaccgtgtgccccactgttaagcctcagacccagggtctggccaaggatgcctgggagatccctagagaatccctgaggctcgaggtgaaactcggtcagggctgtttcggggaggtctggatgggcacctggaatggaactacaaaggtcgccatcaagaccctgaagccaggcacaatgatgcctgaagcctttctccaggaggcccaaatcatgaaaaaattgcgacatgacaagctggtgcccctgtacgctgtagtcagcgaagagcctatttatattgtgacagagttcatgtctaaaggcagtctgttggactttctgaaggagggagacgggaagtatcttaaactgcctcagctggtggacatggcggcacagatcgctgacggtatggcctatattgaacggatgaactatatccatcgggatttacgggcggcaaatattttggtcggggaaaacctggtgtgcaagatcgctgacttcgggctggcgcgacttattgaggacaatgagtacaccgctcggcagggcgctaaatttccaatcaaatggactgctccagaagctgccctctacggaaggttcacaattaaatctgatgtgtggtctttcggcatcttacagacggagttggtcaccaaggggcgtgtgccataccctggaatggtgaaccgggaggtgcttgagcaagtagagcggggctacagaatgccctgtccccagggctgccccgaatcgttacacgaattaatgaatctgtgctggaagaaagacccagacgaacgacccactttcgaatacatccagagcttcttggaggactattttaccgccactgagcctcaataccagcctggtgagaatctctag

SEQ ID NO: 140566 - DNA, 1632 bp, Artificial Sequence
  Description of Artificial Sequence: Synthetic coding sequence
atgggctgtatcaagtcaaaggagaataagtcccccgccatcaagtatagacccgaaaatacaccagaacctgtatcaacatcagtgagtcactatggagccgagccaacaacggtaagtccatgcccctcctccagcgccaagggcactgcggtgaatttctcaagccttagcatgactccattcgggggcagtagcggggtgacccccttcggcggagcctctagcagcttttccgttgtgcctagtagctatccagctggactcaccggaggcgtgaccattttcgtcgctctttatgattatgaagcccggacaaccgaagacttaagctttaagaagggagagaggttccagattatcaacaacaccgagggagactggtgggaggctcgctctattgccaccggaaaaaacgggtatattccaagcaactacgttgcccctgctgactctatacaggcggaggaatggtattttgggaagatgggtcgcaaggacgcagaaagactgttgctgaatcccggaaatcagagaggcatcttcttagtacgggagagcgagaccacgaagggggcttactccctgagtatcagagattgggacgaaatcaggggggacaacgtgaagcactacaagatcagaaagcttgataatgggggatactatatcacgacaagagcccagtttgacacattacagaaactagtgaaacattacaccgaacatgcggacgggctgtgccacaaattaaccaccgtatgcccaaccgtgaagccgcagacacagggcctcgccaaggacgcttgggagattcctagggaatcgctccggttggaggtcaaactgggtcaaggatgtttcggggaggtctggatggggacttggaacgggacaacaaaggtggcgataaaaactttgaagcctggcacgatgatgcccgaggcgttcttacaggaggcccagattatgaagaaactgcgtcacgacaagttggtgccgctgtatgccgtggtgagcgaagagcctatttatattgtcactgagtttatgtctaaagggtcccttctggattttctcaaagaaggagatggaaagtaccttaagctaccccagctggtggacatggcagcacagatcgctgacggtatggcttatattgagcgcatgaattacatacacagagacctgcgcgccgccaacatccttgtgggagaaaatttggtttgtaagatagccgactttggactagcccgtttaatcgaggataatgagtacacagcaagacagggggctaaattcccgataaaatggactgctcctgaggccgccctttatggtcgcttcacaatcaagagtgatgtgtggtcatttggcatattacagactgaactcgttacaaaagggcgcgtgccctaccctggaatggtgaaccgggaagtattggaacaagttgaaagagggtaccgaatgccctgtcctcagggctgtccggaaagtctgcacgagctcatgaacctttgttggaagaaggatccagacgaacgacctacgtttgaatatatccagtccttcctagaggactatttcaccgccacagagccacagtatcagcccggcgagaatctgtag

SEQ ID NO: 140567 - DNA, 1632 bp, Artificial Sequence
  Description of Artificial Sequence: Synthetic coding sequence
atgggttgcataaagagtaaggagaacaagtctccagctatcaagtacagaccggagaatactcccgagccagtgtcaacatcggtgagtcattacggggcggaaccaaccaccgtgagcccctgtccaagcagctcagcaaaagggaccgccgtgaacttctcatccctctcaatgaccccattcggaggttccagcggtgtgaccccattcggcggggctagtagtagcttctccgtggtccctagtagctacccggccggtctgacaggtggcgtcactatcttcgtcgctttatacgactatgaggccagaaccactgaggatctctcttttaagaaaggggagaggttccaaataattaacaataccgagggcgattggtgggaggccaggtccatagcgactgggaagaacggttacatcccttccaactacgtagcgccagccgattccatccaggcggaggaatggtactttgggaaaatgggtcgaaaagacgccgagcggctgctcctgaaccctggtaaccagcgcgggattttcttggtgcgggaatccgaaacaactaagggtgcttattctttgtccattagagactgggacgaaatccgtggggataatgtcaaacattataaaattagaaagctcgataacggcggatactatataactacaagagctcagttcgatactttgcagaagctagtaaaacactacaccgaacatgctgacggactctgccacaaattgactaccgtctgtcccacagtgaagccacaaactcaagggcttgctaaagacgcttgggagattccaagggagagcctgagactggaggtgaagttgggccaaggatgctttggagaggtgtggatgggaacatggaacggcaccacgaaggttgcaattaaaactcttaagccaggtacaatgatgcccgaagccttcctccaggaggcccagatcatgaagaagttgcgacacgacaagctcgtcccactctacgccgtggtcagtgaagaacccatctatatcgtcacagagttcatgtccaaagggtcgttactggactttcttaaggagggagatggaaagtacctcaagttgccacaattagttgacatggccgcccagattgctgatggcatggcctacattgagagaatgaactacatccatcgagatttgagggccgccaatatcctggtgggcgagaatctggtgtgcaaaatcgctgactttgggctggcccgcctgatcgaggacaacgagtatacagctaggcagggcgctaaattccccataaagtggaccgcgcctgaagcagccctgtacggaagatttacaatcaaaagcgacgtgtggagctttggcattttacaaactgaactggtaacaaaaggtagagtgccctacccgggcatggtgaaccgtgaggtgctggagcaggtggaacgggggtaccggatgccttgcccacagggatgccctgagtcactacacgaactgatgaacctgtgttggaagaaagaccccgacgaacggccgacttttgaatatatccaaagctttcttgaagattattttaccgccaccgaaccccagtaccagcctggtgaaaatctgtag

SEQ ID NO: 140568 - DNA, 1539 bp, Artificial Sequence
  Description of Artificial Sequence: Synthetic coding sequence
atgggctgtattaagagcaaaggaaaggattcactctccgacgatggcgtggatctgaagacacagcccgttcgtaatacggaacgcaccatctacgtgagagaccctacctcaaacaagcaacagcgcccggtcccagagtcccagctgctgcctggccagcgcttccagacgaaagaccctgaagaacagggtgacatcgtagtcgccttatacccgtacgacggaattcatccagacgacctttccttcaagaagggagagaaaatgaaggtgttggaggagcatggcgagtggtggaaggccaaaagtctattaaccaaaaaggagggtttcatcccttcaaactacgtggcaaaactcaacaccctggaaaccgaggagtggtttttcaaagacattaccaggaaggacgcggagagacagctgctcgcccccggcaattctgccggcgcattcttgatacgggagtctgagacactgaaggggtctttctctctgagcgtgcgcgattttgaccctgtgcacggtgacgtaatcaaacattacaaaatacgatctctggataatggtggctactatattagcccccgcatcactttcccctgcataagtgatatgattaaacattatcaaaaacaggccgacggcctgtgtcgtcgcctggagaaagcctgtatctcaccgaagccgcagaaaccatgggataaagatgcgtgggaaatacccagagaaagcatcaaactggtaaagcgcctgggggccggacagtttggagaagtttggatgggatactacaacaatagtaccaaggtggctgtcaagacgctcaagcccgggacgatgagcgtgcaggcattcctcgaggaggcaaatctgatgaagacccttcagcacgataagctcgtccgtctatacgcagtagtgacacgcgaagagcccatctacatcatcacagaatatatggcaaaggggtccctgctggacttcctgaagtctgacgagggagggaaggtgcttttaccgaaactgattgattttagcgcccagattgccgaggggatggcttacattgaaaggaagaattacatccatcgcgacctaagagctgccaatgtcctggtgagcgagtcactgatgtgcaaaattgctgacttcggccttgcacgagtgatcgaggacaatgagtacactgcaagagaaggagccaaattccctattaagtggaccgctcccgaggccatcaacttcggatgcttcaccattaagagcgatgtatggtcattcggcatccttctgtatgaaattgtgacctacggcaaaattccctaccccggccgaaccaatgccgatgtgatgaccgccctatctcaaggatatcggatgcctagggtggaaaactgtcccgatgaattgtacgatatcatgaagatgtgctggaaggagaaagccgaggagcgacccaccttcgactatcttcaaagtgtgttagacgacttttacacggctactgaaggccagtatcagcaacagccttag

SEQ ID NO: 140569 - DNA, 453 bp, Artificial Sequence
  Description of Artificial Sequence: Synthetic coding sequence
atgggctgtattaagtctaagggaaaagactccctctctgatgatggtgtagacctgaagacgcaaccggtgagaaacacagagagaaccatttacgttagagacccaacaagtaacaaacagcagcgtcctgtgcccgagagccagctgcttccaggccagaggttccagactaaggatccagaagaacagggcgatatagtggtggctctgtatccttatgacggaattcatccggatgacttaagctttaagaagggggaaaagatgaaagtgcttgaggagcatggggaatggtggaaagctaagagcctgttaaccaagaaagagggttttatcccctctaactatgtcgccaagcttaacaccctggaaaccgaagagtggtttttcaaggatataacccggaaggatgcagaacgccaactacttgcccccggtaactcagcctag

SEQ ID NO: 140570 - DNA, 1476 bp, Artificial Sequence
  Description of Artificial Sequence: Synthetic coding sequence
atgggttgcatcaagtctaagggaaaggattctctctcggacgatggcgtggacttaaagactcaacctgtccctgagtcccaacttctgccaggccaacgatttcaaactaaggacccagaggagcaaggggacattgtcgttgcgctttatccatacgacgggatccaccccgatgacctttcttttaaaaaaggtgaaaaaatgaaagtgctcgaggagcatggggaatggtggaaagctaaatcacttcttactaagaaagaagggttcatcccctccaactacgtggcaaagctaaacacgcttgaaaccgaggaatggttcttcaaggatatcactagaaaagatgcggagcggcagcttctagcgcccggaaattctgccggagcattcctgatcagggaaagcgagacactcaagggtagtttttccctgagcgtgagagatttcgaccccgtccacggagacgtgataaagcactataagattagaagcctggacaatggtggctattatatttctccccgaatcacgttcccttgtataagcgatatgatcaagcattaccagaagcaggccgacggcttgtgtcggcggcttgaaaaggcttgcatcagtcccaagcctcagaagccgtgggataaggacgcgtgggagatccctagagagtctatcaagctggtcaaacggctcggcgctggccagtttggggaagtgtggatgggatattataacaacagcaccaaagtggccgttaaaaccctgaaaccggggactatgtcggtgcaggccttccttgaggaggccaacttaatgaaaaccttacagcacgataaactggtgcggctttacgctgtggtgactagggaggagcccatttacattatcacggaatacatggctaagggtagtcttctcgacttcctgaagagcgacgaagggggaaaggtgctgttgcctaagctgattgacttttcagctcaaattgctgaaggcatggcatacattgagagaaagaactatatccaccgcgacctaagagccgcaaacgttctggtgtccgagagcctgatgtgtaaaatcgcagactttggcctggctcgagtgattgaagataatgagtacaccgcccgtgagggggccaagtttccaattaagtggactgcacctgaagcaattaatttcggatgctttaccataaaaagcgatgtctggtcgttcgggatcttactatacgaaattgtcacgtatggcaaaattccgtaccctggcaggacaaatgctgatgtcatgaccgctctgtctcagggctacagaatgccaagggttgagaattgcccagacgaattgtacgacattatgaaaatgtgctggaaagagaaggcagaagagagacccacgttcgattatctgcaatcagtgctggacgatttttacaccgcgacagaggggcagtatcagcaacagccttag

SEQ ID NO: 140571 - DNA, 993 bp, Artificial Sequence
  Description of Artificial Sequence: Synthetic coding sequence
atggccgctgtcgacagtttttatcttttgtatagagagatagctagatcctgcaattgctacatggaggccctcgccctggtgggcgcctggtacaccgctagaaagagcataactgtgatctgtgacttctattccttgattaggctgcactttattcccagactaggtagccgcgcagatctcattaaacagtacggacgctgggctgtggtttccggagcaactgacggaattggtaaggcttatgccgaggaactggcaagtaggggactgaatattattctgatctcacgcaatgaagaaaagctacaagttgtggcaaaagacatcgccgacacatacaaagtggagactgatattattgtggccgacttctcttctggtcgcgagatctacttgccaatcagggaggcattaaaagacaaggatgtaggaatcctggtcaacaatgtgggcgtgttttacccctatccccagtactttactcagctgtccgaggacaagttgtgggacatcatcaatgtgaacatagctgcggcatccctgatggttcatgtggtgctgcccggtatggtggagcgaaaaaagggcgccatagttaccatctcatctgggagttgctgtaagccaacaccccagcttgctgccttcagcgccagtaaagcgtatctcgatcactttagtcgagcgctgcagtacgagtatgcatcgaaggggatttttgtccagagcctgatcccattctatgtagccacttcaatgaccgcaccttcaaacttcttacacagatgtagttggttggttccgtctccaaaggtctatgcccatcacgctgtcagcacattgggcatttcaaagagaaccacagggtattggagtcactctatccagttcttgtttgcacagtatatgcctgaatggttatgggtgtggggagcgaatatcttgaaccgctctctgagaaaagaagcactctcctgtacagcctag

SEQ ID NO: 140572 - DNA, 336 bp, Artificial Sequence
  Description of Artificial Sequence: Synthetic coding sequence
atgggtagcagttcatttcttgtgctcatggtaagcttggtgcttgttaccttggtggctgtagaaggggtcaaggaaggcatagagaaggctggggtgtgtccagctgacaacgtgagatgcttcaagtccgacccgccacaatgccacaccgatcaggactgcctgggtgagcgaaaatgttgttatctccactgtgggttcaagtgcgtgatccctgtgaaagagctggaagaagggggcaacaaggatgaggacgtgtctcgcccctaccccgagcctggatgggaagccaagtgtccagggtcatcttccacccgctgtccccagaagtag

SEQ ID NO: 140573 - DNA, 675 bp, Artificial Sequence
  Description of Artificial Sequence: Synthetic coding sequence
atgcgcacgcagtcactgctcctcctgggtgccctgctcgccgtgggatcccagctaccagcagtgttcggccgaaagaagggggaaaaaagcgggggctgccccccagatgacggtccctgtctccttagcgtccctgatcagtgcgtggaagactcccaatgtcctctgacgcggaagtgttgttacagagcttgcttcagacagtgtgtccccagagtcagtgtgaagttaggctcatgtccagaggaccagctgagatgccttagcccgatgaaccatttgtgtcacaaggatagcgactgctcaggcaagaagcgctgttgccacagtgcatgcgggcgagactgccgcgaccccgccagaggaacagcccctggctgtccaggacaagcaaatagtgatcttggctccgtggccctgcatcttagctgggggccaacggagagggtccatgatggccgtccaggggcactccccgccgggcaacactacctgtatcaacggtggttccaaccctctgataatcactggccggcagatacatccctgcagcccattcacccttggttcctgctactgggcgtgaaagtgcattcactaagttcagaagagggtctttgcatcaccccagtactctgtacaacagcaattcgcgcatcccacccaagctag

SEQ ID NO: 140574 - DNA, 372 bp, Artificial Sequence
  Description of Artificial Sequence: Synthetic coding sequence
atgcggacccaatcgctgctcctgcttggcgcgctcctggccgtaggttctcagctgcctgctgtttttggcaggaagaagggggagaaaagcggcggctgtcctcctgacgatggaccatgccttctgtcagtccccgatcagtgcgtggaagacagccagtgtcctcttaccaggaagtgttgctacagagcctgcttcagacagtgcgtgccccgcgtgagcgttaagctcgggtcctgtcctgaggatcagctgaggtgcctttctcccatgaatcatttgtgtcataaggattctgattgttcaggcaaaaagcgatgctgccacagcgcctgtggcagagactgcagggatccggcgaggggatag

SEQ ID NO: 140575 - DNA, 1647 bp, Artificial Sequence
  Description of Artificial Sequence: Synthetic coding sequence
atgcctgctctccggccactcttacctctgcttctgctacttaggctgacgtcaggtgccggcctattaccaggtctgggaagccacccgggcgtttgcccgaatcagctcagcccaaatttgtgggtggatgcccaatcaacttgcgagcgcgagtgtagtcgggaccaagactgtgcggcagccgaaaaatgttgcatcaacgtgtgcggtctacacagctgcgtcgctgctcggttccctggcagccccgcagcgcctaccacagcagctagctgtgagggttttgtttgcccccagcaaggatctgattgtgatatctgggatggacagccagtgtgtcgctgtagggacaggtgcgagaaggagccctcctttacttgtgcaagtgacggactaacatactataatcgatgttatatggacgcagaggcctgcctacgaggccttcacctgcacattgtcccgtgtaaacacgtcctgagctggcccccttcttcacccgggcctccggagaccaccgctcgccctactcccggcgctgctcccgtgcctcctgctctctacagcagtcctagcccgcaggccgtacaagtgggaggcaccgcttccctgcactgtgatgtgagtggacgcccccccccagccgtgacctgggagaaacagagccatcagagagagaatcttattatgcgtcccgaccagatgtacggaaatgtagtcgtcacaagtatcgggcagttggtcctgtacaacgctcgaccagaggacgccggattgtatacatgcaccgcacgcaacgccgcaggcctcctccgcgccgatttcccactcagcgtggtacagagagagcccgctagggatgctgcaccttcaattccagcccccgccgaatgcctgccagacgtgcaagcatgcactgggcccacaagcccgcatctggtgctgtggcactatgaccctcagcgagggggatgcatgacctttcctgctagggggtgtgacggcgctgcaagggggtttgagacatatgaggcctgccagcaagcatgtgcccgcggccctggcgatgcatgcgtgctgcccgctgtgcaagggccatgtcggggctgggagccccggtgggcttactctcctctgctgcagcagtgccatcctttcgtttacggcggctgtgagggaaacgggaataactttcacagccgcgaaagctgcgaggacgcatgtcctgtccctaggacccctccttgccgtgcttgccgcctgcggagcaagcttgctctgtcactttgcaggtcggacttcgccatcgtgggccgactaaccgaggtcctggaggaacccgaggctgccgggggcatagcgagggttgccctggaggacgtgctgaaagatgacaaaatgggactcaagtttctggggaccaaatacctggaagtaaccctgtctgggatggactgggcgtgtccgtgcccaaatatgaccgccggtgacggtcctcttgtgatcatgggagaagttagagacggcgtggccgtgcttgatgcaggctcctacgtccgggcagcatcggagaaaagggtcaaaaagattctggagttactcgagaagcaagcctgtgagctgttaaatcgctttcaagattag

SEQ ID NO: 140576 - DNA, 1731 bp, Artificial Sequence
  Description of Artificial Sequence: Synthetic coding sequence
atgtgggccccaaggtgccgtcgattctggagccgttgggagcaggtcgctgcacttctccttttactccttttgctgggagtgccaccacgctcgctggcactgcctcccattcggtatagtcacgcaggcatctgccccaacgatatgaacccgaacctctgggtcgatgcgcagagcacctgtaggcgagagtgtgaaacagatcaagagtgtgagacttatgagaagtgctgtccaaatgtgtgtggcacaaaatcatgcgtagctgctcggtatatggatgtaaaagggaagaaaggaccagttggcatgcccaaggaggctacctgtgatcatttcatgtgcctgcaacaaggctcagagtgcgacatttgggacgggcagccagtgtgtaagtgtaaagatcggtgcgaaaaggaaccatccttcacttgtgcttctgatggccttacgtactacaacagatgctatatggacgccgaagcgtgttcaaagggtatcaccctggctgtcgttacatgtcggtaccattttacctggcccaacaccagccctcctccacccgaaacaactatgcatcctacaaccgctagcccagagactcctgaactcgatatggccgcacccgctctgctcaataaccctgttcaccagtcagttacaatgggggaaacggtctctttcctgtgcgacgtggttgggcggccgagacccgaaatcacatgggagaaacagctggaagaccgggaaaacgtggttatgaggcctaaccacgtccgcggaaatgtcgtggtgaccaacattgctcaactggttatctacaatgcccagctgcaggatgctggcatttatacatgtacagctaggaacgtggcgggggtcctgagagccgactttccgctgagcgtggtgaggggacaccaggccgccgccacaagtgagagctcgcccaacgggacagcttttccggcagcagagtgccttaaaccgcccgactcagaggattgcggcgaagagcagaccagatggcatttcgatgctcaggccaataactgtctgacattcaccttcggacactgccaccggaatctgaaccattttgagacttacgaggcatgtatgcttgcctgcatgagtgggcctctggctgcgtgtagtctaccagctcttcaaggcccatgcaaagcctacgcccctcgatgggcctacaacagtcaaaccgggcaatgtcagagtttcgtctacggaggatgtgagggaaatgggaataattttgaaagccgcgaggcctgtgaagagtcttgcccctttccgaggggaaaccaaaggtgtcgggcttgcaagccacgccagaagctagtgactagcttctgccgcagcgacttcgtcattctggggagggtctccgagctgacagaagaaccagactccgggcgagccttggttaccgtggacgaggtgctgaaggacgagaagatgggcctgaaatttttgggacaagaacctctggaggtcactttgctgcatgtggactgggcatgcccatgtcctaatgtgacagtttctgagatgcctttgattattatgggtgaggtcgatgggggaatggccatgctgcgtccggattcctttgttggcgcaagcagtgcacgcagagtccggaagctgagagaggtgatgcataagaagacatgtgatgtcctgaaagagtttctgggtctgcattag

SEQ ID NO: 140577 - DNA, 849 bp, Artificial Sequence
  Description of Artificial Sequence: Synthetic coding sequence
atggacgtcaagggtaagaagggccctgtcggtatgcccaaggaagctacatgcgatcattttatgtgtctgcagcagggtagcgagtgtgatatctgggatggtcagccagtgtgtaaatgtaaagataggtgcgagaaggagccaagttttacctgcgctcaggcgaataattgcctgaccttcacctttggccactgtcatagaaacctcaatcacttcgaaacatatgaggcatgcatgctcgcctgtatgtccggacccctggcagcatgctccctacctgccctgcaggggccatgtaaggcatatgccccgcggtgggcatacaattcccagactgggcagtgtcagagcttcgtctacggtggatgtgaaggcaacgggaacaattttgaatcccgagaggcatgtgaagagagttgcccgtttccccgagggaatcagcggtgccgcgcttgcaagcctcggcagaagctggtaaccagtttttgtcgaagcgatttcgtcatcctgggtcgtgtgagcgaactcacagaggagcccgactctgggagggccttagtgactgtggacgaggtgctcaaggacgagaaaatgggtctgaagttcttaggtcaggaacctctggaggtgactctactccatgtcgattgggcttgcccttgcccaaacgtgaccgtgtccgagatgcccttaataatcatgggggaagtggatgggggcatggctatgctgaggcctgattctttcgtcggagccagtagcgcccggcgcgtcaggaagctgcgagaggtgatgcacaagaagacctgcgatgtcctcaaggaatttctgggcctgcattag

SEQ ID NO: 140578 - DNA, 1509 bp, Artificial Sequence
  Description of Artificial Sequence: Synthetic coding sequence
atgccacttgttaagcgtaatattgagccccgccatctctgtagaggcgccttgcctgaaggaatcacatccgagctggagtgcgttaccaactctacattagcagcaataatacggcagctgtcttcactgtcaaaacatgccgaagatattttcggagagctctttaatgaagcaaataatttttatatccgggcgaatagcctccaggatagaatcgatagactggctgtgaaggtgacacagctcgatagcaccgtggaggaggtgagtcttcaggacatcaacatgaagaaggcctttaaaagcagcacagtacaagaccaacaggtggttagcaagaatagtatccctaacccagtcgccgacatttataatcagagcgataaacccccaccgcttaacatactaactccttaccgggacgacaagaaggatggtctgaaattttacactgacccaagctacttctttgacctttggaaggaaaagatgctgcaggatactgaggacaagcggaaggaaaaacggcgccaaaaggagcaaaagaggattgacggcacaacacgggaggtcaaaaaagtgaggaaggctcggaacaggcggcaagagtggaatatgatggcctatgataaagagcttcggcccgataatcgcctttcgcagtctgtttaccacggtgccagcagtgaggggagcctctctccagataccaggagtcacgcgtccgatgtgaccgattactcataccctgcaacgccaaatcacagcctgcacccgcaaccggtcacaccatcatacgccgcaggagacgtaccccctcacgggcccgcttctcaggcagccgagcacgagtatagaccccccagtgcaagcgctagacacatggcccttaatagaccacagcaacccccaccccccccgcctccgcaggcacctgaaggttctcaggcatcagccccaatggcaccagcagattatggaatgctgcctgctcagattatcgagtactacaaccccagcggtcctccaccccctcccccgcctccggtaatcccaagcgcgcagaccgcatttgtgtctcccttacagatgccaatgcagcctcccttcccagccagcgcctcctcaactcatgctgcccccccccatccgccaagcaccgggctgctagtaaccgctccgcctccgcccggccccccgcctccccctcccggcccccctggcccagggagttctctgagtagttcacccatgcatggcccaccggtagctgaggctaagaggcaagagcccgcacagcctcccattagcgatgctagaagtgatctactggcggccatcaggatggggatccagctgaagaaagtgcaggagcagcgcgagcaggaggctaaacgcgaacccgtgggcaatgacgtggcaacgatcctgtctaggagaatcgcagtggagtacagtgattcggacgacgacagcgagttcgacgagaatgattggagcgactag

SEQ ID NO: 140579 - DNA, 1500 bp, Artificial Sequence
  Description of Artificial Sequence: Synthetic coding sequence
atgcctttagtcaagagaaacattgagccccgccacctgtgcaggggcgccctgcccgaaggcatcacaagcgagctggagtgcgtcacgaactccacccttgccgctataattcgccagctgtctagcttatcaaagcacgctgaagacatcttcggagagttatttaatgaagcaaacaacttctacatcagggcaaatagcttgcaagatcggatcgatcggctcgccgtgaaggtcacacagctggatagcacggtggaggaagtcagcctgcaggatatcaatatgaagaaagctttcaagagctcaacagtgcaagaccagcaggtcgtaagtaaaaactctattcccaatccggttgcagatatttacaatcagagcgataagcctccccctctgaacatattgaccccttatcgcgatgacaagaaagatggcctgaaattttataccgacccaagttacttctttgatctatggaaggaaaagatgctgcaagatactgaggataagaggaaggagaaacgccgacagaaacgggagaaacacaaactcaaccccaatcgaaaccagcaagtgaatgttcggaaggttaggacacgcaaggaagaatgggagaggcgcaaaatgggcattgagtttatgtctgatgccaagaagcttgagcaggctggaagtgctaaggaggatagagtgccgtccggatcccatgcgtcagatgtgaccgactacagctatccagccacaccgaaccacagcctccatccacagcctgttaccccaagctatgccgctggagacgtccccccccatggcccagcttcccaagcagccgagcacgagtataggcccccgtcagcatcggctcggcacatggctctcaatcgcccacagcaaccacctcctccaccgcccccacaagcacccgagggaagccaagcaagtgcgcccatggccccagctgactatggaatgttgcccgctcaaatcattgagtattataaccccagcggcccgcctcccccacctcccccacccgtgatcccttccgcacagactgcgtttgtctcccctctccaaatgccaatgcaacctccatttcccgcttccgcctcatctactcatgctgcaccaccacatcctccatctaccggcctcttagtgacagctccacccccgccaggacctcccccaccacctcccgggccaccgggacctggctctagcctcagctcttctcctatgcacggtccccctgtagccgaagccaaaagacaggaacccgcccagcctccgatctcagatgcaagaagcgatctgctggccgctatacgtatgggcatacagctgaagaaagtccaggagcagcgagaacaggaggccaaacgggagccagtgggcaatgatgtggcaactattctgtcacggcggatagcggtcgaatactctgacagtgacgacgactccgagttcgatgagaacgactggtcagactag

SEQ ID NO: 140580 - DNA, 786 bp, Artificial Sequence
  Description of Artificial Sequence: Synthetic coding sequence
atggaaggcggtctgggtagagctgtctgcctgctgactggagcatcaagaggatttggaaggacactggctcctcttctcgcctccctgttgtcgcccgggtctgtgctggtgctgtctgcccggaacgatgaggcccttcgccagctcgaagctgagctgggcgctgaaaggtccggactgagagttgtgcgagtgcccgctgacctgggagccgaggccggtttgcagcaactcctgggggctctgagagaactcccgcgtcccaagggccttcaacgcctgctactcatcaataacgctggatcactcggagacgttagtaaagggttcgtcgacctgtcagactctacccaagtgaataactactgggccctcaatttgacctccatgctctgtttgacaagtagcgtgctgaaagcgtttcccgacagtcccggccttaaccggactgtggtaaacatctcttccttgtgtgctcttcagccctttaagggttgggccttatattgcgccgggaaggccgcgcgggacatgttgtttcaggtgcttgctttggaagagcctaatgtgcgggttttaaactatgcgcccggacccctggatacggacatgcagcagctggcaagggaaacatccgtggaccctgatatgcgcaaggggctccaagaactgaaggctaaagggaagttggttgattgtaaggtgtcagctcagaagctgctgtccctgctggagaaagatgagtttaagtccggcgcccacgtcgatttttatgacaaatag

SEQ ID NO: 140581 - DNA, 2430 bp, Artificial Sequence
  Description of Artificial Sequence: Synthetic coding sequence
atggaagatgagcaacccgactctttggagggctgggtccccgtgcgtgaaggtttgttcgcggagccggaacggcaccgcctgcggttcctggtggcctggaacggcgccgaaggaaagttcgctgtcacttgccacgacagaacagcccagcagagacggctacgagaaggagctagattagggcctgaaccagaaccgaagcccgaggccgccgtgtctccatccagctgggccggtctgctgtctgccgccggacttcgtggagcacatcgccagctggccgccctatggcctcccctggaacggtgtttcccccggctgccccccgaattagacgtggggggcgggggagcatggggtctcggattgggcttatgggccttactttggccaacccgggctgggcccggggaagctgccttgcaggagttgtgcggacaacttgaacgttacctcggggccgcagccgacggttgcggcggtgccactgttcgagatgcacttttccctgcagaggggggcgcagcagactgtgagtcacccagggagttcagggagagagcactgcgagcccgctgggtcgaggccgatgccaggttgcggcaggttatccagggacatggcaaggctaacactatggtggccttgatgaacgtgtaccaggaggaagatgaagcatatcaagaattagtgaccgtcgccactatgttcttccaatatctgctgcagcctttcagggctatgagggaggtggctactctttgcaagctggacattctcaagagtttggacgaagacgatctcggaccaagaagggtggtagccctggaaaaagaagcggaggaatggacacggagggccgaggaagccgtagtttcaattcaggacatcactgttaactatttcaaggagaccgttaaagcactggctgggatgcagaaagagatggagcaggacgcaaagagattcggccaggctgcatgggcaacagctatcccccgactcgagaagttgcagctgatgttggcacgcgagacactgcagctcatgcgagccaaagagctctgtctcaaccacaagcgagccgaaattcagggaaaaatggaggacttacctgagcaagagaaaaacaccaacgtcgtagacgaactggaaatccagttttacgaaattcaactcgagctctacgaagtgaagtttgagatccttaagaacgaagagattctgctgacaacccaactggacagcctgaaaaggctgatcaaggaaaagcaggatgaggtggtgtattatgatccctgcgaaaaccccgaagaactcaaagtgatcgactgtgtcgtcggattgcaggacgataaaaatctggaggtgaaggaacttcgcagacagtgccaacaactggaaagcaagcggggccgcatttgcgccaaacgtgcttctctcaggtcacgtaaagatcagtgtaaagagaatcataggtttaggctccagcaggccgaagagtcaatacggtacagccgccaacaccattcgattcagatgaaaagagataagattaaggaagaggaacagaaaaagaaggaatggattaatcaggaaaggcaaaagaccctgcaacgacttcgatcatttaaagacaagagattagcccagtccgtgcgcaatacctccggatccgaacctgtggcccccaatttgccaagtgacctgagtcagcaaatgtgcctgcctgcaagccacgcagtaagcgtcattcacccatccagccgaaaaacgcgtggggtgcctttgagtgaagcaggtaatgtaaaatcccccaagtgccagaactgccacggaaacatcccggtccaggttttcgtgccggtgggagatcagacccactcgaagtcgtccgaggagctgtcccttcctcctccccccccaccacccccacctcctccccccccacctccccctcccccacccccactccgagcattatcatcttcgtcccaggcggccacccatcagaatctgggattccgcgctcccgtcaaggatgatcagccccgcccactcgtttgcgagtcacctgctgagagaccgcgcgactcattagagtccttttcttgtcccggttctatggatgaagtcctcgcatcgttaaggcatggcagagccccattgcgaaaagtggaagtgcccgcggtgcgccccccccatgcctctatcaatgagcacatccttgctgcaatccgtcagggggtcaaactcaaaaaggtgcatcccgacctaggacccaatccatctagcaaacccacctctaatagaaggacctctgacctggagcggtctattaaagcagcccttcagcgaatcaagcgcgtgtccgccgacagtgaggaagattcagatgagcaagaccctggtcagtgggatggatag

SEQ ID NO: 140582 - DNA, 1452 bp, Artificial Sequence
  Description of Artificial Sequence: Synthetic coding sequence
atgcctgtgcctccaccgcccccccctccactgccacccccaccaccccccctcggcgccccacctcccccccccccttccgcccccccagtgagcactgatacgagctctctgcgcagagctgatcccaaggggcggtccgctctactggctgatatccagcaaggaacccgcttacgcaaagtgacgcaaatcaacgatcggtctgcacctcagatcgaatcctccaagggcaccaataaggaggggggtggaagtgctaacacccgcggagcctccacgccccccactctcggagacctcttcgcaggaggctttcccgtgctccggcccgccgggcaaagggacgtggctggcggtaaaaccggccaagggccaggatccagggcgccctcaccaagactgcccaataaaactatttccggtcccctgatcccgcccgcatctcctaggctggggaatactagcgaggcacacggagctgctaggaccgcaccaccacgacctaacgtccctgcccctccccccccaacccccccccccccgcccccacctctgcctcccccactacccagctcttcaccaatcaaaactccccttgtcagccctcctgggcctctgacaaaaggaaatcttcctgttgtggccccacccgttccctgcgctccccccccacccccccccccgccaccgcctactcctccaccgctgccaccagcctcagtcctcagcgacaaagccgtgaagcctcaactcgcccccctgcatctgccaccaatccctcctcccctgccgctgctgccgccgtgtggatatcccgggttgaaagcagagcctgcttctccagcccaggacgcccaggaacctccagctcctccacccccccttccgccgtacgcatcatgctccccacgggcaagtctgccagctccgccactgcctggtgtgaacagtagctctgagacaccccccccactgcccccaaagagcccctcgttccaagctccaccccagaaggcaggagcgcaagccctacccgcaccacccgcgccaccaggttcacagccttttctgcaaaaaaaaagacacggccggccaggagcaggcggtggaaagctgaatccccccccagccccccccgctcgatctcccaccaccgagttgtctagcaaaagccagcaggcaactgcctggactccaacccagcagcccggaggacagctgagaaatgggtcgttacacataatcgatgatttcgaaagcaagttcacttttcattctgtcgaggattttcctccccccgatgaatataagccctgccagaagatctacccttcaaagatccctagatctaggacacctgggccttggttgcaagccgaggccgtgggtcagtcttccgatgacatcaagggccgaaattctcaactgagcctgaagactctgaggtag

SEQ ID NO: 140583 - DNA, 1452 bp, Artificial Sequence
  Description of Artificial Sequence: Synthetic coding sequence
atgcctgtgcccccacctccacccccgccactccccccacctcctccacctctcggggccccaccaccccctccccccagtgcccctccggtcagcacagacacaagctctttgcgcagagccgacccaaaaggtagatctgccctcttggcagacattcagcagggtactcgattgagaaaggttactcagatcaatgatcgcagcgccccccaaatagaatcgtcaaaagggaccaataaagagggggggggctcagctaacacgaggggggcctcaacgcctccaaccctgggcgacctgttcgctggtggcttcccagtgttacgaccggctggccagcgtgacgtcgctgggggaaagacagggcaaggccccggctctcgcgctccgagcccgagactccctaacaaaaccatcagcggtcctctaatcccacccgcaagcccccgactgggaaacactagtgaggcccacggtgcagcacggactgcgccaccacggcccaacgtgccggctcccccgcctcctaccccgcccccccccccacctcccttgcctcctccacttccctcatcttctcccatcaagacacccctggtgtcaccccccggaccattgacaaaggggaacctccccgtggtggcaccacccgtgccttgcgcaccacccccaccccccccaccaccgccgcccactcctccgccgcttccacccgcctctgtgctgagcgacaaagctgttaagccacagctggcacccctacacctgccacctataccgcctccattgccacttttacctccatgcggataccctggcttaaaagccgagccagcttcccctgcgcaggacgcccaggagcccccggctccccccccccctctgccaccttacgcgtcatgtagtcccagggcttctctgcctgcacccccactccctggggtgaacagtagctcggagacaccccctccattacctcccaagagtcctagttttcaggcaccacctcaaaaggccggagcccaggcactgcccgcccctccagcaccccctgggagccaacctttccttcagaaaaagagacacggaaggcctggtgccggaggaggaaagctgaacccaccaccggctcctccggctcgatcccctaccacagagttgagcagtaagagtcagcaagcaactgcctggacaccaacacagcagccaggcgggcagctcagaaatggatcccttcacatcatcgacgatttcgagagcaaattcacgttccactctgtcgaggatttccctcccccagatgagtacaagccatgtcagaagatctatcctagcaagataccaagaagtagaacccccggcccctggctgcaggctgaagctgtcgggcagtcatctgatgatattaaagggcgtaactcccaggtcacacaggcatcctgtctctag

SEQ ID NO: 140584 - DNA, 1452 bp, Artificial Sequence
  Description of Artificial Sequence: Synthetic coding sequence
atgccagtgccgccgccgcccccgcctccccttcctccccccccgcccccactaggcgcaccaccaccgccaccaccaagtgcccccccagtctccaccgacacttcatcactccggagagctgacccgaagggaaggagcgctcttctagccgatattcagcagggaactaggcttagaaaggttactcagataaacgatcgcagcgctcctcagatcgagtctagtaaaggaacaaataaagagggagggggcagtgctaatacacgtggtgcatccacccctcccacccttggagaccttttcgctggcggatttcctgttctgaggcccgctgggcagcgtgatgtggccggagggaagactgggcagggacctgggtcccgggcaccgagtccacgactgccaaataagactataagtggtcctttaatccccccagccagtccccgccttggtaacactagtgaggcccatggggctgcaaggaccgctccacctcgacccaacgtgccagccccacccccacccacccctccgccaccaccaccacctctcccaccccctttgccttccagtagtcctattaaaactcccttagtatctccacccggccctttgaccaagggcaatctgcctgtagtggcacccccggtcccatgtgcacctccacccccacccccccccccccctccaactcctcctccccttccacccgctagcgtgttatctgacaaggccgtgaagccccagctggctcctctgcacctgccccccattccccctccactaccactccttcccccctgcggttatccagggttaaaggctgagccggcctcccccgctcaggatgcccaagaaccgcccgcacctcccccccccctccctccatatgcctcctgctccccccgagcatccctgcctgcccctcctctgcctggagtgaattcctcatcggaaacccctcctcctttgcctcccaaaagcccatctttccaggcacccccccagaaggcaggggcccaggccctgccagccccccctgccccgccgggaagccagcccttcctgcagaagaaacgtcacgggaggcccggtgctgggggtgggaagctgaaccctccgcctgcaccgccagcaaggtccccaaccacagaacttagctccaagtctcaacaggctaccgcctggacccccacgcagcaacccggtggccagctaaggaacgggtcactacacatcatcgacgatttcgagtccaaattcaccttccatagcgtggaagatttcccaccaccagatgagtacaagccctgccagaaaatctatccatccaagatccctagatcgcgcacaccaggcccctggttacaagctgaggccgttggccagagttccgacgatatcaagggaagaaactcccaggtcacccaggcctcttgtctctag

SEQ ID NO: 140585 - DNA, 930 bp, Artificial Sequence
  Description of Artificial Sequence: Synthetic coding sequence
atggctgtgaaccagagccacaccgagaatcgtcggggggcacttatcccgaacggcgagtctctcctcaaacgttcaccaaacgtagagctttctttcccacagaggtctgaggggagcaacgtcttctctgggcgtaaaactggtacgttgttcctgacatcctaccgagtgatcttcattacctcctgcagcatatctgatcctatgctgtctttcatgatgccctttgacctgatgacaaacttgaccgtcgagcaacctgtgtttgctgccaatttcatcaaggggacaatccaggccgccccgtatggcgggtgggagggtcaggctaccttcaaactggtattccgcaatggggacgccattgagtttgcccagctcatggtgaaggctgcctccgcagccgctaggggatttcctctccggacactcaacgactggtttagctcaatgggtatttacgtgatcaccggtgagggaaatatgtgtacgccgcagatgccctgtagcgtgattgtctatggggctccaccagcaggctacggagcgccaccgcctgggtatggagcacctccagctggatatggtgcccagccggtcggaaatgagggccctcctgtcggctacagggcctctcccgtacgatacggcgccccccccctggggtacggagctccccccgcagggtatggggccccccctctcgggtacggcgctcctccactggggtatggcacccccccactgggatacggggccccaccactaggctacggagctcccccggccgggaacgagggacctcccgcaggctatagggctagccccgcaggttccggtgccagacctcaggagagcaccgcagctcaggctccagaaaacgaagcctccttaccttcagcctcgtcatcccaggtgcactcttag

SEQ ID NO: 140586 - DNA, 930 bp, Artificial Sequence
  Description of Artificial Sequence: Synthetic coding sequence
atggccgtgaaccaatctcatacagaaaaccgacgcggcgctctgattccaaacggtgagtccctcctgaagcgtagtcctaatgtcgagttgtcattcccccagcgaagtgagggcagcaatgtcttctctggtagaaagactggaaccctgttcctcacatcataccgtgtgattttcataacttcttgcagtatctcggatcctatgcttagctttatgatgccttttgaccttatgactaacctgaccgtggaacaacccgtattcgctgcaaattttatcaaaggcactattcaagctgctccatatggaggctgggagggccaggctaccttcaagctcgtgtttaggaacggcgacgccatcgagtttgcgcaactgatggtgaaagccgcatccgccgcagcacgaggcttccctcttcgtacactaaacgattggttctccagtatggggatctatgttataaccggagaagggaacatgtgtacccctcagatgccatgcagcgtaatcgtgtatggtgcgccgcctgctggctatggggctcctcctcctgggtatggagctcctcccgccgggtatggggcccagcccgtgggaaacgaaggacctccagtcggctaccgcgcttcccccgttagatacggcgcgcctcccttgggatacggcgctccccctgccgggtacggagcacctccactaggctatggggctccccctttaggttatgggacccccccactgggctatggagcaccacccctgggatatggggctcctcccgcggggaatgagggaccaccagccgggtaccgtgcctcgcctgctggcagcggcgcgcgtcctcaggagagtacagcagcgcaggcacctgagaacgaggcttccctcccaagtgcgtccagctcgcaggttcacagctag

SEQ ID NO: 140587 - DNA, 930 bp, Artificial Sequence
  Description of Artificial Sequence: Synthetic coding sequence
atggctgtcaaccagtcacacaccgagaatcgacgaggcgctctgatcccaaatggagaatcccttctgaagagatccccaaatgttgaactgagtttcccccagaggtccgaaggcagcaacgttttcagcggacggaaaaccggcacgttatttctaacatcctaccgggtcatcttcatcacctcatgtagtatctcagaccctatgttgtcattcatgatgcctttcgacttgatgacgaacttaacggtggagcaaccagtgtttgcagcgaactttattaagggcactatccaggcagctccttacggtgggtgggaggggcaggctaccttcaagctggtgtttcggaacggggacgccatcgagtttgcccaactcatggttaaagccgcatccgccgccgctagaggttttccacttagaacccttaatgactggttctcaagtatgggcatttacgtgataacaggcgaggggaatatgtgcaccccacagatgccttgctccgtgatcgtttacggcgcaccgccggccggctacggagctccaccaccaggatacggagcacctccagctgggtatggggcccagccagtcggtaacgaaggccctccagtcggttatcgcgcctcacccgtgaggtacggcgccccaccactcggttatggcgcgccacccgccgggtacggggcaccacctttaggatacggcgcccctcctcttggctacgggacccccccccttggctatggggcacctcccctgggctatggcgctccccccgccgggaatgaagggcctccggctgggtacagagcttccccagcgggatcaggagcacgacctcaggaaagcaccgccgcgcaggcccccgaaaatgaagcatccttaccatcagcatcgtcttcgcaagtgcacagctag

SEQ ID NO: 140588 - DNA, 708 bp, Artificial Sequence
  Description of Artificial Sequence: Synthetic coding sequence
atgccgtttgacctgatgactaatctgacagtggaacagccagtattcgctgccaattttatcaagggcaccattcaggcagctccatacggcggatgggaggggcaagcaacctttaagctggtgtttagaaacggagacgccattgagtttgctcaacttatggtaaaggccgcctcggccgcagcccgaggcttcccactccgaaccctgaatgactggtttagctccatggggatatacgtaattaccggcgaaggtaatatgtgtacacctcagatgccctgttccgtgatcgtctacggagctccaccggccggatatggcgccccacccccgggctacggagcccctccagcaggctatggtgcccagccggtgggcaacgaggggccccccgtgggctacagggcctccccggtgagatacggagctcccccactcggctacggggctccccccgcaggatacggcgcccctcccctgggatatggcgctccccccctgggctatggtaccccccctctcggctatggagctccccctctcggttacggagcccctccagcggggaatgagggacccccggccggttatagagcaagtcctgccgggtccggcgcccgcccacaggagtccacagccgcccaggccccggagaacgaggcatcattgcccagtgcctccagcagccaagtgcactcttag

SEQ ID NO: 140589 - DNA, 1401 bp, Artificial Sequence
  Description of Artificial Sequence: Synthetic coding sequence
atgccttacgaaatcaaaaaggtattcgcatccctgcctcaagttgaacggggggtgtctaaaattatcggcggagatccaaagggaaacaacttcctctacaccaacgggaaatgcgtgattcttaggaacattgacgatcactcgaggttcgttaattgcgttagattctcccccgatggtaatcggtttgcaactgcgtccgccgatgggcaaatctacatctacgatggtaaaaccggcgaaaaagtctgcgctttgggaggatccaaggcccacgacggcgggatatacgctatttcttggtcacccgattcaactcacttgttgtccgccagcggagacaaaacttcaaaaatttgggacgtgagcgttaacagcgttgtctctacgttccccatggggagcaccgtgctggaccagcaactggggtgcttatggcagaaggaccacctcctgtccgtatcgctctctggctacataaactatctggatagaaacaacccgtccaaacccctgcatgtcataaaaggccacagcaagtctattcagtgcctgaccgtccacaaaaacgggggaaaaagctatatttacagtggatctcatgacggccatatcaactattgggactctgagacaggtgaaaatgacagtttcgctggcaagggacatacgaatcaggtgtcgaggatgacagtggacgagagcggtcaactgatctcgtgttctatggatgacacggtgaggtatacgtctctgatgcttcgagactattccggccagggcgtggtgaagctggatgtacagccaaagtgtgtggccgtgggccctggcggctacgcagtggtggtttgtataggccagatcgtgctgctgaaagatcagagaaagtgttttagcatcgataatccaggatacgagccggaagtggtcgcagtgcatcctggaggagacacagtagccataggcggggtcgatggaaatgtgaggctatattccatcttgggaaccacactgaaagatgagggcaagctcctggaagccaaaggaccggtgactgacgtggcctactcccatgatggggcctttctggctgtctgtgatgcaagtaaggtggtgaccgtgtttagcgttgcagacgggtattccgagaacaacgtgttctacggccatcatgccaaaatcgtgtgcctggcctggtctcctgacaacgagcacttcgccagtggcggcatggacatgatggtctacgtgtggaccctttcagaccccgagacccgtgtgaaaatccaggatgcacatagactgcaccatgtctccagtctcgcctggcttgacgagcacacgctggtaactacctcccacgatgcctctgtgaaggagtggaccatcacatactag

SEQ ID NO: 140590 - DNA, 1821 bp, Artificial Sequence
  Description of Artificial Sequence: Synthetic coding sequence
atgccatacgaaatcaagaaggtgttcgcttccctcccccaggtcgagaggggcgtctccaagattattggaggagatcctaagggcaataatttcctatacacaaacggcaaatgcgtaattctgcgaaatattgacaaccccgccttagctgacatctacaccgaacacgcgcaccaggtggtggtggctaagtatgcgccctcaggcttctacattgcaagcggggacgtgagtggcaagttgcgcatctgggataccacccagaaggagcacctcctgaagtatgagtaccagcctttcgccggcaaaatcaaggacatcgcatggacagaagattcaaaaagaatagccgtggttggcgaagggagggaaaagttcggtgcagtgtttctctgggattccggatccagcgtgggggagattaccggacacaacaaagtaatcaattcagtcgatatcaagcagtcaagaccctacaggctcgcaaccggctccgacgacaactgcgccgcattttttgaggggccaccttttaaattcaagttcacaataggcgaccactctcgctttgtgaactgtgtgcgattcagtccagatggcaaccgtttcgcaacagcatcggcggacggacagatctatatttatgatggtaaaaccggcgagaaggtgtgtgccctgggaggttctaaggcgcacgatggcggcatttacgcaatctcttggtcccccgattccactcatctgttaagtgctagtggagacaagacctccaagatttgggacgtctcggtgaattcagtggtgtcgacgtttccaatgggatccacagtccttgatcagcagttgggatgtctatggcaaaaagatcatctcttaagtgtgtctctgtcagggtacattaactatctggacagaaataatcctagcaagccacttcacgttatcaaaggccattccaagagcatccagtgtctgacagtgcataagaatggaggcaagagctatatctatagcggtagtcatgatggtcacatcaattactgggacagtgagacaggcgaaaatgatagctttgcaggaaaaggccacacgaatcaagtctcccgaatgacagtcgacgaatctggacagctgatcagttgtagcatggatgacacagtccgctacactagtctgatgctacgtgattattctggtcaaggagtggtgaaactcgatgtgcagccaaaatgtgttgccgtaggccctggtgggtacgctgtggtagtttgtatcgggcagatcgttctgttgaaagaccagagaaaatgtttttccatagataacccgggatacgagcccgaggttgttgctgtgcaccctggtggagatactgtcgccattggtggcgttgatggcaacgtccgattgtatagcatactgggcactacactcaaagacgaggggaaactcctcgaggccaaaggcccggtgacggatgtggcttacagtcacgatggggctttcctggccgtgtgcgacgcaagtaaggtcgttacggtgttcagcgttgctgatggatacagtgaaaacaacgttttttatggccaccacgcaaagattgtatgcctcgcctggtcaccagataatgagcatttcgccagcggaggaatggatatgatggtctacgtttggacactgtccgaccctgaaacccgcgtgaagattcaagatgcccacagactacaccatgtctccagccttgcgtggctggacgagcacactctggttaccactagccatgatgctagcgtcaaggagtggacaatcacatactag

SEQ ID NO: 140591 - DNA, 1326 bp, Artificial Sequence
  Description of Artificial Sequence: Synthetic coding sequence
atgctaacatgggtatggtacttaatcatgactagtgtcttacaagcatctgtctcttctgtcgatcattcccggttcgtcaactgcgtcaggttctctcccgacggaaataggtttgctacggccagtgccgacggacagatctatatttacgatggcaagacgggagagaaagtgtgtgcgctgggtggaagcaaggcccacgacggcggcatttatgctatttcatggagtccagacagcactcatctgctgagcgcatctggtgataagacctctaagatctgggacgtgtctgtgaactctgtggttagcacgtttcctatgggatctacagtgttggatcaacaactgggctgcctgtggcagaaggaccacctcctgagcgtgagtctctctgggtacatcaattatctggacaggaacaacccttccaagcccttacacgtcatcaaaggacactctaagtcgattcagtgccttacagtgcacaaaaacggcgggaaatcatacatttattcaggaagccacgacgggcatatcaactactgggattctgaaaccggtgagaacgacagttttgctggtaagggccatacaaaccaggtgtctcgaatgacagttgatgagtccggacaactgatctcctgcagcatggacgacacagtcaggtacactagtcttatgttacgagattattcagggcagggagtagtgaagctcgatgtacaacccaagtgtgtggccgtcgggccaggcggttatgcagtcgttgtctgcattggtcagattgtgctgctgaaggaccaaagaaaatgtttcagcatcgacaatcctggctacgagcccgaggttgtcgcagtgcacccaggaggtgacactgtggcgattggcggggtcgatggcaacgtgcgcctatattcaatcctgggcacaacgcttaaagacgaaggaaagctcctcgaggccaaaggccctgtgaccgacgtggcctattcccatgacggcgcatttctggccgtctgcgacgcatccaaggtggtgactgtttttagtgtggccgatggctactctgagaacaacgtgttctacggacatcatgccaagatcgtttgtcttgcttggagccctgataatgagcactttgcttccggaggcatggacatgatggtgtatgtctggaccctcagcgatccagaaacgagagtcaagattcaggatgcccatcgcctgcatcacgtgagttcgctcgcctggctggacgagcataccctcgtgaccacctctcatgatgcatcggtgaaggagtggacaatcacatactag

SEQ ID NO: 140592 - DNA, 531 bp, Artificial Sequence
  Description of Artificial Sequence: Synthetic coding sequence
ccagcagaaacagagaaagtcttcgctagccttccacaggtggagcgaggcgttagcaagatcatcgggggggatccaaagggaaacaatttcctatacactaatgggaagtgcgtgattttgagaaatatcgatgaccacagtcgctttgtaaactgcgtgcggttttcacccgacgggaacaggttcgccaccgcatccgccgacgggcaatgtctgcctgccccggtcaccgctcagtcccggcgactgcctaacgcaagtcctgacatgcaaaatctggacatagctctgcccacttccgccgattcctcatcagagcccaagccccaatccatggaaaagctgcccccttggtccgcccattttccgtgggctccaaggttctggactagctcatgggcagcttacgggagacgcacaacttgctccgttagcccctgtccgggtacttctaccatctggacagaaacgacccccgctagtccctgtacctcctctcgtgtcaccgtaaaccgatcatcagtgtag

SEQ ID NO: 140593 - DNA, 1821 bp, Artificial Sequence
  Description of Artificial Sequence: Synthetic coding sequence
atgccgtacgagattaaaaaagtgtttgccagcttgccccaggtggagagaggggtgagtaaaattattggtggagaccccaaagggaataatttcctgtatacgaacggaaagtgcgtgatactgcgcaatatcgataacccagccttggctgacatctacacagaacatgctcaccaggtggtagtcgccaaatatgctccttcgggcttttatatagcatccggagacgtgtccggcaaactcagaatttgggatacaactcagaaagagcacctgttgaagtacgagtatcagcccttcgccggcaagatcaaggacatcgcctggacagaagacagcaagagaatagcggtggttggagaaggacgtgagaagttcggggccgtgttcctttgggatagtggttctagtgttggggaaatcaccggacataacaaagtcatcaatagcgtcgatatcaagcagtcacggccttacaggctggccacagggtcagacgataattgcgccgctttcttcgaaggaccccctttcaaattcaaattcactatcggtgatcacagcagattcgtgaactgtgtacggttttctccagatggcaaccggtttgccaccgcttccgccgacggacaaatttacatatacgatggaaagaccggcgaaaaagtgtgtgctttggggggttccaaggctcatgatggcggcatttacgctatcagctggtcgccagattctacccatctactctccgcttcaggcgacaaaacaagcaagatttgggacgtgtccgtgaactccgtggtctctaccttcccgatggggagcacagtgcttgaccagcaacttggttgcttgtggcagaaagatcacctattgtccgtcagtttgtcagggtacatcaactacctggatcggaataatccatctaagcccttacatgtaatcaaagggcacagtaagtcgatacaatgcctgacagtacataaaaacggagggaagtcgtacatctactccggctcccatgatgggcacataaactactgggatagcgagacgggcgagaatgatagttttgcagggaagggtcacacaaatcaggtcagtcggatgaccgtggacgaaagcggacagctgatatcatgctcaatggacgacactgtgcgatatacttcgctaatgctgagggattattctgggcagggtgttgtaaaactggacgtccagcctaaatgcgtggcggtgggacctggggggtacgcagtggtcgtttgcataggacagatagtgctgctcaaggatcagagaaagtgtttcagcatcgataaccctgggtacgagcccgaggtagtagccgtacatcccggaggagacactgtcgccataggaggcgttgatggcaacgtgcgcctctatagcatactgggtacgaccctgaaggatgagggcaagctgctggaggctaagggaccagtaaccgatgttgcttactcccatgacggggcctttctggctgtttgtgacgcctccaaggtcgtgactgtcttcagcgtggctgatgggtactctgaaaataatgtgttctacggccaccacgctaaaattgtctgcctggcctggtctcccgataatgagcattttgccagcggcggaatggatatgatggtctatgtatggactctgagcgatcctgaaaccagagttaagattcaggatgctcacaggctgcaccacgtgtcgagtttggcgtggcttgacgaacataccctggtgacaacttctcatgatgcctcagtaaaagaatggacaatcacctattag

SEQ ID NO: 140594 - DNA, 1401 bp, Artificial Sequence
  Description of Artificial Sequence: Synthetic coding sequence
atgccttatgagatcaaaaaggtgttcgcttctctgccacaagtggagcggggcgttagcaagattatcggaggagatcccaagggaaataacttcctgtacacaaatggaaagtgcgttatcttgagaaatattgatgatcatagccgtttcgtgaactgtgtgcggttttctcccgatggcaacaggtttgccactgccagtgctgatgggcagatctatatttacgacggaaagacaggagaaaaggtgtgtgccctgggcggctcaaaggcccacgatgggggtatttacgcaatcagttggtcacctgactctacccatctgctttctgctagcggagacaagacctccaaaatttgggacgttagcgtcaattccgttgtctcgacctttcccatggggtctacggttctggaccagcagttgggatgtctctggcagaaggatcatttgctgtctgtgagtctgagcggatacatcaattacctggatcgaaataacccctctaagccgctgcatgtgatcaaaggacacagtaaatccattcagtgcctgactgtgcataagaatggcgggaagtcttatatttacagtgggagccacgatggccacataaattactgggattctgaaaccggcgagaacgattccttcgctgggaaagggcataccaatcaggtcagtcggatgactgtggacgaaagcggccagcttatctcttgctccatggacgacaccgtgagatacacctccttaatgctccgggattactctgggcagggagtcgtgaaattggatgttcagcccaagtgcgtagctgtggggcccggcgggtatgccgtcgttgtgtgcatcgggcagattgtgctgctgaaggaccagcgcaagtgttttagtattgacaatcccggctatgagccagaggttgttgctgtccaccccgggggcgacacggtagcaattggcggggtggatgggaacgtgcgtctatacagtatcctgggcacaacactgaaagacgagggaaagctcctggaagcgaaaggtcctgtcactgacgtcgcctacagtcacgacggtgccttcctcgcggtatgtgacgcctctaaagtggtcactgtcttcagtgtggcagacggatattcagagaataacgtgttctatggtcatcacgcaaaaatcgtttgcttggcatggagccccgataatgaacatttcgcttcaggtggtatggatatgatggtttacgtttggaccttatcagatcccgaaactcgagttaagatccaggatgctcaccgattacatcacgtttcttcgctcgcgtggctggacgaacatacacttgttaccacgtcacacgacgcttccgtgaaggagtggaccattacatattag

SEQ ID NO: 140595 - DNA, 3675 bp, Artificial Sequence
  Description of Artificial Sequence: Synthetic coding sequence
atgctcccttacacagtgaatttcaaagtttccgcacgcaccttgactggggcacttaatgcgcacaacaaagctgcagtggactggggatggcaaggtctgatagcttacgggtgccatagtctggtggtagtcatcgacagcatcaccgctcaaaccctgcaggtgcttgaaaaacacaaggcggatgtggtcaaagtgaagtgggctcgtgagaactaccatcacaatattggatccccatactgtctcagactagcgtccgcggacgtcaacgggaaaattattgtgtgggatgtggccgcgggtgtggcccagtgcgaaattcaagagcacgccaaacctatccaggacgttcaatggctgtggaatcaggatgccagtcgggacttgttgctggccatccacccacctaactacatcgtgctctggaacgcggataccgggacgaaactttggaaaaaatcatatgcggacaacattctcagtttcagcttcgacccctttgatccttcacatctgacactgcttacttctgaggggattgttttcatttctgatttctctccgtctaaaccaccttccggacctggaaaaaaggtgtatattagctccccacattcctccccagctcataataaattggccacagcgaccggagcgaagaaagctctcaataaggtgaaaatcctgatcacccaggaaaagccctctgcagaatttatcacactgaatgattgcctgcagctggcttatctgccttctaagcgaaaccacatgttgctcctgtatcctcgagagattctaattctggacctagaagttaaccagacagtgggtgttatcgcgatcgaaaggacaggagttcccttcctgcaggtgatcccttgcttccaaagggacggccttttctgtctccacgaaaatggctgcataaccctccgggtaagacggtcctataacaacatctttaccacgagtaacgaagaaccagatcccgatcccgttcaagagctgacttacgacctaaggtcccagtgcgacgccattagagtaacgaagaccgtcagacccttctctatggtgtgctgtcccgtcaacgaaaacgcagcggccttagtcgtgtctgacggccgggtgatgatttgggagttgaaatcagccgtctgtaacagaaattcgaggaattcttcaagtggcgtgtctccactgtattctcctgtctccttttgtgggatcccggtgggagtgctgcagaataagttgcccgatctgtccctggataacatgatcgggcaatctgccattgcaggcgaggagcaccctagaggatctattcttagggaggtgcaccttaagttcttactgaccggcctcctgagcggcctcccggctccccaatttgccatccgcatgtgcccccccctcacaacaaagaatatcaagatgtatcagcccctgcttgcagtcggcacatcaaatggaagtgttctggtgtaccacctaacttctgggcttctgcacaaagaactgtccattcatagctgcgaggttaaaggcattgagtggacatccctgacttccttcctgtcatttgcaacatccacacctaacaacatgggactggttcgtaatgaattgcaactcgttgatttgccaaccggtcggagcattgcatttagaggtgaaagaggcaatgacgaaagcgctattgagatgatcaaagtctcacacctgaaacagtatttggctgtggtgtttagagataaacccctggaactctgggacgtccgaacttgcacgttactcagggaaatgagcaaaaacttcccgactatcacggctctggagtggagtccaagccataacctgaaaagtctgcgtaaaaagcaattggctacacgcgaggcaatggctaggcagaccgtagtatcggatacagagttgagcattgtggagtcaagcgtaataagtctgctacaagaagccgaatctaaatcagaactgtctcagaacatttctgctcgagagcacttcgtcttcaccgatatcgatgggcaggtttatcatttaaccgtggagggcaattctgttaaggactcagcacggatcccgcccgatggtagtatggggtccatcacttgtattgcctggaaaggagacactctggtgctgggcgacatggacgggaacctgaacttctgggacttaaaaggcagagtaagtcgcggcatccccactcatcgatcatgggtcaggaaaatccggtttgcaccagggaagggaaaccagaaactgattgctatgtataacgacggcgccgaagtatgggatactaaagaagtccagatggtcagcagcctgaggtctggacggaacgtgacattccggatcctggacgtggattggtgtacctcagataaagttatactggcctctgacgatggatgtatccgagttttagaaatgagtatgaagagtgcatgtttccggatggacgaacaggaactgacagaaccagtgtggtgcccctacctccttgtaccacgagcctccctcgcactaaaggctttcctcctgcaccagccgtggaatggccagtatagcttagacatatcccatgttgattatcccgaaaatgaggaaatcaaaaacctgctacaagagcagctgaatagtttgtcaaacgacatcaagaaactcctactcgaccctgaatttacattattgcaacggtgtctcctggtttctaggctgtacggcgacgaaagcgaattgcatttttggactgtcgctgctcattatctgcattctctgtcacaggagaaatcggcatcgaccactgctcccaaggaagctgccccacgggacaaactgtccaaccccctggacatatgctatgatgtcttgtgcgaaaatgcttactttcagaaattccagctcgagagagtcaatctgcaggaggtcaagaggtctacctatgaccatactcgcaaatgtacagaccagttgttgttacttgggcagacagatcgagccgtccagctgctcctggagacctcagcagataatcagcattactattgcgactctttaaaagcatgtttggtgacaaccgtaacctcctctggcccctctcagtccacaatcaagctggtagcaacaaatatgatagcaaatggcaagctcgctgagggcgttcagctgctgtgcctgattgataaggcggcggacgcttgccgctacctgcagacctatggagagtggaacagggccgcatggttggcaaaagtgagactcaatccggaagaatgcgccgacgttctacgaaggtgggtggaccacctgtgttccccacaggtcaatcagaaatccaaggctttgctggtgctcctgtcgctgggctgtttctttagtgtagctgagaccctccactcgatgcggtactttgacagagccgcactcttcgttgaggcatgtctgaaatatggagcatttgaggtgacagaagatacagagaagcttatcactgctatctatgccgattacgcccgaagcctcaagaacctcgggttcaagcagggcgctgtccttttcgcttctaaagcgggcgccgcaggcaaggacttactgaacgaacttgagtcccccaaggaagagcctattgaagagtag

SEQ ID NO: 140596 - DNA, 1371 bp, Artificial Sequence
  Description of Artificial Sequence: Synthetic coding sequence
atgcggaaaaaatggaagatgggagggatgaaatatatcttcagtctccttttctttcttctgctagagggaggtaaaacagagcaggtcaaacacagcgagacttactgcatgtttcaggataagaaataccgggtaggcgagcggtggcacccgtaccttgagccctacggactggtctattgtgtgaactgcatttgtagtgaaaacggcaatgtcttatgtagccgtgtgaggtgcccaaatgtacactgtttgtcccctgtgcacattcctcatttatgttgtccccgatgcccagactcactgcccccagttaacaataaagtgacgtccaagtcttgcgagtataatgggacgacctatcaacacggggagttgtttgtcgcggagggcctcttccagaaccgtcagccaaatcagtgcacccaatgttcatgcagcgagggcaatgtgtattgtggccttaagacctgccccaagttgacatgtgcttttcctgttagtgtgccagattcttgctgtagggtttgtcggggtgatggagaattgtcgtgggagcatagcgacggagacatctttcggcagcccgcgaaccgcgaagcgagacactcttatcacaggagtcattacgacccccctccctcccgacaggccggcgggctttcgcggtttccgggggctcgctcacatcgcggggcactgatggattcccagcaagctagcggaaccatcgtgcagatcgtgatcaacaacaaacataagcacggtcaggtgtgcgtctccaatgggaaaacctatagccatggcgagtcctggcaccctaatctccgggcttttggaattgtcgaatgcgttctttgtacatgtaatgtcacaaagcaggagtgcaagaaaatccattgtcctaaccgctatccttgtaagtacccccagaagatagatggaaaatgctgtaaggtctgcccggggaagaaggcaaaagaattgcccggacaaagttttgacaacaaaggatatttctgtggcgaggagactatgcctgtgtacgagtctgtgttcatggaagacggagagaccactagaaaaatcgccttggagaccgagcgtccgccacaggttgaggttcacgtgtggaccatcagaaaaggaatcctccagcacttccacattgaaaagatcagcaagagaatgttcgaggagctgcctcacttcaagctggtcaccaggacaactctttcccagtggaagatcttcacagaaggcgaagcccagataagccagatgtgtagttctcgggtttgcagaaccgaactggaggatctcgtgaaggtgctttatttggaaaggtcggagaagggccattgctag

SEQ ID NO: 140597 - DNA, 1458 bp, Artificial Sequence
  Description of Artificial Sequence: Synthetic coding sequence
atggccgctgtctggcaacaggtcctggcggtggatgcccggtataacgcttatcggacacccacctttccccaattccggactcaatacattcggagaaggagtcagctgttgcgcgaaaatgcaaaggcgggtcacccacctgctctacgaagacagtacttacggctcaggggtcagttgttgggccagagatatgggccactgagcgagccaggtagtgcccgagcgtactcgaactctattgtacgcagcagtaggacaacacttgaccgcatggaagactttgaagacgatcccagagcgctgggtgctcgcggccaccgacgtagcgtgtctcgtgggagctatcaactgcaggcacaaatgaacagagccgtctacgaggatcgccctcctggcagtgtagttcccactagcgcggctgaggcgagtcgtgccatggctggggatacctctttgtctgagaactacgccttcgccggtatgtatcatgttttcgaccagcatgtggatgaggccgtgcctcgagtgcgcttcgctaacgacgatcggcaccgcttggcctgctgcagcctggatggatctatttcactatgccaactcgtgccggccccaccaaccgtgctgagagtattgcgcggacacacaagaggggtgagcgacttcgcctggtcgctctcgaacgatatccttgtgtctacttctctggatgccaccatgaggatttgggcaagcgaagacgggcggtgcattcgggagatcccagatcctgatagcgctgaactgctgtgctgtacattccagcctgtcaataataacttgacagtggtaggaaatgcaaaacacaacgtccacgtcatgaatatcagtactggcaaaaaagtcaaaggagggtcttcaaaattgaccggccgtgtgctagcccttagctttgatgctcccggccggctcttatgggcaggcgatgaccatggctcagtgttcagtttcctattcgatatggccactggaaagctgactaaggctaagaggctcgttgtacacgagggttctcccgtcactagcataagcgccaggtcctgggtaagtcgagaagcacgagatccatccctgttgatcaacgcctgccttaataaactccttctgtacagagtggtggacaacgaaggaacactccagctcaaacgatcttttcccatcgagcaaagctcacaccctgtccggtcaatattctgccctctgatgtcctttagacagggagcctgtgtggtgacaggttcagaggacatgtgcgttcatttttttgatgttgagagagctgcaaaagctgctgtcaacaaactgcagggacattcggcacccgttctggacgtaagctttaattgcgacgagtccttacttgcatcaagtgatgctagcggaatggtgatcgtgtggagacgagagcaaaaatag

SEQ ID NO: 140598 - DNA, 1893 bp, Artificial Sequence
  Description of Artificial Sequence: Synthetic coding sequence
atggaggccgtcgttcttccttggcagatatttggggttcgggagctgccggtcgaacggggcgtcaccatgaaaggcccccgcctgtttcgcgcgcctggacatgtccctaccggactcaagtgccaccctgaccaggagcatatgatttaccccttgggctgcactgtcttgattcaggccatcaacactaaggagcagaactttctgcagggccatggaaacaacgtctcctgtctcgccatttcacgctccggagaatacatcgcgagtggccaggtgactttcatggggttcaaagccgatatcatcctatgggactacaaaaatcgagaattgctagctagactgagcctgcacaaaggcaagattgaagcgctggctttctctcccaatgatttgtacctcgtgagcctgggcggcccggacgatgggtcggttgtggtgtggagtatagcaaagagagacgctatctgtggtagtcccgcagcgggacttaatgtgggtaatgcgactaatgtgattttctctaggtgtagagacgaaatgtttatgacagccggcaacggaacaatccgcgtgtgggagctggatcttcccaatagaaaaatatggccaaccgaatgtcaaactggtcaactcaaacggatagtgatgtcaatcggagtggatgatgacgatagctttttttacctaggcacaacaaccggcgacattttgaagatgaacccccggacaaaactgctgacagacgtgggccctgccaaggacaagttctctctaggagtgagcgccattcgttgtcttaagatgggtggacttctggtagggtcaggggccgggttgctggtgttctgtaagtctcctggctacaagccaataaagaagattcaactacagggagggataaccagtataactttgcgcggcgagggccatcagttcttagtcggcacagaggagtcacacatctatcgggtatccttcactgattttaaggagacgctcatagcaacgtgtcacttcgatgcagttgaggatatcgtgtttccgtttggtacagccgagctgtttgccacctgtgccaagaaggatattcgcgtctggcacactagtagtaatcgcgagctgttgcggattacagttccaaacatgacctgccacggaatcgactttatgcgggacgggaagtccattatctccgcgtggaatgatggaaaaatacgggcttttgcaccagaaactggccgtttgatgtacgtgatcaataacgcccacagaatcggtgtgaccgctattgcgacaacaagcgactgcaagcgggtcattagcggcgggggagagggggaggtgcgggtgtggcagatcggttgtcagacccagaagcttgaggaggccttaaaagaacacaagagctctgtgtcctgtatcagggtaaaaaggaacaacgaggagtgcgttaccgcatcaactgacggcacttgcataatatgggacctggttaggcttaggaggaatcagatgattctggcgaacactctctttcagtgcgtatgttaccatcccgaagagtttcagatcataacctctggcaccgaccggaaaattgcctactgggaggtattcgatggcactgtgattcgagagctggaaggttccctgtccggctcaatcaacggtatggatattacccaggaaggagtacatttcgtgacaggcggtaatgatcatctggtcaaggtttgggattacaacgaaggcgaagtcacacacgtcggggtcggccattcaggtaacattacccggatccgaattagccctgggaatcagtacatcgtatctgtgagcgctgatggagccattctgcgttggaaatatccttacacaagctag

SEQ ID NO: 140599 - DNA, 1863 bp, Artificial Sequence
  Description of Artificial Sequence: Synthetic coding sequence
atggacaataagattagccccgaagcgcaagtcgcagaacttgaactggatgctgtaataggttttaatggccatgtgcctacaggacttaagtgccatcctgaccaagagcacatgatctatccattgggatgcacagttctgatccaggctattaacaccaaggagcagaacttcctgcaggggcatgggaataacgtgtcttgtttggcaataagccgaagcggcgaatacatcgctagcggccaggtgacctttatgggatttaaagcagacataattctgtgggactataaaaatagagaacttctggcccgcctgtcccttcacaagggaaagatcgaagccttagccttttcaccaaatgacctgtaccttgtatcactcgggggtccggatgacggaagcgtggtggtatggagcatcgctaagagagatgccatttgtggatcaccagccgcagggttgaatgtcggaaatgcaaccaacgtgattttcagccgatgtagggatgagatgttcatgaccgccggtaacggaactataagagtgtgggaactggaccttcccaataggaaaatctggccaacagaatgtcagaccggccagctgaagcggattgtaatgtccatcggcgttgacgacgatgacagtttcttttacctgggcacgacaactggtgacattttaaagatgaatcctcgaacgaaacttctgaccgatgtcggacccgctaaggacaagttcagcttaggagtttctgccattcgatgtctcaagatgggcggtctgctggtgggcagcggcgccgggctgcttgtcttctgcaaatccccagggtacaagcctataaagaaaattcagctccagggtgggatcacatccatcacactccggggcgagggacatcagtttttagttgggactgaggaatctcacatatacagagttagtttcacagacttcaaggagacactcatcgccacctgccactttgatgctgttgaggatatagtgttcccttttggaactgctgagttattcgccacatgcgcaaagaaagacatccgtgtgtggcatacatcctccaatagagagctccttcggatcaccgtgcctaatatgacctgccacgggattgattttatgagggatggcaaatccatcattagtgcttggaacgacggaaaaatccgggcgtttgcacccgagacaggtcgactcatgtatgtcataaataacgctcaccgtatcggagtgacagcaatcgccaccacatcagattgtaagcgcgttattagcgggggaggcgagggcgaagtgagagtttggcagatcgggtgtcagacccagaaattagaggaggcccttaaggagcataaaagcagcgtcagttgcattcgcgtgaagcgtaacaacgaagagtgcgtgaccgcatctaccgatggcacttgcatcatctgggacctggtgagactccgacgtaaccagatgatcctagcaaataccttgtttcagtgcgtgtgctatcacccagaggagtttcagataatcacaagtgggaccgatcggaagatcgcctactgggaggtcttcgacggcacagttattcgcgaactggagggcagtctgagcggcagcataaatgggatggacattacacaggagggtgtccacttcgtgacaggtgggaacgatcacctcgttaaggtgtgggactacaatgagggtgaagttacccatgtaggggtgggacattcaggcaacatcacgcggatccgaatcagccccggcaatcagtatatcgtctcagtgtcagccgatggagccatccttaggtggaaatatccctacacttcctag

SEQ ID NO: 140600 - DNA, 1659 bp, Artificial Sequence
  Description of Artificial Sequence: Synthetic coding sequence
atggataataagatttctccagaagctcaggtggctgagctagagttagatgccgtgatcggatttaatgacatcattctttgggactacaaaaacagggagctcctcgcgcgcctgtccttgcacaaagggaaaatcgaggctctggcattttcgcctaacgatctgtacttagtgtccctgggcgggcccgatgatggctcagtggtggtatggagcatagctaaacgcgatgctatctgtggctcccccgcggccggactgaacgtaggaaatgcgacaaatgtgatcttcagcagatgccgagatgagatgttcatgactgcgggcaacggtacaatcagggtctgggagttggatctacccaacagaaagatctggcccacagagtgccagacaggccaactgaagagaattgtgatgagcataggggtcgatgatgatgactccttcttttatcttggaactacaaccggggatatcctgaaaatgaaccctcggactaagctgttaaccgacgtggggcctgctaaggacaaattcagcctgggagtgtcggccattagatgtcttaagatgggtggtctgctggtggggtctggggcagggctgctcgtattttgtaagagtccaggctacaaaccaataaagaagatccaactgcagggaggtattacgtcgataacactgcgaggcgaggggcatcaatttctcgtggggacagaagaaagccacatctacagagtgtccttcaccgattttaaagagacactcattgctacatgtcactttgacgccgtggaagatatcgtttttcccttcggcaccgccgagctgttcgcaacctgtgctaagaaagacattcgcgtgtggcatacatcaagcaaccgcgagctgcttaggataacagtcccgaatatgacttgtcacggcatcgatttcatgagagatgggaaatccatcatctctgcttggaacgatggaaagattcgagcctttgccccggaaactggcaggctgatgtatgtgataaacaacgctcacaggatcggggtgacagctatagcgaccacaagcgactgcaagcgggtcattagtggtggaggggaaggcgaggttagggtttggcaaatcggctgccagactcaaaagctcgaggaggctctgaaggagcataagagttcggttagctgcatcagggtcaaacgcaataacgaggagtgcgtgactgcatctacagatgggacgtgcatcatttgggatctcgtgaggctccggcggaatcaaatgattctggccaacacactgtttcagtgcgtgtgctatcaccctgaggagtttcaaataataacttctgggacagaccgtaagatcgcctattgggaggtttttgatgggacagtgattagagaacttgaaggtagcttgagtggaagtataaatggtatggacatcacacaggagggtgtgcatttcgtgaccggaggtaatgatcacctggttaaggtttgggattataatgagggtgaagtgacacatgtgggcgtaggccactctgggaacatcaccagaatccgcatctctccagggaatcaatatattgtgtctgtgagtgcagacggcgccattctgcgctggaaatacccatatacctcatag

SEQ ID NO: 140601 - DNA, 3969 bp, Artificial Sequence
  Description of Artificial Sequence: Synthetic coding sequence
atggcctggatgacctatatatcgaactggtttgagcaggatgactggtacgaggggctgcagagggctaatatgtctcaggtccggcaggtaggtctgctggcagccgggtgtcagccctggaacaaagacgtgtgtgccgcaagcggcgacaggttcgcctactgtgctacacttgccatctacatataccagctggaccaccgctataacgaattcaaactgcacgccattatgagtgaacataaaaagaccatcacagccataagctggtgcccccacaatcctgatctgtttgcctccggaagcaccgataatctcgtcattatctggaacgtggcggaacagaaggttatagccaagctggattccaccaagggaataccagcaagtctctcatggtgttggaacgcagaagacgtggtcgcctttgttagccacagggggcctctgttcatttggactataagcgggcccgatagtggggtgattgtgcacaaagatgctcacagttttctaagtgacatctgtatgttccggtggcatacccatcaaaaggggaaggtggtgttcggtcacattgacggctccctctcgatattccaccctgggaacaaaaatcagaaacacgtgcttaggcctgagagcttagagggtaccgacgaagaagaccctgtcacagcactggaatgggaccctctgtcaactgactacctcctcgtagtgaacctgcactacggcatcagactcgtcgatagcgaaagtctgtcctgtatcacaaccttcaacctcccctctgccgcagcttcagttcagtgcctcgcgtgggtgcccagtgcacccggcatgttcattactggtgactcacaggtaggagtgctccgaatttggaacgtctccaggaccacaccgatagacaatctaaaattaaagaagacaggctttcactgcctgcacgtgctcaattctcccccacgaaagaagttctcagtccagagcccaacgaagaatcactatacaagttcaacttcagaggccgtcccaccccctacactgacacaaaatcaggccttttcactgcctcccggacatgcagtatgctgctttcttgacggcggggtcgggctgtatgatatgggagccaagaagtgggactttttgagagatctcgggcacgtagaaactatcttcgattgtaaattcaaaccagatgaccccaatcttcttgccaccgcttcgttcgatggtacgatcaaggtgtgggacataaatacgttaaccgctgtatacacatctcccggcaatgaaggggtgatttactctttgtcatgggcccctggggggttgaattgcattgcgggaggaacttcgagaaacggcgctttcatttggaatgtgcagaaagggaaaataatccagaggtttaatgaacacgggactaatggcatcttctgcatcgcttggtcccacaaggattctaaacgaatcgccacttgttcaagcgacgggttctgcattatccgaaccattgatggcaaagtactgcacaaatacaagcacccagcagctgtgttcggctgtgactggtctcagaataacaaagatatgattgccaccggctgcgaggataccaacgtccgggtgtactatgtggcaacttctagcgaccagcctctgaaggtgttcagtggacacaccgccaaagtgttccacgtgaagtggtcccccctgagggaggggattctgtgttcagggagcgatgacgggactgtgcggatatgggactatacccaggacgcctgtattaatatcttaaatggtcatacggccccagtgaggggcttaatgtggaacaccgagataccctatctcctgatctccgggtcatgggattatactatcaaggtgtgggataccagagaaggcacttgcgtcgacactgtgtatgaccacggcgctgacgtttacgggctgacctgccatccctctagaccgtttaccatggcatcctgcagtcgcgactcgaccgttaggctctggagcctgaccgccctggtcacccctgtccagattaatattctggccgacagaagctgggaagagattatcggcaataccgactacgcaatcgagcccgggacaccgcctctgctctgcgggaaggtgtccagagacatccggcaagaaattgaaaagctgaccgccaactcccaggttaaaaaacttcgctggttttcagagtgcctctccccgcctggcggatcagataatctctggaatctcgtcgctgtaattaaaggtcaggatgactccctgctcccgcaaaattactgtaaaggaattatgcaccttaagcatctgatcaagttccgaacttccgaggctcaggagctaacaaccgttaaaatgtcaaagtttggcggaggaatcggcgtaccagccaaagaggaaaggctgaaggaagcagcggaaatccatctgaggctgggccagattcaacggtactgcgagttaatggttgagctaggcgaatgggataaggcacttagcattgcccccggggtttccgtcaaatactggaaaaagcttatgcagcgccgcgccgaccagctgattcaggaagataaagatgatgtcattccctactgcatcgcaataggagatgtaaaaaagctggtgcacttcttcatgagcagagggcagttaaaagaggccctgcttgtggcacaagctgcttgcgaaggaaatatgcagcccttacatgtttcagtcccaaagggggccagctactccgatgatatttataaggaggatttcaatgaattgcttcacaaggtgtcgaaagagctggccgagtggtactttcaggatggacgagccgtcctcgcggcctgctgccatctggccatcgacaatatcgagctagccatggcatatcttatccggggtaacgaattagagctagccgtatgtgtcgggactgtcctgggtgagtcagcggccccagctactcactatgctctcgagcttttagcgagaaaatgcatgatgatttcagtgtgttttccttgcgtgggatattcagttccgttctgttacgtcaacaggaacctcgcagccgacctgctcttaatgattcctgacaacgagctccacctgatcaaactgtgtgcgttctacccaggctgtactgaagagataaatgatttacacgataagtgcaagctcccgaccgttgaagagtgtatgcagctggctgaaacagctcgagctgacgataatattttcgaaaccgtgaaatattaccttctgtcccaagaaccggaaaaggcactgccgattggaatatcttttgtgaaggagtatattagttcttccgattggaccctggacacaatttaccccgtactggacctgctcagctatattagaactgaaaagctactgcttcacacttgcacagaagcgaggaacgagcttttgattctctgcggctacatcggagctctgctggcaatcagacgccaataccagtctatagttcctgccttgtatgagtacacctcccagctcttgaaaaggcgcgaggtcagcgtgccccttaaaatcgaatacctgtctgaggagctggatgcgtggcgcgcttgtacccagtctacaaataggtccttagaagattctccctacacacccccgtctgactctcagaggatgatatacgctacactgcttaagcgcctcaaggaggaatccctcaaaggaattatcgggccagactacgtaacaggctcaaacctcccctcccatagcgatatccatattagctgtctgaccggcctcaagatacaaggaccagtgttctttttagaggacggaaagtccgccattagcctgaacgacgctctcatgtgggcgaaagtaaatccattttcaccactcggtacagggatccggttgaaccccttttag

SEQ ID NO: 140602 - DNA, 393 bp, Artificial Sequence
  Description of Artificial Sequence: Synthetic coding sequence
atgtcacaggtcaggcaggttggactgcttgccgccgggtgccagccctggaacaaggatgtgtgtgcagcgagtggggatcgcttcgcgtactgcgccactcttgccatttacatatatcagttagaccatcgctataacgagttcaaactccacgccataatgagcgagcacaaaaagactatcaccgccatttcctggtgcccccacaatccagacctgttcgctagtggaagcaccgacaacctagttatcatctggaacgttgctgagcagaaagtgatcgcgaaattagacagggctaggccacccagtccaaagataatttatataaagatcattaacatcatagaagagaacatccataactccgaaatgcagtggattatctag

SEQ ID NO: 140603 - DNA, 3897 bp, Artificial Sequence
  Description of Artificial Sequence: Synthetic coding sequence
atgtcacaagtacggcaggtaggcctcctagccgccggatgccaaccgtggaataaggatgtgtgcgcagctagcggggaccgcttcgcatattgtgcaacactcgcaatctatatctaccagctggaccataggtataacgagtttaagttgcacgccattatgagcgagcacaaaaagaccattacagctatatcctggtgcccacacaaccctgatttatttgcttcaggatcaacagataatctggttattatctggaacgtcgcagaacagaaggtcatagccaagctggactcaacgaagggcattccagcctctctaagttggtgttggaatgccgaggatgtggtggcctttgtcagccaccgaggcccactcttcatatggaccatctcaggacccgattccggcgtcattgtccataaagacgctcacagtttcttgagcgacatttgcatgtttcgctggcatacccaccaaaaagggaaagttgtgtttggtcacattgacggtagcctgtcaatcttccaccctggcaacaaaaatcagaagcatgtactgagaccagaatccttggagggcacagacgaagaggatcccgtgacagccctcgaatgggatcctctttctacagactaccttctggttgtaaatctacactacgggattcggctggtcgacagtgagagcctgtcttgcatcactacctttaacctgcccagtgcagcagcttctgttcagtgtttggcatgggtgccttccgctcccggtatgtttattactggggactcgcaggtaggagtgttgcgtatttggaacgtgtccagaaccacgcccatagacaacttgaaactgaaaaagacgggcttccattgcctccatgtcctgaattccccccccagaaaaaaattctccgtgcagagtcctacaaagaaccattacacatctagcacaagcgaggcagtgcctcctcctactttaacccagaatcaggccttttctttgccgcccggccatgcagtttgctgctttctcgatggcggggtcggcctgtacgatatgggggctaagaagtgggatttcctccgggatctcggacatgtagaaactatatttgactgcaagtttaagcccgatgaccccaacctgttggctaccgctagctttgacggcactatcaaagtgtgggacattaatactctgaccgctgtgtacacatccccaggtaatgaaggcgtgatctatagcttaagctgggcaccaggaggcttaaattgcatcgcgggtggcacctctagaaatggtgccttcatctggaatgtgcaaaaggggaagatcatacaacgttttaatgaacacggaaccaatggaattttctgtattgcatggagccacaaggacagcaaacgcattgcgacatgcagctcggatggtttctgtataattcggacaatagatggaaaggtgctacacaaatacaagcatccggcagcagtgttcggttgtgactggtctcaaaataacaaggatatgattgcaacaggctgcgaagatacaaatgtgagagtctactatgtcgcaaccagctccgaccagccgctgaaagtctttagcggtcacactgctaaggtttttcatgtgaaatggagcccactgcgggaagggattctgtgttccggatccgacgacggcaccgttaggatctgggattatacccaggacgcctgcattaatatcctgaacggccacacagcacctgtacggggcctcatgtggaacactgaaataccctatcttctgataagtggatcttgggactacacgattaaagtctgggatacccgggagggcacatgcgtggacaccgtgtatgaccatggcgcagacgtgtatggactgacatgtcacccttctcgtccctttacgatggcgtcctgttctcgtgactcgactgtccgcctatggagcctcacagctttggttacccctgtgcagattaatattctcgcggacagaagttgggaagaaatcattgggaataccgactatgctattgaacccgggactccccccctcctatgcggaaaggttagtagagatatacgccaggaaatcgagaaacttacagcgaatagccaggtgaagaagctgcggtggttctccgaatgcctgtccccacccggcggcagcgacaatctctggaaccttgtggctgtgatcaaaggacaagacgatagcttactaccgcagaactattgtaaaggaatcatgcatcttaagcacctcatcaagtttaggacttctgaagcccaagaactaaccacagttaaaatgtctaagttcggtggcgggatcggggtgcctgctaaagaggagagattgaaagaggcagctgaaatccatctgagattagggcagatccagcggtattgcgaactgatggttgagcttggagagtgggacaaggccctgtccatcgcccccggcgtctccgttaaatactggaagaaactcatgcaacggcgggccgatcaactcatccaggaggataaagacgatgttataccatactgcatcgcaatcggcgacgtgaagaagctggtgcacttctttatgagcagagggcagctgaaggaagccctgctggttgctcaggctgcttgtgaaggcaacatgcagccattgcacgtgtcagttccaaaaggcgctagctattccgacgatatctataaagaagatttcaacgaactgctacataaggtgagtaaggaactggccgagtggtatttccaggacggtagggccgttctggctgcgtgttgtcaccttgccattgacaatattgagctggcgatggcttatctgatcagaggaaacgagctggaactggcagtgtgtgtgggaaccgtcttgggtgaaagcgcagcgcccgccacacattatgcactcgaacttcttgctcgcaaatgtatgatgatctcagtttgttttccgtgtgtaggatatagcgtgcccttctgttacgtcaacaggaacctggctgcagatctgctactcatgatcccagacaatgaactgcacctaattaaactatgtgccttctatccagggtgcacagaagagataaatgacctgcacgacaagtgcaagctgccgaccgtggaagagtgcatgcagttagccgagactgccagagctgacgataatatcttcgaaaccgtaaaatactatctgttgagccaagagcctgaaaaggctttaccaatcggaatctcatttgttaaagagtacatttcgtcatctgactggactctcgatactatctacccggttctcgacctgctgtcctacattagaacggagaagcttcttcttcacacttgtacagaggcgcgcaacgaattgctaattctctgcggctacatcggtgccctgctggcaattcggaggcagtaccaatccatcgtaccagctctgtacgagtacacaagccagctactgaaaaggcgagaagtcagcgtcccgctgaaaatcgagtatctttctgaagaactagacgcctggagagcatgcacacagtcgacaaaccgcagtttggaggactctccatacacacctccatccgatagccagaggatgatttatgccacgttgttaaagcgactcaaagaggaatctctaaagggtattataggtccggattacgtgacgggttcaaatctaccatcacattcagatatccacatatcttgcctaaccggcctcaagatacaaggcccagtcttcttcttggaggacggcaaaagcgctatctcgctgaacgacgccctcatgtgggcaaaagtcaacccttttagtccgctgggaactggcataaggttgaatcccttttag

SEQ ID NO: 140604 - DNA, 3852 bp, Artificial Sequence
  Description of Artificial Sequence: Synthetic coding sequence
atgagccaagtcagacaggtagggctgctggcagccggctgtcaaccttggaataaagacgtctgcgctgcgtcaggtgatcgattcgcttactgcgccacattggcaatttatatttaccagcttgaccatagatacaatgaattcaaactccatgccatcatgtcagagcataagaaaaccatcaccgctatctcctggtgtcctcacaaccccgatctattcgcatcagggagtacagataacctggtgataatttggaatgtggctgaacagaaggttatcgctaaactagacagcaccaaagggatcccagccagtctgtcatggtgctggaatgcggaagacgtggtggcgttcgtctcccaccgaggaccgctgtttatctggacaatctccggacccgattccggggtgatcgtgcacaaggatgctcatagtttcctttctgatatctgtatgttcaggtggcacacccaccagaagggcaaagttgtgttcggtcatattgatggatcactatctatctttcatccgggcaacaagaatcagaagcatgtattgcggccagaaagcctggaaggtactgacgaggaagaccccgtaacggcactcgaatgggacccgctctccactgactaccttctcgtggttaacttgcattatgggatcagactcgtggatagtgagtctctgtcttgcattaccaccttcaatcttccttctgcggccgctagcgtccagtgtctcgcttgggtgccatctgccccagggatgtttatcacgggggacagtcaagtaggcgtgctgagaatttggaacgtctcccgcaccacaccaatcgacaatctcaaactgaagaaaacaggtttccattgtttgcatgtcctaaactctcctccccgtaaaaaattctctgtacagtcacccactaaaaatcactatacgtcgagtactagcgaggctgtcccaccaccaactttgactcaaaaccaggccttctcattgccacctggccacgctgtatgttgcttcctggatggaggggtggggttatacgatatgggtgccaagaaatgggacttcctacgcgacctggggcacgttgagacaatttttgattgcaagtttaaacctgatgaccccaacctgttagctaccgcctcattcgatggaactatcaaggtctgggatataaacacacttactgccgtttatacatcaccaggtaatgagggcgtgatctatagtttaagctgggcacctggaggcctgaactgtattgctgggggaacctcgcgtaatggggcattcatctggaacgtccaaaaggggaagatcattcaacggtttaacgagcacggcaccaatggcattttctgtattgcctggagccacaaggattctaagcggattgctacatgctcctcagacggcttttgtattattcgcacaatcgacggcaaagtcctacacaaatacaagcaccctgccgctgtttttgggtgcgactggagtcagaataacaaggacatgatagctacaggatgcgaagatactaacgttcgagtctactacgtcgccactagcagcgatcagccactgaaggtgttcagcggacacacagccaaggtgttccatgtgaagtggagtccactacgtgaaggcattctctgtagcggtagcgacgatggcactgttcgcatctgggattacacccaggacgcttgcatcaacatccttaatggccacactgcccccgtgagaggactgatgtggaatacggaaattccctatctcctaatctccgggtcttgggattataccataaaggtgtgggacactcgtgaggggacgtgcgtggatacagtgtacgaccacggcgccgatgtctacgggctcacctgccaccctagtcggccatttaccatggcctcctgttctagagatagcaccgtgcggctctggagtctgacagccctcgtaacccctgttcagatcaacatactggctgaccggtcttgggaagaaatcattggcaacacagactatgccatagagcctgggacccctccgctcctgtgcgggaaggtctcccgagatatccgtcaggaaatagagaagctgaccgctaactcccaggtgaagaaactcagatggttcagtgaatgcctatcaccacctggaggatctgacaatctctggaacctcgtcgctgtaatcaaagggcaggacgattctctgctacctcagaattactgcaaaggtattatgcatctgaagcacctcatcaaattcagaacatcagaggcccaggagctcacaactgtcaagatgagcaagttcggaggcggcatcggagttccggcgaaggaagaacgcctgaaggaggccgccgagattcatcttcgattgggtcagatccagcggtattgtgagctaatggtggagctgggggagtgggacaaggcactctccatcgctccaggggtgagcgtgaagtactggaagaagctgatgcagagacgggctgaccagctgattcaggaggacaaagatgatgtcatcccttattgtatcgctattggcgatgttaaaaagcttgtgcacttcttcatgagcagaggccagttgaaagaggcactgctagtcgctcaggcagcctgtgagggaaacatgcagcccttacacgtgtctgtcccgaagggggcgtcttacagcgacgacatatacaaggaagacttcaatgaacttctgcataaagtttccaaagaactcgcagaatggtattttcaggatggtcgggccgtcctcgccgcttgttgtcacttagctatcgataacatagagttagcaatggcataccttataagaggaaacgagctggagctggccgtctgcgtcgggactgttcttggcgaaagtgccgctcccgctacacactacgccctcgagcttctcgcacggaaatgtatgatgatctccgtgtggaatctagctgccgacctgttattgatgataccagacaatgagctacacctcatcaaactctgcgctttctatcctggatgtacggaggagataaacgatttgcacgacaagtgcaaactaccaaccgtcgaggagtgtatgcagctggctgagacagcacgcgccgacgataacatattcgagaccgtcaagtattatctgctgagccaggagcccgagaaggccctgccaatcgggatttcattcgtaaaagaatatatcagctcgtcagattggacgttagataccatctatcccgttctggatctgcttagctatatacgcacggaaaagctgttgctgcacacttgcacggaagcacgcaacgaactccttatcctgtgtggatacattggagcgttgctagctatccggagacagtatcagtcaatagtgcctgccctgtacgaatatacatcacagctcctaaagcgacgggaggtgagcgttcccctgaagattgagtatctgtctgaggaattggatgcctggcgcgcttgcactcaatcaaccaaccggtcactcgaggatagcccttatactccaccatccgattcccagagaatgatttatgccactcttctcaaacgacttaaggaggagtccttgaagggcattatcggccctgactatgtcactggctctaatttgcccagccactctgatattcatattagttgtctaactggactaaagattcaaggccctgtgtttttccttgaggatggcaagagcgcgatttcccttaacgacgcccttatgtgggccaaggtgaacccattttctcctctgggcaccggcatccgcctgaatcccttttag

SEQ ID NO: 140605 - DNA, 3549 bp, Artificial Sequence
  Description of Artificial Sequence: Synthetic coding sequence
atgatcaccgtcagtaaccaggaaggagacactattcgccaaacacaggtccgctctgaacctagtaacatgcaattctttctcatgaagatggatgatcgcacctcagccgcggaatccatgatctccgtggtcttgggcaagaaaacgctgttttttctaaacttgaatgagccggacaaccctgccgacctcgagtttcagcaagatttcgggaacatagtttgttacaactggtacggagacggacgcattatgattgggtttagttgcggtcatttcgtggtgatttccacccacaccggtgagctgggacaggagattttccaggctcgcaatcacaaggataatctgacttcaatagccgtgtcacagacactcaataaggtggccacatgcggggacaattgcatcaaaatacaagatctggtcgacttgaaggacatgtatgtcatcctgaatctagatgaggaaaataagggccttggcaccctctcctggactgatgatggccagctcttggctctgtctacgcaacgaggttcactacatgtgtttctgaccaaacttccgattctgggcgacgcatgtagcactcgaatagcttacttgactagcctactcgaggtgaccgtggccaatcccgttgagggagaactccccataactgtctcagtcgacgtagaacccaattttgtggcggtgggactgtatcacctcgccgttgggatgaataatcgcgcatggttttatgtcctcggcgaaaacgccgtgaaaaaactcaaagacatggagtacctgggaactgttgcctctatatgcctgcactctgactacgccgcagccctatttgaggggaaggtccagcttcacctgatcgagagcgagatcttggacgcacaggaggaacgagaaacccgtctttttccagccgtggatgataagtgccgtattctgtgtcatgccttgacatctgatttcctcatttacgggaccgataccggggttgtgcaatacttttatatcgaggactggcagtttgtcaacgattaccggcatccagtgagcgtcaagaagatcttccccgaccctaacggaacaagactcgtatttatcgacgagaaaagtgatgggttcgtgtactgtccagtgaatgatgcaacttacgaaattccggacttttctccaacaattaagggggtcctgtgggagaactggcccatggacaaaggagtcttcattgcttatgatgacgataaggtttatacttacgtcttccacaaggataccattcaaggggcaaaggtgatattagcaggaagtacgaaagttccgtttgcccacaagccgctgctgctctataacggggaactgacatgccagacacagtcagggaaggtcaataacatttacctatctacccatggctttctgagcaatttaaaggacactggtcctgatgaacttagaccgatgctggcccaaaacctcatgctgaagcgattcagcgacgcctgggaaatgtgccggatcttaaacgatgaggccgcttggaatgagctggctcgcgcatgcctccaccacatggaagttgaattcgccattcgcgtgtatcggagaatcggtaacgtcggcatcgtgatgagtctggaacagattaaagggatcgaggactacaacctgttggccgggcacttggccatgtttactaacgattataatcttgctcaggacttatacctcgcgtccagctgtccaatagcagcccttgaaatgaggagggatctgcagcattgggactcagctctccagctggccaagcacttggcccctgaccagattccgtttatttctaaggaatacgcaatccagttggaattcgccggcgattacgtcaatgccctcgctcattacgaaaagggaataactggcgataataaagagcacgatgaggcttgcctggctggggtggcacagatgtcaatacgtatgggggacattcgacggggggttaaccaggctctcaaacaccccagccgcgtgctcaagcgggattgtggagctatccttgagaacatgaagcagtttagcgaggctgctcagctctacgagaaaggtttgtattacgacaaggcggctagcgtgtatattagaagtaagaattgggcaaaagtcggagaccttctgccccatgtcagtagccctaagattcatctccagtacgccaaggctaaagaggctgatggcagatacaaggaggccgtcgttgcctacgagaatgctaagcagtggcagtcagttatcaggatctacctggatcacctcaacaatcccgaaaaagccgtgaacatcgttcgggagacccagagcctggacggtgccaagatggtggctaggtttttcctccagctcggcgattacggcagtgccattcaatttctcgttatgtctaagtgcaataacgaagctttcacattggcccaacaacacaataagatggagatctatgctgatatcattgggagcgaggataccacaaatgaggactatcagagcatagcactgtacttcgaaggagaaaagcgctacctgcaagccggaaaattcttcctcctgtgtggccagtacagtagagcactgaaacatttcctcaaatgtccctcaagcgaggacaacgtagcaatcgaaatggctattgagacagtcgggcaggctaaggacgaacttctaaccaaccagctgattgatcatctgctgggtgaaaacgacgggatgccaaaagatgcgaagtacttgttccggctgtatatggcgctcaagcagtaccgcgaggctgcccagactgcgatcatcatagccagagaggagcagtccgctggaaattataggaacgcgcatgatgtcttgttttccatgtatgcagagctcaagtcccagaagatcaagatcccctctgaaatggccacaaatctaatgattctgcacagctacatactggtaaagatccacgttaaaaacggggaccatatgaaaggcgcccgcatgttaatccgcgttgctaataacatcagtaagttcccttctcatatcgtaccgattttgacctcaaccgtaatcgagtgccatcgggcaggactgaaaaacagtgcattctcgtttgctgccatgttaatgaggcctgagtatcgctccaagattgacgcaaaatacaagaaaaagattgaagggatggtacggcgccctgacatttctgagatagaggaagccaccaccccatgccctttctgcaaattcctcctccccgaatgcgaattgctgtgtcctggatgtaaaaattccatcccctattgtatcgctaccggaagacacatgctgaaggatgactggaccgtctgtccccactgcgacttccctgccctgtatagcgagctgaagattatgctgaatacagagtctacctgccccatgtgttcagagcgactgaacgccgctcagctgaagaaaatctcagactgtacccagtacctccgcactgaggaagaactgtag

SEQ ID NO: 140606 - DNA, 4029 bp, Artificial Sequence
  Description of Artificial Sequence: Synthetic coding sequence
atgaaaaggattttcagcctcctggagaagacctggctgggggccccaatacagtttgcttggcagaaaacctcaggcaactatctggcagtgactggggcagactatatcgtcaaaatcttcgaccgtcacggccagaagcgttccgagatcaacctacccggaaattgtgtcgcaatggactgggataaagacggggatgtgctggcagtcatcgctgaaaagagctcttgtatctatctctgggacgctaataccaacaaaacctcccaattagacaatggtatgcgtgaccagatgtcattcctgttgtggagcaaggtaggctccttcctggctgttggcactgtgaaaggcaaccttttgatatacaaccaccaaaccagccgtaaaatccctgtgctcggcaagcacacaaagcgcattacatgcggctgttggaacgccgagaatttgctggctctgggcggtgaagataagatgatcaccgtgtccaatcaggaaggcgataccattcgccagactcaagtccggagcgaacctagtaatatgcagtttttcctgatgaagatggacgaccgaacatctgctgcagagtctatgattagcgtagtgctcggtaagaagaccctcttcttcctgaacctcaatgaaccagacaaccccgcggacttggagtttcaacaagattttggaaatatcgtatgttacaattggtatggcgacggcaggattatgattgggttctcctgcggacattttgtggttatttccactcataccggtgagctaggacaggagattttccaggccagaaaccataaggacaatttgacttcaatcgctgtcagccagacgctcaacaaagtggcaacttgcggtgataattgtattaagatccaggatcttgtcgacttgaaggacatgtatgtgattctgaacttggatgaggagaacaagggcctgggaacattatcctggaccgatgacggtcagttacttgctttgtctacacagcgaggcagcctgcatgtattcctgacaaagctgccgatactgggcgacgcgtgctcaacccgaatagcttacctgaccagcctgcttgaggtcacagttgctaacccagttgagggcgagctacctattacggtgagtgtggacgttgagccaaactttgtggctgtggggctgtaccatttggcggtgggaatgaataaccgggcctggttctacgtcctgggggaaaatgctgtgaaaaaactgaaggatatggaatacctcgggactgtggcttccatatgtctccactcagattacgccgcggccctcttcgaggggaaagtccagctccatctgatcgaatcagaaattctggatgctcaagaagagcgagaaactcgcttgttccctgccgttgatgataagtgcagaatcctctgccacgcgctgacaagtgactttctgatctatggaaccgacactggcgtagttcagtatttctacattgaagactggcagtttgtcaacgattatcgtcacccagtgtcagttaagaagatctttccagatcccaatggcactagacttgtcttcatcgacgagaagtccgacgggtttgtgtactgtcctgtgaatgacgctacgtacgagattccagatttctcaccaacaatcaaaggcgtgctgtgggagaattggccaatggataagggcgtttttatcgcatatgacgatgacaaggtgtacacttatgtgttccataaagatactatacaaggtgcaaaagtgatcctggcgggctcaaccaaagtgccattcgctcacaaacctctgctcttatacaacggggagctgacttgccagactcagagtggcaaggtgaataatatctatttgagtactcacgggtttttgtccaacctgaaggatacaggccctgacgaactcaggcctatgctggcacagaacttgatgttgaaaagattctcggacgcatgggagatgtgcaggatcttaaatgatgaggctgcctggaatgaactcgccagagcgtgtctgcatcacatggaagtggaatttgccattcgagtataccgccggatcggaaacgtggggatcgtgatgtccttagagcaaataaaaggcattgaggattataatctgcttgctgggcaccttgcaatgttcaccaacgactacaacctagcacaggatctctacctggcttctagttgtcctatcgctgccctcgagatgaggagggatcttcagcattgggatagtgccttgcagttagccaaacacctggcccccgatcagattccattcatatcgaaggaatacgctatacaactggagtttgcaggggattacgtcaatgcgctggctcactacgagaagggcattaccggggataacaaggaacatgatgaggcttgtttagccggggtagctcaaatgagtattcggatgggcgacattcggcgtggagttaaccaagctctcaaacacccttcccgagtactgaagagagattgtggcgcaatcctggaaaacatgaaacagttcagcgaggcagcccagctgtatgaaaaaggcctatactatgacaaggctgcatcggtctacattcgcagtaagaactgggccaaggtcggcgatctgttgccacacgtttcctcccctaagatccatctgcaatatgccaaagctaaggaagccgacgggcgctacaaggaagcggtggtggcatatgaaaacgccaagcagtggcagtctgtcatcagaatctatctcgatcatctaaacaatcccgaaaaagctgttaatatcgtgcgtgagacccagagcctggatggcgcaaagatggtagcccgtttctttttgcagctaggggactacgggagcgctatccaattcttggtcatgagcaagtgcaacaacgaggcattcactctggcccagcagcataacaaaatggagatctacgccgatataatcggatctgaggataccaccaacgaggattaccaaagtattgccctgtacttcgaaggagagaaacgatacctccaggcagggaagtttttccttctctgcgggcaatattcacgcgcactaaagcatttcctaaagtgtccaagctctgaggacaatgttgccatcgaaatggctatcgagacagtgggccaggctaaggacgagcttttgacaaatcagctcatagatcatctgctaggggaaaatgacgggatgcccaaagatgctaaatacctgttccgtttgtatatggctcttaagcagtatagggaggcggctcagactgcgataattatagcccgcgaagaacagtccgcaggcaactatagaaacgctcacgacgtgctgttctcaatgtatgctgagctgaagtcccagaagattaaaattccaagcgaaatggccacaaacctgatgatcttacacagctatatcctcgtcaagatccacgtgaagaatggagatcatatgaaaggggcgcggatgctcattcgagtcgctaataacatatccaaattcccttctcacatcgtgcccattttaaccagcactgttattgagtgccatcgagctggtctgaaaaattcggcttttagcttcgcggcaatgcttatgaggcccgagtatagatccaagattgacgcaaaatataagaagaaaatcgagggaatggtgcggaggcctgacatcagtgaaatagaagaagctactaccccctgccctttctgtaagttcctgcttccagagtgcgaactcctctgtccggggtgtaaaaactcaatcccctactgtattgccactggcagacacatgctgaaggacgactggacggtgtgcccccactgcgatttccctgccctgtattctgaactgaaaatcatgctcaacaccgagtctacatgtccgatgtgtagcgaacgccttaacgcggcccagctaaagaaaattagtgactgcacacagtacctcagaactgaggaagagctttag

SEQ ID NO: 140607 - DNA, 1443 bp, Artificial Sequence
  Description of Artificial Sequence: Synthetic coding sequence
aaacgaatcttttctcttctcgagaaaacgtggctcggcgccccaattcagttcgcctggcagaaaacctctggcaactacctagcagtgaccggagcagactacatcgtgaagattttcgaccggcacgggcagaaacgatctgagatcaacctccccggaaattgcgtggctatggactgggataaggacggcgatgtgttagctgttatcgccgagaagtcgtcatgcatttatctgtgggacgccaacaccaataagacatcacagctggataacgggatgagggatcagatgtctttcctgctgtggtctaaagtgggaagctttttggcggtaggcactgtgaaagggaacctgctcatctacaatcatcagacaagcaggaagattcccgtcctcggcaagcatactaagaggatcacctgcgggtgttggaacgctgaaaacctgctcgcactgggaggagaagacaaaatgattaccgtgagtaaccaagaaggcgacaccatacggcagacgcaggtcagaagtgagcccagcaatatgcaatttttccttatgaaaatggatgatcgtacctctgcagctgaaagcatgattagtgttgtgctcggaaagaagacccttttttttctgaacctcaacgagccagataacccagcagatttagagtttcaacaagattttggtaacatagtttgttacaactggtatggagatggtaggattatgatcgggttctcatgtggacactttgtggtaattagcactcacaccggcgagctcggccaggagatcttccaggctcgaaaccacaaggataacctaacaagtattgctgtgagtcaaactctgaataaagtagccacctgtggagataactgcatcaagattcaggacctcgttgacctcaaagatatgtatgtaattctgaacttggatgaggaaaacaaaggcctggggaccctgagctggacagatgacgggcagctgttggccctgtctactcagcgagggagtcttcacgttttcctgacaaagctgcccatcctaggagacgcgtgctctacccggatcgcgtacctgacaagcctgcttgaggtaaccgttgcaaatcctgttgaaggcgaactccccattaccgtttcagtggatgtggaacccaacttcgtggccgtgggtttgtatcaccttgcggtagggatgaataatagggcgtggttttacgtcctgggagaaaacgctgtgaagaagctcaaggacatggagtatctcgggactgttgccagcatttgtctgcattcagactacgcagctgccctctttgagggaaaggtccagctgcacctcaaagccaaaagctggatgcttaagaaaaatgtgaggctggggtttagccagcagtggatgatctcggccgtcagctatgctatgccttag

SEQ ID NO: 140608 - DNA, 1446 bp, Artificial Sequence
  Description of Artificial Sequence: Synthetic coding sequence
atgaaaaggatattctctctcctggaaaagacttggttgggtgctccaatccagttcgcctggcagaagacaagcggaaactacctcgctgtcactggagctgactatattgtgaagatatttgatcgtcacggacaaaaacgaagtgagattaatctcccgggaaattgtgtggctatggattgggacaaggatggagatgtgctggcagttattgccgagaagtcatcgtgcatatacttatgggatgccaacacaaacaaaacctctcaactggacaacggtatgagagatcagatgagttttctcctgtggtccaaggtgggtagtttcctcgctgtcggaaccgttaaaggcaatttgctgatttataaccaccagacttctagaaaaattccagtgttgggtaagcacactaagaggataacctgcgggtgctggaacgcagagaacctcctcgcgttgggcggggaagacaagatgatcactgtgagtaatcaagagggcgataccatacggcagactcaggtcaggagcgaaccttctaatatgcagtttttcctgatgaagatggatgacaggacatccgccgccgagtccatgatctcggttgtgctgggaaaaaagacgctgttctttttgaatctgaatgaaccagataatcctgctgacctggagttccagcaggattttggcaatatcgtttgctacaactggtacggggatggacggatcatgatcggtttcagctgtggacattttgttgtcatttctacacatacaggggagctgggccaggaaatttttcaggccagaaaccacaaggataaccttacatctatcgcagtgagccagacactaaacaaagtggccacatgcggtgacaattgtatcaagatccaggaccttgtggacctgaaagatatgtacgtcattctgaacttagacgaggagaataagggtctcggaactttgtcatggactgacgacgggcaactgctggctctgtccacccagagaggttccttacacgttttcctcacaaaactgcctattctcggggatgcctgtagtacacgaatcgcgtatctaacctcactcctggaagttactgttgctaatccagtggagggagaattgcccatcacagtgtctgtggatgtggaaccaaactttgtagccgtcggcctctatcatttggccgtgggcatgaacaaccgggcctggttttacgtgctcggtgaaaacgccgtgaagaaattgaaggacatggaatatttaggcaccgtcgccagtatatgtctgcactcagattatgctgccgcactatttgaaggaaaggtgcagctccacctcaaggccaagagctggatgctgaaaaagaacgttaggctcggattctcccagcagtggatgatctccgctgtttcgtatgcaatgccttag

SEQ ID NO: 140609 - DNA, 2832 bp, Artificial Sequence
  Description of Artificial Sequence: Synthetic coding sequence
atgggcctcaccaagcagtacctccggtacgtggctagcgcagtctttggagtgatcggttcccagaagggcaacatcgtctttgtgaccctaaggggcgagaaaggccgctatgtagccgttcccgcttgtgagcatgtgtttatctgggatttgcgaaaaggagagaaaatcctgatattacagggactgaagcaagaggtaacctgcctttgcccttctccagatgggctccatctcgcagtcggctacgaggacggctcaatcagaatcttctccctcctgtccggggaaggcaatgtcacatttaacgggcataaagcagccattactacacttaaatacgatcagcttggcgggcgcttggcttccggctccaaggacactgatatcattgtgtgggatgtgatcaatgagtccggattatacagactgaaggggcataaggatgccattacacaagccctgtttctacgagagaagaacctactcgtgacctctgggaaagacacaatggtgaagtggtgggacttggacacacaacactgctttaagaccatggtgggacatcggaccgaggtgtggggcttagtgttgctgagcgaggagaaacggctcattactggagccagcgactccgagctgagagtgtgggatatcgcttacctccaggagatagaagatcccgaggagcctgaccctaaaaagatcaaggggtcgtctccaggaatccaggacactctggaggctgaagatggcgctttcgagacagacgaagccccagaagatcggattctcagttgccgcaaggccggcagcattatgcgggaaggcagggatagggtcgttaatctggccgtggacaaaacaggcaggatactcgcctgtcatgggacagatagtgtgctggaacttttctgtatcctatccaagaaggaaatccagaagaagatggacaaaaaaatgaaaaaggcacggaagaaggcaaagctgcacagttctaaaggcgaagaagaggatccagaagtgaacgtagaaatgtctcttcaggacgagatccagagggttaccaatatcaagactagcgccaagattaaaagttttgacctcatacactccccgcatggtgagctgaaggccgtgttcctgctgcagaataatctggtggaactgtatagccttaacccctcactgcccaccccccaaccagtacggacgtcacggataacaatcgggggccacaggtcggatgttcggacactgtccttcagttctgacaatattgcagtgttgagcgccgctgcagacagtattaaaatctggaataggtccactttgcagtgcataagaactatgacttgtgaatacgcactgtgctcattcttcgttcctggagatcgccaggttgtgatcggcactaaaaccggtaagctgcaactgtacgatcttgccagtggcaatctgctcgagaccatcgacgctcacgatggagcactgtggtcaatgtcgctgagccccgatcaacggggctttgtgaccggcggcgctgacaagagtgtcaagttttgggatttcgaactcgtaaaggatgagaacagtacacagaaaagattatcagtcaagcagacccgcaccttgcaactggatgaagacgttctgtgcgtgtcctactctcctaaccagaagctcctggctgtgtctctgctagactgtactgtgaaaatcttctatgtggataccctcaagttcttccttagtctgtacggtcacaagttgccagtgatttgcatggatatctctcatgatggcgctctgattgctaccgggagcgccgatcgtaacgtgaaaatctggggcttggacttcggcgactgccataaaagcttgtttgcgcacgatgattctgttatgtatctgcagtttgttcctaagagccacctttttttcaccgccggcaaggatcacaagatcaaacagtgggatgccgacaaattcgaacatatccaaactcttgaaggccaccaccaggagatatggtgccttgccgtatcaccgtctggcgattatgtagttagttcttcccatgacaaatcattgagactgtgggagcggactcgcgaacctctcatactcgaagaggagagagaaatggaacgggaggcagagtacgaagagtctgtggctaaggaggaccaacccgcggttccgggcgaaacacagggagattcttacttcactggcaagaaaacaatcgaaacagtaaaagctgcggaaagaatcatggaggctattgaactgtaccgggaggagacagccaaaatgaaggagcataaggctatatgcaaggcagcagggaaagaggtccccctgccctccaatccaatcctcatggcttacggatctatttcccccagtgcttacgtactggagatcttcaagggcattaagagctctgagctcgaagagagcttgcttgtactcccattcagctatgtcccggatattttgaagctctttaatgagttcatccagttagggtctgacgttgagcttatttgcagatgcctgttttttcttctcagaattcactttggacagatcactagcaaccaaatgctggtgcccgtaattgagaagctaagggagaccacaatttccaaggtgtcccaggtgagggacgtgatcggattcaacatggctgggttggactacctcaaacgggaatgtgaggcgaaaagcgaggtgatgtttttcgccgatgcgacctcccacctagaggaaaagaaaagaaagcgcaaaaagcgggaaaagctcatcctgacgctcacatag

SEQ ID NO: 140610 - DNA, 123 bp, Artificial Sequence
  Description of Artificial Sequence: Synthetic coding sequence
atggggctgacaaagcagtacttgagatatgtggcctctgcagtgttcggagttattgggagccagaaaggattggcatctcaagccagctcatccttcgtgttttttgctacagagttctag

SEQ ID NO: 140611 - DNA, 1611 bp, Artificial Sequence
  Description of Artificial Sequence: Synthetic coding sequence
atggctaccagggcccaacctggcccgctgtcccaggcaggctcggctggcgttgccgctctcgcaaccgtgggtgtggccagcgggccgggtcctgggagacccggtcctctgcaggacgagaccttaggcgttgcatccgtacctagccagtggcgcgccgttcagggaatccggtgggagaccaaatcatgtcagaccgcaagcatcgccacagcctccgcctctgctcaagcgaggaaccacgtggacgcccaagtgcagaccgaggctccagtcccagtatccgtgcagcctccttcacaatacgacataccacgcctggctgcctttctgcgccgggtggaagcaatggtaattcgggagctgaacaagaactggcaatcacacgccttcgacggctttgaggtaaattggactgagcagcaacagatggtgtcatgcctgtacaccctcggttatccgccagcccaggctcaggggcttcatgtgactagcattagctggaactctacgggaagcgtagtcgcttgtgcatacgggagactcgatcacggcgattggtccacactcaagtctttcgtgtgcgcctggaacctcgaccgacgtgacttgaggccccagcagccatcagcagtggtggaggtgccttctgctgtgctctgcttggccttccaccccacccagcctagtcacgtcgcgggcgggctttattctggcgaggtgttggtatgggacctgagcaggctggaggatccattactgtggcgcaccggcctgaccgatgacactcacaccgaccccgtcagccaggtcgtatggctgcccgagcccggccattctcaccgcttccaggttctcagtgttgcaaccgatggtaaagtcctgctctggcagggcatcggcgtcggacagctccagttgaccgaggggttcgcccttgttatgcaacagctgccccggagcaccaagctgaagaagcaccctcgcggggaaacggaggtcggcgccacggccgttgctttcagctctttcgatcctcgcttgttcattctgggcacagaaggaggattcccactcaagtgctcactcgctgcaggcgaagccgccctgactcgcatgccgagttcagtgcctctcagagctcctgcacagtttacttttagcccccacggaggaccaatctatagcgtgagttgctcacccttccaccgcaatctgttcctttccgcggggacagatggacacgttcacctttactctatgctgcaggctcctcccttaacgtctctccagctgtccctgaagtacctcttcgcagtgagatggagtcctgtccggccattggtattcgcagccgcgtctgggaagggagacgtgcaactatttgacctgcagaagagtagtcagaaacccacagttctgattaagcagactcaggatgagtctcctgtgtattgcctcgagttcaacagccagcagacccagctcctagcggccggagacgcccaaggaactgtgaaagtttggcagctcagtacagaatttaccgagcaggggcctcgcgaagctgaggatttggactgtcttgctgcggaggtggccgcctag

SEQ ID NO: 140612 - DNA, 420 bp, Artificial Sequence
  Description of Artificial Sequence: Synthetic coding sequence
gccggagtggccgccctggcaaccgtcggggttgcttccgggccagggccaggcagacctggccctctccaggacgaaacgctgggagtagcaagcgtgccaagccagtggcgtgccgtgcaaggcatccgctgggagactaaatcatgccagactgcttccatcgctaccgcttctgcgtcagctcaagctcggaaccacgtggatgctcaggtgcaaacggaggctccagttcctgtctcagtccagcctcctagccaatacgacatcccacgcttagctgcgtttctccgaagggtggaagcaatggtgattagagagctgaataaaaactggcagtcccacgcattcgatggctttgaggtcaattggacagaacaacagcaaatggcaggcccttgggggcttgagcacgcttag

SEQ ID NO: 140613 - DNA, 819 bp, Artificial Sequence
  Description of Artificial Sequence: Synthetic coding sequence
ttgagccaggccggctctgcaggggtggccgctttagcgactgtcggcgtggctagtggacctgggccagggcgtcccgggcccttacaggacgaaaccctgggagttgctagcgtgccctctcaatggcgggcggtgcaggggattagatgggagaccaaaagctgccaaacagccagcatcgccacggcgagtgcttccgcacaggctcgcaatcatgtggatgcgcaggtccaaacagaggcccccgtgccggttagcgttcagcctcctagtcaatatgacattccacgtctggctgccttcttgcggcgggtagaggcaatggtgattcgtgagctcaataagaattggcaaagccacgcctttgacggcttcgaggtaaattggaccgaacaacaacagatggtttcctgtctgtacaccctgggatacccgcctgctcaggcccagggcctccacgttacctcaatatcatggaactccaccggctcagtagtagcatgcgcctacgggcgcctggaccacggtgactggagcacactgaaaagcttcgtctgcgcctggaatttagatcggcgagacctgcgccctcagcagccttcggctgtggtggaggtgccctccgctgttttgtgcttagcattccacccaacgcagccctcccacgtggctggcgaactgccggctgtgagcgcttcttctcccctgcgtactcagctccctgctctgcaacgggcccagggctcctttccatgggctctgtggcccggagatcgcaaggccggtcctgacccactaagcctcgagccgcgttag

SEQ ID NO: 140614 - DNA, 3513 bp, Artificial Sequence
  Description of Artificial Sequence: Synthetic coding sequence
atgttcttctatctatctaaaaaaatatcgatcccaaacaacgtgaaactccagtgcgtatcttggaataaggaacagggtttcattgcctgcggtggtgaagacgggctgctcaaagtactgaagctggagactcagacggatgacgctaagctcagaggactagcggcaccatcgaatttgagtatgaaccagactttagaaggccatagcggctctgtgcaagtggttacctggaacgaacaataccagaagttgactacgagcgacgaaaatgggctaattattgtttggatgctgtacaaaggctcatggatcgaggaaatgatcaacaaccgcaataaatctgtggtgagatcaatgtcgtggaacgctgacggacaaaaaatttgtatcgtgtatgaggatggagctgtcatcgtgggatcagtcgatggcaaccggatctggggcaaagatttgaaaggaattcaactgtctcacgtcacatggtcagccgactccaaagttttgctttttgggatggctaatggagagattcatatttatgataatcaaggaaacttcatgattaaaatgaaacttagttgtcttgtcaatgtaactggggccattagtattgcaggaatacactggtaccacgggaccgagggctacgtagagccagactgtccttgcctggccgtatgcttcgacaacggacgctgccagattatgcgccacgagaacgaccagaaccccgtgcttatcgacacaggaatgtatgttgtgggtatccagtggaatcatatgggcagtgtgctcgccgttgccggattccagaaggccgcaatgcaggacaaggacgtaaatatagttcagttctataccccgtttggagaacacctgggaacactcaaggtcccggggaaggaaataagcgccctgagctgggagggaggcggcctcaaaatagccctagccgttgacagtttcatctacttcgccaacattcgtccaaactacaaatgggggtattgttccaataccgtagtctacgcatacactcggcccgatcggcctgaatattgcgtggtgttctgggatactaaaaataacgagaagtacgtgaaatacgtgaaggggttgattagtataaccacttgtggagacttctgcatcctcgccactaaagccgacgaaaatcacccccaattcgtgctggtgctttgtaacagcattgggacccccctggatcctaagtacatagacatcgtaccgctgttcgtggcaatgactaaaactcatgtgatcgcagcgtccaaagaggccttctacacatggcagtacagagtcgcaaaaaagcttaccgctctggagattaatcaaattacacgaagcagaaaagaggggcgggagagaatttatcacgtagacgataccccgagtggatccatggacggagttctggattactccaagacaatccagggcacgagagaccccatttgcgccattactgcaagtgataagattctgattgttggaagggagtctgggactatccagcggtactctctgcctaatgttgggctcattcagaagtattctctgaactgtcgcgcctatcagctgtctcttaactgtaattcttccaggctggctatcatcgacatttcaggtgtgctgaccttttttgatttggatgcccgcgtgactgactcgaccggacagcaggtagttggcgaacttcttaaactcgaacggagggacgtgtgggacatgaaatgggctaaggataaccctgacctttttgccatgatggaaaaaactcgaatgtacgttttcagaaatctcgatccggaggagcctatccagacttctggctacatctgcaacttcgaggacttagagattaagagcgtcttacttgatgaaattctgaaggacccagaacaccctaataaggactacctgatcaactttgagatcaggagcctgagagatagccgagcgctcattgagaaggtcgggatcaaggacgcctcccagttcatcgaggataaccctcatcctagactgtggcgactacttgcagaggccgctctgcagaagctggacctctatacagccgagcaggccttcgttaggtgtaaggactaccagggtataaaattcgtcaaaagactgggcaaactcctcagcgagtcaatgaagcaggccgaggtagtgggatactttggccgctttgaggaggccgagagaacctatctggaaatggataggcgggacctggccatcggtttgcgccttaagctgggcgattggtttagggtactgcagctgctcaagacaggctcaggggacgccgacgatagtctgctcgagcaagcaaacaatgccatcggcgattatttcgccgataggcaaaaatggttgaatgcagttcagtactatgtgcagggtaggaatcaggagcgcttggctgagtgttattatatgttggaggactacgaaggcctagaaaacctggcaatctcactgcccgaaaaccacaaactgctgcctgagattgcacaaatgtttgtgcgcgtcggaatgtgcgagcaggctgtgaccgcattcctcaagtgcagccagccaaaggccgcagtcgatacgtgcgtacatctgaatcaatggaacaaagcagtggaattagccaagaaccactctatgaaagagattggcagtctgctcgcgaggtatgcaagccatttgctggagaagaataaaacacttgatgctattgaactgtaccgcaaggcaaactacttctttgatgccgccaaactcatgttcaagatcgccgacgaagaagccaagaagggatccaaacccctgagagttaagaaactgtatgtattgtctgctcttctgatagagcaatatcacgagcaaatgaagaacgcccagcgcggtaaagtgaaagggaaatcttctgaagcgacctcagcactggctggtctgctagaggaagaggtgttgagtaccaccgatcgattcactgacaacgcctggcgcggggctgaggcataccacttctttatcctggctcagaggcaactatatgaggggtgcgtggatacagctttaaaaacagccctgcatttgaaagactatgaggatataatccctcctgtggagatttatagcctcctcgctctctgcgcttgcgcgagtcgggcttttggcacttgctccaaagcgttcatcaaactcaagtcccttgagactctttcatctgaacaaaagcagcaatacgaggatctggccctggagattttcacaaagcacacaagcaaagataatcgcaagcccgagctggacagtttaatggaaggcggggaaggtaagctacctacctgtgtggcaactgggtcccccatcactgagtaccagttttggatgtgttcggtttgtaagcatggcgtcctcgctcaggagatttcgcactattcattctgtcctctctgccattctcccgttgggtag

SEQ ID NO: 140615 - DNA, 3546 bp, Artificial Sequence
  Description of Artificial Sequence: Synthetic coding sequence
atgttcttttacctctctaaaaaaatcagcatcccaaacaatgttaagctgcagtgcgtatcttggaacaaagaacaggggttcatcgcttgtggtggggaagacgggctactgaaggttttaaagctagagacccaaacagatgatgccaagctgaggggccttgcagccccttctaacctgtccatgaaccagaccctggaggggcattccggaagcgtccaggttgtcacctggaatgaacagtatcaaaagctgaccaccagcgatgaaaacggactgatcattgtgtggatgctctacaaaggatcttggatcgaagagatgatcaataaccgtaataagtccgtggtcaggagtatgtcctggaacgccgacggccaaaagatatgcatcgtatatgaggatggagcagtaattgttggatcagtagatgggaacagaatctggggtaaggatctgaagggcatccagcttagccatgtgacctggtccgcagactccaaagtgctcctgttcggcatggccaacggcgagatccatatctatgataaccagggcaactttatgatcaaaatgaagctcagttgcttggtgaatgtcacgggggccatttctattgctggcatccactggtatcatggcaccgagggatatgttgagccagactgcccctgcctggccgtgtgctttgataacggcaggtgtcagattatgaggcacgagaatgaccagaatcccgttttaatcgatacggggatgtatgtagtaggcatccagtggaaccacatgggaagtgtcctagctgtggccggctttcagaaagcagcaatgcaggacaaggatgtgaatatcgtgcagttctacactcccttcggcgaacacctggggaccctgaaagtccctggaaaggagatttccgccctgtcttgggagggcggcgggttgaaaatcgcattagcagtcgactccttcatttacttcgcaaatatcaggcccaactataagtggggatactgcagtaacaccgtggtgtacgcctataccagaccagaccgaccagagtactgcgtggtgttctgggatactaaaaacaatgagaaatacgtgaagtatgttaagggactcatcagcatcacgacttgcggtgatttttgcatcttggctaccaaagccgatgagaaccatccacaggaggaaaacgagatggagactttcggagccacttttgtgcttgtactttgcaactccattggtacacctttagatccaaagtacatagacatcgtgccgctgtttgtggctatgacgaaaacccatgtcattgcggcatccaaggaagccttttacacctggcagtaccgggtggccaagaagctgaccgccctggagataaatcagatcacccgaagccgaaaagaaggccgagaaagaatttatcacgttgatgataccccctctggttctatggacggcgtcctggactattctaagacaatacagggtacccgcgatcctatatgtgctataactgccagtgacaaaattctgatcgtggggagagagtccggcaccattcagcgctactcactgccaaacgtgggactcattcagaagtacagtctcaactgtagagcgtaccagctgtctctgaattgtaactcttcccgactcgccatcatcgatatcagcggcgtcctcacctttttcgatctggacgctcgtgtaacagactcaactgggcagcaggtggtgggggaactcctgaaattagagcgccgcgatgtctgggacatgaagtgggccaaagacaatccagacttgttcgccatgatggagaagaccaggatgtacgtgttccggaatctcgacccggaagagcccatccagactagcgggtacatctgtaactttgaggatctggagatcaaatccgtgctgcttgacgagatcctgaaagatcctgagcaccccaataaagactacctcatcaactttgagatccgctccctccgggattctcgcgccctaatagagaaagtcggaatcaaggacgccagtcagtttattgaggataatccccaccccagactgtggcggctactggcagaagccgcactgcaaaagctggatctgtacaccgcagaacaggccttcgtcaggtgtaaagactaccaggggatcaaattcgtgaagcggttgggaaagctgctgagcgagtccatgaagcaagcggaagtcgttggctactttggaaggttcgaagaagccgagagaacttacttagaaatggaccggagggacctggcgatcggcctgcggctaaagcttggggattggttccgtgtattacaacttttaaaaaccgggtcaggtgatgctgatgactccctcctggagcaggcaaataacgctatcggcgattatttcgccgaccgacagaaatggcttaacgcggtgcagtactacgtccagggaaggaaccaggagcggttggcagaatgctattatatgctggaggactatgaaggattggaaaacctcgcaatttccctgcctgaaaaccataagttacttcccgaaatcgcgcagatgttcgtgcgtgtgggtatgtgtgagcaggccgtgactgccttccttaaatgcagccagcccaaagccgccgttgacacatgtgtgcatctgaatcagtggaataaggcagtcgaactagccaaaaaccattctatgaaagagatcggtagcctgctcgcccgttatgcttctcacctgcttgaaaaaaataagactctagatgcaatcgaactgtaccggaaagccaattatttctttgatgccgctaagctgatgttcaaaattgctgatgaggaagccaagaagggatccaaaccccttagggttaagaaactgtatgtgctgtcagctttgcttatcgaacaataccatgaacagatgaaaaacgctcagaggggaaaggtaaagggcaaatccagtgaagccacttcagcgctcgctggcctactggaagaagaagtcctctcaaccaccgaccgattcactgacaatgcttggaggggtgccgaggcgtatcacttttttatcctggcacagaggcaactctatgaggggtgcgtggacacggcactgaagacagccctgcacctgaaggattatgaggacattattcccccagtggaaatctattcattactggccttgtgcgcgtgtgcttccagagcattcggaacgtgctcaaaggccttcatcaagctgaagagcctagaaacactaagctccgaacagaagcaacagtatgaggatttggccctggaaatcttcaccaagcatacatcgaaagacaatcgcaagccggagctagattcgctgatggaaggcggggagggtaaactgccgacctgtgtggccacaggttcaccaataaccgagtatcagttctggatgtgttccgtgtgcaagcatggcgtcttagctcaagaaatatcccattattcattctgtccactttgccattcacccgtggggtag

SEQ ID NO: 140616 - DNA, 1680 bp, Artificial Sequence
  Description of Artificial Sequence: Synthetic coding sequence
atgaccaagacacacgtgattgccgctagtaaggaggctttctacacctggcagtaccgcgtggccaagaagttaaccgcccttgaaattaaccagatcaccagatcacgcaaggagggccgagaacggatctaccacgtcgatgatacccctagtgggtctatggatggcgtgctggattactctaaaacaatacagggcacaagggatccaatctgcgccattacagcctccgacaaaattttgattgtgggcagggagtccggtaccatccagcgctatagtttgcctaacgtcgggcttatccagaaatacagcctgaactgtagggcctaccagttatccctgaattgcaactctagcaggctggctatcattgacatcagcggagtactgacatttttcgacctcgatgccagagtcaccgacagcacaggtcagcaggtggtaggcgagctgttaaaactggaacgaagggatgtgtgggacatgaagtgggccaaggataatccagacctgttcgctatgatggagaaaactcgcatgtatgtgttccgcaacctcgacccagaagaacctattcaaactagcggttacatctgtaattttgaggatctggagataaaatccgtcctgctggacgagatcttgaaggaccccgagcacccaaacaaggactatctcattaatttcgagatccgctcactcagggactctcgtgccctaatcgaaaaagtcgggataaaagacgcttcacagtttattgaggacaatccacaccctagactctggaggctgctggccgaagcagctcttcaaaagctggacctctatacagcggagcaagcgtttgtgaggtgcaaggactaccaggggataaagtttgtgaaaaggctcgggaaattgctcagtgagagtatgaagcaggcagaagtggtgggttattttggtaggttcgaagaggctgagcgaacttatctggagatggatcggcgggacctggccataggactgaggttaaagctgggcgactggtttagggtactgcagttgctcaaaactggatcaggggatgctgatgattctctgctggagcaagcaaacaatgccatcggggactattttgccgatcgtcagaagtggctcaatgctgttcagtattacgttcaaggaagaaatcaggagaggctcgctgaatgctattacatgttggaggattacgaaggtcttgagaacctcgccatttcgctacccgaaaatcataagttgctccccatcgcagacgaggaggctaaaaaggggagcaaaccactacgagtgaaaaaactgtacgtgctgtctgcactgttgattgagcagtatcacgaacaaatgaaaaatgctcaacgcgggaaggtgaaaggtaagagctccgaggccacctcagctttggccgggctgctagaggaggaggtattgagcacaactgatagatttacagataacgcctggcggggagcggaagcctaccactttttcatactggcccagaggcaactttatgagggttgcgtggacacagcacttaagactgttgagaaggggaattgccagcatgctctgcctcaggaggcgcagtcactctcaatcaattcaggttgcgccgtttacgccaatacagtatccttactgcggaaatag

SEQ ID NO: 140617 - DNA, 2856 bp, Artificial Sequence
  Description of Artificial Sequence: Synthetic coding sequence
atgtgctgcacggaaggctccctccgaaagcgggactcccagcgggcccccgaagccgtgttgtgcctccagctatggcagaggaccgtcccgcttgataccttgaaggggctaggaacttgctttccttctggccccgagcttagaggagctggaatcgcagctgccatggagagagcttctgagcgacggacagccagcgccctgtttgccggatttagggctctgggcctcttctcaaacgacattcctcatgtcgtccgctttagtgctcttaaacgaaggttttacgtgacaacatgtgtggggaagtccttccacacctacgatgttcagaagctgagcttagtcgcagtttcaaactccgtcccacaagatatttgttgtatggctgccgacgggcggctcgttttcgcggcctacggcaacgtctttagcgccttcgcaaggaacaaggagatcgtccatactttcaaggggcacaaagccgagatccattttctacagcccttcggcgatcacatcatttccgttgatacggatgggatacttattatttggcacatctactcagaggaagagtacctccagttgacctttgacaaaagcgtgtttaagatttccgcaatcctccacccatcaacatatctaaataagatcctgttgggctctgagcagggcagcctacaactgtggaacgtgaagtcaaacaaacttctgtacactttcccgggctggaaggtcggcgtaactgccctacaacaggctcctgctgttgatgtagttgccattggcctgatgagcggccaggtcataatccacaacatcaagttcaacgagacacttatgaaattcagacaggattgggggcccataacctcaatttccttccgaaccgatggacaccctgtgatggcagcaggctcgccatgtggccacatcggactgtgggacttagaagacaagaagctcatcaaccagatgcgtaatgctcatagtaccgccatagctgggctgacttttttacacagagagccgctgctggtgactaacggcgcagacaatgcgcttcgaatttggatcttcgatggaccaaccggtgaaggacgtctgcttcgtttccggatgggacattccgctccccttacaaatatcagatattacggccaaaacgggcagcagattctgagtgccagccaagacggcacactccagagcttcagcaccgtgcatgagaagttcaataagtctctgggccatgggctgatcaataagaagagggtcaagcgaaaaggacttcagaatactatgagtgttaggttgcctcccatcactaaattcgctgcagaagaggccagagaatctgattgggatggcattatcgcatgtcaccaggggaaactgagctgctcaacgtggaactaccagaaatccactataggcgcctacttcctcaaacctaaggaacttaagaaagatgacatcacagcgactgcagtggatattacgtcttgtggtaacttcgcagtgataggattgagctccggcaccgtggatgtatataacatgcagagcgggattcatagaggctcttttggaaaggatcaggcccataagggctccgtccgcggcgttgcagtcgatggcttaaatcagctgacagtaacaaccgggagcgaggggcttctgaagttttggaactttaaaaacaagatccttatacacagcgtctcactgtcgagctcaccgaatattatgctccttcatagggattctggcatacttggcctggccctggacgatttttctatctcggtgctcgatattgaaacacgcaagatagtccgcgaattctccggccaccagggacaaatcaacgacatggctttttcccccgacggccggtggctgatctcagctgcaatggattgctccattcgaacgtgggatttgccaagtgggtgcctgattgattgcttcttgctcgactcagctcctctgaatgttagcatgagcccaacaggggacttcctggccacaagtcatgtggaccatctgggaatctatctgtggtctaatatcagtctttacagcgttgtgtcgcttcggcctttgccggctgactacgttcctagcattgtgatgctaccgggtacctgtcagacacaagacgtggaggtcagcgaagagacagtggaacccagtgacgagttgatcgaatatgatagtcctgagcaactcaacgaacagttggttacgctgtctctgctgcctgagtcacgatggaagaatctgctaaatttggacgtgatcaagaagaagaacaagcctaaggagcccccgaaggtgccaaaaagcgctccctttttcatacccacgatacctggcttggttccccggtacgctgcgcctgaacaaaacaatgacccgcagcaaagcaaagtcgtcaacctgggagtcttggcccaaaaatctgacttctgcctcaagttggaggagggcctggtgaacaacaaatatgacacggcacttaacctgctgaaagagagtggcccttctggaatcgaaaccgagctgcggtccctgagcccagattgtggaggaagcatagaggtgatgcagagctttcttaagatgatcgggatgatgctcgaccgaaaaagggattttgagctagctcaggcttacctggctcttttcttgaagttgcatctgaagatgttgccatccgaacctgtgttactggaagaaattacaaatctgtctagccaggtggaagagaattggacacaccttcaatccctctttaatcaatcgatgtgcatcctgaactatctgaagtctgcactgctctag

SEQ ID NO: 140618 - DNA, 2856 bp, Artificial Sequence
  Description of Artificial Sequence: Synthetic coding sequence
atgtgttgtactgaagggtccctcagaaagcgtgacagccagcgcgcacctgaagcagtgctgtgcctgcagctgtggcagaggaccgtaccactggataccttaaaagggttaggcacttgctttcctagcgggccggagttgcgcggagccgggatcgccgccgctatggagagagccagcgagcgacggaccgcctctgcgctcttcgctggcttcagggccttaggcctcttctcgaacgatatcccacatgttgtgagattcagcgctctaaaaaggagattttacgtaacaacttgtgtcgggaaaagcttccatacctatgacgttcaaaagctgagcctcgtcgcagtctccaacagtgtgccacaggatatctgttgcatggccgctgacggaaggttggtgtttgccgcctatggcaacgtcttctcggctttcgctaggaacaaagaaatcgttcataccttcaagggccacaaagctgaaatccatttcctgcagccatttggcgaccatataatatccgtcgacacagatggcatacttatcatatggcacatatattccgaggaagaatatctgcagcttacgttcgacaaaagcgtctttaaaatcagcgcgattcttcatccctcgacatacctaaataaaattctgttgggctccgaacaaggaagcctgcagttgtggaacgttaagagcaacaagctgctctacaccttccctgggtggaaggtaggcgtgacagcacttcagcaggcccctgccgtggacgtggtggctattggtctcatgtcaggccaggtcattattcataacataaagtttaacgagactctgatgaagtttcggcaggattggggtccaatcacatccatatcgtttaggactgacggtcatccagtgatggctgctggaagcccatgcggacatataggcctctgggacctggaggacaagaaactcattaatcagatgcgtaacgcacatagcactgccatcgccggcctgacgtttctgcaccgcgagccgcttctagtgactaacggagcagataatgctttaaggatctggatcttcgatggaccaacaggcgagggtcgcctgttaaggtttcgtatgggccacagcgcacccctgacaaatattcggtattacggccaaaatgggcagcagatattatctgcaagccaggacgggacactacaatcgttttctaccgtgcacgaaaaattcaataagagtcttggtcatgggttgatcaataaaaaacgggtgaagagaaagggcttgcaaaacaccatgagtgttcgcctgccacccatcacaaaattcgcagcagaggaggcgagagagagtgactgggatggaattatagcttgtcaccaaggaaagctgtcgtgcagcacatggaattaccagaagtcaaccataggcgcctactttcttaagcccaaggaattgaagaaagatgatatcacagctacagccgtggacatcacaagctgtggaaatttcgctgtcataggattaagctccgggactgttgacgtgtacaacatgcaaagtggcatccacagggggagcttcgggaaagatcaggcccacaagggatctgttcggggtgtcgcagttgacggcctaaatcagctgaccgtcacgacgggctctgaggggctgttgaagttttggaactttaaaaataagattctgatccacagcgtctcactgtccagctctccaaatattatgctgcttcatagggattccgggatcttgggattggcgctggatgatttcagcatttccgtcctggacatcgaaacacgcaaaatagtgcgggagtttagtggccatcagggtcagataaacgatatggcattttccccagatgggcgttggctgatctccgccgcaatggactgttctattcgcacatgggatctgccttccggctgtctgatcgattgctttctcttagactcagcccccctgaacgtgagcatgtcacccaccggagactttctggcaaccagccacgtggaccacctggggatctacctctggagcaacatctccctgtactccgtagtttccctcagacctcttcctgctgactacgtgccttcaattgttatgttgccaggcacatgccaaacacaggacgtagaggtcagcgaggagaccgtggagccttcagatgagctgattgaatatgattcccctgaacagttgaatgaacaactggtcactctgtccctcctgcccgagagtcggtggaagaacctgctgaacttagatgtcataaaaaaaaaaaataagccaaaggaaccacccaaagtcccgaagagcgccccatttttcattccaaccatccccgggctggtgcccaggtacgcagcaccagagcagaacaacgatcctcagcagtctaaggtcgtgaatctgggggtccttgctcaaaaatctgacttttgtttaaaactggaagaaggtctggtgaataacaaatacgatactgccttgaatttactgaaggagtcaggaccctcaggaattgagactgagttgcggtccctctccccagattgtggtgggtcaattgaggtcatgcagagcttcctaaagatgataggcatgatgctcgacagaaagagggactttgaactggctcaggcctatctggccctgttccttaagctacacctgaagatgctacccagtgaacccgtcttgctagaagaaataacaaacctatcctctcaagtggaggagaactggacccacctccagtctctgtttaatcagtctatgtgtattctcaactatctcaagtcagctttgctctag

SEQ ID NO: 140619 - DNA, 1239 bp, Artificial Sequence
  Description of Artificial Sequence: Synthetic coding sequence
atggcaggttctgtggggctggcgttgtgtggtcagacactggtcgtgaggggagggagtagattcttagctacgagtatagcctccagcgacgatgatagtttgttcatctacgattgcagcgctgccgagaaaaaatcccaggagaacaagggtgaagacgcccccctagaccagggttctggagctatcctcgcaagcacgttttcgaagagcggcagctattttgcattaacagatgatagcaagcgcctaatactctttcggactaaaccgtggcagtgtcttagtgtgagaaccgtggccagaaggtgtaccgcactgaccttcatcgcatccgaggaaaaggtactggtagccgacaagtccggcgatgtttatagtttctccgtactggaaccccatggatgtggtcgcctcgagctcggacacctgtcaatgttgctggatgtggctgtcagccctgatgataggttcatcctgaccgcagacagggacgaaaagattcgagtgtcgtgggcagccgccccacattcaatcgaatcattctgtttgggccataccgagtttgtttctaggatctcagtcgtccccactcagccagggctgctcctatcgtcttctggcgacggcacactcaggctgtgggaataccgtagcggtcggcaactccactgctgtcatttggcaagtctgcaggagctggtcgatcctcaggctccccagaaatttgctgcctcgcgtattgcgttctggtgccaggaaaattgcgtcgccctactgtgtgatggtacgccagtggtgtacatcttccagttggacgcgcgtcggcagcagctggtgtatcgccagcagctcgcctttcaacatcaggtgtgggatgttgcatttgaagaaacacagggcctctgggtgctccaagattgtcaggaagctcctcttgtactctacaggcctgtgggcgatcagtggcaatctgtgccggagtcaacagtgctgaagaaagtttccggagtgctgagggggaattgggccatgctggaggggtccgctggagccgacgcttcgttcagtagcctctataaggccacattcgataacgtcacaagttaccttaagaagaaggaagaaaggctccagcagcaattggaaaagaagcagagacgccgatctccccctcccggaccagacggtcacgctaagaagatgcgccctggggaagccactctctcctgctag

SEQ ID NO: 140620 - DNA, 1239 bp, Artificial Sequence
  Description of Artificial Sequence: Synthetic coding sequence
atggccggaagcgtaggcctagctttgtgtgggcagactctggtggtgcgcggcgggtcacggtttcttgcaacgagcatcgcgtcctctgacgatgacagcttgttcatatacgattgcagcgctgctgagaaaaaaagtcaggagaacaagggcgaagacgccccacttgaccaaggatctggagcaatcctggcaagcacctttagcaagagcggatcttattttgccctgacagatgacagcaaaaggctgattctgttcaggactaagccctggcagtgtctatccgtcagaaccgttgctagacggtgtactgctctgactttcattgcttctgaggagaaggtgttggtggcagacaaaagtggcgacgtgtacagcttttcagtcttggagccccatgggtgcggcagactagaacttggccatttaagcatgctcttggacgtggcagtctctcctgacgaccgctttatattgaccgcggaccgggacgaaaagattagagtgagctgggccgccgccccgcatagtattgaaagtttctgcttggggcacaccgagtttgtgagccggatctccgtggtgccaacccagcctggtctgctgctgtccagcagtggggacggcacacttagactgtgggaatacagatctggacgtcagctgcactgctgccacctcgcttcacttcaggagctggtggacccccaggcgcctcagaagtttgcagcaagtcgaatcgcattctggtgccaggagaactgtgtcgctctactttgtgacggtactcccgttgtgtatatcttccaactggatgcccgcagacaacagcttgtgtatcggcagcagctggcctttcagcaccaggtctgggatgtggcatttgaagaaactcaaggtctttgggtgctccaggattgccaggaggctccacttgtgctgtatcgccccgttggtgaccagtggcagtctgtgccagaaagtactgtgctgaagaaagtgtcgggcgtcctgagaggcaattgggcgatgttggaggggtccgctggggcagacgcttccttttcttccttgtataaggccaccttcgataatgtaacatcctatttgaagaagaaggaggaaagactacagcagcagcttgagaagaaacaacgccggagatccccccctcctggtcctgacgggcatgcaaaaaagatgcgacccggggaagcaaccctgagctgttag

SEQ ID NO: 140621 - DNA, 2034 bp, Artificial Sequence
  Description of Artificial Sequence: Synthetic coding sequence
atggccgcacaccatcggcaaaacaccgctggccgacgcaaagtacaggttagttatgtgatccgggacgaagtcgagaagtacaacaggaacggggtgaacgcgttacagttggatccggcgctcaacaggctctttactgcaggacgggacagcataatcaggatctggagcgtcaaccaacataagcaagatccctatattgccagtatggagcaccacactgactgggttaacgacatcgtgctgtgttgtaacggcaagactctgatttcggcttcatccgacaccaccgtcaaagtgtggaatgcgcataaaggcttctgcatgagcacactccggacacataaagactatgtgaaggctttggcatacgcaaaagacaaggagttggtagctagtgccggccttgatcggcagatcttcctgtgggatgtcaacacgctcacagcactaaccgctagtaacaataccgtgacaactagtagtctgtcaggcaacaaagactccatctactctctggccatgaatcaactgggtacaatcattgtctctgggagtaccgaaaaggtgctgcgggtttgggatccgagaacctgtgccaagttgatgaaactgaaggggcatacagacaatgtgaaagccctgctgctgaacagggacggtacacagtgcctgtccgggagcagcgacggcacgatcagactctggtccctaggacagcagcggtgcatagccacataccgcgttcacgacgagggagtgtgggccttgcaagttaatgacgcctttacacatgtgtactcaggtggcagagaccggaagatctattgtaccgaccttcggaaccctgacattcgcgtgcttatatgtgaggaaaaggcccctgtcctcaagatggaactcgacagatctgctgaccccccccctgcaatctgggtcgccaccaccaagtccacagtgaacaagtggaccctgaaaggtatccacaacttccgggcttctggcgactacgataacgactgcacaaacccaattacgcctctgtgtacacagccagaccaggtcattaaaggtggtgcttccattattcagtgtcacatccttaacgataaacggcatattctcacaaaggataccaacaacaatgtggcttattgggatgttctgaaagcctgcaaagtggaggacctagggaaggtggatttcgaagacgagattaagaagcggttcaaaatggtgtacgtgcctaactggttttcagtggacctaaaaaccggcatgctcaccatcacgttagatgaaagcgactgctttgccgcctgggtgtccgctaaggacgccgggttttcaagcccggatgggtccgatccgaaactcaatttgggtggcctgctactgcaggcactgctggagtattggcccagaacccatgtcaacccaatggacgaagaggagaatgaggtcaatcatgtgaatggggaacaggaaaacagggtgcagaaaggaaatgggtactttcaggttcctccccatacacctgtgatattcggagaggccggggggcgaacacttttccgactcctctgtcgcgattctgggggcgaaacagaatcgatgctgctgaatgagaccgtgccccagtgggtgatagatatcacagtagataagaacatgccgaaatttaacaaaatccccttttacctgcaacctcatgcgtcatccggcgcaaaaacactgaaaaaagaccggctctctgccagtgacatgctccaagtgcgtaaggtgatggagcacgtatatgagaaaattatcaacctagacaatgagagccagacgaccagctccagtaacaatgagaaacccggggagcaagaaaaggaggaggatatagctgtgctggccgaagagaagatcgaactcttgtgtcaggaccaggtactcgatccaaacatggaccttcgaactgtcaagcactttatctggaagtctggaggcgatctcacgctccactacaggcagaaatccacgtag

SEQ ID NO: 140622 - DNA, 1788 bp, Artificial Sequence
  Description of Artificial Sequence: Synthetic coding sequence
atggagtgccagtcagcccaggtcatctctgcctcttcagacacaaccgtgaaggtttggaacgctcacaagggtttttgtatgtctacactgcggacacacaaagactacgtcaaagcactcgcttatgcaaaagacaaggagctggttgcctccgccgggctggataggcagatttttctgtgggacgtgaataccctgaccgctctcaccgcttccaacaacaccgtgacaacatctagtttgtccggaaataaagacagtatctacagccttgccatgaatcagctggggaccattatcgtcagcggttcgactgagaaggttcttagggtatgggatccccgcacctgtgcaaaactgatgaaactgaagggacacacagataacgtgaaagctctgctactgaaccgcgatgggacacagtgcctctccggatcctcagatggcactatccggttgtggagtctgggccagcagagatgcatcgcaacttaccgtgtgcatgatgagggcgtgtgggcccttcaggtcaatgacgcgtttactcacgtgtactctggaggccgggatcgaaagatctactgcaccgaccttagaaatcccgacattagagtcctaatctgcgaggagaaggcccctgttctgaagatggagctggaccgttccgcagacccaccacccgcaatctgggtcgctaccaccaagtcaacggtgaacaaatggaccctgaaagggatacacaattttcgagcttctggtgactatgataatgattgcacaaacccaattacacctctatgcacacagccagatcaggttatcaagggaggcgccagcatcattcagtgccatattctgaacgataagcgacacattctgactaaggacacaaacaataacgttgcttactgggacgttcttaaagcctgtaaggttgaagatctgggtaaggtcgattttgaagacgagatcaagaaacgcttcaaaatggtctatgtacccaattggttcagcgttgacctcaagactggcatgctgaccatcactctagacgagagcgactgttttgccgcttgggtgagcgccaaggacgcaggcttctcaagcccagacggctcagacccgaagctaaacctggggggccttttactgcaggccctccttgagtattggcctcggacacacgtgaaccctatggatgaagaggagaatgaagtgaatcacgttaatggagagcaggagaatcgcgtgcaaaaggggaatgggtactttcaggtccccccacatactcccgtaatctttggtgaggcaggcggacgaaccctttttaggctgttatgcagagatagcggaggcgagacagagagtatgctgctcaatgaaaccgttccacagtgggtcatcgacatcacagtagataagaatatgccaaaatttaataaaataccattctacctccagccacacgcttcttcaggcgctaagaccttgaagaaggatcgcctgtccgccagcgacatgttgcaagttcgcaaggttatggagcacgtgtacgagaagattataaacctcgataatgaatcccagactacttccagctctaacaatgaaaaaccaggagagcaagagaaagaagaggatatcgctgtactcgccgaggagaagatcgagttactttgtcaagaccaagtgttggatcctaatatggacctgcggacagtgaaacattttatttggaaaagtgggggagatctgaccttgcactaccgccagaagtccacatag

SEQ ID NO: 140623 - DNA, 366 bp, Artificial Sequence
  Description of Artificial Sequence: Synthetic coding sequence
atgccaaaattcaataaaattcctttttacctacagcctcacgcttccagcggggcaaagaccctgaaaaaagacagactgagcgctagtgatatgctccaagtcagaaaagttatggagcatgtgtatgagaaaatcattaacttagacaatgagagtcaaaccacaagctcctctaacaacgagaagcccggtgaacaggaaaaagaagaggacatagccgtgctggctgaggaaaaaatcgaactcctgtgccaggatcaggtccgagtgctcgaccctaacatggacctgcggacggtcaaacatttcatctggaaaagcggcggggatcttactctgcactacagacaaaaatctacgtag

SEQ ID NO: 140624 - DNA, 1209 bp, Artificial Sequence
  Description of Artificial Sequence: Synthetic coding sequence
atggccgcacatcacagacaaaacacagcaggacgacggaaggtgcagtgtctcagtggatctagtgacggaactattcgtttgtggtctttgggccagcagagatgcattgctacttaccgagtgcatgacgagggtgtgtgggcactccaagtgaacgatgcattcactcacgtctactctgggggtcgagacagaaagatatattgcaccgacctacggaatcctgatatacgggtgcttatctgcgaggaaaaagcccccgttctaaaaatggagcttgatagaagcgctgacccccctcccgcaatctgggttgctaccactaagtcaacagtaaataaatgggcttgtaaggtcgaagatcttgggaaggtggatttcgaagacgagatcaaaaagcgttttaaaatggtgtacgtccccaactggttttccgttgatctaaagacgggaatgctgaccataacccttgatgagtcagactgctttgccgcctgggtctctgccaaggatgcagggttcagttctcctgacgggtccgacccaaagctgaacttaggtgggctgctccttcaagcactgttggaatactggccccgcacccatgtgaaccccatggatgaggaggagaatgaggtaaaccatgtaaatggagagcaggaaaatcgcgtccagaagggtaacggatacttccaggtacccccccacaccccggtaattttcggcgaagccggagggagaaccttattccgactgctatgtcgggactctggtggtgaaacagagtctatgttgttaaacgagaccgttccccaatgggtgattgacatcaccgtggataaaaacatgcccaagttcaacaagatcccgttctacctgcagccacacgcttcttccggcgccaagactttaaaaaaggacagactttctgcttctgacatgctgcaggtccggaaggttatggaacacgtgtatgaaaagatcattaatctggataacgagtcccagactacttcgagcagcaataatgaaaagcctggcgagcaggaaaaggaggaggacatagctgtgctcgccgaagaaaagatcgagctgttgtgccaagatcaggtgctggatcctaatatggacttgagaactgtcaaacatttcatttggaagagtggcggtgatctgaccctccactaccgtcagaagagtacatag

SEQ ID NO: 140625 - DNA, 651 bp, Artificial Sequence
  Description of Artificial Sequence: Synthetic coding sequence
atggatgccctggaagattacgtgtggcctcgcgccacttcagagttgattctgctgccggttacaggccttgaatgtgtgggcgatcggcttctggcaggggaaggaccagatgtccttgtgtactccctggacttcggtggtcatctgcgtatgataaagagggtgcagaatctgttgggtcattacttgattcacggcttcagggtgcggccagaacctaacggagatctggatctggaggctatggtcgcggtctttggatctaaagggctccgggtagtcaagattagctggggccagggacatttctgggagctttggcgctccggcctgtggaacatgagtgattggatctgggatgctcgatggctcgagggtaacattgctctcgcactgggccacaacagtgttgtgctctacgatcctgtggtcggctgtatcttgcaggaagtgccctgcacagacaggtgtaccttgtctagtgcctgcctgatcggtgacgcttggaaagaactcaccattgtggccggcgcggtatctaaccaactgctcgtgtggtacccagctaccgccttcacactgtacttatccgcccggccaacacccttctgttgcgtgctgaccccacggatgtgcacccgtctctag

SEQ ID NO: 140626 - DNA, 3456 bp, Artificial Sequence
  Description of Artificial Sequence: Synthetic coding sequence
atggggtcagcagcccgatgggaaggctctttctctagagaattttcatccctcttatctagggggtgcttgtcaaccagtagaatcgatatggacgccttagaggattacgtgtggcccagggccacgagcgaactcatccttctgcccgtgaccggcttagaatgcgtgggagatagactattagctggagagggaccggatgtgctagtgtacagtctggactttggcggccatctgcggatgattaaacgcgtgcaaaacctgctgggccactatctcatacacggatttagagttcgcccagagccaaatggggacctagatctggaagcaatggtagccgtctttgggtcaaaggggcttcgggtggtgaaaatttcttggggccaagggcacttctgggaactgtggcggagtggattgtggaatatgagtgactggatctgggacgcccgatggttggaagggaacattgcactggctctgggacacaacagcgtggtactctacgatcccgtcgtcggttgcatcttgcaagaggtcccttgcactgaccggtgtaccttaagctctgcctgtttaatcggagacgcttggaaggaactcacgatcgtggctggcgcagtctccaatcaattgttggtctggtatccggcaacagcgcttgctgataataaaccagtcgcacccgaccgacgaatttcgggccatgtgggcataatcttcagcatgagttatctggagtctaagggcctcctggctaccgcttcggaagataggagcgtgaggatttggaaagtgggagatcttagggtgcctggcggacgggtccaaaacattggtcactgtttcggccactccgcccgcgtctggcaggttaaactgctggagaattatcttatctctgccggcgaggactgcgtatgtctggtttggtcccatgaaggcgagattcttcaggcctttaggggtcaccagggcaggggcataagggccatagcggcccacgaaagacaggcttgggtaatcacgggcggtgatgactcaggcattagactctggcatttagtcggccggggctacagaggcctaggagtctccgcgctctgcttcaagagccggtcgaggccaggcactctgaaggccgtgacccttgctgggtcttggaggcttctagcggttaccgataccggggccctttatctttacgacgtggaagtcaaatgttgggagcagctgctggaggacaaacattttcaaagttactgtttgctagaagcagctccaggtccagagggatttggcctgtgcgcgatggcgaatggggagggccgagtgaaagtggtgcccatcaacacgccaaccgcggctgttgaccagaccttgttccctggtaaggtgcattctctctcgtgggcccttcgcggctacgaagagctgctgctgctggctagcggccccgggggagtcgtggcatgcttggaaatcagcgctgcccccagtggaaaagccatttttgtgaaggagagatgtagatatttattgcccccttcaaagcaaagatggcatacctgctcggcctttctcccgcccggggacttcctggtctgtggagatagacgcggctctgtgcttctgtttccttcacgacccggactgcttaaagaccctggagtaggaggcaaagcacgtgctggagcaggcgcacccgttgtggggtccgggtcaagtggcggaggcaacgcctttacaggactcgggccagtctcgacccttccaagcttacatggtaaacagggagtcaccagcgttacctgtcacggtgggtacgtctacacaaccggtcgcgacggagcgtactatcagctgtttgtgagggacgggcagctgcagcccgtcctgagacagaaatcctgcaggggcatgaactggttagccggtctgcgcatcgtgccagatgggtcaatggtaatcttgggattccacgcgaatgagtttgttgtgtggaaccctaggagtcatgagaagcttcatatcgtgaattgcggagggggccacaggagctgggccttcagcgatacagaggcagctatggcttttgcctacctgaaggacggtgatgtgatgttgtaccgggctctgggtggttgcactcggccccacgtgatcctaagggaaggacttcatggccgggaaattacttgcgtaaagcgggtcgggacaatcacgttgggccctgaatatggagttccctcgttcatgcagccagacgacctggaacccggtagtgaagggcctgatctcacagacatcgtgattacttgttctgaggacacgactgtgtgtgtgctagctctgccgacaacaacgggttcagcccacgccctgacagccgtgtgcaaccacattagttccgtccgggctgtggccgtatggggaataggcacaccagggggaccacaggacccacagcctggtctcaccgctcacgtggtgtcagccggggggcgggccgaaatgcattgttttagcattatggttactcccgatccttcaacgccttcccgcctggcttgtcacgtcatgcacctttcttcacaccgcttggatgaatactgggatagacaacgaaatagacacagaatggtaaaggtcgatccagagacaagatatatgagcctggccgtttgcgagctggaccagcctggattgggaccactggtcgcagcagcctgctccgacggagctgtgcgcttgttcttgcttcaggattctgggcgaatacttcaattgcttgcagaaaccttccatcacaagcgttgtgtcctgaaagtgcactccttcacccacgaagcaccaaatcagcggcggcgcctgctgctgtgttcagccgcaacagatggttccttagcattctgggacctgacaaccatgctggatcatgattcaaccgtgctggaaccccccgttgatcctggcttaccatatcgtctcggaacccccagcttgaccttgcaggctcattcctgcggcattaatagcttacacacactgccaaccagagaaggacatcatttggtggcatccggatcagaggacggaagtcttcatgtctttgtcctggccgtggagatgttacagctcgaagaagctgtcggtgaggccggacttgtgccgcaactgcgggtcttagaggagtactcagtcccgtgtgcacatgcggcccacgtcactggccttaaaatcctgagtccctcgattatggtgtccgcgtcaattgatcaaagactcactttctggcgtcttggacatggggagccgactttcatgaactcaaccgtttttcacgtgccagacgtggctgatatggactgctggcccgtttctccagagttcggtcataggtgtgctctggggggccaggggttggaggtatacaattggtacgattag

SEQ ID NO: 140627 - DNA, 3213 bp, Artificial Sequence
  Description of Artificial Sequence: Synthetic coding sequence
atgattaaacgagtccaaaacttgctagggcactacctgatacacggtttcagagtcagaccagagcctaatggggatctcgacctggaggcgatggtggctgtcttcgggagtaaaggcttacgggtcgtgaagatcagctgggggcaagggcatttctgggagctgtggaggtctgggctgtggaatatgtccgattggatatgggacgccagatggctagagggaaacatcgcgctggccctgggccacaattccgtggtcctatatgacccggtggtgggatgtattctccaagaagtcccttgcaccgataggtgcaccctgtccagtgcttgcctcattggtgacgcttggaaagaactaaccattgtggcaggagctgtcagcaaccaattgctggtgtggtatccagccaccgctctggctgacaacaaaccagtggcacctgacaggcggatctccgggcacgtgggcattatatttagcatgtcttacctggaaagcaagggtctgctcgccaccgcgagcgaggacagatcggtacggatttggaaggttggagacctgagggtgccaggtggcagagttcagaatatcggacactgtttcggccatagtgccagagtgtggcaggtgaagctgctggaaaactatctgatatcggcaggagaggattgtgtttgccttgtttggtcacatgagggcgagattttacaggcttttcggggtcatcagggcaggggaatccgggccattgccgcgcacgagaggcaggcatgggtgatcaccggcggggatgacagcggaatacgcctgtggcatctggtcggacgtgggtatcgaggtttgggggtgagtgcactatgtttcaaatctagaagtcggcccggtacgttgaaggcagtgaccctggcaggctcatggcgcttgctggccgtgacagataccggggctctgtacctgtacgacgtggaggttaagtgttgggagcagttgctggaggataagcactttcagagctattgccttcttgaggccgccccggggccagaaggctttgggctgtgcgcaatggcaaatggagaaggacgcgtgaaggttgtccccataaatacgcctaccgccgccgtggaccagaccctgtttccagggaaggtgcatagcttgtcttgggccttgcgagggtatgaggagctcctactcctcgcatcaggaccaggcggagtggtcgcttgcctggagatcagcgcggccccttccggaaaggccatcttcgtcaaagaacgttgcagatacctgctgcccccctccaagcagagatggcacacatgttccgctttcctgcctccaggtgacttccttgtatgcggggaccgtcgcggatcagtccttctgttccccagccgtccaggcctgctgaaggaccccggagtcggaggtaaggctcgggccggcgccggagcccccgtggtgggcagtggctcatccgggggcggtaatgctttcacaggtctcggtccggtgagcactcttcccagcctccacggcaagcagggtgtcacaagtgttacctgccacggcggctacgtgtacaccacggggagggatggcgcatactatcaactgttcgtgcgggatggccagcttcagccagtgctgcggcagaaatcttgtagaggcatgaattggctagcgggtctgagaatagttcctgacggctctatggtcatacttggattccacgcaaacgaattcgtcgtatggaaccctcgtagccacgagaaactgcacattgtcaactgcggcggagggcatcgtagctgggcattctcagatacggaagctgccatggcctttgcttacctcaaggatggtgatgtgatgctgtaccgggccctcggggggtgtacgcgtccacatgtcatcctgagagaaggactccacggacgcgaaataacttgcgtgaagcgtgtgggcacgatcaccctggggcctgaatacggcgtccctagcttcatgcagccagacgatctagagcctggctccgagggccccgacctcacagatatcgtgataacttgcagcgaggacaccaccgtttgtgtgctggcccttcccaccactacaggctctgctcacgccttaaccgccgtttgtaaccacatctcaagcgtgagggctgtggccgtttgggggataggcacgccaggagggccccaagaccctcaacctggcctgaccgcacacgtagtcagtgctggtgggcgggcagagatgcattgcttcagtatcatggtgacgccagacccaagtacacccagcaggctggcctgccatgttatgcacctgtcaagccatagactagacgagtactgggatcgacaacgcaatcggcatcggatggttaaggtcgaccctgagacaagatatatgtctcttgcagtttgtgagctggaccagcccggcttgggacctctggtggccgcggcttgcagcgatggagctgtgagattgttcttgctgcaggactccggtcgcattctccagcttctggctgagacctttcaccacaaaaggtgcgtattgaaggtgcattctttcactcacgaggcgcccaatcagcgcaggcgcctgctactgtgtagtgccgctactgatggaagcctggctttctgggatctcaccaccatgctggatcacgatagtaccgtcttggaaccaccagttgaccccggtctgccttatagactaggcacaccctcattgaccctccaggcccacagttgcggcatcaacagtctccatacactacccacaagagagggacaccacctggtggccagcggtagcgaagacggctcactgcacgtgttcgtgctggctgtcgaaatgttgcagctggaggaggctgtcggagaagccgggctcgtaccccagctgcgggtactcgaggagtatagtgttccctgcgctcacgctgctcatgtgaccggcttaaagatcctgtccccttcaataatggtctctgctagtatcgaccagcgtttgaccttctggcgactcggtcacggagaacctacctttatgaatagcaccgtattccacgtccccgatgtcgctgacatggactgctggcccgtaagcccggagtttggccaccgctgtgctctgggagggcagggactggaagtctacaattggtatgactag

SEQ ID NO: 140628 - DNA, 4557 bp, Artificial Sequence
  Description of Artificial Sequence: Synthetic coding sequence
atggccgctgtgggatccggcggctacgcccgcaatgatgcgggggagaagctcccctctgttatggctggggtgcctgctagaagaggccagtcctctccaccccctgctcccccgatctgcctgaggagaagaacaagattgtccaccgcaagtgaagaaaccgtccagaatagggtgtctctggagaaagtcctgggtattacagcacagaactccagtgggctgacatgtgacccaggcactgggcatgtagcataccttgcaggttgcgtagtggttatcctagacccaaaggagaacaaacagcagcacattttcaatactgctaggaaatcactcagtgccctggccttcagtcctgacggcaaatatatcgtgaccggagagaacggacatcgccctgcagtgaggatttgggatgtggaggaaaaaaatcaagtggctgagatgctaggccacaaatatggtgtcgcttgcgtggcatttagcccaaatatgaaacacatcgtgtctatgggataccagcatgacatggtcctcaatgtttgggattggaagaaggatattgttgtcgctagtaataaggtaagttgccgcgtaatagccctatccttctcagaggatagcagttacttcgttaccgtgggcaacagacacgtgcgcttctggttcctagaagtgagtacagagactaaagtgacatccaccgtcccgttggtgggtcgatccggcatactgggtgaattgcacaacaacatcttttgtggagtcgcctgtggtcggggcagaatggcagggagcacattttgcgtgagttactccgggttgctctgtcaatttaacgagaaaagagtgctagaaaagtggattaaccttaaggtcagtctctcttcttgtctctgtgtttctcaggaactcatcttttgcggatgcaccgacggaattgtgcggattttccaagcacattccctccattacttggcaaacttgccaaaaccacattatctgggcgtggacgtggcgcaaggccttgaaccttctttcttgttccaccgcaaagcggaggccgtttatcccgacaccgtggcgctaacgtttgaccccatccaccagtggctctcctgcgtatacaaggatcacagcatctacatctgggacgtgaaggacattaacagagttggcaaagtatggagcgaactcttccacagtagctacgtttggaacgttgaggtctacccagagtttgaggaccagcgggcctgtcttcccagcggatcattcttaacttgcagcagcgataatactattagattctggaacttagacagttcgcctgactctcactggcagaaaaatattttttccaacaccctactcaaggtcgtctacgtcgagaacgatatacagcacctgcaagatatgtctcacttccctgataggggatccgagaacgggacccccatggacgtgaaggcaggcgtccgagtcatgcaggtgagccctgatggtcaacacctcgcctcaggcgatcgtagtggtaacttaaggatccacgagctgcactttatggatgagctcgtgaaggtggaagcgcatgacgcagaggttctctgcttggaatattctaaacccgaaactggcttaactctgctggctagcgccagccgggatcgcttgatccatgtgctaaatgtagagaaaaattataacttggagcagaccctggacgaccattcttcctctataacagctatcaaattcgcaggcaatcgagatatccagatgatatcatgtggagccgacaaaagcatttactttcgctcagcgcaacagggcagcgatggattgcacttcgtgcgaacccaccacgttgctgaaaaaacaaccctttatgatatggacatcgacattacacaaaagtacgtggccgtcgcgtgtcaggaccggaatgttcgggtgtacaacaccgtgaatggaaaacaaaagaagtgctacaagggcagccagggggacgagggttccctgctaaaggtgcacgttgatccatctggtacatttctcgctaccagctgcagcgacaagtccatctctgtgatcgatttctacagtggggagtgcatcgctaagatgttcggtcatagcgaaataatcacaagtatgaagtttacctacgattgtcaccatcttatcactgtcagtggtgattcttgtgtgttcatttggcatctggggcccgagattaccaactgcatgaaacagcacctgctggagatcgaccacagacagcagcagcagcataccaacgataagaaacgctctgggcacccgcggcaggatacttatgtatcaaccccctcggagatccatagcctctcacccggcgagcagactgaggacgatctggaagaagaatgtgagccggaggaaatgctgaagaccccaagtaaagatagcctcgaccccgaccctcgctgcctgcttaccaatggtaagctgccactatgggcaaagagactgctgggcgacgacgatgtggcggatggcctggcattccacgccaagaggtcataccagcctcacggtcgatgggcagagcgcgctgggcaagagccgctgaaaacaattcttgatgcccaggacttggactgctacttcacgccaatgaagcccgagtcactcgaaaactcaatcctggattcattggagcctcagtccctagcctctcttctcagtgaatctgaatcaccgcaggaagccggccggggccatcctagttttctgccccagcagaaagagtcctcagaagcctctgagctgattctgtactcactcgaggctgaagtcacggtcaccggcacggattcacagtattgtaggaaagaggtagaagcagggcctggagaccagcagggcgatagctacttgagagtcagcagtgactcccccaaggatcagagtccgcccgaagactcaggggagagcgaagccgacttggaatgcagcttcgctgctattcacagccctgcccctcctccggaccctgccccacgatttgctactagtctgccacattttcctgggtgtgctggacccactgaagacgaactttccctacctgagggtccttccgtgccttcctcttccctgccccagactcccgagcaagagaagtttctgaggcatcactttgaaacgctgacagagagcccttgtcgggccctgggcgatgtagaggcctccgaggcagaagatcacttcttcaatcctaggcttagcatttctactcaattcttaagctcgctgcagaaggcgtctcgtttcacgcacaccttccccccccgcgcaacccaatgcctggttaagagtccagaggtgaaactaatggatcgcggtggtagccagccccgcgcagggacaggctacgctagccccgacaggacccatgttttggctgccgggaaggcagaagagactttggaagcatggcggcccccaccgccctgtctgaccagtctcgcctcttgtgtccctgcctcaagtgtgctgcccacggacagaaacttgccaactcccacaagtgcccccacccccggattggcacagggtgtacacgccccctctacttgttcctacatggaggccacagcgagctctagggcccgcatcagcaggagtattagtctcggggactccgagggaccaattgtcgccaccttggcgcagcctctgcgtcgccccagtagcgtcggcgaactggcctctcttggccaggaactccaggccatcacaaccgcgactactcccagtttggactctgaggggcaagaacccgctctcaggagctggggcaatcacgaggccagagctaacttgaggttgacattgtctagcgcatgtgacgggctcctgcaaccccccgtagacacccagcctggcgttaccgtgccagcagtgagctttccagctccgtccccagtggaggagtctgctctgcgcctgcatggcagcgcttttcggcctagtctcccggcccctgaaagccccggcttacctgcacatcctagcaacccccagctgccagaagccagacctggcattccgggaggcacagcttcgttgttagagccgacatcaggagcgttggggctgctgcagggctcgccggcaagatggtcagagccatgggtccctgttgaagctctaccacccagccctctcgaactttcacgagtgggcaacatcttgcatagacttcagacaacttttcaggaggccctggacctttaccgagtgctggtgtcctccggccaagttgatactggtcagcagcaggcaagaactgagctcgtcagtacctttctgtggatccattcacagttagaagctgaatgtctggtaggtacatccgtggcgcccgcccaggccctaccctctccaggaccaccctccccacccactctctaccccctggcctcaccagatctgcaggcactcctcgaacattactcggaactactcgtgcaggccgtccgccggaaagcgagaggacactag

SEQ ID NO: 140629 - DNA, 1245 bp, Artificial Sequence
  Description of Artificial Sequence: Synthetic coding sequence
atggcggccgtgggctcaggaggttatgcgcggaacgatgcaggggagaagctgccttcggtgatggccggcgtgcctgctcggagggggcagtcttcccccccacctgcaccaccaatttgcctcaggcgccgcaccaggctgagcactgcctctgaggaaacagtgcagaaccgggtctccctggagaaagttctggggatcactgcccagaatagctctggcctcacatgtgatccaggcactggccacgttgcctacctggcggggtgtgtcgtggtcatcctggaccctaaggaaaacaaacagcaacatatattcaacacagctcgcaagagcttgtcggccctcgcattctctccagacgggaagtacatagtaactggagagaacggacacaggccagccgttaggatttgggacgtcgaggagaaaaatcaagtagccgaaatgctcggtcacaagtatggtgtggcatgcgtggccttctcaccaaatatgaagcacattgtgtcaatgggctaccaacacgacatggtgctcaacgtgtgggattggaagaaagacatagtggtagcatccaataaagtcagctgcagagtaatcgccctgtccttcagtgaggactcctcctattttgtaactgtcggcaataggcatgttcgcttctggtttttggaagtgagtaccgagactaaagttacctcaactgtgcctctagtgggacgctctggcatcctgggggagctgcataataatattttttgtggagtagcctgtggccgtggtaggatggctggaagtaccttttgtgtttcctatagtgggctgctctgccagttcaatgaaaaaagggtactggaaaaatggattaacctgaaagtctccctctccagctgcctgtgcgtatctcaggaactgatcttttgcggatgcaccgacggaatcgtgaggatcttccaagcgcactcactccactacctggccaacctgcctaaaccccattatctgggtgtggacgttgctcagggtctggagccttcattcctgtttcatcgtaaagctgaggccgtgtacccggacaccgtcgccttgacattcgaccctattcatcagtggctgagctgcgtctataaagatcactctatttatatctgggatgtcaaggatattaaccgtgtcggcaaggtatggtctgagctcttccatagcagctatgtctggaacgtagaagccctttcttag

SEQ ID NO: 140630 - DNA, 1452 bp, Artificial Sequence
  Description of Artificial Sequence: Synthetic coding sequence
atggctgccgtggggtcaggcggatatgcacgaaatgacgccggagaaaagctgccgtccgtcatggcaggggtgccggccaggcgggggcagagttcacctcccccggccccgccaatttgccttcgcagacggactcgactgtccacagcaagcgaggagacagtgcaaaatagggttagcttagagaaggtcctcggtattaccgcacagaactcgtcaggcctcacctgcgaccccggaacgggccatgtcgcctatctagccggttgtgtagtagtcatactggatccaaaggagaacaaacagcagcacatattcaataccgctcggaagtccctttccgctcttgcatttagtcctgatggtaagtacatcgtaactggggagaacggtcaccggcctgcagttcgcatttgggatgtggaggagaagaaccaagtcgccgaaatgttgggacataagtacggagtggcatgtgtcgccttctctcccaacatgaagcacattgtctccatgggataccagcatgatatggtgctcaacgtgtgggactggaaaaaagacatcgtggtagcctctaataaggtgagctgtagagtgatagcattatccttttcagaggacagtagttactttgtcactgtcggtaaccgtcacgttagattttggttcttggaggtgtccaccgagaccaaggtcacctccacggtgccattggtgggccgctcagggatcctaggagagctgcacaacaatattttctgtggcgtggcatgcggccgcggccgcatggctggttccaccttctgcgtctcttactccggcctactctgtcaattcaacgagaagcgagtcctggaaaagtggattaatttaaaagtgtccctgtcaagctgcttgtgtgtatcacaggaactgatcttttgcggatgcacagacggcatcgtgaggattttccaagcacacagtttgcattaccttgccaacttacctaaaccccattatctgggggtggatgtggcccaagggctagagcccagttttctctttcacaggaaggcagaggcggtgtatccagatacggttgcattgacattcgacccaattcatcagtggctctcctgcgtgtacaaggaccatagtatctacatctgggatgtcaaggacataaaccgagtgggcaaggtttggtccgagctgttccacagcagctatgtctggaacgtggaagtgtaccccgagtttgaggaccaaagggcttgtctgcccagcggctccttcctcacttgcagctcggacaacactatcagattctggaatttagattcttcaccagactctcactggcagaaaaacatcttcagtaatctcgcccccgccctgcagatgtgtggccgaggccactctcgccagccgaatacacctagcccaggcgaaatcgcttcctag

SEQ ID NO: 140631 - DNA, 4572 bp, Artificial Sequence
  Description of Artificial Sequence: Synthetic coding sequence
atggcggcagtggggtcaggcggatatgctaggaacgacgccggtgagaaactgcctagtgtgatggcaggagtccccgccaggagaggacagtcttcaccacccccagcccctcccatctgcttgaggagacggaccaggctgagcactgcatccgaagaaaccgtgcagaacagggtgtcactggaaaaggttctggggataactgcgcagaactcctctggattgacatgtgatcccggtaccggccacgtggcctatcttgccgggtgcgtggtggtgatactggaccccaaagaaaataagcaacagcacatcttcaacaccgcaaggaaatccctgagcgcgcttgcttttagccccgatggaaagtatattgtcactggggaaaacggacatagaccagcagtcaggatctgggatgtggaagagaagaatcaggttgcagaaatgctcgggcacaaatatggagtggcatgcgtcgccttttctccaaatatgaaacacattgtttctatgggctatcagcacgacatggtgctcaatgtgtgggactggaaaaaggatattgtcgttgcttccaataaggtatcttgccgcgtcattgccctttctttctcagaagatagttcgtacttcgttacagtgggtaatcgacacgtgcgcttctggtttctggaggtaagcacggagacaaaagtgacctccacggtgccccttgtgggacgatcaggcattcttggtgagctgcataacaacattttctgcggagttgcctgtggccggggacggatggcaggttcaactttctgcgtgagctatagcggtcttttgtgtcagttcaacgaaaagagggtcctggaaaagtggatcaatctgaaggtcagtctgagctcctgcctgtgtgtctcccaggaactgatcttttgtggctgtacagacggaatcgtccgcatttttcaagcccacagtctgcattacctagccaatctccccaaaccccattatcttggggtcgatgtcgcccagggtctggagcctagttttctctttcacaggaaagctgaagcggtgtacccagacactgttgcactcacatttgatccgatacatcagtggctctcctgcgtctacaaggatcattcaatttatatctgggacgtcaaagatattaaccgcgtgggtaaggtttggagcgagctttttcactctagctatgtgtggaacgttgaagtgtacccagaatttgaggatcaacgcgcgtgtctgcccagcggctcatttttgacctgttccagtgacaatacgattagattctggaatttggatagctcaccagattcacactggcagaagaatatctttagcaatactctcctgaaggttgtgtacgtggaaaatgatatccagcacttacaggacatgagtcatttccccgaccgtggcagcgagaacggaacccctatggatgtcaaagccggggtgcgggtgatgcaggtgtctcccgatggacagcatctagcatctggagaccgatctggaaatctgaggattcatgaattacacttcatggacgagttggtgaaagtggaggctcatgacgcagaggttctgtgtctggaatacagcaaacctgagacaggcctgaccctgctggccagtgcgtccagggatcgcttaatccacgtacttaacgtcgagaaaaactacaacttagagcaaactctcgatgaccattccagttccattacagcgattaaatttgcgggcaatcgagacatccagatgattagctgtggagccgacaaatcaatttattttcgaagtgcccagcagggcagcgatggtcttcacttcgtgcgtacacaccatgtagctgagaagaccactctgtacgatatggacatagacatcacccagaaatacgtagctgtggcctgccaggatagaaatgtgagagtttataatacggtcaacgggaagcagaagaagtgctacaagggctctcaaggtgacgaaggctctctgctcaaggtccacgtggatccttccggcacattcttggctacatcatgctcagacaaaagtatctcagtcatcgatttctatagcggtgagtgcatagcaaagatgttcggtcacagtgaaattatcacctcaatgaagttcacctacgactgtcaccatctcatcacagtgtctggggactcatgtgtgttcatctggcacctgggtcccgagattacaaactgcatgaagcagcacttgctggaaattgaccacagacagcagcagcagcacactaacgacaagaagcgctccggccaccccaggcaggacacatatgtaagcaccccatctgagatccactccttgtcccccggagaacagaccgaggatgaccttgaagaggagtgcgaacccgaggagatgctgaaaactccctcaaaggactccctggatcctgacccacgatgcctgttgaccaatggtaagctgcctctgtgggcaaaacggttgttaggtgatgacgacgtcgccgacgggctcgccttccacgctaaacggtcctaccaacctcacggccggtgggcggaaagagcaggccaggagccactgaaaacaatcttagacgcccaggacctggactgttacttcacccctatgaagcctgagagtctggaaaattccatactagacagtctggaacctcagtccctggcgagtctactctccgagagtgaatctccccaggaggctggacgaggtcatccatcattcctcccacagcagaaggagtccagtgaagcctctgagctgatcttatacagcctggaagcggaggtgaccgtgactggcactgacagccagtattgccgaaaagaagtagaggctggaccgggagaccagcagggcgactcgtacctgcgagtcagttccgactcccccaaggatcaaagccctccagaggactctggggaatctgaagctgaccttgaatgctccttcgccgctatccactcaccagccccgcccccggatcctgcccctcgcttcgcaacatctttaccacattttcctgggtgcgcaggcccaaccgaggatgaactctctctgcctgagggcccttctgtgccaagtagcagtttaccccagacccccgagcaagagaaattcctgcgccaccatttcgagacattgactgagtctccatgccgtgaacttttcccagcagcgctcggtgacgtggaagcaagcgaggcggaggaccactttttcaatccacgtttgagtatttccactcaattcctgtcctctctgcaaaaggctagcagatttacccataccttcccccctagggcaacacagtgtctggtaaagtctccagaagtgaaacttatggatcgcggcggatcccagccccgggcgggtaccgggtacgccagtccggaccgaacgcacgtgctggctgcgggaaaggcggaggagactcttgaagcctggagacctcctccaccgtgccttacctctctcgctagctgtgttccagcttcatccgtgctgcccacggatcgaaacttaccgacgcccacttccgcgcctacgcccggactggcccagggtgtgcacgcaccatctacatgtagctacatggaggccactgcttcttccagagcaaggatttcccgcagtatctcacttggtgatagtgaaggccccattgtagcgaccttagcccagccattaaggcggcccagctcagtgggagaactggcttctttaggtcaggagttgcaggctattacaacagcaacgaccccatcactggacagtgaaggacaggagcccgcgctgagaagctggggaaatcacgaagcccgcgccaatctgcgactcacactgagtagcgcgtgcgatggactgctccagcctcccgtagatacacagccaggcgtgacggtgcctgccgtaagcttcccagccccttcccctgtggaggaatccgcactaagactgcacggaagtgctttcagacctagcttacctgctccggagtctcccggcctccctgcacatccaagtaacccccaactgcccgaagctcggcctggcattcctggcggaaccgctagcctgctggagcctactagcggagcacttgggctgctccagggtagtccagctcgctggtctgagccgtgggtgcctgttgaggcattacccccctctcctctcgaactaagtagggttgggaatatactgcatagacttcaaaccacttttcaagaggcactggacctttaccgcgtgcttgtaagtagcggtcaggtggacacgggacagcaacaggccaggacagaactagttagtactttcctgtggatccactcccagctcgaggctgaatgccttgtcggcacctccgttgccccagcgcaggcgctgccatctcccggacccccatccccccccacgctgtacccactagcctcccccgatctacaggccctgttagaacactacagtgaactgctagttcaggccgtccgaagaaaagctcgagggcactag

SEQ ID NO: 140632 - DNA, 1302 bp, Artificial Sequence
  Description of Artificial Sequence: Synthetic coding sequence
ggcgggtacgccagaaatgacgccggagagaaacttcctagcgtcatggccggcgtcccggctaggagaggtcagagctccccccctccagccccccccatctgtctgagacgacgcaccagattaagcacggcgtccgaagaaactgtgcagaatcgcgtttccctggagaaggtgcttggaattacggctcagaacagcagcggcctaacctgcgacccaggaacgggccacgttgcctatctcgcagggatgtggagaatgggacctgcctcggagtcttgcggagaagactcgattgcacccagtctcagcagaactgttcccggaatgtattgtgtggttgtcattctggacccgaaagagaataagcaacaacacatctttaataccgctagaaagagcctcagtgccttggctttcagtcctgatggcaagtatatcgtcaccggtgagaacggccaccgcccagcagtgcgcatttgggatgtggaagagaaaaaccaggtagccgaaatgctcggccacaagtacggggtcgcttgcgtggccttttcacctaacatgaagcacatcgtctccatgggataccagcacgatatggtgctgaacgtgtgggattggaagaaggacattgtggtcgccagtaataaggtgtcctgcagggtgattgcactgtccttcagcgaagatagctcctatttcgtgacagttgggaaccggcatgtacggttttggtttctggaagtgtctactgaaaccaaggtgacctcaacagttccgcttgtgggccgaagcggaattttgggagaactgcataataacattttctgcggagtagcatgtggaagaggacgcatggcaggatcaaccttctgtgtgagctatagtggcctgctttgccagttcaatgagaagagagtgttggaaaaatggataaatctaaaagtctctctgagttcctgtttgtgcgtatcacaggaacttatattctgcggctgtaccgatggcatcgtgcggatctttcaggctcacagtctgcactatctggccaatcttccgaaaccacattacctaggagtcgatgtcgcgcaggggttggagcccagcttccttttccaccgcaaggcagaagccgtgtatccagacacagtggcccttacgtttgaccccattcaccaatggttgtcttgcgtgtataaggaccatagcatctacatatgggacgtgaaggatatcaatagggtgggtaaggtctggtcagaacttttccactcatcctacgtatggaacgtggagtag

SEQ ID NO: 140633 - DNA, 2097 bp, Artificial Sequence
  Description of Artificial Sequence: Synthetic coding sequence
atgagcgccgtcgtggcacagacacttcatgtgttcggcctgaggagccacgtcgcaaataacattttttatttcgatgagcagatcatcatattcccttctgggaaccactgcgtgaagtacaatgttgatcaaaagtggcagaagtttatcccaggttccgaaaagtcccagggcatgctggctctgagtattagtcctaacagacgatacctcgctatctcagagacagtgcaggagaagccagctattacaatttacgagctgtccagcatcccctgtaggaagcgcaaggtcttaaacaatttcgattttcaagtgcagaaatttattagtatggccttctctccggacagtaaatatttgctggcccaaaccagcccaccggagagcaacctcgtgtattggctgtgggaaaagcagaaagtcatggctatcgtaagaatcgatacccagaataaccccgtctatcaggtgagcttttcgccacaagacaatacgcaggtgtgtgttaccggcaacggtatgttcaagctgttgagattcgccgagggtaccctcaagcagacctctttccaacggggagagccccagaattacctggcacatacctgggtggctgatgacaaaattgtggttggcaccgataccggtaaactgttcctcttcgagagtggtgaccaacgctgggagacttctataatggtgaaggagcccactaatggcagtaaatccctagatgtcatccaggagtcagagtccctgatcgagtttccacccgtttcgtccccactaccatcatacgaacagatggttgccgcatcatcccactctcagatgtccatgccacaggtcttcgcgatcgccgcttactccaaaggcttcgcctgcagcgctgggccgggtagagtcctgttgttcgagaaaatggaagagaaggacttctatagagaaagcagagaaatacgaatccctgttgacccccagtccaacgatccctcacagtccgacaagcaggacgtcctgtgcctgtgttttagccccagtgaggagaccctcgtagcctctacaagtaaaaaccagctctactctataaccatgtctcttacagagatctctaagggcgaacccgctcacttcgagtacctcatgtacccactacatagtgctcccatcactggattagccacctgtatcaggaaacccttgatcgccacgtgcagcttagatcgaagcatcaggctttggaactatgagacaaatacgttggagttgttcaaagagtaccaggaagaagcctattccatctccttacacccatctggccacttcattgtggtggggtttgccgataaactgcgcctcatgaatctactgattgacgacattcgatcctttaaggagtattcagtacgcggttgcggcgaatgcagcttttctaacggcggccacctgtttgctgccgtgaatggcaacgtgatccacgtgtacacaacgacgtctctggagaacattagctccctcaagggacatacaggtaaaattaggtctattgtatggaatgccgatgattcaaaattgatttccggaggcacagatggtgctgtgtatgagtggaacttatctactggcaagcgggaaaccgagtgcgtcctcaaatcgtgctcatataattgcgtcaccgtctcccctgatgcaaaaattatttttgcggttggttcagaccatacactgaaagaaatcgccgacagcctgatcctcagagaaatcagcgcatttgatgtgacctacacagcaattgtcatctctcattccgggcgcatgatgttcgttgggacctctgtaggtaccatccgcgcaatgaagtatcctcttccgctacagaaggagttcaacgagtaccaggctcatgccggacccatcacaaaggtgtcgcgggccttatcaccgggcactcagtctcacacttgcctgctccgagctctgttcatcccatcaactagccagtgtctcttttctctcctgctgcttagctacctcttcatccaccactctttaaatcaccatttactcactatgaacattctgttcgtgtag

SEQ ID NO: 140634 - DNA, 501 bp, Artificial Sequence
  Description of Artificial Sequence: Synthetic coding sequence
atgtcggccgtggtggcccaaacattgcacgtgttcgggctgcgaagccacgtggctaacaatatcttctatttcgatgaacagatcattatcttccccagcggaaatcactgtgtgaagtacaatgtggatcagaagtggcagaagttcatcccaggaagcgagaaatctcagggaatgctggccctctccatctctccaaaccgccggtacctcgccattagcgagaccgtccaggaaaagcccgccatcaccatatacgagctcagttccattccatgcagaaagcggaaagtgttgaacaacttcgattttcaggtccaaaagttcatttccatggccttcagtccagactcaaaataccttctggctcaaacctcccctccggaaagcaacctcgtctactggctttgggaaaagcaaaaggtcatggctatagtacgaattgacacacagaacaatccggtataccaagtctcgttttccccacaggacaactag

SEQ ID NO: 140635 - DNA, 4473 bp, Artificial Sequence
  Description of Artificial Sequence: Synthetic coding sequence
atggccggtaattctcttgttctgccaatcgtgctgtggggacggaaggcccctacccactgtatctctgccgtgttgctcactgatgatggggcgaccatcgtcacggggtgccatgacggacagatttgcctctgggatttaagtgttgaactccagatcaaccccagggcactgttattcggccacacagcttctatcacatgcttgagtaaggcatgcgcgtcgtcagacaaacagtatatcgtgtcggcctctgagagcggcgagatgtgcctgtgggacgtgagcgatgggcgctgcatagaattcaccaagctggcctgcacgcacactggcattcagttctaccagttctctgtgggtaaccagcgcgagggacgccttttgtgccacggtcattatcccgaaatccttgtcgtcgacgccaccagtctggaagttttatacagcttagtctccaaaatatccccagactggatctcgtccatgagcatcataaggtctcataggacccaagaggacaccgtggtggctctgtcagtaacaggaatcctgaaagtgtggatcgtgaccagcgagatcagtgatatgcaggataccgagcccattttcgaagaggagtccaagcctatctactgtcagaactgccaatcaatttcattctgtgctttcacccaacgctcactgctcgtggtgtgcagcaagtattggcgggtctttgatgccggagattacagcctgctgtgttcaggcccctccgagaacggacaaacctggacgggcggtgatttcgtgagttcagacaaagttataatctggacagagaacggacagagttatatctacaagctgccagcctcttgtctaccagcttccgactcatttaggtctgatgtcgggaaggccgtggagaacctgattccccctgtccagcacattctgctggatcggaaagacaaggaactgctgatatgtccgccggtgacccgatttttctatggctgccgagagtattttcacaagcttctgattcaaggggattcttcaggccggctgaacatctggaacatttctgatacagctgataaacagggttcagaagaaggcctggccatgacaacctccatatccctccaggaagcctttgacaaactcaacccttgtccagctggcattatcgatcaactgtctgtaatccctaactccaacgagccactcaaagtgacagctagcgtgtacataccagctcatggcagactggtctgtggccgcgaggatggatccatcgtgattgtaccagcgacacagacagcaatcgtgcagcttttacaaggtgagcacatgctgcggcggggttggccaccgcaccggaccctcagggggcataggaacaaagtgacgtgcctcctctacccccaccaggttagtgctcggtacgatcagcgctatttgatctccggaggcgtggattttagtgttattatttgggatatattcagcggcgagatgaagcatattttttgcgtgcacggcggcgagattacccagttgctagtgccaccggaaaactgttctgccagggtgcaacactgcatatgtagcgtcgcatctgaccactctgtgggactcttgtcccttagggagaagaaatgtatcatgctcgcaagtcggcatctcttccccatccaggtcattaagtggagaccgtccgatgattatctggtggtgggttgttctgacggcagtgtgtatgtatggcaaatggatacaggagccctcgaccgatgtgtgatgggcatcacagctgtggaaatactcaacgcttgcgatgaggctgtgcctgctgctgtcgattccctgtcacatccagcagtgaacctcaaacaagctatgactcggcgcagcctggctgccctcaaaaacatggcacatcacaaactgcagacactggccacaaacctgctggcaagtgaagccagcgataaaggtaacttgccaaaatacagtcataattctcttatggtgcaggccatcaagacgaatctcacagatcctgatatccacgtcctattctttgacgtggaagccttaataattcagttgttgacagaagaagcctcccgtccgaatacagctcttatctctcccgagaatctccaaaaagcttccggaagcagcgacaagggtggctcatttctgacaggtaagagagctgcagtactctttcaacaggtgaaggagaccattaaggaaaacataaaggaacatttgttagatgacgaggaggaagacgaagaaattatgaggcaacgcagagaggaaagtgacccggaataccggtccagtaagtcaaagccattgacgctgttggagtataacctgacgatggataccgccaagctctttatgtcctgtctacacgcatggggactgaatgaggttctggatgaggtctgtctggatcggctaggtatgctgaagccgcactgcactgtttcgttcggtctgctgtccagaggaggccacatgtccctcatgttaccaggctacaatcagcctgcttgcaagttaagccatgggaaaactgaagtcgggcgcaagttgccagcaagtgaaggtgtcggcaaggggacttatggcgtgtcaagagctgtaactacacagcacttgctgtcgattatttcactcgcaaatactctgatgtccatgactaatgctacattcatcggggatcatatgaaaaaaggtcccaccagacctcctagaccttcaacacccgatctgagcaaggcacgggggtccccccccacgagtagtaatatagtgcaaggccagatcaagcaggtggcagcccctgtggtgtccgcacgttctgacgctgaccatagtggaagtgaccctccgtcggcccctgctctgcacacctgtttcttggtgaatgaggggtggagtcaactggctgccatgcactgtgtgatgctgcccgatctgctaggcctggacaagtttaggccgccgctactcgagatgcttgcccggaggtggcaggaccgctgtctcgaagttagggaggccgcccaggctctgctcctcgctgagctgcgacgcattgaacaggctggacgaaaggaggcaattgacgcgtgggctccgtatttgccccagtacattgaccacgtgatatcaccaggtgtaactagcgaggcggctcagacaataactaccgcacccgatgcctccggcccggaggccaaagtgcaagaggaagagcacgatctcgtcgacgatgacatcaccaccgggtgtctatcaagtgtacctcagatgaaaaaaatttctacatcatatgaagaacgacgtaaacaggctaccgcaatcgtgttattaggcgtgattggggcggagtttggagccgagatcgaaccccccaagttattaacaagaccgcggtcgtcctctcagatccccgagggcttcggcttgacgagtggaggatcgaattatagcttggcccgacacacatgcaaggctctaaccttcctattgcttcagcccccttcccccaagctgcccccccacagcacaatccgtcggacagctatcgatcttattgggcgcggatttacagtgtgggaaccctatatggatgtgagcgctgtgctgatggggctgctcgagctgtgtgccgatgccgagaaacagttagccaacattacaatgggattgccgctctcccctgccgcggactctgcgcggtccgccagacacgcacttagtttgatcgccaccgccagaccaccagccttcattacgacaatagccaaggaggtccacagacacaccgccttagccgctaatactcagagccagcagaacatgcatacaacaactctggcgcgggctaagggggaaatcctgagagtgatagagatactaatcgaaaaaatgcccactgacgtggtggatctcttggttgaggtaatggatatcatcatgtactgtctcgagggaagcctggttaaaaagaagggccttcaggagtgctttcctgcgatctgtcggttctatatggtttcctattacgagagaaaccatagaatagccgtgggggccaggcatggatcggtggccttatacgacatcagaacgggtaaatgccagactatccacgggcataaaggacctataaccgcggtggcctttgcacctgatggccgataccttgccacctactcaaacaccgattcacatatctcattttggcagatgaacaccagtttgttgggtagcattgggatgctgaacagcgctcctcagttacggtgtattaagacctatcaggttccccctgtgcaacctgcatcccccggctcacataatgccttgaaactcgctcgattgatttggacttctaatagaaatgtaatcctcatggctcatgacggcaaggagcatcgcttcatggtgtag

SEQ ID NO: 140636 - DNA, 4374 bp, Artificial Sequence
  Description of Artificial Sequence: Synthetic coding sequence
atggccgggaactcattagtgctccccattgttctctggggcagaaaagcccctacccattgcatctctgccgtcctgctgacagatgatggagccactattgtgaccgggtgccacgatgggcaaatatgcctgtgggatttatccgtggaactacagatcaatcctcgtgccctgctgtttggtcacaccgcaagcattacctgcctatctaaggcctgtgcttcttccgacaagcagtacatagtctctgcttctgagtcaggcgaaatgtgtctgtgggatgtctcagatggccggtgtatcgaattcaccaagctggcctgtacacacaccggaattcagttttatcagtttagcgttggtaatcagagggagggccgcttgttgtgtcatggacattatccagaaattctcgtagtggatgcaacttccctggaagtgctttacagtttagtctctaagatatcccccgattggatctctagcatgtccatcattcgaagccatcggacacaagaagataccgtggtggccttatccgtgaccggaatattaaaggtttggatagtgacctctgaaattagtgatatgcaggacacagaaccgatctttgaggaggagtcaaagccgatctattgccagaattgtcagtccatctctttctgtgcttttacccagaggtcactcttggtcgtgtgttccaaatattggcgggtgttcgatgccggggactatagtctgctctgctccggcccgagtgagaacgggcagacctggacagggggtgatttcgttagcagcgacaaggtaattatctggactgagaacggccaatcctatatttacaaactgccagcctcctgtttacctgccagcgacagttttaggagcgatgtcgggaaggctgtcgagaacctgattcctcctgttcagcacattttgctcgatagaaaggacaaggaattgctaatctgccccccagttaccaggttcttctatggttgcagagagtatttccacaaactgttgattcagggggacagtagtggcagactcaacatatggaatatctcggacaccgcggataagcaaggatctgaagaggggctggcaatgaccacatctatcagcctgcaggaagcctttgataagcttaacccctgccctgcaggcataatcgatcagctgtccgttatccctaatagcaacgagcccttaaaggttaccgcgtctgtgtatattcctgcccacggcaggctcgtttgcgggcgagaggacggcagcatcgtcattgtgcctgctacccagaccgccatagtacagctgcttcagggagagcatatgctcaggcgcggctggccacctcacaggaccctgcgcggtcatagaaacaaggtgacgtgtttgctctatccacatcaggtttccgcccggtatgaccagcggtatctgatttcagggggagtggatttcagcgtaattatctgggacatcttcagtggcgagatgaaacacatcttctgcgttcacggaggggaaattacacaactgctcgttcctccagagaactgctctgccagagtccagcattgtatctgttctgtcgcaagcgaccattctgtgggcctgctgtcactcagggaaaagaagtgtattatgctcgcttctcgccatctcttcccgatacaggttatcaagtggcgcccaagtgacgactacctggttgtaggctgctccgatggcagtgtgtacgtgtggcagatggacaccggcgctttagaccgctgtgtgatgggcattacggccgtagagatcctgaacgcatgcgatgaggctgtgcctgccgcggtggacagcctgtcacaccctgctgtgaacctgaagcaagcgatgacccgcagatcactagcagccctgaagaatatggctcatcataagctgcagacactggcgaccaacctcctggcatccgaggcctcagacaagggtaacctgccaaaatacagtcataacagtctcatggttcaggccataaaaaccaatttgaccgacccagatattcatgtgctcttcttcgacgtagaagctctgattatccagttgctcactgaggaagcgtctcggccgaataccgccctaatctcgcccgagaatttgcagaaagcctctggctccagtgataaggggggaagcttcctgaccggcaaaagagccgccgtgctgtttcagcaggtgaaggagacaattaaagagaacattaaagagcacttgctggacgacgaggaagaagacgaagaaattatgcgccagagacgagaagagagcgatccggagtacagatcctcaaagtcaaagcccctcaccctgctggaatacaatctgaccatggataccgctaagctatttatgagctgcttacatgcctgggggctgaacgaggtactcgatgaggtctgcctggatagactgggcatgctgaagcctcactgcactgtgtcctttggcctcctgtctagaggaggacacatgtcactgatgctgcctggttacaatcagccagcatgtaagttaagtcatggaaagacggaagtaggccgcaagctgcccgcctctgagggggtgggcaaagggacctacggtgtgtcgagagctgtgacaactcagcatctgttgtctatcatctctctcgccaatactctaatgagtatgacaaacgcaacctttatcggagaccacatgaagaaagggcccacaagaccaccccgccccagcaccccggacctgtccaaagcgaggggcagcccaccgaccagctctaatatcgttcaggggcagatcaagcaggggtggtcccagctggcagctatgcactgtgtgatgctgcccgacctgctcggcctggacaaatttcggccgcccctcctggagatgctggcccgcaggtggcaggatagatgtttggaggttcgggaagccgctcaagcgttgctgctggccgagttgcgccggatagaacaggccggtcgcaaagaggctatcgatgcttgggccccttatttgccgcaatatatcgaccacgtgatctctcccggggtgacctcagaggctgctcagacaataactactgcccccgacgcctccgggccagaggctaaggtccaggaagaggagcacgatctggttgatgatgatattaccaccggctgtctctcaagcgttccacagatgaaaaagatttccacatcatacgaagaacggcggaagcaggcaaccgcaattgtgctcctgggagtgattggtgccgaattcggcgcggagatcgaaccacctaaactgcttacacggcctcgatcttcatctcagatccccgaggggtttggcttgacgtcaggaggtagcaattacagcctcgcacgccatacgtgtaaagccctcactttcctgctgctccagccaccctcccccaagcttccacctcactctacaataaggcgaacagctattgatttgattgggcgggggttcacagtctgggagccctatatggatgtaagcgccgtcctaatgggcctgctcgagttgtgtgctgacgctgagaagcagcttgccaatattacaatgggcttacctttatcaccagccgcagactctgctagatccgcacgacacgcactcagcctcatcgctaccgcgcggccccctgcatttattaccacaatcgctaaagaagtgcaccgccatacagccttggcagccaatacacagagtcagcagaacatgcatacgacaaccttagctagggcaaagggggaaatactcagagtcatcgagatcctgatcgaaaaaatgcccacggatgttgtcgacctattggtagaggtgatggatataattatgtactgcctggagggaagcctggtgaaaaaaaagggtcttcaagaatgctttcctgcaatttgtcgtttctacatggtgagctattacgaacgcaaccaccgaattgctgtgggcgctagacatggctcggtcgccctgtatgacatacgcaccgggaagtgccaaaccattcacggccacaaaggccctattacagccgttgccttcgctcctgacggacggtacctggccacttactctaatactgattcccacattagtttttggcagatgaatacatctttgcttggtagcatcgggatgctcaattccgctccgcaattgcggtgtattaaaacataccaggtgccccctgtgcagccagcttcccccggatcccacaatgcgttgaaactggcccgacttatctggacatctaaccgcaatgtgatcctgatggcacacgatggcaaagagcacagattcatggtgtag

SEQ ID NO: 140637 - DNA, 4374 bp, Artificial Sequence
  Description of Artificial Sequence: Synthetic coding sequence
atggcagggaactctctagtgttgccaatcgtcctgtggggccgaaaagcacctactcattgcatatccgccgtgttgcttactgatgatggagccacaatcgtgacagggtgccacgatgggcaaatctgcctgtgggacttgagcgtcgaattgcagatcaatcctcgcgcattactgtttggacatactgcgagcataacatgtctgtctaaagcttgcgcatcaagcgataaacagtacatcgtgagcgcttcggagtccggtgagatgtgtttgtgggacgtgtctgatggccgttgtattgagtttacaaaactcgcctgtactcatacgggtattcagttctatcagttctccgttgggaatcagcgtgagggacgcctgctgtgccatggccactaccccgagatcctggtcgtagacgcgacctcactggaggtgctgtatagtcttgtgtcgaagattagtcccgactggatttcttccatgagtattataaggagtcataggacccaggaagatacagtggtcgcgctctcagtgaccggaatcctaaaggtatggatcgtgacatccgagattagtgatatgcaggacactgagccaatcttcgaagaggagtccaagccaatatattgccaaaattgccaatcgataagcttctgtgcgttcacacagaggagcttgttagttgtttgcagcaagtattggagagtcttcgacgcaggagactactctctcctgtgctcgggaccctctgaaaatggccagacttggacggggggcgatttcgtgagttccgacaaggtgatcatttggacggaaaatgggcagtcatacatatacaagcttcctgcatcctgtctgcctgcctccgattcttttcgatccgacgtcggcaaggctgtggaaaatctgatccctccagttcagcatatcctcctcgacaggaaagataaagagcttctgatctgccctccagtcacacggtttttctacgggtgtcgcgaatatttccacaaattactaatccaaggagatagttccggcagactgaatatttggaatatcagtgacaccgccgataaacagggtagtgaggaaggtttagctatgaccacttctatttccctgcaggaagcgttcgataaactgaacccctgcccagccggaattattgaccaactttctgttattccaaattccaatgaaccccttaaagtgaccgcctcggtctacatccctgcccacggcagactggtttgtggacgcgaggatgggagcattgtaatcgtgcccgccacccagaccgcaatcgtccaacttctccagggggagcatatgctccgacgcgggtggcctccgcacagaacactacggggccaccgcaacaaggtcacctgcctattatatcctcatcaagtgtccgctagatatgaccaacgctatcttataagtggaggtgtcgacttttccgtaattatctgggacatttttagtggagaaatgaagcatatattttgtgtccacggaggtgaaatcacccagctcttggttccgccggaaaattgctccgcccgcgtccagcactgcatctgcagtgttgccagcgaccactccgtcggcctgttatcccttcgcgagaaaaaatgcattatgctggcaagtagacacctgtttcccatacaggtgataaaatggagaccaagtgacgattacttggtggtggggtgctccgacgggagcgtgtacgtttggcagatggacaccggcgcactggaccgatgtgtcatgggcatcactgccgtagagattttaaacgcttgtgacgaggctgtcccggcggccgtagacagcctgagccatccagccgtgaatctgaagcaggcaatgacgaggcgctctcttgcagcgcttaaaaacatggcccaccacaaactgcaaacgctggctaccaacctcctcgctagtgaggcttccgataaaggaaacctccccaagtattctcacaactctctaatggtgcaggccataaagaccaatctgacggacccagatatccatgtgctattctttgacgtggaggctctgattatccagctgctcaccgaggaagcatcaagaccaaacactgctctgatctctccagaaaacctccagaaggcatctgggtccagcgacaaaggcggctcctttctaacaggaaagcgggcagccgtgctgttccagcaggttaaggaaacgattaaagaaaacataaaagaacacctcttggacgatgaagaggaggatgaagagatcatgaggcaacggagggaagaatccgatccagagtatcggtctagtaaaagtaagcctctgacactcctagagtacaacctgacaatggacaccgctaagctgtttatgagttgcttacatgcatggggtcttaatgaggtgctcgatgaggtttgtctggacaggctagggatgctcaaaccacactgtactgtgtcatttggcctcctgtctcgcggcggtcacatgtctctgatgttgccaggttacaaccagcccgcctgtaaactctcacatgggaagacagaggtcggccggaagctacctgctagtgaaggcgtgggaaagggcacatatggtgtgtcacgggccgtgactacccagcatttgctgagtattatctctctcgccaatactctgatgtcgatgacaaatgccactttcatcggagaccacatgaagaaaggcccgacccggccccctaggccaagtacccccgatctgtctaaagcaaggggtagtccaccaaccagctctaatattgtccaagggcagataaagcaggggtggagccaattggccgccatgcactgcgtgatgctaccagatttgctcggtctagataagtttaggccaccgctcttggagatgctcgctaggaggtggcaggaccggtgtcttgaggtccgggaggcagcacaggcactgctgctcgctgagctgaggagaattgagcaggcaggaagaaaagaagccatcgatgcatgggctccttacttgccgcagtatattgatcatgtcatctccccaggagtgacttcagaggcagcccagactatcaccaccgcgcccgacgcatcagggcctgaagccaaagtgcaggaggaggaacatgatctcgttgatgacgacatcaccaccggctgtctgagctccgtgccccaaatgaaaaagatctctacaagttatgaggagcggagaaaacaggcaactgccatcgtactcctcggggtcattggcgctgagttcggtgctgagattgagccccctaagctgctgacacgcccaaggtcctccagccagattccagaaggctttggcttaaccagcggtgggagcaactattcattggctcgacatacctgcaaagccctcacattcttgctgctgcagccaccatcgccaaagctgcccccacacagcacaatccgtagaacggcgatcgacctgattggtagaggtttcactgtttgggaaccatacatggatgtgtctgccgtcctgatgggactgttggagttatgcgcagacgctgaaaagcagctggcaaacattaccatgggtttacccctgagccccgctgctgatagtgcccgatccgcaaggcatgccctgtctctcattgcgacggccaggccaccagcattcattactactattgcgaaagaggtccatcgccataccgccctggcggcgaatacccagtctcagcaaaatatgcatacaacaacactcgcacgggccaagggagagattctgagggtaatcgagatcctgatcgagaaaatgccaaccgacgttgttgatctgctcgttgaagtgatggatataattatgtattgtctggaggggagcctggtgaagaagaagggcctgcaggaatgtttcccagccatttgcagattttatatggtgtcttattacgaaaggaaccatcggatagcagtaggggcacgccacggcagtgtggccctttacgacatccgtacaggaaaatgccagaccattcatgggcacaaaggaccaataactgccgtcgcattcgccccagacggacggtatctggccacatattcaaacaccgatagtcacatctccttttggcagatgaacacctcgctactcggttcgattggaatgttgaactcagcaccgcagctgcggtgcataaagacctatcaagtccccccagtccaacctgccagccccggttcccacaatgctctgaagctcgcacgtcttatttggacaagcaatcgcaacgtcatcctgatggcccacgacggtaaagaacatcggtttatggtgtag

SEQ ID NO: 140638 - DNA, 2448 bp, Artificial Sequence
  Description of Artificial Sequence: Synthetic coding sequence
atggccgggaacagcctcgttttaccaattgtgctgtgggggcgaaaagctccgactcattgcataagcgctgtactactaactgatgacggagctacaattgtcaccgggtgtcacgatggacagatctgtctctgggacctgtccgttgagttacagataaatccaagggctctcctgttcgggcatacagctgtgcttttccagcaggtgaaggagacaatcaaggaaaacattaaggaacacctgctggacgatgaggaggaggacgaggagattatgcgacagagaagggaagaaagtgacccagagtacaggtctagcaaaagcaaaccgcttaccctgttagaatacaacttaactatggatacagccaagctgttcatgtcatgcttacatgcatgggggctgaatgaggtgttggacgaggtctgtctggaccggctgggcatgttaaagccccactgcactgtttccttcggactcctaagcagaggcggccatatgagtctgatgcttcccggctataaccagcctgcctgtaaactttcacatgggaagacagaggtagggaggaaacttccagctagcgaaggggttggaaagggaacatacggagttagcagagccgtgacaactcaacatctgctttctatcatcagcctggccaacacacttatgtctatgacaaatgccacctttatcggtgaccacatgaaaaagggacccacccggccgcccaggccttcgaccccagatctcagcaaggcaagagggagcccccccacttcgagcaacatagtacaagggcagattaagcaggttgccgcccctgtagttagcgctcgctccgatgctgaccatagtggcagtgacccaccgagtgcgcccgcgctgcatacttgctttctggtgaacgagggctggtcccaattagcagccatgcactgcgtaatgctgccagacctcctgggattggataaatttcgtccccctctgctggagatgttagcccggcgctggcaagatcggtgtctggaggtacgcgaggcagcgcaagccctgttactcgccgagctgagacggattgagcaggctggtaggaaggaggccatcgatgcttgggctccctatcttccccagtatatcgatcatgttatttcccccggagttacctcagaagccgcgcaaacaatcacgacagcgcccgatgctagtggaccggaggctaaagtacaggaagaagaacacgatcttgtcgatgacgacataaccacgggatgtttatcctccgtcccacagatgaaaaaaattagtactagctacgaagagaggcgtaagcaggccactgccattgtgcttctcggtgtgatcggagccgagtttggggctgagatcgaaccccctaaactgttaacccggcctcggtcatcatctcagattccagagggctttggactcacatctggtggttccaactacagccttgcacgccatacctgcaaagcactcacttttcttttgcttcagccaccaagtcctaagctgcctccgcacagcaccatcaggcgcaccgccatcgacttaattggtagagggttcacagtatgggagccctatatggatgtttcagcggttttgatggggctgcttgagctctgtgccgacgccgagaaacagctcgctaacataactatgggcctcccgttgtcaccggctgcagattctgcacgttcagctaggcacgcgttgagtctcattgcgacagccagaccaccggcttttattacaactatcgccaaggaggtgcatcggcataccgcgctggctgcgaacacccaatcccagcagaacatgcatacaaccactctcgcgcgggccaagggagaaatcctgcgcgtgattgagatactgatcgagaagatgcctactgacgtcgtagatttgctagtggaggttatggacatcatcatgtactgcttggaagggtcactggttaagaagaaggggctccaggaatgcttcccagctatatgcagattttacatggtctcctattacgagagaaatcatcgaattgctgttggcgcccggcatggcagtgtggccctgtatgacattcggacaggcaaatgccagacaatccatgggcacaagggccccatcaccgctgttgcctttgcaccggacggacgctacctggcaacatacagcaacacggattcacatattagcttttggcagatgaacacttctttgttaggtagtatcggaatgctgaattctgcacctcagttgagatgtattaagacttaccaggtccctccggtccaacccgccagccccggctcacataacgctctgaagctcgccaggcttatctggactagcaataggaatgtgatcctgatggcccacgatggaaaagagcaccgcttcatggtgtag

SEQ ID NO: 140639 - DNA, 3309 bp, Artificial Sequence
  Description of Artificial Sequence: Synthetic coding sequence
atgagaacatctctgcaggccgtagctctttggggccaaaaggccccacctcactctataacggcaatcatgatcaccgatgaccagagaaccattgtgacagggtcccaggaagggcaactctgtctctggaatcttagtcacgaactgaaaatcagcgcaaaagaattgctgtttggccactccgcttccgtgacctgcctcgcccgggcgcgtgactttagtaagcaaccatacattgtatctgcagctgaaaacggagaaatgtgtgtctggaacgttaccaatgggcagtgcatggagaaggccaccctgccgtatcgccatactgccatatgttactaccactgctccttccgaatgaccggcgaaggctggttgctgtgctgtggggagtaccaggacgtgcttatcatcgacgccaaaactctcgctgtcgtccactcattccgaagttctcaattccccgactggataaattgtatgtgtattgtgcactccatgcggatccaagaagactctcttttggtggtgtctgttgcaggagagctgaaggtctgggacctgagctctagcataaattcaatacaggagaagcaagatgtttacgagaaggaatccaagtttctggaaagtctgaactgtcagactattcgattttgtacctacaccgaacggctgctgcttgtcgtgtttagtaagtgttggaaggtctacgattactgcgattttagcttactcttgactgaggtaagtcgtaatgggcaatttttcgctgggggcgaggttatagcagcccacagaatacttatctggacagaggacggacattcttacatatatcaattgctgaacagcgggctgtccaaaagcatttaccccgccgatggccgcgtgctgaaggagaccatttacccccatctgttatgttccacctccgtgcaggagaacaaggagcagagcagaccattcgtgatggggtatatgaatgaacgcaaagagcctttttataaggtgctcttttccggggaggtgtctggccgaatcactctctggcacatccctgatgtgcctgtaagcaagtttgatgggtctccaagggaaattcctgtaaccgccacctggaccctccaagataactttgacaaacacgatacgatgtcgcagagtattatcgattatttctccggtctgaaagatggagccggtaccgcagtcgtgacgtctagcgagtacattcctagccttgataagctcatctgcggatgcgaggatggaaccattattatcacgcaagcacttaatgccgcaaaggcacgacttcttgagggtgggtccctcgttaaagattcacccccccataaagttctgaagggccaccaccagagcgtgacctcgctgctgtacccccacggtctctccagtaaactcgaccagtcatggatgctgagtggggatctagactcatgcgtgatattatgggacattttcacggaagaaatactgcataagtttttcctcgaagctggacccgttacatctctgctgatgtcccctgaaaagttcaaacttcgtggggagcagatcatttgctgcgtgtgcggcgaccatagcgtggcactgttgcacctagaggggaaatcctgtttactgcatgcccgcaaacacctgttcccagtccgcatgattaaatggcatccagtagaaaactttctgatagttgggtgcgccgacgactcagtgtacatatgggaaatagaaaccgggactctggagaggcatgaaactggcgagcgagcaagaatcatcctgaattgctgtgatgactctcagttggtcaaaagcgtgctgcccatcgcctcagagaccctgaagcacaaatccatcgagcagaggtcctctagcccctatcagttaggccctctgccatgccctggactgcaggtggagtctagctgtaaggtgactgacgcgaaattttgtcctcggccgtttaatgttctgcccgtaaagacgaagtggagtaacgttgggttccacatactcctcttcgacctcgagaacctggtggagctgctgctccccactccgctaagtgatgtggacagctcctcaagtttttacggcggggaagttctgcgacgagcaaaaagtacggttgaaaaaaagactctgacactgaggaagtcaaagacagcttgtggccctctgagcgcggaagctctggcaaagcccataactgaaagtttggcccagggtgataacactattaagttttcggaggaaaatgacggcatcaagcggcagaagaaaatgaaaatctccaagaagatgcagcccaaacctagcagaaaggttgacgccagcctcaccatcgacacagcgaaactgttcctttcctgcctgctaccatggggtgtcgataaggatctggattacttgtgtattaaacatttaaatatcctcaagctgcagggcccgatttctctggggatctcattaaatgaggataatttcagcctcatgctccctggatgggatctatgtaatagcggtatgatcaaggattattcgggtgtcaatctgttttcacggaaggtcctggacctgtccgataagtacaccgccacgctgcctaatcaggtgggtattcccagaggccttgagaacaattgcgatagcctgcgggagagcgatacaattgtgtatctcctgtcaagactgtttttagtcaataagctcgtgaacatgcccctggagctcgcctgtcgtgtggggtccagcttccgcatggagtctatacacaacaaaatgaggggggcgggtaacgacattcttaacatgtcgtcattctactcatgcctacggaatggaaagaacgagagtcatgtgccagaagcagatttgagcctgctcaaactgatttcatgttggcgagaccaatccgttcaagtgacagaagcaatccaggctgtcctccttgctgaggtgcagcagcacatgaagtcgctggggaaaatacctgtcaactctcaaccggtgtcaatggctgagaatggcaattgcgaaatgaaacaaatgttgcctaagttggaatggacagaggagttagaactgcagtgtgtcagaaataccctgccgctccagacaccggtttcacccgttaagcatgactcaaacagtaatagcgcaaatttccaggacgtcgaagacatgcctgaccggtgtgcattagaagaaagtgaatcacctggggaaccaaggcaccacagctggatcgctaaggtttgtccttgtaaggtgagttag

SEQ ID NO: 140640 - DNA, 3309 bp, Artificial Sequence
  Description of Artificial Sequence: Synthetic coding sequence
atgaggacttcactccaggccgtggcattgtggggacagaaagccccgccccattccatcacagccatcatgatcacggacgaccagcgcactatcgtcacaggaagccaggaaggacaactctgcttgtggaacctgtctcacgagctgaaaatttcagccaaggaactcttatttggacatagcgctagcgtcacctgtctggcgagagctcgtgactttagcaagcagccctatatcgtcagtgcagcagagaacggcgaaatgtgcgtgtggaacgtaaccaatggccagtgcatggagaaagcgacgctaccatacagacataccgctatttgctactatcattgctccttccgcatgacgggcgaaggatggcttctgtgttgcggtgaataccaggacgtgctcataatcgatgcaaaaaccctagccgtggtgcacagcttcagatcgtctcagtttcctgattggataaactgcatgtgtattgtgcatagtatgcggattcaggaagattcgctcttagtagtctccgtcgccggggagcttaaggtctgggacctctcctccagcattaacagcatccaggagaagcaggacgtgtacgagaaagagagcaagttcctggagtccctgaactgtcagacaatccggttttgcacatataccgagagactcctgctggtcgtcttttctaaatgctggaaggtctacgactattgcgacttctcccttctcctgacagaagtgagcaggaatggacagttctttgccgggggggaagtgattgctgctcatcgcatcctgatctggacagaggacgggcatagctacatataccagctcttaaactctgggctgtcaaagagtatatatccggccgatggaagagtcttaaaagagacaatttatcctcacttattatgttcaacatcggtccaggaaaacaaagagcagagtcgaccatttgtgatgggctatatgaacgagaggaaagaacccttttacaaagtcctgttctccggcgaagtgtcaggcagaattacactctggcatataccggacgtgccagtctccaaattcgacggaagccctcgagagatccctgtcaccgcaacctggacactgcaggacaattttgacaagcatgatacgatgagccagagcattattgactatttttctggcctcaaggacggcgccgggacagcagtcgtcacgagcagcgaatacattccatcccttgataaactgatttgtgggtgcgaggatggcacaattattattacccaagccttgaatgccgctaaggccagactcctcgaaggaggcagcctcgtcaaggacagccctcctcataaggtccttaagggccatcaccagtcagttacaagcctgctctatccccacggcctgtcaagtaagctcgaccagtcttggatgcttagtggcgatctggatagctgtgttatcttgtgggatatttttaccgaagaaatactacacaaattctttctcgaggctggaccagtaacctctctcctcatgagccccgagaagttcaaactacggggcgagcagattatttgttgcgtgtgtggtgaccatagcgtggccttgctgcatctggaagggaagtcttgtctgctgcatgctagaaagcatttgttccccgtccggatgatcaagtggcatccggtggaaaacttcctcatagtaggttgcgccgatgactccgtctatatatgggaaattgagacagggactctcgagcgccatgagactggcgaacgggctagaatcattctgaattgctgtgacgattcacagctcgtgaaatcagttctgccaatcgcttctgagaccctcaagcataagagcatcgagcagcggtctagttccccttatcagctgggcccgctgccatgtcccggactacaggtggagagttcatgtaaggttaccgacgccaaattttgtcctcggcctttcaatgtcctgcctgtgaagacgaaatggagcaatgtaggatttcacattttattatttgaccttgaaaatctcgtggaactgctgctgcccactcccttaagcgacgtggattcatcatctagcttttatgggggtgaggttttgagacgcgcaaaatccacggtggaaaagaagaccctgactctgcgcaagtcaaagaccgcttgcggaccccttagtgcggaggccctcgccaagcctatcacagagagcctagcccagggcgataacactatcaaattttctgaagagaacgacggtataaagcggcagaaaaagatgaagatctcaaagaaaatgcagcccaaaccctccagaaaggtggacgcttctttaacgattgacactgccaaactctttctatcatgtctactgccttggggagtcgacaaagatctcgactacctctgcattaagcacctcaacatccttaagttgcagggtccaatcagtctgggtatcagtttgaacgaagataacttttccttaatgctgcccggctgggacctgtgtaacagcggcatgatcaaggattactccggcgtcaatttattcagcagaaaggtcttggatctgtctgataagtatacagccaccttgcctaatcaggttgggatcccccgaggcctcgaaaataactgtgatagcttgagagagtccgacacgatagtttacctgttgtctcggcttttcctcgtgaataaacttgtgaatatgcctctggagcttgcctgccgagtaggctccagcttcaggatggaaagcatccataataagatgcgcggcgctgggaacgatattctgaatatgtcttcattctacagctgtcttcgaaatggcaaaaatgagtcacatgtaccggaggccgacctgtccctgctgaagcttatttcctgttggagggatcagagcgttcaggtcactgaggcaatccaggccgttttattggccgaagtccagcagcacatgaaatccctaggcaaaatccctgtgaactctcagcctgtctcaatggccgagaatggcaattgtgagatgaagcaaatgctgcccaagctggaatggacagaggagctcgaactacagtgcgtccgcaacaccctccctctccagacccctgtttctcccgtaaagcacgacagtaattctaatagcgcaaatttccaagacgttgaagatatgccggaccggtgcgccctagaggaatctgaatcgcccggagaacctcggcatcactcatggattgccaaggtgtgcccttgcaaggtgtcttag

SEQ ID NO: 140641 - DNA, 3300 bp, Artificial Sequence
  Description of Artificial Sequence: Synthetic coding sequence
atgagaacctctctccaggccgtcgccttatggggacagaaggcaccaccccacagcatcactgcaatcatgatcaccgacgatcaacggactatcgttactggctcccaggaagggcagttgtgtctttggaatctgtcccacgagctcaaaattagcgccaaggaacttctttttggccactccgcatccgtcacttgcttggcgcgggcccgggatttttcaaagcagccatatattgtgtccgctgctgagaacggagagatgtgcgtgtggaatgtgacaaacgggcagtgtatggagaaagcgacactgccttatcgccataccgcaatctgctactaccactgttcatttcgaatgacgggcgaggggtggctgctctgttgtggtgagtaccaggacgtgttaatcatcgacgctaaaacactagccgtagtgcacagctttaggagctcacaatttcccgattggatcaactgcatgtgcatcgtccattccatgcggatccaagactccctgcttgtggtgagcgtggctggcgagttgaaagtgtgggacctcagctcttctattaatagtatccaggagaagcaagatgtgtacgaaaaagagagtaaattccttgagagcctgaattgccagaccattcggttctgtacatacacagagcgactgctccttgtggttttctccaagtgttggaaagtctatgattattgtgattttagcctgctgcttacagaagtgtcgcgaaatggtcagttctttgccgggggcgaggtgatagcggcacatcgcatcttaatatggactgaggacggacattcatacatttatcagctcttgaactctgggctcagcaaatcgatctatccagctgatggtagggtcttaaaggagacgatctatccacatcttctctgtagtaccagtgtgcaagaaaacaaatccaggccatttgttatgggatacatgaatgagaggaaagagcctttttataaagtgttgttcagtggggaggtgtccgggaggattactctttggcatatccccgatgtgccagtgtcaaaattcgacggatctccaagagaaatacccgtgaccgctacatggactcttcaggacaactttgacaaacatgatacaatgagtcagagcatcatcgattatttcagcgggcttaaagacggcgcaggaaccgcggttgtaactagctcggagtatataccatcactggacaaacttatctgtggatgcgaggacggaaccattatcattactcaagctcttaatgcggccaaagcgcggctgttagaggggggctccctggtaaaggatagtccgccgcacaaagtgctgaaaggacatcaccagtctgtaacttctctcttgtatccacacggtctgtcatccaagctggaccagtcttggatgctgagcggcgaccttgatagctgtgtgatcctctgggatatatttactgaagagatcctgcacaagttcttcctggaggcggggccagtaacttccttactgatgtccccagagaaatttaaactgaggggcgagcagatcatttgctgcgtttgtggagatcactccgtggccttgctgcacctggagggcaagtcttgtctactgcacgccagaaaacatctgtttccagtgcgtatgatcaaatggcatcccgtggagaactttcttattgtggggtgcgccgacgatagtgtgtatatctgggagattgaaaccggtacgcttgagcgccacgagacgggcgagagagcgcggataatactgaattgttgcgatgactcccaactggtcaaatcagtactccctatcgccagcgagacactaaaacataaaagcattgagcagaggtccagcagtccataccaattgggtcctcttccctgtccaggattgcaggttgagtcaagctgcaaagttaccgacgctaaattctgtccacgcccattcaatgtgttaccagtgaaaacaaaatggagcaacgtggggttccacattctcctgttcgacctggaaaatttagtagagctgctcctaccaactccgcttagcgacgtggattcctccagttccttctacggtggagaagtgctacggagggccaagagtactgttgagaagaagacattgacgcttaggaaatccaagacagcatgtggcccattaagcgcagaagcgctggctaaacctataacagagagtttggcccagggggacaacactatcaaatttagcgaagagaacgatgggataaagcgccagaagaaaatgaagataagtaaaaagatgcagcccaagcccagtaggaaggttgatgcttccctgactatcgatacggccaagttgtttctttcgtgcctgttaccttggggtgtggataaggacctcgattatttgtgcatcaaacacctcaacattctgaagctgcaagggcctatatccctcgggatcagtctaaacgaggacaattttagcctgatgctgccagggtgggacttgtgtaacagcgggatgatcaaggattactcaggcgtgaacttattcagccgcaaagttctggacctgtctgacaagtatactgccaccctgccaaaccaggttggtatcccacgcggactggaaaataattgcgattcccttcgcgaatccgacacaattgtgtacctcctgagtcgactgttcttggtgaacaaactggtgaacatgccccttgaactggcatgcagggtgggatcgagctttagaatggagagtatccacaacaagatgcgcggtgctggcaatgacatcctgaatatgagctcattttattcctgcctgagaaatggcaaaaatgaaagtcacgtccctgaggccgacttgtcccttttgaaactcattagctgctggcgcgaccagtctgtgcaggtgacagaagcaattcaggctgtcctgcttgccgaggtgcaacagcatatgaagagcttgggcaaaatccctgtgaactctcagcccgtgagcatggctgaaaacggcaactgtgaaatgaaacagatgcttccaaaactggagtggactgaagagctcgagctgcagtgtgtaagaaataccctaccgttacagactcccgtgtctcccgtcaagcatgactctaattcaaattccgccaactttcaggacgtggaagacatgccagatcgctgtgccctggaggagtctgagtcacccggcgagccaaggcaccattcatggattgcgaaggtgtgcccttgcaaggtgagctag

SEQ ID NO: 140642 - DNA, 2328 bp, Artificial Sequence
  Description of Artificial Sequence: Synthetic coding sequence
atgagaactagcctgcaggccgtcgccttgtggggccaaaaagcgccccctcactccattaccgctattatgattacagacgatcagcggacaatcgtgactggatctcaggaggggcagctgtgtctttggaatctgtcgcacgaattaaaaatctcagctaaagagctgctgtttggtcatagcgccagtgtcacctgtctggcgagggcgcgggacttcagtaaacaaccctacattgtatctgctgcggaaaacggagaaatgtgcgtctggaacgtaaccaacgggcagtgtatggaaaaagcaactctcccatatagacatactgctatctgttattaccactgcagtttccgcatgaccggagagggatggctcctgtgctgcggggagtaccaagacgtgctaattatagatgccaaaacgctggccgtcgtgcactcgtttaggagttctcagtttccagactggatcaattgcatgtgcatcgtgcatagtatgcggattcaggaggattccctgctcgtggtaagtgtggcgggtgaattaaaagtgtgggacctctccagtagtattaactctatccaggaaaaacaggatgtgtatgaaaaggagtccaaatttctggagagcctgaactgtcaaaccatacgcttttgcacttataccgaaagactgcttttagtggtttttagcaaatgctggaaagtgtatgattactgcgacttttctttgctcctgacggaggtgagccggaatggccaattctttgcagggggcgaagttatcgctgcacaccgaatactaatctggaccgaggatggccactcttacatataccagcttttaaactctggtctgagcaagagtatctacccagcagatggtagggtcctgaaggagacgatctacccacatctgctgtgctcaacgagcgtacaggaaaacaaggagcagagtcgccctttcgtgatgggctatatgaacgaacggaaagaacccttctataaagtcctattcagtggggaggtgtccggaagaatcacattgtggcatattccagatgtgcctgtctcgaaattcgacggaagcccaagggagattcctgtgaccgctacctggactcttcaggacaactttgataagcatgacacaatgtcgcagtcgatcatcgattatttctctggtctcaaagacggagccgggactgctgtggttaccagcagtgaatacataccatcactggataaacttatctgtggatgcgaggacgggaccatcatcatcactcaggcgctgaacgctgcaaaggccagactgttggagggagggtcgctcgtgaaggattcgcctccccacaaggtgctgaaaggacatcaccagtcagtcacgtccctcctatacccacacgggctttccagtaagctggaccagtcatggatgctgagcggcgacctcgattcgtgcgtgatcctctgggatatctttactgaggaaatcctgcataagttctttctcgaagccggtcccgtgacctcactcctgatgtctccagaaaagtttaaactccgcggcgaacagataatctgctgcgtgtgcggtgaccattctgtggccctgctccacctcgagggaaagagttgcctcctgcacgctcgcaagcacctcttcccagttagaatgatcaagtggcaccctgtcgaaaatttcctcatagtcgggtgtgcagacgacagcgtgtatatatgggaaattgaaacaggaacgctggaacggcatgagacgggagagagagccaggattatcctgaactgctgcgatgacagccagttggtgaagagcgttcttcccatagctagcgaaaccctcaagcacaaaagcattgagcagcgctcctcgtctccataccagctcggccccctcccctgtccaggtctccaggtggagtcaagttgcaaagtgacagacgctaagttctgtccacgcccgttcaacgtcctaccagttaagacaaagtggtcaaacgtgggattccacatcctgcttttcgatttagagaatctggtcgagttactgttacccacccctcttagtgacgtggactcatcctccagtttttacggaggggaagtcctgcggcgggccaagtctaccgtggagaagaaaactctgacattgcggaagtctaagaccgcctgtggccctctttcggctgaggcactagctaagccaattacagaatccctggcccagggggacaacacaatcaaattttccgaggagaatgatggcatcaaaagacagaaaaagatgaagattagttag

SEQ ID NO: 140643 - DNA, 1119 bp, Artificial Sequence
  Description of Artificial Sequence: Synthetic coding sequence
atggagccagcaccgtctgcgggcgccgaactgcaaccccctctgtttgcgaacgcttccgacgcttaccctagcgcatgccccagcgcaggagccaacgcatccggccccccgggggcaaggagcgcttcttcactggctctcgctatagcaatcacagcattgtattcagccgtgtgcgccgtcgggctgctgggcaatgtgctggtcatgtttggtattgttaggtacaccaagatgaaaacggctaccaacatttacatctttaacttggcgttggctgatgctctggctactagcactctgcctttccaatctgccaaatatttgatggaaacttggccctttggcgagctcctctgcaaagccgtgcttagcatcgactactataatatgtttaccagtatatttactctgaccatgatgtctgtggacagatatatcgccgtgtgtcatcctgtgaaggcactcgactttaggaccccggctaaggccaagttgattaatatctgcatatgggtgctcgcctccggggtcggcgtcccaatcatggtcatggcggttacccgccccagagacggcgctgtggtgtgcatgctgcaatttcctagtccatcgtggtactgggacaccgtcaccaagatttgcgtgtttctcttcgcttttgtggtgccaattctcattatcacagtgtgttatggcctcatgctcctccgactcaggtcagtacggctgttatcaggtagcaaggaaaaagatagatctctaagacgaattacacgcatggtcctggtggtggtgggagcttttgtggtatgctgggcccctatccatatattcgtgattgtctggacgttggtcgatattgaccggcgggaccctctggttgttgccgcactccatctttgtatcgctctaggttatgccaattcctcgctaaatcccgtactatacgcattcttagatgagaacttcaagagatgcttccgccaactatgtcggaaaccatgcgggcgcccagatccttccagcttctcgagagcccgcgaagccaccgcccgtgagcgcgtcacagcctgtacaccatccgatgggccaggaggaggcgccgcggcctag

SEQ ID NO: 140644 - DNA, 837 bp, Artificial Sequence
  Description of Artificial Sequence: Synthetic coding sequence
atgcgcaaagagacaccgccccccttagtgccacctgccgccagagagtggaacctaccacctaatgcaccagcatgcatggagcgccaactggaggcggccagatatcgcagcgatggagccctgctcctgggagcttcctcactgtccgggcggtgctgggctggctccctgtggctgttcaaggatccttgcgcagcacccaatgaaggattctgctccgccggagtccagacggaggctggcgtagcggatcttacttgggtaggagagagaggcatactggtggcctcggacagtgcgcatgcagctcaggtgacctgtgtggcagcgtctcctcacaaggattccgtgtttttatcctgcagcgaggacaatcggatcctcttgtgggacactaggtgccctaaaccagcgtcgcagatcggctgttccgccccggggtatcttcctacaagccttgcctggcacccccaacagtctgaggtcttcgtgtttggcgatgaaaacgggacagtgtctctggtcgacactaaaagcacaagctgcgtgctgtctagtgctgtccattctcagtgcgtcacaggactggttttttccccgcactccgtcccctttctcgccagtttatcagaggattgcagcctggcagtgctcgattcatcattgtccgaactgtttagatcccaggcacacagggattttgttcgagacgcgacatggtccccactgaatcatagccttttaacaacagtcggatgggaccatcaggtggtgcatcatgtggtaccaactgagccgctgcctgccccgggccccgcttcagtcacagagtag

SEQ ID NO: 140645 - DNA, 876 bp, Artificial Sequence
  Description of Artificial Sequence: Synthetic coding sequence
tagtgcgccgccccaaacgaaggtttttgttccgccggggtgcagacagaagctggcgtggctgacctaacctgggtgggggagcgcggcattctagtggcaagtgattctggcgcagtcgaactctgggaactggatgaaaatgagacactcatcgtttccaagttctgtaagtacgagcatgacgacattgtctcaaccgttagcgtcctctcttcgggcacacaggccgtatccggctcaaaagatatatgcatcaaagtttgggatctggcacagcaggtagttttgagctcctatcgagcacacgccgctcaggttacctgcgtggcagcatcgcctcataaggattctgtcttcctgtcctgcagcgaggataatcgaatcctgctctgggacacgcggtgccccaaacccgcctcccagataggctgctctgcccccggctacctgccaacctctctggcctggcacccgcagcagagcgaggtgtttgtatttggggatgagaacggcactgtatctttagtagataccaagagcacctcttgtgttctctctagcgctgtgcattcccaatgtgtgactggacttgtgttctccccacaccggctggatttaagccagccttcccctccatcagactcagtcccgttcttagccagtctcagcgaggattgctccttggccgttctggacagcagcctgtccgagttattccggagccaggcccacagggacttcgtgagagatgcgacctggagtcctctcaatcactcactgctgacaactgtgggctgggaccaccaggtggtacaccacgtggtccccactgagccacttcccgcaccgggccccgcctccgtcactgaatag

SEQ ID NO: 140646 - DNA, 942 bp, Artificial Sequence
  Description of Artificial Sequence: Synthetic coding sequence
atgaaactcacagatagcgtcctgagatcttttcgcgtggccaaggtgttccgcgaaaactctgataagattaattgttttgatttctctcccaatggcgaaacagttatctccagttcggacgacgattctatcgtgctgtatgactgccaggaaggcaagcctaaaaggaccttgtacagtaagaaatacggtgtggatctcatacggtatacccatgccgctaacacggttgtatactctagcaataagatagacgacacaatacggtacttatctctgcacgacaataaatacattagatacttccctgggcacagtaaaagagtggtagctctgtcaatgagtccagtggacgacactttcataagtggctcgctcgacaaaaccattcggttgtgggacctccgttctccaaactgtcaggggcttatgcacttgcaagggaaacccgtctgttcctttgatccagaggggcttatttttgccgccggagttaattccgaaatggtaaaactgtatgacctgcgatctttcgataaggggcccttcgctacatttaaaatgcagtacgatcgaacttgtgaatggactggactgaagttttcgaacgatggcaagctgattctgatctccaccaacggttcgttcatccgactaatagatgcattcaagggagtggtgatgcatacttttgggggctatgccaattccaaggctgtgaccctggaagctagttttacccctgactcgcagttcatcatgatcgggtccgaggatggaaagatacacgtgtggaacggggaaagtggaattaaggtggctgtgctggacggtaagcacactgggcctattacttgtctgcagttcaaccctaagtttatgaccttcgcaagcgcgtgctcaaatatggcattttggcttccaacgattgacgactag

SEQ ID NO: 140647 - DNA, 1359 bp, Artificial Sequence
  Description of Artificial Sequence: Synthetic coding sequence
atgatgggctgtttcgctctgcaaaccgtcgacacagagttgacagccgactccgttgagtggtgtccactgcaggggtgccgccacctgctagcctgcggtacttatcagctcagacggccggaggacaggcccgcaggaccacagaataagggaggcatggaagtcaaggagcctcaggtccggcttggccgtctctttttatattctttcaatgataacaacagtattcatcccctggtggaggtacagcgtaaggacaccagcgccatcctcgacatgaaatggtgtcacattccagtagctggacatgccctgctggggctggccgacgctagcggatctatccaactccttaggctggttgagtctgagaagagccatgtgttggaacctctcagttcactcgcccttgaggagcaatgcttagcactctctctggattggtcaaccggaaagaccgggcgagccggcgaccagccattgaaaataatttcctccgatagcacagggcagctgcatctcttaatggtgaatgagaccaggccacgccttcaaaaagtggccagctggcaggcacatcagtttgaagcttggatagctgcattcaattactggcaccctgagattgtttactctgggggcgacgacggtctgctgcggggctgggatactagagttcctggcaagttcctgttcacttctaagcgccacactatgggcgtctgttctattcagtcttctccgcaccgggagcatatcttggccactggatcatacgatgaacacatcctgctctgggatacccggaacatgaagcaacccttggccgatacccctgtgcaaggtggcgtctggcgcataaagtggcacccttttcaccatcacctgctcctggcagcctgcatgcattccggttttaaaattctgaactgccagaaagcgatggaagagaggcaggaagccaccgtcttaacctctcataccctgcctgactccttggtctatggagccgactggtcttggcttctgtttagaagcctgcagcgggctccctcgtggtctttcccttccaatctaggtaccaagactgctgacctcaagggtgcgagtgaactcccgaccccttgccacgagtgtcgcgaagataatgatggtgagggccatgcccgtccgcagtccggcatgaagcccctgactgaaggaatgcggaagaatgggacttggctgcaggcaacggcagcaacaacccgcgattgcggcgtgaaccccgaggaagcggactcagccttctctctgctagctacctgttcattttatgaccacgcactacacctgtgggaatgggaaggtaattag

SEQ ID NO: 140648 - DNA, 1074 bp, Artificial Sequence
  Description of Artificial Sequence: Synthetic coding sequence
atgagtgcattcgaaaaacctcaaatcatagcacatattcagaagggcttcaactatactgtctttgactgcaagtgggtgccttgttctgccaaatttgtaacaatgggcaatttcgcccgcggtacgggggtcatccagctgtacgaaattcaacacggcgacctcaaactgctcagagaaatcgaaaaggccaagccaattaagtgcggaaccttcggagctacatccctgcagcagagatacttggccacaggcgacttcggcggaaacttgcacatatggaatctagaagctccggaaatgccggtatatagtgttaagggccacaaagagattattaatgccatcgatggcatcggcggcttgggaattggcgaaggtgcaccagagatcgtcacggggtctcgagacggcactgtgaaagtgtgggacccgagacagaaggatgatccggtggccaacatggagccagtgcagggggagaataagcgagattgttggacagtggcattcggaaacgcttataatcaggaggagagggtggtgtgcgctggttacgataatggtgacatcaaactcttcgatcttaggaatatggctctgagatgggagaccaatataaagaatggcgtatgtagtctcgaattcgatcgcaaggacattagcatgaataaattggtcgctacaagcttagagggtaagttccatgtgttcgacatgcgaactcagcacccaactaagggtttcgcttctgtgtctgagaaggctcacaagtcaaccgtctggcaggtgcggcacctcccacagaaccgcgagttgtttctcaccgccgggggggcgggagggctccacctgtggaaatatgaataccctatccagcgcagcaagaaggatagtgagggcattgaaatgggtgtcgccggttcggtgtcactactccaaaatgtaaccctgtcaacacagccaatcagctctctggattggtccccggacaagcggggcctttgcgtgtgtagctcattcgaccagactgtccgagttctgatcgtgaccaagctgaacaagatatag

SEQ ID NO: 140649 - DNA, 867 bp, Artificial Sequence
  Description of Artificial Sequence: Synthetic coding sequence
atgtccgctttcgaaaagcctcagattatcgcccacattcagaaaggattcaattacaccgtattcgactgcaaatgggtgccctgctccgcgaaattcgtgaccatgggaaactttgccagggggacaggagttatccagctatacgaaatccagcatggcgacttaaagctgctgcgcgagatcgagaaagcaaaacccatcaagtgcggcaccttcggcgccacaagtctgcagcagaggtatctggccacaggagactttggaggaaacctgcacatctggaacctggaggctccagagatgcctgtatacagtgtgaaaggtcacaaggagattattaacgcgatagatggaattggcgggctcggcattggcgagggtgcccctgagatcgttacaggaagtagagatggaactgtaaaggtctgggatcccagacaaaaggatgatcccgtcgccaacatggaacctgtgcagggagaaaacaagagagactgttggactgtggcatttgggaacgcctataatcaggaggagagagtagtctgtgcagggtacgacaacggtgacattaaactgtttgacctccgtaatatggcgcttcgctgggagacaaacattaagaatggggtctgctcgctggaattcgaccggaaggatatcagtatgaataaactggtggccacttcacttgagggtaaatttcacgtctttgatatgcgaacccagcacccaactaaaggtttcgccagcgtgtcggaaaaggctcacaagagtacggtctggcaggttcgacatctgccacaaaaccgcgaactgttcctgacagctggaggtgcaggaggacttcatctgtggaaatag

SEQ ID NO: 140650 - DNA, 3816 bp, Artificial Sequence
  Description of Artificial Sequence: Synthetic coding sequence
tgaagggacttccagtcagaagttctgctttcagctatggagcttttccacatgacttcagggggggatgcggccatgtttcgggacggtaaagagccccaacctagcgcagaggctgcggcagctccatctctcgcaaacattagctgttttacccagaagctagttgagaaactgtactccggaatgtttagtgccgatccaaggcacattctgttgtttattctggaacatattatggtggtgatcgagacggccagttcacagcgcgacacagtgctcagcactctctactcgagcctgaacaaggtgatcctgtactgcttgagcaaaccccagcagtctctgtccgagtgtcttggcttactgagcattctgggcttcttgcaggaacactgggacgtggtgtttgccacctataactcaaatatatctttcctcctgtgcttgatgcactgtctgttacttttgaacgagcgttcgtaccccgagggcttcggattggaaccgaaaccgcgcatgtcgacctaccaccaagtcttccttagtcccaacgaggacgtgaaggaaaagcgggaagacttaccatcgctcagtgacgttcagcacaacattcagaagacagttcagactctttggcagcagctcgtagcccaacgccagcagacgctcgaggatgcattcaaaatagacctgtcagtgaagcccggtgaaagggaggttaaaatcgaagaggtcacgcctctgtgggaagaaacaatgcttaaggcctggcagcattatctggcatcggagaagaaatctctggctagtcgatctaacgtggcccatcactctaaggtaaccttatggtccggttcactgagttctgccatgaagctgatgccaggccggcaggccaaggatccagagtgtaaaacggaagatttcgtgtcctgcattgagaactaccgccgtcggggccaagagctctatgccagcctgtataaagaccacgtgcaacgtcgtaagtgcggcaacataaaggctgccaatgcatgggcaaggattcaggaacagctgttcggggagcttggcctgtggtctcagggagaggagacgaagccttgctcgccatgggaactggactggcgagaaggtcctgctcggatgagaaagcgaattaagcggctttccccccttgaggcactttcttccggccgccacaaggaatctcaggataagaacgaccacatatcccagacaaacgctgagaatcaggacgaactgacattacgggaggcggagggggagcccgacgaagtgggagtggactgcacccagctaacattctttccagcactgcacgaaagcctacatagcgaggatttcctggagctgtgcagagaaaggcaggtgatcctgcaagaactgctcgacaaggagaaggtcacccagaagttctcactggtgatcgtccaagggcacctggtgtcagagggagtcctcctcttcggacaccagcacttttacatttgtgaaaatttcactctgagcccaaccggcgacgtgtactgtaccagacactgtctctctaatatctctgatcccttcatctttaacctatgttcgaaagaccgatcaaccgaccactactcctgtcaatgccactcatatgctgatatgcgagaactgagacaggcaagatttctcctccaggacattgctctggaaatattcttccacaacggttactctaagttcctcgttttctacaacaacgatcgctcaaaggcatttaagagtttctgtagttttcagcccagtcttaagggaaaggcaaccagtgaagacactttaagcttaagaaggtaccctgggagcgatcggatcatgctacaaaagtggcagaagagggacatcagcaatttcgagtacctgatgtacctcaacactgccgctggtaggacttgcaatgattacatgcaatatcccgtgttcccttgggtgctggcggactatacttccgagacgcttaatttggctaaccccaagatcttccgagatctgagcaagccaatgggcgcacagaccaaggagaggaagcttaagtttatccagcgcttcaaggaggtggagaagacggagggagatatgactgttcagtgtcactactatacccattatagtagtgccatcatcgtggcctcctacctcgtacgcatgcccccatttacacaggccttctgtgcactccagggcggctccttcgatgtggccgacagaatgtttcatagtgtcaagtccacttgggaatcagcatctagggaaaatatgtctgatgtacgcgagctaacccccgagttcttttacctgccagagtttctgaccaattgcaacggtgtagagtttggatgtatgcaggacggcactgtattaggcgacgtgcagctgccgccctgggctgatggggaccctcgaaaattcatttccttgcacaggaaagcgcttgaatctgactttgtatccgctaatctgcatcattggatcgatctgatcttcgggtataagcaacagggtcccgccgccgtagatgccgtcaacatcttccatccatatttttacggagaccggatggatctttcctctatcacagatccgttgattaagtctaccatattgggctttgtcagcaacttcggacaggttccgaagcaactcttcacgaagccgcaccccgcccggacagcagccggaaagcccctacccggaaaggatgtcagtaccccagtgagcctgcctggacacccccagccttttttctattccctccaaagcctcaggcctagccaggtcacagtgaaagatatgtacctgttctccttgggctctgagagtccgaagggggcgataggacacatcgtttccaccgaaaagacaatcctggcagtggaacgaaataaagtccttcttcccccactatggaaccgcacttttagctgggggtttgacgatttttcctgttgtctcggcagttacggatcagataaagtgctgatgacctttgaaaatcttgccgcctggggtcgttgtctttgtgctgtttgccctagtccaaccacaattgtcactagcggtacatctacagttgtatgtgtctgggaattgtctatgactaaaggcaggccacgaggactgcgcctgcggcaggccctgtatggtcacactcaggccgttacctgcctcgctgcctcagtcaccttctccttgttagtctctgggtcccaggactgtacgtgtatactctgggatctagatcatttaacccacgtaacccgactgccagcccaccgcgaaggaatcagcgctattacaatcagcgatgtatcgggcaccatcgttagttgtgccggggcccacctgagtttgtggaatgtaaatggccagccattggctagcataactaccgcctggggcccagaaggtgctatcacttgttgttgcctcatggaggggccggcctgggacacctcccaaatcatcatcaccggtagccaggatggcatggtgagggtttggaaaactgaagatgtcaagatgtccgtaccagggcgtccagctggcgaggagccccccgcacaacctccctccccaagggggcataagtgggagaaaaacctggctctttcacgcgagctggacgttagcatcgccctcacaggtaagccatccaaaactagtcccgcggtgacagcactcgctgtcagccgaaatcacaccaagctgttagtgggcgacgagcggggcaggatcttttgttggagtgccgacgggtag

SEQ ID NO: 140651 - DNA, 6804 bp, Artificial Sequence
  Description of Artificial Sequence: Synthetic coding sequence
taaaaactcgcgtcacaggcaattgagccggatgttttgcggcagttcctggggcttggaataccctcgtctctgagcgctaccactaaaatactggattcaagccacacccatcgcggcaatccaggctgcagtggctctcagaccgcccagggacttgctgaagggccctggcccgcggccccagacgcgggactgcatccaggcgtgacacaggcgcctcagccactcggcgaaagtcaagatagcaccaccgcccttcagacggccctgtcattgatttccatgaccagtccccgcaatcttcaacctcagcgggctgctctggctccctcatttgtggaattcgacatgagcgtcgaggggtacggatgtttatttattcccactctgtccactgtcatgggaaccagtactgagtactctgtttctggaggaatcggcacaggagccacccgccccttccccccgcccggcgggctgaccttttcctgctggtttttgatctctcggcacggcgctgcaaccgaaggccatccccttagatttttaactctcgtacgccacctggcgcgaacggagcagcctttcgtgtgcttctccgtgagtctctgtcccgacgatctgagtctcgtggtgagcaccgaagagaaggaatttcaacccctcgatgtgatggagccagaggacgacagcgagccgagcgctgggtgccagctgcaggtccggtgcggccaactcctggcctgtggccagtggcaccacctggcggtggtggttaccaaggagatgaagcgccattgtacagtcagcacttgcctcgacggccaagtgattggctccgccaagatgctgtacattcaggccctgcctgggccgtttctctccatggaccccagtgccttcgttgacgtctacgggtacatagctacaccacgggtttggaaacaaaaatcatctctgatctggcgactgggaccgacctatttgtttgaggaggccatctcaatggaaacactagaagtgatcaacaaactaggaccgcgttattgtggcaactttcaagccgtgcacgtacagggggaggatctcgattcagaggcaactcccttcgtggctgaagaacgggttagttttggactgcatatcgcctcttcttccattactagcgttgccgatattagaaatgcgtacaatgaagttgactccagactgattgccaaagaaatgaacatttcctcccgggacaacgcgatgcccgtgtttcttctaagaaactgcgctggccatttgtcaggcagcctgcggaccattggggcagttgccgtgggccagctcggtgtgcgggtattccacagcagtccggccgcttccagcctggatttcattggcggcccagcgattctgcttggactgatcagtttagccaccgatgaccacactatgtacgccgctgtcaaagtcctgcattcagtgctcaccagtaatgctatgtgtgatttccttatgcaacatatttgcggctaccagatcatggcatttctccttcgaaaaaaggcatcgctattgaatcaccgtatatttcaactgatactgtccgttgccgggacggtcgaactgggatttaggtccagtgctataacaaatacgggtgtctttcaacacatcctgtgcaacttcgagctgtggatgaacacagcagataacctcgaactttccttgttttcccacctcctggaaattctacagtctcccagagaaggacctagaaatgcagaggccgcccatcaggcccagctgattcctaaactgattttccttttcaacgaaccctccctcatcccctcaaagatctctactattatcggtattctggcctgccagctgcggggccatttctctactcaagatctgctgcggatcgggctgttcgtcgtatacaccctgaaaccttctagcgttaacgagcggcagatctgtatggacggagcactggatcccagcctgccagcgggaagccagacttccggtaagacgatatggctgcggaatcaactactggagatgttgctgtcagtcatatcttcaccccagctgcacctctcatctgagagtaaagaggagatgttcctgaagcttggtcccgattggttcctgcttctcctgcagggacatcttcatgcctccaccactgtgttggccctgaagcttcttctttatttcttggcttcgccgtccctgcggactcgtttcagagacggactgtgcgcaggcagttgggtcgaacgctcaacagagggcgttgacattgttatggataacctgaagtcacagagccctctgccagagcagtcaccatgtctgctgccaggcttccgcgtcttgaacgattttcttgctcatcacgtgcatatccccgaggtatacctcatcgtgagtaccttcttcctgcagacgcccctgaccgagctgatggacgggccgaaggatagcctagatgcaatgttacaatggttattacagcggcatcaccaggaggaagtactccaggcgggcctgtgcacagaaggcgcgctgctccttctggagatgcttaaggcaaccatgtcccaaccgctggccgggtctgaggatggggcttgggcacagaccttcccagcttccgttttacaatttctgtccctggtgcacaggacttacccacaggacccggcctggcgggcccctgagtttctgcagacactggctattgctgccttccccctcggggcccagaaaggtgtcggcgcagaaagtactcgaaatacatccagcccagaggccgctgcagagggagacagcaccgtcgagggtcttcaggcccctacaaaggcacatcccgctcggcgtaagctccgggagttcacccaactgctcctgagagagctgctcctgggagcgagtagccccaaacaatggttgcccttggaggtgcttctggaggcgagtcccgatcatgcgaccagccagcaaaaaagggactttcagtcagaggttctcctttctgccatggagctgttccatatgacgtcagggggcgatgctgcaatgttccgagatggcaaagagccacagcctagtgccgaggccgccgccgctccctcactggctaatatctcttgtttcactcagaagcttgtcgagaagctctacagcgggatgttctcagccgacccacgccatattttgctcttcattctggagcacataatggtggtgatagaaacagcctcttcacagcgggacacagtgttgtctacactgtacagctccctaaataaagtcatcctctactgcctgagtaagcctcaacagagcctgtcagagtgtctcgggttgttgtcaatcctcggcttcctgcaagagcactgggacgtggtgttcgcaacttacaatagcaacatctcgtttctattgtgtcttatgcattgcctcttactgctcaacgagcgctcctatccagagggcttcggactggagccgaagccccggatgtcgacttaccatcaagttttcctgagccccaatgaggacgtcaaagagaaacgggaggacctgcctagtctttcagacgttcagcacaatatccagaagacagtgcaaaccctctggcagcagctggtcgcccaacggcaacaaacactggaagacgcctttaagatcgacctgtcagttaagcccggggagagggaagtcaagatcgaggaagtcacccccttgtgggaagagactatgttgaaggcctggcagcactatcttgcttctgagaaaaagtccctggccagcaggtctaatgtggcccaccactctaaagtgacgctctggtcagggagcttgagctccgctatgaagctcatgcctggcaggcaggccaaagacccagagtgtaagactgaagactttgtgagctgcatcgaaaattacagaagacgcggtcaagagctctatgctagcctatacaaggaccatgtacagcgcaggaagtgtgggaatatcaaggcagcaaacgcatgggcgaggatccaggaacagctgttcggcgaactaggcctgtggagccaaggtgaagaaactaagccctgttccccatgggaactagattggagagagggccccgcaagaatgcgcaagcggatcaagcgtctgtccccattggaggccctgtcgagtggtcgtcataaggaaagtcaggataagaacgatcacatctctcagactaatgcagagaaccaagacgagctgactcttcgggaagctgaaggggagcctgacgaggttggagtcgattgtactcagctgaccttcttcccagctctccatgaatccctgcacagcgaggattttctcgagctgtgtagggaacgccaagtgattctgcaggaactcctggacaaggaaaaggtgacccagaagttctcgctggttatcgtccagggccaccttgtgagtgagggcgtgcttctgtttggccaccagcatttctacatctgtgaaaatttcactcttagccccaccggtgacgtctactgtacccggcattgcctgagcaatatctcggaccctttcatctttaacttatgtagcaaggatcgctccactgatcattactcctgccagtgccactcctatgccgatatgagggaattgcgtcaggctaggtttctgctccaggatatcgctttggagatctttttccacaatggctacagtaaattcttagtgttctataataacgatcggtccaaggccttcaagtctttttgctcctttcagcctagtttgaagggcaaagccacgagcgaagacaccctgtctttacgccgctaccccgggagcgatcgcatcatgctacaaaagtggcagaaacgtgatatctcaaactttgaatacctgatgtatcttaacacagccgctggcaggacatgcaatgattacatgcagtatccggtcttcccctgggtgctagcggattacacgtccgaaaccctgaacctggctaaccccaaaatttttagggatctgagtaaacctatgggtgctcagactaaggagcgaaagttaaagttcatacaaagatttaaagaggttgagaaaaccgagggggatatgaccgtccagtgtcactactatacacactattcatctgcaattatcgtcgcatcttacctggtgcgcatgccgcctttcacacaggcattttgcgccctccagggcggttccttcgacgtggcagacagaatgtttcatagcgtcaagtcaacctgggaatccgcttcccgagaaaacatgtctgatgtgcgcgagctcacccctgaattcttctatctgcctgaatttctgactaattgcaatggtgttgagtttgggtgcatgcaggacgggactgtgctcggtgacgtccagcttcccccatgggccgacggcgacccccggaagtttatatccttgcaccgtaaggcccttgagtcggattttgtcagtgcaaacctgcatcactggatcgatctgatcttcggatataaacagcagggccctgctgccgtggacgccgtaaatatttttcatccttatttctatggtgatagaatggacctgagtagcatcacggacccgcttattaaatccaccatattgggcttcgtcagcaactttggccaggtgccaaagcagctgtttactaaacctcaccccgccaggactgcagcaggaaagcctctcccaggcaaggatgtttctacaccagtctcactgcccggacacccccaacctttcttctattctctgcagagcctaaggcccagccaggtaactgtaaaggatatgtatttgtttagcctgggctcggagtcacccaagggggcaatcgggcacatagtttccacagagaagacaattttggcggtcgagcgcaataaggtactccttccccctttgtggaatcggacatttagctggggattcgacgatttcagctgctgtctgggctcctacgggtcggataaggttctcatgacctttgagaacctggctgcctgggggcggtgtctgtgtgctgtttgcccttcacctacaactattgttactagcgggacctcgacagtagtgtgcgtgtgggagctgagtatgaccaagggtaggccgagggggctgcggctccgtcaggctctctatggacacacccaagccgtgacttgccttgcggcttcagtcacattcagcctccttgtgtctggatcccaagactgtacttgcatcttgtgggatctggaccacctgacccatgtgacccgactgcccgcccaccgggagggaatcagcgccatcactatcagtgacgtatccggcaccatcgtgagctgcgcgggagcacatctgagtttgtggaacgtgaatggccagcccctggcgtccattaccacagcctgggggccagagggcgccattacctgctgctgcctgatggaaggccctgcctgggacacttctcagataattataaccggtagtcaggatggcatggtgcgggtgtggaaaacagaggacgtaaagatgtctgttcccgggctacagatggggcggaagcgggaagcggccgaagccctggctcagcagtgtcaggcggaggggggtcgtggggattggggcctcagtagtgcttatagaaggaatccacaaggccttctgccccattcgagtcaagggagggcgtcgggaaatcattctagcgccgcacagcccagcccctggcctatggggttgttatag

SEQ ID NO: 140652 - DNA, 9555 bp, Artificial Sequence
  Description of Artificial Sequence: Synthetic coding sequence
atggaagccgaagacctcagtaaagccgaggatcgaaatgaggaccctgggtccaaaaacgaggggcagttggcagccgttcagccagacgtgcctcacggggggcagagcagcagccccaccgcattgtgggacatgctcgagcgtaaattcttagagtatcagcagttgacacataaatcccctattgaacgacagaaatccctgctgtctctgcttcccctgttcttgaaggcatgggagcatagcgtaggcattatctgcttcccttctctgcagaggctagccgaagacgtgtcggaccagctggctcagcagctgcagaaagccttagtggggaaaccagcggagcaggcacggctcgccgctggtcagctgctgtggtggaaaggggacgttgaccaagatggctacctcctgctgaagagcgtatacgtgctgaccggcactgattctgagactttgggccgggttgcagagtcaggtctcccggccctgctattacaatgcctttacctcttctttgtgttcccattggataaagatgagcttctggaatcagatctgcaggtgcagaaaatgttcgtccagatgttgctgaacatctgctcagacagtcagggcctggagggcctccttagtggctccgaactccagtcactgcttatcgctaccacgtgccttcgggagcactcatgttgcttttggaaggaaccaaccttctgtgtacttcgcgccatctccaaagcacagaatctgagcattattcagtatttgcaggctaccgattgcgtaagattgtctctccaaaatctgtcacggttgaccgatacactcccagccccggaggtgagcgaagcggtctctctcatccttggctttgtgaaggatagctacccagtctctagcgcactgtttttggaatttgagaactcagagggatatcctcttctgctgaaagtgctcctccggtatgatggcctgacccagtctgaggtggatccacacctggaggagctgctagggctcgtcgtatggttgactacctgcggcagaagcgaactgaaagtttttgacagcatcacctaccctcaactggaaggttttaagttccatcatgaagcttccggtgtgacggtgaagaacctccaggcattccaggtccttcaaaatgtctttcataaggcttctgatagtgtgctatgtattcaggtcctgtcagttatcagaacgatgtgggcttggaatgctcgcaatttttttctgctcgagtggacactccagcccatcagccagtttgtggagattatgcccttgaagcccgcacccgtgcaggagcactttttccaacttctggaggcactcgtctttgaactccactacgtgccgcatgagattttacgcaaggtgcagcatctcatcaaggagtcgcctgggccatcatgtaccctaatggccttacaaagtatactcagtattgccggtggggacccactgttcactgatatcttccgcgactcaggcctgctcggcctcctcctggcacagctgcgtaaacaggccaagatcatgcggaagtcaggcaataaagtgtcaactcctggagttcaggatccagagcgcgagctcacatgtgtgatgctcaggatcgttgttaccctgctgaagggctccgtgaggaacgcagtagtcctgaaggaccacggtatggtacccttcattaagatcttcctcgatgacgaatgctatcgggaagcctcattatcaatactggagcaactttccgcaatcaacgccgaggagtatatgtccatcatcgtaggagcactttgctcgagtacacagggcgagcttcagctgaaacttgatctgttaaaaagtctgctgcgcatactcgtcactccgaaaggcagggccgctttccgcgtgagcagcggcttcaatggcctcctgtcgctcttgtccgatttagaagggtccctgcaggagcctccactgcaggcctggggagctgtgtcgccccgacagaccctagagttagtactttacaccttgtgcgccgtgtcagccgccctccactgggatcccgtgaacggctattttttccggcgtaatggcctgtttgagaagctcgcggaggacctttgcttgttgggatgtttcggagcactcgaagaagagggtaatctgctgcgcagttgggtggataccaaggctcggcctttcgccgacctactaggcaccgctttttctagctccggctctctgccccctagaatacaatcctgtctgcagatcctgggttttctcgattccatggcaagcggaacactgcacctgcgaggtgatcttaaggagagtctgaggaccaagcaaggcccagtcgtggacgtgcaaaaaggagagaccgggagcgacccacagcgcaacttcaagcagtggccagacttagaggagaggatggacgagggagacgccgccattatgcatccaggggtcgtctgtattatggttcggctactgcccaggctataccacgaggatcatccacagttgtcagaagagattcaatgctcccttgccagccatatccagtcactagttaaatccgaaaagaaccggcaagttatgtgtgaggccggcctccttggcacgttaatggcatcttgtcatcgagccttagttactagtggatctcctctgcattccagattgatcagaatattcgaaaagctggcttcccaggccatcgaaccggacgttctcagacaatttctcggactcggcattccctcgagtctctccgccacgacaaaaatcttagactcaagccatacacatagaggcaatcccggttgctccgggagccagactgcccaaggcctggccgaggggccatggcccgcagcacctgatgccgggctacaccctggggtcacacaggccccccagccactgggtgaatcccaggattctactacggcgttgcagactgctctgagcctgatctcaatgacctccccacggaatctccagccccaaagggcagctctcgccccatcgtttgttgagtttgatatgtctgtggagggatacggctgcttgttcataccaacactttccacagttatggggacctccacagagtactctgtgagcggtggtatcgggacaggtgctactcggccattcccaccgccaggaggtctgaccttctcctgttggtttctgatcagcaggcatggtgccgcaaccgagggacatcctctgcgttttctcacgctagtaagacatctcgcacgcaccgaacagccctttgtttgtttcagcgtgagcctctgtcctgacgatctgtccctggtggtgtccaccgaagagaaagagttccaaccattggatgtcatggaacctgaagatgactccgaaccatccgcaggatgccagctgcaggtccgctgcggacagttattggcgtgcggccaatggcaccacttagccgtcgtggtgacaaaggaaatgaagaggcactgcacagtgtcaacatgtctcgacggccaggtgattggatcagccaagatgctgtatatacaggccctgcctggcccattcctgtcgatggacccctcagccttcgtagatgtgtacggctacatcgcaacaccccgggtctggaagcagaagagcagtctgatatggaggttgggccctacgtacttgttcgaggaagctattagcatggaaactctggaagtgatcaataagctgggacccaggtactgcgggaactttcaggctgtccacgttcagggtgaagatctggacagcgaagctacccctttcgtcgcggaagagcgggtgagcttcggcctccacattgcctcatcttcaattacctctgttgcagacataaggaatgcctacaacgaagtggattcacggcttatagcgaaggaaatgaacatctcttctagagataacgcaatgcctgtattcctgctcagaaattgcgcgggccacctgtcaggatccctgagaaccattggggccgtggccgtggggcagctcggtgtgagagtattccattcatcacctgcagcctccagtttggactttattgggggccccgccatactccttgggctgatatctctggctacagacgatcacacaatgtacgccgccgttaaggttcttcatagcgttttaacctccaacgccatgtgtgattttcttatgcagcatatctgcggctatcaaattatggccttcctcctaagaaagaaggcttcactgcttaatcatcgcatttttcaattaattctttctgtcgccggtactgtggaattgggcttccgatcgtcagcaataacgaatactggagtgttccagcacattctgtgtaatttcgaattgtggatgaacactgctgacaatttagagctgtccctctttagtcacttactggaaatcctgcaatcgcctcgggagggtccaagaaatgccgaggctgctcaccaggctcagctcatcccaaaactcatattcctgttcaacgagccaagccttatcccttcgaaaatcagcaccattattggaatccttgcatgccagcttaggggccacttctctactcaggatctcctgcggataggcttattcgtagtttacaccctgaagcctagttcagtaaacgaacgtcagatctgcatggacggtgcccttgacccttcactgcccgccggctctcagacgtctgggaaaaccatatggcttagaaatcagttgttagagatgctactgagcgtgatttctagtccccagctgcatttaagttcagaatctaaggaagaaatgttcctcaaactgggacctgattggttcctgctcctgctacaaggacatctccatgcttcgaccactgttctggcactcaaacttctgctgtacttcctagcgtctccaagcctgagaacacggtttcgcgatggtctgtgtgccggcagttgggtagaaaggtccactgaaggcgtggacatagttatggacaacttaaaatcacagtctcctctgcctgaacagtccccttgtctccttcccggtttccgggttctgaacgactttttggcacaccacgtgcacattcccgaagtatacctgattgtgagcacattcttcctacaaacccctcttacagagctcatggacggtcctaaggatagcttggacgcaatgctgcaatggctgctacaacgacaccaccaggaggaggtgctacaggcaggactctgcaccgagggggccttgctgctgctggaaatgttaaaggctactatgtctcagccgctggccggtagcgaggacggggcctgggctcagaccttcccagcatcagtcctccagttcttgagtctggtacaccggacctatccccaagaccccgcctggagggcccctgagttcctgcagaccttggcaatcgccgcatttcctttgggcgcacagaaaggcgtcggtgccgaatctactagaaatacatccagccctgaggccgccgccgaaggcgacagcaccgtcgagggcctccaggccccgactaaagcgcacccagcccggcgaaagttgagagaattcactcaattgctactgagggaattgctactcggggcttctagtcctaaacaatggctgccactggaagtcctccttgaagcctctccggaccacgctaccagccagcaaaagagggactttcagtctgaggtgctgctctccgctatggaattgtttcacatgacatctggcggtgacgccgccatgttcagagatgggaaggagccacaaccctccgcagaggctgctgctgctccatcattggcaaatatctcctgctttacacagaagcttgtcgaaaagctgtactctggtatgtttagcgcagatccccgacatatcctcctgttcatccttgaacacattatggtggtgattgagaccgcgtcttctcagcgggacactgtgctgtccacactctacagcagcctgaataaagtgatcctgtattgtttgtcgaagccacagcagagccttagcgagtgccttggcctgttatcaattttgggttttctgcaggagcactgggatgtggttttcgcaacctacaactctaatatatcttttttgctgtgcctaatgcattgtttgctgctcctgaacgaaaggtcgtatcccgagggcttcggtctggaacctaagccgcggatgagtacctaccatcaagtcttcttgagcccgaatgaggatgtgaaagagaagcgcgaggatttaccatctctaagtgacgtccagcacaatatacagaaaactgttcaaactctctggcaacagctggtggcccagcgccagcagaccctcgaagatgccttcaagatcgacctgtccgttaagcccggcgaacgtgaggttaaaatagaggaagttacacccctgtgggaggaaactatgctgaaagcctggcagcactacctagctagcgaaaaaaagagtctcgcaagcagatctaacgtcgcacaccattctaaggtgacattatggagcggttcactgtccagcgcgatgaaactcatgcctggcagacaggcgaaagatcccgagtgtaaaacggaggacttcgttagctgtattgagaactatcggaggcgcggacaggagttatacgccagcctgtacaaggatcatgtccagagaagaaagtgtggcaacatcaaggccgccaatgcttgggcccgcatccaagaacagctctttggtgagttagggctgtggtcccagggggaagaaacaaagccctgcagcccatgggagctggactggcgagagggtcccgccagaatgcgaaaaaggatcaagcggctctcccctctcgaagctctgagcagcggtagacacaaagagagccaggataaaaatgatcacatatcacagacaaatgccgagaaccaggatgaactgactttgcgagaggcagaaggcgagcctgacgaagtaggagtcgattgcacccagttgacctttttccccgccctgcacgaaagcttacacagcgaagatttccttgagctctgcagagagcggcaggtcattcttcaggaactgctcgataaggaaaaggtgacccagaaattcagcctcgtgatcgttcaggggcatctggtttccgaaggcgtgcttctcttcggacaccaacacttctacatttgtgaaaattttactctgtctccaactggggacgtgtactgcactaggcactgtctgagcaacatttcagacccattcattttcaacttatgcagtaaggatcgcagtaccgatcattactcctgtcagtgccattcttatgcagatatgagagaactccgccaggcccggttcttgcttcaggacattgcccttgagatcttttttcacaatgggtactccaagttccttgtgttctacaataacgacagaagcaaagcattcaagtctttttgtagttttcaaccatcgctcaaaggaaaagctacaagcgaggacactctctcccttcgaagataccccggatctgatcgaattatgctgcagaagtggcagaagcgtgatatcagcaattttgaatacctaatgtaccttaataccgccgcaggcaggacctgcaacgactacatgcagtatccagtctttccatgggtattggccgactacaccagcgagacactgaatttggcaaatcccaagatcttccgagatttatccaaacctatgggagctcagacaaaggaaaggaaattgaaatttatccagcggttcaaggaagtcgaaaaaaccgaaggggacatgactgttcagtgccattactacacccactacagctctgcaatcatagtggccagctatttggtgcgcatgcctccattcacccaggccttctgtgccctccagggaggctcttttgacgtggccgatagaatgtttcactccgtgaagagtacttgggagagcgcgtcaagagagaatatgtctgacgtaagggaacttacacctgagttcttttatctgcccgaatttctgaccaattgcaacggggtggagtttggttgcatgcaggacggcacggtcctgggcgatgtgcaactgcctccttgggccgatggagatccaagaaaattcatctcactacacagaaaggccctagagtctgatttcgtgtcggctaacctgcaccattggatcgacctgatcttcggttataagcaacagggaccggctgcggttgacgccgtgaacatctttcacccatacttctatggggatcggatggatttaagcagcatcaccgaccctctgattaagagtaccattctaggattcgtctcaaacttcggacaggtgcctaagcagttattcaccaagccacatcctgccaggaccgctgctggcaagcctctgccaggaaaggacgtgtctacgcccgtgtccctgcccggtcatcctcagcccttcttttactctctccagagcctgagaccatctcaggtgaccgtgaaggatatgtatctgttttcactgggcagcgaaagtcccaaaggggcaatcggccacattgtgagtaccgagaagaccattctggcagtggaaaggaataaggtgctgttgccccccctgtggaatcgcacattcagttggggtttcgacgacttctcatgctgcctgggaagctatggaagcgacaaagtactgatgacttttgaaaatttggctgcatgggggcgctgcctgtgcgcagtctgcccttctccaaccactattgtgacctcggggacatccacagttgtctgcgtctgggagcttagcatgacaaaggggcggccccgggggctacggctcaggcaggcactgtacggtcacacacaagcagtcacttgcctcgctgcctctgtgaccttctccctgctggtgagcgggtcgcaggactgtacatgcattttgtgggaccttgatcacttgacccacgtcacaagacttccagctcaccgtgagggcatttcagcgattaccattagcgacgtttctggcacaattgttagttgtgctggggctcatctatcactctggaacgtgaacggccagcccctcgcctcaataaccacagcatggggaccagagggcgcgattacatgctgctgcctgatggaaggtcctgcatgggatacttcacagatcatcataactggtagccaagatggcatggtaagagtgtggaaaacggaggatgtcaaaatgagcgtccctggccggcccgcaggcgaggagccgccagcccagcctccatcaccaagaggacacaaatgggagaaaaatctggctttatcccgggagcttgacgtttccatcgccctgactggaaagccatccaagacatcccccgccgtgactgcgctagccgtcagtagaaatcatactaaacttttggtgggggacgagagggggcggatattttgctggagcgctgacggctag

SEQ ID NO: 140653 - DNA, 1965 bp, Artificial Sequence
  Description of Artificial Sequence: Synthetic coding sequence
atggaggctgaagaccttagcaaggctgaggacagaaacgaggatccaggaagcaaaaatgaaggtcagctggcagcagtgcagcctgacgtgccacatgggggccagtcttccagcccaaccgctttgtgggacatgctcgagcgaaagttccttgagtatcagcagctgacccacaagagtccaatcgaaagacagaagtcactgctctccctccttcctctttttttgaaggcttgggagcacagtgtcggaatcatttgctttccttctctgcagaggcttgctgaggacgtttctgatcagttggcgcaacagctccaaaaggccctggtgggcaaacctgctgaacaggctagacttgccgcaggccagcttctgtggtggaagggagatgtcgatcaggatggatatctactgcttaagtcagtgtatgtgctgacaggcactgatagtgagaccttaggccgcgtcgccgagagcggtcttcccgccctgctccttcaatgtctgtacttgttcttcgtcttccccctggacaaggatgagctactggagagtgatctgcaggtccagaaaatgttcgtgcagatgctgctcaatatttgtagcgattcccaggggttggagggcctgctgtcgggcagtgagcttcagtctttgcttattgcaaccacgtgtctgcgagaacattcgtgctgcttttggaaagagcccactttttgcgttctgcgggccataagcaaggcccagaatcttagtattatacagtatttacaggccaccgattgtgtcaggctctctttgcaaaatctgtcacgactgactgacacactacccgccccagaggtgagtgaggctgtatccttgattctcgggttcgtgaaggactcatatccagtctctagtgccctgttcttagagttcgaaaattcagaggggtatccattgctgctaaaggttcttctgagatacgacgggttgacccagtccgaagtggacccccaccttgaagagctcctcggcctggtagtttggctgaccacttgtggtcgttctgaactcaaggtgtttgacagcatcacataccctcagctcgagggcttcaagtttcaccacgaagccagtggcgtcacagtgaagaacctgcaggccttccaggtgctccagaacgttttccataaggccagtgattccgtactgtgcatacaggtgctttccgtgattaggaccatgtgggcctggaacgcacgaaatttcttcctgctagagtggaccctgcagcctatctcacagttcgtggaaatcatgcccttaaagcccgctccggtacaggagcactttttccagctgctggaagctttggtgttcgagttgcattatgtgccacatgaaatactgcgaaaggtacagcacctcataaaagaaagccccggaccctcttgcacactcatggctttgcagtctatccttagcatagccggtggggatccgctgtttaccgacattttcagggactctgggctgctggggctgttgctggcgcagctcagaaaacaagcaaaaatcatgaggaaatccggaaacaaggtgagtaccccgggagtccaggatccagaaagggaactcacctgtgttatgctgaggatcgtggtcacattgctcaaggggtcagtacggaatgccgtcgtactgaaagaccatggcatggtgccctttatcaaaatcttcttggatgacgagtgttatcgagaagccagtctgtctatcctggagcagctttctgctattaatgcggaggaatacatgtcgatcatcgtgggagccctgtgctccagtacccaaggcgaattacagctcaagttggacctactgaaagttatctcctccccccctctgagattagcatcactctggatatgtacaaaacggtcgacttttgctcaggccttcgtcttcatgtag

SEQ ID NO: 140654 - DNA, 1659 bp, Artificial Sequence
  Description of Artificial Sequence: Synthetic coding sequence
tgagatgacactgtcgtttgggctgaggagtgtgtggcatgcgccaactggctgtggatgaacaccgccgataatttggagctgtcgctgttttcccatctgctcgaaatcttgcagtccccaagagagggaccaagaaatgctgaagccgcgcaccaggctcagctgatacccaaattgatcttcctgttcaatgaaccctctctgatccctagtaaaattagcacaattatcgggattctcgcatgccaactgcgcgggcacttttctacccaggacctcctccgcatcggcctgtttgtagtgtataccctcaagccctcttctgtgaatgaaagacagatttgcatggacggcgccctggatcctagcctgcccgctggatcccaaacaagcggaaaaacaatctggcttcgaaatcaactcctggaaatgctgctgtctgtcatctccagcccccaattgcacctgtcaagcgagagtaaagaagagatgttcttgaagcttgggcctgattggtttttacttctgttacagggccacctccatgcgtccaccaccgttctagctcttaagctgctgttgtattttttggcgtccccttctttgcggactaggtttcgagatggactctgcgctggctcctgggtggagcgatcaacagagggggtagatattgtgatggacaatctgaagagtcagtcccctctgccagaacagtccccatgtctactaccagggtttcgtgtcctcaacgacttccttgcccatcacgttcatattcccgaggtctacctgatcgtgtctacattttttctccagacgccgctcactgagctgatggatggacccaaggactctctggatgctatgctccagtggttgctccagagacaccaccaagaagaagttctacaggccgggctgtgtacagagggggcgctcttattgctggaaatgttgaaggcaacaatgtcccagccactagccggtagcgaggacggagcctgggcccaaacttttccagcatccgttcttcagtttctttcacttgtacaccggacatatccccaagaccccgcatggcgggcccctgagttccttcaaacattggcgatagcagcatttccgctgggcgcccagaagggagtgggtgctgaatccacccggaatacgagttctcccgaggcggccgccgaaggggacagtacggttgagggattacaagcgcctactaaagctcatcccgcccggaggaaactccgcgaattcacacagctgctgctcagggaactcctgctcggggcctcctccccaaaacagtggttgcccctcgaagttctgctcgaagcgtcacccgaccacgctacctctcagcagaaacgcgatttccagtcagaggttctgttatccgccatggagctgttccatatgaccagcgggggtgacgccgccatgttccgcgacggtaaagagccacagccctccgccgaagcagcggccgccccatctctggccaatatttcttgctttacccagaagctggtagagaagctctatagcgggatgttctccgccgaccccaggcacatactgctcttcatacttgagcatatcatggtaatctctgcacctctgcaggcccgagatttcagttag

SEQ ID NO: 140655 - DNA, 3129 bp, Artificial Sequence
  Description of Artificial Sequence: Synthetic coding sequence
atggaagctgaagacctcagtaaggccgaggaccggaacgaagatccgggttctaaaaacgaaggtcagctcgccgcagtgcagcctgacgtgccacacggaggccagtcatcctcacccactgccctctgggacatgctggaaagaaaattcctcgaataccagcagttaactcacaaatccccaattgagaggcaaaagagtcttctttcacttctgccgttgtttctgaaagcttgggaacactctgttgggataatttgcttcccaagcctccagaggctagcggaggacgtgagtgatcaacttgcccagcagcttcagaaagccctggtcggaaagccagctgagcaggcccgcctcgccgctgggcagctcctgtggtggaaaggagacgtggaccaggatggctatcttttgctgaaaagcgtttatgtactgaccggcacagattccgaaactctgggcagagtcgccgaatccggcctgccggctctcctgctgcagtgcctctacctgtttttcgtctttcctttggacaaggacgagctactggagtccgacttgcaggttcagaagatgttcgtgcagatgttattgaatatttgtagcgactcccaaggattagagggactcctgtctggttctgagctgcagtccttgctcattgcaacaacctgtttgcgcgaacattcatgttgcttttggaaggagcctactttttgcgtgctgcgcgccatcagtaaggctcagaatctttctatcattcaatacttacaggccacggactgcgtgaggctgagcctgcagaatctcagccggttgactgacactctcccagcacctgaggtgtcggaggcagtgtcattaatcttagggttcgtgaaggacagctacccggtgtcatcagctctgtttttggagtttgagaactctgagggctaccccctgctcctgaaagtgttgctaagatacgacggcctcacacaaagcgaagtcgatccacatctcgaggaactcctgggcttggtcgtgtggcttacaacatgtggtcgttcagaactgaaagttttcgattctatcacatatccacagctggagggcttcaagttccatcacgaagcgagcggcgtgactgttaaaaacctgcaggctttccaagtgctacagaacgtgttccacaaggccagtgatagtgttttatgtattcaggttttgagtgtaattcggacgatgtgggcttggaacgcccgaaactttttcctactggagtggacattgcagccaatttcccagttcgtggagattatgccactcaaacctgccccggtccaagagcatttttttcaattgttggaagctctggttttcgagctccattacgtcccgcatgagatcctgcgcaaagtccagcacctcattaaggagagtccaggaccttcctgtaccttgatggcattgcagagcattctttctatagccggtggagaccccctttttaccgatatctttcgcgacagcggcctgctcggcctcttgctggcgcagctgcggaaacaagcgaaaatcatgaggaagtctgggaataaagtgtccacgcccggtgtccaggatccggaacgcgagctgacatgcgtgatgttgagaatagtggttaccctgctgaaagggtctgtccgtaacgccgtcgtgctgaaagatcacggaatggtgccatttattaaaatcttcctggatgacgaatgctatagagaagcatctctgtctatcctggagcagctgtccgccattaacgccgaagaatatatgtcgattatcgtgggcgctttgtgcagctcaacccaaggggagctgcagctaaagttggatttgttaaagtcactcctccggatacttgtgactccaaaagggagggccgcttttagggtttcatccgggttcaacggtcttcttagccttttatctgacctcgagggaagcctgcaggagccgccactacaagcatggggcgcagtttctcctcgccagaccctagaattggtgctgtacactctgtgcgccgtgagtgccgcgctccattgggacccagtgaatggatactttttccgtagaaacgggttgtttgagaagctagctgaggacctctgtctgctaggatgctttggtgccctagaagaggaaggtaatcttttgaggtcttgggttgatacaaaagcccgcccattcgccgatttactgggcacggctttcagttcatccgggtctctccccccgcggattcagagctgtttacagattctgggtttccttgactccatggctagcggtactctgcacctgcgcggtgacctgaaagagagtctaagaacgaagcagggtcctgtagtggatgtacaaaagggcgagaccggcagcgatccacaacgcaattttaaacaatggcccgacctcgaagaacgtatggacgagggagacgctgccattatgcaccctggcgtggtttgcataatggttagactgcttccacgattataccatgaggaccacccccaacttagcgaggaaattcagtgttccctggcttcccacattcagtctctcgtcaaatctgagaagaatcgccaggtaatgtgcgaagccggacttctgggcacgctgatggctagttgccacagagccctggtgacttccggctccccacttcattctcgactaattcgaatcttcgaaaaactggcgagtcaggcaattgaacctgatgtgctgcggcagtttcttggattgggtattccatcttctttgtccgccaccacaaagatactggacagctcccacacacacagggggaacccaggctgtagtggctcacagactgctcagggcctggctgaaggcccatggccagctgcccctgacgctggactgcacccaggcgtaacccaggccccgcagcctttaggcgaatcacaggatagcaccacagccctgcaaacagcattgagcctgatctccatgacatctccgcatatctggaagcccaatatctggaaggacaatctagcccagaaacccgtggccggcgatgccgctcagtgcaacattttccctcccgcgtcctccgtgctttag

SEQ ID NO: 140656 - DNA, 9531 bp, Artificial Sequence
  Description of Artificial Sequence: Synthetic coding sequence
atggaggccgaagacttgtccaaggctgaggaccgcaatgaagatcccgggagtaagaacgaaggtcaactggctgcggtacagccggatgtgccccatggcggccagagctcctcccccactgctctctgggatatgctggagcggaaatttctcgagtaccagcagctgacacacaaaagtcctattgagagacaaaagagcctgctctcccttctccctctctttttgaaggcctgggagcacagtgtcgggatcatatgcttcccaagccttcagaggctggcagaggatgtgagtgaccagctggcccaacagttacagaaggctctggtgggaaagcctgctgagcaggcccgattggctgctggacaactgttatggtggaaaggggatgtggatcaagatggttatcttttgctcaagtcagtatatgttcttacaggcactgattcagaaaccctgggcagggtagccgaatcagggctgcccgcactgctgttacaatgtctgtacttgttctttgtctttcccctggataaggacgagttgctcgaatcagacctccaagtgcaaaagatgtttgtgcaaatgctgttgaatatctgcagcgatagccaggggctggaaggactcctgtccggcagtgagctgcaaagtctccttattgcgactacgtgtctacgtgaacactcttgctgtttttggaaggaacccacgttttgtgttctgcgtgctatttcaaaggctcagaacctgagcatcatccagtacctccaggcaacagactgcgtaaggctctcacttcagaatctgagcagactgaccgacaccttgccagcccctgaggtaagcgaggccgtctccctgatactgggctttgtgaaagacagttaccctgtgagttccgctttgttcttggaattcgagaactcagaaggttatccactgttgctaaaggttctcctgcgctacgacggactaacacaaagtgaagtagaccctcatcttgaggagcttctcggactggtggtgtggctgaccacatgcggccggtccgagctgaaggtgtttgattctattacttatccccagctcgaaggcttcaagttccatcatgaggcttctggggtgacagtgaaaaatctgcaagccttccaggtcctacagaacgtcttccacaaagcctcagattcggtgctgtgcatacaagtgctctcggtgatacgcaccatgtgggcctggaatgcccgaaatttcttcctgctcgaatggacccttcagccaatttcacagtttgtggagatcatgcctttgaagccagccccagtgcaagaacacttttttcaactattggaagctttggtgttcgaactacactatgttccacatgagatcctgagaaaggtgcaacacttgattaaagagtccccaggcccaagttgcacactgatggcactgcagtctattttgtccatcgctggcggggatcctctgtttacagatatttttcgggattctgggctgctcgggctgctgttggcccaactaagaaagcaggcaaaaatcatgagaaagtcaggaaacaaggttagcactccaggagtgcaggacccagaacgggagctaacatgcgtgatgctgaggatcgtggttacacttttaaaaggcagtgtccggaatgccgtcgtgctgaaagaccacggaatggtccctttcatcaaaatcttcctggacgatgaatgttatcgcgaggccagcctgtcaattcttgagcagctgagcgcaattaatgcagaagagtatatgtcaatcatcgtgggtgccctctgcagtagtactcagggggaactgcagctgaaattagatttactgaagtccttattgcggattctggttacccccaagggacgcgcagcgttccgggtgagttcgggcttcaacggactcttgtcactgctgagtgacttggagggtagcttgcaggagccccccctgcaggcctggggagctgtcagcccacggcagacacttgaactggttctgtacaccttgtgcgctgtgtcagctgcacttcactgggaccctgtgaatggatatttcttcagaaggaacggactgtttgagaagttagccgaggacctgtgcctcctgggctgttttggtgcgttagaagaagaaggcaatctgctgagatcatgggtcgatactaaggctcgccccttcgcagacctcctcgggactgcattcagttcttccggatccctaccccctagaattcagagctgtctacagattttggggtttcttgattccatggcaagcggcacactccatctccggggggaccttaaggagtccctgagaacgaagcaaggccctgtagtcgacgtgcagaaaggcgagacgggctccgatccccagagaaattttaaacaatggcccgatctcgaagagcgaatggacgagggcgacgcggcaatcatgcaccccggcgtggtctgcataatggtccgactcctgcctagactgtaccatgaagaccacccacagttaagcgaggaaatccagtgttcactagcctcccatatacagagcctggtcaagagcgagaagaatcggcaggtgatgtgtgaggcaggccttctcggcacactgatggcgtcttgccaccgggcactcgtgacttcaggaagcccattacactcaaggctgatccgcatattcgaaaaactggcctcccaagctatcgaaccagatgtacttcgacagtttctcgggctgggtattcctagctcactgagcgcaacgacaaaaatactggactcatcccacacccaccgggggaatcccggttgcagtggctcgcagactgctcaaggcttggccgaggggccctggcccgccgcacccgatgccgggttacacccgggtgtgactcaggccccacagccccttggagagtcccaggatagtacaacggccctgcagactgccctgtcactaatcagtatgacttcgccccggaacctgcagccgcaaagagccgccctggcaccgtccttcgtggaattcgacatgtctgtcgagggatatggatgcctctttataccgaccttgtctaccgtcatgggcacctctactgaatacagcgtaagcggtggcataggcactggcgccacacggcccttcccccctccgggaggcctgactttcagttgctggttcttgatttcaaggcacggagctgctacggagggccatccactgcgcttcttgactctggtgcggcatctggcacggacagaacagccattcgtctgcttttccgtgtcactctgtcctgatgatcttagtcttgttgtgagtaccgaagagaaggagtttcaaccgctagacgtcatggagccagaagatgatagtgagccttctgccggatgtcagctgcaagtgcgctgcggtcagctccttgcatgcggccagtggcatcacctggccgtggttgtcacaaaagaaatgaagcggcactgcactgtcagtacatgcctcgatggccaggtgatcggctccgccaagatgctgtacattcaggccctcccggggccatttctcagtatggatcccagtgcattcgtggatgtatacggctacatcgctactccaagagtgtggaaacagaagagttcattgatatggcgtctcggaccaacttacttattcgaagaggcgatttctatggaaacactcgaggttatcaataaactgggtccccggtactgcggaaacttccaagccgtgcacgtgcagggagaggaccttgattcagaggccacaccattcgttgccgaggaacgcgtgtccttcggattacatatcgcaagttcatccatcacaagtgtggcagacatcaggaatgcctacaacgaagtggactcacgtctgatagccaaagagatgaacatttcatcccgcgataatgccatgccagtgttcctgttacgcaactgcgctggacatctgagcggctcactgcgaaccataggcgccgtggcggtagggcagttgggcgttcgggtgtttcattcaagtcctgccgcgtccagtctggacttcatcggcggacctgcaattttactgggcctgatttcgctggcaaccgatgatcacaccatgtatgctgccgtgaaagtcctccacagcgtcctgacgagcaacgccatgtgtgactttctgatgcagcatatctgcgggtaccagattatggccttcctactccggaagaaagcctctctgctgaaccatcggatattccaacttatcctgagcgtcgcaggtacagtggaactcggcttccgctcatctgctataaccaataccggtgtatttcagcacattctttgtaattttgagctgtggatgaatactgccgacaacctggagttgtctctcttctcgcatttgcttgagattttacagagtcctcgcgaggggccccggaacgccgaggctgcacaccaggcccagctgatacctaagctcatcttcttatttaacgaaccttccctgatcccttccaagatctcaaccatcattggtatcttagcctgccaacttcgaggccactttagtacccaagacctcctgaggatagggcttttcgtggtctacacactcaaacccagctcagtgaatgaaaggcagatatgcatggatggagctttagatccatccttaccagccggatcccagacatctggaaagaccatctggctaagaaaccaactgctggaaatgttactcagtgtgattagctctccacaactgcatctgtcctctgagagcaaggaagagatgtttttgaagctggggcctgattggttcctgcttctgttgcagggccacctgcacgcctctactacagtgctcgccctcaaactgctcctgtactttctggcaagccccagtctgaggacccggtttcgggacggactttgtgcaggaagctgggtggaacgtagtaccgaaggagtcgatattgtcatggacaatttaaagtctcagtcaccccttcctgaacagagtccctgtctcctccctgggtttagggtcttaaacgattttctcgcccaccatgtacacatcccggaggtttaccttatagtgagtaccttctttctccaaactcctctgacagaactgatggacgggccaaaggattccctcgacgcgatgttacagtggcttctccaacggcatcatcaggaagaagtgttgcaggccggactgtgcacagagggggctttgctcctcctagaaatgctcaaagccacgatgtcccagcccctcgcaggtagtgaggacggcgcgtgggctcagacatttcccgccagtgtgctacagttcctttccctcgtacacagaacttaccctcaggatccagcttggcgagctcccgagtttcttcaaacgctggccatcgccgcctttccattgggcgcccaaaagggagtaggtgccgagagcactcgaaatacatcatcgcctgaggctgctgctgagggggatagtactgtggagggcctgcaagccccaactaaagcccacccagcacgacggaagctgagagaatttacgcagttgttgctcagagagctcctcctgggggcctcgtctccaaagcagtggctaccactggaggtgctcctcgaggcatctcccgaccatgcgacctcccaacagaagcgcgattttcagagcgaggttctgctctccgccatggagctgttccatatgacatccggcggggacgccgctatgtttagagacggtaaggaacctcagcctagtgccgaggcagccgctgctcccagcctcgctaatatcagctgttttacacagaagctagtcgagaaattgtactctgggatgttctcagcagaccctaggcacatcctgctgtttattctggagcacatcatggtggtgatagaaactgcttccagccaaagagacaccgttctctctacgttgtactcaagtctcaataaagttatcctctactgtctctcaaagcctcagcagagcttgtcagaatgcttgggcctcttgtctatcctcggatttctccaagagcactgggacgtggtatttgccacctacaacagcaatattagcttcctcttatgcttgatgcactgcctgctcttgctgaacgagaggagttaccccgagggttttggcctggaaccaaagccaagaatgagcacgtaccaccaagtgttcctttctccgaacgaggatgtaaaggaaaagagagaggacctgccctccctgtcagatgttcagcataatattcaaaagacagtccaaacactatggcagcagttagtggctcagcggcagcaaaccctggaggatgctttcaagattgacctctctgtgaagcccggcgaacgcgaggtgaaaatcgaggaagttacccccttatgggaggagacaatgctcaaagcatggcaacattatttggcttccgaaaagaaatccctggcttccagaagcaacgtggcccaccacagcaaggtgactctgtggtccggctctctatcatcagcgatgaaactgatgccaggcagacaggccaaggacccagaatgcaaaactgaagatttcgtgtcatgcattgaaaactacaggagaagggggcaagaactttacgcgagtttatacaaggaccacgtacagcgacggaagtgtgggaatattaaagctgccaacgcgtgggcgaggatccaggagcaactgttcggggagctcggcctgtggtcgcagggcgaggagactaagccatgctcaccttgggagctagactggcgagagggaccagctagaatgagaaagcgtattaagagactttctccccttgaggcactgagtagtgggcgacataaagagagtcaggacaagaacgatcacattagccagactaatgcagagaaccaggatgagttgaccctgcgggaggccgaaggggagccagatgaggtgggtgtcgattgtacccaactcacattttttccagccttgcatgagagtctgcactctgaagatttcctggagctgtgtcgcgagcgacaggtcattctccaggaactccttgacaaggaaaaggtcactcagaaattctccctagtgatagttcagggtcacctcgtaagcgagggtgtgctcctcttcgggcatcaacatttttatatttgtgaaaatttcaccctatctcccacaggagacgtgtactgcacgcggcattgcctctctaacatctcagaccccttcattttcaatctctgctccaaggacagaagtacagaccattactcttgccagtgtcattcctatgccgacatgcgggaactccgacaagcccgcttccttctgcaggacatcgctttggagattttttttcataacggatactccaaattcctagtcttttacaacaatgacagaagcaaagcgttcaagagtttttgctcctttcagcccagcctcaaggggaaggccacatcagaagacacactgtctctccggcggtaccctggctccgatcgaatcatgctccagaagtggcagaagagggacatcagcaactttgaatatctgatgtacctgaacaccgcagccggccgcacgtgcaatgattacatgcagtatcccgtatttccatgggtcctggccgattacacttcagaaaccctgaacctggcaaaccccaagatattccgcgatctgtctaagccgatgggcgcacaaactaaagagcggaagctcaaatttatccaacgattcaaggaggtggagaaaacagagggagatatgacagttcaatgtcattactacacacactattcctccgcaattatcgtggccagttatctggtgcggatgccccccttcacccaggccttttgtgcgctccagggaggatctttcgacgtggcggataggatgttccattcggttaaaagcacatgggaatcggcaagtagggaaaacatgtccgatgtacgtgagcttaccccagagttcttttaccttcccgaattcttgactaactgcaacggggtcgagttcgggtgtatgcaggacgggactgtacttggagatgtccagctacccccttgggctgacggtgatccacgaaaatttatatctctacatcggaaagcgctggaatctgactttgtgtcagccaacttgcaccactggatcgaccttatctttggttataaacagcagggaccagctgccgtcgacgctgtgaatatattccatccttacttttatggagatcgaatggatctttccagcattactgatccactcattaaaagtactatccttggttttgtgtccaactttggacaggtgcccaagcaactcttcaccaagccacaccctgcacggactgctgctgggaagccactgcctgggaaggacgtgtctactccagttagtctgcctggtcatccgcagccatttttctatagtctccaaagtttgagacccagccaggtaacggtgaaggacatgtacctcttcagcctggggtctgaatctcccaaaggagccattgggcatattgtatcaactgaaaaaacgatcctcgccgtcgagaggaacaaggtcctcctgccacccctgtggaaccgtaccttttcctggggctttgatgatttcagctgttgcctggggagctacgggagcgacaaggtcctgatgacatttgaaaacctggcggcttgggggagatgcttatgcgccgtctgtccaagtccaactacaatagtaacctccggcacaagcacagtcgtctgtgtatgggagctcagtatgacgaaagggaggccaagagggttaaggcttagacaggcactctatgggcatacgcaggcagtcacctgtctggctgcctctgtgacattctccttgctcgtctcagggagtcaggactgtacgtgcatcctgtgggacctggatcatctgacacatgtaaccagacttcctgctcatcgagagggcatttcagcaattacaatttccgacgtcagtggcaccatcgtgtcctgcgccggggcgcatcttagcctatggaatgtgaatgggcagccgcttgcttctattactactgcttggggtcccgaaggggcaatcacatgctgctgcctcatggaagggcctgcctgggacacatcgcagattatcattaccggttctcaagatgggatggtccgagtttggaaaacagaggatgtgaagatgtctgtgcccggtttgcaaatgggtaggaaacgcgaagctgctgaggcacttgcccagcagtgtcaagcggagggtgggcggggggattggggactgagttccgcctaccgaaggaatccccagggcctgttgccacactcctcccagggccgcgccagtggcaatcattcctcggctgcgcagccttcgccatggcccatgggactgctgtag

SEQ ID NO: 140657 - DNA, 3159 bp, Artificial Sequence
  Description of Artificial Sequence: Synthetic coding sequence
ttgaacagcgatttactctgtcacggcatggaggctgaggacttgagcaaggccgaagatcgcaacgaagatcccggctcaaaaaatgagggccagctggctgcagtgcagccagacgtgcctcacggcggccagtcttcatcccccactgctttgtgggacatgctggagcgcaagtttctggagtatcaacaactaacacacaagtcgccaatagagcgccaaaagtcactgctgagcctcctgccactgtttctgaaagcttgggagcacagcgtcggaattatctgttttcctagcctgcagcgcttagctgaggatgtgtctgatcagctggcacagcaattacaaaaggcccttgtgggaaaaccggccgaacaggcccggctggctgccgggcagctgctctggtggaagggagacgtcgaccaggacgggtatttgttactaaagagcgtctatgttctgacaggtacagattcagaaaccttaggtcgggttgctgaatcagggctcccggccctcttactgcagtgcctatacctgttttttgtgtttccccttgataaggatgagctcctcgaatctgacctacaggtgcaaaagatgtttgtgcagatgctgctcaacatttgctccgattcccaagggttggagggcctcctgtcaggctcagaactgcagagtcttctaatcgccaccacgtgcctgagagaacacagttgctgcttttggaaggagcctaccttctgtgttctccgcgctatttctaaagcccagaacctctctatcatccagtatttgcaggccacagattgcgtacggttatcactgcaaaatctcagtcgactgacagacactcttcccgctccggaggtctcagaggctgtatcactcatactgggcttcgtgaaagatagttaccccgtttcaagcgcgctgtttttggaatttgaaaattcggaaggatacccattgctgctcaaggtactcctccgatacgatggtctcacgcagtccgaagtcgatccacacctggaggagcttctgggtctggtggtgtggttaaccacctgcggaaggtctgagctcaaggtgttcgatagcattacttacccacaactggagggatttaagtttcatcacgaagcctccggcgttaccgtgaagaatctgcaggctttccaggtcctccagaacgttttccacaaggccagtgacagtgtgttgtgtatacaggttctttctgttattagaaccatgtgggcctggaatgctcgaaacttcttcttattagaatggactctgcagcctatctctcagttcgtcgagataatgcccctgaagcctgcccctgtgcaagagcacttctttcaactgttggaggcccttgtgtttgaattgcactacgtgccacatgaaattctcagaaaagtgcagcacctgataaaggagtcccctgggccttcttgcacactgatggccctgcagagtatcctgtcgatcgcgggcggggatccactgttcactgatatcttcagggacagcggcctgctcggactcctcctcgcccagctgaggaagcaggccaaaattatgaggaaatctggcaacaaagtgtccactcccggggtgcaagaccctgagagagagttgacctgtgtgatgctgagaattgtcgtcaccctgctgaaagggtccgttagaaacgctgtggtcctcaaagaccacggaatggttccgtttataaagatttttctggatgatgaatgttatagagaagcttcactgtcgatcttggaacagttaagcgcaataaatgccgaggaatacatgagtatcatcgtgggtgcactttgctcttcaacccagggcgaattgcaactcaaactcgatctgcttaagtcccttctgcgtatcctggtgactccaaaggggcgggctgcatttcgcgtgtcctccggattcaatggcctgctgtcattactgtcagaccttgagggatctctgcaggaaccaccattgcaggcgtggggagctgtcagtcctcgtcagaccctggaactagtattgtacacactatgtgcggtgtccgcagccctgcactgggatcctgtgaatgggtacttctttagaaggaatggcctctttgaaaagctcgctgaggatctttgcctgctgggctgctttggcgctctcgaggaggaaggcaacctgctgcgctcctgggttgatacaaaagctagaccctttgctgacctgctaggcacggccttctcaagctcggggagcctgcctccaagaatacaatcttgcctccaaattctcggctttcttgattccatggcgagtggcacccttcacctgcggggcgacctcaaagagtccttacgtacaaaacagggacccgtggtggatgtgcaaaaaggcgagactggctccgatccacagaggaattttaagcaatggccagacctcgaagaacgtatggacgagggagacgccgctatcatgcatccgggcgtcgtgtgtatcatggtacgtctgctgccccgcctgtaccacgaggaccacccccagttatcagaagaaatccaatgcagcctggcaagtcacattcagagcctggtgaaatctgaaaaaaatcgccaggtaatgtgcgaggctggcctgctgggcacgctgatggcctcatgccatagagcccttgtgacctctggctcccctctccattccagactcatccgcatttttgaaaaactcgccagtcaagcgatcgagcccgatgtactccgccagttcctcggacttggcattccatcatctctgtccgccactaccaagattttggatagctctcacactcatcgggggaaccccggttgtagcggctcgcagaccgcccaagggctcgccgagggaccatggcctgctgcgcccgatgccgggctgcatcctggcgtgactcaggctcctcagccattgggagaatcccaagatagcaccactgcgctgcagacagccctgagcttgatttctatgacctcccccgtagccggatcccagacatctggaaaaacgatctggctccggaatcagctcctggaaatgctgctcagcgttatctcgagcccacagttgcacctaagcagtgagtag

SEQ ID NO: 140658 - DNA, 1875 bp, Artificial Sequence
  Description of Artificial Sequence: Synthetic coding sequence
atgctgcagaaatggcagaagcgggacatatctaatttcgaatacttaatgtatctcaatacagcggctggtcgtacatgtaacgactacatgcagtatcccgtgtttccttgggtgctggcagactacacatcggaaaccctaaatcttgccaatcccaaaatcttccgggacttgtctaagcctatgggagcccagaccaaggaacggaagttaaaattcatacagaggtttaaggaagtagaaaaaactgagggtgacatgactgttcagtgtcactattacacccactattcttctgctataatcgtagcatcttacctcgtacgcatgcctccctttactcaggccttctgcgcgctccagggggggtccttcgacgtcgcggatcgcatgttccactctgtgaaaagtacttgggagtctgcttcacgtgagaacatgtccgacgtgagggagctaacaccagagttcttctaccttcccgagtttctgacaaattgtaacggcgtagagttcggctgcatgcaagatgggacagtcttaggggatgttcagctcccaccgtgggccgacggtgacccaaggaaatttatcagtcttcacagaaaagccctggagagcgactttgtctctgccaacttacatcactggatcgacctgatctttgggtacaagcaacagggcccagcggcagtggacgctgttaacattttccatccatacttttacggtgacaggatggacctgagctctattactgacccccttattaaaagtacaatcttaggattcgtgtctaactttgggcaggtgcccaaacagctctttacaaagcctcatcctgcccggaccgcagccgggaaacctctgccgggcaaggatgttagcacaccagtgtctctgccgggccaccctcaacctttcttctacagtcttcagtcactaaggccttcgcaggtgacagttaaagatatgtatcttttcagtttgggttctgagtcccccaagggtgcaatcggacatatagttagtactgaaaaaacaatcttggctgtcgagcgtaacaaggttctccttcctccactgtggaaccgcacttttagttggggctttgatgatttctcttgctgcttgggcagctatggctcggacaaggtgctgatgacatttgagaacttagccgcatggggccggtgcctctgcgccgtttgtcctagtcctaccacaatagtgacatcaggaacctccacagtggtctgtgtatgggaattatccatgactaaaggtagacctcgtggattgcggctgcggcaggccctgtacgggcacacacaggctgtaacatgcctcgcagccagtgtgacattcagcctcttggtgtcaggatcacaggattgcacgtgcatcctttgggacctcgaccacctcacacacgtgacacgcctgcctgcccacagagaggggatttccgccattactatatctgatgttagcgggacgatcgtgagctgcgccggggcccacctgtccttatggaacgtaaatggtcaacccctcgcttcaatcaccactgcctgggggccagaaggtgctatcacttgttgttgtctgatggagggccctgcgtgggacacatcacagattattataacaggatcccaggacggaatggttcgcgtgtggaaaaccgaggacgtcaaaatgtcagtgcctggccggcctgccggtgaagagccccctgcccaaccacctaccctctccatggctgatggtacatcaatgaagagaatgtccacacacacacgacgggccgagcagcatgctggcaactgcgacctcgtcatgccgtcatgtactcggaattacacctag

SEQ ID NO: 140659 - DNA, 1704 bp, Artificial Sequence
  Description of Artificial Sequence: Synthetic coding sequence
atggatgacaaggacatcgacaaagagctccgccaaaaactgaacttcagttattgcgaagaaaccgagattgaagggcagaagaaggtcgaggagagtcgcgaggcgagttctcaaactccagaaaagggtgaagtgcaagatagcgaggccaaagggacccctccctggacccccctgtctaacgtacacgaactggacacttcaagtgagaaagataaggaatctccagatcaaattcttcgcacacccgtgtcccaccccctgaaatgccctgaaacccccgcccaaccagatagtaggtctaagttgttacctagtgactctccaagcactccgaagactatgctatccagactcgtaatttcacccactgggaagcttcctagccgggggcctaaacacttaaagttgaccccagcgcctctcaaggatgaaatgactagcttggctctggtgaatatcaacccattcactccagagtcttataagaagttattccttcaatccggaggcaagcgcaaaataagaggtgatctggaggaagcaggtccagaagagggcaaaggtggactccccgccaagcggtgcgttctgagggaaaccaacatggctagtcgctacgagaaagagtttctcgaagtcgaaaagattggggtcggggaatttggaactgtgtacaagtgcataaaacgcctcgacggttgtgtgtacgcaataaagaggagcatgaagacctttaccgagctgagcaacgaaaactccgccctgcatgaagtgtatgcacacgcagtgctgggtcatcatccccatgtcgtaaggtactactccagctgggcagaggatgatcatatgatcatacaaaatgagtattgcaatggcggaagtctacaagccgccatctcggagaacaccaaatccggtaaccacttcgaagaacccaagttgaaggatatcctcctgcagatttcattgggcctgaactatattcacaacagctccatggtgcaccttgatatcaaaccttctaacattttcatatgccataagatgcagagtgaaagctccggggtcatcgaagaggtagaaaacgaggcagattggttcctgtccgcgaatgtgatgtacaagattggagatctcggccacgcaacttctattaacaagccgaaggtggaggaaggggactcacggttcctggccaatgagatactgcaagaggattatagacacctgcccaaagcagacattttcgccctcggacttaccatcgcagtcgcggctggggctgaaagtcttccaacgaatggggcagcatggcatcacatccggaagggcaacttccctgacgtcccgcaggaattgtcagaatctttcagtagcctgttgaagaacatgattcaacccgacgcagaacagcgcccaagcgccgcagcactagctaggaacaccgtacttcggcctagtctcggtaaaacagaggaactgcagcagcaactgaacctggagaaattcaaaaccgccactctggaaagggaacttcgggaggcccaacaagcccagtcccctcagggttatactcaccacggcgataccggcgttagcggcacccataccgggagcaggagcaccaaacgtttggtcggagggaaatctgcacgtagttcttcctttacctctggggaaagggaacccctccattag

SEQ ID NO: 140660 - DNA, 846 bp, Artificial Sequence
  Description of Artificial Sequence: Synthetic coding sequence
atggttaccattctgatgcgcgctatcaattcgctgggcatccacgtgttagattcctcacgtcccaccgaccctctatcccactcttcgaactcatcttcggagcccgcgatgttcattgaggataaagccgtagacacactcgcctacttaagtgatggtgacgcgcgcgcgggccttaatggactccaacttgccgttctggctcgtctttcctcgcggaagatgttttgtaagaaatctggtcagtcttatagtccctcccgcgtcctcataactgaaaatgacgtgaaggaggggttacaacgatcacatatcctgtacgaccgagccggcgaggagcattacaactgtatatctgccctccacaaaagtatgaggggctctgaccagaacgcatcgctctattggctcgctcgcatgctggaagggggagaggaccctctgtatgtggcgaggagactggtccggtttgcctcagaagacattggtctggcagatccttccgcgcttacacaggccgtcgctgcctaccagggttgtcacttcattggcatgccagaatgcgaggtcctgttagcgcagtgcgtagtatactttgccagggccccaaagtccatagaggtgtacagcgcatacaataacgtcaaagcttgcttacgcaaccatcaaggtccactgccccctgtgcctctgcacctgcgaaacgctcctacgcgactgatgaaggacctcggttatggcaagggatataagtacaaccccatgtactctgagcccgtggatcaggagtatttaccagaggagctgaggggggttgacttctttaagcagagacgatgctag

SEQ ID NO: 140661 - DNA, 1338 bp, Artificial Sequence
  Description of Artificial Sequence: Synthetic coding sequence
atgcttcaaggcaagcctcttgctgacactatgcgcccagatactttgcaggactactttggccagtctaaggcagtggggcaggatacgctactgagatccctactggagaccaatgagataccaagtctcattctatggggcccccccgggtgcgggaagaccaccttagctcatattattgctagtaactctaagaagcatagcatacgctttgtcacgctgtcagcaactaacgcaaagacgaatgacgttagggatgtgatcaaacaggcccaaaatgagaagagtttcttcaagaggaagaccattctatttatcgacgagatccatagatttaataaaagccagcaggatacattcctgccccacgtggaatgcgggacaattactctaatcggagcgacgacagaaaatcccagctttcaggtgaacgcagcgttgctatccagatgtcgggtgattgtgttggaaaagttgccggtggaggcaatggtgaccattctcatgcgagccattaactcactgggcattcacgtcctggacagttcccgccctacggacccactcagtcactcctctaattcctcgtccgaaccagccatgttcatcgaggacaaagctgtagatactctggcctacttgagtgatggcgacgcgcgagcgggccttaacgggctgcagctggccgtgctcgccaggctaagcagccgtaagatgttttgtaagaaatcgggacagtcgtatagcccatcgagggttctgatcacggaaaacgacgtgaaagagggcctgcagagaagtcacatattatatgatagagcaggcgaggagcattataactgcatcagcgccttacacaaatcaatgcgcggatccgaccagaacgccagcctgtattggctcgcaagaatgctcgagggtggcgaagaccccctttacgtggcccgccgactagtaagattcgcttctgaggatatcggcttggcagacccttccgcattaacgcaagccgtggcagcgtatcagggatgccactttatcgggatgcccgaatgcgaagttcttcttgcacagtgcgtggtttacttcgccagagcccccaagtcgatcgaagtctactccgcttacaataatgtgaaggcgtgtctcagaaaccatcaggggcctctccctcccgtgcccctgcatctgcgcaatgcgcccacaagactcatgaaggacctgggctatggaaaagggtacaagtacaaccctatgtactccgagccagttgaccaggagtacttgcccgaggagttgcggggcgttgattttttcaagcagaggaggtgttag

SEQ ID NO: 140662 - DNA, 1923 bp, Artificial Sequence
  Description of Artificial Sequence: Synthetic coding sequence
atggaagtaagtgggcctgaagacgaccctttcttgtctcagcttcaccaggtgcaatgccctgtgtgccagcagatgatgccggcagcacatatcaattctcatctggaccgttgtctgttgttgcatccagccggacatgccgagccagcggcaggatcccacagagctggtgagcgcgccaagggcccctctcctcccggtgcaaaaagacggcgtctgagtgagagctcagcactgaagcagcccgccacccccacagctgcggagtcaagcgagggcgaaggggaagaaggtgatgacggtggggaaaccgagtcacgcgagagctatgatgcacctccaactccatctggcgcccggcttattcccgacttccccgtcgccaggtcttcatcccctggccggaaagggtccggtaaacgcccagcagccgcagctgccgccggtagtgcctctccacgttcgtgggacgaggccgaagcacaggaagaagaagaggccgtcggtgatggagatggcgacggtgacgctgacgcggacggagaggacgaccctggacactgggacgccgacgccgctgaggcagccactgcttttggagccagtggcggcggtcggccacatccccgtgctctcgctgccgaagagatccggcaaatgttgcaaggcaaaccattagcagacaccatgcggccggatacattgcaggattacttcggccagagtaaggctgtcgggcaagataccctgctgcggtccctgcttgagacaaacgaaatcccatctctgattctatggggtccacctggctgtgggaaaacgaccctcgctcacattattgcgtctaactccaaaaagcattctatcaggttcgtcaccttgagcgccaccaacgccaagaccaacgacgtgcgggacgttattaagcaggcccagaatgagaaaagcttcttcaaaaggaagaccatcttattcatcgatgagattcaccgctttaacaagtctcagcaggtgaacgctgccctactgtctaggtgccgggtgatcgtgttggaaaagcttccagtcgaagcaatggttactattctgatgcgagccataaatagcctgggaatccacgtgttagatagcagtagacccactgaccccctgagccattctagcaactcgagcagcgagcctgccatgttcatcgaggataaggctgtagataccttggcctatctctctgacggagacgcccgggctggacttaacggcttgcagcttgccgttcttgcacgtctatcgtcaagaaaaatgttctgcaagaaatcaggacagtcctacagtccctccagagtcctgattactgaaaacgacgtcaaggaggggctgcagcgctcccacattttgtatgacagagcaggcgaggagcactataactgcatttccgcactgcacaagagcatgcgaggcagtgatcagaatgccagcctctactggctcgcccgaatgctggaggggggggaggaccctctatatgtggcccggcggctggttcggttcgcatcagaggacatcggtctcgccgatccaagtgccctgacccaagccgttgccgcttatcagggatgccatttcatcggaatgccagaatgcgaggtactgctggctcagtgcgtagtctactttgctagggccccgaaatccatcgaagtgtacagcgcgtataataacgtgaaggcatgcctcaggaatcaccaaggacctctccccccagttcccctgcacttacgaaacgctccaacccggctcatgaaggacctaggctacgggaaaggctacaagtacaatcccatgtacagtgagcctgtggaccaagagtatctgccagaagaactgagaggcgtcgacttttttaagcagcgcaggtgttag

SEQ ID NO: 140663 - DNA, 1998 bp, Artificial Sequence
  Description of Artificial Sequence: Synthetic coding sequence
atggaggtgtccggaccagaagatgatccattcctatcccagctgcatcaggtacaatgcccggtgtgtcagcagatgatgccagcagctcacatcaattcacacttggatcggtgtctgctactgcatccagcaggacacgccgaacctgccgctgggtcgcaccgcgccggggagagagccaaaggcccttcaccaccaggtgcaaagcgcagacgactgtctgagtctagcgctctgaaacagcctgccacccctactgctgcggaatcctcagagggagagggggaggaaggcgacgacgggggggagactgaaagtcgcgagagctacgatgccccacctaccccttcgggagctaggcttataccagatttccctgtagcaagaagctccagcccagggagaaagggcagtggcaaaagacccgccgccgccgcagccgccggatccgctagcccccgcagctgggacgaagcagaggcacaggaagaggaggaagcagtgggagatggggatggggacggagatgccgatgcggatggcgaagatgatcctgggcactgggacgcagacgcagctgaggcagctaccgcgtttggtgctagcgggggcggccgcccccacccaagggccttggccgctgaggagatacgccagatgctccagggcaagcctcttgccgatacgatgcgaccggacacccttcaagactattttggccagtccaaagcggtcggccaggacacattactgcggtcgctgcttgagacaaacgaaattcctagcctgatcttgtggggaccacccggatgtggcaaaaccaccctagcacatataatcgcatctaatagcaaaaagcatagcatccgcttcgttacactgagcgcgacaaacgcaaagacaaacgatgtcagagacgtcatcaagcaagcccaaaatgaaaagagtttctttaaacgtaaaacaatactgttcatagacgaaatccaccgctttaataaaagccagcaggatacatttctgccacatgtcgaatgcgggaccattacattgataggagcaaccaccgagaatccttcttttcaggtgaacgctgcactcctctcaagatgcagagtgattgtgctggagaagttaccagtcgaggccatggttaccattctgatgcgggctattaattcactgggcattcacgtgcttgattcatcaagacctacagatccactgtctcactctagcaactccagctcagaacccgctatgttcatcgaggacaaggccgtcgacaccctggcctacttgtctgacggagacgcccgggccggcctgaacggtctgcagctggctgtgctcgcacgattgtcttctcgaaagatgttctgtaaaaaatctggccagagttactcaccatctcgcgtattgataacagagaacgacgtgaaggaggggctgcagaggagccatatactgtatgatcgcgctggagaagaacactataactgcattagcgccttacataagagtatgcgcggctccgaccaaaacgcgtccctgtactggttggcaagaatgctggaaggaggcgaggacccactgtacgtcgcccggagacttgtccgttttgccagcgaggatattggcctagcagatcccagtgcactaactcaggctgttgctgcctaccaaggttgccatttcatcggtatgcccgagtgtgaagtgctgctagcgcagtgtgtggtgtatttcgctcgcgcgccaaaaagtatcgaagtgtattcagcatataacaacgtgaaggcttgtctgcggaaccatcagggtcctcttcctcccgtccccttgcacttgcggaacgctcctacaagactgatgaaggatttaggctacggaaagggatataaatataatccaatgtattcagaacctgtggaccaagaatatctcccagaggagctaagaggtgtggacttttttaagcaacgtcgttgctag

SEQ ID NO: 140664 - DNA, 4299 bp, Artificial Sequence
  Description of Artificial Sequence: Synthetic coding sequence
atgagcgaaaaaaagcttgaaactactgcgcagcagcggaagtgcccagagtggatgaatgtgcagaataaaaggtgtgctgtcgaggaaaggaaagcctgcgttcgcaaatctgtcttcgaagatgatctgccatttttagagttcaccgggagcatcgtttattcctacgacgccagcgattgctcattcctgagcgaggatatttctatgagcctctccgacggggacgtagtcggatttgatatggagtggccccctttatacaatagaggcaagctaggaaaggtggcgttaattcagctttgtgtaagtgaatctaagtgctacctgttccacgtttcttctatgtcagtgtttccgcagggtcttaagatgctgctggagaataaggccgtaaaaaaagctggagtggggatcgagggcgatcagtggaaactcctgagggacttcgacatcaagctcaagaattttgtggaacttactgacgtcgctaacaaaaagctgaagtgtactgagacctggtctcttaattcccttgtgaagcacctcttaggaaaacagctcctgaaggacaaaagcataaggtgcagcaattggagtaagttccccctgactgaggaccagaagctatacgcagccacggacgcttatgctggtttcataatatacaggaatcttgaaattctagatgacactgtgcaacgcttcgctatcaataaagaagaagagatactcctgtccgacatgaataaacaactgacatccataagcgaggaagttatggatcttgcgaaacacctgccccacgctttcagtaaacttgagaacccccggagagtgagcatactgctcaaagacatatccgagaacctgtactctctgaggagaatgataataggatccactaatatcgagaccgaactgcgaccttccaacaacctaaacctgctgtcctttgaggacagcaccactggcggtgtacaacagaagcagatcagggaacacgaagttttaattcacgtggaggacgaaacatgggaccccacgttggatcatttggcgaaacatgacggcgaggatgttcttgggaacaaggtagaaaggaaggaggatgggttcgaggacggagtggaagataacaagctgaaggagaacatggaacgcgcctgcctgatgagtcttgacatcactgagcatgagctacagattctagaacagcagtcgcaggaggaatacctgtccgacatcgcatataaatcgaccgagcaccttagtccaaacgacaatgagaacgacacaagctatgtgatcgagagcgacgaggatctcgagatggagatgcttaagcacctcagccctaacgacaatgaaaatgacacatcctacgtgatagagtctgatgaagacttggagatggagatgcttaagtcgctggaaaatctcaattccggcacagtggagcccacacatagtaagtgtctgaagatggagcgcaatttggggctgccaaccaaagaagaggaggaggatgatgagaacgaggctaacgagggtgaagaagacgatgacaaagacttcctgtggcccgctcccaatgaggagcaggttacatgcttgaaaatgtactttggacacagcagctttaaaccagtacagtggaaagtgattcattctgtccttgaagaacgacgcgacaacgttgctgtgatggctaccgggtatgggaagagcctatgttttcaatatcccccagtctatgtgggtaaaataggcctcgttatatctccactcatttcgttgatggaagatcaggtcctgcagctgaaaatgtcgaatatcccggcctgtttcctgggctcagcccaatctgagaatgtgttgactgatatcaagctcggtaaatatcgtatcgtctatgtgacccccgaatattgcagcggaaacatggggctgttgcagcagctggaagccgacatcggaattacattgattgccgttgacgaagcccattgcatatctgagtgggggcacgactttcgcgactcttttcgcaagttggggtcgctcaagactgcccttcctatggtacccatcgtggcactgacggccactgcctctagttccattcgggaagatatcgtgcggtgtctgaatctgcgcaatcctcagatcacttgtacaggcttcgaccggccgaacctatatctggaggtgcgacgcaagactgggaacattctacaggatctccagccattcctggttaaaacttcttcgcactgggaattcgagggaccaacgatcatttactgcccttcaaggaaaatgactcagcaggtgaccggagagctcaggaaactgaacctgtcctgcgggacataccatgctgggatgtcatttagcacccggaaggatattcaccaccgcttcgtacgcgacgaaattcaatgcgtcatagccaccatcgccttcggtatgggcatcaataaggctgatatacggcaagtcatacactacggggccccaaaggatatggagtcctactaccaagagattggcagagccggcagagacggacttcagagcagttgtcacgtgctgtgggcccccgctgacatcaatcttaatagacatctccttaccgagatacgaaacgaaaaatttaggttatacaagctgaaaatgatggcaaagatggaaaaatatcttcacagctcccgatgcaggcggcagattattctgagccatttcgaagataagcaggtgcagaaggcaagtctgggtattatggggaccgagaaatgctgcgacaactgccgaagcagactcgatcactgttattctatggacgatagcgaggacactagctgggactttgggcctcaggctttcaagctgctgtctgccgtagacatccttggggaaaagtttggtattggactccctatcctgtttctgcggggttcaaactcacaacggctggccgatcagtacaggaggcactctctgttcgggacgggcaaggatcagacagagtcctggtggaaggcatttagccgtcagctaatcactgaggggtttttagtggaagtttcacgctataacaagttcatgaaaatctgcgctctgacaaagaagggccgcaactggcttcataaggccaacacggagagccaatcattaattctccaggcaaacgaagagctctgtcccaagaagctgttgcttccatcttctaagacagtgtcttcggggactaaggagcactgttacaaccaagtgcctgtcgagctcagcactgagaaaaaatcaaaccttgagaaactttactcatataagccctgtgacaagatctcctctgggtcaaatattagtaaaaagtcgatcatggtgcagtcaccagagaaggcttactcctccagccagcccgtcataagtgctcaagagcaggagacacagatcgtgctatatggcaagctagtcgaggcaaggcagaaacatgccaacaagatggacgtgcctcctgccatcctggccacgaacaaaatcctagtcgatatggccaagatgaggcctactaccgttgaaaacgtgaagcggatagatggagtgagtgaaggtaaagcggctatgctggcccctctcctggaggttatcaaacacttctgccagacaaattccgtacaaacagatcttttctccagcacaaagcctcaggaggagcagaagaccagcctggtggccaagaataaaatctgtactctttcacagtcaatggcgatcacatattcacttttccaggaaaaaaaaatgcctttgaagagcattgccgaaagcaggatactgccacttatgacaattgggatgcatttatcccaggccgtgaaggccggatgccccctggacctcgaacgggcagggctgacaccagaggtccagaagatcatagccgatgtaattcggaatcccccagtcaacagcgacatgtccaagattagtttaatccgaatgttagttccagaaaatatagacacttacttgatccacatggctatcgagattctgaagcatgggccggactccggcctgcaaccctcatgcgacgtaaacaagagaaggtgctttccagggagcgaagaaatctgtagtagcagcaagcgctccaaagaagaagtgggaatcaatactgaaaccagttctgccgagaggaaaagacgcctgcctgtgtggttcgctaaaggcagtgacaccagcaaaaaattgatggataagaccaagcggggggggttgtttagctag

SEQ ID NO: 140665 - DNA, 738 bp, Artificial Sequence
  Description of Artificial Sequence: Synthetic coding sequence
atggcgcaggaggaagggggttcactaccagaagttagagctcgggtgcgagctgctcatgggatccctgacctggcacaaaagctgcacttttacgacagatgggccccagattacgatcaggatgtcgccactctgctgtaccgagccccgcgtcttgccgtggactgtctcacacaggccctccccggtcccccacactctgccctcatcttggacgtagcctgtggtacagggttggtagctgccgagttaagagcccctggattcttgcagctgcatggcgtggacgggagccctggaatgctcgaacaagcacaggctccaggactgtatcagcgccttagcctctgtacactcggccaggaaccccttccaagtcccgagggaacctttgatgccgtcctgattgtaggggctttgtctgacggccaggtcccctgtaatgcaatcccagaactccatgtaacgaagccaggaggcttggtgtgcctaaccaccagaaccaatagctctaatctccagtacaaagaagccctcgaggccaccctggatcgcctagagcaagcgggcatgtgggagggtctggtggcctggcctgtagatcggctttggactgccggctcttggttaccacctagctggagatggtaccccgcgagccttccacggatggctagttcccctgcactctcaacttgtacagaatctgggagaagaccacgcttgagaaagtag

SEQ ID NO: 140666 - DNA, 798 bp, Artificial Sequence
  Description of Artificial Sequence: Synthetic coding sequence
atggaagctttgccgccagtccgatccagcctcctaggtatcctgctccaggtgactcggcttagcgtgcttttagtccaaaacagggaccacttgtataactttctcctgctgaagatcaatttgttcaaccactgggtgtccggactagcacaagaggcaagggggtcttgcaactggcaggcgcacctccctctcggtgcggcagcttgccccttggggcaggccctgtgggccggcttggccctgattcaggtgccggtgtggttggtgctgcagggccctcggcttatgtgggccggcatgtggggcagtactaagggcctgggtctagccttactgagcgcctgggagcagctcgggctgtcagttgccatctggacagacttgttcctgagctgccttcacggcttgatgctggtggctttgctactggtagtcgtaacatggcgagtgtgccagaagagccactgtttccggttgggtcggcagctgtccaaggctctccaagttaattgcgttgttaggaagcttctggttcagcttcgccggctgtactggtgggtggagaccatgacggccctcacctcctggcatctcgcctacctgattacttggacaacctgccttgcctcccacctcctacaggctgcgttcgagcatacaacgcagctggctgaggcccaagaagtggaacctcaagaagtgagtgggtctagtctgctaccctcactgtctgcttctagtgattcagaatccggaactgtgctcccagaacaggagacacctcgcgaatag

SEQ ID NO: 140667 - DNA, 456 bp, Artificial Sequence
  Description of Artificial Sequence: Synthetic coding sequence
atgactaatgaggaacccctgcccaagaaggttagactgagcgagacagattttaaggtgatggctcgggacgagctgattctccgatggaagcagtacgaggcgtacgttcaggcacttgaaggtaagtacaccgatttgaatagtaacgatgtaacagggctccgggagagcgaggagaaactgaaacagcaacagcaagaaagcgcacggcgggaaaatatcctagtgatgcggttggccactaaagaacaggagatgcaggagtgtacgacccaaattcagtatctgaagcaggtacaacagccatccgtcgcccagctccggtcgacgatggtcgacccggctatcaaccttttcttccttaaaatgaaaggtgagctcgaacagacaaaggataagcttgagcaggctcaaaatgaactcagcgcatggaagtttacccctgatcgctag

SEQ ID NO: 140668 - DNA, 1191 bp, Artificial Sequence
  Description of Artificial Sequence: Synthetic coding sequence
atgacgaatgaagagccgctccctaagaaggtgaggctgtccgagactgacttcaaagtcatggcgagggatgagttaatactccggtggaagcagtacgaggcgtacgtgcaagctctcgagggcaagtacaccgatctgaattcaaacgatgtgaccggtcttagggagtctgaggagaaactgaagcaacagcagcaggagagtgcaaggagagaaaacatactcgttatgcgtcttgctactaaggaacaagagatgcaggagtgtacaactcagatacagtacctgaaacaggtacaacagccgtctgtcgcacagttaaggtctactatggtggatccggcaattaacctatttttcttaaagatgaaaggcgagctcgaacagaccaaggacaagttagagcaagcacagaacgagttgagtgcatggaaattcacgcccgactcccaaacaggaaagaaactgatggctaagtgtcgaatgcttattcaggaaaatcaggaactcgggcggcagttaagtcagggccggatcgcacaattagaggcagagttagccctgcagaaaaagtacagtgaagaactgaaaagttcccaggacgagctgaacgactttattattcagctcgacgaagaagtcgaagggatgcagtctacaatactcgtgttgcagcagcagctgaaagaaacccgacagcaattggcccagtatcaacagcaacagtcccaagcttcagctcccagcactagtagaactactgcctccgaaccagttgagcagagcgaggcaacttccaaggactgttcgagactgactaatggaccgtcgaacggctcctcctcacgccaaaggacaagtggctcgggctttcatcgcgagggcaataccacagaggacgacttcccatcctcccccggcaacggaaataagtcttcgaactcatcagaggagcgaaccggccggggaggtagcggatatgtgaatcagttaagtgcagggtatgagtcagtcgactcaccaaccggaagcgagaacagtctgacccaccagagcaatgacacggacagttcacatgatccccaggaggagaaagcagtcagtggtaaaggcaaccggactgtgggctcgaggcacgttcagaatggtctggatagttccgtgaatgtccagggttccgtgttatag

SEQ ID NO: 140669 - DNA, 1083 bp, Artificial Sequence
  Description of Artificial Sequence: Synthetic coding sequence
atgaacgccccactgggaggaatttggctctggttgcccttactgctgacctggttaactcccgaggtgaacagctcgtggtggtacatgcgagcaaccggaggaagcagtcgggtcatgtgcgataatgtgcccggtctagtaagcagtcagcgacagctgtgtcataggcatcccgatgtgatgcgggccatcagtcagggcgttgcagaatggacagcagagtgccaacaccagttcagacagcataggtggaattgcaataccttggatagagatcacagcctgttcggccgcgttttgctgcgctcttctcgagaatcagctttcgtgtatgccataagtagtgcaggagtagtgttcgctatcactagggcgtgttcgcaaggggaggtgaagtcctgctcatgcgacccgaagaaaatgggcagtgcaaaggactcaaaaggaatctttgattggggaggttgctccgataacatcgattatggaataaaatttgcacgagcctttgtggatgcaaaggaaaggaaggggaaggatgctcgggctctgatgaatctgcataataaccgggccgggagaaaagcagtaaagcgcttcctgaaacaggagtgcaagtgtcacggtgtctcgggctcctgcacactcaggacctgctggctcgccatggcagatttccggaagacgggagattatctttggagaaagtacaacggagccatccaagtcgtgatgaatcaggacggaaccgggtttactgtcgccaatgagcgatttaagaagcctaccaaaaacgacctggtctatttcgaaaatagccctgactattgcattcgggatcgagaggctggcagtctgggcacagcgggcagggtctgtaatctgacctcccggggcatggattcttgcgaggtgatgtgctgcgggcggggctacgacacctctcatgtgactagaatgacaaaatgtggatgcaagttccactggtgctgtgcggtgaggtgccaggactgccttgaggcactcgatgtacacacatgcaaggcccccaaaaacgccgactggactaccgctacctag

SEQ ID NO: 140670 - DNA, 1113 bp, Artificial Sequence
  Description of Artificial Sequence: Synthetic coding sequence
atgggcctttgggcgcttctcccaggctgggtgtccgccaccttgctgctggccttggccgcgctgcccgctgccctggcggcaaattcgagcgggaggtggtgggggattgtcaatgtcgcctccagtactaacctgctgacggactccaagtcactgcaactcgttctggagccatctctgcagctcctgagccgcaaacagcggcgcctgataaggcagaatccagggattttgcactcggtctcgggtggtctccaatcagcggtacgggaatgcaagtggcagtttcgcaacaggcgctggaactgtccgacggcccctggacctcaccttttcgggaaaattgttaaccgaggttgtcgagaaaccgcttttattttcgctattacctccgccggagtgactcactccgtagctaggtcttgctctgaggggagcatagagagctgtacctgcgactatcggcgacggggtcccggcggccctgattggcactggggcgggtgtagtgacaacattgattttgggaggctctttgggcgtgagttcgtggattcaggtgaaaaaggaagagacctgaggttcttaatgaacctgcacaacaacgaggcaggtcggacaacagtgttctccgagatgcgacaagagtgcaaatgccatggcatgtctggcagctgcactgtccgcacatgttggatgcgcctgcctaccctgcgagctgtaggcgacgtcctccgtgatcgatttgatggtgcctcccgcgttctctatggaaatcgaggcagcaatagagcgtctcgtgccgagttgctacgtttggaaccggaggatccagcccacaagcccccatccccacatgatcttgtgtacttcgagaagtcgcccaatttctgcacctactccgggcgtctcggaaccgctggcacagccggtcgcgcctgcaattcaagtagccccgcactcgatggatgcgagctgctgtgttgcgggcggggccaccgaacacgaacccaacgagttacagaaagatgcaactgcactttccattggtgttgccatgtatcttgtcggaactgcacgcacacaagggtactccacgagtgcctttag

SEQ ID NO: 140671 - DNA, 588 bp, Artificial Sequence
  Description of Artificial Sequence: Synthetic coding sequence
tggcactggggcgggtgcagcgacaacattgattttgggcgtttatttgggagggagttcgtggattccggggagaagggcagagaccttcggttcctgatgaatctgcacaacaatgaagccggccggaccacagtgttttcagagatgcggcaggagtgtaagtgtcacggcatgagcggttcctgcaccgtcagaacatgctggatgagactgccaacattaagggcagttggcgatgttctcagggacaggtttgacggagcctctcgcgtgttatatggaaacagggggtcaaatcgggcgtctcgcgcagaattgctccggctggagccagacctagtatattttgagaagtcccctaacttctgcacctactcaggtagattaggtacagccggaactgctggacgagcatgcaattcttcttcacccgccctggacgggtgtgaactgctgtgctgcggacgaggccaccgcacgcgcactcagcgagtgactgagagatgcaattgcacattccactggtgctgtcacgtgtcttgcaggaactgtactcacactcgggtcctgcatgagtgtctatag

SEQ ID NO: 140672 - DNA, 1254 bp, Artificial Sequence
  Description of Artificial Sequence: Synthetic coding sequence
atggggagcgcccacccgagaccctggcttcgcctgcgaccgcagcctcagccccggccagcgctgtgggtgctccttttcttcctgttgctgctggctgctgccatgccaaggtccgcgcccaacgacatccttgatctgcggttgcctcccgaacctgtgctgaatgccaatacagtgtgcttgacgttgccaggattatcacggagacagatggaagtttgcgtgcggcaccctgatgtagcagccagcgcgattcagggaatccagattgcaattcatgagtgtcaacaccagttccgtgatcagagatggaattgctcctctctggagacccgcaataagattccttatgagtcacctatctttagccgagggtttagggaatcagctttcgcctacgctattgcagctgccggcgtggttcacgcagtgtccaatgcatgcgctctaggcaagctgaaagcatgtgggtgcgacgccagccgacggggagatgaggaggcctttagacgcaagctgcaccggctgcagctagatgccctgcagcgaggaaaagggctttcccacggcgtacccgaacacccggcgcttccgacagcctccccagggctgcaggattcatgggagtgggggggttgtagtccggatatgggcttcggagaacgcttcagcaaagacttcttggatagccgagagccccatcgagatatacacgcccgcatgcgcctgcacaataatcgagtcgggagacaagctgtgatggagaacatgagacggaaatgtaaatgccatggcacgtctggatcctgccagctaaagacatgctggcaagtgacccccgaatttcgcaccgttggtgctctgctgcggtcgaggtttcacagggctaccttgattagacctcacaatagaaacggaggacaacttgagcccggaccggctggggctccatcccctgcccctggtgcccctggaccacgcaggagagcaagtcccgctgacctggtttattttgaaaagagccctgacttctgcgagagggaaccccgacttgatagtgcaggaacggtgggtcgcctgtgtaacaagtctagcgctggatccgatggatgcggcagtatgtgttgcggcaggggacacaacatcctccgccaaacgagaagtgaacgctgtcattgtcgcttccactggtgctgttttgttgtgtgcgaggaatgtcgcataactgagtgggtctccgtctgtaaatag

SEQ ID NO: 140673 - DNA, 1170 bp, Artificial Sequence
  Description of Artificial Sequence: Synthetic coding sequence
atgctggaagaacctcggccacgcccaccaccaagcggtctggctggactgctgtttcttgcgctctgttctcgagcacttagtaatgagatactcggtcttaagctgcctggtgaaccacccctcaccgctaatacagtgtgcctgaccctttccggcctgagcaagcggcagcttggcctctgcctgcgtaaccccgacgttactgcctctgccttgcagggactgcacattgccgtgcacgaatgccagcaccagctcagagatcaaagatggaactgcagcgccctggagggtgggggtaggctaccccatcactctgccattctgaaaagggggttcagggagagcgcattcagttttagcatgctcgctgccggcgtgatgcacgccgtcgccacggcttgttcgttgggcaagctggttagctgcggctgtggctggaagggaagcggagagcaggacaggttgagggccaaactactgcagctgcaggctctgtcacgaggaaagagtttcccgcattccttgccaagtccaggaccgggctcctccccaagtccgggtccgcaagatacttgggagtggggcggttgcaatcacgatatggatttcggcgagaagtttagccgagactttctggactctcgggaggccccccgcgatatccaggcacgcatgagaattcataacaatcgggtgggccggcaagtggtgaccgagaacctgaagcgcaagtgcaaatgtcacggcacctcgggcagttgccagtttaaaacgtgttggcgcgcggctcccgagttcagagccgtgggcgcagcacttcgtgagcgtctcggcagagcaattttcattgacacgcacaatcggaactctggcgcatttcagcctaggctccggcccaggcgtctgtccggagagctggtatactttgagaaatcccccgacttttgcgagcgggatccgactatgggcagccccggcactcgagggagggcctgcaataaaaccagtcgactcctggacggatgcggctcgctgtgttgtggacgcggacacaatgttttacgccagacaagagttgagcggtgccattgtcggtttcattggtgctgctacgtcctctgtgatgagtgcaaagtgacagagtgggtcaatgtctgcaaatag

SEQ ID NO: 140674 - DNA, 576 bp, Artificial Sequence
  Description of Artificial Sequence: Synthetic coding sequence
atgctcgaagaacccaggcccaggccgcctccctctggcctagcagggctgttattcctggcactgtgttcgcgggccctgagcaacgagatcttagggcttaagttgcccggggaacctccactcaccgccaacactgtttgcctcactctgtctggccttagtaaaaggcaattaggactttgccttaggaatcctgacgtcacagcctccgcgctgcagggcttgcatatcgccgtccacgaatgtcagcatcagcttcgggaccagcgttggaattgttccgccctcgaaggtggtggacggctcccccaccatagcgctatattgaaaagaggctttagagaatctgccttttctttctccatgttggccgcaggggttatgcatgccgtggcaacagcatgtagtctcgggaagttagtgtcttgcggatgtgggtggaaaggctctggagagcaggatcggcttcgggccaagttactgcaacttcaggccctgtctagagggaagctgcctggaacgtcgagacatgaatgcgaatctacaactactggctggggcgctcgatggtag

SEQ ID NO: 140675 - DNA, 309 bp, Artificial Sequence
  Description of Artificial Sequence: Synthetic coding sequence
atgctagaggagccccgcccacgccccccgccctccgggctggcagggctgctgttcttagcactctgctcccgcgccctctctaacgagatactcggcctgaagctgccgggtgagccccctctgactgcaaacaccgtttgtctaacattgtctggtctgtccaagcggcaactgggcctgtgcctgcggaaccccgatgtgacagcctcagcactccaggggctccatatcgcggtgcacgaatgccagcatcagctccgggaccaaagatggaactgttcggccttggagggtggaggccgctag

SEQ ID NO: 140676 - DNA, 354 bp, Artificial Sequence
  Description of Artificial Sequence: Synthetic coding sequence
atggccctggagaccgtacccaaagatttgagacatctccgcgcctgtctcttgtgttctttagtaaaaactattgatcagtttgagtacgatggctgcgacaactgtgatgcctacctacagatgaagggtaatcgggagatggtttacgattgtaccagctcatccttcgatggcattatcgccatgatgtctcccgaagatagttgggtctctaagtggcagagagtgagtaacttcaaacctggagtgtacgctgtaagcgtgactgggaggctcccacaaggaatcgtgcgcgagttgaaaagccgcggcgtcgcctataaatccagggacacagctattaagacttag

SEQ ID NO: 140677 - DNA, 1059 bp, Artificial Sequence
  Description of Artificial Sequence: Synthetic coding sequence
atggccccactgggctactttctgttactgtgtagtcttaaacaggctctgggctcgtaccccatttggtggtctctggctgtcggcccgcagtactcctcactcggttcacaacctattctctgcgcctcaatccctgggttagtcccaaaacagctccggttctgtagaaactatgtggagatcatgccctcagtagccgagggcattaagattggcatccaagaatgccaacaccagtttagaggtaggcgatggaattgcaccaccgttcacgattccctcgccatttttggtccagtactggataaggctacgcgggagagcgcttttgtacatgctatcgcttctgccggggtggcttttgccgtgactcgaagttgtgctgagggcacagcagccatctgcgggtgttcaagcaggcatcaaggctccccaggtaagggctggaagtggggcgggtgttcggaggacatcgagtttggcggaatggtctcacgcgagttcgccgatgcccgtgagaaccggcccgacgctaggtcagccatgaacaggcataacaacgaagctgggcgccaggctattgcctctcatatgcacctgaaatgtaagtgccacggcttaagcggtagctgcgaggtcaaaacatgctggtggtcacagccagattttagagccatcggcgacttcctcaaagacaagtatgactccgctagtgagatggtagttgaaaagcacagagagtcacgagggtgggtagaaaccctgcgtccgcgctatacatatttcaaggtgccaactgagcgggacctggtttactatgaggctagccctaacttttgtgaacctaacccagaaacggggagcttcggtacaagggataggacttgcaacgtgagcagccacgggattgacggatgcgaccttctctgctgcggcagggggcacaacgccagagccgagaggagaagggaaaaatgtcgatgcgtgtttcactggtgctgctatgtgtcctgtcaagaatgcacacgagtgtatgatgtgcacacttgcaaatag

SEQ ID NO: 140678 - DNA, 1158 bp, Artificial Sequence
  Description of Artificial Sequence: Synthetic coding sequence
atggcacctcttggttatttcctgcttttgtgctccttgaagcaggctctgggctcctatccaatctggtggtccctggccgttggtccacaatactcttcattggggagtcagccaatactctgtgccagtattcccgggttggtacccaaacagttacgcttctgtcgtaattacgtggaaattatgccatccgtggctgaaggcataaaaatcggcatccaagagtgtcagcaccaattcagaggaagaaggtggaattgtactacggtgcacgacagcctggcaattttcggccccgtcctcgacaaagcgacacgggaatcagctttcgtgcacgctatcgctagcgcgggcgtcgcttttgctgtgacccgcagttgcgccgaaggtactgccgccatttgcggctgcagttctcggcaccaggggagtcctggcaagggctggaaatggggtggctgctctgaagacatcgagttcggaggtatggtatctagagagttcgcagacgctcgcgagaacagaccagatgctcgttccgccatgaaccggcataacaatgaggctggtagacaagccattgcttcacacatgcacctgaaatgtaagtgtcacggactgagtggctcttgcgaggttaaaacatgctggtggtctcagccagactttagagcgatcggagactttcttaaagacaaatatgacagcgcttctgagatggtggtggaaaagcacagggagagccgcgggtgggtcgaaacacttaggccccgttatacgtattttaaagtccccactgaacgggacctggtttactatgaggcctcccccaacttttgcgagcctaaccctgaaacagggagttttggcacccgagatagaacgtgcaatgtctcctcccacggtattgacgggtgcgacctcctctgctgcggcagaggccacaacgcacgcgcagagaggaggcgtgagaagtgcagatgcgtgttccactggtgctgctacgtgtcttgtcaggaatgcactcgagtgtacgatgtgcatacctgcaaaaaccctggctctcgtgccggtaacagcgcacaccagccaccacatccccagcctccagttagatttcaccccccacttaggcgggctggcaaggttccttag

SEQ ID NO: 140679 - DNA, 1056 bp, Artificial Sequence
  Description of Artificial Sequence: Synthetic coding sequence
atgagtccccgctcttgccttagatctttgagattgctggtattcgctgtatttagcgcagctgcgtcaaactggctgtacctcgccaagctttcctccgtcggctcaatttctgaagaagagacctgtgagaagctgaagggactgatccaacgacaggttcagatgtgcaagcgcaacctggaggtcatggactccgtcaggcgcggagcgcagctcgccatcgaagagtgtcaatatcagttccgcaatcgtaggtggaactgttcgactctcgactcactaccagtgtttggtaaagtggtcacccagggtacccgggaggcagcattcgtgtatgctatctcctcagccggagtggcgtttgccgtgactcgagcttgcagcagcggggaattagaaaagtgcggctgtgataggactgtgcatggagtgtctcctcagggctttcaatggtctggatgcagtgataacatcgcatatggcgtagccttctcacagtccttcgtagacgtcagggagcggagcaagggggcgtcctccagccgggccctcatgaacctgcacaataacgaagctggtaggaaagctatcctcacccatatgagagtggagtgcaagtgccatggagtaagcggctcatgcgaagtaaagacgtgttggagggccgttcctcccttcagacaggttggccatgcccttaaggagaagtttgatggcgccaccgaggtagagcccaggcgggtgggaagcagccgggcactggtcccccgtaacgctcagttcaagccgcacactgacgaagacctggtgtatcttgagccatctccagatttctgcgagcaggacatgcgcagcggggttctgggaacccgcgggcggacttgcaacaagacgtcaaaggcaatagatggttgtgagctactctgctgtggaagggggtttcacacggcccaggtggaactggccgaacgctgttcatgcaaattccactggtgctgcttcgttaaatgcagacagtgtcagcgcctcgtcgagttgcatacctgcaggtag

SEQ ID NO: 140680 - DNA, 528 bp, Artificial Sequence
  Description of Artificial Sequence: Synthetic coding sequence
atgagccccaggtcttgcctaagatcccttagactgctggtgttcgcagttttttcagcggccgccagtaattggttgtatctagccaaactgtcctcagtgggctccattagtgaggaggaaacatgcgagaaattgaaagggttgatccagcgacaggtgcagatgtgcaaacgcaatctggaggtcatggattccgtccgtcgcggcgcacagctcgccatagaggaatgccagtaccaatttagaaatagaaggtggaactgctcaaccttagatagcctgcccgtttttgggaaggtggtcacacaaggtggcaaagcttggcatgggggagatagtggttgtcatctgctgactgagagcagaagcggggaacgcacacagcgcaggaaggagggcggttcgttgggccagtgctggcccgaggccatcgtgggaacgcaggatcctatgagatcaccaccttatctttggggcagaaatcaggggggaacccacacagggagcgcttctgaaggccattag

SEQ ID NO: 140681 - DNA, 453 bp, Artificial Sequence
  Description of Artificial Sequence: Synthetic coding sequence
tgatacttggcaaaattatcatccgtgggctccataagcgaagaggagacttgtgagaagctcaaggggctgatacagcgacaggtgcagatgtgtaagcgcaacctggaagtgatggatagcgtcagacggggcgctcagctggccatagaggagtgccagtaccagttccgtaaccgtcgttggaactgttctaccctggatagtttgcccgtgttcgggaaggtcgtgactcagggaggtaaggcctggcacggaggggattctggttgtcacttactgaccgagtccaggagcggcgaaagaacacaaagacggaaagaagggggatccctggggcagtgttggcccgaggccatcgtgggaacccaggacccgatgagatcccccccttatttatgggggagaaatcaaggaggaacccataccgggagtgcaagtgaggggcattag

SEQ ID NO: 140682 - DNA, 159 bp, Artificial Sequence
  Description of Artificial Sequence: Synthetic coding sequence
atgtgcaaacgcaaccttgaggtcatggattcagtccggagaggagcacagttggctattgaagaatgtcagtatcaatttaggaacagaagatggaactgttcaacgttagactcactgccagtgtttggaaaagtggtcactcaagggggaaagtag

SEQ ID NO: 140683 - DNA, 891 bp, Artificial Sequence
  Description of Artificial Sequence: Synthetic coding sequence
atgtgcaagaggaatcttgaggtcatggattctgttcgcagaggcgcacagctggctatagaggagtgtcagtaccagtttcggaaccgcaggtggaattgctctactctggatagtctgccagtgttcgggaaggtagtaacacagggaacccgggaagcagcatttgtttacgctattagcagcgcaggggtagcgttcgctgtaacacgagcctgcagctcaggcgagctcgaaaagtgcggttgcgaccgcactgtccacggggtgtctccacaagggttccagtggagcgggtgcagtgataacattgcctacggggttgcattttcccaaagtttcgttgacgttcgcgaacgctccaagggggcgtcttccagcagggctcttatgaacctgcacaataatgaggcaggaaggaaggcgatcttgactcacatgcgcgtggagtgtaaatgtcacggcgtgtctggctcgtgcgaagtaaaaacatgttggagagcggtccctccctttcgccaggttggtcacgccctcaaggagaaattcgacggggctaccgaagtggagccacgccgagtagggagcagtagagctcttgtcccacggaatgcccagtttaagcctcacaccgatgaagacctcgtgtacctcgagccctcccccgatttctgtgaacaggatatgcgaagcggggtcctgggaacccgaggaagaacgtgtaacaaaacatccaaagctatcgacggatgtgagctgctgtgctgtggacggggttttcacaccgctcaggttgaattggcagagcgctgctcttgcaaattccattggtgttgtttcgtaaagtgtcggcagtgccagagattagtggagcttcatacgtgtcgatag

SEQ ID NO: 140684 - DNA, 1710 bp, Artificial Sequence
  Description of Artificial Sequence: Synthetic coding sequence
atgaaagtgctcctgcgactcatctgcttcatcgccctgctgatttcatccctcgaggccgacaagtgcaaggagagggaggagaaaatcatcctcgtttcctcggccaacgagatcgatgtgcggccttgccctctgaacccgaacgagcacaagggcaccattacatggtacaaggatgacagtaagacgccagtctcaactgagcaagccagcaggattcaccaacacaaggagaagttgtggtttgtgccagccaaggtggaggattcaggccactactattgcgttgtgcgaaattcctcgtattgccttcggatcaaaatttccgcaaagtttgtggaaaacgaaccaaacctctgttacaacgcccaggcgatcttcaagcagaaactcccagtggccggggatggaggattagtttgcccttacatggagttcttcaaaaatgagaacaacgaactaccaaaactacagtggtacaaggactgcaaacctctgttgctggataatattcacttctccggggtcaaagatagactgatcgtgatgaatgtggccgaaaaacaccgcgggaattacacatgccacgcttcttacacgtacctgggcaagcaatacccaatcacccgagtcatagaattcattacgctcgaagagaacaagccaacaagacccgtaatcgtctcacctgcgaacgaaacgatggaggtcgatctcggtagccagattcaactcatttgcaatgttaccgggcagctgagcgatattgcctactggaaatggaacgggtccgtgattgatgaagatgaccccgtgctgggagaggattactactcagtggaaaaccccgccaacaaaagacggtccacactcatcactgttctaaatatctctgaaatagagagtcgcttttataagcatccgttcacatgcttcgccaagaacacacacggcattgacgctgcatatattcagttgatctatcctgtcactaattttcaaaagcatatgattggcatctgtgtgacactgactgtcatcatcgtctgttccgtgttcatctacaaaatatttaaaatcgacattgttctgtggtacagggattcatgttacgactttttaccgattaaagctagtgatggaaagacatacgatgcctacatcctatacccaaagactgtgggcgaaggttctactagcgattgtgacattttcgtcttcaaagtgctgcccgaagtgttagaaaagcagtgcggatacaagctctttatctatggccgagatgattacgttggcgaagatatcgttgaagtcatcaatgaaaacgtgaagaaatccagaaggctgatcattatcctcgtgagggaaacttcaggcttctcttggctgggggggagttctgaagaacagattgcaatgtacaatgccctggttcaggatgggatcaaagtagtgctgttggagctagagaagatacaggactacgaaaaaatgccagagtctatcaagttcatcaaacagaaacacggcgccatacggtggagcggggacttcacccaaggtccccagtccgccaaaacccggttttggaaaaatgttaggtatcacatgcccgtgcaaaggcgaagtccttcctcaaaacatcagctgctcagccctgccacaaaggagaagcttcagagggaagcccacgtgccattagggtag

SEQ ID NO: 140685 - DNA, 1050 bp, Artificial Sequence
  Description of Artificial Sequence: Synthetic coding sequence
atgaatcggaaagctcgcaggtgtttagggcacctgttcctctccctgggtatggtgtatctgcgtatcggcggtttctcttccgtagtggctctgggggccagcatcatttgtaataagattccaggattagcacccagacaaagagccatctgtcagagccgtccagacgccatcatcgtcatcggagagggtagccagatgggtctggatgagtgccagttccaattcaggaacgggagatggaactgctctgcattaggggagcggactgtgtttgggaaggaattgaaagtgggctcccgggaagctgctttcacatatgcgatcatagccgcaggcgtggctcacgctattactgccgcctgcacccagggcaacctgtcggactgcggatgcgacaaggagaaacagggtcagtaccatagagacgaggggtggaagtggggtgggtgctctgctgatatccgctacggcattggattcgccaaggtatttgtggacgctagagaaataaaacagaacgctcgcactctcatgaatctccacaataacgaagccggccggaagattctcgaggaaaacatgaaactggagtgtaaatgccacggagtgtccgggagctgcacgaccaagacctgctggaccaccctgccccagtttcgtgagttaggatatgtgctgaaagacaagtacaacgaggctgtgcatgtcgagcccgtccgcgcctcccgcaacaagagacccacctttctcaagatcaagaagccccttagttatcgcaagccaatggataccgacctggtgtacatcgagaaaagcccaaattactgtgaggaggatcccgtgaccggatcagtcggcacccaaggtagggcatgcaacaaaacagcgccccaggcctcaggctgtgacctgatgtgctgtggacgcggttacaacactcaccagtacgcacgggtctggcaatgtaactgcaagtttcactggtgctgttacgtgaagtgtaacacctgtagcgagcgcactgaaatgtatacatgtaagtag

SEQ ID NO: 140686 - DNA, 1050 bp, Artificial Sequence
  Description of Artificial Sequence: Synthetic coding sequence
atgcataggaacttcaggaaatggattttctacgtttttctgtgcttcggggtcctctatgtgaagctgggagccctgtcctcagtggtggctctgggagccaatatcatatgcaacaagattcctggacttgctccaaggcaacgtgcaatttgccagtcacgccctgatgccatcatcgtgattggcgagggcgcacaaatgggtattaatgagtgccagtaccagttccgtttcggccggtggaattgttctgccctgggagaaaagaccgtgtttggccaggagctccgtgtcggatctcgagaagcagcatttacctacgctattacagccgctggagtggcccatgccgtgacagccgcctgctcccagggaaacctttcaaactgtggatgtgatcgcgagaagcagggatattacaatcaggccgaagggtggaagtggggaggatgttccgccgacgtgagatacgggatcgacttctcccgcaggtttgtcgacgccagggaaataaaaaagaatgcgcgtcggctgatgaacctgcacaacaacgaagccgggagaaaagtgctggaggacaggatgcagttggagtgcaagtgccatggcgtctcaggaagctgtactacgaagacctgttggacgactctgccaaagtttagagaggttggccacctgctgaaggaaaaatacaatgccgccgtgcaagtggaggtggtgagggcgtccagattgcgtcagccaacttttctacgcatcaaacagctgcgtagctaccagaagccaatggaaacagacctcgtctacatcgagaaatcacccaactactgcgaggaggacgcagctacggggtctgtcggcactcagggccgtctctgcaataggactagccccggagccgacggctgcgatacgatgtgttgcggcagagggtacaacactcaccaatatacgaaggtatggcagtgcaactgcaaatttcactggtgctgttttgtgaaatgtaatacatgctctgaaaggacagaagtgttcacatgcaaatag

SEQ ID NO: 140687 - DNA, 1062 bp, Artificial Sequence
  Description of Artificial Sequence: Synthetic coding sequence
atgctactgttgtctcccaggagtgctctcgtgagtgtctactgtccacagattttcctgctcttatcgtctggtagctacctcgctcttagtagcgtggtggctttgggtgctaatataatctgcaacaaaataccaggcctcgcaccgcgtcaaagagccatttgccagagtcgccccgatgcaattatcgtcatcggagagggcgcccagatgggcattaacgagtgccagtaccaattcaggttcggccgatggaattgcagcgctctgggggaaaaaactgtgtttggccaagagttgagagtggggtctagagaagcggctttcacctatgcaatcactgccgcgggcgtggcccacgctgtgaccgccgcctgtagccaagggaatctttctaattgtgggtgcgatcgcgagaaacagggttactataaccaagctgagggctggaagtggggcggatgttccgccgacgtgcgttacgggatagactttagccgaaggtttgtcgacgcgcgggaaataaagaaaaatgccagaaggctgatgaaccttcataataacgaggctggtcggaaagttctggaggatagaatgcagctggaatgcaagtgccacggggtatcaggcagctgcaccacaaaaacatgctggaccactctgccaaagtttcgggaagtggggcacctgttaaaggaaaagtacaatgctgcagtgcaggtggaagtagtacgtgcgagtcggctccgtcagccaacattcctccggattaagcagcttaggtcttaccagaaacccatggagactgacctggtatatatagagaagtcccccaattactgcgaggaagacgccgccaccgggagcgttggtactcagggacggttatgcaatcgtaccagtcccggcgctgatggctgcgacacaatgtgctgtgggcgcgggtataacacccatcagtacaccaaagtgtggcagtgtaactgtaaattccactggtgctgtttcgtaaagtgcaacacctgctccgagcgcacagaagtatttacttgcaagtag

SEQ ID NO: 140688 - DNA, 618 bp, Artificial Sequence
  Description of Artificial Sequence: Synthetic coding sequence
atgcacagaaattttcgaaaatggattttctacgtgtttctctgcttcggggtcctgtatgtgaagctgggtgcattgtcctctgtcgtcgccctcggggccaatattatctgtaataaaatacccggactggcccctaggcaacgggctatatgccaatctcgccctgatgccattatcgttataggtgagggggcacagatggggataaatgagtgccaataccaatttagattcggtcgatggaactgtagcgctctaggagagaaaacagtcttcggccaagagttgagggtcgggtctcgggaggctgcctttacatacgcgataacagccgcaggtgtggctcacgcagttaccgccgcatgcagtcaaggcaacctttcaaactgcgggtgtgatcgggagaagcaaggctactacaaccaggctgagggttggaaatggggtggatgcagcgctgacgtacgctatggaatcgatttcagcaggcgtttcgtcgatgcacgggagattaagaaaaatgccaggcgactgatgaatctccacaataatgaggcgggcaggaagggcctgctgggccaacctagagttacatcatcccctctattcccatag

SEQ ID NO: 140689 - DNA, 1002 bp, Artificial Sequence
  Description of Artificial Sequence: Synthetic coding sequence
atgagtgcgccacccttttacagggccctcagcagtgtcgtggccttaggggctaatattatctgtaacaagatccctgggctagcaccccgacagcgggccatatgccagtcccggccagacgcaatcatcgtgattggagagggggcacagatgggaattaacgaatgtcagtaccaatttaggttcggtcggtggaattgcagtgccctaggcgagaagacagtcttcggacaggaactgcgcgtgggctctagagaagcggcgttcacctacgccatcactgccgcgggagtcgcccacgcggtgactgctgcttgttctcaaggaaatctttctaactgcgggtgcgaccgagaaaagcagggttactacaaccaggctgagggctggaaatggggcggctgctctgcagatgtccggtacgggattgacttcagtcgcagattcgtagatgctagagaaatcaaaaaaaacgcgagaagactgatgaacctgcacaacaatgaggccggccgtaaggtattggaggatcggatgcagctcgagtgcaaatgccacggggtgagtggatcctgcacaaccaagacttgttggaccaccttgccaaaatttcgggaggttggtcatctcctgaaagagaaatacaatgcggccgtacaggtcgaggtggtccgcgccagcaggctgcgccaacccacttttctgcggatcaagcaactgcggtcttaccaaaaacccatggagaccgatctggtttacatcgagaagagccctaactactgcgaggaagatgcagctaccgggagtgtcgggactcaagggcgactatgtaacagaacctcccccggcgcagacggatgcgacaccatgtgctgtgggcgagggtacaacacccatcagtatacaaaagtttggcagtgcaactgtaagtttcattggtgctgcttcgttaagtgcaacacctgctcggagcggactgaagtgttcacgtgcaagtag

SEQ ID NO: 140690 - DNA, 174 bp, Artificial Sequence
  Description of Artificial Sequence: Synthetic coding sequence
atgggtatcaacgaatgccagtaccagttcagattcggccggtggaactgttctgccttgggcgaaaaaacagtattcggacaggaactacgcgtcggttctcgcgaagcagcattcacctatgccatcaccgccgctggggtggcccacgccgttacagcggcctgtagttag

SEQ ID NO: 140691 - DNA, 1056 bp, Artificial Sequence
  Description of Artificial Sequence: Synthetic coding sequence
atgttcctgtctaaacccagcgtctacatctgtctttttacatgcgttctgcagctgtcccatagctggagtgttaacaacttcctgatgacggggcctaaagcttacttaatttatagcagttccgtcgcagcgggcgcccagtccggaattgaggaatgtaaatatcagtttgcgtgggatcggtggaattgtccggagcgagcactccaactgtcctcacatggaggtttacggagcgccaatcgagaaaccgccttcgtgcacgccatttcttctgctggcgtgatgtatacacttacccggaactgctcactcggcgacttcgataactgcggctgcgacgactccaggaacggacagctgggcggccagggatggctctggggaggctgttctgataatgtggggttcggcgaagctatttccaagcaatttgtagacgcactcgaaaccggacaagatgcccgagccgcaatgaacctgcacaacaatgaggctggacgaaaggcggtgaagggaacaatgaaacgtacctgtaagtgtcacggcgtttcaggatcctgcaccacccagacgtgctggctccagttgccggaatttcgcgaagtgggcgcccacctcaaagaaaaataccatgccgcgctcaaggtggacttgttgcagggagcaggcaattctgcggctggtaggggtgcaattgccgataccttccgatccatttctacccgtgagctcgtgcatctggaagacagtccagactactgtctggaaaataagacactcggactccttgggacagagggccgagaatgtctgcgcagggggagggcactgggtcgctgggagaggcgatcttgtagacgtctctgtggcgactgtggcctcgctgtggaagaaaggagggctgaaaccgtttctagctgtaactgtaaattccattggtgctgcgctgtgcggtgtgagcaatgtcgacgccgcgtgaccaaatacttctgtagtcgggctgagcgcccaagaggaggtgccgctcacaaaccaggtcgaaagccatag

SEQ ID NO: 140692 - DNA, 1209 bp, Artificial Sequence
  Description of Artificial Sequence: Synthetic coding sequence
atggatctggatagagccagtctggaccttatgatcagattgctcgagctcgagcaggacgccagtagtgcaaaattgctcaacgagaaagacatgaataaaataaaggagaagatccgccgcctgtgtgagacagttcataacaagcatctagatcttgagaacatcaccacaggccatttggccatggagacgttactctccctgacctcaaagcgtgctggcgactggttcaaggaggagttgaggctgctcggcggactagaccacatcgttgacaaagtgaaagagtgcgtggatcatctgtcaagagacgaggacgaggagaaactggtcgccagcctttggggtgccgagcgttgcctgcgggtcctggaaagcgtgaccgttcacaacccggagaatcagtcgtatctgatagcatataaggattcccagctaatagtgtcctccgctaaggctctgcagcattgcgaggaactgatacagcagtataaccgagctgaggatagcatctgcttggccgactccaaacctctgccgcaccaaaacgtgacaaaccacgtgggtaaggccgtagaagattgcatgcgtgcaatcattggggtactcctgaatctgaccaacgacaacgaatgggggagcacaaaaacaggggagcaagacggattgattggcaccgccctgaattgcgtgctgcaagttcctaaatatctcccccaggagcagaggtttgatatcagggtgttgctgttcctcgagagggagagggcagctcagctggccgagtctaaaaccgatgaactgattaaggatgccccaaccacgcagcatgataagagcggtgaatggcaagagacatcaggtgaaatccaatgggtttcaacggaaaagacagatggtaccgaagagaagcacaaaaaggaggaagaagacgaggaattggatctcaataaagcactccagcacgcaggcaagcatatggaggactgcatagtggcgagctacacggcactcttgttgggctgtctctgccaggagagccccataaatgtgacaacggtacgcgagtacctacctgaaggtgatttcagcattatgacggagatgcttaagaagttcctctccttcatgaacttgacttgcgccgtgggcacaactggacagaagagtattagccgcgtgatcgagtacttagaacactgctag

SEQ ID NO: 140693 - DNA, 3573 bp, Artificial Sequence
  Description of Artificial Sequence: Synthetic coding sequence
atgactagtaggttcggcaagacctactcaaggaaaggaggcaatggttccagcaagtttgacgaagtgttttctaataaaaggacgaccctgtccacaaaatggggcgaaacaacatttatggccaaactagggcagaaacgccccaactttaaacctgatatacaggagattccaaaaaaacctaaggtggaagaagaatccacaggggatccattcggcttcgatagcgacgatgagtctctgcccgtcagctctaaaaacttggcacaagtcaagtgttctagctattcagaatcctccgaggccgcccagcttgaggaagtgacctctgtcctagaggccaactcaaagatcagccacgtcgttgttgaagataccgtcgtttctgacaaatgctttcccttggaggacacactcttgggcaaggagaaatccaccaacagaattgtggaggacgacgcttctatatcctcatgcaataaactgatcacgagcgacaaagtggaaaatttccatgaggagcatgagaaaaactcccaccacattcataagaatgccgatgactcaactaagaagccaaatgctgagacgaccgtggcaagtgagatcaaggagacgaatgacacctggaactcccagtttggtaaacgcccagagagtccatcagagatctcgccgatcaagggatcagtccgtaccggactttttgagtgggacaacgattttgaggatatccgttcagaggactgcatattaagccttgactccgatccattgctagagatgaaagatgacgatttcaagaatcgactggaaaacttgaacgaggcgatcgaggaggacatcgtgcaatctgtgctgagacctaccaattgtaggacgtactgcagagccaataaaacaaagagctctcagggagcaagcaactttgataaactgatggacgggaccagccaggcactggcaaaggccaattcagagagtagcaaagacggcctgaatcaagctaaaaagggcggcgtgtcgtgcggaacatcatttagggggacagtgggtagaacccgcgattatactgtgctgcaccccagctgcctgtctgtctgtaatgtgactatccaagacacaatggaacgctcaatggatgagttcacagccagtacccctgcagacctgggggaggctggcagattaagaaaaaaggcggatattgctacatcaaagacgactacccgttttaggcccagcaacaccaaaagcaaaaaagacgtcaaactggagttctttggcttcgaagaccacgagaccggtggcgacgagggaggttccggatcctccaattataagattaagtattttggatttgacgatctgtcagaaagcgaggacgacgaagatgacgactgccaggttgaacggaagaccagcaaaaagcgtaccaagactgctcctagtccctctcttcaacccccaccagagtctaacgataatagccaagactctcagagcggcactaacaatgcagagaacctggattttacagaagacctccctggagttcctgagtctgtgaaaaagcccatcaacaaacagggagataagtcgaaggagaatacccggaaaatatttagcggccccaagcggtcccccacaaaggctgtttacaatgcccgccattggaatcatcctgatagcgaggaactgcctggaccccctgtggtgaaaccgcagtccgtgactgtccgcctctcttccaaggaacctaatcagaaagatgacggagtctttaaggctccggcgcctccttcaaaagtgatcaagacagtgacaattcccactcagccctaccaggatatcgtcaccgcactgaagtgtcgaagagaagacaaagagctgtataccgtcgtacagcacgttaaacattttaacgatgtcgttgagttcggagaaaatcaggagttcacggacgacatcgagtatctgttgagtggcctcaaatctacccaacctctcaatactcgatgcttgtcagtgatttctctagccactaagtgtgcaatgccctctttccgcatgcacctccgggcccatggaatggtcgccatggtgttcaaaactctggatgacagccagcaccaccaaaacctaagtttatgcacagccgcgctgatgtacatcctctccagagaccggctcaacatggacctggatagggccagcctcgacttaatgatccgccttctggagttggaacaggacgcctcctctgcgaagcttcttaatgagaaagacatgaataaaattaaagagaaaattcggcgcctatgcgaaaccgtgcacaataaacatcttgacctggagaacatcaccaccggtcaccttgctatggagacactcctttcgctgacctccaagcgggcgggcgactggttcaaagaagaactgagactcctcggtggtcttgaccacatcgtagacaaagtgaaggagtgtgtggaccacctttcgagggacgaggacgaagagaaactggtcgccagtctgtggggagccgagcgctgccttagggtgcttgagagtgtgacagtgcacaatcctgaaaaccaaagctatctgatagcctataaagactctcaacttatcgtgtccagcgctaaagctctgcagcactgcgaggaactgatccaacagtacaatcgagcggaagatagcatatgcctggcagattcaaaacctctgccgcatcagaatgtgaccaaccacgtcggcaaagccgttgaggactgcatgcgcgccatcatcggggtcctgctgaatctgactaacgataacgaatggggtagtacaaagaccggagaacaggatggtttgatcggaacggcactgaattgcgtgcttcaggttccaaaatacctgccccaggaacagagattcgatataagggtgctaggcttgggtcttctgattaatctagtcgagtacagcgcaagaaatagacattgcttagtgaatatggaaaccagctgtagcttcgactcctcaatctgcagtggcgagggtgacgattccctgcggataggagggcaggtgcacgcagtgcaggctctcgttcaactcttcttggagagagagagggctgcccaattggccgagtcaaaaacagatgaactgattaaagatgctcctacgacccagcatgataaatccggagagtggcaggaaacatcaggcgaaattcagtgggtgagtacggaaaaaaccgacggcaccgaggaaaaacacaaaaaggaggaggaggacgaggaattagacctgaacaaagcactccagcacgctggcaagcacatggaggactgcattgttgcctcctacacagccctactcctgggctgtctgtgccaggagtcaccaatcaatgtgaccactgtgcgggagtatttgcctgagggggattttagtattatgactgaaatgctaaagaaatttctatccttcatgaatctcacctgcgcagtcggcacaacaggtcaaaaaagcatatcccgcgtgatcgaatacttggaacactgctag

SEQ ID NO: 140694 - DNA, 3828 bp, Artificial Sequence
  Description of Artificial Sequence: Synthetic coding sequence
atggtacagggccccgtgcaaaccccagccctgacaatccatcgaaggaagcgccgacgctcctgccctcccaatcgcgcatcctacctgcccaaggccgaatccctggcttcactgggctctcacctgcccgctttactatcacgcgctcgtgtgcctaggccgccggcagggagacgcgaaagggaacgcagacgtcggcctgttgcaaaggctccagcacgccttagaggcgaatatgagactggggtcaagatgactagcaggttcgggaagacttattccagaaaaggaggtaacgggagcagcaaatttgacgaggtttttagcaacaaacgcaccactctgtctaccaagtggggtgagacaacatttatggccaaactcggccagaaaagacccaacttcaagccggacatccaggaaatccccaaaaagcccaaagtggaggaagagagtaccggcgatcccttcggctttgactccgacgacgagtcgttgcctgtttcatcaaagaacctggcacaagtaaagtgctcgtcttactctgagtcatcagaggcagctcaactggaggaggttacctcagtactggaagctaactctaaaatttcacacgtagtggttgaggacaccgtcgtctctgacaaatgttttccgctcgaggacacactcctggggaaggagaagtccaccaacaggatagtggaagatgacgcgagcataagctcttgcaataagcttattacctccgacaaagtagagaatttccacgaagaacatgaaaagaactcccaccatatacacaaaaatgccgacgacagtaccaaaaaacctaatgccgaaaccacagtcgcatcagaaataaaggagaccaacgacacatggaattctcagttcgggaagcgtcctgagagcccttctgagatttctccgattaagggctcagtgcggaccggactgtttgagtgggacaacgatttcgaggatattcggtctgaagactgtatcctgtctctggactctgaccctcttcttgagatgaaagacgacgatttcaaaaatcgtctggaaaatctgaatgaagccatcgaggaggatatcgtacaatcagtgttgcggcccaccaactgtcgaacctactgtcgcgcaaacaagacgaaaagctcccaaggggccagcaactttgataaactcatggatggtacctcgcaagccctggcaaaagcaaactccgagagcagtaaggacggactgaatcaggcaaagaaggggggcgtctcatgcggtacctcctttcggggtacggtgggcagaacgagggattatacggtgctgcacccctcgtgccttagtgtctgcaatgtcaccatccaagacacaatggaacgaagtatggacgagtttaccgcctccacccctgccgacctgggggaggccgggcgtctgagaaaaaaggcggatatagcaacatctaagactacaacccggtttcggccttccaatacaaagagcaaaaaggatgtgaagctagagtttttcggtttcgaagaccatgagacagggggagacgaagggggaagtgggtctagcaattataaaataaaatactttgggtttgatgatctctctgaatctgaggatgatgaggacgatgactgccaggtagagaggaagacaagcaaaaagagaaccaaaactgcccctagccctagcctgcagccgcctcccgaatccaacgacaattctcaggacagccaaagcggtacaaacaacgcggagaatctggactttaccgaagatctgcctggcgtgcctgagtccgtgaaaaagccaattaacaaacaaggtgataagtccaaagagaatacgagaaagattttttccggccccaaacggagccccaccaaggccgtctataatgcccgccactggaatcatccagatagtgaggagctgcctgggcctccggttgtaaaaccacagtcggttacagtgcgcttgtcttctaaggaaccaaatcagaaagacgacggtgtgtttaaggccccagctcccccaagcaaagttatcaagaccgttaccatccccacccagccctaccaagatattgtcaccgcgctgaagtgccggagagaggataaagagctgtacactgtcgttcaacatgtcaagcactttaatgacgtggttgagttcggggaaaaccaagagttcactgacgacatcgagtatctgctttcaggcctcaaaagcacccagcctctgaacactagatgtttgtctgtgatctccttggctacaaaatgcgctatgccctccttcaggatgcacctgagagctcacggcatggtcgccatggtctttaagactcttgacgacagtcaacaccaccagaatctgtctctttgcacggcggcacttatgtatatcctcagtcgagatcgcttaaatatggatttggatagagccagcctggacctcatgattcgattgctagagctcgagcaagacgctagcagtgcaaaactgctcaacgaaaaggatatgaataaaatcaaggagaagatccggcggttgtgtgagactgtacataacaagcacttagatctggagaatattaccactgggcacctagccatggagacactcctgagtcttacctccaagcgcgccggcgactggtttaaagaagagctgcgactgctcggcggtctggaccacatcgtggacaaagtgaaagaatgtgttgatcacctctcacgggatgaggacgaagagaaactcgtcgcctcactctggggagcagagaggtgcctgagggtgctggagtcagtgacagttcataacccggaaaaccagtcctacttgattgcgtacaaagacagtcagctcatcgtgtccagtgccaaggccctgcagcactgcgaagagctaatccaacagtacaaccgcgccgaggattccatatgcctggcagattcaaaaccactcccgcaccagaatgtgaccaaccacgtcggcaaagctgtggaagattgtatgcgcgccataatcggggtccttctcaatctcactaacgataatgaatgggggtctacgaaaaccggggagcaggatggacttatcggaactgcattgaattgcgtactgcaggtgcctaagtacctgcctcaggagcagcggtttgatataagagtgttgggcctgggacttctgattaatctggtggaatactcagcgcggaatcgccattgcttggtcaacatggaaacgtcctgctcattcgacagcagcatatgttctggcgaaggcgacgatagcctacggattggaggccaggtgcacgcagtccaagcacttgtgcagttgtttctggagcgcgagcgcgccgcccagcttgctgagtccaagactgatgagctgatcaaagacgcacccactacccagcatgataaatcaggcgaatggcaggagacatctggagagatccaatgggtctcaaccgaaaagacagatggtaccgaggagaagcataagaaagaagaagaagacgaggagttagacctgaacaaggccttacagcatgctggcaaacacatggaggactgcatcgtagccagttacaccgccctactgctgggatgtctttgccaagaaagcccaatcaacgtgaccaccgtccgggagtacttgcccgaaggcgattttagcattatgacagagatgttgaaaaaatttctgagttttatgaatctgacatgtgccgtggggacaactggccagaaatcaatctcccgcgtcattgaatacctcgaacactgctag

SEQ ID NO: 140695 - DNA, 1209 bp, Artificial Sequence
  Description of Artificial Sequence: Synthetic coding sequence
atggacctcgatagagcatctctcgacctgatgatccggctccttgagcttgagcaagacgccagctccgctaagcttctgaacgaaaaagatatgaataagattaaagagaagatacgcaggctctgcgagactgtgcataacaagcacctggaccttgagaacattactactgggcatctggctatggagactctgttgagcttaacgtctaagcgggccggggattggtttaaagaagagttgcggctactgggcggcctggaccacattgttgataaggtgaaggagtgcgtggatcatctcagtagagacgaggacgaagagaaactggtggctagcttgtggggagccgaacgttgtctccgcgtgctggagagtgtaacagtacacaatcccgaaaatcagtcctaccttattgcgtataaagattcccaactgatcgtgtccagcgctaaggccctgcagcattgcgaagagctgatccagcagtacaatcgggccgaggactctatctgtctggccgactcaaagcccttgccgcaccagaacgtgacaaaccatgtggggaaggcagtagaagactgcatgagggccattattggcgtgctattaaacctcacaaatgacaacgagtgggggtcgaccaagactggagagcaggacggattgatcggtaccgcgttgaattgtgtgcttcaggttccgaagtaccttccacaggaacaacgcttcgacatcagggtgctcctgtttctggaaagagagagagcagcccaactggcagaatctaaaaccgacgagctcatcaaggacgcccctacaactcagcatgacaagtccggggagtggcaggagactagtggggagattcaatgggtaagcaccgagaagaccgatggcacagaggagaagcacaagaaggaagaggaggatgaagagcttgatcttaataaagctcttcagcatgcaggtaagcacatggaagactgtatcgtggcttcttacacagccctcctgctggggtgtctatgtcaagaaagtcccattaatgttaccacggtcagagaatatttgcctgaaggcgatttttccatcatgactgagatgctcaagaaattcctgtctttcatgaatctgacttgtgccgtcggcacgaccggacaaaagtcaattagcagggtcatcgaatacctcgaacattgctag

SEQ ID NO: 140696 - DNA, 3828 bp, Artificial Sequence
  Description of Artificial Sequence: Synthetic coding sequence
atggtgcagggcccggtgcagacacctgcattgacaatccacagacgcaagcggcggcgctcttgtcctccaaaccgcgcctcctatctccctaaagcagaaagcctggcatctctagggagtcacctcccggcactgctctctcgcgctcgagttccgcgcccccctgcaggccgtcgcgagagggaaagaagaagaagacccgttgctaaagcaccagcacggctgcgcggggagtatgaaaccggggtgaaaatgaccagcaggtttggaaagacatactccaggaagggcgggaatggatcctcgaagttcgatgaagtattcagcaataaacgcaccaccctgagtactaaatggggcgagacaactttcatggccaagttaggacagaagagaccgaacttcaaaccagatatccaggagattccaaaaaaaccaaaggttgaggaggagagcaccggcgatccattcggttttgattcagacgatgaaagcctccctgtcagtagcaaaaacctggctcaggtcaaatgcagttcttacagcgagtcatctgaagcagctcagctcgaagaggtaacttctgtgcttgaagctaacagcaagatctctcatgtcgtggtcgaagacacagtggtgagtgataaatgtttccccctggaggacacactgttaggaaaggagaagtctacaaacaggattgtggaggatgatgccagcattagcagttgcaacaagctcattacaagcgataaagtggaaaactttcacgaagaacacgagaaaaatagtcaccacatccataagaacgcggacgactcaactaaaaaacccaatgcagaaacaacagtcgcgtctgagattaaggagactaatgacacctggaatagtcaatttgggaaaagacctgaaagtcccagcgaaatctctcctatcaagggaagcgttagaaccggtctgtttgagtgggataatgactttgaggatatcagaagcgaggactgtattctaagcttagacagtgaccccctgcttgagatgaaggatgatgattttaagaatcgtctggaaaaccttaatgaggccattgaggaagacatcgtacagtccgtgctgcggcccactaactgtcgaacatattgcagggctaacaaaacaaaaagttcccagggcgcttcaaactttgataaactgatggacgggaccagccaggcactggccaaggccaacagcgagtcatccaaggatggcttaaaccaagctaagaaaggcggggtgtcttgtgggactagttttcgcggcacagtgggaaggacacgggactacaccgtgctgcatccttcctgtctcagtgtatgtaacgtcacgatccaagatactatggagcgcagcatggatgaattcaccgcttccaccccggccgacctcggcgaggctggtcggctgagaaaaaaggccgatattgccaccagtaagaccaccacacgcttcagaccttctaacactaagagcaaaaaggacgtgaaattagagtttttcggatttgaggatcacgagactggaggagatgagggcggctctggaagtagtaattataagatcaagtattttgggttcgacgatcttagtgaatcagaggacgacgaagatgatgactgtcaggtggagaggaaaacgtcaaagaaaaggaccaaaaccgctccttcgccgagtctccagccccccccggagtctaacgataacagccaggattcccaaagcgggaccaacaacgctgagaacctggactttaccgaagatctgcccggcgtgccagagagtgtgaaaaagcccatcaacaaacagggtgacaagagcaaggagaacacccggaagatcttcagcggtccaaaacggagcccaaccaaggctgtctataacgcccgccattggaatcaccccgactctgaggagcttcctggtccccccgtggtgaagccccagtcagtgacggttaggctcagctcaaaagagcccaatcaaaaggatgatggcgtgttcaaggccccagccccaccctccaaggtgatcaagacagtaactatcccgacacaaccataccaagacatcgtaaccgccctgaagtgccgaagggaagataaagagctgtataccgtggtacagcatgttaagcactttaacgacgtggtggagttcggggagaaccaggagttcactgacgacatcgaataccttctttctggcctgaaatccactcagccactcaatacaaggtgcctaagcgtcatttccttggccacaaagtgcgccatgccttcattcagaatgcacctgcgcgcgcatggaatggtcgcaatggtgttcaagacactggacgactcccagcaccaccagaatctgagcctctgcaccgcagctttgatgtatattttatccagagatcgcctgaatatggatttggacagagcctcgttggatctgatgattaggttgcttgagctcgaacaagacgcctcctctgccaaactgctgaatgagaaggatatgaataagattaaagagaagataagaagattatgcgagactgtgcataacaaacacctggacttggagaacatcaccaccggacatctggctatggaaactctgctaagcttaacatccaagagagccggcgactggttcaaggaggaattgcggctgcttgggggcctggaccacatcgtcgataaggtcaaggaatgtgttgaccacttgagcagggatgaggacgaggagaagctggtagcgtccctttggggagcagagagatgcctgcgtgtgttggagtcagtgacggtgcataatcccgagaaccagagttatctgatcgcctacaaggactcccagctgattgtctcttctgctaaagctctccaacactgtgaagagttgatccagcagtacaacagggctgaggatagcatctgtctcgcagattcgaaacccctccctcaccaaaatgtcactaatcatgtggggaaagccgtcgaggactgcatgcgggcaattattggtgtgttattaaacctgactaacgacaacgagtgggggagcaccaaaactggggagcaagacgggcttatcggaacagcattgaactgcgtactacaggtgccaaagtatctccctcaggagcagcggtttgacattagagtactgggcctggggttgcttataaacctggtcgagtacagtgcacggaatcggcattgccttgtcaatatggaaactagctgttccttcgatagctccatctgcagcggtgagggagacgactcccttcgcatcggcggccaggtccatgctgtgcaagccctggtgcaattatttctggaacgcgagcgggcggcgcagctcgccgaaagcaaaactgatgaacttatcaaggatgccccaacaacacagcatgacaaaagcggggagtggcaagagacaagcggggagatccagtgggtgtcgactgagaaaaccgatggtacagaggaaaaacacaagaaggaagaggaagacgaggagctggatctaaacaaagccctgcaacatgccgggaaacatatggaggactgcatcgtcgcctcatacaccgcactactactggggtgtctgtgccaagaatctccaattaatgtcaccaccgtgagggagtatctgcccgagggggatttctccattatgacagagatgctcaaaaaattcctgagttttatgaacctgacctgcgcggtgggcaccaccggccagaaatcaattagccgtgtgatcgagtacctggagcactgctag

SEQ ID NO: 140697 - DNA, 1509 bp, Artificial Sequence
  Description of Artificial Sequence: Synthetic coding sequence
atgtctggaggccctatgggtggaaggcctgggggtcggggggcaccagctgtgcagcagaacattccctcaactctgctacaagatcacgagaaccagcggctatttgaaatgctcgggcggaagtgcctgactttggcaactgcagtggtgcagctgtatttagcgctcccgcctggcgcagagcactggaccaaggagcactgtggggccgtatgcttcgtcaaagacaacccccaaaagagttatttcatccgcctgtacgggcttcaggccggaagactgttgtgggagcaggagctgtacagtcaattggtgtactctacgcccaccccatttttccacacgttcgctggcgatgactgtcaggctggcctgaatttcgccgacgaggacgaggctcaggcttttagagcgctggtgcaggaaaaaatccagaagagaaaccaaaggcagtccggtgaccggagacagctgccacctcccccaacacctgcgaatgaggagcggagaggggggttgcctcccctgccactgcatcccggcggagaccagggcggccctccggtgggtccgctctctctcgggctcgccaccgtcgatatccagaacccggacattacctcaagcaggtaccgaggactcccggctcccggcccatcccccgcggataaaaagcgtagtgggaagaaaaagattagtaaggccgacataggagcacctagcgggttcaaacacgtgtctcatgtcggttgggatccccaaaacggctttgacgtgaacaatctcgatcctgatctcagaagccttttctccagggccgggatctccgaagcgcagctcaccgatgccgaaaccagtaaactgatttacgattttattgaggatcagggcggattagaggcggtcaggcaggagatgcggcggcaagaaccccttccacccccccctccgccaagccggggagggaaccagctcccgcgccccccaatcgtcggcgggaataagggacgctccggccccttaccgcccgtccctcttggcattgcaccacccccaccaacacctcgtggtccccctccacctgggaggggggggccaccacccccccccccacccgccaccggcagatccggtcctctgcctccgccacctcccggcgcgggaggtccaccaatgcctccaccaccacccccaccccctccccctccttccagtggtaatggaccggcgcccccacccctccctccagcactggtcccagcaggaggcttagcccctggaggaggccgcggagccctactagatcagattaggcaggggatccagctaaacaagactcccggcgccccagaaagttcagccctgcagcctccgccacaatcctcagaggggttggtgggggccctcatgcacgtaatgcagaagagatcgcgcgcaattcacagttctgatgaaggcgaggatcaagctggcgacgaagatgaggatgacgaatgggacgactag

SEQ ID NO: 140698 - DNA, 654 bp, Artificial Sequence
  Description of Artificial Sequence: Synthetic coding sequence
atgtcaggggggccaatgggagggcgtccaggtggccggggtgcccctgctgtgcagcaaaacattccttccacgcttctccaggaccacgagaaccagcgcctgttcgagatgttgggccgcaagtgcctgaccttggctacagccgtcgtccaactgtacctagctctgccacctggtgccgaacactggactaaagagcattgcggagcagtgtgctttgtgaaagataatcctcaaaagtcctatttcatcagattgtatgggttgcaggctggaaggttattgtgggagcaagagctgtactcccagctggtgtatagtacgcctacaccatttttccatactttcgcaggagatgattgccaggctgggcttaattttgccgacgaagacgaggcccaggcatttcgagcgctggtgcaggagaaaattcagaaacgaaatcagcgacagtcaggcgaccgcaggcagttaccgccgccacctacaccagccaacgaggaaagacgcgggggtttacccccgctccccctccaccccggcggcgaccaaggtggacccccagtggggcccctcagcctgggcctagccacagtcgatattcaaaaccctgatattactagcagccggtaccgtggcttgcccgcctag

SEQ ID NO: 140699 - DNA, 4668 bp, Artificial Sequence
  Description of Artificial Sequence: Synthetic coding sequence
atggcgaaggccattaaggacagggtctctttgataaagcggaaacgcgagcaacgacaactggtacgggaagagcaagagaaaaagaagcaggaggaatcctcattgaagcagcaggtcgagcagtcatctgcatctcaaacagggattaaacagcttcctagtgcatcgaccggaatcccgaccgcatccaccacgagtgcgtcagtgagtacccaggtggaaccagaggaaccagaagcagatcagcaccagcagctgcagtaccagcaaccctctatatctgtcctcagtgacggcactgtggacagcggacagggatcgtccgtattcaccgagtcacgggtctcatcacaacagacagttagttacgggagccagcacgaacaggctcactcaaccgggacggtacctggccatatccctagtacagtgcaggcgcagagccagcctcatggagtatacccaccttctagtgtccagcagggaattcagcaaaccgctccaccgcaacaaacggtccagtactccctaagccagacatccacctcgtcagaggccactaccgcccaacctgtaagccagccacaggcccctcaggtgctcccacaggtgtccgccggcaaacagagtactcagggcgtttctcaggttgctcccgccgaacccgttgccgtggctcaaacccaggcaacgcagccaaccaccctggcatcatcggtggattcagcacactctgacgttgccagcgggatgtcagatggaaacgaaaacgtaccatcaagtagcggacggcacgaaggacgcaccaccaaacggcattaccgcaaatctgttcgatcacggtcccgccacgagaagaccagcaggccaaagctgcgaattctgaatgtttccaataagggggacagagtagtggagtgtcagcttgaaacccacaacagaaagatggttaccttcaaattcgatctggatggagacaaccccgaggagatagccaccattatggtgaacaacgacttcatcctggccattgagagggaaagcttcgtggaccaggtcagggaaatcattgagaaggctgacgaaatgttgtccgaagacgtcagtgtagaacctgagggagaccaggggttggaatcgttgcaggggaaggatgattatggctttagcgggagccagaaactcgagggcgaatttaaacagccaattcccgcctcctctatgccgcaacagattggtatccctaccagtagcctcacacaggttgtccatagcgctgggcggcggtttatcgtgtcacctgtgccagagtcccggctcagagagtcgaaagtcttcccaagcgagatcacagatacagttgcagcatcaaccgcccaatcaccaggaatgaacctgagccacagcgcatcatctctgtccctacagcaagcctttagcgagctgcgacgggcacaaatgacggaggggcccaacactgctccgcccaatttcagccacacgggccccaccttccccgtggtgcctccctttttgtccagcattgcgggagtccccacaaccgctgccgcaaccgcccctgttccagcaactagtagtcctccaaacgacattagtacaagtgtaatccagtccgaagtgacagttcctaccgaggaggggatagccggggtggcaacctcaactggtgtggtaacatcaggcggcttgcccatcccacctgtttcggagagccctgttttgtcatctgtggtttccagcatcactataccagccgtcgtgtccatcagtacaacaagtcctagtcttcaggtgcccacatcaacctctgaaatcgtcgtttctagcaccgccctctaccctagcgtgaccgtgagtgcaaccagcgcctcagccggtgggtctacagccaccccgggcccaaagccaccagcggtggtcagccagcaagctgctgggtctaccacagttggcgcaacattgacctcagtctcaactacaactagctttccttccaccgccagccaactttgtatccagctctcatcatcaactagtacccccacattggcagagaccgtagtcgtgtccgcacatagcctggataagacaagccattcctctactactggactggccttttctctctcggctccttcttcgagttcctcacctggcgcaggcgtgtcttcatacatcagtcagcctggtggtctgcacccactagtcattccttccgtgatagcctctacccccatcctgccacaggctgccggtcccacatcaacccctctgctgccacaggtgccctccatccctcccttggtccagcccgtcgcaaatgtgccagctgtgcagcaaactctaattcactcgcaaccgcagccagcattgttgccgaatcaacctcatacacactgcccagaggtggattccgacacacagcccaaagcaccagggatcgacgatattaagaccctggaagaaaagctgaggtcactgttctcagaacattcttcctctggcgcccagcacgcttctgtgtctctggaaaccagtctcgtaatcgagagtaccgtgacaccgggcatccctaccacagctgttgccccctcaaagttattgacgtccaccactagtacatgtctcccaccaacaaatctgcctctcgggactgtggccctgccagtaactccggtggttacccctggccaggtgagcacgccagtatctactactacatccggtgtgaaaccaggaacagctccctccaaaccacccttgaccaaggccccagttctgccagtggggacagaattgcctgccggcacactaccctctgagcagctgcccccattccctggcccaagccttacacagtcacagcagcctctggaggatcttgacgctcagttgcgacggacattgtcaccagaaatgatcacggtgaccagtgctgtgggtcccgtgtccatggccgcaccgaccgctatcacggaagccggaacacagcctcagaagggggtaagccaggttaaggaaggtcctgtcctggctacatctagcggtgcaggtgtctttaaaatgggaaggtttcaggtctcagtcgccgcagatggagcccaaaaggaagggaaaaacaagtcagaagacgccaagagtgtccactttgaatcgagcactagtgaatcttccgtgctgtcctcctcttcccctgaatctaccctagtaaaacctgagcccaatgggataacgatcccaggcatctcatcggatgtacctgagtctgcgcacaagaccactgccagcgaagctaaatcagatacaggccagcctacaaaagtgggtagattccaggtgaccactacggcgaacaaagttgggcggtttagcgtaagcaagactgaggacaaaattacagacactaaaaaagaaggacctgtggcctcccctccctttatggatctggaacaggccgtgcttccggccgtcattcctaaaaaggagaaacctgaattatcagaaccatcccacttgaatggaccctcatctgatcctgaggcagcattcctctcaagagatgtcgatgacgggtccgggtctcctcactctccacatcagcttagtagtaaatccctgcctagtcagaacttgtcacagagcttaagcaactccttcaacagctcctacatgagctccgacaatgagtccgatatcgaggacgaggatctgaagttagagctgcgccgactacgggataagcacttgaaggagatccaggacctgcagtcccggcaaaagcacgagatcgagtcactctatacgaagctaggcaaagtgccccccgctgttatcatacctccggctgcccctctttcgggccgtcgtcgacgccccactaagagtaaggggtccaagagcagtaggagttcctcattgggcaacaagagcccgcaactgtctggcaacctgagcggacagagcgcagcatctgtgcttcaccctcaacagacactccacccaccaggcaatatccctgagtcgggccaaaaccagctccttcagccactgaaaccatcaccatccagcgataatctgtatagcgcttttaccagcgatggtgccatctccgtaccctccctgtctgctcccggtcaagggacctcgtcaaccaataccgtcggggccaccgttaactcccaggccgcccaggcccaaccccctgccatgactagcagccggaagggtacctttaccgacgacctccataagctggtcgacaactgggcacgtgacgctatgaacctgtccgggagaagagggagcaaaggtcatatgaattatgagggccctggtatggccagaaaatttagtgctccggggcagttgtgcatcagcatgacttctaacctgggggggtccgctcccatctccgccgcttccgccacctcactcggacactttacgaagagcatgtgcccacctcagcaatacggtttcccagctacaccgtttggagctcagtggtccggaaccgggggcccagcccctcagccgttagggcaatttcagccggtcggtacagccagcctgcagaatttcaacatatcaaacctgcagaaaagtatctctaatccaccgggatcgaaccttcggaccacctag

SEQ ID NO: 140700 - DNA, 7149 bp, Artificial Sequence
  Description of Artificial Sequence: Synthetic coding sequence
atgtccggcggcgctgccgagaagcaatcttccactcccggttcactgttcctctcaccccctgcccctgccccaaagaatgggtcgagttcagacagcagtgtaggagaaaaactgggagccgctgccgcagatgcagtgacaggccggactgaagaataccgacgtagacgacatacgatggacaaggattctagaggggccgccgccacaactactacgacagaacacagattctttcgccgatctgttatttgcgactcaaatgcaacagctctcgagctgcccggccttccacttagcctcccacagccctcaatcccggcagctgtgccacagtctgctccaccagagccacatcgcgaagagactgtgacagcaactgccacctcccaggtggctcagcagccaccggccgccgccgccccaggtgagcaggccgttgccgggcccgctccatctaccgttccctcctccacgtctaaagaccggcccgttagtcagccctcactggtcggttcaaaagaggagcctccgccggcccgaagcggatcaggcgggggatccgccaaggagccccaagaggaacggtctcagcagcaggatgatattgaggaactagaaactaaagcagtcgggatgtctaacgatggtcgcttcctcaaatttgacattgaaattggcagggggagctttaagaccgtgtataaaggccttgacaccgaaaccactgtggaagtggcctggtgcgagttgcaagacaggaaactgactaaatccgaaagacagaggttcaaagaagaagccgaaatgctcaaagggctgcagcatccgaacatcgtcagattttatgattcgtgggaaagcactgtgaagggaaaaaaatgtattgtgctggttactgagctaatgacttcaggtactctgaagacctacctaaaaagattcaaagtcatgaagataaaggtcttgagatcttggtgtagacagatcctgaagggattgcaatttctgcatacaaggacaccccctatcattcaccgcgacctcaagtgtgacaacatcttcatcactggacccacaggttcagtcaaaatcggcgacttaggcctggccacccttaagcgtgctagcttcgctaaaagtgtgatcgggactccagagttcatggctccggagatgtatgaggaaaagtacgacgaaagtgttgatgtgtacgcattcggcatgtgcatgctagagatggctacaagcgagtacccatactctgaatgccagaatgctgctcagatatataggcgtgtcacctcaggggtgaagcctgcttcattcgacaaagtcgccatacccgaagtcaaggaaataattgagggctgtattcgacagaacaaagatgagaggtacagtataaaagacctgctcaaccatgcattcttccaggaggagaccggtgtccgggtagaattagccgaggaggacgatggagagaaaatcgccattaaactatggcttcggattgaggatatcaaaaagcttaagggtaaatataaagacaacgaagcaattgagttcagcttcgacctggagagggacgttcctgaagatgtggctcaagagatggtggaatctggctatgtgtgcgagggagatcataaaaccatggctaaagccatcaaggaccgggtcagcctcattaaacggaagcgggaacagagacagcttgtaagagaggaacaggagaaaaaaaagcaggaggagtcgtctttgaaacaacaggtggagcagtcctctgccagtcagacaggcattaagcagttacctagcgctagtacagggattccaaccgcatccactacgtccgcttcagtgtctacccaggtggaacccgaggaacccgaggctgaccaacatcaacagctgcagtaccagcagcccagcatttccgttttgtctgacggaacagttgatagtgggcaggggtcgagcgtgttcacagagtcacgggtttcctcccagcagacagtgtcctatggctcccagcacgagcaggcgcattccacagggactgttccaggacacattccttccaccgtccaggctcagtcacagccccatggagtgtacccaccttcaagcgtggctcaagggcagtctcaaggacagccttccagctcctccctaactggggtttcatctagtcaacctatccagcacccacaacagcagcaaggtattcagcaaacagcgcctccacaacagacggtccagtactctttgagtcaaactagtacgtccagcgaggcaactactgcacagcccgtgagtcagccccaggcacctcaggtcctcccacaggtgtcagccggaaagcagctacccgtttctcaaccggtgccaactatacagggggaacctcagatacctgttgcaactcagccgtccgtagtccctgtgcactccggagcccactttctgccagtggggcagccactgccaaccccactgctcccccagtaccctgtatcccaaatacccatttcaactccacacgttagcacagcgcagacaggcttttcatctttgccgattactatggcagcgggcatcactcagcccctgttaactctggcttccagcgcaacaacggccgctatccctggggtcagcactgttgtccccagtcagcttccaactctcctccagcctgtgactcagctgccgagtcaagttcatccccagctactgcagccagccgtgcagtcaatgggcatacctgcaaatctggggcaggccgccgaggttcccctttcatccggtgacgtgctgtaccaggggttccctccacgactgcctcctcaatacccaggcgatagtaatattgccccctcctctaacgtagcgagcgtttgtatccactctacagtgttgagccctccaatgccaacagaagttctggccactccggggtacttccccacagtggttcagccatacgttgagagcaatcttctcgtccccatgggtggtgtgggcggccaggtgcaggtttctcaacctggcggatctctagcacaggcaccgacaacctccagtcagcaggcggtactggaatcaactcagggagtgtcacaggttgctccggctgagccagttgccgtggcccaaacgcaggcaacccagcccactacactcgctagtagcgtagattccgctcacagtgacgtggcctcgggaatgtccgatgggaacgagaacgtgccatcatccagcggacgtcatgaggggcgtactactaagcgccattataggaagtcagtccgaagcaggtcccgccatgagaaaaccagccgcccaaaacttaggatcctcaatgtgtctaataaaggggaccgagttgtggagtgtcagctggagacccacaaccgaaagatggttacctttaagttcgatctggacggtgataatcctgaagagatcgctactatcatggtgaataacgatttcatacttgccattgaaagggagtctttcgtcgatcaggtgcgagagatcatcgaaaaggccgacgaaatgctgagcgaggacgtttccgttgaacccgagggcgaccaggggctggaatcattgcagggaaaagacgattacggattttctggcagccagaaactggaaggcgaatttaagcagccaatccccgctagttccatgccgcagcaaataggaattccaacctcctccctgacacaggttgtgcattccgccggcaggcgattcatcgtttctcccgtgcccgagtcgcgcctgcgggagagcaaggtgttccccagtgagatcacagatacagtggcagcctccacagcgcagtctcctggcatgaaccttagccacagcgctagcagcttgagtctgcagcaggcttttagcgaactgagaagagcccagatgaccgaaggaccgaatactgcacctcctaattttagccacaccggcccgaccttccccgtcgtgcctccctttttgagcagcattgccggggtgcctacaaccgctgctgctacagctccggtgccagcgacaagttcgccacctaatgatatctccacatccgtgatccagagcgaagtgacagtccccaccgaggagggtatcgccggagtggcaacttccactggcgttgtaacatccggtggactgcccatcccacccgtctctgagagtcccgtgttaagcagcgtggtctcctccatcaccatcccagctgttgttagcatcagcaccaccagtcccagccttcaagtcccaacatctacatccgagatcgtggtgagttccaccgccctgtatccctccgtcactgtgtctgccacctctgcctctgcgggcggctctaccgctacgccaggaccaaagccgccagctgtagtatcgcagcaggcagccggtagcactacagtgggggctaccctgacttccgtgtctaccaccacatcctttccaagtaccgcatcccagctatgtatccagttaagctcctctacttccacccccaccctggccgagacagtggtggtgtcggcacattcattggataaaacttctcactcaagcacaacaggactcgctttcagtcttagtgcaccttctagtagtagctctcctggagcaggggttagttcctatatctcacagcccggcggcttacatcccctggttattccttccgttatcgctagtacaccaattctcccacaagccgccggtcccacatctaccccgctcctcccacaagtgccgtccatacctccactcgttcagcctgtggcgaacgtcccagccgtgcagcaaaccctcatccacagtcagccacagccagcgctgctgcccaaccaaccccatacgcactgccccgaggtggacagcgacacacaaccgaaagcaccggggatcgatgacatcaaaaccctggaggaaaagctgcgatccctgttcagtgaacatagctcttctggggcacagcatgcatcggtttcactagagactagcctcgttatagaatcgaccgttacccccgggatcccaactacggcagtcgcacctagcaaattgctgacatcaacaacaagtacatgtttgcctcccaccaatctgcctcttgggactgtagcgctgcctgtgactccagtagtgacacctggtcaagtcagcacaccagtctcgaccaccacgtcaggtgtgaaacctggaacagcaccatccaagcctcctttaactaaagcgccagtactaccagtcggcacagagttacccgccggcaccttaccatccgaacaactgcctcctttcccagggccatcactgacacagtcgcagcaaccactggaagatcttgacgctcagctgaggagaaccctatctccagagatgattaccgtgactagcgctgtcggccctgtgtccatggctgctcccacagccataaccgaagccgggacccagccgcagaaaggggtgagccaagtgaaggagggtcctgttttagcgacctcttcaggtgctggggtgtttaaaatgggacgcttccaggtgtctgtcgcagccgatggtgctcagaaagaaggcaaaaataaatctgaagatgccaagtctgtgcactttgagagctcgacctccgaatcttctgtgctttcatcgtctagccctgagagcactttggtgaagccggaacccaacggcatcaccatccccggcatcagcagtgatgtgcccgagagcgcacacaagacgaccgcctctgaagccaagtccgatactgggcaacccaccaaggttggtcggtttcaagtgaccaccaccgcaaataaagtcggcagattcagcgtgtccaaaacagaggataaaattactgacacgaaaaaggagggtcccgtggccagtcccccattcatggatttggagcaggctgtactacctgccgttatccccaagaaggagaagccagagttatctgagccatcacatctaaacgggccctcttccgacccagaagccgcattcttaagtagagatgtcgacgacgggtcaggttcgccacacagccctcatcagttatcttccaagagcctgccatcgcaaaacctgagtcaaagcttgagcaattcatttaactcctcctatatgtctagtgataatgaaagcgacatcgaagacgaagacctcaaattagaattaaggcgactgcgggataaacatttaaaggagatccaggacctgcaaagtagacagaagcacgagatagagtctctttacaccaagctgggcaaagtccctcccgctgtcataatcccccctgcagcccccttgtcagggaggagacgacgccctacaaaatccaaggggagcaagtcttctaggtccagctccctgggaaataagtctccacagctgtcaggtaatctgtccggtcagagtgcagcctctgtactacatccgcagcagacgctgcacccccccggcaatattcccgagtcaggccagaaccagctcctgcagcccctgaagccctcgccatccagtgacaatctgtattccgcatttacttctgacggagccatatcggtgccaagcctgtcggctcctggccaagggacctcttctaccaataccgttggcgccacggttaactcacaggccgcacaagctcaaccccccgctatgacgtcatctcggaagggaacattcaccgacgacctccacaaactcgtggataattgggctcgcgatgccatgaatctcagtggacggcggggctccaaaggacacatgaactatgagggtcctgggatggcgaggaaattcagtgcacccgggcaactgtgcatttcaatgacgagcaatcttggcgggagtgcccccattagcgccgcttccgccacctcgttggggcacttcaccaaaagcatgtgcccgccgcagcagtacggtttccccgccaccccctttggggcacaatggagcggaactggcggacccgcacctcaacctctggggcagtttcagccagtgggaacagccagcctccagaacttcaatattagtaatcttcagaaatccatatctaatccccccggtagcaacctccggactacctag

SEQ ID NO: 140701 - DNA, 5928 bp, Artificial Sequence
  Description of Artificial Sequence: Synthetic coding sequence
atggatatcaaaaaaaaagacttctgctccgtgtttgtgatcataaatagccactgttgctgttgtccccaaaaggattgtatcaacgaaggggtcaagcctgctagctttgacaaggtcgcaatcccagaggtcaaggaaattatcgaaggttgtatcagacagaacaaggatgagcgctacagcatcaaggatcttctgaaccacgccttctttcaggaggagacaggcgtacgcgtggagctagcagaggaggatgatggcgaaaagatagcaatcaaactctggctcaggattgaggacattaagaagttgaaagggaaatacaaggacaatgaggctattgagtttagcttcgacttagagagagacgttccagaagatgtcgcccaagagatggtggagagcggatacgtctgcgaaggggaccataaaacaatggctaaggccataaaagatcgagtctccctgattaagagaaagagagaacagcggcaattggtgcgcgaggagcaggagaagaaaaaacaggaagagtcctctctgaagcagcaggtcgagcagtcttcggcttcccaaacgggcatcaagcaattaccttctgcgtctaccggcatcccgaccgcctcgaccacatccgcaagcgtgtccacccaggtggaacctgaggagcctgaggctgaccaacaccaacaacttcaataccagcagccctccatcagcgttctgtccgatgggaccgtagacagtggccaggggtcctctgtattcacagagagccgagtgtcaagccagcaaacagtgagctacggcagtcagcacgaacaagctcactcaaccggcaccgtcccaggacacataccttctaccgtgcaggcacaaagccagcctcatggagtttatcctcccagttccgtggcccagggtcagtcccaaggccaaccttcatcctcctctctgacaggtgtctctagtagtcagccaattcagcatcctcagcaacagcaggggatccagcaaacagctcctcctcagcagacggtacagtactctctctctcagaccagtaccagctctgaggcaacgactgcacagcccgtgagtcagccacaggcccctcaggtactaccccaagtcagcgcaggcaagcagctgcccgtgagccagcccgtaccaacgatacagggagagccgcagattccagtcgctacccagccctctgtagttccagtccattcaggtgcccattttctgccagtgggccagccacttcccacaccactactgccacagtaccccgtctcccagattccaatcagcacccctcacgtatccacagcccagactggtttttcctccctgccgatcacaatggcggcggggatcacccaacctctgctaacgctcgcctcctccgccacaaccgcagccattcctggggtctctaccgttgttccttcccagcttcccactcttttgcaacctgtgacacagctgccttctcaggtgcacccccagctccttcagcccgcggtccagtccatggggatcccagcaaacctgggacaggcagccgaggtccccctctcgagcggcgacgtgctctatcagggtttccctccacgcctgcctccacagtaccccggtgactctaacatcgccccctcctccaatgttgcctccgtctgcatccatagcacagtgctgagtccgcccatgccaaccgaagttttggccacacctggttatttccccaccgtcgtgcagccatatgtggaatcaaatcttctggtcccaatgggcggggtgggtggacaagtacaagtgagccagccagggggcagcctggcgcaagctccaacaactagttcgcagcaggccgtcctggagtcaacccagggggtaagtcaggtggcccctgccgagcctgtggccgtggctcagacacaagccactcagccaaccactctggcttcctccgtggattccgcacacagtgacgtagctagtggcatgagcgacggcaatgagaatgttccatcaagctcaggaagacacgagggtaggacaacaaagaggcattaccgcaagtcagtgcggagccgtagccgacacgagaagaccagcaggccaaaactgaggatcctgaacgtctcaaacaagggtgacagagtcgtggagtgtcagctggaaacacacaacaggaagatggtgactttcaagttcgatctggacggcgacaatcccgaagaaatcgccaccataatggttaacaatgactttatcttggctattgagagagagagcttcgtcgatcaagtgagggagattatcgaaaaagccgacgagatgctttcagaggacgtgtcggtagagcctgagggagatcaggggctggagtccttgcaaggcaaagatgactatggcttctccggcagccagaaactggagggcgaatttaagcagccaattccggcgtcttctatgccccaacaaatcgggattcccactagtagtctcacacaggtggtgcattccgctggtagacgatttatcgtttccccggttcccgaaagccggctgcgggaatctaaggtctttcccagcgaaattacagacaccgtggccgcctcaactgcccagtcacccggtatgaacctcagtcactccgcttcttccctctctctacaacaggccttcagcgaactgcggcgtgcacaaatgaccgaaggccctaacactgcacctccaaacttcagtcatacggggccgacctttccagtggtcccaccatttttgagctccatagctggcgtcccgactaccgccgccgccacagcgcctgtaccagctacatcctcccctcctaatgatatttcaaccagtgttatacagtccgaggttactgtgcctacagaggaaggtatcgccggcgttgcaacctccacaggcgttgttacatccggcggtctgcctattccgccggtctccgagtcccccgtcctcagtagcgtggtgtcgagtattacaatcccagctgttgtcagcatcagcactacgtctccctccctgcaagttcccacaagtacatccgagattgttgtgtcttctactgcgctgtacccatcagtcaccgtgtccgctacatccgcttctgccggtgggagtaccgcgacacctgggcccaaaccacctgcagtcgtctctcagcaagccgctgggtccactaccgtgggcgccactcttacctccgtctctactaccacaagctttccgtctaccgcctcccagctctgcatccaactgagtagcagcactagtacacccactttggctgagactgttgtagtttccgctcacagcctagacaaaacctcacattcatccacaacaggcctggccttcagtttaagcgcccctagctccagctccagccctggcgctggcgtttccagttatattagtcaaccaggcggcctgcaccccctggtgattccctctgtcattgcttctacaccaatactgccccaggcagctggacccacctctacccccttgctcccgcaggtgcctagcatcccaccgctagtgcagcccgtggccaacgtgcctgccgtccagcagacattgatccactcccagcctcaacccgcattacttcctaatcagccccatacccattgcccggaagtagattctgatactcaaccgaaggctcccggtattgacgatatcaagaccctcgaagaaaaactccggagcctgttctcagaacatagttcatcaggcgctcagcacgcctcagtgagtctcgaaacctccctcgtaatagagtcaactgtgacacctgggatcccaaccacggctgtggccccaagtaagttactgacgtccactacaagcacttgtcttccccccacaaacctgccgctgggtaccgtagctttgcccgtgacccctgtggttacccctggccaggtgagcacaccggtgtctacgaccacctccggagtcaagcctgggaccgctcctagcaagcctccccttacgaaagctccagttcttccagtgggaaccgaactgcctgccgggaccctcccaagtgagcaattgccaccatttccaggaccctcattaacacagtcgcagcagcccctcgaagatctcgacgcgcagctcaggcgcacactgagtccagaaatgataactgtgacttcagcagtcgggcctgtatctatggcagcgcccaccgcaattaccgaggccggaacacagcctcagaaaggcgtcagtcaggtaaaggaagggccagtgctggcgacctctagtggcgctggagtgtttaaaatgggaagattccaagtctccgtggcggcagatggcgcacagaaagagggaaaaaataaatcggaggacgccaagagtgtgcatttcgaaagttcgacctccgagagctcggttctctctagctcttcccccgaatccactctcgtgaaacccgaacccaatggcatcactatccctggaataagctctgatgtgcctgaatccgcgcataaaacaactgcatcagaagccaagagcgacactggccagcctaccaaagtaggccggtttcaggttactacgaccgctaacaaggtgggaaggttttccgttagcaaaaccgaagataaaattacggatactaagaaagaaggaccggtggctagcccccccttcatggatttagagcaggccgtattacctgccgtcatacctaagaaagaaaagcccgagctctcagaaccatctcatcttaacggcccatcctcggatcctgaagccgcctttctgagcagagatgtggacgacggctccggttctccgcacagcccacatcaattatcatcgaagtctcttcctagccagaatctgagccaaagcttatcaaactcattcaattcaagctacatgagtagcgacaacgagtccgacatcgaggacgaggacctgaagctggagttacgtcgacttcgtgataagcacttgaaggaaatacaagatctgcagagtaggcagaagcacgagattgaatccctctatacaaagttgggcaaagtgcctcctgccgtgataattcctcctgcagcccccctgagcggcagacggaggagacctacaaaatcgaaaggcagcaaatcaagccggtcatcctcacttggcaataaaagtccccagttgagtggaaacctgtccgggcagtcagccgctagtgtgcttcatcctcaacaaaccttgcatcccccgggaaatatccccgagagcggccagaaccagctgttacagccactcaaacccagcccctcctctgacaacctgtattctgccttcacatcagatggcgcgatctcagtgcctagtctgtctgctcccgggcagggcaccagctcaactaacactgtgggtgccaccgtgaatagccaagccgctcaagctcaaccgcccgctatgacctcatcccgtaagggcacgtttacagacgatcttcacaaattggtggataattgggctagagatgccatgaacctaagtggacggcggggtagtaagggacatatgaactacgaaggtccaggaatggcccgaaaattctccgctccgggccaactgtgcatttcgatgacatcgaacctggggggcagcgcccctatcagcgcagcgtccgccacgtcgctcggtcacttcacaaaaagtatgtgccccccccaacagtatggctttcccgctactccttttggggctcagtggagtggtaccggaggaccggctccccaaccacttggccagtttcagccagtgggaacggcttcccttcaaaattttaacatttccaatctgcaaaaatccatctcaaatccccccgggtccaatttgaggaccacttag

SEQ ID NO: 140702 - DNA, 1182 bp, Artificial Sequence
  Description of Artificial Sequence: Synthetic coding sequence
atgagtggaggcgccgctgagaagcagtcctctacacccgggagcctcttccttagtccgcctgcccctgcccctaaaaatggttcatcttctgattcctctgtcggcgagaaacttggtgcagccgctgccgacgccgttacaggacggactgaggagtacagacggcgcagacataccatggacaaggactcgcggggggccgctgccaccaccacaaccaccgagcaccgttttttcaggcggagtgtgatctgcgactctaatgcaaccgccctggaattgcccggcctccccctaagcctcccacagccctcgattccagccgccgtcccccagtccgcacctcccgagccacatagagaagaaaccgtgacagctaccgcaacctcccaggtcgcccagcagccccctgcggcagctgctcccggcgagcaggcagtcgccggccctgccccttcaaccgtgccttcctctacttccaaggatagacccgtgagccaaccttcattggtcggtagcaaagaggaacctccacctgccaggagcggttctgggggcggctctgctaaagaacctcaggaggaaagaagccagcagcaggacgatattgaagaactcgaaaccaaggccgtcggaatgtcgaacgatggccgtttcctaaaatttgacatcgagattggaagggggtcatttaagactgtgtacaaaggtctggatacagagacgacagtcgaagtcgcgtggtgcgagcttcaggacagaaagctgacaaaaagtgagcgacagagatttaaggaagaggccgagatgctgaagggcctgcagcacccaaatatcgtcagattctacgattcctgggagtcaactgtcaaaggtaagaagtgcatcgttctggtcactgaactcatgacaagtggcactctcaagacttacctcaaaaggttcaaagttatgaagattaaagtccttcggtcctggtgcaggcaaatcctgaagggcctgcagtttctgcacactagaacaccacctatcattcatagggatctcaagtgcgataacattttcatcacaggccccaccggatccgttaaaatcggcgatttaggactggccacgttaaaaagagcctccttcgccaagtctgttatcgggatgttccaggtgtacctgggcgcctag

SEQ ID NO: 140703 - DNA, 8643 bp, Artificial Sequence
  Description of Artificial Sequence: Synthetic coding sequence
atgagcggtggcgccgccgagaaacagagcagcacgcccggcagcctgtttcttagtcctcctgcccctgcacccaaaaacgggtcaagctctgattcctcagttggggagaagctgggggcagcagctgctgacgcggtgacagggaggacagaggaatatcggcgccgcagacacacaatggacaaggattcccggggggccgcggccactacaaccacaaccgagcaccgattctttagacgtagtgtaatctgcgactcaaacgctactgcactcgagcttccaggactgcctctcagcctgccccagccaagtattccagccgcggtgccacagagtgcaccccccgagccgcaccgggaggagactgtcactgccactgcaacatcccaggttgcgcagcaacctccagcggcagccgctcctggagagcaggccgtggccgggcccgcaccttccaccgtgccctcaagcacttcaaaggaccggcccgtcagtcagccctcactggtaggaagcaaagaggagcccccccctgccaggtccgggagcggcggcgggagtgccaaggaaccccaggaggaacggagccagcagcaggacgatattgaggagttggaaacaaaggctgttggcatgtcgaatgatggccgatttctgaaatttgatatcgagattgggagaggcagctttaagaccgtgtacaagggccttgacaccgaaacgaccgtggaggtggcctggtgcgaactccaagatcgaaaactcacaaaatccgaacggcagcggtttaaagaagaagctgagatgcttaaagggcttcagcaccccaacatcgtgaggttttacgatagttgggaatctacggtgaagggaaaaaaatgtatcgtgctcgtaaccgaactgatgacctccggcactctgaaaacctatctgaagcgctttaaagtaatgaaaattaaggtgctccgatcctggtgtagacaaattctgaaagggctgcagttcttacatacacggacacccccgatcatacatcgggatttgaaatgcgataatatctttataaccggccccacaggtagcgtcaagatcggcgacctggggctggcaacacttaaaagagcatcattcgccaaatctgtaattggcacgcccgagtttatggcacccgagatgtacgaagaaaagtacgacgagtcagtggacgtgtacgctttcggaatgtgcatgctcgagatggctacaagtgagtatccatattcagagtgccaaaatgctgcacaaatttaccggcgtgtgactagtggggtgaagccagcgtcatttgacaaggtggctatcccagaggttaaagagattattgaaggatgtatacgacagaataaggacgaaaggtatagtatcaaagacctgctgaatcacgccttttttcaggaagagacgggcgtgcgggtggagctggcagaggaggatgatggtgagaaaatcgccatcaaactgtggctacggattgaggacattaaaaagctcaaagggaagtacaaagacaatgaagctattgagttctcctttgacttagagagagacgttcctgaggatgtagcacaggagatggtggaaagcgggtatgtctgtgagggcgatcacaagaccatggctaaggcaattaaggatcgcgtgtctctcattaagagaaagcgtgaacagcgccagctcgtgcgggaggaacaggaaaagaaaaagcaggaagagagcagcctgaagcagcaggtcgaacagagctctgccagtcagacgggtattaaacaactgccaagtgcctccacgggaatacccacagcctccacaacctcagcctctgtttcaacacaagtggagccagaagaacccgaagctgaccaacaccagcaactgcagtatcagcagccgagtatttctgtgctatccgatggcaccgtggacagcggacagggcagttccgtgtttaccgaatctagagtatcctcccagcagaccgtctcttatggctcgcagcacgaacaagcacacagcacaggaaccgtgcctggacacatcccaagcacagtgcaagcccaatcccaaccacatggggtgtaccctccctcttcggtcccccgaagaggacggtctatgagcgtgtgcgtgcctatatttctgctgctgcctctgtgccctgcatccctgcctgtgctgtttcaccccacagctagcactgtttgcacatctttttccttcccccctcccgattgtccagaggagacattcgcggaaaaattatccaaagctctcgaatccgtccttcccatgcattctgctagtcagcggaagcacaggcggtcaagcctgccatctctgttcgtgtccaccccacagagtatggcacacccctgtggggggacacctacataccccgaatcccagattttcttcccaactattcacgaaaggcctgtctctttttcacctccccctacttgcccgccaaaagtagctatctcccaaagaagaaaaagcacatcctttcttgaagctcagactcaccattttcagccactgctaaggacggtagggcagagcttgctgccccccggcggttcccccaccaattggactcccgaagccgtcgtaatgctggggactaccgcaagtcgagtgacaggagaatcttgcgaaattcaggtgcatcctatgtttgagcctagccaggtgtattcagactaccggccgggtctagtgctaccagaagaggctcattactttatccctcaggaagctgtgtatgtagccggagtacactaccaggcaagggtggccgagcaatatgagggaatcccgtacaattcttcggtactatcttctccaatgaaacagatccctgagcagaaacctgtccaaggcggccccacaagttcgtcagtattcgaattcccatccggccaagcattcctcgtaggccatctgcagaatttaaggctagactctgggcttgggccagggtctccactgagctccattagcgccccaatttcgacagacgctacgcgcctgaagttccatccagtgttcgttccacacagcgcccccgccgtcttaacacacaataacgaaagccgctcaaattgcgtgttcgaattccacgtgcacaccccgagctcaagttcaggagagggtggtggtattctgccccagcgggtttatcgaaaccgacaggttgcggtggacctcaatcaggaggaactgcctcctcaatctgttgggctgcacggatatttgcagccagtcacagaggaaaagcataactaccacgcccctgagcttactgttagtgtagtcgagcccataggccaaaactggccaatcggatcccccgaatactcctccgacagtagccagattacgagcagcgatccttctgactttcaatcacctccaccaactggcggcgcggcagccccctttggtagtgatgtgtctatgccctttattcatctgccccaaactgtactccaggaatccccactgttcttttgtttccctcagggcacaacgtcccagcaagtgctcaccgcctctttcagcagtggagggagcgccctgcacccccaagcccaaggacaatcccaggggcaaccatcgagcagcagtctgaccggtgtttcaagcagccagcccatacagcacccccagcagcaacagggtatacagcagacagcgccaccacagcagacagtgcagtacagccttagtcagacctctacttccagtgaagccactaccgcacagcccgtgagccagcctcaggctccccaggtgctccctcaagtctccgctggaaagcaactgccagtatcccagcccgtccctacgatccagggcgagcctcagattcccgttgctacacaaccttcagtggtccctgttcactcaggcgcacatttcctcccagtgggtcagcctctgccaactcctctattaccacagtaccctgtttctcagattcccatatcaactccccatgttagtacagcacaaactgggttctcctcactgcctattaccatggcagctggcatcacacagcccctgctgacattggcatcctcggctaccacagcagctattcctggtgtttccactgttgtgccatcacagctaccgactctcctgcagcccgtgacccagctgccgtctcaggtccacccccagctgctccagcccgcggtccagtcgatggggattccggccaatttaggccaggccgccgaggtgccacttagtagcggcgacgtgctgtatcaggggtttccgccaaggctcccgcctcaataccctggtgactctaatattgcacccagctctaacgtagccagcgtctgcattcactctactgtcttaagccctcccatgcctacagaggttctggcaacaccgggatactttccaacagtcgtacaaccatacgttgaatccaatctcctggtcccaatgggcggagtgggcgggcaagtgcaagtttctcagccgggtggctcgctcgcacaggcccccacaaccagcagccagcaagccgtcctggagagcacccagggtgtaagccaggtggctccagccgagcctgttgcagttgcgcagacacaagccacacagcccaccactctggcgtcatcagtggatagcgctcactctgacgttgcctcagggatgagtgacgggaacgaaaatgtcccgagttcttcagggaggcatgaagggagaacaactaagagacactacagaaagagcgttaggtctaggtcgaggcacgaaaaaacatctcggcccaaactgcgcatcctaaatgtctcaaacaagggggatcgggtagtggagtgtcagctggagacccacaatcggaagatggtcacctttaagttcgacctcgatggagacaaccccgaggagatagccacaatcatggtcaataatgattttatcctggctatcgaacgagaatccttcgtggaccaggttcgagagattatcgagaaagccgacgagatgctctccgaggacgttagtgtggaaccagaaggcgaccaaggtcttgagtccttacaaggcaaggatgattacgggtttagtggttctcagaaactggagggcgagttcaaacaaccgatcccagcgagcagcatgcctcagcagattggaattccaacatccagcctcacacaagtcgtgcactccgcgggccggcgattcatcgtgtcccccgtcccagaatcgaggctccgtgaatcaaaagtcttcccaagtgaaattactgacactgtggccgcaagcacagcccagtcaccgggcatgaacttatctcattcagcctcttccctgtccctgcagcaggcatttagcgagctcagaagggctcagatgacagaaggacccaataccgcccctcccaacttttcccataccgggccaacgtttcccgtggtccccccgtttcttagctctatcgccggcgtgcccactacggccgccgccacagctccagtgccggctacctcctccccgccgaacgatataagtacctccgtcatccagagcgaagtgaccgtgccaacggaggagggcattgctggagtggccacatctacaggagtcgtgacctcagggggactccctattccccctgtgtcggagtccccggttcttagcagtgtcgttagtagcatcaccataccagcggtggtgagcatcagcactacttctccgagcttgcaggtccccaccagcacatccgaaatcgtagtatctagcactgctctctaccctagcgtgactgtttctgctactagcgcctctgccggaggttccacggctacacccggcccaaagcccccagcggtagtttcccagcaggccgctggatcaactacagtcggggccaccctgactagcgtctcaactactaccagttttccatctacagccagccagttgtgtatccagcttagctcctctacatctactccgacgctcgcggagaccgtggtggtgtccgctcactccttagataagacttcacattctagcacaaccggtctcgcgttctctctttctgccccaagttccagtagcagtcctggagcaggagtgtcttcctacatttcccagcctggaggacttcacccactggtaatccccagcgtcatcgcctcaaccccaattctgccacaggccgccggccctacaagtaccccactgttgccacaggtcccctccattccgccgcttgttcaacctgtcgcaaatgtacctgccgtccaacagactcttattcacagccagccgcagccagcccttttacctaatcagcctcatacgcattgccctgaagtcgacagcgatacccaaccaaaagccccaggaattgatgacatcaagactctggaagaaaagctaaggagcttgttctccgagcattcctcatccggcgcacagcacgcatccgtgagcctcgaaaccagcctggtcattgaatcaacagtaaccccagggatcccgaccaccgcggtcgccccgtcgaaactgctgacctcaacaacctctacctgtctcccccctaccaaccttcccctcggcaccgtcgctctaccagtgaccccagtggtgacgcccgggcaagtgtccacccctgtcagcactactacatcaggagtgaagcccggaactgctccttcaaagccacccctaaccaaggctccagtactgcccgtcggtacagaattacctgctggtactctgccgtccgagcagttaccaccgttccctggcccctccctcacacagtctcagcaacctctggaggacttggatgcccagttgcgtagaaccctgtcacctgagatgattacagtaacttccgccgtcgggccagtatcaatggcagccccaacagctattaccgaagctggaacccagcctcagaaaggggttagccaggtgaaggaggggcccgttctggcaaccagctctggagccggggtgttcaagatgggacgttttcaagtgagtgtggccgcggacggtgcccagaaggaaggcaagaataagtctgaagatgccaagagtgttcatttcgagtcctcaacgtccgagtcctcggtcctttcgagttctagccccgaatcaacgctggtgaaacctgagcctaacggcataactatcccaggcatcagcagcgacgtccccgagagcgcccacaagactaccgcaagcgaggctaagtccgatacggggcagcccactaaggtaggccggttccaggtgaccactactgcaaacaaagttggtcggtttagcgtgtctaagactgaagataaaattaccgacaccaaaaaggaaggtccagtcgcttccccacctttcatggacctcgaacaagctgtcctgcctgcagtgatcccaaaaaaggagaagccagaactctctgaaccaagccatctgaacggaccctcttccgatcccgaggcggcttttctttcacgggacgttgacgacggatccgggtcaccacactctcctcaccagcttagcagcaaatccctgccgagccagaatctcagccagtctctgtccaactcttttaatagtagctacatgtcttctgataacgaatcagacatagaggatgaagatctgaagctcgaattgcgaagactaagggacaagcacctgaaagagattcaagacctccagagccgccagaagcatgagatcgagagcctgtacaccaagctgggaaaggtgccacccgcggtgatcatcccgcctgctgcgccactcagtggcaggaggaggaggccaacaaagtccaaagggtccaagagctctcgcagcagttccctcggcaacaagagtccgcagctgtctggtaacctctctggccagtccgccgcctccgtgctccatcctcaacaaaccctgcacccacccggtaacatacccgaatccggccagaaccagttgttgcagccgctcaaaccatcacccagtagcgacaacctgtattcagccttcactagtgatggggcaattagcgtcccatccctatccgcacccggccagggcacttcctcaaccaatacagtcggggctaccgtgaattcgcaggccgctcaagcacagccaccggctatgacctccagcagaaaagggacgttcacggacgacctccataagctggttgataactgggctcgggatgccatgaatctcagcgggcggcgtgggtcaaagggacatatgaactacgaaggaccaggcatggcaagaaagttttcggccccagggcagctttgcatcagcatgacctccaatttaggcggctcagcccctatcagtgccgctagtgctaccagcctgggccatttcacgaagtctatgtgcccaccccagcagtatggctttcctgcaacaccgttcggagctcaatggtctggtacaggggggcccgctcctcaaccacttggacagttccagccagtaggaaccgcgagcctgcagaacttcaatattagcaacttgcagaaaagcatttcaaaccctcccggttccaacctcaggacaacctag

SEQ ID NO: 140704 - DNA, 6405 bp, Artificial Sequence
  Description of Artificial Sequence: Synthetic coding sequence
atgagcggtggcgcggccgaaaagcagtccagcactcccggttctttatttttgtccccaccggctcccgccccgaaaaatgggtctagctctgactcatcagtcggcgaaaaactaggcgccgctgccgctgatgccgtgacagggaggaccgaggaatatcgccggcggagacacaccatggataaagacagtcggggagccgccgcaacaactacaacaacagagcatcggttttttagacgcagcgtcatttgtgatagtaacgccactgccctggagttacctggactgccactgtctttgccgcagccgtccatccctgctgcagtgcctcaatccgcccctcccgagccacaccgcgaggagacagtgacagccaccgcgacgtcccaggtggcccagcagccccccgccgccgcggcaccaggcgaacaggccgtggctgggccggcccccagcacagtgcccagtagcacatccaaggaccgaccagtgagccaaccttctttagtcggttcaaaagaagagccccctccagccagatccggttctgggggcgggtctgccaaagagccacaggaggaacgatcacaacaacaggacgatatcgaggaattagaaaccaaggctgtcggcatgtctaacgatggacgtttcctgaagttcgatatcgagatcggtagagggtcatttaagaccgtgtacaagggccttgacacagagacaactgtagaagtcgcatggtgcgagctgcaggacagaaaacttaccaaatctgaacgacaaaggtttaaggaagaagccgagatgctgaaaggactgcagcaccccaacatagtgcggttttacgactcatgggagtcaacagtgaaagggaagaagtgcatagtgctcgttaccgagctaatgacttctggcacgcttaagacttatctgaaacggtttaaggtgatgaagatcaaggtgcttcggtcctggtgtcgacagattctcaaaggccttcagtttttgcacacaaggacaccgcccattattcatcgggacttgaaatgtgataacatttttatcaccggccccaccggctccgttaagatcggcgatttaggccttgcaacactgaagcgggctagcttcgctaagagtgtcattgggaccccagagtttatggcccctgagatgtacgaggaaaagtacgacgagagcgtagatgtatacgccttcggcatgtgcatgcttgagatggcaaccagcgaatacccctactctgaatgccagaacgctgctcaaatctatcgtagagtcacctcaggggtaaagcctgcaagctttgataaggtggctattccagaagttaaagagataattgaggggtgcatcagacagaacaaagacgaacggtactccatcaaggatttgctcaatcacgctttcttccaagaggagacgggcgtcagagtggagctggcggaggaggacgacggggagaaaattgcaatcaaattatggctacgcatcgaagatatcaagaaactgaaaggaaaatataaggataatgaggccatcgagttctcattcgacctcgaacgcgacgtccctgaggacgtggcccaggaaatggtagaaagtggctacgtatgcgaaggggatcacaagactatggctaaggccatcaaggacagggttagcctaatcaaaaggaagcgggaacagcgccaactcgtgcgagaagagcaagagaagaagaaacaggaagaaagctctcttaagcagcaagtcgagcaatcaagtgcctctcagactggaattaaacagctgcccagtgcatctaccggcataccaactgcatctaccacgtccgcctccgttagcacccaagtagagcccgaagagcccgaagcggatcagcaccaacagttacagtatcaacaaccttccataagcgtgctttccgatggcactgtggacagcggccagggctcctctgtgtttacagaaagtcgtgtgagctctcagcagactgtgagctatggcagtcagcatgaacaggcgcactccacaggaactgttcccggtcacattccatccacggttcaggcccagtctcagcctcatggggtctaccctccttctagcgtggcacagggtcagtctcagggtcaaccttctagcagcagtctgaccggcgtcagttcatcacagccaattcagcatccccagcaacagggaatccagcagaccgcaccgcctcagcagaccgtgcagtatagcttgagccagacctcgaccagcagtgaggctacaacggctcagccagtgtctcaaccacaagctcctcaggtgctgccccaggtgagtgctggcaaacagagcacgcagggagttagtcaagtcgcaccagcggagcccgtggcagtggcccagacccaggcaacacaacccaccacacttgcttcctctgtagactctgctcacagcgacgtggccagtgggatgtcagatggcaacgaaaacgttccatcttcttcggggcggcacgaaggccgcacgaccaagcggcactataggaaatccgtacggtcacgatctcgacatgaaaaaaccagtaggccaaaattgcgcatcttgaatgtgtctaataaaggcgatagagtggtagaatgtcagctagaaacacataatcgcaagatggtcacctttaagttcgatctagatggggacaatcctgaggagatagccacaattatggttaataacgactttatacttgccattgagagggagtcattcgtggatcaggtgcgcgaaatcattgaaaaggcagacgagatgctttcagaggatgtgagcgttgaacccgagggcgaccagggtttggagagccttcagggcaaagacgactacggcttctcaggaagccagaagctggagggtgagttcaaacagcccatcccagcaagcagcatgccccaacaaattggcatccccacatcaagcctgactcaggtagtgcacagcgctggacgacgcttcatcgtgagccccgtgcccgagagcagacttagggaatcaaaggtcttcccttccgagattactgacacggtcgccgccagcactgcccagtctccaggcatgaacttgtctcatagtgccagctctctttcactccagcaggcattctccgaattgagaagagcccagatgacagaagggcccaacacagccccaccaaatttttcccacacaggccccactttcccagtggtacctccctttctgtcatctattgccggcgttcccaccactgcagcagccactgctcctgtacctgctacaagtagtccaccaaacgacataagtacctccgtgattcagtccgaggtgaccgtgcctactgaggagggaattgctggtgtcgctacttcaacaggggtggtgaccagcggcgggttaccgatccctcctgtgtcagagtccccggtgctgagctcggtagtctcctccatcacgattcctgccgtggtgtccatttccaccaccagtccttcccttcaggttcccacctctacttcagagattgtcgtctccagcactgctctgtacccctcggttacagtcagtgccaccagcgcaagcgccggggggagcaccgccacccctggtcccaagccaccagccgttgtcagccaacaggccgcgggatccacaaccgtgggagctactcttacctcagtgtcaacaacgacaagcttcccaagcacagccagccaactatgcattcagctctcatcctctacttcaacccccactctggcggagaccgtagtcgtctctgctcacagtctcgacaagacttcccattcctcaaccacaggtctggcattttcattaagtgctcccagcagtagtagctcaccaggagccggagtgagctcgtacatttcacaacccggcggcctccatcctcttgtgattccaagcgtaatcgcctcaactccaatcctgccacaggccgcaggacccacatccactcccttactccctcaggtccccagtattccgccactggtgcagcctgtggccaatgtgcccgccgtgcagcaaactcttatacacagccagcctcagcccgccctattgcccaaccaaccccatacccactgcccagaggtggatagcgatacccagccgaaagcgcctggcattgatgacatcaagactctggaggaaaaactacggagcctgttcagtgagcacagctcctctggagctcagcatgccagtgtgtcattagagacttctctggttatcgagagcaccgtgacccccggaatcccaaccaccgcagtggccccgagtaaactattgacttctacaaccagcacatgcttgccgccaaccaacctaccgttggggacagtggctctgcctgtaactccagtcgtgacaccaggacaagtgtctacaccagtctccaccaccacttccggcgtcaaacctggcacagctccttcaaagcccccccttacaaaggcccctgtgctgcccgttggtacagaactacccgccggaacacttccctccgagcaattacctccttttccaggcccctccctaacccaaagccagcaacctctggaggatctcgatgctcagttgaggcggaccctgtcaccagagatgatcacagtaacttccgccgtcgggccagtgtcaatggctgcccccacggctataaccgaggctggaacccaacctcagaaagtgtcccaggttaaggaaggacccgtactggccaccagcagcggagcaggagttttcaaaatggggcgattccaagtaagcgttgctgcggacggggcccagaaggaggggaagaacaagtcagaggatgccaaaagcgtgcatttcgagtcttccacttccgagagctcggttctgtcaagcagcagtcctgaaagcaccctcgtgaaacctgagcctaatgggatcaccattccaggaatctcaagcgacgtgccagagtctgcccataagacaaccgctagtgaggctaagtcggatacaggtcagcccacaaaggtcggccgcttccaggtgacaaccacagctaacaaggtgggtcgcttctctgtgagcaagaccgaggataaaattactgacacaaaaaaggaaggccccgtcgcatcacctccattcatggacctagaacaggctgtgctccccgcagtgattcctaagaaagaaaagccagagctgtccgaacctagtcatctgaatgggcctagcagcgaccctgaagctgccttcctgtccagggatgtggacgatggctctggttcacctcattctccccatcagctctccagtaagagtttgcctagtcagaacttgtcacagagcctgagtaactcttttaactcttcctacatgagcagtgacaatgagtccgacattgaggatgaggatctgaaactggaactcagacgactgagggataaacatttgaaagagatccaggacctccaaagcagacagaagcacgagattgagtcgttgtacacaaaactcggcaaagtcccacccgcagtgattattccgccagcagcacctctgagcggcagacgacgaagacctaccaagtcaaagggatcaaaaagctcacgcagctctagcctaggaaataagtccccccagctgagcggaaacctctccggccagtcagctgcctccgtgctccatccacaacagacactgcatcccccagggaacattccggaaagcggacagaaccagttactgcaacccctgaaaccctcgcccagctcagataatctctattcagcctttacatcagacggggctataagcgtcccttccctcagtgcccccggccagggtacaagctctaccaacaccgtaggagctaccgtcaactcacaagcagctcaggcgcagccgcccgccatgaccagctccagaaagggcaccttcactgatgacctgcataagctcgtggataactgggctcgagacgccatgaacctgtccgggcgacgcggctccaagggccatatgaattacgagggtccaggtatggcacgcaagttcagcgccccagggcaactgtgcatatccatgacctctaacctgggcggctccgcgccaatcagcgcagcatcagcgacatcccttggtcacttcaccaaatcaatgtgtccaccgcaacagtatggattccctgctactccctttggggcacaatggtccggcacggggggcccggctccccagcctctggggcagttccagcctgtgggaaccgcctctctgcagaatttcaacataagtaatctccaaaagtccatctctaacccccccggttccaacttgaggacaacttag

SEQ ID NO: 140705 - DNA, 975 bp, Artificial Sequence
  Description of Artificial Sequence: Synthetic coding sequence
atgtcttcagacaacgagagcgacattgaggatgaggatttgaagctggaactcagacgccttcgagataaacaccttaaagagatccaagacctccagagtaggcagaagcacgaaattgagagcctctatacaaagttaggcaaagtgccccccgcagtaattataccacctgctgcacccctctctggtagacgtcgtagacctaccaagtccaagggctcgaagtccagtcggagttcaagtcttggaaacaagtccccccagctgtcaggaaacctttctggacagtccgcggcctcggtcttacacccccaacagacccttcaccctcccggaaacatcccagaatctgggcaaaaccagttgctacagccacttaagccaagccccagctcagacaatctgtattctgcctttacatcagacggtgccatcagcgttccttctttatccgccccaggacagggcacaagtagcacaaacactgtgggggccactgtcaacagtcaggcagctcaagcccaacctccagccatgacctcttccaggaagggaacctttactgacgacctccacaagctcgtagataattgggccagagacgccatgaacttaagtggcaggagaggcagtaaaggccatatgaattacgagggaccagggatggctcggaagttttctgctccaggccagctgtgcattagcatgacctcaaatctcggcggatccgcgccaatcagcgcggcctcagcaacctcactgggccatttcactaagagtatgtgtccaccacagcagtatggattccctgctacacctttcggcgcacagtggagcggtaccgggggtcctgcaccccagcctctcggccagtttcagcccgtaggcaccgcatccctgcagaactttaacatcagcaacctccagaaaagcatctcgaacccacctggctccaacctacgcactacatag

SEQ ID NO: 140706 - DNA, 7929 bp, Artificial Sequence
  Description of Artificial Sequence: Synthetic coding sequence
atgagtggcggcgcagccgaaaaacagagctcaacgcctggaagtttatttctcagcccccccgcacccgcccctaagaatgggtctagctcagactctagtgttggagagaaacttggcgctgcagccgccgatgcggtaaccggtagaaccgaggagtataggaggcgtcggcacactatggacaaggattcccgcggcgcagccgccactacaaccacaacggagcacagattcttccgtcgctcggtcatctgcgactctaatgctaccgccttagagcttcctgggctgcccttaagtctgccacaaccctctattcccgcagccgtgcctcagtcagcacctcccgagccacaccgggaggaaaccgtgacagcaactgcaacttcccaggtggcacagcagccccccgctgccgccgccccaggggaacaggccgttgcgggacctgcaccttcaaccgtgcccagttccacctccaaggaccggccggtgtctcagccgagcctagtgggaagcaaagaggagccacctcccgcaaggtctgggagcggcggaggttccgcaaaggagccacaagaggaacgcagtcagcagcaagatgacatcgaggagctggagaccaaggcagtgggaatgagtaatgatggccggtttttgaaatttgacattgagatcggccgtggcagctttaagacagtgtataagggacttgatacggaaaccaccgtggaagtcgcgtggtgtgagctgcaggataggaagttaactaagagtgaaaggcaaagattcaaggaagaagcggagatgctgaaaggcctgcagcacccaaatattgtccgtttctacgactcctgggagtcgacagtcaaaggcaaaaaatgtatagtcctggtgactgaactcatgacctccggcacccttaagacctacctgaagaggtttaaagtcatgaagattaaagtccttcgttcgtggtgccggcaaattctcaaaggattacagttcctgcatacaaggacccccccaatcattcatcgggaccttaagtgcgacaacatttttatcacaggccccaccggttccgttaaaatcggcgatctggggctcgctactttgaagagagcatccttcgcgaaatccgtaatcggcacacccgaatttatggctccggagatgtacgaggaaaagtatgatgagtctgtggacgtgtatgcatttggcatgtgtatgctcgaaatggccacttcagagtacccctattctgagtgtcaaaacgctgctcagatttatcgccgcgtaacatcaggcgtcaagccagcatcctttgacaaggtggctatccccgaggttaaagaaattatcgaagggtgtatccgtcagaataaggacgagaggtacagcataaaggacctgcttaaccatgccttcttccaggaggaaactggggtccgcgtggaactggctgaggaagacgacggggagaagattgccatcaagctgtggctacgaatcgaagacataaagaaactgaagggaaagtacaaagataacgaagctattgagttcagctttgacttggagagagatgttccagaggacgttgcccaggagatggtggaatcggggtacgtgtgtgagggtgatcataaaactatggcgaaagcaattaaggatcgggtttcactaatcaaaagaaagcgtgagcagcgacaacttgtgagagaagaacaggagaaaaaaaaacaagaagagtcttccctgaaacagcaagtggagcagagcagtgcgtcacagactggcataaaacagcttccatcagcaagtacaggcattccgacggcgtcgacaacttcagcctctgtgtcaactcaggtcgagccggaagagcccgaagctgatcaacaccagcagttgcagtaccagcaacctagcatcagcgtgctaagcgacgggacagtggattccggccagggaagcagtgtgtttacagagtcacgagtttcatctcagcagactgttagttacggctctcaacatgagcaggcccactcaacaggcacagttcccggacacatcccttctacagtgcaggcccagagccaaccccacggcgtgtatccgccaagctctgttccccaatccatggctcacccctgtggcggcacaccaacttatcccgaatcgcaaattttttttcctactatccacgaaagacccgtatcattttctccacctcccacgtgcccccctaaagtcgccatcagccaacgacgaaaatccactagcttcttggaggctcaaactcaccactttcagcctctactcaggacagtgggccaaagcctcttgccccctgggggcagtccaacaaattggacccctgaagcagtggtcatgcttggcaccacggccagccgcgttaccggcgaatcctgtgaaattcaggtccacccgatgtttgagccgagtcaggtctattcagattacaggcccgggctagtgctcccagaggaggctcattattttatcccccaggaagcagtttatgtggcaggggtgcactatcaggcaagagttgctgagcagtacgaaggcattccatacaattccagcgttctttcctctcccatgaaacagattcctgagcagaagcccgttcagggcggacccacctcctcctccgtctttgagttcccaagtggacaggcttttctagttggccaccttcagaacctcagattagacagtggcctcggccccggatctcccctttctagcatcagcgctcccatttctacagatgctacacgactcaaattccaccccgtgttcgtcccacattctgcccccgccgtgcttactcacaacaatgaatccagatccaactgtgtttttgagttccatgttcatacaccctctagcagctcaggagagggcggaggtatcctgccacaacgggtgtaccgcaacaggcaggtcgccgttgatctgaatcaggaggagctcccaccccaaagcgtcggacttcacggatacttgcaaccagttaccgaggagaagcacaactatcacgccccagagctcacggtgtccgtggttgagcctatcggccagaactggcctatcgggtcccccgagtactccagcgattcatctcagataacctcaagcgacccgagcgactttcagagccccccacccacaggaggagctgctgccccattcggcagtgatgttagcatgcctttcatccatctcccgcagaccgtgctccaagagtccccattgtttttctgcttcccacagggtaccacttcccagcaggtcctaacggcttctttctcttcaggggggtctgccttgcatcctcaggcccaggggcagtcccagggacaaccttccagctcgagcctcacaggcgtctcttcctcacagcccatccagcatccacagcagcagcagggcatacagcaaacagcaccacctcaacagaccgtccagtactctctgtctcagacgtcgacatcatctgaagctactaccgcccaaccagttagtcagcctcaagcaccccaggtcttaccccaggtgagcgccggcaagcagggctttcctccccggctccctcctcagtacccaggagattcaaacattgccccttcatccaacgtcgcttctgtctgcatccactccacagtcctcagccctcccatgcctacggaggttctcgccactcccggttactttccaactgtggtccagccctacgtagagtcaaatctgcttgtgcctatggggggcgttggcggccaagtgcaagtctcacagcccggaggatccttggcccaggcacccactacctcctctcagcaggcagtactcgagtccacacagggcgtgtcacaagtcgcccccgcagagccagtcgcagtcgctcaaactcaggccacacagcccacaaccctggcttcaagcgtcgacagtgcacactccgacgtggccagcggaatgtcagatgggaacgagaatgtgccttccagttccggccgacacgaaggacgcactacgaagcgtcattaccgcaagagtgtgcgaagcagaagtagacatgaaaaaacctcaaggccaaaacttcgcattctgaatgtctccaataagggtgatcgggtcgtagagtgccagcttgagacacataatcgcaagatggttacttttaagtttgatctggatggcgacaatcccgaggaaatagctactatcatggtcaataatgattttatactcgccatcgagcgagaatccttcgtagaccaggtgcgcgagatcatcgagaaagcggatgagatgctctctgaggatgtgtctgtggagcccgagggagatcaaggtctagagtctctccagggcaaggacgactacggcttctccggaagccagaagctggagggcgagtttaagcagcctattccggcatccagcatgcctcagcagattggaatcccgacctcctccttaactcaggttgtgcacagtgccggccgccgcttcatagtgtctcccgtgccagagagtcgcctgcgcgaaagtaaagtgttcccatcggaaataaccgacacagtcgcagcctcaaccgcacagtcgccaggaatgaacctcagtcactctgcaagtagtctcagcctacaacaggcattttcggaactgcgacgagcccagatgaccgagggccccaatacggctccacccaatttctctcacactgggccgactttccccgtcgtgccaccctttctctcatctatcgccggcgtgcccaccacggctgccgccactgcaccagtgcccgccactagctccccacccaacgacatttcaacttcggtcatacagtcagaagtcaccgtaccgacagaagagggaatcgccggggtcgccaccagcaccggagtggtgacatcgggcggtctccccataccccccgtctcagaaagccccgttctgtcgtcagtcgtttcctcaataactatccctgcagtggtgtcaatctctacaacatccccctcccttcaggtgccaacttccacctcagaaattgtcgtgtcctctactgctctgtaccccagcgtgacagtcagcgccacttctgctagcgctgggggatccacggcgactcccggaccgaaaccacctgcagtggtcagccaacaggccgcagggagcaccaccgtcggggcgacgcttacctccgtctcaaccaccactagtttcccatctactgcttcccaactgtgcatccagttatcatcatctacttctactccgacactggcagaaacggtggtggtgtcagcccacagccttgacaagacgagccacagttcaaccacgggcctggccttttctctttcggcccctagctcttccagctcacctggcgctggagtaagctcgtatatcagtcagcctgggggcctccacccactcgtgatcccctccgtcatagcatcaaccccgattctgccgcaggctgctggcccaacatcgactcccttactgcctcaggtaccctcgatccccccactcgtgcagccagttgccaatgttcctgcagtgcagcagacactgatccactcacagcctcagccagcgcttctgccaaaccaaccacatacgcactgtcctgaggtggatagtgacacgcaaccgaaagctcccgggatcgacgacattaagactctcgaggagaagctgcgctcgctattctctgaacattccagttcaggtgcccaacacgcttccgtctctctggagaccagcctcgtaatcgaatctactgtcacgccagggattcctactacggccgttgcacccagcaaattgctgacctctacgacgtccacctgcctccctcccaccaatctgcccctgggaacagtcgctcttcctgtgacacccgtggtaacaccaggccaggtctctacaccagtttctaccacgacctccggcgtgaagcccggaacagccccgtcaaagccccccctgaccaaggctcccgtgctcccggttggcacagaactccctgcagggactctgccatccgagcagttgccaccctttccaggcccaagtctgacccagagccagcagcccttggaagatctggatgcacagctacggcggactctctcccccgaaatgatcactgtgactagcgccgtcggccctgtaagcatggccgctccaactgccatcacagaagctggcacccaaccacaaaagggggtgtcccaagtgaaagagggtcccgtactggccacaagcagcggggccggcgtttttaaaatgggtcgattccaggtctctgtggccgccgacggtgctcagaaagaaggcaagaacaagagcgaggacgccaaatctgtccatttcgagtcgtcaacttccgaatcctcagtgttgagttcctccagtcccgaaagcacactagtcaagcctgagcccaatggcataaccatccctgggattagctctgatgtgccagagtctgcacacaaaaccaccgcgtcagaagccaagtccgataccggccagcccactaaggtgggcagatttcaagtgacaactactgccaataaagtaggaaggttctccgtgtcaaagacggaagataagatcaccgataccaagaaggagggtccagtcgccagcccccctttcatggatctggaacaggctgtgttgccagccgtgatacccaagaaagagaagcctgagctgtctgagcccagccaccttaatggcccgagctcagatccagaagcagccttcctgagccgcgatgtggacgatgggtcaggatctccgcattccccacatcagttatcatcaaaatcactcccctctcaaaatctgtcccaatccctgagcaattctttcaactcaagctatatgtcaagcgataatgagtcagacatcgaagacgaagacctaaagctcgaacttaggagactgcgggataaacatttgaaggagattcaggatctccagtctcgtcagaagcacgagatagaatccctgtataccaaattggggaaagtgccaccggccgtgataatcccacctgctgcaccattgtcaggcagacgacgtcgacccacgaagtcaaagggttctaaatcctccagaagctccagcctgggaaacaaatcgccacagctctccggcaatttgtccggtcagagcgcagctagcgtgctgcatcctcagcagaccctgcacccacccggcaacatcccagaatccggccaaaaccagctcctgcagccattaaagcctagcccaagctctgataacctttattccgcttttaccagcgatggggccatttctgttccttcacttagcgccccgggccaggggacctcctcgacgaacaccgtcggtgctactgtaaactcccaggccgcgcaggcccagccccccgcaatgacatcttcccgcaaggggacctttacagacgatctccacaaactcgtggacaactgggccagggatgctatgaacctctcagggagacgcggaagtaaaggacacatgaattacgaaggccccggaatggcaaggaagttttctgctccaggccagctgtgtatcagcatgacgtctaacctgggaggatcggcacccatcagcgctgcatcagctaccagcctggggcactttaccaagtctatgtgtcccccacagcagtacggattcccggccactccattcggagcccagtggtcggggaccggcggacctgcccctcaacccctcggccagtttcagcctgtgggcacagctagcctgcagaattttaacatctcaaacctgcaaaagtccatcagcaatccccccggctccaacctacggactacctag

SEQ ID NO: 140707 - DNA, 6894 bp, Artificial Sequence
  Description of Artificial Sequence: Synthetic coding sequence
atggatggcgacggggggagacgggacgttcctgggaccctaatggaacctggccgtggagccggccccgcgggcatggcagagccccgcgcaaaagctgccaggcctggtccccagcgctttctccggaggtcggtcgtggagagtgaccaggaggaaccgccagggctagaggccgccgaggctccgggtcctcagccgcctcaacccctgcaaaggcgcgttctgcttctgtgcaaaacccggcggttgatcgccgaacgtgcaagaggccgccccgccgcaccagcgcccgcagccctggtcgcccaacccggcgccccgggagcccctgccgacgcaggccccgagccggttggtacccaagagccgggacccgaccccatagctgctgccgtggagaccgctcctgcaccagacggaggtccccgcgaggaggctgccgctaccgtcaggaaggaggacgaaggagctgcggaagccaagccggagcccggccggaccagaagggatgaaccagaagaggaggaggacgacgaggacgacctgaaggctgtggcaacctcacttgacgggcgcttcctgaagttcgacatagaactgggacggggctcttttaaaacggtgtataaaggacttgatacagagacttgggttgaggtggcctggtgtgagcttcaagataggaaactcacaaagctggagcgccagaggttcaaggaggaggctgagatgttaaagggcctccaacaccctaatatagtgcggttctacgatttctgggaatctagtgcaaagggaaagcgctgcattgtgctggtcaccgagctgatgacttctggcaccctcaagacatatctcaaacgattcaaagttatgaagccgaaggtgctgaggagctggtgtcgccagatcctgaaaggactcttgtttctgcatacacggacgcctccaataattcaccgcgatctcaagtgcgataatatcttcattaccgggcccacaggttcagtgaaaattggcgacctcggacttgctactctgaagcgagctagtttcgccaagtccgtgatcggaaccccagagttcatggcccccgaaatgtatgaggagcattacgacgagagcgtggatgtgtacgcctttgggatgtgtatgctcgaaatggccacatcagagtatccgtatagtgaatgtcagaatgctgcacagatctataggaaagttacttgtggcatcaaacccgcatcattcgagaaggttcacgatccagaaatcaaagaaatcattggcgaatgcatctgcaaaaacaaggaagagcgctatgagatcaaagatctcctctctcatgcatttttcgccgaagataccggggtccgtgtggagctggcagaggaagatcatggaagaaaatctactatcgctttaaggttatgggtcgaagatccgaaaaagttgaaaggaaaaccaaaagataatggcgctatagagttcacctttgaccttgagaaggagaccccggacgaggtcgcacaagagatgattgagtcaggctttttccatgagtcagacgtgaaaatcgtggctaaaagtattagagaccgagtggccctaattcagtggcggagagagaggatttggcctgcccttcagccaaaggaacagcaggatgttggttcccccgacaaggctaggggccctcccgtaccccttcaggttcaggtgacctaccatgcgcaagccgggcagccagggccccccgaaccagaggagcccgaggcggaccagcatctgttacctccgacactgccgaccagtgcgacatccttggcatccgactctaccttcgatagcggacaaggtagcaccgtgtatagcgattctcagagttcccagcagagcgtgatgctgggaagtctggcggatgccgccccttcccccgctcagtgcgtgtgttctcctccagtgagtgagggaccagtcctccctcagtctttgcccagcctgggcgcatatcagcaacccacagcagcccctggcttgccggtaggctcagtgcccgcaccggcttgccctccctctcttcagcagcactttcctgatcccgccatgtcttttgcacccgtgttaccacccccttccaccccgatgcctacaggacctggacagcctgcccccccaggacaacaacctcctcccctggcacagcccacccctttaccccaggtgcttgcacctcagccggtggtaccactgcagcctgtgcccccccacctccctccgtatctggcacctgcttctcaagtgggcgcccctgcccagctgaagccccttcagatgccccaagcacctttacagcctttggcacaagtgcccccccagatgcctcccattccggtagtgccacctatcacaccgttggccggaatcgatgggctccctcccgcactgccagacctcccaacagccacagtgcccccggtgcctccgccccaatacttttcccccgcagtcatcttaccatccttggcagcccccctcccacctgcctccccggcattgccactgcaggcagtgaaactcccccaccccccaggtgctccactcgcaatgccttgccgtactatagtcccgaacgcccctgctactattccacttctggcagtggctccacccggggtggctgctttgagtatccatagcgctgtggcccagctgcccggacagccggtctaccccgcagcatttcctcaaatggctccaaccgacgtcccaccctctccacatcacacagtgcagaatatgcgagccacccctccgcagcccgcacttccccctcagccaactctgcctccccaacccgttctgccacctcaacctactctgcccccccaaccagtcctccccccgcagccgaccagaccacctcaacccgtactccccccccaacccatgctacctccccagccagtcctccccccgcagccagcattacccgttcggccagagccccttcagccccatctgcctgagcaagctgccccagcagcaacgcccggctcccagattttgttagggcatccagcgccatacgcggttgacgttgccgcgcaggtcccaaccgtccccgtgcctcccgccgctgtgttgtcccctcccttgcccgaagttttactgccagcagcacccgagctattgccacagtttccttcaagcttagctacagtttccgctagcgtccaaagtgtgccgacgcagaccgccaccctcctgcccccggcaaaccctccattacctggggggccaggaatagccagtccatgccccacagtgcagttaaccgtcgagccagtgcaggaagagcaagccagccaggacaagccccccggcctaccgcagtcatgtgaatcgtacggaggttccgatgtgacttctggaaaagaactaagtgattcgtgtgagggagcattcgggggtggtcgattggaaggacgagctgcacggaagcatcatcgccggtccaccagggcccgttcaaggcaggaacgggccagccgcccccgtctgacgatcctcaatgtgtgtaataccggagacaagatggtggagtgtcagcttgaaacccataatcataagatggtcaccttcaagttcgatctggacggtgatgctcccgatgaaattgccacatatatggtcgaacacgattttatccttcaggctgagagggagacgttcatcgaacagatgaaggatgttatggataaagccgaagatatgctgtcagaagataccgatgcagataggggtagcgatccagggaccagcccacctcatctgagtacttgtggcctggggactggggaggagtcacgacagagccaggccaacgctcccgtctaccagcagaacgtcctccacactggcaaaaggtggtttatcatttgtcctgttgccgagcatcctgctcctgaggccccagaatccagccctccactccccctcagctccttacccccagaagctagtcaggggccgtgcagggggctcaccttgccctgccttccatggaggcgcgccgcctgtggggctgtctttctgtctcttttcagtgccgagtcagcccaaagcaaacaaccccctgatagtgccccctataaggaccagctttcatccaaagagcagccatccttcctggcgtcccaacagctgctctctcaggctggtccttccaacccgccaggcgccccgcctgcccccctagcacctagctcacctcctgtgaccgccctgccgcaggatggggccgccccagcgaccagtaccatgccagaaccagcctcggggaccgcatcacaggccggcggtccaggaaccccccagggactgacatctgagttggagacaagccaaccactggccgagacccatgaggcacccctggctgtgcagccgctagtcgtggggttggccccctgtacccccgccccggaggcagcttcaactcgggacgcctctgccccacgtgaacctctacccccccccgcgcccgagccctcacctcattctgggacgccacagcctgcactgggccaacctgcccctctgctgcctgccgctgttggagccgtctctttggccacctcccagcttccgagtccccctctgggcccgaccgtccccccacagcctccttcagccctggaaagcgatggggaaggccctcccccgcgagtgggttttgtggactctactatcaaaagtctggacgagaagctccgaaccctgctctatcaggagcacgtgcctacctcctccgccagcgcagggacccctgtcgaggtgggtgaccgcgacttcacactggagccattgcgcggggatcaaccgcgctcagaggtgtgtggaggagacctggccctgccgccagtgccaaaagaggccgtgtccgggagagtacaactgccgcaacccctggtcgaaaagtcagagctggcgcctacaaggggtgctgttatggaacagggaacctcatcaagcatgacggctgagagttcgccaagatctatgctggggtacgatcgcgacggtaggcaagtggcttccgatagccatgtggtgccctcagtcccccaggacgtccccgcctttgtgcgaccggcccgcgtggaaccgaccgacagggacggcggcgaggccggggaatcctccgctgaacctcccccctccgatatgggcaccgtggggggccaggcctcccatccacagactctcggcgcccgagccttggggagccctcggaaacggcctgaacagcaagatgtctcgtcgcctgccaaaacagtgggacggttttctgttgtgtccacccaagacgaatggacacttgcttctcctcattcactgcggtactctgcccctccggacgtctaccttgacgaggctcctagcagcccggacgtgaagctggcagttcgccgagcgcaaacagccagctcgatagaggtaggagttggagagcccgttagttcagattctggagacgagggacctagagcacggccacccgtgcagaaacaggccagcctgcctgtttcgggctctgtggctggggacttcgtcaaaaaggcgaccgcatttttgcagaggccatcccgcgctggtagcttgggaccggagactccctcccgggtggggatgaaagtcccaacaatttcagtgaccagctttcatagccagagttcttatatctcctcagacaacgacagcgagcttgaggacgccgacatcaagaaagagttgcaaagcctgcgagagaaacaccttaaggaaatctctgagctgcaaagccagcagaagcaggagatagaagccctctaccgtagactgggcaagccactgcctcctaatgtaggattctttcacaccgcacctccaacaggtcgccgcaggaaaacttccaagtccaagctgaaggctggaaagctactgaatcctctggtccgccagctcaaggttgtcgcaagctcaaccggccacctggcggatagctctcggggacccccagctaaagaccctgctcaggccagcgtaggcctgacagcagattctactggactctcaggaaaggccgttcagacccagcagccttgttctgttcgcgcaagtctgagctcagacatctgttcggggctcgcctcggacggtggaggcgcgagaggccagggttggactgtctaccacccaacctcagagagagtgacatataagtcaagttcaaagcccagggctcgcttcctctctgggcccgtttctgtgtctatttggtccgctctgaaacggctctgtctcggcaaggagcactcttcccgtagtagtacgtcttccctggcacccgggccagaacccggcccacagcccgccctgcatgtccaggcacaagtgaacaattccaacaacaaaaaaggtacatttacggatgacctccacaagcttgtggacgagtggacctccaaaacagtcggagcggcccagttgaagcctacactgaatcaattgaaacagacccaaaaactacaggacatggaagcgcaggctggttgggcagcccccggcgaagcacgggctatgaccgctcctagagctggtgtcggtatgcctagactaccacccgctccaggccctctatcaactacggtgattccaggagcggcccccactctgtcagtgcctacgcctgacggggctctggggactgcaaggcgaaaccaggtttggttcggtttgcgcgtgccaccaacggcttgctgcggccacagtacccagccgagaggggggcagcgcgttggaagcaagaccgcgagctttgcggcctccgatccggtacggtcctag

SEQ ID NO: 140708 - DNA, 5601 bp, Artificial Sequence
  Description of Artificial Sequence: Synthetic coding sequence
atggccactagtgaatacccttactccgaatgtcagaatgccgcccagatctacagaaaagtgacctgcgggattaagcccgcctcgtttgaaaaggtgcacgatccagaaataaaagagatcatcggcgaatgtatctgcaagaataaagaagaacgctatgaaataaaagaccttctgtctcatgcgtttttcgccgaagataccggggtgagagtcgagctggccgaggaagaccatggacggaaaagcaccattgccctgcgtttgtgggtagaggaccctaagaagctgaaaggtaagcccaaggataacggcgctatcgagtttacctttgaccttgaaaaggagacgcctgacgaagttgcgcaggagatgattgagtccggctttttccacgagagcgatgtaaagatcgttgcaaagtccatccgggatagagtggccttgatccaatggaggcgggagcggatctggccggcgttgcaaccaaaggaacaacaggatgtgggctcaccagacaaagcgcgcggcccacccgtgcctcttcaagtgcaggtaacttatcacgcccaggccggtcaaccagggccacctgagccagaggaaccggaagccgatcagcaccttctgcctcctactcttccgacatccgcaactagcctagcctctgacagtactttcgattccggacagggatctacggtttactccgacagccagtcatcccaacagtcggtcatgttggggagcttggccgacgctgcaccctcgccggcacagtgcgtctgctcacctcccgtctcagaaggaccagtgctccctcagtccctcccatcactcggcgcctaccaacagccaacggcggcgcctggcttgcccgttgggagcgtgcctgcacctgcatgtccgccgtccttgcagcagcacttcccagacccagctatgagttttgccccagtacttccgcctccatcgacccctatgcctacaggccctggtcagcctgctccacctggacagcaaccccctccactggcacaacccaccccactcccgcaggtgttggcccctcaaccagtagttccactgcagcctgttcccccccacctgcctccctacctcgccccagctagtcaggtgggcgcccctgcccagctgaagcccctacagatgccacaggctccactgcaaccactcgcccaggttccaccgcagatgccccccatacctgttgtgcccccgattacaccccttgccgggatcgatgggcttcccccagctctgcctgatctgcctacagcgacagttccccctgtgcctccaccgcaatacttctccccagccgtgattctcccttccttggccgcgcccctgccaccagctagccccgcccttcctctacaggccgtgaaactcccacacccccctggcgccccgctcgctatgccgtgcaggaccatcgtacccaacgccccggccaccataccactattagcagtggctccaccaggtgttgctgctctgtcaatccattcagcagtggctcaactgccaggtcagcctgtgtatcccgccgctttcccccaaatggcacctaccgatgttccgccgtctccacatcataccgttcagaacatgagagctaccccaccgcaaccggcattgccaccccagccaaccctcccaccccagcccgtactgcctcctcagcccacacttccccctcagcctgtgctcccccctcagcccacgaggcctccacagccagttcttccccctcaaccgatgttacctcctcagcccgtcctccctccgcagcctgctctgcccgtcaggccggaacccctgcaacctcatctccccgaacaggcggctcctgcagcaacgcccggaagtcagatcctgctcgggcaccccgcaccttatgcggtggatgtcgccgcccaggtgcctacggtgcctgtgcctcccgccgctgtattaagccctccgctccccgaggtgttgctccccgcggcacctgaattattgccccagttcccaagtagcctcgctaccgtttccgctagcgtacaatctgtgcctacgcagacggccacactactgccgcctgcaaacccccctctccctggcggaccggggatcgcctccccatgccctactgtccagctgaccgtcgagcccgtgcaggaggagcaggcctcacaggataaaccgccagggctgccacagtcatgcgagagctacggcggatcagacgtgacaagtggaaaggagctgtctgactcatgcgagggggcttttggagggggcagattggaggggagagccgcaagaaaacatcacagacggtcaacaagagctcggtcacggcaggagcgcgcctcccgcccaagactgaccattctaaatgtgtgcaataccggcgacaagatggtggaatgccagctcgaaactcacaaccacaaaatggtgacattcaaattcgatttagacggggatgcccctgatgagatcgctacctatatggtggaacatgacttcatcctgcaagccgagagggagacattcatagaacaaatgaaggacgtgatggataaggcagaagacatgcttagtgaggatactgatgcggaccggggatccgacccaggaacttcccctccccacctgtccacctgcggtttaggtactggggaagaaagtaggcaaagtcaggccaacgccccagtataccagcagaatgtgctccacacaggcaagaggtggtttataatttgtcctgtggccgagcatccagcccccgaagcaccggagtcttctccccccttacctctttcctctctgcctcctgaagctagccagggcccatgtcgtgggctcacactgccttgcctcccttggagaagggccgcctgcggcgctgtcttcctgtcacttttctccgccgagtcagcccagtccaagcagccacccgactccgcgccatataaagatcagctgagttccaaggagcagccttcatttttagcgagtcagcagctcctctcccaggccggaccctctaatcctccgggcgcccccccagctcccctggcccccagcagcccccccgtgaccgctttaccccaggacggggctgcccctgccaccagcaccatgccagaaccagcctccggaaccgccagccaagctggcgggcctgggacaccccagggtctgaccagcgagctggaaactagtcagccactcgctgagactcatgaagcacctctcgctgtgcagccccttgttgtcgggctggctccctgtacaccagcccccgaggcggcctcaacacgagacgcctctgctccccgggagcccctgcctccacccgccccagagccgagtcctcactctggcactccgcagcccgctttgggccagccagccccactcttgccagccgccgtcggcgcagtaagcctggcaacctctcagttgcccagccctcctcttgggcccacagtgccgccgcaacccccctccgccctggagagcgacggcgaaggcccccccccacgcgtagggttcgttgacagcactatcaaatctctcgatgagaaactccgaaccctcctctaccaagaacatgtgcccaccagctccgcgagcgcagggacgcctgtcgaagtaggcgacagagattttaccctggaacccctgcgtggagaccagccacgttctgaggtttgcggcggcgatctggccctccctcccgtaccaaaggaagccgtgtccggacgcgtgcagctgccacagcccttggttgagaagagcgagttggcccctacccgcggggcagtcatggaacagggaaccagctcatctatgactgcagagagttctccccggagcatgctcggttatgaccgcgacggtagacaagtggcctctgactcacatgtggtgcctagcgtcccacaggatgtgcctgcctttgtcagaccggcccgagtggagccgactgacagggatgggggtgaagctggagagtcatccgctgagcctccgcctagtgatatggggactgtgggtggacaggcaagtcaccctcagacactcggcgcccgggcactggggagcccaaggaagcgtcccgagcagcaggacgtctcaagccccgctaaaacggtgggacgcttctccgttgtgagcacccaggatgaatggacactggcctcgccccattctctgcgttattctgcgccccccgatgtgtatctggacgaggccccttcttctcccgatgttaagcttgcggtgagaagggctcagacagcgtcctcgatcgaagtgggtgtgggggagcctgtcagctcagattcaggcgatgaagggccaagggcaagacccccagtgcagaaacaggcctccctgccagtgtctggttcagttgcgggtgactttgtcaaaaaggccaccgcatttctacaacgtccatcacgcgctggctccctgggccctgaaaccccaagtcgggtggggatgaaggtgccgactatctcagtcaccagctttcatagtcaatcaagttatatttcctccgacaatgatagcgagcttgaggatgccgatatcaagaaggagttacagtctcttcgggagaagcacctcaaagagatttcagaacttcagtcacagcagaagcaggagatcgaggccttgtacagacggctgggaaagcctctgccaccgaacgtgggattttttcatacggcgccccccaccggacgcaggcgcaaaacatcaaaatcaaagctcaaagctggaaagctcctaaacccattggtaaggcagcttaaggtggttgcctcctctaccggccacctcgctgacagcagcagaggacctccggccaaggacccagctcaggcttctgtcggtctcaccgctgacagcactggccttagcgggaaggccgtgcaaactcagcagccgtgctctgtgagggcatccctctccagcgacatatgcagcggccttgcttccgacggcggaggcgccaggggccagggctggacagtctatcatcctacgtctgagagagtaacctacaaaagctcctcgaaaccccgcgcaaggtttctgtccggacccgtctccgtgagcatctggtctgccctcaagcggctctgtttgggaaaggagcacagtagccgctctagtacatccagtctggcccccgggcccgagcccgggccacagccggcactccacgtgcaggcccaagtgaacaattcaaacaataaaaagggaaccttcactgatgaccttcacaagctcgtggatgagtggacttccaagactgtgggtgccgcccagttgaagccaacgctgaatcagctgaaacagactcagaagctccaagacatggaggcgcaggcgggttgggccgcccctggagaggcaagagccatgaccgccccacgcgctggcgtagggatgccgcgattgcctcccgctcctggacccctctccaccacagtcatccctggcgccgcgcccacattgagcgttcctaccccagaccccgagagcgagaaaccggactag

SEQ ID NO: 140709 - DNA, 1092 bp, Artificial Sequence
  Description of Artificial Sequence: Synthetic coding sequence
atggagcagggaactagctcttctatgacagagtcctcacctcggagcatgctcggctacgaccgcgatgggcggcaagttgcctccgattctcacgtcgtcccatctgtccctcaggatgtccctgcctttgtgcggccagcacgagtggaacctacagatagggacgggggcgaggcgggcgagtctagtgccgaacccccaccatccgatatggggacagtagggggtcaggcctcacacccccagaccttgggtgcccgagctttgggctcaccccggaaacgccctgagcaacaggacgtgtctagccctgccaagaccgtaggtcgctttagcgttgtgtctacgcaagacgagtggacacttgcttctcctcatagcctcaggtactccgcccccccagacgtgtatttggacgaggctccttcctctcccgatgtgaagcttgctgttcggagagcccagactgcctcaagcattgaagtgggggtgggcgagccagtcagctctgactccggcgatgaaggcccccgcgcccgaccccctgtgcagaaacaggcatccctgccagtgagcggctctgtcgcgggtgatttcgtcaaaaaagccactagctgtcgcggcctgttgggcccgtctctgggacctgaaactccttctagggtcggcatgaaagtgcctacgatatctgtgaccagttttcactcacagtcttcttatatcagctctgataacgattcggaactcgaagatgcggacatcaaaaaggaactgcagtcactgcgggagaagcacctgaaagaaatcagtgaactacaaagtcaacagaagcaagagatcgaagcactttatagacgtctagggaagcccctgcctcccaatgtgggattcttccacacggccccacccacaggtaggagacgcaaaacctctaagagcaaactgaaggcaggaaagttgctgaatcctttagtccgacagctcaaggtggtggcatccagtaccggccatttggctgatagttcccgcggtccaccggccaaggatcccaaaccagtgtggggatctcttcaaaccgcccgggcatag

SEQ ID NO: 140710 - DNA, 2340 bp, Artificial Sequence
  Description of Artificial Sequence: Synthetic coding sequence
atggaacctggaagaggcgcaggacccgcaggcatggccgagccccgagccaaggcggcacgcccagggccccagcggttcctgcgccggtcagtagtcgaaagtgatcaggaagagcctccgggccttgaggctgctgaggctcccgggccacagccaccgcagcctctgcagcgccgagtcctccttctgtgtaaaacacgacgccttatcgccgagcgggcccgcggaagaccagcagccccggcccctgctgcactcgttgctcagcctggtgcacccggagctcccgctgacgcgggtcccgagccagtcggtactcaggagcccggaccggacccaatcgctgctgccgtcgaaacagcgccagctccagacggagggcctagggaagaggctgctgcgacagtccgcaaggaggatgagggggcagccgaggcaaagccagagcccggccgcacccggcgcgacgaacccgaggaagaggaagatgatgaagacgatctgaaagcagtggccaccagcttggatggccggtttttgaagtttgacatagaattgggccggggttcgttcaagactgtgtataaggggcttgacaccgaaacctgggtagaggtagcctggtgtgaactgcaagaccgcaagctgacaaaactagaaaggcagaggtttaaagaagaagcagaaatgctcaaaggcctgcagcatcctaacatcgtccgcttctatgacttctgggagtcctctgccaaaggtaagcgatgcatcgttctggtgaccgaactcatgacatccggcaccctgaagacctatctgaaaagattcaaagttatgaagccaaaggtgctcaggtcctggtgtcgccagatcctcaaaggcctgttattcttgcatactcggacccccccgatcattcacagggacctgaaatgtgacaacatctttataacagggcccacaggaagcgtgaagattggggatcttggcttagctaccctgaagcgggcgagctttgcgaagtcagtgattggcacacccgagtttatggctcctgaaatgtatgaagagcactatgacgagtcagtggatgtctatgcattcggcatgtgcatgctggaaatggcaacttccgaatacccatattccgagtgccaaaacgccgcccagatctaccgtaaggtcacctgtggcataaaaccagcctcatttgagaaggtgcatgatcctgagatcaaagaaattataggagagtgtatctgcaagaacaaagaggaacgatacgaaatcaaggatttgttgtcccatgcattcttcgccgaagataccggagttcgggtggaactggccgaggaagaccacggtaggaagagcactattgctctgcgcttatgggtcgaggacccgaaaaaattgaaaggcaaacccaaggataacggggccatcgaattcacatttgatctggaaaaagaaacccccgatgaggtggctcaggaaatgattgaatctggctttttccatgaatccgacgtcaaaatagtcgctaaatcaatccgcgatagagtagcattaattcagtggaggcgagaacgaatctggccagccctccaaccgaaggagcagcaggacgtgggctctcccgacaaagccaggggaccccctgtgcccctgcaagtgcaagtcacttaccacgcccaggctggccagcctgggcctccggaaccagaagagccagaggcagaccagcacttgctgccacccacactacctactagcgccacctctctggcgtctgatagcaccttcgattctggtcagggcagcactgtatactcagactcacagtcgtcccagcagagtgtgatgcttggatcactggctgacgccgcccccagcccggcacagtgcgtgtgctctcctcctgtcagtgaaggcccagtcctgccacaatccctgccaagtttgggcgcctaccagcagcctaccgccgcaccgcccccattagcccagcccactcctctcccgcaggtgcttgctcctcagccggttgtccctctccaacctgtgccacctcacttgcctccttacctggcaccagcgagccaagttggagcaccagcgcagctgaaacccctccaaatgccccaggcccccctacagcctctggcccaagtgcccccccaaatgcctccgattcctgtggttccaccaatcacccctctcgctggcattgacgggctccctccagctctgccagatttacctaccgcaactgtcccacctgtaccccctccacaatacttctcccccgctgtaattctgcctagcctggccgcatag

SEQ ID NO: 140711 - DNA, 6654 bp, Artificial Sequence
  Description of Artificial Sequence: Synthetic coding sequence
atggatggcgatgggggtagacgcgacgtcccaggaaccctcatggagcctgggagaggggctggccctgccggtatggccgaaccccgggcgaaggcagccaggcccggtccccagcgcttccttagaaggtcagttgttgagagcgaccaggaagaacctccgggactggaagccgccgaagcacccggaccccagcctcctcagcccctccagagaagagtgctactcttatgcaagactcggagactgatcgcggaacgggcccgcggacgaccagcagcacccgccccagctgctctcgtcgcacaaccaggcgcccctggggctccggccgatgccgggcccgagcccgttggcacacaagaaccagggcctgaccccattgccgccgctgtggagacagccccagcccccgatggtggcccgagagaagaagctgctgccactgtacgcaaagaggatgaaggtgcagcagaagccaaaccggagcccggcagaaccagacgggacgaaccagaagaggaggaggacgacgaggacgacttgaaagccgtcgcaactagcctcgacggcagatttctcaagtttgacatagagctcggccgaggttcgttcaagaccgtctacaagggactcgacacagagacttgggtggaggttgcctggtgcgaactgcaagacagaaagctcactaaactggagagacaacggttcaaggaagaagcagagatgctgaagggactgcagcacccaaacatcgtgcgattctatgatttctgggagtcttctgcaaaaggtaaaagatgcatcgtgctcgtgacggagctaatgacgtcaggaactcttaagacgtacctgaagcggtttaaagtgatgaaaccaaaagtcctcaggagttggtgccggcagatcttgaagggactcctttttctgcatactaggaccccgcccattattcatcgtgatttaaaatgcgataatatatttatcaccgggccaaccgggagcgtcaaaatcggcgacctgggcctggctacacttaagcgcgcctcatttgcaaagtcggttatcgggactcccgaattcatggctcccgagatgtacgaggagcactatgacgagagcgtggacgtgtacgcttttgggatgtgcatgctggagatggccacctcagaatatccgtactctgagtgtcagaatgctgcccagatttatcggaaggtgacgtgtggaattaaacctgcctctttcgaaaaggttcatgacccggagattaaagagatcatcggagaatgtatttgtaaaaataaagaggagaggtacgaaatcaaagatttactgtcgcatgccttttttgccgaggataccggggtgcgcgtggagctcgcggaggaggaccatggacgcaagagcacaatagcccttagactgtgggttgaagacccaaagaaactgaaaggaaaacccaaggataacggcgcaattgagttcacattcgatctcgagaaggaaacacctgacgaggtagcacaggaaatgatcgagagcgggttctttcatgagtctgacgtcaaaattgttgctaaaagcattcgcgaccgtgtggccttaatccagtggcgacgcgaaaggatatggcccgcactgcaacccaaggaacagcaggacgtgggcagtcccgataaggctaggggcccgcctgtacctctgcaggttcaggtcacatatcatgcacaggctgggcagcctggacctcccgaacccgaggagccggaggctgaccaacatttgttacctccaaccctccccacgtcagccactagtctcgcttcagacagcacctttgactcagggcaagggtcaaccgtctattctgactcccagtccagccagcagtccgtgatgttaggtagcctagcggatgctgcccctagtccagctcagtgcgtctgctcgccacccgtcagcgaaggaccagtcctccctcagtcacttccatcactgggagcctatcagcagcctacggcagctcctggactgccggtaggtagcgtcccagccccagcctgtccaccctctcttcaacaacacttcccggaccctgctatgtccttcgccccagtccttccccccccttctacccccatgcccacaggccctggacagccagcacctccaggccagcagccaccccccctcgctcagccaaccccacttccacaggttctagccccccagcccgtggtacccctgcaacctgtaccaccccacttacctccctatctggccccagcatctcaagttggcgcacctgctcagctgaagcccctgcagatgccacaggcgccgctccagcccctcgcccaagttccccctcagatgccacctatccccgtggtgccaccaatcaccccactcgccggaatcgatggtttgccgcccgcattgccagacctccctactgccaccgtgccccctgttcctccgccccagtattttagcccggctgtaatcttgccgagcctggcagcaccactgccaccagcttctccagccctgccactccaggccgtgaaactgccgcaccctccaggcgctccccttgctatgccatgccgcacaatagtacccaacgcaccagcaactattcctctgcttgccgtggccccccccggcgtggcggcacttagcatacactctgcagtagcccagcttcccggacagccagtgtacccagccgcttttccccaaatggcaccgacagatgttcctccatcaccgcaccacaccgtgcaaaacatgcgcgctaccccaccccaacccgctctcccgccacagcccacgttacctccccagccggttctgccccctcagcccactctgcctcctcagcccgtacttcccccccagccgacccggcccccgcagccagttctgcccccgcaaccaatgctgcccccccagccggtcttgcctccacagcccgccctacccgtgcgccctgagccactgcagcctcacctgcccgagcaagcagcccccgccgctacgccggggtctcagatcctgttagggcatcccgccccttatgctgtggacgtagcagcacaggtaccaacagtgccggtgccccctgccgcagtccttagccctccccttccagaggtcctactccctgccgcaccggagcttttaccgcagtttccctctagcctggctacagtgtcagcgtctgtacagtctgtcccaacccagaccgccaccttgctgccaccagctaaccccccactgcccgggggtccagggattgccagcccctgccctaccgttcagctcactgtcgaaccagtgcaggaggagcaggcatcacaggacaagcccccaggacttcctcaaagctgcgagtcatatggagggagcgacgttacaagtggtaaagaactgagcgattcctgtgagggcgccttcgggggtgggagattggaggggagggcagccagaaagcatcatcgacgaagcactagagcacggtcacgccaggagagggcatccagaccccggctgaccattttaaacgtctgtaacaccggggacaagatggtggagtgccagcttgaaacgcataatcataaaatggtgacctttaaatttgatttagatggcgacgcccccgatgaaatcgccacatacatggtggaacacgattttattctgcaggcagaacgcgagacattcatcgagcagatgaaggacgtgatggacaaggccgaagacatgctgtccgaagatacagacgccgaccgggggagtgatcccggtacaagtccgcctcatttgtctacgtgtggcctcggtactggagaggagtcacggcaatcccaagcaaacgcaccagtctatcagcagaatgtcctccataccggaaaacggtggtttattatatgccctgtggcagaacatcccgctcctgaagcacccgaaagctccccaccgcttcctctatccagtctgccccctgaggcctctcaggactccgccccatataaagatcaactctcttctaaggagcaaccctccttcttagctagccagcagcttctgtctcaggccggtccatccaaccctcccggggctccgcccgcaccactggccccatcatccccaccagtgactgctcttccacaggatggggcggctcctgccacaagcaccatgcccgaacctgcctctggcaccgctagccaagccgggggacctggtaccccccagggacttactagcgaactggaaacgagtcagcctctggctgaaacacatgaggctccactggccgtgcagccactggtagttgggctcgccccctgtaccccagcccctgaagccgcttccacgcgagatgcaagtgcacctcgtgaacccctcccgcctccagctcctgagcccagtcctcattcaggtacacctcaaccggcattgggacaacctgcacccctcctgcctgctgccgtgggagcagtgagccttgcgaccagccagttaccatcaccacctcttggtcctaccgtgcccccacagcctccctctgccttggagtccgacggagaaggacccccgccgcgcgtggggtttgtcgactccactatcaagtcactggatgagaaattgaggacactgctttaccaggaacatgttccgacttcttctgccagcgccggaactccagtcgaggttggcgatcgggacttcacgttagagccattacggggggaccagcctagatcagaggtgtgtgggggcgacctggccctgccaccagtgcccaaagaagccgtttctggacgggtgcagctgccacagccacttgtggagaagagcgaactcgccccgacaagaggggctgtaatggaacagggcacatcctctagcatgaccgctgaatcatccccacgatcgatgctgggttatgaccgggatggacgacaggtggccagcgattcacatgtggtgccaagtgttccgcaagacgtgcctgccttcgtgagacccgctcgggtggagccaaccgaccgtgacgggggcgaggccggagaatctagcgccgaacctccaccaagcgacatgggcaccgtcggcggacaggcctcccacccgcagaccttaggggcccgagctcttggtagcccccgcaaaaggccagaacagcaggatgtgtcaagccctgcaaagaccgtggggagatttagcgttgtcagtactcaggatgagtggaccctggcgagtccgcattcactgcgatattccgccccccccgacgtgtatctagatgaggcccctagttccccagatgtgaaactggccgtgaggcgcgcacaaaccgcctcaagtattgaagtgggggtcggcgagcccgtatcttccgactccggagacgaggggccacgcgcccgtcccccagtacagaaacaggcctccttgccagtcagtggatcagtggccggagatttcgtaaaaaaggctacggcctttctgcagaggcccagtcgggccgggagtctcgggccggagacccccagcagggttgggatgaaagttccaaccatttctgttacctccttccactctcagtcctcttacatcagcagtgacaacgactccgaactcgaggatgcagacatcaaaaaagagctgcagagtctccgggaaaagcatctgaaggagatcagtgagctgcagtcgcagcagaaacaggagattgaggccctctatcgccgcctgggaaagcccctcccccccaatgtcggcttctttcacactgcacctcccactggccggcggcggaagacttctaaatctaagctcaaagctggaaagttactgaatcccctcgtgagacagctgaaggtggtcgcctctagcacaggccatttagccgactcttcccggggcccacccgccaaggaccccgcccaggcctccgtcggactgactgcagactcaacaggtctttcaggcaaggccgtgcagacacagcaaccatgttcggtgcgagcctctctgtctagcgacatctgctcgggactggcctcagatggtggaggcgcgcgaggtcaaggttggaccgtttatcatcctactagcgaacgagtgacatataagtcttcttcaaagccccgggctaggttcctgtcaggtccagtcagcgtttccatctggagtgctttgaaacgactatgccttggtaaggaacacagtagccgctcttcaaccagctccttagctccaggcccagagccggggccccagcctgctcttcatgttcaggcccaggtgaacaattcaaacaacaaaaagggaaccttcactgacgatttacataagctggtggacgaatggactagtaagactgtgggagcagcacagctcaagcccacactgaaccagctcaaacaaacccagaaacttcaagacatggaggcacaggccggatgggccgcccccggtgaggcccgggccatgaccgcccctcgcgccggggtcggaatgcctcggttacctcccgcccccgggccacttagcaccaccgtgatccccggtgctgcccctaccttgtctgtcccaactcccgaccccgagagcgagaagccagactag

SEQ ID NO: 140712 - DNA, 5511 bp, Artificial Sequence
  Description of Artificial Sequence: Synthetic coding sequence
atggccacaagcgagtacccctattctgaatgtcagaatgccgcccagatttatcgcaaggttacctgtggcattaagcctgccagctttgaaaaagtgcatgatcccgagatcaaggagattatcggggagtgcatctgtaagaataaagaagaacggtatgagattaaggatctcctgagccatgcattctttgcggaggacactggagtgagggtggagttagcagaggaagaccacggccgcaaatcaacaatagccctcagactctgggtggaagatccaaagaaactgaaaggaaagccaaaggataatggcgccatcgaatttaccttcgaccttgagaaggagacccctgacgaagtagctcaggagatgattgaatcaggcttcttccatgagtctgatgttaagattgtagccaagtctattcgcgatagggtggcactaattcagtggcggcgtgagagaatttggcccgcactgcagccgaaagaacagcaggatgtgggctcgcccgataaagctagaggcccgcctgtgcccctgcaagtgcaggtgacgtatcacgcccaagccggtcaacctgggcccccagaacctgaagaaccagaggcagaccagcacctgctaccaccaacactcccaacttccgcaacatccctcgccagtgatagtacctttgactctggccagggcagtacagtttattctgattcgcagtcaagtcaacagtcagttatgttggggtctttggccgacgcagccccctcgcctgcccagtgcgtatgttcccctcctgtgtcagagggcccagtgctgccgcagagcctgccctccttgggcgcataccagcagccaaccgcagccccagggcttccagtcggatctgtgcccgctcctgcatgccccccatcactacaacaacactttcccgatccagcaatgtccttcgcacctgtactgccacctccaagtacacccatgcctactggccctgggcagccagctcccccgggtcaacagcctcccccgctggcccagcctacccctttaccacaagtgttggcgccccagccggttgtgccgttgcagcccgtgcctccccaccttccgccgtacctcgcaccagcctcacaagtaggcgcaccagcccagctgaaacccttacaaatgccacaggctcccctacagccacttgcgcaggtacccccccaaatgccacccatccccgtcgtgccacccattactccacttgccggcatcgacggcctgcccccagctctcccagacctgccaactgccaccgtgcctcccgtgccacctccccagtacttcagccccgccgtcatccttccttccctggcagcccccctgccacctgcgagcccggcgctgccacttcaggctgtgaagctgcctcacccccccggtgcaccccttgcaatgccctgcaggaccatagtgcccaacgcaccagctactattccactcctggcggtggctccccctggcgttgccgccctctccattcacagtgctgtggcccaactccctggccagccggtatatcctgccgcatttccccagatggcacccactgacgtacccccttctccgcaccataccgtacagaatatgcgcgctacccctccgcaaccagccctgcccccacagccaacgcttcccccccaacccgtgttgccaccacaacctactctgccccctcagcccgtgctcccacctcagcccacaagacccccgcagccagttctgccccctcagcccatgctccctccccagcctgtgttgccaccgcagccggctctgccagtcagacctgagcctctgcagccacaccttcctgaacaggctgccccagccgccactccaggctcacaaattttactgggacaccctgcaccttacgcagtcgatgtcgccgcccaggttcctacggtgcctgttcccccagcagccgtgctctcccctcccctccccgaggtcttgttgccagccgctcctgagttgctgccccagtttccgtcaagcctggcgactgtcagcgccagtgtgcagagcgtacctacccagacagcaacattgctcccccctgcaaacccgccactgccaggcggccccggaatcgcgagtccttgtcccactgtccaactgactgttgaaccagtgcaggaggagcaggcctcccaggacaaaccacccggtctccctcagtcttgtgagtcctacggtgggagcgacgttacatcagggaaagagctaagcgattcttgcgagggtgcctttggaggcgggagattagaaggaagggctgcccgcaagcaccacaggcgaagtaccagggccaggtcgcgacaggaaagagcaagcaggccaagattaaccatcttgaatgtttgtaatacaggggacaaaatggttgagtgccagcttgaaacccacaaccataagatggtcacatttaagttcgatctcgatggcgatgcccctgatgaaattgccacgtatatggtcgaacatgacttcatactgcaggctgagcgagagacctttatcgagcaaatgaaagatgttatggataaagccgaagatatgctaagtgaagatacagacgcagaccgcgggagcgatcctggcacatcccctcctcacctgtccacgtgcggcctgggcaccggggaagagagccgccagtcccaggcaaatgcacctgtatatcaacaaaatgtgctccacactgggaagcgatggtttattatctgcccagtagccgagcatcccgcacccgaggccccggagagcagcccacctctgccattatcatcactgccccctgaggccagccaggattccgctccctacaaagaccagctttcttcgaaggagcagccttcctttctggctagccagcagttgctatctcaagcaggccctagcaatccaccgggcgcccctcccgccccactggccccttcatctccccccgtgacggccctgccccaggacggcgccgcacctgcaacttctactatgcctgagcctgcctccggaaccgcctctcaagcaggaggtccagggactccacagggattaacctccgagctggaaactagccaacctctggcggaaacgcacgaagctccccttgcggtccagccgttggtagttgggttggcgccttgcacccctgctccagaggctgcctctacaagagacgccagtgcaccccgggagcccttgccaccacctgccccagaaccatccccacattcaggtaccccacagcccgcactcggacagcccgccccactcctccctgcagctgtgggggctgttagtctggccacttctcagctaccctctccccccttgggacccacagttccaccacagcctcctagtgctctggaatcagatggcgaggggcctccgcctcgggttgggttcgtggactctacaatcaaaagtcttgacgaaaagctgcgcaccctgctctatcaggagcacgtcccgacatcctctgcaagtgcaggcactcccgttgaagtgggggaccgagattttaccctggagccactacgaggcgatcagccccgttccgaggtatgcgggggggacctcgctctgccacccgtgccaaaagaggctgtgtcaggaagggtccagctaccacagcctctggtcgagaaatctgaactagcgcctacaagaggtgctgtgatggaacaagggaccagtagttctatgacggccgagagctccccaagatccatgctgggttatgatcgtgacggacgacaagtggctagcgattcccacgtggttcccagtgtgccacaggacgttccagcctttgtgaggcctgcccgcgtggagcctacggatcgcgatggtggagaggccggggagtcgtctgcagagccaccaccatccgatatggggaccgtggggggccaagccagccacccgcagactctgggagccagggcactgggctccccccgcaaacgcccggagcagcaggatgtgtcatcaccagcaaagaccgttggtcgattcagcgttgtgtctacccaggacgagtggactttggcttccccgcattctctgagatacagcgctccccctgatgtatatctggacgaggcaccttcatcacctgacgtgaaactggctgtcaggcgggcgcaaacggcgtcatccattgaagtcggcgtgggggaacctgtttcttcagatagtggagacgaaggacctcgcgcaaggccaccagtacagaaacaggcctcgcttcccgtatctggctctgtcgccggggactttgtcaaaaaggcaactgcgtttctgcaacgccctagccgtgccgggtctctcgggcctgagacgccaagcagggtaggcatgaaggtgccaactatcagcgtcacatcatttcactcccagagttcatatatctcctcagacaatgacagcgagctcgaagacgctgatatcaagaaggagctacagtccctgagagaaaaacatctcaaggaaatctctgagttgcagagccaacagaagcaggagatcgaagctttgtatagaagacttgggaaacctcttccacctaacgtcgggttcttccataccgccccaccaactggaaggcgacgcaagacatccaagtccaagttaaaggcgggcaagctgcttaacccactggttagacagctgaaggtggttgccagttcaacaggccacctcgctgattcatcccgcggaccacccgcgaaggaccccgctcaagcttctgtggggctaactgcggatagcactggcctaagcgggaaggcggtacagacccagcagccctgcagtgtacgggccagcctttccagtgatatctgttctgggctggctagtgatggcggtggagctcggggacagggctggactgtttaccacccaacatctgagagggtcacatacaagtcttcctccaagccccgggcgcgcttcctgtctggcccagtgtccgtgtcaatctggtccgcacttaagaggctttgcctcggtaaggagcactcctcccggagctccactagctcactagcacccgggccagaaccaggccctcagccggctctacatgtccaagcccaagtgaacaacagcaacaataaaaaaggtactttcacagacgatctgcacaaactggttgacgagtggacatcaaagacagttggtgcggctcaacttaaacctacgttaaaccagctgaagcaaacccagaaattgcaggacatggaggcccaggctggctgggctgcccctggtgaggcacgcgctatgaccgcccctcgagcgggcgtgggcatgccaaggctgcctcccgctcccggccccctgtcaacaacggtcatcccaggtgccgccccgaccctctcagtacctacacctggaagctgtggaccccgcgccgtgtcaacacccacttcctatacttag

SEQ ID NO: 140713 - DNA, 5403 bp, Artificial Sequence
  Description of Artificial Sequence: Synthetic coding sequence
atggccaccgactccggcgaccccgcaagcactgaagactccgagaaacctgatggcataagcttcgagaaccgggtccctcaggttgcagctacacttactgtcgaggcccgtctgaaggagaagaacagcacattctcagcctccggggaaacggttgaaagaaagcgtttttttagaaaatctgtggagatgacagaggatgataaagttgctgagtcaagtcctaaggacgagcgcatcaaagccgccatgaatattcctcgcgtggataaactgccgtcaaacgtgttacggggagggcaggaagtaaaatatgagcagtgtagcaaaagcacatccgaaatttctaaggattgttttaaagagaaaaatgaaaaggagatggaggaagaagctgagatgaaagctgttgctaccagcccatccggcaggtttctcaagtttgatatcgagctcggaaggggtgctttcaagacagtttacaagggactggacactgaaacctgggttgaagtagcgtggtgcgaactgcaggaccgcaagcttaccaaggccgagcagcagcgtttcaaagaggaagctgaaatgctcaagggactgcagcaccccaatattgtacggttctacgattcctgggaatctatccttaaagggaagaaatgcatcgtgctagtgactgagctcatgacgtctggcactcttaagacctacctcaaacggtttaaggttatgaaaccgaaggtgttgcgctcttggtgtcggcagattctgaaggggctccagttcctccacacccgaactcctccgatcattcatagggatctgaagtgtgacaacatatttattacgggccccactggatccgtgaagattggcgatctcggtctcgctaccctcatgagaacatcctttgcaaaatccgtcatcggcacacccgaattcatggcgccggagatgtatgaggagcactatgatgagtccgtagacgtgtacgccttcggcatgtgcatgctggaaatggctacatctgaatatccctattccgaatgtcagaatgccgcccagatctaccgaaaagtgacctcggggatcaaaccagcaagcttcaataaggttacagaccccgaggtcaaggagatcattgagggctgtatccggcagaacaagtctgagcggctctcaattcgagatctgcttaatcatgcttttttcgcagaggacacaggcttgagagtggaacttgcagaagaagacgattgcagcaactcaagcttggctcttcgtctttgggtggaggatcctaaaaagctcaagggcaagcataaggataatgaggccattgaattttcttttaatctcgagacagacactcccgaagaagttgcgtacgagatggtgaagtccggcttttttcacgagagcgactcaaaagcagttgccaaatcaataagggatcgcgtgacacccattaaaaagaccagggagaaaaagcctgcaggttgcctggaggagagaagggatagccaatgtaagtctatgggtaatgtttttcctcagccccagaacacgacgcttcccttggcccccgcccagcagacgggcgctgaatgtgaggagaccgaggtcgatcagcacgtcagacaacagcttttacagcgcaagcctcagcagcactgctccagtgttaccggtgataatctttcggaagctggtgcggcctcggtgatccactctgacacaagcagtcagccaagtgttgcctatagttctaatcaaaccatggggtctcaaatggtcagcaacatcccacaagctgaagtgaacgtgcctggccagatctacagtagccaacagctggtaggccactatcaacaagtttcgggactgcagaagcattcaaagctgactcaaccccaaatcctacctttagtgcagggacagtctaccgtgctccctgtgcatgttttaggacctactgtcgtgtcgcagcctcaggtgtccccactaacagtccagaaggtgccacagatcaaaccagtaagccagccagttggcgcagagcagcaggccgcactgctgaagccggatctggttcgctccctaaaccaagacgtggctaccacaaaggagaacgtaagctctcctgacaatccgtctgggaatggcaagcaagacagaatcaaacagaggagggcatcttgccccaggccagagaaagggactaaattccagttgactgtcctgcaggtgtctacttctggtgataacatggtggaatgtcagctcgaaacccacaataataagatggtgacattcaagtttgacgttgacggtgatgctccagaggatatcgctgactacatggtggaggacaattttgtgctggagtccgaaaaagagaaattcgtagaagagctgagagcaatagtggggcaagctcaagagatcttacacgttcatttcgccactgaacgcgccacaggagtagattctattaccgtcgactctaacagctcccagacgggttctagtgaacaagtgcaaatcaattccaccagcacacagacgtcgaatgaatccgctcctcagtcttcacctgtcggtcgctggagattctgtattaaccagaccatacgcaatagagagacccagtctcctcccagtcttcagcatagtatgtcagccgtacccggaaggcatccattaccttctcccaagaatacatcaaacaaggagatcagtcgtgataccttattaacaatcgagaacaatccctgccatcgtgctctgttcacttcaaaaagtgagcataaggacgtcgtggatggaaagatatctgaatgcgctagcgtggagacaaagcagccagccattttatatcaggtggaggacaaccggcagatcatggcccctgtgactaattcttcctcttatagcaccacaagtgtgcgggccgtgccagcggaatgcgaaggcctcaccaaacaagcaagtatcttcattccagtgtacccctgtcatcagaccgcctctcaggcagacgcactgatgtcccatccaggtgagtcgacacagacctccggtaacagcctgacgactttggcctttgatcagaaaccccagacgctgtcagtacagcagcccgctatggacgcagagttcattagtcaagaaggcgagaccaccgtcaatacagaagctagttctcctaaaaccgtaataccgacgcagacccccggactcgagccaactacgcttcaacccactaccgtgctggagagtgacggagagaggccaccaaaactcgaatttgcagacaaccgcataaaaacactggacgagaaactgaggaatctcctgtatcaggagcatagtatctcatctatctatcccgaaagtcagaaggatactcaaagtatcgacagtccgttttcaagcagcgctgaagataccctttcatgccctgtgacggaggtcattgctatctcacactgcgggattaaggattcacctgtccagtccccaaactttcagcagaccgggtcgaagctgctgtctaatgtcgcggctagtcagccggcaaatatatcagtctttaagagggatttaaatgtgatcacatcagtgccaagtgaactgtgcctgcatgagatgtcctcagacgcatccctccccggcgacccagaggcataccccgctgccgtgagcagtgggggtgcaatccatctgcagaccggcggaggctactttggtctgtcctttacctgcccctccttgaagaaccccattagcaagaaaagttggactaggaagttgaagagttgggcttacagattgcggcagagtacctcttttttcaaaaggagcaaggtgagacaggttgaaaccgaggaaatgagaagtgcgatcgcccccgatcccatacctctgacgagggagtcaacggctgatacacgagccttaaatcggtgtaaggctatgtccggcagctttcagcgggggcgatttcaagtgataaccatcccgcaacagcagtctgccaaaatgacctcatttgggatcgaacatatttcagtgttcagcgaaactaaccacagttctgaggaggctttcatcaagaccgccaagagccagctagtggagatcgagcctgccacacaaaacccgaaaacctctttttcctatgagaaattgcaggcacttcaggaaacttgtaaggagaacaagggagtgcctaagcagggcgacaattttctttccttctctgccgcttgtgagactgatgtgtcatctgtgacccccgaaaaggagtttgaagagactagcgcgaccggttcaagcatgcagtccggtagtgaactcctgctcaaggagcgggagatcctgacagccggcaagcagccctcaagcgatagcgagtttagcgccagcctggctggatcaggaaagtctgtagccaagacaggtcctgagagtaaccagtgcctacctcaccatgaagaacaggcctatgcccaaacccagtcttcactgttttactctccatccagccccatgtcctctgatgacgagagcgagattgaagatgaagacctgaaggtggaactgcagagactgagagagaagcatattcaggaggtggtgaatctgcaaacccagcaaaataaagaactgcaagagctgtacgaaagacttaggtctatcaaagatagcaagacgcagtctaccgaaatccctcttccacccgcatcaccccgacggccaagaagcttcaaatctaagctcaggagccgccctcaaagcctgactcatgtagacaacgggattgtggccacaggcaagtcatgcctgatcaacgaattggagaatcccctctgcgttgaaagcaatgctgcctcctgtcagcagtccccagccagcaagaagggtatgtttaccgatgacctgcataaactcgtggacgattggactaaagaggccgtagggaattccctcataaagccttccttgaatcagctgaaacagtcccaacacaagttagaaaccgagaattggaataaggtctcagaaaatactccgagtactatgggctacacgtccacatggatctcatctttgtcgcagataagaggtgccgtgccgactagcctgccccagggtctaagccttcccagtttccctggcccactcagttcgtacgggatgccacacgtctgccagtacaatgccgtcgcaggcgccgggtacccagtccaatgggtgggcatttccggtacgacccagcagtcagtggtaatccctgcacaatctggtgggcccttccagcctggaatgaacatgcaggccttccctactagctcagtgcagaaccccgccactataccccctggtcctaagtag

SEQ ID NO: 140714 - DNA, 5403 bp, Artificial Sequence
  Description of Artificial Sequence: Synthetic coding sequence
atggccactgattctggagatcccgccagcacagaggacagtgaaaagccagacggcatttccttcgagaaccgggtaccacaggttgcagccacattgacagtggaggccaggctcaaagaaaaaaatagtaccttcagtgctagtggagaaacagtggaacgcaagagatttttcagaaaaagtgtggagatgactgaggatgacaaggtggcagaaagtagtcctaaggacgagcggatcaaggctgcaatgaacatccctagggtcgataagctgccatccaatgtgctgcgcggaggacaggaagtcaagtacgaacagtgttctaagagcacttcagaaatttccaaggactgcttcaaggagaagaatgagaaagaaatggaagaggaagcagaaatgaaggcagttgcaacgagcccctccggtaggttcctgaagttcgacattgaattgggaaggggcgccttcaagaccgtgtacaagggcctggacaccgaaacatgggtggaggtggcttggtgtgagctgcaagataggaagctgacaaaagctgaacagcagaggttcaaggaggaggcagaaatgcttaaaggattacagcatccaaacatagtccgcttctacgacagttgggagagcatcctgaaaggcaaaaagtgcatagttctcgtgaccgagctgatgaccagcggtacccttaaaacgtatctgaagagatttaaagtaatgaaaccgaaagtgcttcggtcctggtgcagacagatcttgaagggactccagttcttgcatactaggactccgccaattatccatcgggatcttaagtgcgataacatttttataaccggtcctactggctccgtcaagatcggcgaccttggcttagctactctgatgaggaccagttttgccaaatcagtgatcgggacccctgagtttatggccccggaaatgtatgaagagcactatgacgaaagcgtggatgtctatgcttttggcatgtgtatgctggagatggccacgtcggagtacccttattctgaatgccagaatgccgcccagatctaccgaaaagtgacatcaggaataaagcctgcttcattcaataaggtaaccgaccccgaagtgaaggagatcatcgaagggtgcataaggcagaacaagagtgagagattaagtatcagggatttgctgaaccacgccttttttgctgaagacactggattgagggtggagctagccgaagaggatgactgctctaactctagcctggctttaaggctctgggtggaagaccccaagaaactcaaaggaaagcacaaggacaatgaggccatagagttttctttcaatctcgagaccgacacacctgaagaagtggcatacgagatggttaagtcaggcttttttcacgagtccgatagtaaagctgtagccaagtccatccgagatcgtgttactccaatcaagaagactagggagaagaagcccgcgggctgcttagaagaacgacgggatagccaatgcaagagtatgggcaacgtctttccacagccacagaatacgacactacccctagcacccgctcagcagactggggcggagtgcgaagagacagaggtggatcagcacgtgagacagcagctcctccaacgcaagcctcagcagcattgcagttctgtgacaggtgacaacttatccgaggctggtgcggcctccgtgatccatagcgacacttccagccagccttcagtcgcttactcatctaatcagactatgggctcacagatggtgtccaacatcccccaggcagaggtgaatgtccctggtcagatttacagtagtcagcagctggtcgggcactaccagcaggtgtctggcttgcagaagcattcaaagctgacccagccacaaattctgccgttagtacagggccaaagtacagtgctcccagtacatgttctgggccctactgttgtgagccagccccaagtgagccctctcacagttcagaaggtacctcagataaaaccggtgtcccagcccgtgggagccgagcagcaagccgctctgctcaagcccgacctggtgcgctctctgaatcaagatgttgctacgaccaaagaaaatgtgagttcccctgacaatccatccggaaatgggaagcaggaccgaatcaaacagcgtcgggcttcttgtcccagacctgagaagggcaccaaatttcagttaaccgtgctacaggtcagtaccagcggcgacaacatggttgagtgccagctggagacgcataataacaagatggtcactttcaagttcgatgttgacggcgacgccccagaggatatagccgactacatggtcgaggacaattttgtccttgagtctgagaaggagaaattcgtcgaggaacttcgagcgatcgttgggcaggcccaggaaatcctgcacgtccactttgccaccgagcgggccacaggcgttgactctataaccgttgattccaacagctcccaaaccggctctagcgaacaggtgcagatcaacagcaccagtacacagacttctaacgagtcagctccccagtcttccccagtgggaagatggcgattctgtataaatcagacaatacgtaacagagagacccagagccccccatcattacagcactccatgtccgcagtgcccggaagacatcctctgccgtcacctaaaaataccagcaacaaggagatctcccgggatacgctgctgaccatcgaaaacaacccctgccacagagccctgtttacaagcaagtccgaacataaggacgtggtcgatggaaagattagcgagtgtgcttcagtcgagactaaacaacccgctattctgtaccaggtggaggataacaggcagattatggcacctgtgacgaattcctcctcctattccaccaccagcgtgcgcgccgtgccagcagaatgtgaaggcctaaccaagcaagcatcgatctttatccccgtgtatccttgccatcagacggcatcacaggccgacgccttgatgagtcatcctggagagtcaactcagacgtcaggaaattctctgacaacgctggccttcgatcagaagccccagacactctccgtacagcagcccgcaatggacgcggaattcatttcccaggaaggcgaaaccacagtgaacacggaagccagtagccccaagactgttatccccacccaaacccccggcctggaacccacgacattacagccaacaacggtcctagagtcggatggtgagcggccgccaaagctagaatttgcagacaaccgtattaagacactggacgagaaacttagaaatctgctttaccaggaacatagtatcagctccatctaccctgaatctcaaaaggatacccagagcatcgatagccctttttctagtagcgctgaagacacactctcttgccccgtgacggaggtgattgcgatctctcattgcggtataaaggactctcccgtccaatctccgaactttcagcagactggatctaaactgttatccaatgtggcagcaagtcaaccggccaatatttccgtgtttaagagggaccttaacgtaattacatctgtgccctcagagctatgcctgcatgagatgagcagcgatgcaagtttacctggggaccccgaagcctatcctgctgccgtgagctcaggcggcgcaatccacttacagacagggggaggctactttggcctgtctttcacctgcccaagtcttaaaaatcctatttccaaaaagtcttggacacgcaagcttaagagctgggcgtatcggctgcgacagtccacctcattttttaagagatctaaagtgagacaggttgaaacagaggagatgcggtctgctatcgccccagatccaatccctttgacccgagaatctacagctgacacaagggccctcaatcgatgcaaggcaatgtccggctcattccagcggggccggtttcaagtaataaccattccccagcagcaatccgccaagatgacatccttcggaattgagcatatcagcgttttcagtgaaacaaaccattcaagcgaggaagcattcattaaaaccgctaaatcccagctcgtggaaatagagccagcgacacaaaacccgaaaacctctttctcatacgagaaactgcaggcattgcaggaaacttgtaaagagaacaagggtgtccccaagcagggagataattttctgtcttttagtgccgcatgcgagactgatgtgtcatcagtcaccccagagaaagagttcgaggagaccagcgcgacagggagcagcatgcaaagcgggagcgaacttttgttgaaggaacgggaaattctgaccgctggcaaacagccatccagcgatagtgaattctccgcctccctggccggatcaggcaaatccgtcgctaagacgggaccagagtctaaccaatgccttccacaccatgaggaacaagcctatgcccagactcaatcatctctgttctatagtcccagttcacccatgagctccgatgacgagtcagagatagaagacgaggacctcaaggtggagcttcagcggctgcgggaaaaacacatccaggaggtcgtcaatttgcaaacgcagcagaacaaggagttacaggagctctacgagcgcctgagaagcatcaaagactccaagacccagtctactgaaattcctctgcctccagcgagccctaggcgtccacgctccttcaagagcaagctgagaagccggccacagtctttaacacacgtggataatgggattgtggctactggcaagtcctgcctcatcaatgagcttgagaatccgctgtgcgtcgagtccaatgccgctagttgccagcagagtcctgcgagtaagaaggggatgttcactgatgatcttcataagctagtggatgactggacaaaagaggccgtaggcaacagtttgattaaaccttcactgaaccagttgaagcagtcccagcacaagttggaaacggagaattggaacaaggtgtctgagaacactccttcgaccatgggatacacgagcacatggattagcagcctcagccagatccgtggggccgtgcccacctctctcccccaggggctgtcattgccaagctttccaggaccacttagtagctacggcatgccacacgtatgccaatacaacgcagttgccggagccggctatccggtccagtgggtgggtattagtggaactacgcagcaatctgtagtcattcccgcgcaaagtggcggaccatttcagccaggcatgaatatgcaagcgttccctacgtcaagtgttcagaatcccgcaacaattcctccaggaccgaaatag

SEQ ID NO: 140715 - DNA, 5232 bp, Artificial Sequence
  Description of Artificial Sequence: Synthetic coding sequence
atggcgaccgattccggagaccccgcttccaccgaagattcagaaaagcccgatggaatttcttttgagaatcgagtccctcaggtggccgcgacattgacggtagaggctcgacttaaagaaaaaaactccactttctctgcttccggggaaactgttgaacggaaaaggttctttcgaaagagcgttgaaatgacggaggacgacaaagtggctgagagttctcccaaagatgaacggattaaagcagctatgaatattccgcgagtcgataagttacctagtaatgtcctcagaggggggcaggaggttaaatatgaacagtgtagcaagtccaccagcgaaatttcaaaggattgctttaaggagaaaaacgagaaggagatggaggaggaagccgaaatgaaggccgtggctacatccccttcaggacgcttcctgaaatttgacatcgagctgggacgtggggcttttaaaactgtctataaaggattggatacagaaacatgggtcgaggtcgcatggtgcgaactgcaggacaggaagctgaccaaggcggaacagcagcgcttcaaggaggaagcggagatgctcaaggggctgcagcatccaaatattgtgaggttctatgatagttgggagtccatactgaagggcaaaaagtgtatcgtcctggtaaccgagttaatgacatcaggtaccttaaagacttatctgaagagattcaaagttatgaagcctaaggttctgcggtcctggtgcagacagatactaaagggcctgcagtttctccatactagaactcctccaataatccacagggacctcaaatgtgataatatctttatcaccggtccgactggcagcgttaaaatcggagacttgggattggcaaccttaatgcggacttctttcgccaaaagcgtgattggcacgcccgagtttatggcccccgaaatgtatgaggagcactatgatgaaagcgtggatgtgtatgcctttgggatgtgtatgttagaaatggcgactagtgagtacccgtacagcgaatgtcagaacgccgcacagatttatcggaaggtcacttctggaataaagcctgctagtttcaacaaagttacagacccagaggtgaaagaaattattgagggctgtattagacaaaacaaaagcgaacgtctgagcatccgggatcttcttaaccatgctttcttcgcggaagacaccggactacgtgtcgagttagcagaagaggacgattgcagcaatagtagcctggccctgcggctgtgggtggaggaccccaagaagctgaaagggaagcacaaggacaacgaggcgatcgagttcagtttcaacctggaaactgatacgccagaagaggtggcctacgaaatggtgaaaagcgggtttttccacgagtctgatagtaaggctgtggcaaagagcatccgagatagagtgacacccataaaaaaaaccagagaaaaaaagccggctggctgcttggaagagaggcgtgattcgcagtgcaagtccatgggcaacgtcttcccacagccacaaaatactactctgcccttggcgcctgctcagcagaccggcgcagagtgcgaggagactgaggtcgaccaacacgtccggcagcaactcttacagcgaaaaccccagcaacattgtagctctgtcaccggcgacaacctgtcagaagctggggcggccagcgtgatacactcagacacgagctcacagccttctgtagcttatagttcaaaccaaactatgggtagtcagatggtctctaacattccacaagccgaggtgaacgtgccgggacaaatttactcctcacagcagctggtggggcactatcagcaggtctctgggctgcagaagcactccaaactcactcagccgcagatactgccattggtgcaggggcagtccactgttctcccggtccatgtgctgggacctaccgtggtgagtcagccccaggtatccccgctgactgtgcagaaagttccccagatcaagccagtgtctcagcccgtaggggccgagcaacaggcagccctgctgaaacctgatcttgtcagatcactgaatcaggacgtggctaccacaaaggaaaacgtaagcagtccagataacccgtccgggaacggtaagcaggatcggatcaaacagcgtcgggcttcatgtccccgacccgagaaaggcacaaagtttcagcttactgttctgcaggtgagcacgtctggggacaacatggtcgagtgtcaacttgagacccacaacaataaaatggttacatttaagttcgatgtcgatggcgacgcccccgaagacattgcggactatatggtggaggataactttgtgttagaaagcgagaaggagaagtttgtggaagaactacgggccattgtaggacaagcacaggagatccttcatgtgcacttcgccacggaaagggctactggtgtggacagcataaccgtcgattcgaactcaagccagacaggaagttccgagcaggtccaaattaacagcacgagcactcagactagcaacgagtccgctccccagagttctccagttgggcgctggagattctgcatcaaccagaccataaggaaccgagagacgcaatcccccccctccttacagcattcgatgtctgctgtgcctggaaggcatcctctgccgtcacctaagaacactagcaataaagagatctcccgagataccctgctcacaattgagaacaatccatgccatagagctctgtttacgagcaagtctgaacacaaagatgttgtggacgggaagatcagcgaatgtgcatccgtagagactaagcaaccagccatcctttaccaggtggaggacaatcgacagatcatggcacctgtgaccaactctagttcctactctactaccagcgtacgggccgttcccgcagagtgtgagggactgactaaacaggcatctatcttcataccagtctacccctgccatcagactgccagccaagcagatgcactcatgagccatcctggcgagtccacacagacctctgggaactcgctaacaaccttagcttttgaccagaaaccacagactctgagcgtgcaacagccagcaatggatgctgagtttatctcacaggagggagagaccacagtgaataccgaggcgtccagtccaaagacggtgatccccacccagacccctggcctggaaccaactaccctccaacctacaacggtactggagagtgatggtgaaagacccccaaagctagaatttgccgataaccggattaaaacactggacgagaaactacgtaacctcctctaccaggagcactccatttcatccatttatcctgagtcccagaaggatacgcaatcaatcgactccccttttagctcatctgccgaggatacgctcagctgccctgtgaccgaggtgattgccataagccactgcgggatcaaagacagcccggtgcagtctcccaacttccagcagaccgggagcaagttgctgtccaacgtcgcagcgagtcagccagccaatattagtgtgtttaaaagagatctcaacgtgattacatctgtgccaagcgagctttgtctacatgagatgtcgtcagatgcctccctccctggtgatccagaggcctatcctgcagccgtatcaagtggcggcgctatccacctccagactggagtggagacagaggaaatgcgctccgcaatagccccggacccgattccactgacacgagaatccactgctgatacacgggctcttaaccgttgtaaggcgatgtctgggtcttttcagcggggccgcttccaggtcattacaatcccacagcagcagagcgcgaaaatgacatccttcgggattgagcacatctcagtctttagcgagacaaatcactcttcggaagaagcctttattaagaccgccaaaagccagttggtggaaattgagcctgccacccagaatccgaaaacctctttcagctatgagaaattgcaggcactccaggagacatgcaaggaaaacaagggtgtccccaagcagggagacaattttctgtcgttttccgcagcatgtgaaactgatgtttcctcggtgactcccgaaaaagagttcgaggagacatccgccaccgggagtagcatgcaatccgggtcagagctgttgctgaaagaacgagaaatcctgacagccggtaagcagcctagctccgacagcgagttttcagcgtcgctggcgggttctgggaagagtgttgccaagaccggaccggaatccaatcagtgcctgcctcatcatgaggagcaggcgtatgctcagacccagtcttcactattctattctccttcaagcccaatgagttcagacgacgaatcagagatagaagacgaggatttgaaggttgagcttcagaggctcagagaaaaacatattcaggaggtggtaaacctccagacacagcaaaataaggagctccaggagctctacgaacgcctcagatctatcaaagactcaaagacgcagtcaactgagatacctcttccaccagccagtccccggaggccgcggtcatttaaatccaagctccgttctcgccctcagtctctgacccacgtggacaacgggatagtggctacagacccattgtgcgtcgagagcaatgcagctagctgtcagcagagccccgcaagcaaaaaagggatgttcaccgacgacctgcacaagctggtagacgattggacaaaagaagccgtagggaattctctgattaagccgtccctgaatcagttaaaacaatctcagcacaagttagagaccgaaaactggaataaggtctcagaaaataccccctcaaccatggggtatacttctacatggatatcttccttatcccagatccggggtgcagtgccaaccagcttgcctcagggtctctctctgccatccttcccaggaccactgtctagctacggaatgcctcacgtgtgccaatacaacgccgtagctggagccggctatccggttcagtgggtcggtatcagcggcacaacccaacaaagtgtcgtcatccccgcccaatcaggcggcccgttccagcccggaatgaacatgcaagcatttcccacttcctctgtacagaacccagctacaatacccccgggccctaagtag

SEQ ID NO: 140716 - DNA, 498 bp, Artificial Sequence
  Description of Artificial Sequence: Synthetic coding sequence
atggccacagacagcggggatccagcctctactgaggattccgaaaagcccgacggaatcagcttcgaaaatcgcgtccctcaggttgcagctacgctgaccgtagaggcccggctgaaggagaaaaattcaactttctcggcatccggtgaaaccgtagaacgcaagcggtttttcagaaagagcgtggagatgaccgaggatgataaagtcgccgagagctcacctaaggacgaacgcattaaagctgccatgaatattcctagggttgacaaacttccaagcaacgttctcagggggggccaggaagtgaagtacgaacagtgttctaaatctacaagcgagatatccaaggactgctttaaggagaagaacgagaaggaaatggaagaagaagctgagatgaaggccgttgctacgagcccctccggtagatttcttaaattcgatattgagctgggacgcggagctttcaaaaccgtttataagggcttgtag

SEQ ID NO: 140717 - DNA, 3732 bp, Artificial Sequence
  Description of Artificial Sequence: Synthetic coding sequence
atgcttgcctcaccagccacagagactacggtgctcatgagccaaaccgaggctgatctggctctccggcctcctccgcctctgggcacagctgggcaaccccgcctggggcctccccctcgccgggctcggcggttttcagggaaagctgagccaagacccaggagcagccgtttatctcgtagatccagcgtggatctgggcctcctcagctcctggtcgctgccagccagccccgcccccgacccgccagacccccccgattctgccgggcccggccctgctcgctccccacctcctagctccaaagagccacccgaaggaacctggaccgaaggtgcccccgtgaaagccgcagaagacagcgctcgtcctgagctaccagattccgccgtaggtccaggttctcgcgagccactacgggtgccagaggcggttgcactcgagcgaaggcgcgaacaggaagagaaggaagacatggagacacaagccgtagccacatcacccgatgggaggtatttgaagttcgatatagaaatcgggcgtggcagctttaaaacagtgtacaggggattggatacagacacaacggttgaagtggcctggtgtgaacttcagaccagaaagctgtctcgcgccgaacgacagcggttctcagaagaagttgagatgttgaagggactgcagcacccgaacattgtccgattctacgatagctggaaatctgtcctgcgaggacaggtatgcattgtgctggtaaccgaactgatgacaagcggtacccttaagacatacctccgccgctttcgggaaatgaagcccagagtgctccaacgctggtccagacagatccttaggggcttgcactttctgcactcgcgggtccccccaatcttgcacagggatctaaagtgcgacaatgtgttcatcactggcccgacaggtagcgttaagattggcgacctaggccttgcaacccttaagcgggcaagcttcgctaagagcgtcatcggaaccccagagttcatggccccagagatgtatgaggaaaaatacgatgaagccgtcgacgtgtacgccttcggaatgtgtatgctggaaatggcaacatccgagtatccttatagcgagtgtcagaacgcagcccaaatttaccggaaggtgacttcaggcagaaagccaaacagcttccacaaggtgaagattccagaggtgaaggaaattatagagggttgtattcggacagataaaaatgaacgtttcaccattcaggacctgttagcccatgcatttttcagagaagagagaggagttcatgtggagttggcggaggaagacgacggtgaaaagcccggccttaaattgtggcttagaatggaagacgcccggcgcggagggcggcctagggacaatcaagctattgaatttctttttcagctgggcagagacgccgcagaggaagtggcccaggaaatggttgctctagggctcgtgtgcgaagccgattaccagccagtggcccgggccgttagggagcgagtggctgccatccagagaaagcgcgagaagctgcgtaaagcccgtgaactggaggcccttccacccgagccaggtccccccccagcaactgtgcctatggcccctggaccaccgtcggtatttcctcctgaacctgaggagccggaggcggaccagcatcaaccattccttttccggcatgcctcatacagctccaccacatccgattgtgagactgatggatatctgagctccagcgggtttctcgatgcatcagaccctgccctgcagccccctggaggtgtcccaagcagcctcgcggagtcccacctttgtttgccttccgcctttgccctgtcaattcctaggtctgggcccggaagtgacttcagcccaggcgattcatacgcatctgatgccgcctccgggctgtcggacgttggcgagggcatgggtcagatgagaagacccccagggcgcaacctccgcaggcggccacggtcgcgtctgcgggtaacttctgtgagtgatcagaatgacagagtagtggagtgtcagctccagacacacaattccaagatggtaacctttcggttcgatctggatggcgactcacccgaagaaattgctgcggcgatggtttacaacgagttcatactgccttccgagcgggatggtttcctcaggcggattagggagattatccagcgtgtggagaccctccttaagagagacaccgggccaatggaagctgccgaagacaccctgagcccacaggaagagccagcccctctgccggcactgccagtgcctctgcctgatcccagtaacgaggaattacagtcttccacatctttggagcatagaagttggacagcttttagcacctcaagcagctcccctggcacccctctttctccgggaaacccattcagccccggcactcccatatctcccggcccgatctttcccattacaagtcctccctgtcatcctagtccctcaccattttcacccatttcttctcaggtgtccagcaacccctcccctcaccccacatctagcccccttccatttagctcatctacccctgagttcccagtccccctcagtcaatgtccatggtcctcactgcctactacatcacccccaactttctcccctacgtgcagccaagtcaccttgtcatcgccctttttccctccctgtccctctactagcagtttcccgtctacgacagcagctccactgttatcactcgcttcagccttctctctggccgtgatgaccgtggctcagtccctactgagcccaagcccgggcctgctgtcacagagtcctcccgcccctccttctccactcccatcgctgcccctcccccctccggtggcccccgggggccaggagtctcctagtccccatacagccgaggtagagagtgaagcctcaccacctcctgcacgtcccctgccaggggaggcacgcttagccccaatctccgaggaggggaagcctcagctagtcggtaggtttcaggtcacttcaagtaaagaacctgcagagcccctgccactgcagccaaccagccccacactaagtggaagtcctaagccatcaaccccccagctcacaagtgagagcagcgacacggaggatagtgccggaggagggcccgagacccgggaggccttggcagaatccgatagagcggctgaggggctgggcgctggagtggaagaggaaggagacgatggaaaggagcctcaggtcggaggatctccacagccactgtcccatccgagtcccgtttggatgaactactcctatagctctttgtgtttatcatctgaggaatccgaatcaagcggagaagatgaagagttctgggcggaactgcagtccttgcgacagaagcacctgtccgaagtggagaccttacagactctacaaaaaaaagagatagaggatttgtactccagactcggcaaacagccccctccagggattgtcgcacctgcagccatgctgagtagcaggcagagaagactttccaaggggtccttccccacttcaagaaggaattcactgcagcggagtgaaccccccgggccaggcataatgcggcgtaactctttgtccgggagctccactggcagtcaggagcagagggcgtccaagggagtgacattcgcaggcgacgtcgggcgtatgtag

SEQ ID NO: 140718 - DNA, 1992 bp, Artificial Sequence
  Description of Artificial Sequence: Synthetic coding sequence
atgcgccggcggcagcagggggctgcaggaggaaacttcccggtgggagggtcattcccagaagatgtgagccctcatcaagactcagggtatgcaccttcccctagatatttgaggcgcttcagagaaatgaaacctagggtgctacagaggtggtcacggcagattttgcggggcctacatttcctacattcaagggtcccgcccattttacatcgagatctgaaatgcgacaatgtgttcatcacgggcccaactggctcagtgaaaatcggcgatctggggctggccaccctgaaaagggccagttttgctaagtccgtcattggcaccccagagttcatggctccggagatgtacgaggagaaatacgatgaagccgtggatgtctacgccttcggcatgtgcatgctcgagatggccacgtctgagtacccctacagcgagtgtcagaatgcagctcagatttaccgcaaggtgacatcaggaaggaaacccaatagcttccataaagtgaagattccggaggtaaaagaaatcatagagggctgtattaggacagacaaaaacgagaggtttacgatccaggatctgctcgcccacgccttctttcgagaggagcggggggtacacgtagagctggccgaggaggatgacggtgagaaacccgggctgaaactctggctgagaatggaggatgcccgtaggggaggacgcccacgggacaaccaggccattgaatttttatttcaactgggccgcgatgctgctgaagaggtggcacaggaaatggttgcactggggctggtatgcgaagctgattaccagccagtcgcgagggccgtgcgagagcgggtagctgctatccaacggaagcgggagaagctacggaaagctcgggaactcgaggctctcccaccagagccagggcccccacctgccacggtccctatggctccgggccctcccagcgtcttcccgccagagcctgaagagccggaagcagatcagcaccagccttttctcttccgtcacgcgagctactccagtactactagcgattgtgaaacggatgggtatctgtctagcagcgggtttctcgatgcttcagatcccgccttacagcctccaggaggggtgcctagcagcttggccgaaagccatttgtgcctaccaagcgcttttgcactgagcatacccagatcagggcccggctcagatttcagccccggggatagttacgcctccgacgccgccagtgggctgtcggatgtcggggaaggaatgggtcagatgagacgaccacctggtaggaacctcagacgccgcccccgaagtcggctgcgcgtcaccagcgtgagcgaccagaatgacagagtcgtcgaatgccagttgcagacacacaactctaaaatggtgacatttaggttcgatttggatggagactccccggaggagattgcggcagctatggtatacaatgagttcattctgccatccgaaagagacgggttcctacggagaattcgagaaatcatccaacgcgtggagacattgcttaagagagatacaggaccgatggaggctgctgaagatacactctctcctcaggaggagccggctcctctccctgccctccctgtgccattgcctgacccttctaacgaggagctgcaatcatctacttcacttgagcacaggtcatggactgcattctctacaagctcatcctccccaggcacccccctcagccctgggaatcctttctcacccggcacccccatttcccccggaccgattgcactccaacgggaatcgagatcctttagtctacagagagcacagattcagcggaccgtgctggaagccgggcagcgacccggcaagttatggttgagggcgacagtgcagcttcgtgtttgggggctcgagctccgcagaaaggagatgatgggaagaaaccccaagttgggggcagctccaaatccttag

SEQ ID NO: 140719 - DNA, 471 bp, Artificial Sequence
  Description of Artificial Sequence: Synthetic coding sequence
atgggccagatgaggaggccacccgggaggaatctgagaagaaggccacgtagtaggctgcgcgtgacctcagtctccgaccagaacgatcgggtagtggaatgccagctacaaactcacaattcaaagatggttacctttagattcgacctggacggggattcccctgaagaaattgcagccgctatggtttacaacgaattcatccttccaagtgaacgggatgggtttttgaggcgtattcgagaaattatccagcgagttgagaccctcctgaaacgcgacactggccccatggaggccgctgaggatacactgagccctcaggtccgccccctcggggggcacttccaagggaaatggaccctgtgttcacgggtgtactattctctgccctctgccgtccctctcgacctcacccctctccatctgtgggaccccaaaacagtggctttgttcttctttttctag

SEQ ID NO: 140720 - DNA, 894 bp, Artificial Sequence
  Description of Artificial Sequence: Synthetic coding sequence
atggccaaggtcagcgaactgtatgatgttacctgggaggaaatgagggacaaaatgcgcaaatggcgggaagagaacagcagaaacagcgagcagatcgttgaggtgggtgaagaacttattaatgagtacgcgtcaaagcttggagacgatatttggattatctacgagcaagtgatgatcgcggcgctagactatggcagagatgaccttgcactcttttgtctgcaggagctgagacgacagtttccgggctcacatagagtgaagcgcctgacaggtatgcgcttcgaagctatggaaagatacgatgacgccatccagctgtacgatcgcatactccaagaggacccaactaacacagcagcacggaaacgtaagatcgcaatacgcaaagctcaagggaagaacgttgaggcgataagagaactgaatgagtatttggaacaattcgtgggggaccaggaggcttggcacgagcttgcggagctgtatatcaacgagcatgattacgccaaggctgctttttgcctagaggaactcatgatgaccaacccgcataatcatctttactgccagcaatacgccgaagtcaagtacactcagggaggccttgaaaatttggagctgtcccgcaaatactttgcacaggcactaaaattaaataatcgaaacatgcgagccctgttcgggctatacatgagtgcatctcacattgccagcaatcccaaggcttcagcaaaaacaaagaaggataacatgaagtacgcctcctgggccgcaagtcagattaaccgggcctaccagtttgccggaagatccaagaaggagaccaagtattctctgaaggcagtggaggacatgctggagacactgcagatcactcagtcctag

SEQ ID NO: 140721 - DNA, 1104 bp, Artificial Sequence
  Description of Artificial Sequence: Synthetic coding sequence
atgcggtggttcctgccctggaccctggccgcggttactgctgcagcggcctcaaccgttttggcgaccgcattaagtccagcccccactaccatggacttcacaccagctcccctcgaagacacatcatctcgaccacagttttgcaagtggccttgcgaatgccccccgtctcctcctaggtgcccattaggcgtctccctcatcactgatggctgcgaatgctgtaagatgtgcgcccaacaactcggcgacaattgcacggaggctgcgatctgtgacccccaccgcggtctatattgcgactactccggcgacagaccccggtacgcgatcggggtgtgcgctcaggttgtcggcgtggggtgcgtactggatggagtacgctataataatgggcagtccttccagcctaactgtaagtacaactgtacctgtatcgatggagctgtggggtgcacacctctatgcctgagggttaggcccccacggctttggtgcccccatccacgcagggttagcattcctggccactgttgtgagcagtgggtgtgtgaagatgatgccaagcggccacgtaaaaccgccccacgggatacgggcgcctttgatgctgttggcgaagtggaggcttggcacaggaattgtatcgcttacacatccccatggagtccatgctcaacctcatgtggcctgggagtttcaacccgtatttctaacgtaaacgcacagtgttggcccgagcaggagtcacgcctgtgtaatctcagaccctgcgacgtggacatccacacactgataaaagctgggaaaaagtgcttagcagtgtaccagcccgaggcttctatgaatttcacattggctgggtgcatttcaacacggagctatcagccgaagtactgcggcgtgtgcatggacaaccggtgctgtatcccctacaaatctaagaccatcgacgtaagcttccagtgtcctgatggtctgggatttagcagacaggtcctgtggattaatgcctgtttttgcaacctcagttgtcggaacccaaatgatattttcgcagatctagagtcatatcccgattttagtgagattgctaattag

SEQ ID NO: 140722 - DNA, 588 bp, Artificial Sequence
  Description of Artificial Sequence: Synthetic coding sequence
atgcccgtgcctctgacctcacgccacgaagtcgtgccagccctcgacgcggggagcagtgacagttcgtctaggcagcaccggcccggccacgacgcagtcggcgaagtggaggcgtggcacaggaactgtattgcctacacgagcccgtggtcaccatgtagcactagctgcggtctaggcgtgtcaactagaatctcgaatgtgaatgctcagtgctggcctgagcaagaaagtcgcctgtgcaacctgcgtccatgcgatgtggacattcataccctgataaaagccggaaagaagtgcctcgccgtttatcaacccgaggcaagcatgaacttcaccttggccggctgcattagcaccagatcttaccagccgaagtattgcggggtgtgcatggacaaccggtgctgcatcccctataagtcgaagacaattgatgtgtctttccagtgccccgacggtctaggtttttctaggcaggtcctgtggattaatgcttgcttctgcaatctgtcctgtcgtaacccgaacgacatctttgcagatctcgaaagttatccagattttagtgaaatcgccaactag

SEQ ID NO: 140723 - DNA, 468 bp, Artificial Sequence
  Description of Artificial Sequence: Synthetic coding sequence
atgagatggttcctgccctggaccctggccgcggtcacagccgctgccgcctctaccgtcctcgctaccgctctctcaccagcccccactaccatggatttcactcctgcgcccctcgaggatacctcgagcagaccccagttctgtaaatggccatgcgaatgcccaccctctcctccacggtgtcctttgggtgtaagcctcataactgatggctgtgaatgctgtaagatgtgtgcgcagcaactgggggataattgtaccgaggctgcaatttgcgacccccaccggggcctgtactgtgactactctggtgatcgcccccgatatgccatcggtgtctgcgctcggcgggaagaggtgtccgggtgcgtgcccgcccgcggcattcatgaactgcacacctgtggtctgcaccaacataccctcctctctactcaggtactctggtctcttcacgggcagtag

SEQ ID NO: 140724 - DNA, 369 bp, Artificial Sequence
  Description of Artificial Sequence: Synthetic coding sequence
atgaggtggtttttaccatggacactggccgccgtgactgccgccgctgctagcaccgttcttgcaacagccggcaagaaatgcctggcagtataccagcccgaagcctccatgaacttcactctcgctgggtgcatcagcaccagaagttatcagcccaaatattgcggcgtttgcatggataaccggtgctgtatcccttacaagagcaaaaccattgacgttagtttccagtgccctgacggcctgggcttcagccgccaagtgctctggatcaatgcgtgcttctgtaatttgtcttgtcggaacccaaacgatattttcgccgatctggaatcatatcctgacttctcagagatagcgaattag

SEQ ID NO: 140725 - DNA, 753 bp, Artificial Sequence
  Description of Artificial Sequence: Synthetic coding sequence
atgagaggcacacccaaaacacatctgctggccttcagtttgttgtgcctgctgagcaaggtcaggacacagttgtgtccaaccccatgcacatgtccctggccgccgcctaggtgtccgctcggcgtcccacttgtgctagatggctgtggctgttgtagagtgtgcgctagaaggttgggtgagccttgcgaccagcttcacgtgtgtgacgcatcacaggggctagtctgtcagcctggcgcaggtcccggcggtcgtggggccctgtgcctactggcggaggacgatagctcatgtgaagttaatgggcggctgtaccgagagggtgagacctttcaaccacactgttccatcagatgccgctgtgaagatggaggtttcacttgcgtgcccctctgttctgaggatgtcaggctgcctagctgggactgtccccacccgagacgggttgaagtgctcggcaagtgctgccccgagtgggtgtgtgggcaagggggtgggttggggactcagcctctgccggcacaggggcctcagttctccggtctggtgtcaagccttccacctggcgtaccttgcccagagtggtcaacagcctgggggccctgttctactacctgtggcctcggcatggccactcgggttagcaaccagaatcgattttgcaggttagagactcagaggagactttgcctgagtaggccttgccccccgtctagagggaggagtccacagaattctgcattctag

SEQ ID NO: 140726 - DNA, 657 bp, Artificial Sequence
  Description of Artificial Sequence: Synthetic coding sequence
atgcgcggtacacctaaaacccacctgctggctttcagtctgctgtgtctgttatccaaagtacgtacgcaactgtgcccaaccccctgcacttgtccctggcccccccctcgatgtccacttggtgtgcctttggtcctcgacggctgcggctgttgtcgcgtgtgcgcaagaagactgggagaaccttgcgatcagctccatgtctgcgacgcgagccagggactggtatgtcagccaggtgcaggacccggcggacgaggtgcactttgtttatgcaagcaagacccgtcttttctggcactgtcactgccttgcccgcttgttagcccagcccagaatggcgcacggcctggggaccccgcccgacccccggttggttgggcatggccacccgggtgtccaactcgcaccgctagtgctgattggcgcccatctgccgcctgcgcctgtcccggccccgctcatccgccaggagtggccgtacacaagacagtgccatcaagggcagggctgggaatgggcactaggtgtccacccagccctgcagggggccccgtgcccggaccttgggcagacggaagatggtctgtgcctcgacctcttgccgccggcaatactctcgcatgggtacatcacgccgagcaccagtactag

SEQ ID NO: 140727 - DNA, 753 bp, Artificial Sequence
  Description of Artificial Sequence: Synthetic coding sequence
atgagggggaccccgaagacgcatctgctagccttctctctgctctgcctcctttctaaggtaagaactcaactgtgtcctacgccttgtacctgcccttggcccccaccaaggtgcccactaggagtgcccttggtcttagacggatgcggctgttgtagagtgtgtgctcggcgtctgggtgagccctgcgatcaactccatgtttgcgatgcctcacaggggctggtctgccagcctggcgctggtcctggtgggaggggagccctgtgcctactagctgaagacgattcatcatgcgaggtcaacggtagactgtatagagagggcgaaactttccaaccccactgctctattagatgtcggtgtgaggacggcggattcacatgcgtacccttgtgctccgaggacgtaaggcttccttcctgggattgcccgcaccctaggagggtcgaggtactgggtaagtgttgtcccgaatgggtgtgcgggcaaggtggtgggttgggcactcagccactgccagcccagggcccccagttcagcggcttagtctccagccttccacctggagtgccgtgcccagagtggtctaccgcgtggggaccatgctctactacctgtgggctgggcatggccaccagagtctcaaatcaaaacaggttttgtagacttgagacccagcgcaggctgtgtctgtcgaggccatgcccgccttctcgcggccgctccccgcagaatagcgccttctag

SEQ ID NO: 140728 - DNA, 2571 bp, Artificial Sequence
  Description of Artificial Sequence: Synthetic coding sequence
atggaatccgaggatctgtcgggcagggagctcaccatcgacagtatcatgaacaaagtccgagacatcaaaaacaaattcaagaacgaagacctgactgacgagctgagtctgaataagatctccgcagacacaaccgataatagcggtacagtgaaccagattatgatgatggccaacaaccccgaagattggctgtctctcttgctgaaactcgagaagaattctgttcctctgtccgatgcactgctgaacaagctaatcgggaggtactctcaagcgatcgaggccctgcccccagacaagtatgggcagaatgaaagctttgccagaattcaggtgcggtttgccgaattgaaagctatacaggagcccgatgatgctagagactacttccagatggcacgggcaaattgtaaaaaatttgcttttgtgcacatctctttcgctcaatttgagctgtctcagggaaatgtgaaaaagtctaagcaactcctccagaaggctgtagagagaggcgccgtccctctagagatgctggagattgccctgaggaatcttaatctgcaaaagaaacaactgcttagtgaggaggagaagaagaacctgtctgcctccacagtactgaccgcccaggagtctttcagcggtagcctgggtcacctacaaaaccgaaataatagctgcgacagtcgagggcagacgactaaggcgaggttcttgtatggtgagaacatgcctccccaggacgctgagatcggatatcgcaatagtcttaggcagaccaataaaacgaaacagtcttgcccattcggccgcgtcccagtaaacctacttaactccccagactgtgacgttaagacggacgattccgttgtcccctgcttcatgaaaaggcagaccagcaggagtgaatgcagggatctagtggttccaggatccaaacccagcggcaacgacagttgcgagcttcgaaatcttaaaagtgtgcaaaactcacactttaaggaacccctggtctccgatgagaaaagttccgagctcatcatcaccgattccattacactcaaaaacaaaacggagtcttccctgcttgctaaactggaagagactaaggagtaccaggagcctgaagtaccggagtccaaccagaagcagtggcagtctaagcggaaaagtgagtgcatcaatcagaatcctgcagcctcatccaaccattggcagatcccagaactggccagaaaagtgaatacggaaaagcacaccacatttgagcagccagtattctctgtgtctaagcaatcgccacccatctccaccagtaaatggtttgacccaaagtcaatctgtaaaacaccgtcttcaaacaccctggatgattatatgtcctgtttcagaactccggttgtaaagaacgattttcctccagcctgccaattatccactccctatggccaacccgcatgttttcagcagcagcagcatcaaatcttagccaccccacttcagaacttgcaggtgctggcctcgtccagtgctaatgaatgtattagtgtcaaaggccggatttattctatcctgaaacagattggcagcggtggtagcagcaaagtcttccaggtgctaaacgagaagaagcagatctacgccatcaagtatgtgaatctagaggaggctgacaaccagacattagattcctataggaacgagatcgcatatttgaacaaactgcaacagcacagcgacaagattatcaggctgtatgattatgagataactgaccagtacatatacatggtgatggagtgcggtaatattgatctgaatagttggttgaagaaaaaaaaatccattgatccgtgggagcgcaagtcatactggaagaacatgcttgaagccgtgcacacgatacaccaacacggcattgttcatagcgacctgaagcctgcaaatttcctcatcgtggatggaatgcttaagctcattgatttcggtatcgcaaatcagatgcagccagacaccacgtcagtggtgaaggactcacaggtcggaacagtgaattacatgccccctgaggccataaaagacatgtcatcatcccgggagaacgggaaatccaagtctaagatatcccctaaaagcgatgtttggagcctgggttgcatcctgtactatatgacctatggcaagacaccgtttcagcagattatcaaccagatctcaaaactgcacgccatcatcgatcccaaccatgagattgagttcccagacataccggaaaaagatctacaggacgtgcttaaatgttgtcttaagcgggacccaaaacaacggatttcgattccagagctcttggcccatccatacgtgcaaatccagacacatccagtcaaccagatggccaaggggaccacagaggagatgaagtatgtgcttggacaacttgtaggcctaaattctccaaattccatcctcaaagcagcaaagacactgtatgaacattactccgggggcgagagccataactccagctcatcaaaaacattcgagaaaaaacgcggaaagaagtag

SEQ ID NO: 140729 - DNA, 1119 bp, Artificial Sequence
  Description of Artificial Sequence: Synthetic coding sequence
atgaataaacgccgccttttatatccatctggatggctgcacgggccctctgatatgcaaggtctgctgttcagcaccttactcctagctggcttggcacaattctgttgcagagtgcagggcactggaccactcgacactacaccagaaggacggccaggggaggtctccgacgcacctcagaggaaacaattctgccactggccttgcaaatgccctcaacaaaaaccacggtgtccacccggtgtttctttggttcgtgatggctgtggatgctgtaaaatatgcgccaagcagcctggcgagatctgtaacgaggccgacttgtgtgacccccacaagggtctgtattgtgattacagcgtcgatagaccacgctatgagacaggagtctgcgcgtatcttgtggctgtggggtgtgaatttaaccaggttcactaccataatggccaggtttttcagcccaatcctctgttctcatgcctgtgcgtgtcaggggcaattgggtgtacaccactcttcatacctaaactggctggcagccactgcagcggggcgaaaggcggcaaaaagagcgaccagagcaattgcagcctggagcccctgctgcagcagttgagcacctcttacaagactatgccggcttatcgcaacttgccattgatctggaaaaaaaagtgcctcgtgcaagctacgaaatggaccccttgttccagaacatgtggtatggggatctccaacagagtgaccaatgaaaatagtaattgcgagatgcgcaaggaaaaacgtctgtgctatattcagccatgcgactcgaatatcctgaagaccatcaagattccaaaagggaagacctgccagccaacttttcagctgagtaaggcagagaaattcgtcttctctggttgttcctccacccagtcatacaagccaacattctgcggaatctgcctcgacaagcgatgttgtatccctaacaagtctaagatgattacaatccagtttgactgccctaatgaaggctcattcaaatggaaaatgctgtggatcaccagctgcgtttgccagcgaaattgccgcgagcccggggacatttttagcgaactgaaaattctgtag

SEQ ID NO: 140730 - DNA, 996 bp, Artificial Sequence
  Description of Artificial Sequence: Synthetic coding sequence
atgaagattagtaggggccgtgtgtgcctggagagtgagaataaggatgccggggtggcgggtaggaagcagttttgccactggccgtgtaagtgcccacagcaaaagccgcgttgccccccaggagtgagtctggtgcgggacggatgcggctgctgcaagatatgtgcaaagcaaccaggtgagatctgtaacgaggctgatctgtgtgacccccacaaaggtctctattgcgactactctgtggataggcctcggtatgagacaggcgtgtgtgcttgcaagtccgttggctgcgagtttaaccaggtacactaccataacgggcaagtgttccagccaaatccgctattcagttgtctgtgtgtgtcaggagccattggttgcacacccctttttatacctaagctcgctggcagccactgttccggggccaaggggggcaaaaaaagcgaccagagcaattgttcgctggaaccactgctgcagcaacttagcactagttataagacaatgcccgcctacagaaatttgcccttgatctggaagaagaagtgcctggtgcaggccacgaagtggacaccgtgcagcaggacatgtggaatggggatctctaatcgtgtgaccaatgagaattccaactgcgaaatgcgcaaagagaaacggttatgttacattcaaccctgcgacagcaacatcctaaaaaccatcaagattcccaagggaaagacctgccagcccacttttcagctgagcaaggccgagaagttcgtcttcagtggttgttcctccacgcagagctataagcccaccttttgcggaatatgcttggataagcggtgctgcatcccaaataaaagcaagatgattaccatccagttcgattgtcccaacgaaggatccttcaagtggaagatgctctggataacatcctgtgtctgccaacgcaactgcagagaaccgggcgacatattcagcgagctgaaaatcttgtag

SEQ ID NO: 140731 - DNA, 1065 bp, Artificial Sequence
  Description of Artificial Sequence: Synthetic coding sequence
atgcaggggctcctcttctccaccttgctcttggccggactggctcaattctgctgccgcgtacaagggacgggacccctcgacacgacccccgaagggagacccggggaggtgtccgacgccccacaaagaaagcagttctgtcattggccttgtaaatgcccccagcagaaaccgaggtgtccaccaggagtttccctcgtgcgggacgggtgcgggtgctgtaagatttgcgctaagcagccaggcgagatctgtaacgaagccgatctttgcgatcctcacaaggggctctactgcgattatagcgtcgaccggcccaggtatgagacaggcgtctgtgcgtaccttgtggcagttgggtgtgaattcaaccaggttcactaccataacgggcaggtgtttcaacctaatccccttttcagttgcctctgtgtttcaggagccatcggctgcactcctctgtttatccccaagctcgctggcagtcactgttcaggggccaaaggcgggaaaaaatccgaccagagtaattgctcactggagccactgttgcaacagttgagcacttcttataaaacgatgcctgcctatcgtaaccttcccctgatttggaaaaaaaaatgtctggttcaggccaccaaatggaccccatgctccaggacctgtgggatgggtatttccaaccgcgtgaccaatgagaatagtaactgcgaaatgagaaaggagaaacgcctttgttacatccagccttgtgattcgaacattctgaagactatcaaaattccaaaaggcaagacctgtcagccaacgtttcagctgtccaaagctgagaagttcgtgttcagtgggtgtagttctacccagagttacaagcctacattctgtgggatttgtcttgataaacggtgctgcattccaaacaaatctaagatgatcacaattcagtttgactgcccaaatgaggggagctttaaatggaaaatgctgtggataacctcatgcgtgtgccagagaaattgcagggagcccggtgatatctttagcgagctgaaaatcctatag

SEQ ID NO: 140732 - DNA, 693 bp, Artificial Sequence
  Description of Artificial Sequence: Synthetic coding sequence
atgcagggattgctcttctccacactccttctagctggactggcacagttttgctgtcgcgtgcagggtaccggcccactggataccacaccggaaggacggcccggggaggtgagtgatgctcctcagagaaaacagttttgtcactggccatgtaaatgtccgcaacagaagccccgctgtccgcctggagtctcattggtgcgcgacggctgtggctgctgcaaaatatgcgcgaagcaacctggcgaaatctgcaatgaggcagatctgtgtgatcctcacaagggcctctattgcgactactctgtcgatcgacccagatacgaaactggggtgtgtgcctacctggtggcagtgggttgtgaatttaatcaagtccactaccacaatgggcaggtctttcagcctaacccgctgttctcctgtttgtgcgtgagtggcgccattgggtgtacacctctgtttattcctaagctcgctggctcccattgctccggggccaagggaggcaaaaagtctgatcaatccaactgtagcctggaacccctcctgcagcagttaagcacctcatacaaaaccatgcccgcttatcgtaacctgccactgatttggaaaaaaaatgtgctgtgtaaacagcaaaacggcctgcccgcacccgaacatgtggggtgggaataccttaccggatag

SEQ ID NO: 140733 - DNA, 393 bp, Artificial Sequence
  Description of Artificial Sequence: Synthetic coding sequence
atggggatctctaacagggttactaacgaaaactctaactgcgagatgcgcaaggagaagaggttgtgctacattcagccctgtgatagcaacattctcaagacgattaaaattccaaaggggaagacatgccaacccacattccagttgagcaaggccgagaagttcgtgttctccggttgctccagtacacagagctacaaacccactttttgcgggatttgcctcgataagcgatgctgcatccctaacaagtctaaaatgataacaatccaatttgattgccctaacgagggaagctttaagtggaaaatgctctggatcacgagttgtgtctgtcagcggaattgtagagagcctggcgatatcttttctgaactaaaaatactttag

SEQ ID NO: 140734 - DNA, 1626 bp, Artificial Sequence
  Description of Artificial Sequence: Synthetic coding sequence
atggccggcgccattatcgagaatatgtcaacaaaaaaactgtgtatcgtaggtgggattctgctggtgtttcagataatagcgttcctggtgggcggcctgattgctcctggtcccaccaccgccgtgagttacatgagtgtgaaatgcgtagatgcaaggaagaatcaccataaaaccaagtggttcgtgccatgggggcccaatcattgcgataagatcagagatattgaggaggcaattccaagggaaatcgaggccaacgacatcgtgttttcggtccacatccccctgccgcatatggaaatgtccccttggttccagtttatgctctttatcctgcagcttgacatagcttttaaactcaacaatcagatacgcgaaaatgcagaggtttcaatggacgtctcactcgcttatcgagacgacgcattcgccgagtggactgaaatggctcatgagagggtcccaagaaagctaaagtgtacatttacttcacccaagacccctgagcatgagggacgatactacgaatgtgacgtgctgccattcatggagattggttctgtggcacataaattttacctgctgaacattcgactcccagtcaatgagaagaaaaagattaatgtaggcatcggcgaaatcaaggacatccgtcttgtgggcattcatcagaatggcggattcacaaaggtctggttcgcaatgaagacttttctgactccttcaatattcatcattatggtgtggtactggaggaggatcacaatgatgtctcggccccccgtgctgttggagaaggtgatttttgccctggggatctctatgacctttatcaacatccccgtggaatggttttcaatcggcttcgattggacatggatgctgcttttcggggacatccggcaggggatcttttatgccatgctcctatcgttttggattatcttctgcggagagcacatgatggatcagcatgagagaaatcacatcgcgggatattggaaacaagtgggcccgatcgccgtgggaagcttctgcctgttcattttcgatatgtgcgagcggggtgtccagcttaccaaccctttctatagtatctggaccaccgatatcggcaccgagctggctatggccttcattatcgtggccggtatttgtctgtgcctgtactttctgtttctctgcttcatggtatttcaggtgttccgcaatatctcaggcaagcagtcatccctgcccgccatgagtaaagttcgtcggttgcactatgaggggctgattttcagattcaagttcctgatgctcattaccttggcttgcgcagccatgacagtgatcttcttcatcgtgtctcaggtgaccgagggacactggaagtgggggggagtgacagttcaggtgaattccgcattttttacgggcatatatggaatgtggaacctgtatgtttttgccctcatgttcctctacgccccttctcacaagaactatggggaagatcagagcaacggtgacctgggggtgcactctggggaggagcttcagctgacaactaccattactcatgtagatggccctaccgagatctacaagctcacccgcaaggaagcccaggaatag

SEQ ID NO: 140735 - DNA, 1632 bp, Artificial Sequence
  Description of Artificial Sequence: Synthetic coding sequence
atggctggcgctatcattgagaatatgagcacaaaaaagttatgcattgtgggcggtatcctcttggtattccagataatagccttcctggtgggaggcctgattggccccaccactgccgtctcatatatgtcagttaagtgtgtggatgcccgcaaaaaccaccacaaaaccaagtggtttgttccctggggcccaaaccactgtgacaaaatcagagacatcgaggaagccatccctagggagatcgaagcaaacgatatcgtctttagcgtccatatccctcttccgcatatggaaatgtctccatggtttcagttcatgctgttcatccttcagttggacatagcctttaaattgaacaaccagatccgcgaaaatgctgaggtgtctatggatgtttccctggcgtacagagacgatgcgttcgccgaatggactgagatggcccatgagagggttccaaggaagctaaagtgcacatttacctccccgaaaacaccagaacacgaaggccggtattatgaatgcgacgtcctgcccttcatggagatcggcagcgtagctcacaagttttacctcctgaacatccgactgccggtgaatgagaagaaaaagattaatgtcgggataggagaaatcaaggatatccgcctggtgggaatccaccagaatggagggttcacaaaagtgtggtttgccatgaaaacgtttctcaccccttccatctttatcataatggtgtggtactggcggcggattaccatgatgagtcgtcctccagtactgctggaaaaagtcatcttcgcactgggaatctctatgacctttatcaatatacccgtggaatggttctcgataggatttgactggacatggatgcttctgtttggcgatatccgccagggtatcttctatgccatgttgttatccttctggattattttctgtggtgaacacatgatggaccagcatgagaggaatcacattgcaggttactggaaacaggttggcccgatagcagttggctccttttgtctgtttatctttgatatgtgcgaacggggagtgcaactaaccaatcctttttatagcatctggaccacagatatagggacagagctagcaatggcattcatcattgtagcgggcatctgtctttgtctgtactttttatttttgtgtttcatggtcttccaggtgttccggaacatctctggcaaacagtcgtccctgcctgccatgtcgaaagttcggagactgcattatgaaggccttatcttccggttcaaattcctaatgctgatcacacttgcctgtgcggctatgaccgtcatattcttcatagtgagtcaagtcacagagggacattggaaatggggcggtgtaacagtgcaggtcaattcagccttcttcacaggcatttacggcatgtggaatctgtatgtcttcgctctgatgtttctttacgcgccaagtcacaagaattatggggaagaccaatctaatggtatgcaattaccatgcaaatcaagggaggactgcgcgctcttcgtgagtgagctgtaccaggaacttttcagtgcatcgaaatactcatttatcaacgacaacgcagcttcaggcatatag

SEQ ID NO: 140736 - DNA, 1353 bp, Artificial Sequence
  Description of Artificial Sequence: Synthetic coding sequence
atggccggcgccatcatcgaaaatatgagcacaaaaaagctgtgtattgtgggcgggattttgctcgtcttccagataatcgcgtttctggtaggcggactgattggggaaaatgctgaagtgagtatggatgtttctctggcgtatcgcgatgacgcatttgccgagtggactgagatggcccatgagagagtcccgagaaaactcaaatgtactttcacctcccccaaaactccggagcatgaaggccgctactatgagtgcgatgtgctgccttttatggaaatcggctctgtcgcccacaaattctacctgctgaacatccgtcttcctgtgaatgagaagaaaaagataaatgtcggaatcggcgagataaaggatatccgccttgtcgggattcatcaaaatggtgggtttacgaaggtgtggttcgccatgaagaccttcctgacacccagcatctttattattatggtttggtattggcggaggataaccatgatgtctcgacctcctgtgttgcttgaaaaggttatctttgccctgggcatctccatgacttttattaatattcctgtcgagtggttctccatcgggttcgactggacatggatgttactcttcggggacattagacaagggatattctatgccatgttgcttagcttctggattatcttctgcggggagcacatgatggaccagcatgaaagaaatcacatagccggttattggaaacaggttgggccaatcgcggtcggcagcttctgccttttcattttcgatatgtgcgagaggggggtgcaactcaccaaccctttctactccatatggaccaccgatataggaaccgaactggctatggctttcatcatagtagctggcatctgcctctgtctgtacttcctcttcttgtgctttatggtgttccaggtctttcgaaacattagtggaaaacagtcctcattaccggccatgagcaaggtgcgcagactgcactacgaagggctgatatttaggttcaagttcttaatgttaattaccctggcctgcgcagccatgacagttatattcttcattgtctcccaggtcacagaaggacactggaaatggggaggcgtgactgttcaggtaaacagtgctttttttacaggaatctacgggatgtggaatctttatgtgttcgctttaatgtttctttatgctccctcccataagaactacggggaagatcagtcaaatggggatctgggcgtgcatagcggggaggagctccaacttacaacaacaatcactcacgtggacggacccacagaaatctacaagctgacccgtaaggaggcccaggaatag

SEQ ID NO: 140737 - DNA, 1638 bp, Artificial Sequence
  Description of Artificial Sequence: Synthetic coding sequence
atggccggcgcaattatcgagaatatgagcacgaaaaagttgtgcatcgtgggcggcatcctcctggtgtttcaaattattgccttcttagttggtggcctgattgctccagggcccaccacagcagtatcatacatgtctgtgaaatgtgtcgatgccaggaaaaatcatcacaagaccaagtggttcgtgccctggggacccaaccattgcgacaaaatccgggatatcgaagaggcgatccctcgtgaaatcgaggccaatgatattgtctttagcgtgcatattcctctgcctcatatggaaatgtccccctggtttcagtttatgctcttcatcctgcagctggacatagcctttaagctaaacaaccagatccgtgaaaacgcggaggtgtcaatggacgtgtctttagcttaccgtgatgacgcctttgccgagtggacggaaatggcccacgagagggtgccacgtaagctgaaatgcaccttcacctccccaaaaactcccgagcacgaagggcggtattatgagtgcgacgtgctgccattcatggagattggatctgtcgctcacaaattctacttgctgaacattaggctgccagtgaacgagaagaaaaaaattaatgtgggcattggtgaaattaaagacatcagacttgtgggcatccaccagaacggcggatttaccaaagtgtggttcgctatgaaaactttcctgactccatctatcttcatcatcatggtgtggtactggagacgcataaccatgatgtccagaccaccagtgctgttggagaaggtcatttttgcgctggggatcagcatgacatttataaacatcccagtggagtggttttcgattggatttgattggacatggatgttgttgtttggggacatcaggcaaggcatcttctacgcaatgttgttgtcattttggatcatcttttgcggcgaacatatgatggatcagcatgaaagaaatcacatagccggatattggaagcaggtgggccctatcgccgtgggcagtttctgtctgtttattttcgacatgtgcgagcggggtgtgcaactcaccaaccccttctatagtatttggacgacggacatcggcacagagctggccatggccttcatcattgttgccggaatctgcctatgcctttactttctgtttctctgttttatggtgttccaagtgttcagaaacatctccggaaaacagagtagtctacccgctatgtccaaggtccgacggcttcactacgagggtctcatctttcgctttaagttccttatgctgatcacattagcctgcgccgctatgacagttatattctttatcgtttctcaggttactgagggccactggaagtggggaggtgtaaccgtgcaagtgaattcggccttcttcacaggcatctatggtatgtggaacctgtacgtgtttgcacttatgtttctgtacgctcctagtcacaagaactatggtgaggaccagagcaatggtatgcagctcccgtgtaagtcccgtgaggactgcgctttatttgtatctgagctctaccaggagcttttctcagcaagcaagtacagttttattaacgacaacgctgccagcggcatatag

SEQ ID NO: 140738 - DNA, 2142 bp, Artificial Sequence
  Description of Artificial Sequence: Synthetic coding sequence
atggctggatcgttctgttggaggatgttagggctcgtaagtaaagttggcaatcgagctcgctgtttttcttccatggcagctagcgaagaggagttgctggacttcagcggtagtgaactccagttcaacagctgttccctgcatctgagcctgcatccgtttttcaacttccttctcggtattcacagctgcttcgtttgcaaggagtccaaaaccgatgtcaagagatgtgtcgtgacccagtgtggaaaattttaccatgaggcctgcgtgaaaaaataccccctaacagtgttcgagagtcggggcttccggtgccccctgcatagctgtgtcagctgccatgcttctaacccctcgaacccaagaccatccaagggcaagatgatgcgatgcgtcaggtgccctgtggcctaccatagtggcgatgcttgcctggctgccgggtgtagcgtgatcgcctccaacagcattatctgcacagctcacttcacagccagaaaggggaaaagacatcatgcgcatgtgaatgtgtcttggtgctttgtgtgcagcaagggtggatcattgttgtgctgtgaaagctgtcctgccgcctttcaccccgactgtctgaacatcgagatgccggacgggagctggttctgtaacgattgccgcgccgggaaaaaactgcacttccaggatatcatatgggtcaagctggggaactatagatggtggccagcagaagtgtgccaccctaagaatgtgccccccaatattcaaaaaatgaagcacgaaatcggcgaatttccagtattcttcttcgggtcaaaagattactactggacccaccaagccagagtcttcccatacatggagggagacagagggtcacgataccagggagtgcggggcataggacgggtgttcaaaaatgctttgcaggaagcggaggctcgcttccgcgagattaagttacagcgcgaggcccgggaaacacaggaaagcgaacgtaaaccccctccatataagcacatcaaggtcaacaaaccttacggcaaggttcagatttataccgcagacatttccgaaattccaaagtgcaactgtaagccaacggacgagaacccatgtggattcgactcagagtgtctgaaccgcatgctgatgtttgagtgtcacccacaagtttgccctgcaggtgagttctgccagaatcaatgttttactaaaaggcaatatcctgagaccaagataataaaaactgatggcaagggatggggtctggtggcaaaacgcgatattcggaagggtgaattcgtcaatgagtacgtaggcgagcttatcgatgaagaagaatgcatggcccggataaaacacgcccacgagaatgacattactcacttctatatgctgaccattgataaggaccggattatcgacgccggtccaaaggggaactactcccgattcatgaaccacagttgccagccgaattgtgagacgctgaaatggacagtgaatggtgatacgcgagtggggctgttcgctgtctgtgatatcccagccggcacggaactcacattcaattataacctggattgcttaggcaatgaaaagactgtgtgccgatgtggagccagcaattgcagcgggtttctgggcgatcgacctaaaacctctaccacattgagtagtgaggaaaaaggaaaaaagacgaagaagaagacgagaaggcgacgggcaaagggcgagggcaagcgacagtctgaggatgagtgcttcaggtgcggagacgggggtcagctcgttttgtgcgatcggaagttctgcaccaaggcataccatctgagttgtctggggctgggcaaacggccctttgggaaatgggaatgcccgtggcaccattgtgacgtctgtggcaagccgagtacaagcttttgccatctttgccctaactccttttgtaaggaacaccaggatggtactgctttctcatgtacacccgatggacgcagctactgttgcgaacacgatttgggcgcagcttccgttagaagcacaaaaaccgaaaagcctccgccagaacctggaaaaccaaagggtaagcgaaggaggaggcgcgggtggaggagagtgacagagggaaaatag

SEQ ID NO: 140739 - DNA, 4098 bp, Artificial Sequence
  Description of Artificial Sequence: Synthetic coding sequence
atggagttcagcattaagcaatcgcctctgtccgttcaatccgtcgtgaaatgcatcaaaatgaaacaggccccagagatcctgggtagcgccaatggcaaaacgccatcgtgtgaggtcaatagagaatgctccgtcttcctgagtaaggcccagctcagctcctccctgcaggagggagtgatgcagaagttcaacggacatgacgctcttccttttatcccagcagataagctgaaggatctgaccagccgcgtctttaatggtgaaccaggcgcccacgatgctaaactgcggttcgagagccaggagatgaaaggtatcggtacccctcccaacacaacgccaattaaaaatggttccccagaaatcaaactcaagataaccaagacttacatgaatggcaaacccctctttgagtcttccatatgcggtgactctgcagccgatgtcagtcagagcgaggagaacggtcagaagccagagaataaagccaggcggaaccggaagcgatcaatcaagtatgactctctgctcgaacaaggcctcgtagaagcggccctggtctcgaaaatcagctccccaagcgacaagaagatacccgctaaaaaggagtcttgtcccaacaccggacgagacaaggaccatctactgaaatataacgttggagatctcgtgtggagcaaggtgagcggatacccatggtggccgtgtatggtttctgccgatcctcttttacattcctacaccaagttaaagggtcagaaaaaatcggctagacagtatcatgtgcaattttttggagatgcccccgagcgcgcatggatcttcgagaagagcttggtcgccttcgaaggagaaggtcagttcgagaaactatgccaggagtctgcaaaacaggctcccaccaaagcggaaaagataaagctgcttaagcccatttctggaaagttaagggcacagtgggaaatgggtatcgtgcaagcggaagaagccgcttccatgtctgtagaggagaggaaggccaagttcaccttcctgtacgtgggcgatcagcttcatcttaaccctcaggtcgcaaaagaggctggaattgctgccgagtccctcggggagatggcagaaagctcgggggtgagcgaagaggccgcagagaatcccaaatctgtgcgggaggagtgcattcctatgaagaggagaagacgtgcaaagctttgttcctccgcagagacactcgaatcccaccctgatatcggaaaatctactcctcagaagacagccgaggctgaccctcggcgcggcgtgggctcgccaccagggcgcaaaaagaccaccgtgtctatgcctagatcccgcaagggtgatgctgcttctcagttcctcgtgttttgccagaagcatagggatgaagtcgttgctgaacaccctgatgccagtggcgaggaaatagaggagttgctacgctctcagtggtccctcctgagtgaaaagcagcgcgccagatataacactaaattcgccctggtcgcgccggtgcaagccgaagaagatagcgggaacgttaatgggaaaaagcggaatcacacaaaaagaatccaggaccctactgaggacgctgaagcggaggatacaccacggaagcgcctacggacggacaagcactccctccgtaagcgcgatacgattacagataaaacagcgaggacatcctcatacaaagcgatggaggctgccagttcccttaaatcacaggctgccacaaagaatctgtctgatgcatgcaagcccctgaagaagcgcaatcgcgcgtctaccgccgcgtcaagtgcgttgggcttctccaagagttcctcaccatctgcttctctcaccgagaacgaggtgagcgattcccccggagacgagcccagcgagagcccatatgagtcagcagacgaaactcaaactgaagtctcggtgagcagtaaaaaaagtgagagaggtgtcaccgccaaaaaagagtacgtgtgccaactgtgtgagaagccagggtccctcttactctgtgagggcccctgttgcggcgctttccatctcgcttgcctgggactctcaagacgcccggaaggccggtttacctgttctgagtgtgcatccggaattcacagctgctttgtatgtaaagagtctaagaccgatgtgaaacgctgtgtggttacccaatgtggtaaattttatcacgaggcgtgcgttaagaagtaccctctcactgtgtttgagtccagagggtttagatgtcccctgcattcctgtgtatcttgtcatgcctccaacccatctaatcctcgcccttcgaaagggaaaatgatgcgctgcgtgaggtgtcctgtggcttatcactccggtgatgcctgcctcgccgcgggatgctccgtcattgccagtaactccattatttgtacagctcatttcaccgcaagaaaggggaagcggcaccacgcacatgtgaatgttagctggtgcttcgtctgctccaaaggaggaagtctgctgtgctgcgaaagttgcccggctgctttccacccagattgtctgaatatcgagatgccagacggttcatggttttgtaatgactgcagagctggaaagaagttacattttcaggatattatttgggttaaactgggtaactatagatggtggcctgccgaagtgtgccaccctaagaatgtgcctcccaacattcagaagatgaagcacgagatcggcgaatttcccgtttttttcttcgggagcaaggactactattggactcaccaggcccgagtgttcccctacatggaaggcgaccggggaagcaggtatcagggagttcgggggatagggcgagtgtttaagaacgccctccaggaggctgaagctcgcttccgagagataaaactgcagcgcgaagcgcgcgaaactcaggaatcagagaggaaaccacccccctataagcatatcaaggtcaacaagccttatggcaaggtccagatatacaccgcggacatttcagagatcccaaagtgtaactgtaagccgactgatgaaaacccctgtgggttcgacagcgaatgccttaatagaatgctaatgttcgaatgtcacccacaagtatgtccggctggcgaattctgccagaatcaatgtttcactaagagacagtatccagaaactaagattattaagacagacggaaaggggtggggcttagtagccaagcgcgatatacgaaagggggagtttgtgaacgagtacgtgggcgagctgatcgatgaagaagaatgcatggcaaggattaagcatgctcacgagaatgatattactcacttctacatgctcacgatcgacaaagacaggataattgatgctgggccaaagggaaactacagtaggttcatgaatcattcatgccagcctaattgtgagaccctaaaatggaccgtgaacggtgacactcgggtcggcctttttgccgtctgcgatatacctgccggcaccgagctaacattcaattataatctggactgtcttggtaatgagaagaccgtttgcagatgtggagcatccaattgttcaggtttcctgggagaccggcccaagactagcaccaccctgagtagcgaggagaagggtaagaaaactaagaaaaagaccaggaggcgccgggccaagggggagggcaaaagacaaagcgaagacgagtgctttaggtgcggtgacgggggacagctggtcttgtgcgataggaagttttgtaccaaggcataccatttgtcctgtttgggactcggcaagaggccatttggcaaatgggagtgcccatggcatcactgtgatgtgtgtgggaaaccaagcacgagtttttgtcatctttgtccgaatagtttttgcaaagagcaccaggacggaacagcctttagttgtacacctgacggaaggtcttactgttgtgagcacgacctgggggcagcaagcgttcgatccactaagacagagaaacctccgcctgaacctggcaagcctaaaggtaagagacgtcgacgacggggctggaggagagtgacggaaggcaagtag

SEQ ID NO: 140740 - DNA, 4098 bp, Artificial Sequence
  Description of Artificial Sequence: Synthetic coding sequence
atggagttctctatcaagcagagcccgctgtctgtacagagcgtggtgaagtgtattaagatgaagcaggcacctgaaatactgggctcggcaaatgggaaaactccatcctgtgaggttaaccgggagtgtagcgtctttctttcgaaggcccagctgtccagctcactgcaagagggggtgatgcagaagtttaatggtcatgacgccctcccctttatcccggcagacaagctcaaagacctgacatcgcgagtcttcaatggcgagcccggcgcacacgacgctaaactgcgcttcgagagtcaggagatgaaaggtatagggacaccccccaataccaccccaatcaagaatgggtcaccagaaattaagctcaagataaccaagacctatatgaacggaaagcctctttttgagagctcaatatgtggagattcagccgcggatgtgtcacagagtgaggagaatgggcaaaagcccgagaacaaagccaggagaaaccgtaaacgcagcatcaaatatgactctctacttgaacagggactagttgaagctgctttagtatccaaaattagctcaccatcggacaagaaaatacctgcgaaaaaagagtcatgtccaaacacaggcagggacaaggatcacttattgaagtacaatgtaggcgacctagtttggtctaaagtgagtggttacccctggtggccatgcatggtgagcgccgatcctctcttgcactcatacacgaaattgaagggccaaaagaaaagtgccaggcagtatcatgtgcaattctttggagatgctcccgagagagcatggattttcgagaagagccttgtggcctttgagggggagggccagtttgaaaaattgtgccaagagtcagccaaacaggccccaaccaaagcagagaaaattaagttacttaaaccgatctccggaaagttgagagctcagtgggaaatgggtattgtgcaggcagaggaggccgccagcatgagtgttgaggagcgtaaagccaaattcacttttctgtacgtgggggaccagctccacttgaaccctcaagtggcaaaggaggccggcatcgctgcggagtccttaggagagatggcggaatcttccggcgtgtcggaggaggccgccgagaatcccaaatctgtgagagaagaatgcattccgatgaagcggcggagacgggctaagctgtgttccagtgccgagactctggagtcacacccagacattgggaaatcaactccacagaagacagctgaagccgacccaaggagaggcgtgggttcacccccaggccggaaaaaaaccacggtgtccatgccccgctccagaaaaggtgacgcggcatctcagtttctggtcttctgccaaaagcatcgggacgaggtggtcgcagaacatccagatgcttcaggagaggagatcgaggaactgctgcggagccaatggtctctccttagtgagaagcaacgggccagatataacacgaagttcgcactcgtggcccctgtgcaggcagaggaggattccggcaatgtgaatggcaagaaaaggaaccacacaaaacgcatccaagatcctaccgaggatgccgaggccgaggatactccccgaaagaggttaagaacggacaaacatagtctgcgcaagcgtgataccatcactgacaagacggctagaacctcatcctataaggccatggaagctgctagcagtttgaagtcccaagccgccacgaagaatctgtccgacgcctgtaagcctctgaagaaacgcaacagagccagtacagcggcctcaagcgcgttaggcttctcgaagagctcgtcacctagtgcctctcttacggaaaatgaggtttccgactcccccggagacgagccatccgagagcccctatgagagcgctgatgagactcagacggaagtgagcgtgagctcaaagaagagcgaacgtggcgtcacagccaaaaaagagtacgtctgtcagctgtgcgaaaagcccgggagcttgcttctgtgcgagggcccatgctgcggcgcttttcacttagcctgtttggggctgagccgtagacccgaaggtaggtttacgtgttcagagtgtgcatccggcatccatagctgctttgtctgtaaagaaagcaagaccgatgtgaaacggtgtgtcgtaactcagtgtggtaagttctaccatgaagcctgcgttaaaaagtacccactgacagtgttcgagagcagggggttccgctgtccactccatagctgtgtatcatgtcatgctagtaaccctagtaacccgagaccatccaagggcaaaatgatgcgttgcgtaaggtgccctgtggcatatcattctggagatgcgtgccttgccgctggttgcagcgtgattgccagtaacagtatcatttgtaccgcccacttcactgcacgaaaaggaaagcggcaccatgcccatgtgaacgtgtcttggtgctttgtgtgtagtaagggggggtcgctgctatgttgtgagtcgtgtcccgcagccttccatcctgactgccttaatatagagatgcccgatgggagctggttttgtaatgactgccgggctggcaagaagctgcattttcaagatatcatttgggtcaagctgggtaattaccgctggtggccagccgaagtttgtcatcccaagaacgtgccccctaatatccagaaaatgaagcacgagattggtgaattccccgtctttttttttggaagcaaggattattactggacccaccaggccagggtatttccctatatggagggcgaccgggggagccggtatcagggagtcaggggcatcgggagggtatttaagaatgccctccaggaggcagaggccaggttcagggagattaaacttcaacgagaagcgcgggaaactcaggagagtgagaggaaaccccccccctataagcacataaaggtgaacaagccctatggtaaggttcagatctacacagccgatatatcggaaattcccaagtgtaattgtaagcccactgatgagaacccatgtggctttgactctgagtgcctgaatcgaatgttaatgttcgagtgccatcctcaggtatgtccagcaggagagttctgtcagaaccagtgcttcactaaaagacagtaccccgaaaccaaaatcatcaagactgacggcaaaggctgggggctggttgccaagagagatattcggaaaggcgagtttgtgaatgaatatgtcggagagctgattgatgaggaggagtgtatggcaaggataaagcatgcacacgagaacgacatcactcacttctacatgctcacaattgacaaggataggattatcgatgccggtcctaaggggaactacagccgattcatgaaccattcatgccagcccaattgcgaaacactgaagtggacagtgaacggtgatacaagggtgggtctcttcgctgtgtgcgacataccagcggggactgaacttacctttaactacaatctcgactgcctcgggaacgaaaagaccgtgtgccgttgtggagcatccaattgttccggattcttaggtgacaggcccaagacaagcaccacactgtcttctgaggagaaggggaagaagaccaagaaaaagacacgcaggcgccgagctaagggggagggaaagcgccagtctgaggatgagtgctttcggtgcggcgacgggggacaattagtcctgtgtgaccggaagttttgcacgaaggcctaccacctcagttgcctgggactgggaaagcggccctttggcaaatgggaatgtccgtggcaccactgcgatgtctgtggcaaaccgtctacatctttttgccatctatgtcctaatagcttctgtaaggagcatcaggatggaacagcattttcatgcacacccgatggccgatcctactgttgtgagcatgatctgggcgccgctagtgtgcgatctacaaaaactgaaaagcccccccctgagcccggcaaacctaaaggaaagcggcgccggaggagggggtggcgcagggtcaccgaggggaagtag

SEQ ID NO: 140741 - DNA, 4098 bp, Artificial Sequence
  Description of Artificial Sequence: Synthetic coding sequence
atggaattcagcatcaagcagtcccctctcagcgtacagagcgtggtaaagtgcatcaaaatgaaacaagcccctgagattctggggtctgctaacggaaagacaccctcatgcgaagtgaatcgggaatgcagcgtttttctgagcaaggctcaactctctagctccctgcaggaaggtgtgatgcagaaattcaatggccacgatgccctacccttcattccagcagataagttgaaagatcttacctcccgtgtttttaatggcgagccaggagcacatgacgcaaaactgcggttcgaatcccaggagatgaaaggcataggcactcccccaaatactacacctatcaaaaatggcagcccggagatcaaattaaaaattacaaaaacatacatgaatgggaaacccttgttcgaaagttccatctgcggtgattcggctgcagacgtgtctcagagtgaggagaatgggcaaaagcccgagaataaggctcgccgaaaccggaagaggtctatcaaatacgattcactgttggaacagggattggtggaagcagccttggtgagtaagatttccagcccaagcgacaagaagataccagcaaaaaaagagtcatgcccaaacacaggccgcgataaagaccacctgctcaaatacaacgtaggggacctcgtctggtccaaagtgtccggctacccctggtggccatgtatggtctctgccgacccgttgctgcattcatataccaagctgaaaggacagaaaaaaagtgctcgtcagtaccacgtccagtttttcggcgatgcgccggaacgcgcgtggatcttcgagaaatctctggtcgcgttcgagggcgaagggcagttcgaaaaactgtgtcaggagtctgcaaagcaggctcccaccaaggctgagaaaattaagcttctcaagcccatctccgggaagttgcgcgcccagtgggaaatgggcattgtccaggctgaagaggccgcctccatgtcagttgaggagcgaaaggcaaagtttacatttctgtatgtcggagatcagctccacctcaacccccaggtggctaaggaagcaggaatagccgccgagagcctcggggagatggctgaaagctcaggagtgagcgaggaagctgccgaaaatccaaagtccgtgagagaagagtgcatacccatgaagaggcgaagacgcgccaagttatgttcgagtgccgaaacactggagagtcaccctgatatcggcaaatctaccccacagaaaaccgctgaagctgatccaaggaggggtgtcggatctcctccgggacgcaagaagaccacagtgtccatgcctaggtccaggaaaggggacgcagcaagccaattccttgtgttctgccaaaagcacagagacgaggtggtggccgaacaccccgatgcatccggagaagaaatcgaggaactcctgcgctcccagtggtccctgctttcagagaagcaacgggccaggtataatactaagttcgcgctggtagcacccgtgcaggcagaagaggatagtgggaacgttaacggcaaaaagagaaaccacacgaagcggatccaggatccaacggaggatgctgaagctgaggatacaccaagaaaaaggctgcggaccgataagcactcactgagaaagagggacacgatcaccgataagacagcacgtactagcagttacaaggccatggaagcagcttcgagtttgaagtcacaagccgccaccaaaaacctgtccgacgcatgtaagccactcaagaagaggaacagggcttccacggccgcatcctccgctctggggtttagcaagagctctagccccagcgcatctctcacagaaaatgaagtctcagactcgcccggggacgaaccctccgagtccccctacgagtccgctgacgaaacccagacagaagtgtccgtgagtagtaagaagagcgaaagaggggtgactgccaaaaaggaatatgtttgtcagttgtgcgagaagcccgggtcacttctgttgtgcgagggtccttgttgtggagccttccacctggcctgcctgggcttgtccaggagaccggagggccgctttacttgtagtgaatgcgccagtggcattcactcgtgcttcgtatgcaaagagtcaaagacggatgttaaaaggtgtgtagtgacccaatgtgggaagttctatcacgaagcctgtgtgaagaagtaccccctaaccgtgtttgagagccgcggctttcggtgcccactgcattcttgtgtttcctgccatgccagtaacccttccaacccgcgcccttcaaaaggcaaaatgatgaggtgtgtccgttgccccgttgcatatcattccggggacgcttgcctggcagccggctgctcggttatcgcctccaactctattatctgcactgcccatttcacggcccgaaagggcaagcgccaccatgcacatgtgaatgtctcttggtgtttcgtctgtagtaagggcggatcgctcttgtgttgcgaatcatgccctgctgctttccatcccgactgtctgaacattgaaatgccggatgggtcttggttctgcaacgactgtagggccgggaaaaaactgcacttccaggatatcatttgggtaaaactcggaaactacagatggtggcccgcggaggtgtgccatcctaagaacgtgccccccaacattcagaagatgaaacacgaaatcggggaatttcccgtctttttctttgggtccaaagattactactggacacaccaggcgcgcgtgttcccatacatggagggcgacaggggcagtaggtaccaaggcgtgcgtggcattggaagggtatttaagaacgcactccaggaggccgaggcaagatttagagagattaaacttcagagagaggctcgggaaactcaggagtccgagaggaagcctccaccttacaaacacattaaagtcaataaaccttatgggaaggtgcaaatttataccgccgacatctctgagatcccaaaatgtaactgcaaacctacagacgaaaatccctgtggatttgactctgaatgtctcaacaggatgctcatgttcgaatgtcacccacaggtatgtccggctggcgaattctgtcagaaccagtgttttaccaaacgccagtatccagaaaccaagatcattaagacagacggaaagggctggggactcgtggcaaagcgggatatacgaaaaggcgagttcgtcaatgaatacgtgggtgaattaatcgacgaagaagaatgcatggcacgtataaagcatgcccacgagaacgacatcacccatttctatatgctgaccatcgacaaggacagaattattgacgcagggccgaaaggaaattactccaggtttatgaatcatagttgccaacccaactgcgagaccttaaaatggaccgtcaacggcgatactagagtgggcctgtttgcagtgtgcgacatccccgcaggaacggagctcactttcaactacaacctggattgtctaggcaacgagaaaacggtgtgccgatgcggggccagtaattgtagcggttttctgggggaccggcccaagacgagtacaactctgagctccgaggaaaaaggcaaaaagactaagaagaagacccgcagacgtagggcaaagggcgaaggaaaacgccagtccgaagatgaatgcttcaggtgtggggacggagggcagttggtgctgtgtgatagaaagttttgcactaaagcttaccacctgagttgtctaggcctgggcaagcgtcccttcgggaagtgggagtgtccttggcaccattgcgatgtgtgtgggaagccatctaccagcttttgtcacctttgccctaactccttctgtaaggagcaccaagatggcaccgccttctcatgtaccccagacgggaggagctactgctgtgagcacgatctgggcgcagcatccgtccggtccacgaaaacagagaagcccccccctgagccgggtaaaccgaaagggaagagacgacggcgtagagggtggagaagggtcacggaaggcaaatag

SEQ ID NO: 140742 - DNA, 1944 bp, Artificial Sequence
  Description of Artificial Sequence: Synthetic coding sequence
atggaattcagcataaagcagagtccactgagcgtgcaaagcgtcgtgaagtgcatcaaaatgaagcaggcccccgaaattctggggtcagccaatggaaaaacgccctcctgcgaggtcaacagagagtgctccgtgttcctgtcgaaggcccaactgagttcctcacttcaggagggcgtcatgcagaagttcaacgggcatgacgcattgccttttatccctgctgacaagcttaaggatctgacaagtcgcgtttttaacggcgagccaggagctcatgatgccaaactgagatttgaatctcaggagatgaagggcatcggtacaccaccaaataccactccaattaagaacgggtcgcccgaaatcaagttaaaaattactaaaacttatatgaacgggaagcctctgttcgagagcagcatatgcggtgactccgctgctgacgtgtcccagtcagaagagaatggacaaaagccagaaaataaggcccggagaaaccgaaagagatcaataaaatacgactccctgctcgagcaggggcttgttgaggcagcgctggtttccaaaattagctccccttccgataaaaagatccctgccaaaaaagagtcttgccctaacacaggacgggataaggatcatttgctgaagtacaatgttggggacctcgtgtggtcaaaggtgtccggatacccgtggtggccttgcatggtgtcagcggacccactgcttcattcttacaccaagcttaaaggacagaagaagtccgccaggcagtaccacgtgcagttcttcggggacgcccccgagcgcgcctggatcttcgaaaaatcgcttgtagcatttgagggagagggtcagttcgaaaaactctgccaggagagtgccaaacaggctcctactaaggccgagaagatcaaactgctgaaaccaatttccggaaagctccgagcgcaatgggagatgggtattgtgcaggcagaagaggctgccagcatgagcgttgaggagaggaaggcgaaatttacattcctgtatgtaggagaccagcttcatctcaatccccaggtagccaaggaagctggcattgctgccgaaagccttggagagatggcggagtcttcaggcgtttccgaggaggcggcggagaaccccaaatctgttcgggaggagtgcatacccatgaagcggcgccgtagagctaagctgtgttcctccgcagaaaccctggagtcccaccctgatattggaaaatccacccctcaaaaaaccgccgaggccgacccgaggaggggggtcggctctccccctggaaggaagaagaccacggtcagtatgcctaggtctaggaagggggacgctgcctcgcagtttctcgtattttgtcagaagcatcgggatgaagtggttgctgagcaccctgatgcaagtggtgaggaaatcgaggaactgctgcgttcccagtggagcttgctcagcgaaaagcagagggcacgctataacactaagtttgccctggtggcgcccgttcaagccgaagaagacagcgggaatgtcaatggcaaaaaaaggaaccatacgaaacggattcaagaccctactgaggatgctgaagccgaagacacgccccgcaaacggctgcgcaccgataaacatagtctgaggaagcgagataccatcactgacaagaccgcaaggaccagttcctacaaggcgatggaagcagctagtagtctcaaatcgcaagcagctacaaaaaacttgtccgacgcctgtaaacccctgaaaaaaagaaatcgggcttcaaccgctgccagctctgctcttgggttttccaagtctagctcgccttccgcgtcccttacggagaacgaactgctgtgggaacccacccctgtgaagctggacctcaatcccgctgcattgtattgcacttag

SEQ ID NO: 140743 - DNA, 1890 bp, Artificial Sequence
  Description of Artificial Sequence: Synthetic coding sequence
atggagttcagcataaagcagagcccgctttccgtccaaagtgttgtcaagtgcatcaaaatgaaacaggccccagagattcttggtagtgctaatggaaagacgccctcttgcgaggttaatagagaatgcagcgtcttcctttctaaggctcagctgagtagttctctccaggaaggcgtgatgcagaagttcaacggacacgatgctctgccttttatccctgccgacaaacttaaagacttaaccagccgagttttcaatggtgaaccaggagctcacgacgcaaagctgagattcgaaagccaagagatgaaagggatcggcacgccgcccaatacaacgccaatcaaaaacggctcgcccgaaatcaagttaaagatcactaagacctatatgaacggaaagcctctgttcgaatcttccatctgtggtgactcggcagctgacgtctcacagagtgaggaaaacggccagaaaccagagaacaaagctcgccgcaacagaaaacgatcgattaaatacgacagcctattggagcagggcctggtcgaagccgctttggtgagcaagatctcttcacctagcgataagaaaatcccggcgaaaaaagaaagctgtccaaatacagggcgtgataaagatcacctgctgaaatacaatgtaggtgacctagtgtggtccaaggtttccggttacccgtggtggccgtgcatggtgagtgccgatcccctgctgcacagctacactaaattgaaaggtcagaagaaatccgctcgacagtaccacgtgcagttcttcggtgatgctcccgaacgcgcgtggatcttcgaaaagtctctggtcgccttcgaaggtgagggccagttcgagaaactctgtcaggagtccgctaaacaagccccaacaaaagctgaaaaaataaaattgctcaagcccatttctggcaagctgagagctcagtgggaaatgggcatcgtgcaggctgaggaggctgcatctatgtcagtggaggagagaaaagccaagttcacatttctgtacgtgggcgatcagcttcacctgaacccccaggtcgctaaagaagcagggattgccgcagagtcgcttggtgaaatggccgagtcttctggtgtgtccgaggaagccgctgagaaccccaaatctgttagggaagagtgcattcccatgaagaggagacgacgggccaaactttgcagtagtgcggaaacgttggaatcccatcccgacattgggaaatctactcctcagaagaccgcagaagccgatcctcggcggggtgtcggcagcccccccggtcgaaaaaagaccaccgtatcaatgccacgttcccgcaagggagatgctgcctctcagttcctggtcttttgtcagaagcacagggatgaagttgttgccgagcacccggacgccagcggagaggagatagaggaactactgcgcagtcagtggagcctgctgtccgagaaacagagggctcggtacaacacaaagtttgccctcgtggctcctgtgcaggccgaggaggactctgggaatgttaacggaaagaagaggaaccataccaaaagaatacaggatcctactgaggatgcagaagcagaggacacacccaggaagagactgcgtactgataagcactcactgaggaaaagagacacaataacagataaaacagctagaaccagctcctacaaagccatggaggccgcctccagtcttaagtcccaggcagctaccaaaaacctgtccgacgcttgcaagcctctcaagaaaaggaatcgcgcctcgaccgccgccagcagcgcactcggcttttcaaaatccagcagcccgtccgcaagcctaacggagaacgaggtcaagtag

SEQ ID NO: 140744 - DNA, 822 bp, Artificial Sequence
  Description of Artificial Sequence: Synthetic coding sequence
atggaattctctataaagcagtcccctttatccgtgcagagtgtagtgaagtgtattaagatgaagcaggctcccgagattttgggatccgccaatggcaaaacaccgtcatgcgaagtcaatcgagagtgttcggttttcctgtcaaaggctcaacttagttcctcacttcaggagggtgtgatgcagaaatttaatggtcatgacgccctgccttttattcctgcagacaagctcaaagatctcacttctagggtttttaatggcgaaccaggggcccatgacgcaaaactgaggttcgagtcgcaggaaatgaagggtatcggcacccccccgaacaccacgcccatcaagaatgggtccccagagattaagctgaagatcacgaaaacctacatgaatggcaaaccgctcttcgaatcgtctatttgcggtgatagtgccgccgacgtcagtcagagtgaggagaatgggcagaagcccgagaataaagcaaggcgcaatcgaaagagaagcattaagtacgacagcttactagaacagggccttgttgaggccgcccttgtaagcaaaatatcttcccctagtgataagaagattcccgcgaaaaaggagagttgtcccaacacaggacgtgataaggatcatctccttaaatacaatgtcggtgacctggtatggtccaaagtgagtggttacccctggtggccttgcatggtttccgcggaccccctgttgcactcgtatacaaagctcaaaggaatcttcaagtcaaagaagtttgagcatctgaagacatcccagatagtactgaaggactag

SEQ ID NO: 140745 - DNA, 1944 bp, Artificial Sequence
  Description of Artificial Sequence: Synthetic coding sequence
atggagttctccattaagcaaagccctctgagcgtccagagtgttgtaaagtgcataaagatgaaacaggcaccagaaatcctggggtctgctaatgggaagacgccctcatgtgaagtgaatagggagtgttcagttttcttaagtaaggcgcagctgtccagctcactgcaggagggggttatgcagaagtttaatggccacgatgcgttgccctttatcccagccgacaagctgaaggacctgacaagccgcgtcttcaacggcgaaccaggcgcccatgatgcgaaactgcggttcgaatcacaggagatgaaaggcattggcaccccccccaacactacaccaattaaaaacggcagcccggagataaaactgaaaatcactaagacctacatgaacggaaaaccgcttttcgaatcaagtatttgtggggatagtgccgccgacgtgtctcaatccgaggagaacgggcaaaaaccagagaacaaagccaggagaaacagaaaacgctctatcaagtatgattctctgttggaacaaggactggtggaagccgccctggtttctaaaatcagtagtcccagtgataagaaaattcccgctaaaaaagagagctgccccaacacaggtagagataaagatcatctgcttaagtacaacgtcggtgatctcgtctggagcaaggtgagtggctacccttggtggccgtgtatggtctctgccgatccactcttgcattcttataccaagcttaaaggccagaagaagagcgcaagacagtaccatgtgcagttttttggtgacgccccggagagagcctggatcttcgaaaagagtttggtggccttcgagggggagggacaatttgagaagctctgtcaggagtctgcgaagcaagctccaactaaggcggagaagatcaaactgctgaagcccatcagcggcaagctgcgagctcagtgggagatgggtattgtacaagccgaagaagcagccagcatgtctgtggaggagagaaaggctaagtttaccttcctgtatgttggtgatcagttgcatctcaatccccaagtagctaaagaggccggaatcgccgccgaatcacttggggagatggctgaaagttccggggtgagcgaggaggctgccgaaaacccgaaatccgtgcgggaggagtgcatccctatgaagcggagaaggcgcgccaagctctgcagctctgcagagactctcgagagccatcccgacatcggcaagtccactccacagaaaacggctgaggccgacccacggcgaggagttgggtctccacccgggagaaagaagacgacagtttctatgccacgaagcagaaagggcgacgccgctagtcaatttttagtgttttgtcagaaacaccgcgatgaagtcgtggctgagcacccagatgcatcgggggaagaaattgaggagttattgcgctcccagtggtcactcctgtccgaaaagcagagagcccggtataataccaagttcgccttggtggcaccagtgcaggcggaggaggactcaggcaacgtgaatggaaagaagcgaaaccataccaagagaatacaggaccctacagaagacgccgaggccgaagacactcctcggaagaggttgcgaactgacaagcatagcctgagaaagcgcgatacaattaccgacaagaccgcccgcacctccagctacaaagctatggaggccgcttcatcactgaagtctcaggcggcaactaaaaacctgagtgacgcatgcaagccactcaaaaagagaaatcgcgcctccactgccgcctcctcagcattgggtttctccaagagctcctccccttcagcttcattaacagaaaatgaacttctctgggaaccaacccctgtgaaactggaccttaatcctgcagcattgtactgcacctag

SEQ ID NO: 140746 - DNA, 114 bp, Artificial Sequence
  Description of Artificial Sequence: Synthetic coding sequence
atggagtttagcatcaaacagagtccgctgtccgttcagagcgtggtgaaatgtatcaaaatgaagcaggcccctgagatactgggcagtgccaacggtaaaacaccatcctag

SEQ ID NO: 140747 - DNA, 4098 bp, Artificial Sequence
  Description of Artificial Sequence: Synthetic coding sequence
atggaattctctatcaaacagtcccccctatccgttcagagcgtggtgaagtgtatcaagatgaaacaggcaccagagatcctgggatccgcgaatggaaagaccccttcttgcgaagtcaacagggagtgtagcgtatttctcagcaaggcgcaactttcttcaagccttcaggaaggggtcatgcaaaagtttaatggtcatgatgcccttcccttcatcccagccgataagctcaaggacctgaccagcagggtgtttaacggggagccaggggctcacgatgccaaacttaggtttgagtcccaggagatgaaggggattgggacgccgcccaatactacacccatcaagaacggaagtccagaaatcaaacttaaaattaccaagacctacatgaacggtaaaccattgtttgagtcctctatttgcggggattctgccgctgacgtgtctcaaagcgaagagaatggccagaagccagaaaacaaagctcgaagaaatcgaaagcgctcaattaaatacgatagccttctggagcagggactggtggaggccgccctggtgagtaagattagcagccccagcgataaaaaaattcctgccaagaaggaatcctgccccaacacgggacgggacaaggaccatctgttgaagtacaatgtgggcgacctcgtctggtctaaagtcagcggctacccatggtggccgtgcatggtttccgctgaccctttactgcacagctataccaagttgaagggccagaagaaaagtgcaagacaatatcacgtccagttctttggggatgcccccgaacgggcttggattttcgagaagtcccttgtggccttcgaaggggagggtcagtttgagaagctgtgccaggaatccgcgaagcaggcgcccaccaaagctgagaagataaagctactgaaacccatttccgggaagttgagggcacagtgggagatgggaattgtacaggctgaggaagcagcatctatgtccgtggaagagagaaaggccaagtttacctttctgtatgtgggcgaccagctgcatctgaacccccaggttgcaaaggaggcaggaatagcagccgagtcactgggtgagatggcagagagttcaggcgtctccgaagaggcggccgagaacccaaagtcagtacgcgaagagtgtatccccatgaaacgtaggaggagggcaaaactctgttcaagcgccgagacattggagagccacccagatatagggaagtccacaccacagaaaacagccgaggctgaccctcggcggggtgtcggatccccacccggaagaaaaaagaccactgtctccatgcctagatccaggaaaggcgatgccgcatctcagtttcttgtgttttgccagaagcatagagacgaagtagtggccgagcaccccgacgcgtccggtgaagaaattgaggaactgcttcgcagtcagtggagcctgttatccgaaaagcaaagagcgcgatacaatactaaattcgccttggtggcccctgttcaggctgaggaagatagcgggaatgtcaatgggaaaaaacgcaaccacaccaagcggatccaggatcctaccgaggatgccgaagccgaggatacaccgagaaaacgactgcgcacagataagcactccttacggaaaagagatactattacagataagaccgcaaggacctcttcttataaagctatggaagccgcctcttcactgaaatctcaagctgctactaaaaacttgagtgatgcttgcaaaccattgaagaagcgaaacagggcctccaccgctgccagttctgcactaggattttcaaagagctcatccccatctgcatcactgaccgagaatgaggtatccgattcccctggagacgagccatctgagagcccatatgaatctgccgacgagactcagaccgaggtttctgtctctagcaagaagagtgagagaggcgtgacagctaaaaaagaatatgtgtgtcagctttgtgaaaaaccaggctcccttctgctttgcgagggaccgtgctgcggagcttttcacctcgcctgcctgggattgagtcggcgcccagagggtaggtttacttgcagcgaatgcgcctccggaatccacagttgtttcgtgtgcaaggagtctaaaacggacgtgaagcgatgcgtggttacgcagtgtgggaaattttaccacgaggcctgcgtcaagaagtacccgctcacagtgtttgaaagccgcggtttcagatgcccactccatagttgcgttagttgccacgcttccaatccgtctaacccccgccccagtaaggggaagatgatgagatgtgtgcgatgccccgtggcgtatcacagcggcgacgcctgcttggccgcaggttgttccgtaatagcatccaactccatcatctgcacagcgcactttactgcccggaagggtaagagacatcacgcacacgtgaatgttagctggtgctttgtgtgctcaaagggcggaagtctgctctgctgcgagagttgtcccgcggccttccatcctgattgtttgaacatcgagatgcccgacggatcttggttctgcaacgactgcagggccgggaagaagctccatttccaagacatcatctgggttaagctcggtaactataggtggtggcccgctgaggtgtgccaccctaagaatgtccctccaaacatccaaaagatgaaacacgagattggcgagttcccagtgttttttttcggttccaaggactattactggactcatcaggcccgagtctttccttatatggagggggaccggggctcacggtatcaaggagtacgcggcatcggccgtgtgttcaagaacgcactgcaagaggccgaggcaagattcagggaaataaaactccagagggaggcacgggaaactcaggaatccgaacgtaagcctcccccctacaaacatatcaaggtaaataaaccttacgggaaggtacagatctacacagcagatatctctgagatcccaaaatgcaactgtaagccgacagacgaaaatccttgcggatttgattcagaatgtttgaaccgtatgttgatgttcgagtgtcacccccaggtctgccccgcaggggagttctgccagaatcaatgtttcactaagaggcagtatcctgagactaaaatcattaagaccgacggcaagggctggggcctcgtggctaagagggacatacgcaaaggcgaatttgtcaacgagtatgtaggcgaattaatcgatgaggaggagtgtatggctagaattaagcacgcacacgagaacgacatcacgcatttttacatgctcactattgataaggatcgcattattgacgcaggcccgaaaggtaactacagtagattcatgaaccatagttgccagcctaattgtgaaactctgaagtggaccgttaacggagacacccgagtaggcctcttcgccgtgtgcgacattccggccggcactgagctgacattcaactacaatctagactgcctgggcaatgagaaaacagtctgtcgatgtggggcatcaaactgttcaggatttctcggtgaccgccctaagaccagtactacgctgtcctccgaggagaaaggaaagaaaaccaaaaaaaaaacaagaagacgcagagcaaaaggagaggggaaacggcagtcagaggacgagtgctttcgttgcggagatggtggacaactcgtgttgtgcgatcggaagttctgcaccaaagcttaccacttatcttgcctagggctcgggaaacggcccttcgggaagtgggagtgtccctggcaccactgtgatgtgtgtggcaaaccctcaactagcttctgtcatttgtgtcccaacagcttttgcaaggagcatcaggacggtactgcgttctcttgcactccagatggtcgttcatattgttgcgaacatgatctcggcgcggcgagcgtgagaagcactaagactgagaaacctccacctgaacccgggaaaccaaagggaaaacggcgtcgacgacgcgggtggcgccgcgttactgaggggaagtag

SEQ ID NO: 140748 - DNA, 1179 bp, Artificial Sequence
  Description of Artificial Sequence: Synthetic coding sequence
atggaatttagcatcaagcagtctcccttgagtgtgcaaagtgttgtaaaatgcattaagatgaagcaagcccccgagatcctgggctcagctaatggaaagaccccgagctgtgaggtcaatcgcgaatgcagtgtgttcttgagtaaggcacagctgagctcttcactgcaggagggtgtgatgcagaaattcaacggtcacgatgccttgccattcatcccagccgacaagctgaaggatctgacaagcagagtattcaacggcgagcccggcgcacacgacgcaaaactgaggttcgaaagtcaggagatgaaaggcataggcacaccaccaaatacaacacccatcaagaacggaagccccgagatcaaattgaaaattacaaagacttatatgaatggcaagccactattcgaatccagcatttgcggggactctgcagcagatgtctcacagagcgaggagaacggccaaaagcctgagaataaggcccggcggaatcggaagaggtcaataaagtacgattcactgctcgaacagggccttgtggaagccgcactggtctctaagatcagttccccatctgacaagaagattcctgctaaaaaggagagctgccctaatactggtcgggataaggaccacttgcttaaatataacgtcggggatttggtatggtcgaaggtgtccggatacccttggtggccctgtatggtgtctgctgacccgctactgcattcatacacaaagctaaaagggcaaaagaagtcagctcgacagtatcatgtccagttctttggtgacgccccagagcgggcctggatatttgagaaatccctggtggcattcgaaggcgagggccagttcgagaaactctgtcaggagtccgccaaacaggctccaacgaaagccgagaaaattaagctgctgaaaccaatatccggcaaattgagggcacaatgggagatgggcatcgtgcaggctgaggaagctgctagcatgagtgtggaggagcgaaaggcaaagttcaccttcctttacgtcggagatcagctccatctgaacccgcaggtggcaaaggaggcgggcattgccgcagagtcactcggcgaaatggctgagagtagtggcgtgtccgaagaggccgccgagaatccaaaatctgttagggaatag

SEQ ID NO: 140749 - DNA, 1890 bp, Artificial Sequence
  Description of Artificial Sequence: Synthetic coding sequence
atggaattttctattaagcagagccctttatcagtccagtcagttgtgaagtgcatcaaaatgaaacaggcacccgagatcttaggaagcgctaatggaaaaactccgtcatgcgaagtgaacagggagtgcagtgtgtttctgtctaaggcccagctttcttcatctctccaggagggggtgatgcaaaagttcaacggacatgacgccctgcccttcattcccgcagataagctgaaggatctcaccagccgcgtgttcaacggggagccgggggcacacgatgcgaaactgcgcttcgaatcacaggagatgaaaggcatcgggacccctccaaacacaacccctattaaaaacggctcaccggaaattaaactgaagattacgaagacatacatgaatggcaagccgctttttgagtcctctatctgcggcgattccgccgccgatgttagccaatccgaagagaatgggcagaaaccagagaataaagccaggcgtaacagaaaacgctcaataaagtacgactcactcctggagcaaggattggtcgaggccgcgcttgtgtctaagatctccagccctagcgacaagaagatccctgcgaagaaagagtcttgcccaaataccggacgcgacaaggaccaccttcttaaatacaatgtgggcgacttggtgtggtcgaaagtgtctgggtatccatggtggccctgcatggtctctgcggacccactgctgcacagctataccaaactgaagggtcagaagaaatctgccaggcaataccatgtgcagttctttggcgatgcccccgaaagagcgtggattttcgagaagtccctggtggcgtttgaaggcgaagggcaattcgagaagctgtgccaggagtccgcaaaacaggccccaactaaagctgaaaaaattaagctcttgaaaccaatctccgggaagctgagagcccagtgggaaatgggtatagtgcaggcggaggaagcagccagcatgagcgtggaggagaggaaggccaaatttacattcctgtacgttggcgaccagctgcatctgaacccacaagtagccaaggaagccggcatcgcggcagagagcctcggtgaaatggccgagtccagcggcgtcagtgaggaggctgccgagaatcccaagagtgtgcgagaagagtgcatcccaatgaagaggcggcgacgtgcaaaactttgttcttctgctgagactctggagtctcatcctgacatcgggaaatccacaccacagaaaacagccgaggcagatccccggcggggggtaggctcccctccaggtcgcaagaagactacagtgtcaatgccacgctcccggaagggagatgccgcctcgcaattcttggtgttctgtcaaaagcatagagacgaagtggtggcggaacaccccgatgcctctggtgaggaaattgaggagctcctgagaagccagtggtcccttttatcggagaaacagagggcgaggtacaacaccaaattcgccctcgtcgcccccgttcaggcagaggaggattctggtaatgtgaatggcaaaaagaggaatcacaccaaacgaattcaggacccaacggaagatgccgaagccgaagacacaccgcgcaaaagactccggaccgataagcattcactccgcaagcgggatacgatcaccgataaaacagcccgcacaagctcctataaagccatggaagccgcttcatctctgaagagtcaagccgctacgaaaaatctgtccgatgcctgcaaacctttaaagaagcgtaatagggcatccacagccgcctcaagcgcccttggattctccaaaagctcatctccaagcgccagtctgacggagaatgaagttaagtag

SEQ ID NO: 140750 - DNA, 600 bp, Artificial Sequence
  Description of Artificial Sequence: Synthetic coding sequence
atggaattctctattaagcagtctcccctgagcgtgcagagcgtcgtcaagtgcatcaaaatgaaacaagcaccagagattctgggcagcgcgaatgggaaaactccctcttgcgaagtgaaccgggaatgttccgtgttcctgtctaaggcacagctttctagctcactacaggagggggtgatgcagaagtttaatgggcacgacgccctgccattcatcccagccgataagctgaaggacctgacttctagagttttcaatggagagcccggcgcccacgatgctaaacttagatttgaatcacaagaaatgaagggcattggaacccctcccaatactactcccattaagaatggcagccccgaaataaagctcaagattaccaagacctatatgaatggaaagccgttgttcgagagctctatttgtggtgattccgccgccgacgtgagtcagtccgaagagaacgggcagaagccggaaaacaaggcccgcaggaaccgaaagagatctattaagtatgattccctgctggaacagggccttgtggaagcggctctagtttctaaaatttcctctccttccgataagaagtag

SEQ ID NO: 140751 - DNA, 1938 bp, Artificial Sequence
  Description of Artificial Sequence: Synthetic coding sequence
atggacttctcgttttccttcatgcaaggtattatgggtaataccattcagcagccgccccaactgatagatagcgcaaatatccggcaggaagacgcctttgataacaacagcgacatagctgaggacggaggtcagactccgtacgaggctaccctccagcagggttttcagtacccagccaccacggaggatctcccgccactcaccaacggctaccccagctcgatctctgtttatgagacccaaactaagtaccaaagctataaccagtatccaaatggaagtgctaacgggtttggagcagtgcgtaatttctccccaaccgactactaccacagcgagattcccaacacacgtcctcatgaaatactcgaaaagcccagtccccctcagcctcccccgccaccatctgtgcctcagaccgtaatcccgaaaaagaccggaagtcctgaaatcaaactaaagatcaccaagaccatccagaatggacgcgagttgtttgagagcagcctgtgcggagacctactgaatgaagtgcaggcctcagagcacaccaagagcaaacacgaatcgaggaaagaaaagaggaaaaagagcaataaacatgactcaagcaggagcgaagaaagaaaatctcacaaaatccctaaactagaaccagaagagcaaaatcgacccaatgagcgggtcgacaccgtgtccgaaaaaccgagggaggagccggtgttgaaagaagaggcccctgtgcagccaatcctgtcttcggtccccacgacggaagtgtcgaccggggtgaagtttcaggtcggagatttggtgtggagtaaggttggcacatatccctggtggccttgtatggtttccagtgatccacagctcgaggtgcatacaaaaatcaacacgagaggggcccgggagtaccacgtccagttttttagcaatcagcccgagagagcctgggtgcatgaaaaaagagttcgggaatacaaaggacacaaacagtacgaagagttgttggcggaggcgaccaaacaggcctctaaccattctgagaagcaaaaaatcagaaaaccccggcctcagcgagaaagggcacagtgggacatcggcatcgcgcacgccgaaaaagcgctgaaaatgacgagagaggagcgaattgagcagtacaccttcatttacatagataagcagcctgaggaggctttgagtcaagctaaaaagtcagtggcgtccaagacagaagtcaaaaaaacacgccgcccccgcagcgtgctgaatacacagccagagcagaccaacgcgggcgaggtggcttcatccctgtctagcaccgagatcagacgccacagtcagaggcgccatacaagtgcagaagaggaggaaccgcctcccgttaaaatcgcatggaagacggctgcagcacggaagagcttgcccgcgagtattacaatgcacaagggcagcctcgacttgcagaagtgcaacatgtctccagtggtcaagattgaacaggtgtttgcgctgcagaacgcaaccggagacggcaagtttattgaccagtttgtttactcaaccaaaggaattgggaacaaaactgaaatctcagtgcggggacaggaccggctgataattagcaccccaaatcagaggaacgagaaacccacacagagtgtgagttcacccgaggctacctctggctctaccggatctgtggaaaaaaaacagcagcgccgtagtattcggacccggagcgagagtgagaaaagtacagaggtggtcccaaaaaaaaagattaagaaagaacaggttgaaactgtgccccaggccaccgtgaaaaccggtttgcagaaaggaagcgccgaccgaggcgtgcagggaagcgtgcgcttttccgacagttccgtcagcgctgcaatcgaagagactgtggactag

SEQ ID NO: 140752 - DNA, 4314 bp, Artificial Sequence
  Description of Artificial Sequence: Synthetic coding sequence
atggacttcagcttctccttcatgcaaggtattatgggcaacactatccagcagccacctcagctcattgattctgctaacattcgccaagaggatgcctttgataacaattcggacatcgcagaggatggcggtcagacaccctacgaggctacacttcagcagggatttcagtaccccgccaccaccgaagacttacctcctttgaccaatggttacccttcctccatttccgtttacgaaacgcaaactaagtatcagagttacaatcagtaccctaatggcagtgccaacgggtttggtgccgtgcgtaacttttcccctaccgactattaccacagcgaaatacccaatacacgccctcacgagatcctggaaaaaccttcacccccccaacctccaccccccccgtcagtcccccagaccgtcatccctaaaaaaaccggcagccctgaaataaaattaaaaattacaaaaaccatccagaatggcagggagttgttcgagtcatctctgtgtggtgaccttctgaacgaagtgcaggcctcagagcacaccaaatctaagcacgagagcagaaaggaaaaacggaaaaagtcgaacaagcatgatagcagtagatccgaggagcgcaagagccataaaattccaaagcttgagcccgaggaacaaaataggccaaatgagagggtggacacagtttcagaaaagcctagagaggaacccgtcttaaaagaggaggcaccagttcagcccatcctgagctccgttcccacgactgaagtctccacaggggtcaaatttcaggtgggagatcttgtgtggagtaaagtgggcacctacccttggtggccttgcatggtctcctccgacccgcagctggaggtccatacaaaaataaatactaggggcgctcgagaatatcatgtccagtttttttcaaatcagccagaaagagcttgggtgcacgagaaaagagtaagggaatacaaaggccataagcagtacgaggagttactcgccgaagccaccaagcaggccagcaaccacagcgagaaacagaaaatacggaagccgcggccccagcgcgaacgcgcccagtgggatataggaatcgcccatgccgaaaaggcccttaaaatgacgagagaggagagaatcgaacagtacacattcatctacatcgacaaacagccagaagaagcattgagccaggccaagaagtccgtggccagtaagacggaggtaaagaagactaggcgtccccgttcagtgctcaacacccagccggagcagactaacgctggtgaagtcgcctcctcccttagcagcacagagattagacgccatagccaacggcgtcatacaagtgcagaagaggaggagccacctcctgtgaaaattgcctggaagacagcagccgccaggaaatctctgcccgccagtatcaccatgcataaaggaagcctggatctccagaagtgtaacatgagtccagttgttaaaatagagcaggtcttcgctctccaaaacgccaccggggatggtaaatttattgatcaattcgtgtattctaccaaaggcatagggaataaaacagagatttccgtccggggacaggaccgcctcattatcagcaccccaaatcagagaaacgaaaagccaacccaaagtgtgtcttccccagaagccacatcaggcagtactgggagcgtcgagaagaaacagcagcggcggtcaatcagaacgcgctcagagagtgagaagagcaccgaagtggtgcccaagaaaaaaataaagaaagagcaagtagagaccgtgccccaagcaaccgtaaagacaggactgcaaaaaggcgccagcgaaatcagtgattcttgcaagcctctaaagaagagatccagggcctcaacggatgttgaaatgacatcttctgcttatcgggacacaagcgatagtgactctagaggcttgagtgacttgcaggtggggtttggtaaacaggttgacagcccaagcgcaacagccgacgccgacgtttctgatgtgcagagcatggattcgtctttgagtcgcaggggcactggcatgagtaaaaaagacactgtgtgtcagatctgtgaatcttccggcgattcgctgatcccttgcgagggcgagtgttgtaaacattttcacttggaatgtctgggcctggctagtctacctgattcaaaatttatttgcatggagtgtaaaaccggacagcacccgtgtttctcatgtaaggtgtccgggaaggatgtcaaaaggtgtagcgtaggagcctgcggcaagttttatcatgaagcctgtgtgaggaagttcccgacagccatcttcgagagcaaggggtttcgctgtccgcagcattgttgctcggcctgctcgatggagaaggatattcacaaggcatccaagggaaggatgatgcggtgcctgaggtgtcctgttgcctatcattctggcgacgcgtgcatcgccgctggttccatgctcgtgtctagttatatcttaatctgctctaaccattcaaagcgcagttcaaattcctctgcggttaatgtggggttctgctttgtttgcgcccggggactcatcgtgcaagaccactcagacccaatgttttcaagctacgcttataagtcacactacctcctaaacgagagcaatagggctgagttgatgaagctgcccatgatcccatccagttctgcctctaagaagaagtgtgaaaaaggaggtaggcttctgtgttgtgaatcttgccccgcatccttccaccccgaatgcctgtcaatcgagatgcccgaagggtgctggaactgcaacgattgcaaagctggaaaaaaattacactataaacaaattgtgtgggtcaaactgggcaactaccggtggtggcctgctgaaatctgtaaccccaggagtgtgcctttaaacatccagggcttgaagcatgatctaggcgactttccggtgtttttctttggctcccacgactattattgggtgcaccagggacgcgtcttcccgtatgtggaaggcgataaaagttttgctgaaggacagacatcaattaataagacatttaaaaaggctctcgaggaggctgctaaacggttccaagaattgaaagcacagagggaatctaaagaagcacttgaaatagagaagaactcccgaaagccgcctccttacaaacatatcaaagctaacaaggtgatcggtaaggtgcagatccaagtcgcagacctgtccgagatacctagatgtaattgcaagcccgccgatgagaacccctgtggcctagagagcgaatgcctgaaccgaatgctgcagtacgagtgccaccctcaagtctgccctgccggggatcggtgtcaaaatcagtgcttcactaaaagactgtatcccgacgccgaaatcatcaaaaccgaacgaagaggttgggggcttcgcacaaaaaggagtattaaaaagggcgagttcgtgaatgaatacgttggtgagctgattgatgaggaagagtgtcgactgcggattaaacgggcccacgaaaactccgtgacaaatttctatatgttaacagtaacaaaggacaggattatagatgcgggcccaaaagggaattactcgaggtttatgaaccacagttgcaacccaaactgcgaaacccagaagtggactgttaacggagacgtgcgcgtaggtttattcgccctttgcgatatccccgccggcatggagttgacattcaactacaacctcgattgtctgggaaatgggcgtacagagtgtcattgtggggcagacaactgttcgggtttcctcggagtgcggcctaagagtgcctgcgccagcaccaatgaagaaaaagctaaaaatgctaaactgaagcagaagcgcagaaaaataaaaactgagccgaagcagatgcacgaagattactgtttccagtgtggcgacggaggcgaactggtgatgtgtgataaaaaagattgtcctaaggcttaccatctcctgtgtttaaatttgacccagccaccctacggaaagtgggaatgcccctggcatcagtgtgacgaatgctcctccgcggccgtgagcttttgtgaattttgtccccacagcttctgcaaggatcatgaaaagggagcattggttccctcagctcttgaggggcgtctctgctgttcagaacacgaccctatggcaccagtgagtcctgagtattggtctaagatcaagtgtaaatgggagtcgcaggaccacggtgaagaggtgaaagaatag

SEQ ID NO: 140753 - DNA, 4167 bp, Artificial Sequence
  Description of Artificial Sequence: Synthetic coding sequence
atggacttctccttttcttttatgcaaggcatcatgggaaacactatccagcagccaccacagttaatcgattcagctaatatcagacaggaggatgcctttgacaacaactctgatatcgcagaagacggaggccagacaccctacgaggccaccctgcagcagggatttcagtatccagcaacaacagaagacctgcctcctctgacaaacggctacccgagctctatctcggtctacgagacccagactaaatatcaaagttataaccagtatccgaacggatctgccaacggatttggagccgtgcggaatttttcccctactgactattatcacagtgaaattccaaataccagaccccatgaaatcctggagaagccctcgcccccacaaccgccaccacccccttccgtgccacagactgtgatccctaaaaagactggaagtcccgagataaagctgaagatcacgaagacaattcagaatggacgcgaactgtttgaatccagtctgtgcggcgatcttctgaatgaggtgcaggcctctgagcacactaaaagcaaacatgagagcagaaaggagaagagaaaaaagagcaacaaacatgacagctctcggtccgaggaacgaaaatctcacaaaattcccaagctcgaaccagaagaacagaaccgcccaaatgagagagttgatacggtgagcgagaagcctagggaggagccggtgttgaaggaggaggctccagtgcagccaatcttaagttctgtgcccaccacggaagtaagcacaggcgttaaatttcaggtgggcgaccttgtgtggagcaaagtcgggacatacccctggtggccttgcatggtgtcttccgaccctcagttagaggtgcatactaagatcaatactcgaggcgcaagagagtaccatgtgcaatttttttcaaatcaaccggagcgagcctgggtccacgagaaacgggtgcgggaatataaaggacacaagcagtatgaagaactcctggcagaagcgacaaaacaggcgtctaaccattctgagaaacagaagattcggaagccaaggccacaacgcgaacgcgctcagtgggatataggcattgctcatgcagaaaaagccttgaagatgactagggaggagcgaatagaacagtatactttcatctacatcgataagcaaccggaggaggccttgtcccaagccaagaagtcagtagcatctaagaccgaagttaaaaaaacccgacggcctcgatccgtgctaaacactcaacccgagcaaactaatgctggcgaggtggcatctagtctctctagcacagaaattaggcgacacagccagcgaagacatacttctgccgaagaagaggagccaccacccgtgaaaatcgcgtggaagactgcagccgccaggaaaagcctgccagcttctatcaccatgcacaaaggctcactggacttacagaagtgtaacatgtctcctgtggttaagatcgagcaggtctttgctctccagaacgccacaggcgatggtaagtttatcgatcaattcgtgtatagcaccaaaggaattggtaacaaaaccgagatttcagtacgaggccaggaccggcttataatttccacccctaaccagagaaacgagaagccaactcagtctgtgtccagtccggaggcaacatccgggtctacaggcagtgtcgagaaaaagcagcagagaaggagcattcgcacgcgtagcgaaagtgaaaagtctactgaggttgtgcccaagaaaaaaatcaaaaaggagcaggtcgaaaccgtcccccaagctactgtgaaaaccgggcttcaaaaaggagcctcagaaatatctgattcctgtaaacccctgaagaaaaggagccgagcctccaccgacgtggagatgacttcttctgcttaccgggacacatcggacagcgactctcgaggactgtctgacttacaggtcgggtttgggaagcaagtggattccccttcagctaccgctgatgcggacgtgagcgacgtgcaatccatggatagtagtctttcacggcgaggcaccggaatgtctaaaaaagacaccgtttgccaaatatgcgagtcttctggggattccctgatcccgtgcgaaggggagtgctgcaagcactttcacctagagtgtcttggactggctagtctcccggattccaaattcatatgtatggaatgtaagactggacagcacccatgctttagttgcaaggtctctggcaaggacgtcaagaggtgcagcgtgggcgcctgcggcaagttttatcatgaggcgtgcgtgcggaaattccccaccgccatcttcgagagcaagggatttcgatgccctcagcattgctgctccgcatgttccatggaaaaagacatccacaaggccagtaagggacggatgatgcggtgtcttaggtgccccgtagcctatcactctggagatgcatgcatcgcggccgggagcatgctggtgtcgtcttatattttaatttgcagtaaccattccaagcgctcaagcaatagctccgcggtaaacgtcgggttctgtttcgtctgcgcaagaggcggcaggttgctgtgctgcgaatcctgcccggccagttttcacccagagtgcttgagcattgagatgcctgagggctgttggaactgtaacgattgtaaggccggcaaaaagctgcactacaaacaaattgtgtgggttaaattagggaattataggtggtggcccgctgaaatctgcaacccacggtctgtgccactcaacatccaaggcctcaaacacgatctgggagacttccctgtgtttttctttggctctcacgactattactgggtgcatcagggacgcgttttcccgtacgtggaaggggataagtcctttgccgaaggacagactagcatcaacaagactttcaaaaaggctctggaggaggccgccaagcgcttccaagagttaaaggcccaaagagaaagcaaggaggccctggagattgaaaagaattcacgcaaaccgcctccgtataagcacattaaggctaataaagtgatcggaaaagttcagatccaggtggccgatttgtctgagatcccccggtgcaattgcaaaccagccgacgagaatccctgtggtctggagagcgagtgtttaaatagaatgctccagtatgagtgtcaccctcaagtctgccccgccggcgataggtgtcagaaccagtgcttcactaagaggttgtatcctgatgccgagattattaaaaccgaaagaagaggatggggcctgaggactaagcgatctatcaaaaaaggagaattcgtcaatgaatatgtgggagaattgattgatgaggaagagtgcagattgcgaataaagcgcgcccacgagaattctgttaccaacttctatatgctcaccgtcacaaaggatcgcatcatcgatgcaggccccaagggaaattactcgcgcttcatgaaccactcatgtaatcctaattgcgaaacgcagaaatggactgttaacggcgacgtgcgcgtgggtctattcgctctttgcgatatcccagctgggatggaactgacattcaactataatctggactgtctaggcaatggcagaactgaatgccattgtggtgcagataactgcagcgggttcctgggcgtgcggcctaagtcagcatgcgcaagcaccaacgaggaaaaagctaaaaacgccaaattgaagcagaaacgccggaagatcaaaacagagcctaagcagatgcatgaagattactgttttcaatgcggcgacggcggggagctcgtgatgtgcgataaaaaggattgccccaaagcgtatcacctgctttgtttaaatctcacccaacctccatacgggaagtgggaatgcccttggcaccaatgtgacgagtgctccagtgcggctgtaagcttctgcgaattctgcccccattcgttttgtaaagaccacgagaagggtgcgctagtgccttccgcactggagggtagactgtgttgtagtgagcacgacccaatggctcccgtctctcccgaatactggtcgaagattaagtgcaagtgggagtcccaggaccacggggaggaggtgaaggagtag

SEQ ID NO: 140754 - DNA, 4125 bp, Artificial Sequence
  Description of Artificial Sequence: Synthetic coding sequence
atggatttctcatttagcttcatgcaggggattatggggaatactatccagcagcccccacaactcattgactcagcaaacattcgacaggaggacgctttcgataacaactccgatatcgccgaagatgggggccagaccccatacgaggcaaccctccagcaaggatttcaataccccgccactacagaggacctcccccctcttcctcctccaccgccttccgtgcctcagacagtgatccccaagaaaaccgggtcgccggagataaagctcaagatcacaaaaaccatccagaatggaagggagttgttcgagagctcactttgcggggatctcttgaacgaggtccaagcatcggagcatacaaagtccaaacatgagtctaggaaggaaaagagaaagaagtctaataaacatgacagctctaggtccgaagaacgtaagtcacacaaaatcccaaagctggagcctgaagagcagaataggcccaatgagagagtggataccgtgtccgagaagcctagagaggagccagttctcaaagaagaagcacccgttcagcctatccttagcagcgttccaaccaccgaagtgtcaactggtgttaaattccaggtgggcgacctcgtctggtcaaaagtgggcacgtatccctggtggccctgcatggtgtccagtgatccacagctggaggtacacacgaagattaacactagaggagcgcgagagtaccacgtgcagttcttctctaaccagccagaacgcgcgtgggttcatgaaaaaagagtgagagagtacaagggccataaacagtacgaggagctgctcgccgaagcaaccaaacaagcttctaaccactctgagaagcagaaaattcgtaaacctcggcctcagcgcgaacgtgcccaatgggatattggcatcgcccatgctgagaaagccttaaagatgacccgggaagaacgtattgagcaatatacatttatttatattgataagcagccagaagaagccctgtcccaggccaagaaaagcgtcgccagtaaaaccgaggtgaaaaaaacacgcagaccacgctcagttctgaacactcagcccgagcagaccaatgcgggggaggtggcatcatccctcagtagcaccgagatccgtcgacacagccagcgtcggcatacctccgctgaagaagaggaaccgcctccggttaagatagcatggaaaactgctgcagcgcgaaagtctctgccggcctcaattactatgcacaagggatcgctggacctgcaaaaatgcaacatgtcaccagttgtgaaaatcgaacaagtgttcgctttgcagaatgcaactggtgacggcaaatttattgaccagttcgtgtattcgaccaaggggatcggaaataagacggaaatcagcgtgcggggccaggaccggcttattatcagcacccctaatcagagaaatgaaaagcccacgcagtcagtgagtagcccagaggcgacaagtggctcaactggatctgtagaaaaaaagcaacagaggaggtccattaggacaaggagcgagtcagaaaagtctaccgaagttgtgcctaaaaaaaaaatcaaaaaggagcaggtggaaacagtcccccaggccaccgttaagacagggctccagaagggcgccagcgagatctctgatagctgcaagcccctgaaaaagcgctccagggccagcaccgatgtcgagatgacttcttcagcgtatcgggatacatctgatagcgacagcaggggactgtcggatcttcaagtgggcttcggtaagcaagtcgacagcccgtcagcgactgctgacgccgacgtttcggacgtccagtctatggacagcagcctatcaaggcgggggaccggaatgtccaagaaagatacagtctgccagatctgcgagtcttccggcgatagcctcatcccttgtgagggcgagtgctgtaagcattttcacttggagtgcctcggcctggcatctctgcctgatagtaagtttatttgcatggagtgcaaaacagggcagcatccatgtttcagctgtaaggtgtcaggcaaagacgtaaagagatgcagcgtaggcgcatgcggaaaattctatcacgaagcctgcgtacggaaattcccgaccgctattttcgaatctaagggctttagatgccctcagcactgttgctccgcatgcagcatggaaaaagatatccataaagcatctaagggaaggatgatgcggtgtctgcgttgccccgtcgcctaccacagcggcgatgcctgtatagctgcaggcagcatgctcgtatcaagttacatcctgatttgctctaaccatagcaagcggtcgagtaatagttcagccgtcaatgtggggttttgctttgtatgcgctagaggcctcattgtgcaggaccacagcgatccgatgttcagtagttatgcatataaaagtcattaccttctcaacgagtccaacagggcagaactgatgaagcttcccatgatccccagcagttcggcctccaaaaagaaatgtgaaaagggcggccgcctgttatgctgtgagtcctgcccagcaagtttccatccggagtgcctttcaattgaaatgcccgaagggtgttggaactgcaacgattgcaaagcaggcaaaaaattgcattataaacaaatcgtgtgggtgaaactcgggaattaccgttggtggccagctgagatctgtaaccctaggtccgtaccccttaacattcagggcctgaagcacgatctgggtgacttcccagtttttttttttggtagtcatgactattattgggttcaccaagggagggtgtttccatatgtagagggtgataaatctttcgcagagggacaaacctctatcaataaaacgtttaaaaaggcacttgaggaagctgctaaacggtttcaagagctgaaagctcagagggagtccaaagaggccctggaaattgagaagaacagcaggaagccaccgccctataagcacataaaggcaaacaaggtgatcggaaaagtgcagatccaggtcgccgatctatctgagattcccagatgtaactgtaaacctgccgatgagaatccatgcggcctggaatccgaatgcctgaatcggatgctccagtatgagtgccacccccaggtctgtcctgcgggcgatagatgtcaaaatcagtgtttcactaagagactatatcccgacgctgaaataatcaaaactgaaagacgggggtggggcctgcgaaccaaacggtctatcaagaagggagagttcgtgaatgagtacgtgggggaactcatagacgaggaggagtgcagactgagaatcaagagagcccacgagaactccgttaccaatttttacatgcttacagtaaccaaagaccgtatcatcgatgcagggccaaagggaaattacagccgatttatgaatcacagttgcaacccaaactgcgagacacagaagtggaccgtcaacggggatgtcagggtgggacttttcgctctttgcgatattccagcaggcatggagctgacctttaactataacctggactgcctggggaacggcagaacggaatgccattgcggcgcggacaattgctctggattcctgggtgtgcggccaaaaagcgcatgtgcctccacaaatgaggagaaagcaaaaaatgccaagctcaaacagaaacggcgaaagattaagacagagccaaaacaaatgcatgaggactactgcttccagtgtggcgacggaggggagcttgttatgtgcgataaaaaggactgcccaaaggcctatcatttgctctgcctaaacctgacccagcctccatacgggaaatgggaatgtccctggcatcagtgcgacgagtgctcttcagctgcagtctccttctgtgagttttgtccccattccttctgtaaagatcacgaaaagggcgcccttgtcccttccgcgctggaaggtcggttgtgctgttcagaacacgaccccatggctccggtgagtccagagtactggtctaagattaaatgcaaatgggaaagccaggatcacggcgaggaagtgaaggagtag

SEQ ID NO: 140755 - DNA, 4281 bp, Artificial Sequence
  Description of Artificial Sequence: Synthetic coding sequence
atggatttctcattttcattcatgcagggaatcatgggaaatacaatccagcaaccaccacagctgatagattctgcaaacattcggcaggaggacgccttcgacaataattccgacattgccgaggatggagggcagacgccttatgaggcaacactgcagcagggattccagtacccggcaacaacggaggatcttccacccttgaccaacggatacccgtcctccatatcggtgtacgagacccagacgaagtaccaatcttacaaccagtaccccaatggttctgctaatgggtttggagctgttcggaacttcagccctactgactattaccacagtgagatccccaacaccaggccccacgagatcctggaaaaaccatctcccccccaacctccgccccctccttccgtgccccaaactgttattccaaagaaaacggggtcacctgagattaaattgaagattacgaagaccattcagaacggacgggagttattcgagtcttctctgtgtggtgatttactgaatgaagtgcaggcctctgaacacactaagtccaagcacgagtctcggaaagaaaagagaaagaagtccaataagcacgactccagtaggtccgaggagagaaaatcacataaaattcccaagctggagccagaggaacaaaatcgccccaatgaaagagtagacacagtgagcgagaagccccgagaagagcctgtgctgaaagaggaggcccccgtgcagccgatcctcagttcagtgcccacgacagaggtgtccaccggggtgaagtttcaggtcggtgatctggtctggagtaaggtggggacttacccctggtggccatgtatggtatcttccgacccgcagctcgaggtgcataccaaaatcaatacccgcggggcacgggaatatcacgtccagtttttcagcaaccagcccgagcgcgcgtgggtgcacgagaagagggtgagagagtacaagggtcacaagcagtatgaagagcttctagccgaggccacaaagcaggcaagtaatcacagcgagaagcagaaaattcgaaagccccgaccccagagggagcgcgcccagtgggatatcgggatcgcccatgctgagaaggccctgaagatgactagagaagaacgtatcgaacagtacacattcatttacatcgataagcagcctgaggaggcattgtcccaggccaagaaatcggttgcctctaaaaccgaagtgaagaagacaagacgtcctcgcagtgtcctcaacactcagcctgaacagactaacgctggcgaggtggcctcttccctttcttccactgaaatcaggagacattcccaacggcgccatacttccgctgaggaggaggagcctcctcccgttaaaatcgcgtggaagactgcagccgccaggaagtcactgccagctagcattacaatgcataaagggtccctcgatttgcaaaagtgcaatatgagcccagtcgtgaaaatcgaacaggtctttgccctgcagaatgctaccggcgacggaaaattcatcgatcagtttgtgtactccacaaaaggcattggcaacaagacagagatttcagtgcgcggacaggaccggcttatcatatccactcccaatcaacggaacgaaaaacctactcagtccgtgtctagcccagaggccacctccggaagcacaggctccgtggaaaaaaaacagcagcggcgatccattaggactcgctcagaatccgaaaaatctactgaggtggtgccgaagaagaagatcaagaaggagcaggtagaaactgtgcctcaggccacagtaaaaacgggattacagaagggtgcctccgagatctctgactcttgcaagcccctcaaaaaaaggtctcgagctagcaccgacgtggaaatgacatcgagcgcctatagggacacgagcgatagcgactctaggggcttatccgatctccaggtgggattcggcaaacaggtggattccccgagtgccaccgccgatgcagatgtatcagatgtgcaatctatggactcctctctgagcagaaggggtacgggaatgagcaagaaagacaccgtgtgtcagatttgtgagtcatcaggagattctctgataccgtgcgagggcgaatgctgcaaacattttcatttggaatgtcttggactggctagcttacctgactctaagttcatatgtatggagtgcaaaacgggccaacatccctgtttttcctgcaaggtaagcgggaaggacgtgaagagatgctccgtgggcgcttgtggcaaattctaccatgaagcgtgtgtgaggaagtttcccacagcaatctttgagagcaaaggttttcggtgcccacagcactgctgcagtgcttgctccatggaaaaggacatccacaaggcctccaaaggtaggatgatgcggtgcctgcgctgccctgtggcttaccactccggcgatgcctgcattgcagccggatcaatgttggtatcatcttacatcctgatttgttcaaatcattcaaagaggtcatcaaattcatcagctgtgaatgtaggattctgctttgtgtgcgccaggggattgatcgttcaggatcactcagatcccatgttttcatcttatgcatacaaatcccactaccttctcaacgagtcaaaccgagccgagcttatgaagttgcccatgataccaagttccagcgcctccaagaaaaagtgtgaaaaaggaggtcgcttgctctgttgcgagtcgtgtcccgcctctttccaccctgaatgtctgagtatcgagatgcctgagggatgctggaattgcaacgactgcaaggctggaaagaaactccattacaaacagatagtttgggtgaagctgggtaactaccggtggtggcctgcagagatttgtaacccacggtccgtccctctgaatatacagggactcaagcacgacctcggcgacttccctgtgtttttcttcgggtctcatgactactattgggtccaccagggccgtgtgttcccctacgtagagggcgacaagtcctttgctgaaggacagacatcaataaacaagacttttaaaaaggcattggaagaagcagctaaaaggttccaggaactgaaggcccagagagaaagcaaggaggcactggaaattgagaagaattcacgcaaaccaccgccttacaaacacataaaagcgaacaaggtcatcgggaaggtccagatacaagttgcagatctctccgagatccctaggtgtaattgcaaaccggccgatgaaaatccttgcgggctcgaaagtgagtgtctgaacagaatgctgcaatatgagtgccacccacaggtgtgtccagcaggtgatcgatgccagaaccagtgtttcacaaagcggctttatcctgacgccgagataattaagaccgagcgccgagggtggggcctgaggacaaagcggagcattaaaaaaggcgagttcgtcaacgaatatgtaggagagctcattgacgaggaagagtgccgcctacgtattaagcgggcccacgagaattccgaccgaatcattgatgcgggcccaaaggggaattactctcgcttcatgaaccactcgtgcaaccccaactgcgagactcaaaagtggactgtgaacggggatgtacgcgtgggtctctttgcactgtgcgatatccctgccgggatggagctcacgtttaactataatctggactgtctagggaacggtcgaacagaatgccattgcggcgccgataattgctccgggtttttaggagtcagacccaagagcgcctgcgcctccaccaacgaggagaaagccaagaacgcaaaactcaaacagaagaggagaaagataaagacagaacccaaacagatgcacgaggattattgctttcagtgtggagacggcggcgagttggtgatgtgcgacaaaaaggactgcccaaaagcctatcacctcctgtgcctgaacctgacgcagcccccctacggcaaatgggaatgcccatggcatcaatgcgatgaatgttcaagcgctgcagtctcgttctgcgaattttgtccgcatagtttctgtaaggatcacgaaaaaggagcgcttgttccttctgccctggaaggccggttgtgctgctcggagcatgacccgatggcccctgtcagcccagaatactggagcaagattaaatgcaagtgggaaagtcaggatcatggggaggaggtgaaagaatag

SEQ ID NO: 140756 - DNA, 849 bp, Artificial Sequence
  Description of Artificial Sequence: Synthetic coding sequence
atggacttttccttctcttttatgcagggaatcatggggaatacaatccaacagcccccacagctgattgacagtgctaacatccgccaggaagacgcttttgataacaactctgacattgccgaggacggcggccaaactccgtatgaggctacacttcaacagggtttccagtatcccgccaccacggaagatttgccaccccttaccaatggctatccgagctctatatcagtctacgagactcagactaaatatcagagctacaatcagtatccgaatggatccgctaatggctttggggctgttcgcaatttctcgccaaccgattattatcattcagaaattccaaatactcggcctcatgagatcctggaaaagccctctcccccccaacccccgccccccccgtccgtcccccagacagtgatccccaagaagacgggaagtccagagatcaagctgaagatcacaaaaactatccagaatggacgcgaactgtttgaatcgtcactgtgcggcgatctgttaaatgaggtacaggcttccgaacataccaagtcaaagcatgaaagccgcaaagagaagaggaagaagtcaaataaacatgacagctccagaagtgaggaacgaaaatctcacaaaattcctaagctggagcctgaggagcagaaccgcccaaatgagagggttgacaccgtttccgagaagcctagggaggagcccgtgctcaaagaagaggcccctgtgcagccaattttgtcctccgtgcctactactgaggtgtcgacgggggtcaagtttcaagtgggtgatctagtgtggtccaaggtcgggacgtacccctag

SEQ ID NO: 140757 - DNA, 78 bp, Artificial Sequence
  Description of Artificial Sequence: Synthetic coding sequence
atggatttctcattctcttttatgcagggaataatggggaataccatacagcaaccaccccaacttattgactcttag

SEQ ID NO: 140758 - DNA, 48 bp, Artificial Sequence
  Description of Artificial Sequence: Synthetic coding sequence
atggatttttctttctcgtttatgcagggaattatgggcaacacctag

SEQ ID NO: 140759 - DNA, 1620 bp, Artificial Sequence
  Description of Artificial Sequence: Synthetic coding sequence
atgcctggccagcgccgcgccctgagccccaaaatggccagcatgagggaaagcgatacaggactgtggttacacaataaactaggagcaaccgatgagctttgggcgcctccttctattgcttctctccttacggcagcggtgattgataacataaggctgtgcttccatgggctttcctcggcggtgaagctcaagctgctgctggggacacttcatctgccgagaagaactgtcgacgagatgaagggtgcattgatggagatcatacaactggcatcattagattccgatccttgggtgctgatggtggccgacatcctgaagagctttcctgacaccggctcccttaacctggagctggaagaacagaacccaaacgtgcaggatatcctaggggagctgagagagaaagtgggcgagtgcgaggcctcagccatgttgccactggaatgccagtacctcaataagaatgccctcactaccctggccggtccactaaccccccctgtgaaacatttccagcttaagaggaaacctaagagcgcaactctacgggccgagctcctgcagaagtcaactgaaaccgcccagcaattgaaacggtcagcaggtgtgccattccacgctaagggccgcggactccttcgaaagatggacactaccaccccacttaagggaatccctaaacaggctcctttccgtagccctactgcgccatcagtctttagtccaaccggcaatcgcaccccgataccaccttcgaggaccctgctgcgtaaggagaggggggtaaagctgctggatatttcagaattggacatggtaggggcggggcgcgaggcaaagaggcgccgaaagaccttagatgcagaagtggttgagaagcccgctaaagaagaaaccgtagtggaaaatgcaacacccgactacgccgcagggctcgtcagcacccagaaattgggtagtctgaacaatgaaccagcccttccctcaacgagctatctacctagtactccgtcagtggtgcccgcttcttcctacattccttctagcgagacacccccagctccatcctcccgcgaagcgagtagacctccagaagaacccagcgcgccctcgccaacactacctgctcagtttaagcagcgggcaccgatgtacaattcgggactgtctcccgccacgccgacccctgctgcccctaccagtcccctgacccctaccaccccccctgctgtggcccccacgacccaaaccccacccgtggccatggtcgctccacagacccaagccccggctcagcagcagcccaaaaagaacttgtccctaactcgcgaacagatgttcgcagcccaggaaatgttcaaaacggccaacaaagtcaccaggccggagaaggcgctgattctgggcttcatggctgggtctagagagaacccatgtcaggagcaaggggacgtcattcagatcaagttgtcagagcacaccgaagatttgccaaaagcggacggacagggttctaccacaatgctggtggacacagtgtttgagatgaactacgcgactggacagtggactcgtttcaaaaaatataaacccatgacaaatgtcagctag

SEQ ID NO: 140760 - DNA, 1587 bp, Artificial Sequence
  Description of Artificial Sequence: Synthetic coding sequence
atggcctctatgcgggagtcagacactgggttgtggttgcacaataagcttggtgcaactgacgagctgtgggcaccgccctctattgctagcctgctgacagctgcggtaatcgataacattaggctgtgttttcacggcttgagttccgccgtgaaactgaagctgcttctcggtactttgcaccttcctcgaaggaccgtagatgagatgaagggagccctaatggaaattattcagctcgctagcctggatagcgacccctgggtccttatggtggccgatattctcaaaagcttccccgacacaggttccctcaatctggagcttgaagaacagaatccaaatgtgcaagatattctgggagagctgcgcgaaaaggtgggcgaatgtgaagcctcagctatgctgccacttgagtgccagtacctaaataagaacgccttaaccactttagccggcccccttaccccaccggttaagcatttccagttgaagcggaagcctaagtcagctacactgcgtgccgaattgctccagaagtcaaccgaaactgcacagcagttgaagcgctctgccggagtgccttttcatgccaaaggccggggattgctgcggaagatggacaccaccaccccccttaaagggatcccaaaacaagctccattccggtcccccaccgcgccaagcgtgttttcacctactggtaaccgcaccccaattcctccatctagaacattgcttaggaaggaacgtggcgtgaaactgctggatatttcagagcttgacatggttggtgcagggagagaagcaaagagaaggcgtaagaccctcgacgcagaggttgttgagaaaccagcgaaagaagagacagtagtggagaacgccactccagactacgccgctggacttgtatctacccagaagcttgggagcttgaataacgaacctgctctcccctcaacctcatacctcccatcgaccccaagtgtggtgccagcttcttcttatattccgagttctgagacaccgcccgcaccatcatcgagggaagcatcccgtccccctgaagagccgtccgcaccatcaccaaccttgcctgcccagtttaagcagagggcaccaatgtataactcaggactcagtcctgccacccctactcccgcagctcccactagccctctcacaccaaccactccacccgctgttgcccccactacccagacacctccagtggccatggtggctcctcagactcaggcgcccgctcagcagcagccgaagaaaaacctatcactcacccgcgaacagatgttcgcggcacaggagatgttcaagactgccaacaaagtcacccgaccggagaaagccttgatcctgggctttatggccgggtcccgggagaacccttgtcaggagcagggggatgtcatccagatcaaactgtctgaacacaccgaggacctaccaaaggccgatggacaaggaagtacaactatgctggtggacactgttttcgagatgaattacgccaccggccagtggacccgatttaagaaatacaagccaatgacaaacgtgtcgtag

SEQ ID NO: 140761 - DNA, 1182 bp, Artificial Sequence
  Description of Artificial Sequence: Synthetic coding sequence
atgcttccattggaatgtcagtaccttaataagaacgctctgaccacgctcgcaggtccgctcactccaccagtaaagcatttccagttaaagcgcaagcccaagagcgccacactgcgagccgagctactgcagaaaagcacagagactgcacaacagctgaagagatccgctggcgttcctttccatgccaaggggcgcggtctgctgcggaagatggacaccaccacacctctcaagggtatccccaagcaggcgccattcaggagcccaacggcccccagcgtctttagtcccacgggcaacagaacccccataccaccttcaagaactctgcttaggaaggagcgaggcgtcaagctgctggacatctcggagctggacatggtcggggccggtagagaagccaagagacgtcggaaaacattggacgcagaggtcgttgagaagcctgctaaggaagagaccgttgttgagaacgccacaccagattatgcagccggattggtatctacccaaaagttaggttcattgaataatgagcccgcactgcctagcacctcctaccttcccagtactccatcggtggtgccagcgagttcatacattcccagctcagaaaccccgcctgcaccttctagccgcgaagcgagtcggcccccggaggagccctcagcacctagccctaccctgcccgcacagtttaaacagcgagcgccaatgtacaactccggactctccccggccaccccaaccccagcagccccaactagcccactgactccgactacaccgcccgcagtggcccccactacgcagaccccgcctgtagccatggtggcgccccagacccaagcgcctgcccagcagcaacccaaaaaaaacctgtctctcacgagggaacagatgtttgctgcacaggagatgttcaagaccgccaataaagtcactcgcccagaaaaggccttaatcctcggctttatggccgggtcaagggagaatccatgccaagagcagggtgatgtgattcagatcaaattgagtgaacacaccgaggacctgcccaaggccgatggccagggcagcacgactatgcttgttgatactgtctttgaaatgaattatgctactgggcagtggacccggttcaagaagtacaagccaatgaccaatgttagctag

SEQ ID NO: 140762 - DNA, 462 bp, Artificial Sequence
  Description of Artificial Sequence: Synthetic coding sequence
atgtatcggatgcagctgctttcatgcatcgctctgtcattggccctggtgaccaacagcgcccccacctcctcatcgacaaaaaaaacccagctgcagcttgagcatcttctcttagatctccagatgattttgaacggtattaataattacaagaatcctaagcttacgcgcatgctcacattcaagttctatatgccgaagaaggctactgaattaaaacacctgcagtgtctcgaggaagaactgaaaccattggaagaagtattaaacttggcccaatccaaaaacttccatctccgtcctcgggatctgatctcaaacataaacgttattgttctcgaactgaagggtagcgagactacgttcatgtgtgagtacgcagacgaaacagccaccatcgtagagtttctcaacaggtggatcacattttgtcaatccatcatcagcactcttacctag

SEQ ID NO: 140763 - DNA, 2673 bp, Artificial Sequence
  Description of Artificial Sequence: Synthetic coding sequence
atggatagcaatacggcacccctcggaccaagttgtcctcagccacccccagctccacagcctcaggccagatcaagattgaatgcaacagcgagcctggaacaggaaagatcagagagacctcgtgcaccaggcccccaggccggacccggacctggggtgcgagacgcggccgcccccgcagagccacaggcccagcacacccgtagccgcgagagagctgatggcaccggacctaccaagggggacatggagataccgtttgaggaggtgctggaacgcgcgaaagccggcgatccaaaagcccagaccgaagtcggcaaacactacctgcagctagcaggtgatacagacgaggaactaaattcttgtactgccgtcgattggctggtcctggcagccaagcaggggcgccgggaggcagtcaagctcctccgtagatgcctggcggacaggcgcggcatcacatccgagaacgagagagaggttcgacagttgagctccgaaactgatctggagcgcgcagtgcgaaaagcagccctggtgatgtattggaaattgaatccgaagaaaaagaagcaggtcgccgtggcggagctgttggagaatgtaggacaagtgaatgagcatgacggaggcgcacagccagggccagtgccaaagagcctgcagaaacagcggcggatgttggagcgccttgtgagctcagagtccaaaaattacattgccttggacgacttcgtggaaattacgaagaaatacgctaaaggagtgataccttcctcactgtttttgcaagatgacgaagacgatgacgagctcgccggcaaatctccggaggacctccctctcaggctgaaggtcgttaagtaccccctgcacgctattatggaaattaaagagtacctgatcgacatggcctctagggctggcatgcattggctgagcactataatcccgacccaccacattaacgccctgatcttctttttcatcgtttctaaccttacaatagatttctttgccttttttatccctcttgtcatcttctacttgtcgtttatcagtatggtgatatgtaccctcaaggtgtttcaggacagcaaagcatgggaaaattttaggactctaaccgaccttcttcttcgcttcgaaccaaatctcgatgtcgagcaggctgaggtgaatttcggctggaatcatctggagccttacgcacattttttgttatccgtgttcttcgtgatcttcagcttcccgatcgcctccaaggattgcatcccatgttcagagctcgcagtaattacaggctttttcacagtaacctcatacttgtcattaagtactcacgctgaaccgtacaccaggcgggcacttgctactgaagtcaccgccggattgctcagcctgctgccttccatgcccttaaattggccatacttgaaggttttgggccagactttcatcactgtaccagtcggacacttagttgtgctgaatgtcagcgtgccctgtttgctctatgtgtacctcttatacctgttttttagaatggctcagctgaggaactttaaaggcacttactgttacttggtgccgtacctggtctgttttatgtggtgcgagttgagtgtcgttatcttgttggaaagcaccgggttggggttgttgagggcaagcataggatattttctgtttctatttgccttgcctattcttgttgctggcctcgcgctcgtgggggttttacagttcgcccgctggtttaccagtctggagctgacaaagattgccgtcaccgtggctgtctgctccgttcccttgctcttacggtggtggacaaaggcttcatttagcgtagtcgggatggtcaagtctctgacacggagcagtatggtcaaactgattttggtttggcttaccgcaattgtgcttttctgttggttctatgtttaccgtagcgagggtatgaaagtgtacaacagcaccctgacttggcagcagtacggagcactctgtggtccaagagcctggaaagaaaccaatatggctcgaactcagatcctgtgctcacatctagaagggcatcgtgtaacttggacagggcggtttaaatatgtgagagttactgatattgataactctgcggagtcagccatcaatatgctgccgtttttcattggcgactggatgcgatgcctgtacggagaggcatatcctgcctgcagcccaggcaatacatccactgctgaggaggagctgtgcaggctgaaactgcttgccaagcatccatgccatatcaaaaaatttgatcggtataagttcgaaattacagtgggcatgccctttagctccggagctgatggaagccgtagcagagaagaagatgatgtcaccaaggacatagtccttcgagcatctagcgaattcaagagcgtgctcctgtctcttcgccaaggcagcctcatcgaattcagcacgattctggaaggacgcctcggctcgaaatggcctgtcttcgaactgaaagcaattagttgtctaaattgtatggcccagctttctccgacaaggcgccatgtcaaaatcgagcatgattggcgctccactgttcacggggccgttaagttcgcctttgacttcttcttcttcccattcctgagcgcagcctag

SEQ ID NO: 140764 - DNA, 807 bp, Artificial Sequence
  Description of Artificial Sequence: Synthetic coding sequence
atggtaaaatcacttacacgaagctctatggtcaagctcattctggtctggctgaccgctatcgtgctattttgctggttttacgtgtatcggtcggaaggaatgaaagtgtacaactccactttaacatggcagcaatacggtgcgctatgtgggcccagggcctggaaggagacaaacatggccaggacgcagatcctgtgctcgcacctagaaggccaccgcgtgacttggacgggaaggtttaagtatgtacgcgtcacagatatagacaattctgccgagtcagcaattaacatgctgccgttcttcattggggactggatgcggtgcctctatggcgaggcctatccagcttgctcccctgggaatactagtaccgctgaagaggaactgtgtcgcctcaaacttctggctaagcacccttgtcatattaagaaatttgatagatataagtttgaaatcactgtgggtatgccttttagctcaggtgccgacgggtcccggtcacgggaggaggacgatgttaccaaagacatcgtgctccgcgcctctagtgaatttaagtctgtactgctctcattgcgccagggaagcctgatcgagttctccactatactggaggggaggttgggatccaagtggccagtctttgaactgaaggccatttcctgcctgaactgtatggctcagctcagcccgacgcggagacatgtaaaaatcgaacacgattggcgcagcaccgtgcatggcgcggttaagttcgcatttgactttttctttttcccatttctgtccgcggcgtag

SEQ ID NO: 140765 - DNA, 3342 bp, Artificial Sequence
  Description of Artificial Sequence: Synthetic coding sequence
atgccccggcctgagttacctttgccagaaggttgggaggaagctagagactttgatggcaaggtatactacattgatcacaccaatcggacaacatcttggatagatcctcgggataggtatacaaagccgctgacgttcgctgactgtatcagcgacgagctaccactcggatgggaggaggcttatgacccacaggtgggcgattacttcatcgaccataacacgaaaactacccaaatcgaagaccctcgagtgcagtggaggcgagagcaggagcacatgcttaaagattatctcgtggtcgcacaggaagccctgagcgcccaaaaggagatctaccaagtcaaacagcagcggctagagttggcccaacaggagtaccagcagctccatgcggtgtgggagcacaaactcggatctcaggtcagtctggtgtcaggatctagctcaagctcaaagtacgaccctgagatcctgaaagcagaaatcgcgaccgccaagtcccgagtgaacaagctgaagcgggagatggttcatctccagcacgagctgcagtttaaggagaggggtttccagactctgaagaaaatcgataagaagatgagtgacgctcaggggtcatataaactcgacgaggcgcaggccgtgctgagggaaacaaaggccattaaaaaagcaataacgtgcggagagaaagaaaaacaagacttgataaagagcctcgccatgctgaaggatggttttcgtactgatagaggtagtcacagcgacctctggtcaagtagttcatcactggaatcctcctcttttccgctccctaagcagtatctcgacgtgtccagtcagacggacatctcgggttcatttgggatcaacagcaataatcaactcgctgaaaaggttcggctgcggcttcgctacgaggaggctaagaggcggatcgccaacctgaagatccaactggcaaagttggattccgaggcctggccaggcgtgttggattccgaacgtgacaggctcatccttattaatgagaaggaggagctgctgaaggagatgcggttcatctccccacggaagtggacccagggtgaagtggaacagctggagatggcacgaaagagactggaaaaggacctgcaagcagcaagggacacgcagtccaaggccctgactgagagactgaaactcaatagcaagcggaatcagcttgtccgagagctggaggaagccacacggcaagtggccacactccacagtcagctgaagagcttgtcctcaagcatgcagtctctgtcctctgggtcctctcccggaagcctgacctcttctcgcggaagtctcgtcgcatcatcactcgatagctccaccagcgcatcttttactgatctttactacgacccattcgagcagctggactcggagctgcagagcaaggtggaattcctgttattggagggcgctaccgggtttcggccttcaggctgtattactaccatccacgaggacgaggtcgccaaaactcagaaggctgaggggggcggacggcttcaggcgctgagatctctgtctggaactcctaaatcgatgaccagtcttagcccccgcagcagtctgtcctctccgtcacccccctgctcaccgttgatggcagatccgcttttggcaggggacgcctttctcaactcactggagtttgaggacccagagctcagtgccactctgtgcgagctgtccctgggaaattccgcacaggagagatatcgcctagaagaacctggaacagaaggcaaacagctggggcaagccgtaaacaccgctcagggttgtggtctaaaagtcgcttgtgtgtcggctgccgtctccgatgagagcgtggccggggattctggagtgtacgaggcttccgtccagcggctgggcgcaagcgaggccgctgccttcgattccgatgagtctgaggcggttggggccactcgcattcagatcgcgctgaaatacgacgagaaaaacaagcagtttgctatcctcattatccaactgtctaatctgtccgccttgctacagcagcaagatcagaaagtgaacataagagtggcagtcctcccttgtagcgagtctacaacatgcctttttcggacccgtccgctcgatgctagcgataccttggtgtttaacgaagtcttttgggtgtcaatgtcctatcccgccctccaccagaagactctcagggtggatgtctgtacaactgatagatcacatctggaggaatgcctcggaggcgcccaaatttctttggccgaggtatgcagatctggagagagaagcactagatggtacaacctgctgagttacaagtacctgaagaagcagtcaagagagttgaaacccgtgggcgtcatggctccagccagcggaccagctagcactgacgctgtttctgccctactggaacagaccgccgtggaattagagaagaggcaggagggaagatctagtactcagacgctcgaggacagttggcgttatgaggagacatctgagaacgaagcggtggcggaggaggaggaagaagaggttgaggaagaggagggcgaggaggatgtgttcaccgagaaagcaagcccggatatggatggatatcctgcccttaaagttgacaaggaaaccaatactgagacacccgcccctagccccactgttgtcagaccgaaagatagaagagtgggcaccccatctcaagggcccttcctgaggggcagcaccatcatcaggtcaaaaaccttctccccagggccacagtcacagtatgtgtgccggctgaatcgcagtgattccgactcaagtactctgagcaagaaaccaccgttcgtgcggaattctttggagcgacggagcgtcagaatgaaaagacccagttccgtgaagtctctgaggtctgagcggcttatccggactagccttgatctcgaattggacctgcaggccactaggacctggcactcacagctgacacaagaaatcagcgtcctgaaggagctcaaggaacagctggagcaggctaagagccacggagaaaaggaacttccccagtggctacgcgaggatgagagatttaggttgctgctgcgaatgctggagaaaaggcagatggatagagcagaacacaagggggaacttcaaacagacaaaatgatgagggccgcggccaaggatgtgcatcgactccgcggacaatcttgtaaggaaccacctgaggttcagtcgttcagggaaaagatggccttctttaccaggcctaggatgaacatccctgccctgtccgccgatgacgtctag

SEQ ID NO: 140766 - DNA, 3360 bp, Artificial Sequence
  Description of Artificial Sequence: Synthetic coding sequence
atgcctagacctgagctgcctttgcctgaaggctgggaggaagccagggattttgacggcaaagtgtattatatagaccacaccaataggactacatcatggatcgatccaagggaccgctacactaagccacttacctttgccgattgtattagtgacgagctgcccctgggctgggaggaggcgtatgacccccaagtgggggattactttattgaccacaatacaaagacaacccagatcgaggatcctcgcgtccagtggagacgcgaacaggagcacatgctgaaggactatctcgtcgtggcccaggaagcgctgagtgctcaaaaggaaatataccaagtcaaacagcagagactggaactagcccaacaggaatatcagcagttacacgctgtgtgggaacataagctgggatctcaggttagcttggtgtccgggagttcctcgtccagcaagtacgatccagaaattcttaaggccgaaattgctactgcaaagtccagagtcaacaagctgaaacgggaaatggttcacctgcagcacgagctgcagttcaaggagagaggtttccagactcttaagaaaatcgataagaagatgtccgacgctcagggctcctacaagctagacgaggctcaggccgtgctgcgggagaccaaggccatcaagaaggccattacatgcggtgaaaaggaaaagcaagaccttatcaaatccctcgccatgctgaaggacggctttaggacggaccgcggctctcactctgatttgtggagcagcagcagcagtctcgagagctcctctttcccgctcccaaaacaataccttgacgtcagcagtcaaaccgatatctccgggtcctttggtattaactccaacaaccagctggccgagaaagtccggttgcgactacgatacgaggaggcgaaaaggcgcatagcaaatttaaaaattcaactggctaagcttgattccgaagcttggccaggagtccttgatagtgaacgcgatcggcttatactcattaatgagaaagaggagttgctcaaggagatgaggttcatctccccaaggaagtggacgcagggggaagtcgaacagctagaaatggcgcggaaacggttggagaaagatctgcaggctgccagggacactcagtcaaaggcgttaacagagaggctcaagctgaactctaaacggaaccagctggtgcgggagttagaggaggctactcggcaagtcgccacactgcacagtcagttaaagagcctatcttcatccatgcagagtctttcttccgggtccagtcctgggagtctcacaagtagccgagggtccctcgtggcatcatcgctggatagcagtacctcagccagctttaccgacttatattatgatccctttgaacagctcgatagtgagctccagagcaaggtcgagttcctcctgctggaaggagcaacaggctttcggccctctgggtgtattactacaatccatgaagatgaagtagccaagactcagaaagcagaaggcggcgggagactgcaggcattaaggtctttgtcaggaactcccaagtctatgacatccttgtcaccgcgttcaagcctgagcagtccaagccccccttgttcccctctaatggctgatcctctgctggccggagatgcatttctcaacagcttagaattcgaagacccagaactctcggcaaccctttgtgaactcagcttgggaaacagtgctcaggagcggtatcgtcttgaggaacctgggaccgaaggcaagcagctgggacaagctgtgaatactgcccagggatgcggtcttaaagtagcttgtgtgtcagccgctgtttcagacgaaagcgtcgctggagactcgggcgtgtatgaagcgtccgtgcagcgactgggtgcgtctgaagcggccgccttcgactcggacgagagtgaagcagtgggagccactcggattcagatagctctgaagtatgatgagaaaaataagcaatttgccatcctgattatccagctttcaaacctgtctgcactgctccagcagcaggaccaaaaagtgaacatcagggttgctgtgttgccctgctccgagagtaccacatgtctgttccgaaccagaccattggacgcatcggacactctcgtctttaacgaggtgttctgggtgtctatgagttatccagctctgcatcagaagacacttcgcgtcgacgtatgcacgaccgacaggtctcatctcgaggaatgcctgggcggtgcccaaatttcgctggcagaagtctgcaggtctggagagcgaagtactcgctggtacaacctgctaagctacaagtatctcaagaagcaaagtagggagttgaagcctgttggcgtaatggcccccgcttctggccctgcctcaacagacgcagtcagtgcactgctcgagcagaccgccgttgagttagaaaagcgccaggaggggagatcttccactcagactctggaggactcctggcgctacgaggagacgtccgagaatgaagcggttgcagaagaggaagaagaggaggttgaagaagaagagggtgaagaggacgtgttcaccgagaaagcctcccctgatatggacggctatccagctttaaaagtcgataaagagactaacaccgaaacccctgccccgtctccaacggtggtgcggcccaaggatcgccgtgtggggacaccttcccagggtccatttctgaggggcagcactatcattcggagtaagacattctcccctggtccccagtctcaatacgtttgcagactgaatagatccgattccgattcatctaccctcagtaaaaaaccaccattcgttagaaactcactggagagacgctctgtccgaatgaaacgacctagtccacctcctcagccttcatctgtcaagtccttgcgcagcgagaggctgatccggacctccctagatttagaactcgacttgcaggccactcgaacatggcattctcagcttactcaggaaatttcagtccttaaggagctaaaagagcagttagagcaggcgaagagccacggagaaaaggagcttccccagtggttaagggaagacgaaaggttcagacttctgctgcgtatgctcgagaagagacagatggatcgcgccgagcacaaaggagaactccagactgacaaaatgatgagggccgccgccaaggacgtgcatcgcctgaggggccagagctgcaaggaacctcctgaggtccagagtttccgcgaaaagatggctttctttacacgcccacgcatgaatatccccgcactatctgcggacgacgtgtag

SEQ ID NO: 140767 - DNA, 438 bp, Artificial Sequence
  Description of Artificial Sequence: Synthetic coding sequence
atggccgaggtcgagcaaaagaagaaaaggacctttcgcaaattcacctatagaggcgtcgatctcgaccaactcctggatatgtcgtatgaacagctgatgcagctctacagtgctagacagagaagacgactcaataggggcttgaggcgtaagcaacacagcctgcttaagagactgagaaaggccaaaaaggaggcccctcccatggaaaagccagaggtcgtcaagacccatttaagagatatgattatactacctgaaatggtgggatcaatggtgggcgtgtataacgggaaaacttttaaccaggtggaaatcaagccagagatgatcggacattacttgggcgagttcagtatcacttataaaccagtgaaacatggcaggcccgggattggcgcaacccatagttctagattcattccacttaaatag

SEQ ID NO: 140768 - DNA, 786 bp, Artificial Sequence
  Description of Artificial Sequence: Synthetic coding sequence
atggctctaaataaaaatcacagcgaaggaggcggagttattgtgaataacaccgagagcatcctgatgagctacgatcatgtcgaactaacctttaatgacatgaagaacgtccctgaagctttcaagggcaccaaaaaaggcactgtgtacctgactccgtatagggtcatcttcctgagtaaaggaaaggacgcaatgcaatcttttatgatgcccttctatctgatgaaggattgcgaaatcaagcagcccgtgttcggagccaactatatcaagggcactgtgaaagctgaggctggagggggctgggagggttccgcctcctacaaactgacattcaccgccggaggggctatcgagttcggtcaacggatgctacaggttgcaagccaggccagcagaggggaagttcccagcggtgcgtacggatactcatatatgccatcaggcgcttacgtgtacccgcctccagtggctaacggcatgtatccatgccctcctggttacccctacccccctcctccccccgaattctatccgggaccaccgatgatggacggggccatgggttacgttcagccaccaccgcctccatacccgggaccaatggaacccccagtcagcgggcctgacgtaccttccaccccagctgccgaggccaaggcggcagaagcagctgcaagcgcctactacaatcctgggaacccacacaacgtctacatgcctacaagccaacctccacctcctccctactatccccccgaggacaaaaagactcagtag

SEQ ID NO: 140769 - DNA, 720 bp, Artificial Sequence
  Description of Artificial Sequence: Synthetic coding sequence
atgagttatgaccatgtagagctgacttttaacgatatgaagaacgttccagaagccttcaaagggaccaaaaagggaacagtatacctcacaccatacagagtaatctttctcagcaagggcaaggacgccatgcagagctttatgatgcccttttacctaatgaaggattgtgaaattaaacagcccgtgtttggcgctaattacataaagggaaccgtcaaggcggaggcaggcggcgggtgggagggctccgcaagttataaattgacattcactgcgggtggagcaattgagttcggccagaggatgctccaggtggcaagccaggccagccgaggtgaagtgcctagcggagcctatggttacagctatatgcccagcggcgcatacgtgtacccaccgccagtggccaatggcatgtacccgtgccccccaggatatccgtatcctcctccacccccagagttctatcctggccctcctatgatggacggggcaatgggatacgttcaaccaccaccaccaccgtaccctgggcccatggaaccacctgtgtccgggcccgatgtcccatcgactcccgcagctgaggccaaggcagcagaggcagctgcttcagcctattacaaccctggcaatccacataatgtgtacatgcctacctcccaacctcccccccccccatattatccccccgaggacaagaagactcagtag

SEQ ID NO: 140770 - DNA, 654 bp, Artificial Sequence
  Description of Artificial Sequence: Synthetic coding sequence
atggctttaaacaagaatcactcagagggcggaggagtgatagtgaataataccgagagcattctcatgagttatgatcatgttgagctcacctttaatgatatgaaaaacgtgcccgaagcctttaagggtactaagaagggaacggtgtacctcaccccttacagagtgatcttcctgagcaagggtaaagacgcgatgcagtccttcatgatgcctttctatctgatgaaggattgtgaaattaagcagcctgtgtttggggccaactacatcaagggaacagtgaaggccgaggcgggcgcctctcggggtgaggtgcccagcggagcgtacggttatagctacatgccctccggggcctatgtttaccccccccctgtggcgaacggcatgtatccttgtcctccagggtacccttatccacctcctccacccgaattctaccccggtcctcccatgatggatggcgcaatgggatatgtgcaacccccacccccaccatatcccgggcctatggagcctccagtttctggccctgacgtgccatctactcccgccggcgagggcccttgggtcctggccgccctgagggatcaaccgtcaccccctaggtgtaggacagaatcactgcggatggctcgggattgctag

SEQ ID NO: 140771 - DNA, 630 bp, Artificial Sequence
  Description of Artificial Sequence: Synthetic coding sequence
atggcattgaacaaaaaccactctgagggcggtggggtaatcgtcaacaacaccgagtccatactgatgagttatgaccacgtagaattaaccttcaatgatatgaaaaatgtgccagaggcattcaaaggaacaaaaaagggaacagtttatcttacaccatacagggtaatcttcctcagcaagggcaaggacgctatgcagtctttcatgatgcctttctacttgatgaaagattgcgagatcaagcagcccgtcttcggcgccaactatataaaaggaactgtcaaggctgaggctggcggtgggtgggagggctccgcctcatacaagctgacctttacagctccaatgtcaccgcctctcctgcagcccaaaccaagaccccagaagcagcctccagctccgattacaactcaggccatcgccagccgacgacatctgcctacgactcaccggaaaatagaggaccccgtgggtccccccgcgagtctgcctccaacgctgatctcactcccatatcctagccaccgcggttgtgctggggcatgggggggcgagggggccccttgcagcccatcgcgatcagaccacaaacagcttccaggcacttccattgtcggccattag

SEQ ID NO: 140772 - DNA, 651 bp, Artificial Sequence
  Description of Artificial Sequence: Synthetic coding sequence
atggctctcaacaaaaaccactcggaaggcgggggcgtgattgtgaacaatacagaatctattctgatgagctatgaccacgtcgagctcacattcaacgatatgaaaaacgtgcctgaagccttcaaaggcacgaagaaaggaactgtgtacctgacaccttatcgagtgatctttttatctaagggtaaggacgccatgcagtcctttatgatgccattctatctgatgaaagactgcgaaatcaagcagcccgttttcggcgcaaattacataaaaggtaccgtgaaggccgaagccggggggggttgggagggatccgctagttataaactgacgttcactgccggaggagcgatcgagttcggccagcgtatgctgcaagtggcttctcaagagttttaccccggtcccccgatgatggatggagccatggggtacgttcaaccacctcctcccccctaccctgggcccatggagcctccagtaagcggtccagatgtcccatccaccccagccgccgaagcaaaggcagccgaagccgccgcatctgcttactacaacccgggcaacccccacaacgtttacatgcctacttctcaaccccctcctcctccatattatcctcctgaagataaaaagacccaatag

SEQ ID NO: 140773 - DNA, 2769 bp, Artificial Sequence
  Description of Artificial Sequence: Synthetic coding sequence
atggccacagcatcgcccagatccgacacttctaacaatcatagtgggagactccagctgcaggtgacagtgtcctcagccaaactcaagcgcaagaagaactggtttggcacagcgatttacacggaagtagtggtggacggagaaataactaaaacagctaaaagcagctcatcaagcaaccctaaatgggatgagcagcttacagttaacgttaccccacaaactacgctggagtttcaggtatggtctcataggacactgaaagccgacgctttgctgggcaaggcgactattgatctcaaacaggccctgctgatccacaatcgaaagctggaaagagtgaaggagcaactcaagctttcactggagaacaagaatggaatcgcacagacaggcgagctcaccgttgtgctcgacggcctcgtcatcgaacaggagaacattaccaactgctccagttctccaacaatcgaaatccaagaaaatggggatgcacttcatgagaacggggaaccctctgctagaacaactgctcggttagcagtagagggaaccaatggtatagataaccatgtccctacatcgacgctggtgcagaacagctgctgctcgtacgtcgtcaatggcgacaacacccccagcagcccttcccaagtggcagcgcggcccaaaaatacacctgccccgaagccactggcttctgagcccgctgacgacacagtgaacggagaatctagtagctttgccccaacagataatgcgtccgtcacagggacaccggtagtttctgaagagaatgcactctccccgaattgcaccagtactaccgtcgaggatccaccagtgcaggagatacttacctcaagtgagaacaacgagtgtatccccagcacatctgctgagctggagagcgaggcccggagcattcttgaacctgacacctccaattccaggtcttcctcagcatttgaagccgcgaagtcgcgccagcccgatggatgtatggatccggtaagacagcagagcggcaatgccaataccgaaaccctgccatccggctgggaacagaggaaggatccacacggacggacttactatgtagaccacaatacaagaacgaccacgtgggagagaccacaaccactgcctcccggctgggaaagaagagtcgatgatcgccgccgcgtctactacgtggaccacaacacaagaacgacaacctggcagcgaccaaccatggagagtgtgaggaacttcgaacagtggcaatctcagcggaaccaactgcagggggcgatgcagcagtttaaccagcgctatctgtacagtgcctcaatgcttgccgccgagaacgatccatatggacccctgcctcctgggtgggaaaaacgtgttgactcaactgaccgggtatattttgtgaaccataacaccaagacaacccagtgggaggatccgcgcactcagggtctgcagaacgaggagccgttacccgaaggatgggaaatccggtacacaagagagggcgtgcgatactttgtcgatcataatacccggacgaccaccttcaaagacccccggaatgggaaatcctccgtcaccaaaggcggtccacaaatagcctacgaaaggggcttccgctggaagctggcacatttcaggtacctttgtcagagcaacgctctgccctcccacgttaagattaacgtgtcccggcaaactttgttcgaggactcatttcagcaaataatggcattgaagccatacgacctgcgtaggcggctctatgtgatcttcaggggcgaggaagggctcgactatgggggtctggctcgtgagtggtttttcttgctgtcccatgaggtgctcaaccccatgtactgcctgttcgagtatgctggcaaaaacaattactgcctgcagattaaccctgcttctacaattaaccctgaccatctatcgtatttttgctttatcggtagatttattgctatggccctctttcacggtaagttcatcgataccgggtttagcttgcccttctacaaacgaatgctgtcaaaaaagcttaccataaaggacctcgagtctatagacacagaattctacaatagtttgatatggatacgtgataataacattgaggagtgcggccttgagatgtatttttctgtggacatggaaatcttaggcaaagtcacctcccatgatttgaaactgggcggatcaaatatccttgtaactgaggagaacaaagatgaatacattggactgatgactgaatggcggttcagcagaggagtccaagaacagacgaaagcatttctggacggcttcaacgaggttgtgcccctgcaatggctgcaatacttcgatgaaaaggagctggaagtgatgttgtgtggcatgcaggaggtggatcttgcagattggcagcggaataccgtgtatcgccactacacccggaactctaagcagataatttggttttggcagttcgtgaaggaaacagacaacgaagtcaggatgcgcctcttgcagttcgtgacaggcacttgtcgtctcccgctgggcgggttcgcagaactgatggggagcaatggcccacaaaaattctgcatagagaaggtagggaaggatacctggctgccaaggtcccacacttgctttaacagactcgacctgcctccctacaagtcctacgaacagctgaaggaaaaactcttgttcgctattgaggagacagagggcttcgggcaggagtag

SEQ ID NO: 140774 - DNA, 2379 bp, Artificial Sequence
  Description of Artificial Sequence: Synthetic coding sequence
atggccaccgctagtccacggagcgacacctcaaataaccacagcgggcggcttcaattgcaggttaccgtttctagcgcaaagctgaaacgcaaaaaaaactggttcggcacagctatatataccgaggttgtggtcgacggtgagataactaagaccgcaaagtctagcagttccagtaaccccaaatgggatgaacagctgacagtcaacgtgactccccagaccaccctagagtttcaagtatggagccacaggacgctcaaagctgatgccctgttgggaaaggctactattgacttgaaacaggcgttactgattcataaccgaaagttcaatggggagtcttcatctttcgctccaaccgacaacgcctccgtaactggaaccccggtcgtgagtgaggagaacgccctgtctcccaactgtacttcaacaacggtcgaggatcctcccgttcaagagattttgaccagttcggagaataatgaatgcatcccttcaacctccgccgagctcgagtccgaggccagaagtatccttgagccggatacatcaaactcaagaagttcgtcagctttcgaagccgccaagtcccggcagccagatggatgtatggaccccgtcagacagcaatctggcaatgcgaacacggagacacttccctcaggctgggagcagcgaaaagacccccatggtcggacttattatgttgatcataataccaggacgacgacatgggaacgccctcagccattgccacccgggtgggagagaagggtagatgaccggcggagagtgtattatgttgatcacaatactagaactactacatggcaaagaccaacaatggagagcgtcagaaattttgaacaatggcagtcccaacgcaatcagcttcagggggccatgcagcagttcaaccagcgctacctgtactcggcctcgatgctggcagccgagaatgatccttatggtcccctgccacctggctgggagaagcgggtggattccacagatagggtgtattttgttaaccacaatacaaaaaccacacagtgggaggatcctaggacacagggcctgcaaaacgaagagccactccctgaaggctgggagatcagatacacccgagaaggcgtgcggtatttcgtagatcacaacactagaactaccactttcaaagaccccaggaacggaaagtcttcagtcactaagggggggcctcaaattgcctacgagagggggtttcggtggaagctggcccattttaggtatctgtgtcaatctaatgctctgccctctcatgtaaaaataaatgtcagtcggcagactttgtttgaggacagctttcagcaaataatggcactgaagccgtacgatctccgccgtaggctgtatgtgattttccgcggcgaagagggcttggactatgggggactggcacgggagtggttcttcctcttatctcatgaggtacttaacccaatgtactgtctttttgagtatgccggcaagaataactactgcttgcaaatcaacccagctagcaccataaatccagatcatctaagttatttctgctttatcggcaggttcatcgccatggccctgttccacgggaagttcatcgacaccgggttttccctccccttctataagagaatgctctccaaaaagctaactattaaagacttggagtcaatagacaccgaattctataattctctgatctggatccgggacaataacatcgaggaatgtggcctggagatgtacttttcagtggacatggaaattcttggtaaagtgaccagtcacgatttaaaactcggcgggtccaacattctggtcactgaagaaaacaaagacgaatacatcgggcttatgactgaatggcggttctctcgaggtgttcaggagcagaccaaggcctttcttgacggattcaatgaagtggtacctctgcagtggttgcagtatttcgacgaaaaagagctggaggtgatgctgtgtggcatgcaggaggtcgatctcgccgactggcagcgaaacactgtgtaccgacactatacaaggaacagcaagcagattatctggttttggcaattcgtgaaagaaacagacaacgaggttaggatgcggctgcttcagttcgtcacggggacctgcagactaccgctgggagggttcgcggagctgatgggttctaacggcccgcaaaaattttgcatcgagaaggttggaaaggacacctggctcccacgctctcacacctgttttaaccggctcgatctgcctccctacaagagctacgagcaactaaaggagaagctgctgttcgcaattgaggagacggaggggttcggtcaggaatag

SEQ ID NO: 140775 - DNA, 2115 bp, Artificial Sequence
  Description of Artificial Sequence: Synthetic coding sequence
atggctaccgcctcccctcgtagtgacacctctaacaatcattccggcagactgcagttacaggtaactgtgaacggggaaagttcaagctttgcccctaccgataacgcttctgtgaccggcactcccgtggttagtgaggagaacgccctgtccccgaactgtacgtcaaccactgtcgaggacccgcccgttcaggagatcctgacgtcctccgaaaataacgagtgcatcccaagtacgtccgctgagctggaatctgaggcccgcagcatcctggagcccgataccagcaactctagaagcagttccgccttcgaagcagcaaagagccgacaacctgatggctgcatggatccggttcgccagcagtcaggcaacgctaatactgagacgctgccctctggctgggaacagaggaaggatccacacgggcggacctattacgtcgaccacaataccagaactaccacctgggagaggcctcagccgctgcctcccggatgggagaggagagttgacgacagaagacgcgtatactacgtcgatcataacacacggaccactacatggcagcggccaacaatggagagtgtccgcaactttgaacaatggcagagccagcgcaaccaactgcagggtgctatgcagcagttcaaccagaggtatctttactcagcatctatgctcgcagctgaaaacgacccatatggacccctgcctccaggctgggaaaaaagggtggacagtacagatcgcgtgtactttgtaaatcacaataccaagacgacacagtgggaagacccgcggacacaagggctccagaatgaagagcctctgcccgagggctgggagattcggtatactcgggaaggcgtccgctatttcgtggatcataatacacgaactactacttttaaagacccccggaacggcaaatcttccgtgacaaaaggcggcccgcaaatagcctacgaacggggctttcgatggaagcttgcacatttccgctacctttgtcagagtaatgcgttgccgagccacgtcaaaattaacgtaagccgccagacactgtttgaggactctttccagcagatcatggccctgaagccttatgatttaaggcggcggctgtatgtaattttccggggcgaagaaggcctggattatggcgggcttgcacgggaatggttttttcttctttctcatgaggtgctaaatcctatgtactgccttttcgaatacgccggaaagaacaactactgtctccagatcaaccccgccagcacaattaacccagatcatctctcctacttctgctttatcggacggttcattgccatggcactcttccatggcaaattcatagataccggattcagcctgcctttttataaaaggatgctgtctaaaaagctcacgatcaaggacctagaatccattgataccgagttttacaattccctgatttggatcagagacaacaacattgaggagtgcggtttagaaatgtacttctcggtcgacatggagatccttggtaaggtgacaagtcatgatctgaagctcggggggagcaatattcttgtaactgaggagaacaaggacgagtacatcgggctcatgactgaatggcggtttagccgaggggtgcaggagcagactaaggctttcttagacgggttcaacgaagtcgtgccattgcagtggctccaatacttcgacgagaaagagttagaggtgatgctgtgcgggatgcaggaggtagaccttgcagactggcaaagaaacactgtttacagacattacacgagaaactccaagcagatcatatggttttggcagttcgtaaaagaaaccgataatgaagttaggatgaggctcctgcagtttgtgactggcacttgtagactgccgcttggaggcttcgctgaactcatgggatcaaacggcccacagaagttctgtatcgagaaagtgggcaaggatacgtggttgcctcgcagtcacacgtgtttcaatagactggacttaccgccctataagtcttacgagcagctcaaagagaagctgcttttcgccatcgaggagacggagggattcggacaggaatag

SEQ ID NO: 140776 - DNA, 336 bp, Artificial Sequence
  Description of Artificial Sequence: Synthetic coding sequence
atggctactgctagcccccggtccgatacctcaaacaaccattctggaagactgcagctccaggttaccgtcagctccgctaaacttaagcggaaaaagaattggtttgggaccgctatctacactgaggtggtggtggacggtgaaatcaccaaaacagctaaatcctcctcctctagtaaccctaagtgggacgaacagctgaccgtgaatgtgactccccagacaacgttggaatttcaggtctggagccatagaacgctcaaagccgatgcattactagggaaggccacaatcgatctgaagcaagcccttctaatacataaccgaaaatag

SEQ ID NO: 140777 - DNA, 2769 bp, Artificial Sequence
  Description of Artificial Sequence: Synthetic coding sequence
atggcaacggcatcacccagaagtgacaccagtaacaaccattccggtaggttgcagctccaagttaccgtgtcatctgccaaactgaaaagaaaaaagaactggttcgggactgccatctacactgaggtcgtagtggacggagagataactaaaacggcaaagtcttctagctccagcaaccccaagtgggacgagcaactcactgtgaatgtaactccacaaactacactcgagttccaggtgtggagtcacagaaccctgaaggccgacgccctactaggcaaagctacaatagatctgaagcaagctctcctcatccataaccgaaagttggagcgtgtcaaggaacaattgaagttgagcttggaaaataaaaatggcatcgcgcaaaccggggaactcactgtggtcctggacggccttgtcatcgagcaggaaaatatcacaaattgctcttcgagtccaactatcgagattcaggaaaacggcgatgcccttcacgaaaacggtgagccttctgcaaggacaactgccagactggcagtcgaaggaacaaatggtatagataaccacgtgcccacatccaccctggtgcagaatagttgctgtagctatgtagtgaatggagataataccccatcgtccccttcgcaggtggcggcccgcccaaaaaatacacccgcccctaaacccctggcatcagagccagctgacgacactgtgaatggcgagtcaagctcttttgcccctacagataatgcaagtgttaccggtactccggtggtgtcagaggagaacgccttgtcacccaactgcacctccacgaccgtggaggaccccccagtgcaggaaatcctcacttcgagcgagaacaacgaatgtattccctcaacaagtgcagagctcgaaagtgaagcccggagcatactggagcccgatacctctaatagccgatctagctctgcctttgaagccgccaagagtcgtcagccagatggatgtatggatcccgtaaggcagcagtcaggaaacgctaacaccgaaacgctcccaagcggctgggaacagcgaaaggatcctcatggtaggacttattacgtggatcataatacgcgtactacaacatgggaacgacctcagcccttgccgccggggtgggaacgaagagtggacgacagaaggcgagtttactatgtggaccacaacaccaggactacaacatggcagaggcccacaatggaatcggtgcgtaactttgagcagtggcagagtcagagaaaccagcttcagggggcaatgcaacaattcaatcagaggtacctttacagtgccagcatgctcgccgcagaaaacgacccgtatggccccttaccgcctggatgggagaaaagagtagattctactgacagggtttacttcgtaaatcacaacactaagaccacccagtgggaggatcctcgcacgcagggccttcagaatgaggaacccttgcccgaggggtgggaaataagatatacacgggagggcgtcaggtattttgtcgaccataacacccgtacaactaccttcaaggatcccagaaacggcaagtcgagtgtcacgaaggggggtccccagattgcctatgagaggggatttagatggaaactggctcacttcagatatctctgccagtcgaacgcacttccgtcacatgttaagattaatgtgagtcgacagaccttattcgaggatagttttcagcaaatcatggctctcaagccatacgatctgcggaggcgtctgtatgtgatctttcgcggcgaggagggattggactacggggggttagcccgagagtggttcttcctactgtcacatgaagtgttgaacccgatgtattgcctctttgaatatgctggcaaaaataactactgcctccagattaaccccgcaagcaccattaaccctgaccacttgagctacttctgctttatcggcaggtttatcgccatggcgctgttccacgggaagtttattgacactggcttctccttgccattttataagaggatgctgtcaaaaaagctgactattaaggacttagaatccatagacaccgaattctacaacagcttaatttggatccgggataataacatagaggagtgcggcctggaaatgtacttctctgtggacatggagatactggggaaggtcacttcacatgaccttaagctgggaggtagtaatatacttgtgaccgaggagaataaagacgaatatatcggtcttatgacagaatggagattctctcggggggtgcaagagcagacaaaggcttttttagacggtttcaacgaagtcgtgccactacagtggctgcagtactttgatgaaaaagaactggaagtgatgctctgcggcatgcaagaagtggatttggcagattggcaaagaaacaccgtttatcggcactatactcgaaattctaaacagatcatatggttctggcagttcgtaaaagaaacagacaatgaggtgcggatgcgcctgctgcagttcgttaccggcacttgtcgtctgcctcttggaggtttcgcagagttgatgggatcaaacgggccccagaaattttgtattgagaaggtcggaaaggatacatggttgccacgttcacatacgtgctttaatcgtttggacttgccaccttataagtcctatgaacagctgaaggagaagctactttttgcgattgaggaaacagaggggtttggccaggagtag

SEQ ID NO: 140778 - DNA, 2613 bp, Artificial Sequence
  Description of Artificial Sequence: Synthetic coding sequence
atggccagcgcttccagcagcagagccggcgtggccttgccattcgagaagtcgcaactgactctaaaagtagtgtccgctaagccgaaggtgcataatcggcagccacgcattaactcatatgttgaagttgcagttgatggattgccaagtgagacaaaaaaaacaggtaagcggataggaagcagcgagcttctgtggaacgaaatcattattctaaatgtcactgctcagtcacaccttgatcttaaggtttggagctgtcataccttgcggaacgaactgctaggaaccgcatcagtcaatttaagcaatgtgctgaagaacaacgggggcaagatggaaaatatgcagcttacattaaatctgcagaccgagaataaaggatccgtggtgtccgggggtgagctgacaatctttctggatggccccaccgtggacctggggaacgtccccaacggctcagccctcactgacggtagccagctgccgtcgcgcgatagctcagggacagctgtggcacctgaaaaccggcaccagccgccttcaaccaactgctttggcggccgcagcaggactcacaggcactcaggggcatccgctagaacaactcccgcaaccggcgaacagagccccggagccaggtctcggcatagacagcccgtgaagaacagcggccattcgggactcgccaatgggaccgttaacgatgagccaaccactgcaactgacccagaagagcctagcgtggtgggtgtcacctctcctccagctgctcccttgtccgtcaccccaaatccaaacacaacctctttgcctgcaccagcaacccctgctgagggagaggaaccctctacttctgggactcagcagctgcccgccgccgctcaagcccctgatgcactccctgccgggtgggagcaacgtgaactgccaaacggccgagtgtattatgttgatcacaacactaagaccacaacctgggagcggccgctcccgcccggctgggaaaagcgtaccgatccaagagggagattctattacgtggaccataacacccgcacaaccacctggcaacgccccaccgcagaatatgtgagaaattacgaacaatggcagtcccagcgaaaccaactgcagggcgctatgcagcatttttcccagcggttcctgtatcagtccagcagcgcaagtacagatcacgatcctctgggcccgctccctcccggctgggaaaagcgacaggacaatggcagagtctattatgttaaccacaatacaagaacaacacagtgggaggacccacggacccagggcatgattcaagaacctgcgttgccaccagggtgggaaatgaagtatacctccgagggagtgagatacttcgttgaccacaacacacggaccactacattcaaggacccccgtcctggtttcgaatccggcacaaaacaaggatctccgggcgcctatgatcgatctttcaggtggaagtatcatcagttcaggtttctttgtcattccaacgccctgccctcacacgtgaaaatctccgtctctcgccagacactttttgaagactctttccagcaaatcatgaatatgaagccttatgacctccggagacgcctgtatatcatcatgaggggtgaagaaggactggactatggcggcattgctcgggagtggttcttcctgctcagccatgaggtactaaatccaatgtattgcctgtttgaatatgcagggaagaataattattgccttcagatcaatcctgcttcttctattaatccagaccacctgacctatttccgtttcatcgggaggttcatcgctatggcactgtatcacgggaagttcattgatacaggctttacacttccattctacaagcggatgctgaacaaacggcccacattaaaggacctcgaatccattgatccagagttctataatagcatagtctggattaaagaaaataatctggaggagtgcggcctggagctgtacttcattcaggacatggaaatcttgggcaaggtcacgacccacgagttgaaggagggtggtgaatcgatcagagtaactgaggagaacaaagaggaatacattatgctattgaccgattggcgcttcacacgtggcgtggaggaacagactaaagcttttttagatggatttaacgaagtggcccccctagaatggctgagatactttgatgagaaagagttagagttgatgctctgcggaatgcaggagatcgatatgtccgactggcagaaaagtacaatctaccggcactacacaaagaactccaaacagatacagtggttttggcaagttgtgaaggaaatggacaatgagaagcgcattaggcttctccagtttgtcacaggcacttgccggctgccggtgggcgggttcgcagaactgatcgggtccaacggcccacaaaagttctgcatagacaaagtcggcaaggagacttggctccctagatctcatacctgtttcaatagattagacctccctccttataagtcctacgagcaactgcgggaaaagttactgtacgccatcgaggagactgagggctttggacaagaatag

SEQ ID NO: 140779 - DNA, 2613 bp, Artificial Sequence
  Description of Artificial Sequence: Synthetic coding sequence
atggcctcagcgtcctccagccgggcaggtgtggcgctgcccttcgaaaagagccaactgacactgaaggtcgtctctgccaagcccaaagttcacaaccggcagccacgaatcaattcatacgttgaagttgccgtggatggcttaccttctgaaaccaagaaaactggcaagcgcattggttctagtgaactcctttggaacgaaattatcatcttgaacgtcactgcccagtcccatcttgacctgaaggtgtggagctgtcacaccctacggaacgagttactgggcacagcctccgtcaatctgtctaatgtcttgaaaaacaatggagggaagatggagaacatgcagttgaccttgaacctgcaaacggaaaataaggggagtgtggtttctggtggcgaactgaccatctttctggatggtccaacagtggacctcggtaacgttcctaatggttccgcgctgacagacggctcacaactgccctcaagggactcatctggcactgcagtcgctcctgaaaatagacaccaacctcctagtacaaattgctttgggggcaggtcacgaactcaccgccattccggagcctccgcccgcactactccagctactggagagcaaagccccggcgccaggtctcgccaccggcagcccgtcaagaactctggtcattctggccttgctaacggtactgtgaacgacgagcctactactgctaccgatcctgaggagcccagcgtggtgggagtgaccagccctcccgccgcccccctgtccgtgaccccaaaccccaatacaaccagcttgccagccccagcaacccccgctgagggagaggagccttctacttccggcacccagcagctccctgccgccgcacaggctccagacgcgttgcccgcaggctgggaacagagggagctgcctaatggtagagtatattatgtggaccataacactaaaaccactacctgggagaggccccttccgcccggatgggaaaagaggacagacccccggggtaggttttactacgtggatcataatactcgcaccactacgtggcagaggcccaccgcagaatatgttagaaactacgagcagtggcagtctcaacggaaccagctgcagggcgccatgcagcacttcagccagcggtttctctatcagtcctctagtgcttccacagaccacgatcctctgggtcccttacctccagggtgggagaaacggcaggataatggtcgagtctactatgttaatcataatactaggacaactcaatgggaagaccctaggacccaaggtatgattcaagagccagctctcccgcctggttgggaaatgaagtatacatcagaaggtgttcgctattttgttgaccataacacacggacaaccaccttcaaagaccctcgacctggattcgaaagcggaaccaaacaggggtcccccggcgcctacgaccggtctttccgctggaagtatcaccaatttcgctttctgtgccactctaatgcactgccttcacacgtgaagatctcggtgagtaggcagacactgttcgaggatagcttccagcagatcatgaatatgaagccttacgatttgagacgcagactctacattattatgcgtggcgaggaaggtctggactatggaggcatcgcccgggagtggttcttcctcctgagccatgaggtgctgaacccgatgtactgcctgttcgaatatgccggaaaaaataattattgcctacagattaaccccgcctcttctattaatccagaccacttgacctatttccggttcatagggcgattcatcgccatggctctgtatcacggcaagttcattgacactggctttacactgccattctacaagaggatgcttaacaaacggcccacgctgaaagatctggaatcgatcgacccagaattctacaacagcatcgtttggatcaaagaaaacaatctggaagagtgtgggttggaattgtacttcattcaagacatggagattctgggcaaagtcactacccacgagttgaaagagggcggcgagtcaattagggtgaccgaggagaacaaggaggagtacattatgctgcttacagactggaggtttacccggggtgtggaagagcagaccaaggcgttcttggatggcttcaacgaggtcgctccactcgagtggctgagatacttcgacgaaaaagaattggagctgatgctctgtggcatgcaagagatcgacatgagcgattggcaaaagagcactatctaccgccactatactaagaattccaagcagatccagtggttctggcaagtggtgaaggaaatggataacgagaaacgaattagactactgcagttcgtgaccggaacgtgccgcctgcccgtgggcgggtttgcagagcttatcggctcaaacgggccacagaaattttgtatcgataaagttggtaaggaaacttggctcccacgatcccacacctgctttaatcgtttggacctgcctccttataagtcttatgagcagctgcgggaaaaactgctctatgcaatcgaggagaccgagggcttcggccaggagtag

SEQ ID NO: 140780 - DNA, 2613 bp, Artificial Sequence
  Description of Artificial Sequence: Synthetic coding sequence
atggcttctgccagctccagccgcgccggcgtcgccctgccttttgagaagtcacagttgactctgaaagtggttagcgctaagccaaaagtgcataataggcagccaaggatcaacagttatgtggaggtggcagtcgatgggctgcccagcgaaactaagaagacgggaaagcgcattggcagctcagaactactgtggaatgaaatcattatcttgaacgtcacagcccagagccatctggacctgaaggtgtggtcgtgccatacccttaggaatgagctgttgggcaccgcctccgtgaatctgtctaacgtgctgaaaaacaacggggggaagatggagaacatgcaactgacactgaatctgcaaacagaaaacaaaggcagtgtggtctcagggggtgagctgaccattttcctggatggacctacagtcgatctgggaaatgtcccaaatggctccgctctaacagacggctcacaattgcctagtagggacagtagcggaaccgctgtcgcacccgagaatcggcatcagccaccaagcactaattgcttcggcggacgatctaggacacacagacactctggtgccagcgcccgcacaacaccagccaccggtgagcagagcccaggggcgaggtctcgccacaggcagcctgtaaagaactcggggcactctggcctcgcaaatgggacagtgaatgacgagccaaccaccgctactgacccagaggagcccagcgtggtcggcgtgacctcaccccccgccgcccctttgagcgtaacgccaaaccccaatacgaccagtttgcccgccccagcgactcccgccgaaggtgaggaaccaagcaccagcggcacacagcaactgcccgcagccgctcaagccccagacgctctaccagccggctgggaacagcgggagcttccaaatgggcgggtttactacgttgatcataatactaagacgactacgtgggagaggccactacctcctggatgggagaagcggacggacccccgcggccgcttttattatgtagaccataacacccgcaccacaacttggcagcggccaacagctgagtacgtgaggaactacgagcaatggcaatcacaacgcaaccagctgcagggtgcaatgcagcacttttcccagagattcttataccaatctagttcagcatctacagaccatgatcccttggggcctttacccccagggtgggaaaagcgtcaggacaacgggcgggtgtactatgttaatcataatacacggacaacacagtgggaggacccaaggacacagggtatgatacaggagcctgcgcttccacctgggtgggagatgaaatacacctcggagggagtacgctacttcgtggatcacaacacacgtaccaccactttcaaggaccctagacccggcttcgagtctgggaccaaacagggcagccccggggcctatgatcggtcatttcggtggaagtatcatcagttccgtttcctgtgccactcaaacgctctgcccagtcatgtaaagatctctgtgtcccggcagaccttgttcgaagactcatttcagcaaatcatgaacatgaagccttacgacctgaggagacgcctgtatatcataatgcggggcgaggagggactggactatggcggcatcgcccgggagtggttcttccttctctcacacgaggtgttgaacccaatgtattgcctctttgagtacgctgggaagaacaattattgcctgcaaatcaacccggcctcatctattaatcctgatcacttgacctatttcagattcattggcagattcatcgcaatggccctgtaccatggaaaattcatcgatactgggttcacattaccattttacaagcgaatgcttaacaaaaggcctacgctcaaggacctggagtcgattgaccccgagttctacaacagtatagtttggatcaaggagaacaacttggaagaatgtggcctggagctgtattttattcaggatatggaaatactgggtaaggtgaccacccacgaactgaaggagggcggggagtccatcagagtgaccgaggagaataaagaggaatatatcatgctgcttactgactggcgctttacaaggggagtggaggagcagactaaggccttcctggatggttttaatgaggtggctcccctagaatggctgcggtactttgacgagaaggagctcgagttgatgctttgcggtatgcaagaaatcgatatgtcagattggcagaagagcaccatatatcggcactatacaaagaatagtaagcagatccagtggttctggcaggttgtgaaagagatggacaacgagaagcgcattcgactcctacaatttgttacaggcacctgtagactgccagtggggggatttgcggaacttatcgggtcgaacggaccacagaaattctgcattgacaaggttggtaaagagacatggctgccaaggagccacacctgctttaacagactggacctgcccccctataagtcttacgaacagctccgtgaaaaactgctttacgctatagaagaaacagaggggttcggtcaggagtag

SEQ ID NO: 140781 - DNA, 2265 bp, Artificial Sequence
  Description of Artificial Sequence: Synthetic coding sequence
atgcagctcacgttgaacctgcaaactgagaataagggcagcgtggtctctggtggtgaactgacaatctttctcgatggacctactgttgacctgggcaacgtgcctaacggatcggctctgacggatggttcccagttgccttccagggatagctccgggacggctgtcgctcccgagaacaggcaccagcctccctctactaattgtttcggggggcgcagtagaactcatagacactccggagcttccgcgcggactactccggccacgggtgagcagagccccggcgcccggagtcgacacagacagccggttaaaaattctggtcatagcgggctggcaaacggcaccgttaacgacgagcccaccactgctacagatccggaggagccgagcgtggtgggcgtgacttctccacctgccgcacccctctctgtaacacccaatcctaataccacaagcctgccagcacctgctactcccgctgagggagaggagccttccacctctgggacccaacagttgcctgcagctgcccaggcaccagacgcattacccgcagggtgggagcagcgggaattacccaatggccgtgtgtattacgtggaccacaacaccaagactacaacgtgggaacgacctttgccccccggatgggagaagcgaactgacccccgggggcgcttctactacgttgatcataatacgagaaccacgacatggcagcgccctactgccgagtacgtcaggaactatgaacaatggcagagtcagcgcaatcaactccagggagccatgcagcatttctctcagcgtttcttgtatcagagctcttctgccagcacagaccacgaccctcttggacctttgcctcccgggtgggaaaaacgtcaggacaatgggagggtatactatgtcaaccacaatacccgcactactcagtgggaggatcctagaactcaaggaatgattcaggaacctgcactccccccaggctgggagatgaagtatacaagtgagggcgtgcggtatttcgttgaccacaacactcggactaccacatttaaagatcccagaccaggcttcgagtcgggaaccaaacagggctctcccggcgcttacgaccggagttttcggtggaagtatcatcagtttagattcctctgccattcaaatgccttgccgtcccacgtcaaaatcagtgtgtcgcgtcagacattgttcgaagattccttccagcagattatgaatatgaagccttacgacctccggagaaggctttatataatcatgcgcggcgaagagggtctcgactacggaggcattgccagagaatggttctttctcctttcccacgaggtcctaaatccaatgtactgcctcttcgaatatgcgggcaagaataactactgtctgcaaatcaaccctgcatcctcaatcaaccccgatcacctgacctatttcagatttattggccgattcatcgcaatggctctctaccacggaaagtttatagatacgggctttaccctcccattttacaagagaatgctgaataaacggcctacccttaaagatttggaatcaattgatcccgagttttataatagcattgtatggatcaaagaaaataacctcgaagagtgcggactggagctttactttattcaagatatggagatcctggggaaagtaacaacacatgagctcaaggagggaggggaaagcattcgggtcaccgaagagaacaaggaagagtacattatgctccttactgactggaggttcacgagaggggtcgaggagcagacaaaagcctttctggacggcttcaatgaagtggccccgctggaatggctgaggtacttcgatgagaaggaacttgagctgatgctttgcgggatgcaagaaatcgatatgagtgattggcagaagtctacgatatatcgccattacacaaagaactctaagcagatccagtggttctggcaagtggtgaaggagatggacaacgagaaaaggattcggctcctgcaatttgttaccgggacgtgtagactgccagtaggtggctttgcggagttgatagggtccaatggcccacagaagttttgcattgataaagttggtaaggagacgtggttaccacgctctcacacttgtttcaaccggttggacctgccaccttacaagtcctacgagcagctgcgagagaaactgctttacgccatcgaggagacagaaggtttcggacaggagtag

SEQ ID NO: 140782 - DNA, 2274 bp, Artificial Sequence
  Description of Artificial Sequence: Synthetic coding sequence
atggagaatatgcagcttactctgaatttgcagaccgaaaacaagggctctgtagtgtcaggtggagagctgacgatctttctggatggaccaaccgtcgatctgggtaacgttccaaacggttccgccctgacggacggatctcagctgccgagtcgcgatagtagtggcacagccgttgctccagaaaatagacatcagccaccctcgactaattgctttggaggacggagtcgcactcacaggcattctggagctagtgcacggactacccccgctacgggtgaacagtctccgggcgcgcgtagccgccaccggcagcctgtgaaaaacagcggccacagtgggctggcaaatggcaccgttaatgatgagcctacaacagcaaccgacccagaagagccttcggtagttggggtcacatccccgcccgccgctcctctgagcgtcacacctaaccctaatacaaccagcctccctgcccccgccacaccggccgagggggaggagccgtccactagcggaacccagcagctaccagcagcagcacaggctccagacgccctgcctgcaggctgggaacagagggagctcccaaatggccgcgtgtactatgtcgatcataatacaaagaccactacttgggaacgcccactcccgcccggttgggaaaaacgcaccgaccctcggggccggttctattatgttgaccacaatactagaactactacctggcagaggccaacagccgagtatgtccggaactatgagcaatggcagtcccagagaaaccagctccagggagccatgcagcacttctcacaacgcttcctgtaccagtctagctcggcatctacggatcacgacccactgggccctctccctccgggctgggagaagagacaagataatggcagggtgtactacgttaaccacaacactcgcacaacccagtgggaagatcctcgtacacaaggaatgatccaggagcctgccctgcctcctggctgggagatgaaatacacttccgagggagtaagatatttcgtagaccacaataccagaaccacaacgtttaaggatccgcggcccggcttcgaatcaggtaccaaacaggggtcccccggcgcctatgaccgaagttttagatggaaataccaccaatttcggtttctttgccactctaatgccctgcctagtcacgttaaaatatcagtgtcccgccagacgcttttcgaagactcatttcagcagataatgaacatgaaaccctacgatctgagacgcagactgtacatcattatgagaggcgaagagggccttgactatggtggaatcgcccgcgaatggttttttctgcttagccatgaggtgctcaatccaatgtactgcctctttgaatacgccgggaagaataactactgcttgcagatcaatccagcaagtagcattaatcccgaccacctcacgtacttccgattcatcggcaggtttattgctatggccctctatcacggtaagtttattgacacaggctttacactgccattttataaacgcatgctgaataaaagacccactctgaaggaccttgaatccattgacccagagttttataacagcatcgtgtggattaaggagaataaccttgaggaatgcggcttggaactctactttattcaagacatggagattctggggaaggtgacaacccacgaacttaaagagggcggcgagtccatccgtgtcacagaagaaaacaaagaggaatatattatgctccttacagattggaggttcactcgcggcgtagaggaacagaccaaagccttccttgacggattcaatgaggtcgctcctctggaatggttaaggtattttgacgaaaaagaactggagcttatgctatgtggcatgcaggagattgatatgagcgactggcagaagagcactatctatcggcactacacaaaaaactctaagcagatccagtggttttggcaggtggtgaaagagatggataatgagaagaggatcaggctgctgcaattcgtgactggaacctgtcgcttgccggtggggggcttcgccgagctgattggttcaaatggccctcagaagttctgtatcgataaagtgggaaaagaaacttggttgccaagatcccatacctgcttcaacaggctcgatcttcctccctataaatcttatgaacagttgcgcgaaaaattgctgtacgcaatagaggagactgaaggctttggccaggaatag

SEQ ID NO: 140783 - DNA, 1029 bp, Artificial Sequence
  Description of Artificial Sequence: Synthetic coding sequence
atgatacaagagcctgcgctaccaccaggatgggagatgaaatacactagtgagggcgtaaggtatttcgtcgaccataacacccggacaactacattcaaggatcctaggcccggcttcgagagcggtaccaaacaaggcagccccggggcatacgaccggagcttcaggtggaaatatcatcaatttcgattcctgtgccattctaatgccctcccatcccatgtgaagatttccgtctcacgccaaaccctgtttgaagactcttttcaacagatcatgaatatgaagccctacgaccttcggcggaggttgtacattatcatgcggggggaggagggtcttgattacggagggatagctcgtgagtggttttttttactgtcccatgaagtgctcaatccaatgtactgcctgtttgagtatgcggggaagaacaactattgcctccagataaacccggcaagcagcataaatcccgatcacctgacctacttcaggttcatagggcgatttatcgccatggccctgtatcatggtaaattcattgacacaggcttcaccttacctttctacaaacgcatgctgaataagcggcccacactaaaagatctggaatccattgaccctgagttttataactcaattgtgtggatcaaagagaacaacctggaggagtgtggcctggagctgtattttatccaggacatggagattctgggaaaggttaccacccatgaactgaaggagggaggcgagagtattagagttacggaagaaaacaaagaagagtatattatgctgctaactgactggcgctttactaggggggtggaggagcaaactaaggctttcttggatggattcaacgaggtggcgcctttagagtggctccgctattttgatgaaaaagagcttgaacttatgctctgcgggatgcaggagatagatgccacaggacgacgcgcgcctagtaccgggaccactccacgaactgcctcgagaagcagtggttccggtaggtggtag

SEQ ID NO: 140784 - DNA, 1296 bp, Artificial Sequence
  Description of Artificial Sequence: Synthetic coding sequence
atgatccaggaacccgcgttgcctccaggctgggagatgaagtatacttctgaaggtgtacgttactttgtggaccataacacccgaaccacaacattcaaagaccccagacctggcttcgagagcggcaccaaacaagggtctccaggagcttacgataggtccttccggtggaaataccatcaattcagattcctctgccacagtaacgccttgccctcccatgtcaagatctccgtctcgcgccaaaccctctttgaggattcgttccagcagattatgaacatgaagccctacgatctacgccgcaggttatacattatcatgcgaggagaggagggcctagactatgggggcatcgccagggaatggttcttcttgttaagccacgaggtgcttaatcctatgtactgcttgttcgagtacgctggtaagaacaattactgtctgcagatcaatcctgcctcgtccataaaccctgaccaccttacctatttccggttcatcgggaggttcattgcgatggccctataccacggaaagtttatcgacaccggtttcaccctgccattctacaaacggatgttgaacaaaaggccaaccctaaaagacctggaatccatcgaccctgaattctataattctatcgtgtggatcaaagagaataacctggaagagtgtggcctggagctttacttcatccaggacatggaaattctgggcaaggtcaccacccacgaactgaaagagggcggggaatcaatacgtgttacagaagagaataaagaggaatacattatgcttctcaccgactggagattcacgagaggagtggaagaacagactaaagctttcctcgatgggttcaatgaagttgcgcccttggaatggctgcgctactttgatgagaaggagttagagctgatgctatgcggaatgcaggaaattgacatgtcggactggcaaaagagcacgatttacagacattacacgaaaaactcaaagcagatccagtggttctggcaagtagtgaaggagatggataacgaaaagcgcattcgactgctgcagttcgtgaccggcacatgtcggctccctgtgggcgggttcgccgagcttatcggctctaatggccctcagaagttctgcatcgataaagttggaaaggagacgtggctgccaagaagccacacttgctttaacaggctggacctacccccgtacaaatcttatgagcagctccgagaaaaactcttatatgccatcgaggagaccgaaggctttgggcaggagtag

SEQ ID NO: 140785 - DNA, 1008 bp, Artificial Sequence
  Description of Artificial Sequence: Synthetic coding sequence
atggcgagcgcaagctcgagtcgcgcaggcgttgctctgcccttcgagaagtcccagctaacccttaaggtcgtctcagccaaaccaaaggtgcacaatcggcagcctaggattaactcctatgtcgaagtagccgttgatggactcccatcggagacaaaaaaaaccgggaagcggattggcagtagcgaacttctgtggaacgagataattatcctgaatgtgaccgcccagtcacacttagacctgaaggtttggtcctgccacactttgcgaaacgaactgctcggaaccgcatctgtaaacctttctaacgtgttgaagaataacggaggcaagatggagaatatgcagctcacactgaacctgcaaaccgagaacaagggcagcgtcgtttcaggaggcgaactaacgatctttcttgatgggcccaccgtggaccttggtaatgtgcccaacggatctgctttgacagacggatctcagctcccctcgagagattcctcagggaccgctgtcgcccccgaaaacaggcatcagcctcctagtactaactgcttcgggggaagaagcagaacacaccggcattccggcgcctcagcccgcactacccctgccacgggcgagcagagtcctggggctcgctcccggcacaggcagcccgtcaagaattctggccactcaggcctcgcaaacgggaccgtgaatgatgaacctactacagctacagaccctgaggagccatctgtggtcggcgtgacctcaccacccgccgcccccctgtccgtgactcccaaccccaacaccacatcgctacctgctccagccacgcctgctgaaggcgaggaaccgtctactagcggcacccagcagctccccgcagctgctcaggctcccgatgctctgcccgcaggctgggaacagcgcgaactacccaacgggagggtgtactatgtggaccataacacaaagacgaccacctgggaaaggcctctgccacctgggtag

SEQ ID NO: 140786 - DNA, 210 bp, Artificial Sequence
  Description of Artificial Sequence: Synthetic coding sequence
atggagtctcctaagaaaaaaaatcagcagctcaaagtcggcatattgcacctgggatcccgccaaaaaaagatcaggatccaactgcgttctcaagtgctgggcagggaaatgagagacatggagggggacctccaggagcttcaccagagcaatactggcgataaatctgggtttgggtttcgccgccaaggtgaggataatacatag

SEQ ID NO: 140787 - DNA, 246 bp, Artificial Sequence
  Description of Artificial Sequence: Synthetic coding sequence
atggagtcgcctaaaaagaagaaccagcagctcaaggtgggaatcttacacctggggtctagacagaagaagattcgcatccagctccgtagtcagtgtgccacgtggaaggtcatttgcaagagttgcatttcgcaaactcctggtattaatctggacctgggcagtggagtcaaggtgaaaatcatacccaaagaagagcactgcaagatgccagaggcgggtgaagagcagccgcaggtctag

SEQ ID NO: 140788 - DNA, 441 bp, Artificial Sequence
  Description of Artificial Sequence: Synthetic coding sequence
atgctgttgtggtgcccacctcaatgtgcctgctcccttggcgtgtttccatccgcaccatcaccagtctgggggacaaggaggagctgtgaaccggctactagggtgcctgaggtatggatcttatcgccactcctgcgtcacggcggccacacccaaacccagaaccacacagcttccccccggtcccctgttatggagtctccaaagaagaagaaccagcagctaaaggtcggcattttgcaccttggctccaggcaaaaaaaaatcagaattcagctgagaagtcagtgtgcgacctggaaagtaatttgcaaatcttgcatctcacaaacacctgggatcaatctggatctgggctccggagtaaaggtgaagattattcctaaagaggagcactgcaagatgcccgaggccggcgaagaacagcctcaggtatag

SEQ ID NO: 140789 - DNA, 210 bp, Artificial Sequence
  Description of Artificial Sequence: Synthetic coding sequence
atggagagcccaaagaagaaaaatcagcagttaaaagtcgggatcctgcacctgggcagccggcagaagaaaatccggattcagcttaggtctcaagtccttggaagagagatgagggatatggagggcgaccttcaggagctacaccagtcgaacaccggggataaatctggatttggcttccgacggcagggggaagacaatacatag

SEQ ID NO: 140790 - DNA, 210 bp, Artificial Sequence
  Description of Artificial Sequence: Synthetic coding sequence
atggaatccccaaaaaagaagaatcaacaattaaaagttggcatcctgcatctgggctcgagacagaagaaaataagaattcagctgcggtcccaggtgctgggaagagagatgcgagacatggagggagacctccaagagctgcaccagagcaacactggggacaagtctggcttcggttttcggcgtcagggggaagataacacctag

SEQ ID NO: 140791 - DNA, 246 bp, Artificial Sequence
  Description of Artificial Sequence: Synthetic coding sequence
atggaatctcccaagaagaagaaccagcagcttaaagtgggtattctgcatctggggtctcggcaaaaaaaaatcagaattcagcttcgtagtcagtgcgccacttggaaagttatttgtaagtcctgtatttctcagactccagggataaacctcgatcttggcagcggcgtcaaggtgaaaattataccaaaagaggaacactgtaagatgccagaggccggggaggaacagcctcaggtgtag

SEQ ID NO: 140792 - DNA, 210 bp, Artificial Sequence
  Description of Artificial Sequence: Synthetic coding sequence
atggaatcccccaagaaaaaaaaccaacagcttaaggtggggatcctgcaccttggttcccggcaaaaaaaaatccgcatccaactacgtagtcaagtgctgggaagggagatgagagacatggaaggggacttacaggagctacatcagagcaacacaggggataaatcaggttttggctttaggagacaaggcgaggacaacacgtag

SEQ ID NO: 140793 - DNA, 441 bp, Artificial Sequence
  Description of Artificial Sequence: Synthetic coding sequence
atgctgctgtggtgcccacctcagtgcgcatgctcgttaggggtttttccaagtgctccaagcccggtttggggcactcggcgttcttgcgaacccgccacaagggtgcctgaggtttggatcctgtcccccctactcagacatggtggacatactcagacacagaatcacaccgcctcacctagaagcccggtaatggagtctcctaagaaaaagaaccagcaactgaaggttggaatcctgcacttggggtctagacagaaaaagatcagaatccagttgagatctcagtgtgcgacttggaaggtcatatgtaaatcatgcatctctcagacaccaggcataaatctcgacctcgggtcaggggtcaaagtgaaaataataccaaaggaagagcattgcaagatgccagaggccggagaagagcagccccaggtgtag

SEQ ID NO: 140794 - DNA, 246 bp, Artificial Sequence
  Description of Artificial Sequence: Synthetic coding sequence
atggagtcgccaaagaaaaagaaccaacagctgaaagtgggcatcctgcacctgggcagccggcaaaaaaagatccgaatacagttgcggtcacagtgcgcaacttggaaagtcatttgcaagtcttgtatctcgcagacccccggtatcaatctcgatttaggttctggagtaaaagttaagatcatcccaaaggaggaacactgcaaaatgccagaagcaggagaggaacaaccccaggtgtag

SEQ ID NO: 140795 - DNA, 210 bp, Artificial Sequence
  Description of Artificial Sequence: Synthetic coding sequence
atggaaagcccaaagaagaaaaaccagcagctgaaagtgggtatcttacacctaggcagcaggcaaaagaaaatcagaatccagctgagatcccaggtcctggggcgcgagatgcgggacatggagggtgacttacaggaactgcaccaatccaacacaggggacaagagtggctttgggtttcgccggcagggagaggataacacgtag

SEQ ID NO: 140796 - DNA, 246 bp, Artificial Sequence
  Description of Artificial Sequence: Synthetic coding sequence
atggaaagtccaaaaaaaaagaaccagcagttaaaggtgggaatccttcatctcggatctagacagaagaagatcagaattcagttaagatcccaatgtgccacatggaaggtgatctgtaagtcctgcatttcccagacaccaggcattaacctcgatcttggatccggagtcaaagtcaagattatccctaaagaagagcactgtaagatgcctgaagcaggcgaggagcagccacaggtttag

SEQ ID NO: 140797 - DNA, 441 bp, Artificial Sequence
  Description of Artificial Sequence: Synthetic coding sequence
atgttactctggtgtccccctcaatgtgcctgctctctgggcgtcttcccttctgcgccatccccagtctggggtacgcgaagaagctgtgagccagccacacgagtgcctgaggtctggatcttgtcacctcttttgagacacggcggacacacacaaacacaaaaccataccgcatcaccacgttcacccgttatggagtctccgaagaagaaaaaccagcagctgaaggtggggatcttgcacctgggctccaggcagaaaaagatccgtattcagcttcggtcccagtgcgccacatggaaggtaatctgcaaaagctgtatcagccagacacccggaattaacctcgacctggggagcggcgtgaaggtgaaaattattcccaaagaggagcattgcaaaatgccagaagccggcgaggaacaaccacaggtgtag

SEQ ID NO: 140798 - DNA, 210 bp, Artificial Sequence
  Description of Artificial Sequence: Synthetic coding sequence
atggagtctccgaagaagaagaaccagcagctgaaagtgggtatcctgcacctggggtcccgtcagaaaaaaattagaattcagttacgcagtcaggtgctcgggcgggaaatgagggatatggagggcgatctccaggagctacaccagtcaaacaccggtgataaaagcggctttggatttcggcggcagggggaagataacacgtag

SEQ ID NO: 140799 - DNA, 210 bp, Artificial Sequence
  Description of Artificial Sequence: Synthetic coding sequence
atggagtccccaaagaaaaagaaccagcagcttaaagtgggcatcctgcatctaggctcccggcagaagaaaatcagaatccagcttagaagccaggtgctgggcagagagatgcgggatatggagggagacctccaagagctccatcagtcaaacaccggggataaaagtggcttcgggtttaggagacagggcgaagataacacttag

SEQ ID NO: 140800 - DNA, 246 bp, Artificial Sequence
  Description of Artificial Sequence: Synthetic coding sequence
atggagtcccctaagaagaagaaccaacagctgaaggttggcattctgcacctcggcagtagacagaagaagatccgcatccagctgcggagtcagtgcgcgacgtggaaggtcatctgcaagtcgtgtataagccaaacacccggtattaacctcgacctgggatctggagttaaagttaaaataatacccaaagaggagcactgtaaaatgcctgaagccggcgaggaacagccccaggtttag

SEQ ID NO: 140801 - DNA, 441 bp, Artificial Sequence
  Description of Artificial Sequence: Synthetic coding sequence
atgctactgtggtgtccaccacagtgcgcgtgttctcttggtgtcttcccatccgctccatcacccgtgtggggtacccggagaagttgtgagcccgcaactcgcgtcccggaggtatggatcctttcccccctgcttagacacgggggacatactcagactcagaatcacaccgcctcccccagaagtcccgtgatggaatcacccaagaaaaaaaatcagcagctcaaggtcggcatcctgcatctcggctcccgacagaagaagatccggatccagttgagatcacaatgcgcgacctggaaggtaatctgtaagtcttgcatctctcaaacaccaggcatcaacctggacttgggtagcggggtcaaggtaaagatcattcccaaagaggaacactgcaaaatgcctgaggctggtgaggaacagcctcaggtgtag

SEQ ID NO: 140802 - DNA, 336 bp, Artificial Sequence
  Description of Artificial Sequence: Synthetic coding sequence
atgatttggcgcggccgatccacatatcgtccacgaccaagaaggtctgtgcctccaccagaactcattgggccgatgctggagcccggtgatgaggaacctcagcaagaggagccccctacagagtccagggaccccgcaccaggccaggaacgcgaggaagaccagggagccgccgaaacacaggttcctgacctggaggccgaccttcaggagctctctcagagtaaaaccggaggcgaatgcggcaacggccccgatgatcaaggcaagattctgccaaagtccgaacagtttaagatgcctgaggggggcgatcgtcagccccaggtgtag

SEQ ID NO: 140803 - DNA, 336 bp, Artificial Sequence
  Description of Artificial Sequence: Synthetic coding sequence
atgatatggcggggacgttctacttatcgtccgcgccccagacgatccgtccctccaccagaactcattggcccaatgctcgaacccggcgatgaagaacctcaacaagaagagccaccaactgagagtcgagacccagcccccgggcaggaaagggaggaggaccagggggccgccgaaacacaggtaccggacttggaggccgacctgcaggagctcagtcagagcaaaaccggcggcgagtgcggcaatggccctgacgaccagggcaagatccttccaaaatcagaacaatttaaaatgccagaagggggcgatcgtcagccgcaggtttag

SEQ ID NO: 140804 - DNA, 4002 bp, Artificial Sequence
  Description of Artificial Sequence: Synthetic coding sequence
atgacagccgataaactagtgtttttcgtgaacggacgcaaagtggtggagaagaatgccgatccagagactacgctactcgcctacttaagaaggaaactgggcctgtcaggcacgaagctcggctgcggggagggcggctgtggggcgtgcacggtcatgttgtctaagtacgaccgtctgcagaacaaaatcgtacatttttctgcaaacgcctgcctggcacccatttgtagtctgcaccacgttgctgtcacgaccgttgaggggattggctcgaccaagacccggttgcaccccgtccaagagaggatcgccaagagccacggatcccagtgcggcttttgtacacccgggatcgtgatgtcaatgtatacacttcttcgaaaccagcctgaacccaccatggaagagatagaaaacgcctttcagggcaatttatgtagatgtaccggctatcggcccattctgcaggggttccgcacatttgcgcgggacggaggctgctgcgggggagacggcaacaaccctaattgttgcatgaaccagaaaaaagaccactctgtgtctctaagccccagcctgtttaaaccagaggaattcactccattggaccccacgcaggaaccgatcttccctccagagcttctgcgtttgaaggacacaccccgcaagcagctgagattcgaaggggagagggtcacctggatccaggcatctacactgaaggaactgttagacctaaaagctcagcaccctgacgctaaactggtcgtcggaaacaccgagatcgggatcgagatgaaatttaagaatatgctgtttcctatgatcgtgtgccctgcgtggataccagagttaaatagcgttgagcacgggcccgatggcatctcttttggagcggcgtgcccactcagcatcgtcgaaaagacgctggttgatgcagtggccaagctacccgcccagaagaccgaggttttcagaggagtcctggagcagcttagatggttcgccgggaaacaagtgaagagtgtggcctctgtgggggggaatatcattaccgctagtccaatctccgacctgaatcctgtatttatggcctcgggagcaaagctcacccttgtgagtcgcggcacaagaagaaccgtacagatggaccatactttcttccccggctacaggaagacactactgagtcccgaggagatactgctgtccattgagatcccatactcgcgagagggcgagtattttagcgcttttaagcaggctagcagaagggaggatgacatcgcaaaggtgacttcagggatgcgcgtcctgttcaaacccggtactacagaggtccaggaactggctctctgttatggtggcatggccaatcggactatcagcgcgctaaagactacacagcggcagctaagtaagctgtggaaagaggagctcctccaggacgtgtgtgccgggctggccgaagagctgcacctgcctcctgatgccccaggcggcatggttgatttcaggtgcactcttactctgagtttcttttttaagttttatctgacggtgttacaaaagctggggcaggaaaacctggaagataagtgtggcaagctggaccccactttcgcctccgcgacgctgttattccagaaggatccccccgccgatgtccagctattccaagaggttccaaagggccagagtgaagaggacatggtcggaaggcccttaccccacctggccgcagacatgcaagccagtggagaggcagtgtattgtgatgacatccccaggtacgagaacgaactgtctctgagactcgtgactagcacgagagcccacgcgaagatcaaatcaatcgacacttcagaagccaaaaaggtgcccggttttgtctgcttcatatccgccgatgacgttccagggtcgaatattaccggaatctgcaacgatgaaaccgtcttcgcaaaggacaaggtcacttgtgtgggacatatcatcggagccgtagttgcagacacgccagagcacacacagagggctgcccaaggcgtaaagataacctacgaagagctcccggcaattataacgatcgaggatgcaatcaagaataatagcttttatggcccggagctcaaaattgagaaaggcgatctgaaaaagggcttcagcgaggccgataatgtggtctcaggcgaaatttacataggcggtcaggaacacttctatttggagacccattgtaccattgcagtacctaagggcgaagcaggcgagatggaactattcgtgtctactcagaacacaatgaaaacccagtcctttgtagctaagatgctcggtgtgcccgctaaccggattgtagtacgcgtgaagcgcatgggaggtggatttgggggaaaggagacccggagcacggttgtgtccacagccgtcgccctggcagcctacaaaacgggccgccctgtgagatgcatgctcgacagggacgaagacatgctcatcacgggaggtcgccacccattcttggcccgatacaaagtgggctttatgaagaccggcactgtagtggcgctcgaagtggatcacttctctaacgtgggcaacacccaggatctcagccagtctattatggaaagggcgctctttcatatggacaactgttataagatcccaaatatccgtggaacaggacgactttgtaagactaaccttcccagtaatacagctttcagaggattcggaggcccccaggggatgcttatcgcagaatgctggatgtctgaagtcgcagtgacatgtggtatgcccgcggaggaggtgcggcggaagaatctatacaaggagggggacctgactcactttaatcagaagttggagggcttcacactgcctcgctgttgggaagaatgcctcgccagcagccagtatcacgcaaggaaatctgaagttgataagttcaataaagaaaactgctggaagaagcgcggtctgtgtattattccaactaagttcggcatctcgttcacagtgcccttcctgaaccaggccggcgcactgctgcacgtttataccgatgggagcgtgctgctcacacatggagggacagaaatgggacaggggctgcacactaagatggtgcaggtagcaagcagggctctcaaaattccaacatcaaagatctacatttcggagactagcaccaatacagtgcctaacacatcgcctaccgctgcgtcagtgtcggccgatctcaatgggcaggccgtgtatgcagcctgccagaccattttaaagaggctggagccctacaagaagaagaacccctccggctcatgggaggactgggtgactgcagcctacatggacacagtgagccttagcgctactggattttaccggacccccaatctcggatacagtttcgagactaattctggcaatccattccactattttagctatggcgttgcctgctctgaggtggagattgattgcctgacaggcgaccacaagaacctaaggaccgacatcgtgatggatgttggcagtagcctcaaccccgccatagatatagggcaggtagagggagccttcgtccagggcttagggttatttaccctggaagagcttcactattcgccggaagggtccttacatacacgaggaccatcaacctataagatccccgcctttgggtccatccccatcgagtttagagtgtctctgttgagggactgccccaacaagaaagccatctatgcaagcaaggctgtgggtgaacctccactgttcttggcagcaagtatctttttcgcaatcaaagacgctattcgagccgctcgtgctcagcatactggtaacaacgtcaaagagctgtttcgtctcgactcccccgcgacccctgagaagatacggaatgcatgcgtggacaagttcaccaccctgtgtgtgacgggagttcctgagaattgtaagccctggtccgtccgtgtttag

SEQ ID NO: 140805 - DNA, 1896 bp, Artificial Sequence
  Description of Artificial Sequence: Synthetic coding sequence
atgaagtttgcggagcatctatccgcgcacatcaccccggaatggaggaaacaatacatccagtacgaagcctttaaggatatgctgtattctgcacaagatcaagcgccttccgtggaagtgaccgatgaggatacagtgaaaaggtactttgccaagtttgaggagaaattctttcaaacgtgcgagaaggaactggccaaaataaatactttctatagcgagaagctggctgaagcccagcgacgtttcgcgacactgcagaacgaactgcagagtagcctcgacgctcaaaaggaaagtactggcgtgactactctgaggcagcgccgaaagccagtgtttcacctgtcccatgaagaaagagttcagcataggaatattaaggatctgaagttggcattctcagagttttatctgagcctcatcctactgcagaattaccagaaccttaatttcactggatttcggaagatactgaagaaacatgataagattttggaaaccagccggggtgccgactggcgcgtggcccacgttgaagtggcgcccttctacacatgtaaaaagattaatcagctgattagtgagaccgaggcggtggtcaccaacgaactcgaagacggggataggcaaaaggccatgaagaggctgcgggtcccgcccctcggggccgcccagccggcgccagcctggacaacattccgcgtgggactgttctgtggcatctttatcgtattgaatatcactctcgtccttgcagccgtgtttaaactggagactgaccggagcatctggccccttatccggatctatcgcggcggctttttgctcatcgagttcctatttctccttggcatcaacacctacggatggagacaggccggggtcaatcacgtcctgattttcgaactaaacccgcgtagtaatttaagtcaccagcacttgtttgaaattgctggattcctgggtattctctggtgtctctctctgctggcttgtttcttcgcaccgattagcgtgatacctacatacgtttacccacttgccctgtacgggttcatggtcttcttcctcattaatccaacaaagaccttttactacaaatccagattttggcttcttaagctgttgtttagggttttcactgcccctttccacaaggtgggcttcgcagatttttggttggcggatcagcttaattccctgagtgtgattctcatggacctggaatatatgatctgtttttattccctggaactaaagtgggacgaaagtaaaggtctgcttcccaataattctgaagaacgcggtcactccgataccatggtcttcttctacctttggattgtgttctacattatctctagctgttataccctcatctgggacctaaagatggattgggggctgttcgataagaatgcaggggagaacaccttcctgcgcgaggaaatcgtgtaccctcaaaaagcatactattactgcgctatcatcgaggacgtgatcctgagatttgcctggactattcagatctcaattacctctacaacactgctccctcattccggcgatattatcgctaccgtttttgcgccgttagaggttttccgtcggtttgtgtggaacttcttcaggttggaaaatgaacatctaaacaattgtggtgaattcagggcggtgcgagatattagtgtagcccccctgaacgctgacgaccaaactctactggagcagatgatggatcaggacgatggagtacgtaatcgccagaagaaccgcagctggaagtataaccagtctatttctctgagacgaccacgtctggcctcccagtccaaggcccgagataccaaggtactgattgaagatactgatgacgaggcgaatacctag

SEQ ID NO: 140806 - DNA, 2091 bp, Artificial Sequence
  Description of Artificial Sequence: Synthetic coding sequence
atgaagtttgccgagcatttgtcagcacacataacgcctgagtggcggaagcagtatatccagtacgaggcgtttaaagatatgttatacagcgcccaggatcaagccccgagcgtggaagtgactgacgaagatacagtgaaaaggtatttcgccaagtttgaagaaaaattcttccagacttgtgaaaaagaactggccaagatcaataccttctactctgagaaattagctgaggctcaaaggagatttgcaacactacagaatgagttgcagagctcactcgacgcccagaaggagagcacaggggtgaccaccctacggcagcgccgcaagcctgtttttcacctgtcccacgaggaaagagtgcaacatagaaatattaaagacctgaaactagcctttagtgagttctatctctcactgatcctcctgcagaattaccagaacctgaacttcacaggcttccggaagattctcaaaaagcatgacaaaattctggaaaccagtaggggggctgactggcgcgtcgcacacgtagaagtggcacccttttacacttgcaaaaagataaaccagctgatttctgagactgaggcagttgttactaatgagcttgaggacggcgatcgccaaaaagctatgaagcgactgcgggtgcccccactgggtgcggcccagcccgcccccgcgtggacaacctttcgagtgggcctcttttgtgggatctttatagtcttgaatattacgctcgtgcttgcggctgtgttcaagctggaaaccgatcggagcatttggcccttgatccgtatataccgcggtggtttcctgctgattgagtttctgtttctcttgggtatcaatacctatgggtggaggcaggctggtgtgaatcatgttttaatatttgaactgaatccacggagtaatctctcgcatcaacacctgttcgagattgcaggatttctgggcattctgtggtgtctctctctgctcgcctgtttttttgcccctatatcagtcatacccacatacgtgtacccattggctctctacggtttcatggttttcttccttatcaatccaacaaaaaccttttactataagagtagattctggctcctcaaacttctgttccgtgtattcaccgcaccctttcacaaagttggcttcgccgatttctggctggcggaccagctgaactctctttcagtgatactcatggaccttgaatatatgatctgtttctacagcttagagttgaaatgggatgagagcaaggggctgttgccgaacaacagcgaagagagcggaatctgccacaaatacacatatggtgttagggcgatcgtccagtgtatccctgcatggttaaggttcattcaatgtcttagacgttatcgggatacgaaacgtgccttccctcacctggttaacgccggcaagtacagcacaaccttcttcatggtaactttcgccgccctctacagtactcacaaggagagagggcactctgatacgatggtgttcttttacctgtggatagtcttttacattatttccagctgttatacattgatttgggatctaaagatggattggggactgtttgataagaacgcgggagagaacacattcttgagagaagagattgtgtatccacagaaggcctactattattgcgccattatcgaagatgtcatccttcgttttgcttggacaatccagatatcaataacaagcacaacattgctgccccactctggggatatcatcgccaccgtctttgcaccactggaggtttttcgccggttcgtttggaatttttttcgacttgagaatgaacacctgaacaactgcggagagttccgagcagtgagggatattagtgtggctcctctgaacgcggatgaccagacactgttggagcaaatgatggaccaagacgatggcgtgcgaaaccgccagaaaaaccggagctggaagtataatcagagcataagcctcaggagacctaggctcgcatcacagtcgaaggccagagatacgaaggttcttatagaggacactgacgatgaagcgaacacctag

SEQ ID NO: 140807 - DNA, 543 bp, Artificial Sequence
  Description of Artificial Sequence: Synthetic coding sequence
atggagagctggtgggggttaccttgtctggctttcctgtgttttctcatgcacgctaggggacagcgcgatttcgacttggccgacgcgttggatgaccccgagccaactaagaaacctaactccgacatctatcctaaacccaaacccccctattacccccaacccgagaatcctgattccggaggtaatatttatcccaggcccaaacccagaccgcagccacaacccgggaacagcggtaattccgggggatattttaatgacgtcgacagggacgacggccggtacccaccccgtcctaggcctaggccaccggccggcggcggtggcggtggctatagttcttacggtaatagtgacaacacacacgggggcgaccaccactcgacgtacggtaatccggaaggaaatatggtagcaaagattgtgtcacccatcgtgagtgtcgtcgtcgtaaccctcctcggcgctgccgctagttactttaagctcaataaccggcggaactgcttccggacccacgaaccggagaacgtatag

SEQ ID NO: 140808 - DNA, 588 bp, Artificial Sequence
  Description of Artificial Sequence: Synthetic coding sequence
atggaatcctggtgggggctgccttgcctcgcctttctgtgctttctgatgcacgctcgaggccagcgcgattttgatctcgctgacgcactggatgaccccgagcctactaagaagcccaacagcgacatctacccaaagccaaaacccccatattacccgcaaccagagaatccagactccgggggaaacatctatccgcggccaaaaccaagaccacagccgcagccaggtaatagtggaaactccggtggatatttcaacgacgtagaccgagacgacggtcgctaccctccgcgtcccaggccccgaccaccagcaggcggggggggtggtgggtattccagctatggtaatagcgacaacacacatggccgggggggctaccgtctgaattcgagatacggaaatacttacggtggtgatcaccactctacatatggcaatcccgagggaaatatggtggccaaaatcgtgagtcccatcgtgtccgtagtagtggttacactgctgggtgctgccgcgtcctacttcaaattaaataataggagaaactgttttcgaactcacgagccagagaatgtttag

SEQ ID NO: 140809 - DNA, 546 bp, Artificial Sequence
  Description of Artificial Sequence: Synthetic coding sequence
atggagagctggtggggcttgccgtgcttggcctttctatgttttctgatgcacgctcgaggccagagagacttcgacctggcagacgctttggatgatccggagcccactaaaaaaccaaacagtgatatttacccaaagccgaagcccccatactacccgcagcctgaaaaccctgactccggcggcaacatctatcctaggccaaagcctcgaccgcaacctcagcctggaaactccggaaattctgggggctcttatttcaatgatgttgaccgcgatgacggcaggtatccgccacggcccaggccccgccctcccgccggggggggaggcggaggctacagcagttatggaaatagtgacaacacacacggaggtgaccatcacagtacttatggtaatcccgaaggcaacatggttgcaaaaatagtgagtcctatcgttagtgtggtggtagtgaccttactcggtgccgccgcctcatactttaaattaaataaccgcagaaattgctttagaacccacgagcctgaaaatgtctag

SEQ ID NO: 140810 - DNA, 129 bp, Artificial Sequence
  Description of Artificial Sequence: Synthetic coding sequence
atggtggctaagattgtgtctcctatagtcagcgtggtggtcgtcaccctgttaggagccgccgctagctatttcaagctcaataatcgccgcaattgcttccgaacacacgagcctgagaatgtctag

SEQ ID NO: 140811 - DNA, 10650 bp, Artificial Sequence
  Description of Artificial Sequence: Synthetic coding sequence
atgtttcctatgcaaaaggggagtctgaacctgctccgtcagaagtgggagtcctgcgattatcagcgctctgaatgccatccccgcgactcccactgcactatttttcagcctcaggaaagtaagcttttggctcccgagggagaagttgtgtccgcaccccaaagtttggacccgacgtctctgccatattcgaccggagaagaaatgtggtcgagcaaacccgaggagaaggattctgttgacaagtccaataatacccgggagtatggacgtcccgaagtcctcaaggaggactctctgtcttcaaggcgcaggattgagagattttctatagccctggacgagcttcgatccgtcttcgaggctcctaagtctggcaataagcccgccgagtacggagggaaggaagtggagatcgagcgcagtctctgttcgcctgctttcaaatcccaccccggctctcagctcgaggactccgtcaaggattccgacaagaaaggcaaagagacttcatttgataaaatgtcccctgaatctggccactcccgaatattcgaggctacggccggacccaataagccggagtcaggctttgcggaggactccgcggcaagaggggagggcgtctcagacctgcatgaggtcgtaagtcttaaagagcgcatggccagatatcaggccgcagtgagtcgcggagattgccgctcattttcagccaatatgatggaggaatcggagatgtgtgccgttcctggcggactggcgaaggtgaaaaagcagtttgaagatgaaatcacatcttctcgcaatacttttgcccagtaccagtaccagcaccaaaataggagcgagcaggaagcgattcactcttctcaggtgggcacttccagaagtagccaagaaatggctcgcaacgagcaggagggcagtaaggtccagaagatcgatgtccatggaacagaaatggtctctcacctcgagaagcacacagaggaggtaaaccaggcctcgcagttccaccagtacgttcaggaaacggtgatcgacacgccagaagatgaggaaattcctaaagttagcacaaagttactgaaggagcagttcgagaagtccgcccaggagaaaattttgtactctgacaaagagatgactactccggccaaacagattaagacggagagcgagtatgaggagacttttaaaccatcttcagttgtgtccacatcatccactagttgcgtatctacatcgcagcgcaaggagacatctactacccggtacagcgatcattccgtgacgagcagcacactggctcagattaacgcgacctctagcgggatgacggaagagtttccaccacccccacccgatgtgctgcaaacctcagtggatgtgacggctttctctcagtcacccgaactgccttcccctcctaggcggcttccagtcccaaaggatgtgtattctaaacagcgaaacctgtacgaactgaaccgtctctataaacatatacatccggagcttcgcaaaaacctggagaaggactacatctccgaggtatctgagattgtaagttcacagatgaattctggaagttctgtctccgctgacgttcagcaggctaggtacgtatttgaaaataccaatgattcctctcagaaagacttgaacagcgagcgcgagtatctggagtgggacgagatactgaagggagaggtacagagtattcggtggatcttcgaaaaccaacccctagatagtataaacaacggatctcctgacgaaggcgacatttcccgcggaattgctgaccaggagatcatcgcgggaggcgacgtgaagtataccacgtggatgttcgaaacccagcccattgacaccttaggcgcatatagttctgacacagtggaaaacgcagaaaagattcctgaactggccaggggagatgtgtgcaccgctcgctggatgtttgagacgcgcccactggactccatgaataaaatgcaccagagtcaagaggaatccgccgtgaccatttcgaaggacattacaggcggagatgtgaagactgtacgttatatgtttgaaacccagcaccttgatcagttaggtcagctacactccgtggatgaggtgcatcttctgcaactgaggtccgaactgaaggaaattaaagggaacgtgaaacgttctatcaaatgctttgagacacaaccactatatgttattagagatggctctggccagatgctggagatcaagaccgtgcaccgtgaggacgtagagaagggagacgtccgaactgcacgctggatgtttgaaacacagccattggacacaataaacaaggacatcaccgaaatcaaagttgtgaggggaataagcatggaagaaaatgttaagggtggtgtgagtaaggccaagtggctgtttgagacacagccgctggagaagattaaggaatcagaagaagtgattatagaaaaagagaagatcataggcactgatgttagtaggaagtgctggatgttcgagacgcagcctttggatatcctgaaagaggtgcctgacgctgactctttgcagagggaggaaatcattggcggagacgtacaaaccaccaaacacctgtttgagacactacctattgaggctctgaaggattcccccgatattggtaaactgcagaagatcacggcgtccgaagaggaaaaaggggacgtacgtcatcagaagtggatttttgaaacgcagcccctcgaagatattcgtaaagataagaaggagtatacacgcaccgtcaaactggaggaggtcgaccgaggggatgtaaaaaactacacgcacatttttgagagcaacaacctgatcaagttcgatgcttctcacaagatcgaggtggaaggcgtgactagaggcgctgtggaactcaacaagagtctgttcgaaacaaccccgttgtacgctatccaggacccactgggaaagtatcatcaggttaagaccgttcagcaggaggagatcgtgcgaggggacgtgcgcagctgccggtggctttttgagactcgaccaatcgatcagtttgatgagtcgatccacaagtttcaaattatacggggcatcagcgcacaagaaatccaaacaggcaacgtgaaaagcgcaaaatggttgttcgagacgcagcccctggacagcataaaatatttcagcgatgtcgaggaaaccgaaagcaaaaccgaacagacccgggacattgttaaaggggacgtaaaaacctgtaagtggttgttcgaaactcaacccatggagagcctgtatgagaaggtgtcactgatgacatcttcagaggagattcacaaaggcgacgttaagacctgtacctggctcttcgagacccagcctcttgataccatcaaagacgattccgaaactgcggtgaaattgcagacagttaaacaggaggagatacagggcggagatgtcaggactgcctgtttcttgttcgaaacggagaacttagattcgattcaaggggaggaggtcaaggagatcaaacccgtcgaaatggacattcaggccggcgatgtgagctccatgcgttataagttcgagaatcagtctctggatagcatttcatcatcaagcgaggaagtgctgaagaagattaagactctgaagacagaagacattcaaaaggggaatgttctgaactgtcggtggttgtttgagaaccaacccatcgataagatcaaggaatcacaggagggcgacgaatgtgtgaagacggtgaccgatatccagggtggagacgtcagaaagggctgcttcatttttgaaaccttcagcctggatgaaataaaagaagagagtgattatatctccacaaaaaaaactataaccgaggaggtcattcagggcgacgttaagagttatcggatgctctttgagacacaacctctctacgcgattcaggacagagagggaagctatcatgaggtgaccactgtcaaaaaggaggaagtaatacatggcgacgtgagggggactcggtggttgttcgagacgaaaccattagatagtatcaacaagtcagagacagtatatgtaattaagagcgtcacgcaggaggatattcagaagggtgatgtgtcaagcgtgagatatcgctttgaaacacagccactagaccaaatctccgaggaaagccacaatatcatgccctctatagaccatatccaaggagggaatgtgaaaacgagccggcagttttttgaatctgagaattttgacaaaaacaattatatccgaactgtgtccgtcaatgagattcagaagggcaatgtgaagacatccacttggttatttgaaacccacacgatggatgaactgcgaggcgagggcctggaatacgagaacatcaagaccgtgactcaggaggacgttcagaagggcgatgtgaaacaagccgtctggttgttcgagaacagaactttcgacagcatcatggaagctcacaaaggaatcactaaaatgacgaaggaagaaatccctccttcagacgtgaagaccaccacctggctcttcgaaaccacacccctccacgagtttaatgagacaagagtggagaagattgaaatcataggcaagtcaatcaaggagacactcgaggacctgtattctcaaaaggtaatccaggccccaggcatcataattgaagctgacgagatcggcgacgtccgcatggctaagtacaagcttatgaaccaggcaagtcctgagatccagaaagaagagattatacgtgccgatctgagaaatattatggtcaacctgctgtcaaaaagggactgtactgaaagggagatcctcatatcggaggaagagaaaggcaatgtcaacctgaccaagactcaactgcttaatagatctacggagttccatgcagagaaggaggagattgtgaagggcgatgtccagcaggccatcaagaatctcttcagtgaagagcggagtgtcaagaagggcatcctcatccaggaggatgagaaaggcgacattaacatgaccatttactgcctgctccatgaaaacgatggcgatacgattgagcgggaggaagtgataggcggcgacgtgaagcgtactatccacaacctactgagcagtacctctaacaacaagatttccgagcgtgccaagattgacgcatcagaaagggggaacgtccagttttttactacatgcatcgaggctggcgcactggactacctgaagcagctacatactgaatccaatgaaacacttactgcgaagaaacaagagggggagaaagaaatcataggcggcgacgtcgagggcacaaaactactgctcaagaagcggcaaagcctcgtagaacgcacagtttctgagacagatattattcctggcgacgtgcacaacaccgtgaaggttttcatgaccgaaccgcagtccacattcggcaagatccccaaagaggagatcataaagggtgatttaacctcaacattaaacagcctctcacaggctgtcaaccagaagacagtaacaaagactgaggagattataaagggaaacatgctggccacactgaaaagcctgaaggagtctagtcaccggtggaaggaatctaaacagccagacgccattccaggagatattgaaaaggccatcgagtgcctggagaaggccaccaacacaaagaccgagattttaaaaaaggaactgctcaaggatgacttggagacttctctgagaagcctgaaagaagcccagagatctttcaaagaagtccataaagagggcgtaatcaaaaaagatgctaaagccgtaatggcaggctcctcaggagagcagaagaccgatattcatcaggttgcggtccagagaaataagaattctcttctccagccgaaacccggtccatttgagcctgcggccaagtggcagggtggggcagataccctgagccagaccatgggcaagagttgccacggcaacttggtggaggagagaacagaagtcaatctgcctaaagccccgaaaggcaccgtaaagatcgtcatagatcgagagcaaaacaacgacgcattagagaaaagtctgagaaggttaagcaacagtcatcataaatccaacgtgctggagagtggagataaaacaggcgtgtggacagatacaaccggggaacagcatttgcgagacgaatacatgagccgacagctcactagcacggtatccgtgaagaataatctgactacaaaagagtctgatcgggccgtgcgcgagctgaagaaagatgatgtgttcaatagtatccagtccgctggaaagaccgtgggcaaacagcaaacctatgagctgagaaatgatcatcaaaaaatggaaggcttccacatcaagtctcctaagaagactaagaacatcaaaatccttactgacacccaaagttccaagccaagccccacccaacaccctgtctcaatgcccgtaggcggtacctacgacctgagcggggactttcagaagcagacacttctcaaacaggaaacaaaatactcaaataaggatatcaagaaaaagaatattaatctacagcctatgtggcagcttttaccggtcgaacaggacacctccaacgtgacagagatgaaagtgagtgagaaatcgcataatacctttaaggccacgaacaagaaaagggaaaccgatgttcatctcaaaagccaggattttctcatgaaaaccaacacttcaacaggactcaaaatggccatggaacgcagcctgaatcctattaatttcaatcccgaaaacaacgtgaaggagtcagaatgccctctgcctccaccctcccctccccctccacccccatcaaatgccagctccgaaatagaatttcccctgcctcccccgccaccgctaatgatgtttccagagaagaatggctttttaccatccctcagtacagagaagattaaggcagaatttgagtcctttcctggcctacccctaccaccgccccctgtggatgaaaaatcggaacgcgaaagttctagtatgttcctacctccgccgccaccgcccactccatcgcaaaaaccagcacacctgctatctagttcagcccctgagaaacattctggggatttcatgcagcagtactcccagaaggaagcgtccaacagccagaactctcaagcaaagatcatcactggtaagacgggtgttctgccacccccaacacttcccaagccaaagttgcccaaacatattaaagataacaagaacgacttttctccaaaggttgaactggccacatctcttagcgacatggagtgcaagatcactaccagcaaggaccagaagaaggtcatggtgatgactagtagtgagcacactgaaactaagcagaacgttatttccaagagcctggatgaacgtaaacagctgtccatcgatagcgctaactgcctaagtcatacagtcccaggaactagcgcaccaaggaagaaacagatagcgcccttaatcaagtcccatagcttccccgaaagttcagggcagcagaacccaaaaccctacatgaggaagtttaaaacacccttaatgatcgccgaggagaaataccgccagcagaaggaagagattgagaaacagaagcaagaatcttcctattataatatcgttaagacacagtctcagaaccagcacatcacagaggtggaaaaggaaatgcccctgcagaaaactaatgaagaagtctctctcagtgggatcgattcggagtgcactgtagtccagccgtcgcccggcagccaaagcaacgccaggatcctgggagtgtgtagcgacaaccagctgagcaccacatcgcctgagacggtggccgctaaacggctacatcacgtgctggccgccagcgaggacaaagacaaaatgaagaaagaggtgctgcagtcttctcgggacatcatgcagagcaaatctgcctgtgagatcaagcaatctcatcaggagtgttccacacagcagacacaacagaaaaagtacctggagcaactacacctaccccaaagcaaacctatttccccaaatttcaaggttaaaacgatcaaactgcctacattggatcacactttgaatgaaaccgaccactcatatgagagtcacaagcagcaaagtgagatcgacgtgcagacattcaccaagaagcagtatctaaagactaagaagaccgaggcctccacagagtgcagccataaacaaagtcttgcggagcgacattaccaactgccaaagaaagagaaaagggtgacagttcaacttcctacagaatctattcagaaaaatcaggaggacaagttgaagatggtccctcggaagcaaagggagttctcgggatctgatcgggggaaactcccagggtctgaggagaagaatcagggaccaagcatgatcgggaggaaagaggaacgtctgattactgagagaaagcacgaacacctgaagaataaatctgcaccaaaggtggttaagcagaaagtcattgatgcccacctggacagccaaactcagaacttccagcaaacccagatacagaccgccgagtcaaaagccgaacacaagaagttgcctcagccttataattcgctccaggaggaaaagtgtttggaggtcaaagggatccaggagaaacaggtctttagtaacactaaagactcaaaacaggagattactcagaataaatctttcttcagcagcgtgaaggagtcacagagagatgatggcaaaggtgccctgaacatcgttgagttcctcaggaaacgcgaggagttgcagcagatcctgtcaagagtgaaacagtttgaggcagaacctaataagtccggtctcaaaacttttcagactctgctgaacaccattccaggatggttgatttccgaagacaagagagaatatgctgtgcatattgccatggagaacaacctggaaaaggtgaaggaggaaatcacccacataaaaacccaggctgaagacatgttggtcagctacgaaaacataattcagaccgccatgatgtccagtaaaactggcaagccaggcaacaagcctaccagccttgacgagacatccagtaaggtatcaaacgtccatgtatcaaataataagaacagtgagcagaaggagaataagatcgccaaggaaaaaacagttcagcaccaggtggccgctcaccacgaggccacagtccgctctcacgtcaaaactcatcaggaaataaagttggacgacagcaacattcccccgccctcgttgaaaacccggccccccagtcccaccttcatcacaattgaatccaccgcgcggcggacagagaatcctaccaaaaatgagctgagtcagtctcccaaaaaagactcctacgtggagccgccacctcggaggccaatgtcccagaagtccgagatccacagggcgaacacctccccctcacccccgaggtctaggagcgagcagttggttcgcctcaaggataccacagcgaagctgagcaagggcgccatcccttgtccagccgctactcccgtaccaattgttgagaaacggtctgagataattatgagcccagcaactcttcgacgtcagattaaaatcgagaccaggggcagggactccccgcctaccataaccatacccgtgaatatcaaccacgccgcatccgggtcatttcgcgagagtgttgacgctcaggaggagattaggaaagtggagaagcgcgcaacgtatgtacacaaggatggtctgaactcaactgatcacatggtccccgacacagaatcttacgatgccgttgagatcattcggaaggttgccgtaccacctcgactgagcgagcatactcagagatatgaagcggccaaccgaaccgtgcagatggcagaaaattttgtaaatgatccagagaatgaaatcaacagatggttccgtgagttcgaacacggccctgtgtctgaggctaagtcaaatcgtcgcgtgtacgctaagggcgaaaccaatcacaatattcagcaggagtcgcgcacattctgtaaggaagagtttggcctcacttcccttggtaataccagcttcacagatttttcctgcaaacatcctagagaacttcgggagaagatcccagtcaaacagcccaggatatgcagtgaaaccagatctcttagcgaacatttttccggcatggatgcctttgaaagtcagattgttgaatccaaaatgaagacatcctctagtcactcttccgaggctggcaaatccggttgcgattttaaacacgctccacccacatacgaggatgtcattgcgggccatatcctcgacatctctgattcccccaaggaggtgcggaagaacttccaaaagacctggcaggagagcgggcgggtgttcaaaggacttgggtacgctacagcggacgcatcagccaccgaaatgcggacaacctttcaggaggaatccgcgtttataagcgaggcagctgctccccggcagggcaatatgtacaccctctcaaaggattccctgagcaacggtgttcctagtggtcgccaagcagagttcagctag

SEQ ID NO: 140812 - DNA, 2817 bp, Artificial Sequence
  Description of Artificial Sequence: Synthetic coding sequence
atgtttccaatgcagaaaggctcgctgaacttgctccggcaaaagtgggagagctgtgactaccagcgatccgaatgtcaccctcgcgattcccactgtacgatttttcagccacaggagtccaagctactggctcctgagggtgaagtggtgtctgcacctcagtccttagatcctacgtccctgccttacagcacaggggaggagatgtggtcttctaagcccgaggaaaaggattccgttgataagagcaataacacaagggagtacggcaggcccgaagttcttaaggaggattccctgtcaagccggagacgtatcgagagattctccattgctctggatgagctgagatctgtcttcgaggcacccaagtccggaaacaagcctgctgagtatggaggtaaagaggtggaaatcgaacggagtctttgttctcccgcattcaagagccacccggggagccagctcgaggactctgtgaaggactccgacaaaaagggtaaggaaactagctttgacaagatgtctcccgaaagtggacacagccgaatcttcgaagccaccgcaggtcccaacaaaccagagagtggattcgcggaggattctgcagcccggggcgaaggcgtcagtgatctgcatgaagtcgttagcctgaaagagaggatggcacggtaccaggctgcagtttcccggggcgattgcagatccttctccgccaacatgatggaggaatcggagatgtgtgcggttcccggcggcctggcaaaggtcaaaaaacagtttgaggatgagatcacctcttctagaaatacctttgcccagtaccagtaccagcaccaaaataggtctgagcaggaggctattcacagctcacaggtgggaacatcaagatcgtcacaggagatggctaggaatgagcaggaaggcagcaaggttcagaagattgacgtccacggaactgagatggtgagtcacctggaaaagcataccgaggaagtcaatcaggcttctcagtttcaccaatacgttcaggaaacagtaatcgacactcctgaggacgaggagatccccaaggtgagtaccaagttgctgaaggagcaattcgaaaagtccgcacaggaaaagatcctgtatagcgacaaggagatgacaacccccgcaaaacagattaagaagctgttgctgcaggacaaggagatctgcattctgtgccagaagaccgtttatcccatggagtgcttagtggccgataagcaaaatttccacaagtcatgttttcggtgtcatcactgtaacagcaaactgagcctggggaattatgcatctctgcacggccagatctattgtaagccccacttcaaacagctttttaagtctaagggcaactacgacgagggattcggacacaagcaacacaaagaccgttggaattgtaagaaccagtccagatctgtggacttcatccctaacgaggagccaaacatgtgtaagaacattgcagaaaacaccctcgttcctggggatcgcaatgaacacttagacgccggaaactccgaaggacagcggaacgacctgcggaagctcggagaaagaggcaagttaaaggtgatttggcctcccagcaaagaaatcccaaagaaaactctccccttcgaagaggagctcaagatgagtaaaccaaagtggccacccgagatgacgactctcctttcacctgaatttaagagtgaatcacttctggaggatgtgcgcacaccagagaacaagggacagcggcaggatcactttccctttcttcagccctacctgcagtcaactcatgtttgtcaaaaagaagatgtgatcggaataaaagaaatgaaaatgcctgagggtaggaaggacgagaagaaggagggcagaaaaaatgttcaagaccgcccatctgaagccgaagataccaaatcgaaccgtaaatccgctatggacttaaatgacaacaataacgtcatagtgcagtcagccgaaaaggagaagaacgagaaaaccaaccagacgaatggcgccgaagtgctccaagtgactaacactgatgatgagatgatgcctgaaaaccataaagagaacctgaataagaacaacaataataattatgttgccgttagttacctgaacaactgtagacagaagacgtccattctcgaatttctcgacctcttgcccctgtcttccgaagccaacgataccgcaaacgagtatgagatcgagaagctggaaaatacatcgcgcatctctgagttgctcggtatctttgaatctgagaagacatactctagaaatgtgttggccatggctctgaagaagcaaactgaccgggccgcggccgggtcccccgtgcagcctgctccaaagccctctttatcccgtgggttaatggtgaaaggggggtcctccattatctcccccgacactaatttactgaacataaagggaagccattccaagtctaaaaatctgcacttcttcttctctaataccgtcaaaattacagctttttcaaaaaagaacgaaaatatcttcaattgcgatttaatagatagcgtcgaccaaattaaaaacatgccttgccttgacttacgggaatttgggaaagatgtgaaaccttggcacgttgaaacaactgaggcggcacggaacaacgagaatacgggatttgatgcactctcccatgaatgtacggcgaaaccgttattcccgcgggtggaagtccagagcgaacagttaaccgttgaggagcagataaaacgaaacagatgttattcagacaccgaatag

SEQ ID NO: 140813 - DNA, 10650 bp, Artificial Sequence
  Description of Artificial Sequence: Synthetic coding sequence
atgttcccgatgcagaaaggctcacttaacttgctccgccaaaaatgggaatcctgtgattatcagcgctcagagtgtcatcctcgggactctcactgtacaatcttccagcctcaggaatccaagttgctggctcctgagggagaggtggtatccgcccctcagtcacttgatccaacttcactcccttactctacaggagaggagatgtggtcgagcaagcccgaggagaaagatagcgttgacaagtctaataacacacgggagtacggccgccccgaggtgttgaaggaagattcactgagctctcggaggcgcattgaacgattctccatagctttggatgaactgcgctctgtgttcgaggcccccaaaagcggaaataagcccgctgaatacggcggtaaagaagtcgagatagaacgaagtttatgcagccccgcctttaagagtcaccccggcagccagctggaggactcggtgaaggattccgacaagaagggaaaggaaacatcgttcgataagatgagcccagaatctggccattctcggattttcgaggcaaccgccgggcccaacaagcccgagtctggttttgcggaggattcagccgcccggggcgaaggtgtgagtgacctgcatgaagtcgtctcccttaaggagaggatggctagatatcaggccgctgtctcacgaggtgattgccgctctttcagtgccaacatgatggaggaatctgagatgtgcgccgtccctgggggcttggctaaagtgaaaaagcaatttgaagacgagatcacaagcagtcggaacaccttcgcacagtatcaataccaacaccagaatcgttcagaacaggaggccattcacagctcccaggtcggaacttcacgcagctcgcaagaaatggcacgaaatgaacaggaaggaagtaaggtccagaaaattgatgtgcatggcactgagatggtctcgcatctcgagaaacacaccgaggaagtgaatcaagcctcccagtttcaccagtatgtacaagagactgtgattgacactcccgaagacgaagagattcctaaagtcagtactaagcttctgaaagaacaatttgaaaagtccgcacaggaaaaaattctatatagcgataaggagatgactaccccagccaaacagattaagaccgagtcagaatatgaagaaacctttaaacccagcagtgtggtgagcactagctcaacctcatgtgtctctacgtcccagcgaaaagagacatccaccaccagatactccgatcattctgtgacaagtagtacactggcccagatcaatgcaacctcctctgggatgaccgaggagtttccacccccaccaccggacgtccttcaaaccagcgtggacgtgacggccttcagtcagtccccggagctgccttctccgcctaggcgcctgccagtccccaaggacgtatacagtaaacaacgcaatctctacgagctgaatcggctctataaacacatccacccagagctgcggaagaatctcgaaaaagactacatcagcgaagtttcggagatcgtatcatcccaaatgaacagtggcagttctgtctctgcagacgtgcaacaggctcgttacgttttcgagaacactaacgattcctctcaaaaggacctgaacagtgaaagggagtatcttgaatgggatgaaatactcaagggcgaagtacagagcatccgctggattttcgaaaatcagccacttgactcaatcaacaacggatcccctgacgagggcgatatctctcgggggattgccgaccaggagattatcgcaggcggcgatgtcaagtacactacatggatgttcgagactcaacccatagacacactgggcgcctacagtagcgataccgtagaaaatgcagaaaagatccctgagttggcaaggggggacgtctgcaccgccaggtggatgtttgaaacccgccctctcgatagcatgaataagatgcaccaatcgcaagaggaaagtgctgtgactatttcaaaggacattacaggtggggacgtgaagaccgtgcggtacatgttcgagactcagcacctggaccaactcggccagctgcattcagtggatgaagttcatctcctccagttaagatccgagctcaaggagattaaaggtaacgtgaagagatctattaagtgtttcgaaactcagccgctctacgtgataagagatgggtccgggcagatgttagagatcaagactgtccaccgtgaagacgtggagaagggtgacgtgcgcaccgctaggtggatgtttgagacccagccactcgacacgattaataaagatattacggaaattaaggtggtacgagggattagcatggaggagaatgtgaaaggaggagtgagcaaagccaagtggcttttcgaaactcagcctctcgagaagattaaggagagcgaggaggtaatcatagaaaaagaaaagatcataggcaccgacgttagtcgaaagtgttggatgttcgagacccagcccctggacattctgaaggaggtgcccgatgctgattccttgcagagggaggaaatcattggaggtgacgtccagaccaccaagcatttgtttgagaccctgcctattgaggcgctaaaggacagcccggacatcggaaagctccagaaaatcactgccagtgaggaggagaagggcgacgtccgccatcaaaagtggatcttcgagactcaacccctggaagacattcgaaaggacaaaaaagagtacacacgcaccgtcaaattagaagaggtagacaggggcgatgtgaagaactacacacatatatttgagtctaataacctgatcaagttcgatgctagtcataagatcgaagtcgagggtgtgacccgcggggccgttgagctcaacaaatccctttttgagaccacccctctgtacgctattcaggatccgcttgggaaataccaccaggttaagactgtgcagcaggaagagatagttagaggggacgtgcggtcctgtcgttggttattcgagacaagacccattgatcagtttgatgagagcatacataagtttcaaatcattagaggaataagcgcccaagaaattcagacaggaaacgtcaaatccgctaagtggctcttcgagacccaaccccttgacagtattaagtacttctctgatgtagaagagacggagtcaaagaccgaacagactagggacatcgtgaagggtgatgtgaagacatgcaaatggctattcgagactcaaccaatggaatctctgtacgagaaggtctccctgatgaccagttcggaagagatacacaaaggggacgtcaaaacctgtacctggttattcgaaactcaaccactggacaccataaaagatgactccgaaacagcggtcaagttacagaccgtcaaacaggaggagattcaaggaggcgatgtacgaaccgcgtgttttctgtttgaaacagaaaatctagattcgattcagggtgaggaggtgaaagaaataaaaccggtggagatggacatccaggccggcgacgtcagctcaatgcgctacaagttcgaaaaccaatcgctggacagcatcagtagtagctctgaagaggtattaaaaaaaatcaaaactcttaagacagaagacattcagaagggcaatgtgttaaactgccggtggttattcgaaaatcagcccatcgataagatcaaggagagccaggaaggcgacgagtgcgtaaaaaccgtgacagatatacaggggggagacgtgaggaaagggtgtttcatctttgagacctttagcttagatgagatcaaggaggagtctgactacatatccacaaagaaaacaatcactgaagaagttattcagggggacgtcaaaagctaccggatgttatttgaaacccaaccgctgtacgccatccaggacagggagggctcataccacgaagttactaccgtcaagaaggaggaagtcattcacggggatgtccgtggaactaggtggctgtttgagactaagccactcgatagtatcaacaagtccgagacagtttatgtgattaagtcagtcacccaggaggacattcagaagggcgacgtgtcctctgtgagatacagattcgaaacacaacccctcgatcagatttctgaggaatcacacaatattatgccttcaatcgatcacatccagggggggaatgttaagacaagccgacagttcttcgagtccgaaaattttgataagaacaattacatccgcaccgtcagcgtgaatgaaattcagaaaggaaatgtcaaaacctctacgtggctttttgagacacacacaatggacgaactgagaggcgagggcctggagtacgaaaacattaaaaccgtcacccaggaagacgtacagaaaggggacgtaaaacaggccgtctggctattcgagaatcgaacatttgattccattatggaggcccataagggaatcaccaagatgacgaaggaagaaatccccccttctgacgtgaaaacaaccacctggctgttcgagacaacacccctccacgaattcaatgagactcgggtcgaaaaaatcgagatcatcggtaaatctattaaagaaacactcgaggatctgtatagccagaaagtcattcaggccccgggaatcatcattgaggctgacgaaattggtgatgttcgcatggcaaagtacaaactgatgaatcaagcttcccccgaaatccagaaggaggagattatcagagcagatctgcggaatattatggtgaacttattgtcaaagcgcgattgcaccgaaagagaaatcctcatatccgaagaagaaaaggggaacgtcaacttgacaaaaacccagctgctgaaccgcagcacagaattccacgccgagaaggaagaaattgtgaagggggatgtacaacaggcaattaagaatctttttagcgaggaacgttcagtgaagaaaggcattcttattcaggaagatgagaagggtgacataaatatgaccatatactgcctcctacatgagaatgatggagatactatagagagagaggaagtgatagggggcgatgtcaagcgtaccatccacaatctgctctcaagtaccagtaataataaaatctccgaacgcgcgaagatagacgcctccgagcgtggaaatgtacagttcttcactacctgtatagaggccggcgctttggactacctgaaacagctacatactgaatctaacgagactttgacggcaaagaaacaggaaggcgaaaaagagatcatagggggagacgtggaagggacaaaacttctgctcaagaaacggcagtccctggtagaacgaacggttagcgaaacggacattatcccaggagatgtgcacaacacagtcaaggtgtttatgacagagccacagtcaacgtttggtaagatcccaaaggaggaaattatcaagggagacctcacgtccacgctgaacagcctatcccaagccgtgaatcaaaaaaccgtgacgaaaaccgaggaaataattaagggcaatatgcttgccacactaaaaagccttaaggaaagctcacaccgctggaaggaatcgaaacagcctgacgccatccccggggacatcgaaaaggcaatcgagtgcctggaaaaggctacaaacaccaaaacagagattctcaaaaaggagctgcttaaagatgacctcgagacctccctccgctctttgaaggaggcccagcggagtttcaaggaggttcataaggaaggcgtcatcaagaaggatgccaaagctgtgatggccggtagtagcggcgaacaaaagactgacatccaccaggtcgccgtacagagaaacaagaattctctcctgcagcctaagcccggaccctttgaacccgccgccaagtggcagggtggggctgataccctatcacagacaatgggaaagagttgccacggcaatttggtggaagagaggacagaagtaaatctgccaaaagcacctaaaggtacagttaagatcgtgattgacagagaacagaacaatgatgccctggaaaaaagcctcaggcgactatccaattcacaccacaaatccaacgtgcttgaaagcggggataagactggagtgtggactgacacaacaggggagcagcaccttcgagacgagtacatgagccgccagttgacaagtaccgtttccgtgaaaaacaaccttaccaccaaggaatcagatagagcagtgcgcgagctcaaaaaggacgacgttttcaactccatacaatccgctggcaagacagtgggtaaacagcagacttacgaattgagaaatgaccaccagaagatggaggggtttcacataaaatcccccaagaagacaaagaatataaaaatcctaactgacacccagagtagcaagccaagtcccacgcagcaccccgtgtcgatgccagtcggggggacttacgatctgtctggcgatttccagaagcagacactacttaagcaggagactaagtactcgaataaagacatcaaaaagaaaaatatcaacctccagcccatgtggcaattgttgcccgttgagcaggatacttcaaatgtaaccgagatgaaggtgtcagagaagagccacaataccttcaaggccacaaataaaaaaagagagacagatgtgcatctgaagagccaggattttctgatgaagacgaacacctctacaggtttgaaaatggccatggaaaggtcactcaacccaatcaatttcaatccagagaataacgtgaaggaaagtgaatgtcccctgcctcccccttcaccccctcccccaccaccttctaatgcctcatccgagatcgagttcccactgcctcctcctcccccactgatgatgttccctgaaaagaatggttttttgcctagcctgtccacagaaaagatcaaggccgagttcgagtcgtttcccggcctgcccctgcctccacctcctgtagacgagaaaagcgaacgcgagagctcatccatgttccttcctcctccacccccacccacaccctctcagaagcccgcacacttactgtcaagttcagccccagagaagcactccggtgacttcatgcagcaatacagccagaaagaagcttctaactcccagaactcccaggctaaaatcataaccggaaagaccggcgtgcttccaccgccgacattacccaagcccaagctgccaaaacatatcaaagacaataagaatgattttagtcctaaagtggaactggcgacctctttatctgatatggaatgtaaaattacaacttccaaggatcagaaaaaggtgatggttatgacaagttcggaacatacagaaacaaagcagaatgtcatctccaaaagccttgacgagcgcaagcagctatccatcgattccgcaaactgcctaagccatacggtgccgggaacctccgctcctaggaagaagcaaatcgcaccactgatcaagagccacagtttccctgagtcttctggtcagcagaatcctaagccatacatgagaaaattcaaaacccccttaatgattgccgaggaaaagtataggcagcaaaaagaggagatcgagaaacagaaacaggagtcttcctactacaacatcgtgaagactcagagccagaaccagcatatcactgaggtagagaaggagatgcctctccagaaaacaaacgaggaggtgtctctttcagggattgatagcgaatgtaccgtagtccagccctctcccgggtcccagtccaacgctcgaattctgggagtgtgttcagacaaccagttgtctacaacctccccagaaaccgtggcggcaaagcgattgcaccacgtgctggcagctagtgaagacaaggataaaatgaaaaaggaagtgctccagagcagccgggatatcatgcagagcaagtcagcttgcgagatcaagcagtcacaccaggagtgcagcacccagcaaacccagcagaaaaagtacctggagcaactgcacctgccccagagcaagcctatcagtccaaactttaaggtcaagacaatcaagctcccaactctggaccatacactcaacgagaccgaccactcctacgagagccataagcaacagtctgaaattgacgtacagactttcacaaagaaacagtatctgaaaactaaaaagacagaggcttcaacagaatgtagccacaaacaaagcttagcggagaggcactaccagctgccaaaaaaagagaagcgcgtgacagtacagttacccacggagagtatccagaagaaccaggaagacaagctgaagatggtgccacgcaaacagcgcgaatttagtggctctgataggggtaaattgcccggctccgaggaaaagaaccaaggaccatccatgattggccggaaagaagagcgactgatcactgaaaggaaacacgagcatctgaaaaacaaaagtgcaccaaaggtcgtcaaacagaaagttatagacgctcacctcgattcgcaaactcagaacttccagcagacgcagatccagacagctgagtcgaaggcagaacataagaaactgccccaaccctataatagcctgcaggaggaaaagtgcctggaagtaaagggcatacaggaaaagcaagtgttctccaacacgaaagactccaagcaggagattactcaaaacaagagttttttctcctctgtgaaagaatctcaaagagatgacggcaaaggcgctctgaatatagtagagttcttacgcaagcgggaggagctgcagcagattctttctagagtgaaacagtttgaggccgaaccaaataagtccggcttaaagacgttccagaccctcctgaacactatcccaggttggctgatctctgaggacaaaagggagtatgcggtccatatcgctatggaaaataacctggaaaaggtcaaggaggaaatcactcacattaaaacccaggccgaagacatgctagtctcttatgagaacatcatccagactgcaatgatgtctagcaagacaggaaagccaggcaacaagcccacatctcttgacgagacatctagtaaagtctccaatgtgcacgtgtcgaacaataagaacagcgagcagaaggagaacaagattgcaaaagaaaagacggtgcagcatcaagtcgccgcccaccacgaagccaccgtgcgatctcacgttaaaacccatcaggaaatcaagctggacgactctaacatccctcccccgtccttgaaaactcgcccaccgtcccccacgttcatcaccattgaaagcacagctaggagaacagagaatccaactaagaacgagctaagccagtccccaaaaaaagattcctatgtagagccgccgcccagacgtccaatgtcccaaaagagtgaaatccatcgggctaacacatcgccatcaccgcctcgctctcggagcgagcagctggtccggctgaaggataccacagccaagctgtccaagggtgccatcccttgccccgctgcaactcccgtcccgattgttgagaagcgcagtgaaataatcatgagtcccgccaccttaaggagacagataaagatagaaaccagaggacgcgattcaccacctactatcactatccccgtcaatatcaaccatgccgcatccggatccttccgcgagtccgtcgacgcacaagaggagattagaaaagtggaaaagagagcaacttatgttcacaaggacggtctcaatagcactgaccacatggttccggacacggaaagctacgacgccgtcgagatcatcagaaaggtcgctgtccctcctaggttatccgagcacacacagcgttacgaggcagctaacagaactgtgcagatggcagaaaactttgtgaatgatcccgaaaatgagatcaaccgctggtttagagagttcgaacatgggcctgtcagcgaggccaagtctaaccggagggtctacgctaagggcgagacaaaccataatattcaacaggagagtagaacattctgtaaagaagaatttggattaacaagcctggggaacacttctttcaccgactttagttgcaagcatccacgcgagctgcgcgaaaagattccagtaaaacagcctaggatatgtagcgaaaccagaagtctatcggagcattttagtggcatggatgcgtttgagagccagatcgtagagagtaagatgaagacttcaagtagtcatagcagtgaggcggggaagtccggttgtgacttcaagcacgcaccgccaacctacgaagatgtgattgctggacacattcttgatatcagtgatagccccaaagaggttcgaaaaaacttccagaaaacttggcaggagtcaggacgggtcttcaaaggactaggctatgccactgctgacgcgtctgcaactgagatgaggaccaccttccaggaagaatccgcattcatttctgaagcagccgcccctagacaaggaaacatgtataccctgagcaaagacagcctgagcaatggcgtaccgtctggaagacaggccgagttctcttag

SEQ ID NO: 140814 - DNA, 9984 bp, Artificial Sequence
  Description of Artificial Sequence: Synthetic coding sequence
atggcccggtatcaggctgcagtgagtaggggagattgcagatctttcagcgcaaacatgatggaggagtccgaaatgtgtgccgtccccggtggattagctaaggttaagaagcagtttgaggatgaaattacgagtagcaggaatacttttgctcagtatcagtaccaacaccagaatcgctccgaacaggaagctatacattcatctcaggtcggcacaagcagatcaagccaggagatggctcggaacgagcaggaaggatccaaagttcagaaaatcgatgtacacggtacagagatggtctctcacctcgagaagcacaccgaagaggtaaaccaggcctcacagtttcatcaatatgtgcaggagactgtgatcgatacccctgaagatgaagagatccccaaggtgagtactaagctgctcaaggaacagtttgagaagtctgcccaggaaaaaattctctactcggataaagagatgactacacccgcgaagcagattaagacggaatctgagtatgaggaaaccttcaagcccagttctgttgtgagcacaagttcaacaagctgcgtgtccacctctcagcggaaagagactagtaccacccgctactcagaccactcagtcaccagctctaccttggcgcagattaacgccacatcttccgggatgacggaggagttcccccccccacccccggacgtactacagactagcgtcgacgtaaccgcattcagccagtcacccgagttgccgtcacccccacgccggctgcctgttccaaaggatgtgtatagcaagcagagaaacctctacgagctcaaccgcctgtataagcatatccaccccgagctccggaagaatttggaaaaagattatataagcgaggtatctgaaattgtatcttctcagatgaattctggaagtagcgtaagcgccgatgtgcagcaggccagatacgttttcgaaaacactaacgactcatctcaaaaagatctgaactctgagagggagtacctggagtgggatgaaatccttaaaggggaggttcagtccattcgctggatcttcgagaaccagccattagactctatcaataacgggtcacctgacgagggagatataagtagggggatcgctgaccaagagataattgcgggaggggatgtcaagtacaccacctggatgtttgaaacccagccaatagacacgctcggggcctactctagtgacacagtggagaatgctgaaaaaattccagagctggcccggggcgacgtgtgtaccgctcgctggatgttcgagacaagacccctcgattcaatgaacaagatgcaccagtcgcaggaagaaagtgccgttaccattagcaaagatattaccggtggggatgtgaagactgtacgctacatgtttgagacacagcatttggatcaactcgggcagttgcactcagtggacgaggttcatctgctacagttgcggagcgaacttaaggaaataaagggaaatgtaaaacgatccattaagtgcttcgaaactcagccgctgtacgtgatacgggacggatccggccaaatgctggagatcaagaccgtccaccgagaggatgtagagaagggcgacgttcgcaccgcaaggtggatgttcgaaactcaacccctggatacaataaacaaggatatcaccgagattaaagtggtcagggggatctctatggaagaaaacgtgaaaggcggtgtttctaaagccaagtggttgttcgagacccagccacttgagaaaatcaaggagtccgaggaagttataatcgagaaggagaagatcattggcaccgacgtcagcagaaaatgctggatgttcgagacacagcccctggacatcttaaaggaggttcctgatgccgatagcctgcagcgggaggagatcatcggaggcgacgtccagaccacaaagcatttgtttgagaccctcccaatcgaggctcttaaggatagcccagacattgggaaactgcaaaaaattaccgccagcgaagaagaaaagggagacgtgagacatcagaaatggattttcgaaacccagcccctggaggacatcagaaaggataagaaggagtacactcggaccgtcaagctggaggaagttgatcggggcgatgtgaaaaactacacccatatctttgagtcaaacaacttaatcaagtttgacgcgtcacataagattgaggtggagggcgtgactcggggcgcggtagaactgaacaaatcactattcgaaaccactcctctgtatgctatccaggacccattgggcaagtaccaccaagtcaagacagttcaacaggaagagatcgtgagaggggatgtccgcagttgtaggtggctcttcgaaaccaggcctatcgaccagttcgatgaatccattcacaaattccaaatcatccgaggtatctccgcccaagaaatccagacgggtaacgttaaatccgccaagtggttatttgagacacagccccttgatagtataaagtatttctcggatgtggaggagacggagagcaagactgaacagactcgcgatattgtgaagggagacgtcaaaacctgtaagtggttattcgagacccagcctatggagtctctatacgaaaaagtgtctcttatgacctcctctgaagaaattcataagggagacgttaaaacctgtacatggctctttgagacccagcccctggacaccataaaagacgacagcgagactgctgtgaaactccagactgttaaacaggaggaaatccagggaggagatgtgcgaacagcatgtttcctttttgagacagaaaacctggactccatacaaggcgaggaggtgaaggagataaagccagtcgagatggatatacaggcaggggacgtcagctccatgagatataagtttgagaatcagagtctagactccatttcgtccagctctgaagaggtcctgaagaagatcaagactctgaagacagaggatatacagaaagggaatgtactgaattgtcgctggctgttcgagaatcagcccatcgacaaaatcaaggaatcccaggaaggcgatgagtgtgtgaagaccgtaacggatatccaaggaggtgatgtgagaaagggatgcttcatcttcgaaacctttagtctggatgagattaaggaagagtcagactacatcagcactaaaaagaccatcactgaggaggtcatccagggtgatgtcaagtcttataggatgttattcgaaacccagcccttgtacgcaattcaggatcgcgagggctcttaccacgaggttaccacggtgaaaaaggaggaggtgatccatggcgacgtgcgtggtaccagatggctgttcgagacgaagcccctggacagcatcaataagtcagagactgtctatgttatcaaaagcgtcactcaagaagacattcagaaaggcgatgtgagcagcgtgcgctaccgattcgagacccagcctttggatcagattagcgaggagtctcacaatattatgccctctatcgaccacatccagggcggcaatgttaaaacatctcgtcagttctttgaatctgaaaacttcgataaaaacaactacatccgtactgtgtcagtgaatgagattcaaaaaggcaacgtgaaaacctccacttggctgttcgagacccacacaatggacgagttaagaggtgagggcctggaatatgaaaacataaaaaccgtgactcaggaggacgttcagaaaggggacgtcaagcaggctgtatggctttttgagaaccggactttcgattcgataatggaggcccacaagggtatcacaaagatgactaaggaggaaatcccaccatccgatgtaaagacaaccacctggcttttcgagacgacaccactgcacgagttcaacgaaactagggtcgagaagatagaaattattggaaaaagtatcaaagaaacactcgaggatttatacagccaaaaggtgatccaggccccaggaatcattattgaggcagatgaaatcggtgacgtgcgcatggcgaagtataagcttatgaaccaggcatcccctgagatacagaaggaagaaattatcagggctgacctgcggaacattatggttaacttgctgagcaaaagggattgcactgagagagaaatactgatatcagaagaagaaaaaggaaatgtgaacctgacaaagacccagcttctgaaccggtcaactgaatttcacgctgaaaaggaggagatcgtgaagggcgacgtgcagcaggctatcaagaacctattctccgaagagaggagtgtgaaaaagggaattcttatccaggaagacgaaaaaggcgacattaatatgacgatctattgcctactgcatgaaaacgacggggataccatcgaaagagaggaggtgattggaggagacgtgaaacgcaccatccataacctgctttcatcaacgtccaacaacaaaatatcggagcgggctaagatagacgcctctgagaggggaaatgtccagttcttcaccacgtgtatcgaggctggtgccttggattatttgaagcaactacatactgagtccaatgagaccctaacggccaagaaacaggaaggtgagaaggaaataattgggggcgacgtggagggcacaaaattgctgctgaagaaacgccagagtctggtggagcgaacagtgtcggagaccgatatcatcccaggagacgtgcataacaccgtcaaggtatttatgacagagcctcagagtacatttggcaaaatccccaaagaggaaattattaagggcgacctaacctccactctgaattccctgagtcaagcggtgaatcagaaaactgttactaagacagaggaaatcataaagggaaacatgcttgccacactaaagagcctcaaagagagctctcaccgatggaaggaatcaaagcaacccgacgccataccaggtgacatagagaaggcaatagagtgtctggaaaaggctactaacactaaaaccgagatactaaagaaggaactcctgaaggatgacttagagacaagcctgaggagcctgaaggaggctcagcgatctttcaaggaagtccataaagagggcgtgataaagaaggacgctaaagccgtgatggcagggtcatccggggagcagaagacagacattcaccaggtcgccgttcagcggaataaaaattcgctgctgcagccaaagcctgggcccttcgaaccagctgcaaaatggcaggggggggccgacaccctgagtcagacgatgggaaagagctgtcacggaaacctagttgaggaaagaacagaggtgaaccttccgaaagctccaaagggaacggtgaagatcgtaatcgatagagaacagaataatgatgccctcgagaagtctttgcggcgcctgtccaattcacaccacaagagtaatgtgcttgaatccggagacaagaccggcgtgtggaccgatacgactggcgaacaacacctcagagacgaatatatgtctaggcaactgaccagtaccgtgtcagtcaaaaataatcttacaaccaaggaatctgatcgggccgtgcgggaactcaagaaggacgacgtgttcaatagtatacagagcgctggaaaaacagtggggaaacaacaaacctacgagctccgaaatgatcaccagaaaatggagggattccacataaagtcccctaaaaagaccaagaacataaagatcctgactgacacgcagagctcaaagccatctccaactcaacacccggtgtcaatgccagtgggcggcacttatgatctgtccggggacttccagaaacagaccctgctgaagcaagagactaagtacagcaataaagacataaagaagaaaaacattaatctgcaacctatgtggcagttgctgcccgttgagcaagataccagtaacgtgaccgagatgaaggtgagtgagaaatctcataacacctttaaggccacgaataaaaaaagagagacagatgttcatctcaaatcgcaagattttcttatgaaaaccaatacctcgactggtctcaagatggctatggagaggagccttaaccctatcaactttaatcccgagaacaatgtgaaagaatcagagtgtccgcttcctcccccatctcctccacctcctccaccatccaacgcgtcaagcgagatcgaattccctctgcctccacctccaccactcatgatgttccccgaaaagaatggatttctgccgtctctgtccaccgagaagattaaggcggaatttgaatcttttccaggtttgccgctaccccctccacctgttgacgagaagagcgaacgtgagagctcgtctatgttcctcccgccccctccccctccaactccgagccagaagcccgctcaccttctgtcatcttcggccccggaaaaacatagtggggatttcatgcagcagtactcccagaaggaggcttctaacagccagaacagtcaggcgaagattatcacaggaaagaccggggtgctgccacccccaaccctccctaagcctaaactgccaaagcacattaaggacaacaagaatgattttagtcctaaggtggagttggctacgtcattatccgacatggaatgtaaaataacaacctctaaagaccagaagaaggtgatggtaatgacgagcagtgaacatacagaaaccaagcaaaatgtcatatctaaatccttggatgaaagaaaacagctgtccatagacagcgctaactgtcttagccacacggtcccaggaacttcagctccccggaagaagcagatcgcccctctgatcaaaagccattctttcccagaaagtagtggacagcagaaccccaagccgtacatgcggaagttcaagactcccctgatgatcgccgaggagaagtatagacagcaaaaagaagaaatcgaaaaacaaaaacaggaaagtagctattacaatatagtgaagacacagtctcagaatcaacacataacggaagtggaaaaagagatgcctctgcaaaaaacaaacgaggaggtctccctcagcgggatcgacagcgaatgcaccgttgtgcagcctagccctggatcgcaatccaatgccaggatcctgggcgtgtgttccgacaaccagctgagcaccacatctcccgagaccgtcgctgctaaacgattacaccatgtcttggccgccagcgaagacaaagacaagatgaagaaagaagttctgcagtcgagtagagatattatgcaatctaagtccgcctgcgagattaaacagtcccatcaagaatgcagtacacaacaaacgcagcaaaaaaaatatctcgaacagctgcacctgcctcagtcaaaaccgatttctcctaactttaaagtgaaaactatcaagcttcctaccttggaccacactctcaatgaaactgatcactcttatgagtcccacaaacagcagtccgagatcgatgtgcagacctttaccaaaaaacagtacctgaagactaaaaagaccgaggcctcaacagagtgctctcacaagcagagcctggccgaacgacactaccagctgcccaaaaaagaaaagcgagtcaccgtccaactccccactgaaagtatacagaaaaaccaggaggataaactcaagatggtgcctcgcaagcaaagagagttctcgggcagcgatagaggaaagttaccgggttcagaggaaaagaatcagggtcccagcatgattggtagaaaagaagagcggttgatcacagaaaggaagcacgaacacctcaagaataagtcagcgcctaaagtagtgaagcagaaggttattgatgcccacttggactctcaaacccaaaacttccagcaaacacagattcaaacagcagaaagcaaggccgagcataaaaagctgccccagccctataacagtctgcaagaggagaagtgtctggaagtcaagggcattcaggagaaacaggtcttcagcaacactaaggacagcaaacaggaaattactcagaacaagtccttcttttccagtgtcaaagaatcccagcgggacgatgggaagggtgcactgaatattgtggagttcctcaggaagcgggaagaactgcagcagatcctctcaagagtcaagcagtttgaggctgagccgaacaagagtggactgaaaacattccagacccttctcaatacaattccggggtggctaatttcggaagataaaagggagtacgctgtccatatagccatggagaacaaccttgagaaggtcaaggaagagattacccatatcaaaacccaagccgaagatatgctggtctcctacgaaaatattatccaaacagctatgatgtcttcaaagaccggaaaacccgggaacaaaccgacctccctagatgagacctcctctaaggtttccaatgtgcatgtatctaacaataagaattccgaacagaaggaaaacaagatagccaaggaaaaaacggtgcagcaccaggtcgccgcccatcacgaggccactgtgcgcagccatgttaaaacccatcaagagattaagcttgacgattctaacatccctcctcccagcctgaagactaggccaccaagccccacctttattactattgagagcaccgcgcgccggaccgagaaccccacaaagaatgagctctctcaatctccgaagaaggatagctacgtggaaccgccacccagacgcccaatgagccagaagagcgagatccatagggccaatacgtccccaagtcctccacggagcaggtccgaacagctggtgagattgaaagacacaacggctaagcttagcaagggagctataccctgtcccgctgccactcccgtgccgatagtagaaaaacggtctgaaatcatcatgtccccagcaactctgcgcaggcagatcaagatcgaaaccagaggcagggacagtccacccactatcaccatccccgtgaatatcaatcacgctgcctccggttcattccgcgaatcggttgatgcacaggaggaaatcaggaaagtggaaaagcgcgcgacctacgtccataaggatggccttaactcaacggatcatatggttccagatacagagagttacgacgctgtggaaatcatacggaaggtcgctgttccgcctcgattatcggagcatacccagcggtatgaagcggccaatcgcactgtccagatggctgagaactttgttaacgatcctgaaaacgagatcaatagatggttcagagagttcgagcatgggccagtctcggaagccaagagcaaccgcagggtctacgctaagggagagactaaccataacatccagcaggagagccgcacattttgcaaagaagagtttggcctgactagtctggggaacacatctttcacagattttagttgcaaacatccacgggagctgcgcgagaagatcccagtcaagcagcctcggatatgtagcgagacccgctcactgtctgaacacttcagcggcatggacgccttcgagagccaaatcgtcgaatcaaaaatgaaaacttcaagcagccattcctctgaggccgggaagagcggttgcgactttaaacacgcacctcccacatatgaggatgtgatcgcagggcacatattagacatctccgactctcctaaggaggtgcgcaagaacttccaaaagacatggcaggaatccggcagggtctttaaaggcctgggatacgcgaccgcagacgctagcgctacagaaatgaggacaacgtttcaggaagagagtgcattcatttctgaggcggctgccccaagacagggcaacatgtatacactgagcaaagattccctgtctaatggcgtacctagcgggcggcaggcggaattcagttag

SEQ ID NO: 140815 - DNA, 2151 bp, Artificial Sequence
  Description of Artificial Sequence: Synthetic coding sequence
atggcccgttatcaggctgccgtttcaagaggggattgtaggagcttctccgcaaatatgatggaggaaagcgagatgtgcgcagtcccaggagggctcgctaaggtgaaaaagcagttcgaggatgagatcactagtagtaggaataccttcgctcagtaccaataccagcaccaaaacagatccgagcaggaagctatccattcttcccaggtgggaacatcaagaagtagccaggagatggcaagaaacgagcaggaagggagcaaggttcagaagatagacgtccacggcacagagatggtttctcacctagagaagcataccgaagaggtgaatcaggcatcacagttccatcaatacgtccaggaaaccgtcatagatacccctgaggacgaagaaattcccaaagtgtccactaagttactgaaagaacagttcgaaaaatccgcccaggagaaaattttgtatagcgataaagagatgacgacaccggctaagcaaattaagaagttactcttgcaagataaagagatatgcatcctgtgccaaaagacagtataccctatggaatgtctcgtggccgataaacaaaacttccacaagagttgttttaggtgccatcactgtaattctaaactgtcactgggaaattatgccagtctgcacggtcagatctactgtaagccgcactttaagcagctctttaaatccaaagggaattatgacgaaggatttggccataagcagcataaggaccgctggaactgcaagaatcagagccggagtgttgatttcatccccaacgaggagcctaatatgtgcaagaacattgcagagaatacactcgttccgggggataggaacgagcatctggacgcaggcaattcagagggacagcggaatgaccttcgaaaacttggcgaacgaggaaagcttaaggtcatttggcctccttccaaagaaattcctaagaagaccctaccatttgaggaggagctgaagatgtcaaagcctaagtggccgccggagatgacaactctcttaagcccagaatttaagagcgagagtctgctcgaggacgttcggacgccagagaacaagggccagcgacaggatcacttcccatttcttcagccatacttacagagcactcacgtttgtcagaaggaagatgtgatcggcatcaaggagatgaaaatgcccgaggggaggaaggacgaaaaaaaagaaggccggaaaaatgtccaggatcggccatctgaggcagaagatacaaaatccaacaggaagagcgccatggaccttaacgacaacaacaatgtgattgtgcagtccgccgagaaggaaaaaaatgaaaagaccaaccagaccaatggtgctgaagttctgcaagtgaccaacacagatgacgaaatgatgccagaaaaccacaaggagaatttgaataagaacaataataacaactacgtagcagtgtcgtatctcaataattgccgtcagaagacatcgattcttgaatttctcgatctcctgcccctctccagcgaggccaatgacaccgcgaatgaatacgagatcgagaaattggaaaacacttcacgaatctcagagctgctcgggatatttgaatctgagaagacatattcccgcaacgttctcgcaatggcactgaagaaacagaccgaccgggctgcggcgggctctccggtgcagcccgcgcctaaacccagtctctctcgcgggttgatggtgaaggggggttcaagcatcatcagtcccgacaccaatctgctaaacatcaagggctcgcattctaaatccaaaaatctgcacttcttcttttccaacaccgtcaaaattaccgcgttcagcaaaaagaatgagaatatatttaactgcgatctgattgattctgtcgatcagatcaagaacatgccctgtctcgatctcagagagtttggtaaggacgttaagccctggcacgtggaaacaacagaggcagcccgcaacaatgagaacaccggttttgacgccctgagtcatgagtgtactgcaaagcctttgttccccagggttgaggtacagtccgaacaactgaccgtggaagagcaaataaaacgcaatagatgttacagtgacacagagtag

SEQ ID NO: 140816 - DNA, 2817 bp, Artificial Sequence
  Description of Artificial Sequence: Synthetic coding sequence
atgttccccatgcagaaagggtccctcaatctgcttaggcagaagtgggagtcttgcgactatcagagatctgagtgtcacccccgagatagccactgtaccatcttccagccccaggaaagtaaactgctcgcaccggagggagaagtggtgagcgccccacaaagcctcgatcctacaagtctcccctactctacgggagaggaaatgtggagctccaagccagaggaaaaggatagtgtcgacaagtctaataatactcgggagtatggtcggcctgaagtgcttaaggaggacagcctgtctagccgcagacggatcgagaggttcagcattgcgttagatgagttgagaagcgtttttgaagcgcccaaaagcgggaacaagcctgctgaatacggcggcaaagaagtagagatcgagcgctccctctgttctcctgctttcaagtctcaccccggcagccagctggaagatagcgtcaaggattcagataagaagggtaaagagacatcttttgacaaaatgtcacctgaaagtggccattcacgcattttcgaagcgactgcaggtccgaacaagccagaaagcgggttcgccgaagactctgctgcacgaggggagggagtcagcgacctacacgaggtggtgtctctcaaggagaggatggcccgctaccaggccgcagtgtcacggggcgattgtaggtccttctctgcgaacatgatggaggagtctgaaatgtgtgcggtgccggggggcctggctaaggtgaagaaacagttcgaagatgaaatcaccagtagtcgaaacacgttcgctcaataccagtaccagcatcagaacaggtctgagcaggaagcaatacactcatcccaagttggaacatcacgctccagtcaggagatggcccgaaacgagcaggagggatccaaagtgcaaaaaattgatgtccacgggacggagatggtcagtcacctggaaaagcacacagaagaggtgaatcaggccagccagttccaccaatacgtgcaggagacagtcatagacactccagaggatgaggagattccgaaagtctcaaccaagctgctgaaggagcagtttgaaaaatccgcccaggagaagatcctgtatagtgacaaggaaatgacaacccccgcaaagcagattaaaaagctgctattgcaggataaggaaatatgcattctttgtcagaagacagtgtaccccatggagtgtcttgtggcggataaacagaattttcataagtcttgctttaggtgtcaccattgcaacagcaaactgagcctcgggaattacgcctctcttcacggtcaaatctattgcaagccacattttaagcagctgttcaaaagcaaaggtaactacgacgaaggattcggccataaacaacataaggacaggtggaactgcaagaaccaatcgcgttccgtcgactttatcccgaacgaagaaccgaacatgtgcaaaaacatagctgagaataccctggtgccaggcgacaggaacgaacacctggatgcaggtaatagcgagggccaacggaatgacctgaggaagctgggggagcgaggcaagctgaaggtgatttggccacctagcaaggagatccctaagaaaaccttacctttcgaggaggaactgaagatgtctaaacccaaatggccaccagagatgaccactctgcttagccccgagtttaaaagcgaatcactgctcgaggacgtcagaacgccagagaacaagggacaaaggcaagaccattttccttttctccagccatatctccaatccacacatgtctgccaaaaggaagacgtgatcggtattaaggagatgaagatgccagagggacgcaaggacgagaaaaaggaaggaaggaagaacgtgcaagaccgacctagcgaggctgaggataccaagtccaacagaaaaagtgcaatggacctgaatgacaataacaatgtaatcgtccaatccgcagaaaaagagaagaacgagaagacgaatcaaacaaacggagcagaagtgttacaggtcactaatacagacgatgaaatgatgccagagaatcacaaggaaaatctaaataaaaacaacaataacaattatgtggctgtatcatatcttaataactgccggcagaagacctccatccttgagtttttagacctcttacctctctcctctgaggctaacgataccgccaatgaatatgaaattgagaagttggagaacacgtcccggataagtgaactcctcggaattttcgagtccgaaaagacatactctcgaaacgtcctggctatggctcttaagaaacagactgatcgtgcggccgcagggagcccagtccagcctgcaccgaagccctccttgtctagaggcctcatggtgaagggcggtagttccatcatttctcctgacacaaacctgctgaatataaaaggcagtcacagcaagtccaagaacctgcacttttttttctcgaatacagttaaaatcaccgccttttccaaaaaaaacgaaaacattttcaactgcgatcttattgactccgttgatcagattaagaacatgccgtgcttggatctacgggaatttgggaaagacgtgaaaccctggcatgtcgagacgaccgaagccgcacggaataacgagaataccggattcgatgctttgagccatgagtgcacagccaaacccctatttccacgcgttgaggtccagtcagaacagctgacagtggaggagcagataaagagaaacaggtgttattctgataccgagtag

SEQ ID NO: 140817 - DNA, 2892 bp, Artificial Sequence
  Description of Artificial Sequence: Synthetic coding sequence
atgccacttcagaaaaccaacgaagaagtgagcctgagtggtattgacagcgagtgcacagtggtgcagccctcacctggaagccaatcaaatgccagaattctcggagtgtgctcggacaatcagctgtctactacttcccctgagactgtggccgctaagcgattgcaccatgtattagccgcaagcgaggacaaagataagatgaagaaagaggtacttcagagcagcagagacatcatgcagtccaaaagcgcgtgcgaaatcaaacagagccaccaggagtgttcaactcagcagacacagcagaaaaagtacctcgaacaactgcacctcccgcaatcaaaacccatcagtcctaactttaaggtgaagaccataaagttaccgaccttggaccacacattgaatgaaacggaccactcctacgaatcccataaacagcagtccgaaattgacgtccaaactttcaccaaaaagcaatacctgaagactaagaaaacagaggcctccacggagtgctcacacaagcagtcgcttgcagaacgtcactatcagttgcctaagaaagagaaacgggtcacggtccagttaccaacggagtctattcaaaagaaccaggaggacaagctcaaaatggtaccacgaaagcagagggaattcagtggttccgacagagggaaactccccgggagcgaagagaaaaatcagggacccagcatgataggaaggaaggaggaacgcttaatcaccgaacggaaacacgagcatctcaagaacaagagtgccccgaaagtagtcaaacagaaggttattgacgcccacctggacagccagacgcagaacttccagcagacacagatacagactgctgagagtaaggccgagcacaagaagctgccacaaccctataactcgttacaggaggaaaagtgccttgaggtcaagggtatccaggagaagcaggtattctccaataccaaggactccaaacaggaaatcactcagaacaaaagctttttttcctcagtgaaggagagccagcgcgacgacggcaaaggtgccttgaacatcgtggaattcttacggaaacgcgaagagctccagcagatcttaagccgtgtgaagcagttcgaggcagagcccaataagtctgggctcaagactttccagacattacttaataccatcccaggttggttgatctctgaagacaagcgtgagtacgcagtgcacattgccatggaaaacaacctggaaaaggtgaaagaggaaattacgcatatcaaaacacaggcggaggatatgcttgtgtcgtacgaaaacatcatccaaaccgcaatgatgagctcaaaaacgggtaagcctggaaataaaccaacaagtctggacgaaacgtcaagtaaggttagcaatgttcacgtctcgaacaataagaatagcgagcagaaagaaaacaagattgccaaggagaagaccgttcagcatcaagtggctgcgcatcacgaggccacagtcaggtcccatgtcaaaactcatcaagaaattaaattagatgacagcaatatccctcccccatccctaaaaacccgtcctcccagtccaacctttatcacaattgaatctacagctaggcgaacggaaaacccaacaaagaacgagctgtcacaatctccgaaaaaagattcttacgtggagcctcccccacggcgcccaatgtcacagaagagtgaaattcatcgcgccaatacgtccccgtccccacctcgcagtcgctcagagcagctggtcaggcttaaagatactactgctaaattgtcgaagggcgccatcccctgcccagccgcgacgcccgtgccgatcgtggagaagcgaagcgaaattatcatgtctcccgcgaccctccggcgccagatcaagatcgaaacccggggccgcgacagtccacctactattacaatacccgtcaatattaatcacgccgccagcggatcgtttcgcgaatcagtagacgcccaagaggaaatacgcaaggtcgaaaaaagggccacatacgtccacaaggatggacttaattcaaccgatcacatggtccctgataccgaatcctacgacgcagtggagattataagaaaggtggccgtgccgccgcgcctctcagagcacacacagcggtatgaggctgccaaccgtaccgttcaaatggcagagaactttgttaacgatccagagaatgagattaatcgctggttccgcgagttcgaacatggccccgtgtccgaggccaaatctaataggagagtgtacgctaagggtgaaaccaatcataatatccaacaggagtcgaggaccttctgtaaggaagaattcggtttaacctcactcggcaatacttcctttacagacttctcatgcaaacatccccgagagctcagggaaaagattcccgtaaagcaacctagaatttgctcagagaccaggagcctatctgagcacttctctgggatggacgccttcgaaagtcaaattgtggaaagcaagatgaaaacgagttcctctcacagttctgaggccggcaaatctggatgtgactttaaacacgccccacccacctatgaagatgtcatcgcagggcatatacttgatatttctgacagtccaaaggaggtgcgcaaaaactttcagaaaacttggcaagaaagcggcagagtgtttaaaggattgggttacgctactgcggacgcgtccgccactgaaatgcgaaccacctttcaggaggaatccgctttcatttccgaagctgccgcaccacgacagggcaacatgtacacactgagcaaggattccctgtctaacggagtgccatccggccgccaagcagagttttcttag

SEQ ID NO: 140818 - DNA, 2916 bp, Artificial Sequence
  Description of Artificial Sequence: Synthetic coding sequence
atgtttcctatgcaaaagggttcattaaacctgctgcggcagaagtgggaaagctgcgattaccagcgtagcgagtgccatcctcgcgactcacattgcactattttccagcctcaggaatccaagctcctcgccccggaaggcgaggtggttagcgccccacagagtctcgacccaacgtcactcccttactcaactggagaggagatgtggtcaagtaagcctgaagaaaaggactctgtggataagtccaataatactcgggagtatggtcgtccagaggttttgaaggaagactccttgtcttctcggagacgcatcgaacggttctctatagcattggacgagctcaggagtgtcttcgaggcccccaagagcggcaacaagccagctgaatatgggggcaaagaagtagaaatcgaacgctcgctgtgttcccccgcctttaaaagccaccccggatcccagttggaggactctgtaaaagactcggacaaaaaggggaaggaaacctcattcgacaaaatgtcaccggaatccggccactctcggatctttgaagctgtgtttagtactgaccaggcccagatcttacgccttcatctacacccaaaactaaccaaaacccctaaaaattcattaaaatcttccacttacatcagcacggccggcccgaataaaccagagagtgggttcgctgaagactcagcagctcgaggggagggcgtctcagacctgcatgaggtcgtgtccctgaaggaacgtatggctcgttatcaggcggccgtgagccgaggggactgccggtctttttcggcgaacatgatggaggaatccgagatgtgtgccgtgcccggtgggttggcgaaagtcaaaaaacagtttgaggatgagataacatctagccgcaatactttcgctcagtatcagtaccagcatcagaatcgtagcgagcaagaagccatccatagctcgcaggtcgggactagccgctccagccaggaaatggcaaggaacgaacaggagggaagcaaagtgcagaaaattgacgtacacggaaccgagatggtaagccacctggagaagcatactgaggaggtcaaccaagcctcccagtttcatcagtatgtgcaggaaaccgtcatagacaccccagaggacgaagaaattcctaaagtgtcaaccaagttgctgaaggagcagtttgagaaatccgcacaggaaaaaatcttgtactcagataaggaaatgaccactcccgctaagcagatcaaaaaattgctgctgcaggacaaggagatctgcatcctgtgccagaagacggtctaccccatggagtgtttggtggctgataagcagaactttcacaagagctgtttccggtgccatcactgcaactcaaagctttctttaggaaactacgccagcttacatggccagatctactgtaagccgcactttaaacaactcttcaagagcaaaggcaactacgacgaggggttcggccacaagcagcacaaagaccggtggaattgtaaaaatcagagccggagcgtggactttatacctaatgaggaaccaaacatgtgcaagaacatagcagaaaatactctcgtccctggggacagaaacgaacacctggatgctggcaatagtgagggtcagcggaacgatctgagaaagcttggagaaagggggaagctgaaggtgatatggccacccagcaaggaaatccctaagaaaactctgcccttcgaagaggagctgaagatgagcaaaccgaaatggcctcccgaaatgaccaccctcctcagcccggagtttaagagtgagtcacttttggaggacgtaagaaccccagagaataaaggccagcgccaggaccattttccatttttgcaaccatacctgcagtccactcacgtgtgccaaaaggaggacgtgattgggatcaaagaaatgaaaatgcctgaaggaaggaaagatgaaaagaaggagggtaggaaaaatgtacaggaccggccctccgaggctgaagacacaaaatctaatcggaaaagtgccatggatttaaacgacaacaacaacgtgatcgtacagtctgcagagaaagagaaaaacgaaaaaacaaatcagacaaacggggctgaagtgctacaagtcacgaatactgatgatgagatgatgccagagaaccacaaagagaatctcaataaaaataacaataacaattacgtagcagtgagttaccttaacaattgtcggcagaaaacatccattttggagtttctcgatctactcccccttagttctgaggccaatgacacggcgaacgagtacgagattgagaaactcgaaaatacttcccgcattagcgagctcttagggattttcgagagcgagaagacctacagccgcaacgtcctggccatggccctcaagaaacagacagaccgggccgccgccggatcccccgtgcagccagcccctaaacctagcctcagccgaggtctgatggtgaagggaggttctagcattatctctccagacacgaatctactcaacatcaaaggtagtcactctaaatccaaaaacctacatttcttcttctccaataccgtgaaaattaccgccttcagcaaaaagaatgagaacatatttaactgtgatctgatcgattcagtcgatcagatcaaaaatatgccatgcctcgaccttcgcgaattcggtaaagatgtgaagccttggcatgtcgagacaactgaagccgcacgaaacaacgagaataccggctttgacgctctgtcccatgagtgcaccgcaaagcctctgtttccacgggttgaggttcagagtgagcagttgactgtggaagagcagatcaaaaggaacaggtgttatagtgacacagaatag

SEQ ID NO: 140819 - DNA, 2916 bp, Artificial Sequence
  Description of Artificial Sequence: Synthetic coding sequence
atgttccctatgcagaaaggttcactcaacctcctgcgacaaaagtgggaatcatgtgactaccagaggagtgagtgccatccccgggattcccactgcacaatctttcagccacaggagagcaagctgctggcacctgagggagaggttgtctccgccccccagagtctggaccctaccagcctcccctactctaccggtgaggagatgtggtcttctaagcccgaggaaaaggattctgtggataaaagcaataacacacgggagtatgggaggccagaagtgctgaaagaagatagcctaagtagtagaaggaggatcgagcgcttttcaatcgccctggatgagctgaggtcggttttcgaggcccctaagtccggtaacaagcccgccgagtacgggggtaaggaagttgaaattgaaaggagcctgtgctcccccgcttttaaaagtcaccccggaagccaactcgaggattccgttaaggattccgacaagaagggaaaggaaacaagtttcgacaaaatgtcgccagagtctggacattcacggatctttgaagccgtgttctcaacggaccaggcccagatcctacgactgcatctgcatcctaaactcactaagacgcccaagaattcactcaaaagcagtacgtatatcagcacggccgggcctaataagccagagagtggattcgctgaggatagtgcggcccgcggtgagggagtcagtgacttgcacgaagttgtctccctgaaagaaagaatggccaggtatcaggccgcagtcagtcgcggcgactgtcgatccttctctgcgaacatgatggaggaaagtgaaatgtgcgccgtgcctggcggtctggccaaagtgaagaagcagttcgaggacgagatcacatcaagccgcaacacctttgcacagtaccagtatcaacatcagaatagaagcgagcaagaagcgatccactcatcacaggtgggaacatctagaagcagccaggagatggcacgaaacgagcaagaaggatccaaggtgcagaaaattgacgtgcacggaaccgagatggtttcccaccttgagaaacacacggaagaggttaaccaggcctcccaattccaccagtatgtccaggaaaccgtcattgacactccagaagacgaggaaatccccaaggttagcactaagctgcttaaagagcagtttgaaaagtccgcacaggagaaaattctgtactcggacaaggagatgaccacccctgcaaaacagatcaagaaactccttctgcaagacaaggaaatttgtattttgtgccagaaaactgtgtatcctatggagtgtctggtggcagacaaacagaattttcacaagagttgtttcaggtgtcaccattgtaatagcaaactttctctaggtaattacgcctccttgcacggccagatatactgtaaaccacacttcaagcaactgtttaaatccaagggcaactatgacgagggttttgggcacaagcagcacaaggaccgctggaactgcaaaaatcaatcgcgtagcgtggattttattcctaacgaggagcctaatatgtgcaaaaacattgccgaaaatacactggtcccaggcgataggaacgaacacctcgatgctggaaacagcgaaggtcaaagaaatgacttgcgaaagctgggtgagcgggggaagctgaaggtgatctggcccccaagcaaggagatcccaaaaaaaactctaccatttgaggaagagctgaaaatgagcaaacccaagtggcctcccgaaatgacaactctactttcgcccgagttcaaatccgagtcactgctcgaagacgtcaggacacctgagaataaggggcaacggcaggaccattttcccttcttgcagccgtatctgcaatccactcacgtttgtcaaaaggaagacgtgattggcattaaggagatgaagatgcctgaagggagaaaggacgagaaaaaggaggggagaaagaacgttcaagatcggcctagtgaggcagaggatacaaagtctaatcgtaaaagcgcaatggacctgaacgacaataataacgtcatcgtccaaagtgccgagaaggagaagaatgaaaagacaaatcaaaccaacggcgccgaggtcttgcaggtaactaacacggacgatgagatgatgcctgaaaatcacaaggaaaatctgaacaagaacaataacaataattatgtggctgttagctatttgaataactgtaggcagaaaaccagtattttagaattcctcgatttactacccctgtcttctgaggctaatgacacggctaatgaatacgagatcgagaagctcgaaaatacatcgcggatatctgaacttttggggatctttgaatccgaaaaaacatatagcaggaacgtcctcgccatggccttaaaaaagcagaccgatagggccgccgcaggctctcccgtccagccagccccgaagcctagtctatcacggggtctgatggtcaagggaggctcctctatcatatctccggacacaaatcttctcaacattaagggatcacattctaagtcaaagaacctccacttcttttttagtaacactgtgaaaattaccgcattttcaaaaaagaatgagaatattttcaactgcgatttaattgacagcgttgaccagattaagaacatgccctgcctggatctgcgggagttcggcaaggatgtcaagccgtggcacgtggagactaccgaagccgctcgcaataacgagaacactggcttcgacgcattgtcacacgagtgtaccgcaaaacccctattcccgcgagtcgaagtgcagtcggagcagctaaccgtggaggagcagataaaacgcaaccgatgctactccgataccgaatag

SEQ ID NO: 140820 - DNA, 1380 bp, Artificial Sequence
  Description of Artificial Sequence: Synthetic coding sequence
atggagacagtgttcgaagagatggatgaggaaagtactgggggggtgagctcaagcaaggaggaaatcgtcctgggacagcgactgcacctgagtttccccttctccatcatcttttctacagtgctatactgcggggaggtggcttttggcctgtatatgttcgaaatataccgtaaagctaacgacactttttggatgagttttacaatctctttcattatagtcggagcgattctggatcaaatcatcttaatgttttttaacaaagatctgcgccgcaataaagccgcattactgttctggcatattctgcttctcggcccaatagtacgctgcttgcacactattaggaattaccacaagtggctcaagaatctgaagcaggaaaaagaggagactcaggtgtctattaccaaaaggaacacgatgctggagagagaaattgcctttagtattagggataattttatgcagcaaaaggcctttaaatacatgtctgtgattcaggcctttctgggctcagtgccacagttgatactccagatgtacatctcattgaccattagggaatggccactgaatcgcgctctactgatgaccttttctctgctgagcgtgacctacggtgctataagatgcaatattctagcaatccagatcagcaacgatgataccaccattaagttgcctcctattgagttcttctgtgtggtcatgtggcgattcttggaagtgatatcaagggtggtgacattggcattttttatcgcaagtctaaagctcaaatccctgccagtgctgctgattatttactttgtttctttgttagcaccttggcttgagttctggaagagtggtgcccacctcccaggaaataaggagaacaacagcaatatggttggcactgtactcatgctctttctgatcacactgctgtatgccgccattaacttcagctgctggagtgccgttaagcttcagctcagcgacgacaaaatcattgacggtcggcagcgatgggggcatagaattctgcattacagctttcaattccttgaaaatgttatcatgatcctggttttccgtttttttggagggaaaactctgctcaattgttgcgactccctgatcgctgtacaactgatcatcagttacctgctggcaaccggcttcatgttgctgttctaccagtatttgtatccgtggcaaagcggcaaggtactgccgggacggacagagaatcagcccgaggcaccttactactacgtcaacatagagaagacggagaagaataagaataaacagcttcgcaattattgtcacagttgcaaccgggtgggatacttctcaattaggaaaagcatgacctgctcatag

SEQ ID NO: 140821 - DNA, 1389 bp, Artificial Sequence
  Description of Artificial Sequence: Synthetic coding sequence
atgaacaccagaccacaacactcagagcgtacatctacgatggatcgtgtgtatgagattcccgaagaaccaaatgtggatcctgtgtcttccctggaggaagacgttatccgcggagctaatccacgattcacatttcctttttccattcttttctccacatttctctactgcggagaggctgcaagcgcgttatacatggtgagaatttaccggaagaattccgagacttactggatgacatacaccttttcattttttatgttctcaagtattatggttcaactgacattgatattcgtacacagggatctggccaaagacaagcctctgtcgctttttatgcatttgatcctgctcggtcccgttataaggtgcctggaggctatgattaaataccttaccctgtggaaaaaggaggagcaagaagagccatatgtctcactgactcgaaaaaagatgctaatcgacggagaagaggttttgatcgaatgggaagtcgggcacagcattcgcactcttgcgatgcataggaacgcatacaagaggatgtcacaaattcaagcctttctaggatcagttccacagctcacctaccaactctacgtcagtcttatttccgccgaagtccctctgggcagggtcgttctgatggttttttccctggtgagcgttacttatggggctacactctgcaatatgcttgccatacaaattaagtatgatgattataagattagattgggtcccttagaagtgctgtgcatcactatctggcggacgctggagataacatcaaggttgctcatcttagtcctgttctccgccactctgaagctgaaggctgtgcccttcctcgttctgaatttcctaatcatcttattcgagccctggataaagttctggcgcagcggcgcacaaatgccaaataatattgagaagaacttttccagggtaggaactctcgtcgttctgataagcgtcaccatattgtatgcaggcatcaatttttcttgttggagcgctctccagctgaggttggctgatagggacctggtggacaaaggccagaactggggccacatgggattacactactcagttcgcctggtggagaacgtgatcatggtcctggttttcaagttcttcggagtgaaggtgctcctcaattactgccactcgctcatcgccctgcagcttataatcgcctaccttatttccatcgggtttatgttgttgtttttccaatacctgcacccactaagatctctcttcacacacaatgtagtagattacctgcattgcgtgtgctgccaccagcatccaagaacccgggtcgagaactcagagccccccttcgagacggaggcccgccagagcgtcgtgtag

SEQ ID NO: 140822 - DNA, 1350 bp, Artificial Sequence
  Description of Artificial Sequence: Synthetic coding sequence
atggaccgtgtctatgaaattcccgaagagccgaatgtcgatccggtgagctctctcgaagaggacgtgattagaggcgccaatcctcgttttacattcccgttttcaattttgttttccaccttcctgtactgcggcgaggctgccagtgccctctatatggtgagaatctacaggaagaatagcgaaacatactggatgacctacacattctcgtttttcatgttctcatcgatcatggtgcagctgacacttatctttgtacacagggaccttgctaaggacaaacctctgtctctctttatgcacctgatactcctaggaccagttataaggtgcctggaggccatgatcaagtacctcacgctttggaagaaagaggagcaagaggaaccttacgtgtcgcttactaggaagaagatgctgattgacggtgaggaggtgttaattgagtgggaggttgggcactcaatccggactttggccatgcacaggaacgcctacaagcgcatgtcacaaatccaagcttttctcggctctgtaccacagctgacctaccagctctacgtctcactgatcagtgcggaggtcccactgggaagagtcgttctgatggtgttttccctggtttccgtcacatacggcgccactctttgcaatatgcttgctattcaaatcaagtacgacgactataaaattagactcgggcccttagaggtgctctgcataaccatttggcgcacactcgagatcacatcaagacttctcattctcgtactgttctctgctactctcaaattgaaagccgttccattccttgtattgaattttctgatcatcctcttcgagccatggatcaagttttggagaagcggagcgcagatgccaaataacatcgagaagaattttagccgtgtcgggacactcgtcgttctcatatctgtgactatcctgtatgctggaattaacttctcatgttggagtgccctgcagctgcggctggcagatagggatctggttgacaaaggacaaaactgggggcacatggggctacattatagcgtaagacttgtggaaaatgtgattatggtgctggttttcaaatttttcggcgtgaaagtgctgctcaattactgccactcactgattgctctgcagctgattattgcatacctgatcagtattgggtttatgctgctcttttttcagtatctgcatcccctacggtctctgtttactcataacgttgtagattatctgcattgtgtttgctgtcatcagcaccctaggacccgggtggaaaattccgaaccccccttcgagactgaggctcggcagagcgtcgtctag

SEQ ID NO: 140823 - DNA, 1335 bp, Artificial Sequence
  Description of Artificial Sequence: Synthetic coding sequence
atgaagttccccgccagtgttctggcatctgtgtttctctttgtcgcggagacaacagccgcacttagtctgagtagtacttacagatctggtggagataggatgtggcaggccctcacattgctgttttccttactcccttgcgccctagtccagctaactttgctcttcgtgcatcgggacctgtcacgggaccgccctttagttttgcttctccacctgctgcagcttggccccctgttccgttgttttgaggtgttctgtatttatttccaaagcgggaacaacgaagaaccttacgtctcaatcacaaaaaaaagacagatgcctaaaaatgggctgtcagaagaaattgaaaaggaagtaggccaggccgaagggaagctgatcacgcaccggtccgccttcagtagggccagcgtaattcaggcttttcttggtagtgcgccccagctgactctgcaactatacatctcagtgatgcagcaagacgttacagttggacgctcactgctgatgacaatttcattattatccattgtatacggggccttgcgctgtaacatactggcgattaaaatcaaatacgatgagtatgaggtaaaggtgaagcccctcgcatatgtctgtatttttctgtggcgctcctttgaaatcgcaacccgggttgtggtactagtgcttttcacctcagtcctgaaaacctgggtcgttgttataattctgataaactttttttcattctttttgtacccctggatcctgttttggtgtagtggatcacctttcccggagaacatagaaaaggccctgagccgcgttggcacaaccatagtgctgtgcttcctgaccttactgtacactggtatcaatatgttctgttggtccgccgtgcagttgaagattgactcaccagatttgatttccaaatcccataactggtaccagttgctggtctactacatgattagattcatagagaatgctatcctgctgctactctggtacctattcaagactgatatctacatgtatgtctgcgccccgctgttggtcctccagctcttgatcggctactgcactgccatcttattcatgctcgtcttctaccaattttttcacccatgtaagaagttattcagtagttcagtctccgagggtttccagagatggcttcggtgcttctgctgggcctgtcgacagcaaaaaccttgcgagcccattggaaaagaagatctccagtctagtcgtgaccgtgacgaaactccctcctcttccaaaacatctcctgagccagggcagttccttaatgcagaggatctgtgttcagcatag

SEQ ID NO: 140824 - DNA, 1929 bp, Artificial Sequence
  Description of Artificial Sequence: Synthetic coding sequence
atggctgcaagccgaaagcctcctagggtgcgcgtgaatcatcaggacttccagctccgcaacctgagaataatagaacccaatgaggttacacactctggcgatacgggcgtggagaccgacggccgaatgccaccgaaggtgacatccgaactcctgcgtcagctgagacaagcgatgcgaaattcagagtatgtcaccgaaccaatccaggcctacatcatacctagtggagacgcccatcagtctgaatacatcgctccctgtgactgcagaagagcattcgtctctggcttcgacggtagtgcgggcacagcgattataacagaggagcacgctgctatgtggaccgacggacgctattttctgcaagccgccaagcagatggattctaattggaccctcatgaagatggggctgaaagatacccctacgcaggaggactggctggtgtcagtgttaccggaggggtctcgcgtcggcgtagatcctctgattattccaaccgactactggaagaaaatggccaaggtactgcggtccgcaggacaccatctgattcctgtgaaggagaatctggttgataaaatttggaccgaccgtccggagcgaccctgcaagccactcctgaccctcgggctggactacacaggtatcagctggaaggacaaagtcgcagacttaaggttgaaaatggcagaacgcaatgtgatgtggtttgtggtgaccgcactcgatgaaatagcatggctgttcaatctgcgtggcagcgatgtggagcacaatccggtgtttttcagctatgccatcataggtctggaaaccatcatgcttttcatcgacggcgaccgcattgatgccccatcagtgaaagaacatctgttgctcgacctcggactcgaggccgaataccggatccaggtgcacccttataaatcgattctgtcagagctaaaagctttgtgtgctgacctaagccctagggagaaggtctgggtgtccgataaggcttcctatgcagtgagtgagacaatccccaaggaccatcgttgttgtatgccctacacgcctatttgcatcgccaaagccgtgaaaaatagcgcagaaagcgaaggtatgcgtcgtgctcacatcaaagatgccgtcgccctttgtgagctgttcaactggctggaaaaagaagtcccaaagggtggggtgaccgagatttccgcggccgataaagcagaagagtttcgacgccaacaggctgacttcgtggacctctcgtttcctacaatctcttcaaccggccccaacggggctatcatccactacgctgacgggaccactgacgtaaccaggactatgcatttcggaacacccacagcttacgagaaagagtgttttacctatgtcctgaaaggacacatcgctgtgagcgcggccgtcttcccaacaggcacaaagggccacttactcgatagtttcgcccgctctgccttatgggacagcgggcttgactatctgcacggaacagggcatggagtaggtagcttcttaaacgtccatgaggggccttgtggaatctcctacaagaccttcagcgatgaacctctggaggctgggatgattgtgaccgatgagcccggatactacgaggacggggctttcgggatcagaattgaaaatgtcgtgctcgtcgttcctgtcaaaactaagtataattttaataatcgtgggagcctcactttcgagcctcttacgctggtccccatccagaccaagatgatcgacgtggacagtctgacagacaaggaatgtgactggctcaataattatcacttgacatgcagggacgtcattggtaaagaattgcaaaaacagggccgccaggaagcgctggaatggctgattcgcgagacccagccaatcagcaagcagcactag

SEQ ID NO: 140825 - DNA, 1872 bp, Artificial Sequence
  Description of Artificial Sequence: Synthetic coding sequence
atgccgcccaaggtgacttcagagttactgagacagctgaggcaggccatgcgtaattctgagtacgtgacggagcccatacaggcttatataattcctagtggcgatgcccaccaatctgagtacatcgccccgtgtgactgtaggcgtgcttttgtcagcgggtttgatggcagcgcaggaacagccattataacagaagaacacgcagcaatgtggaccgatggacggtactttcttcaagccgcaaaacagatggatagtaattggactctaatgaagatgggactcaaggacacgcccactcaagaggattggctggtgtctgtgctgcccgagggctcaagggttggggtggaccctctgattattccaacagattactggaagaaaatggcaaaggtgctgcgcagcgccgggcatcatctaatccccgtgaaagagaaccttgtggacaagatctggactgaccgtcctgagcggccctgcaagcctctgctgacacttggtctggactacacaggtatctcctggaaggacaaagtggctgatctgcgactcaagatggccgaacgcaacgtcatgtggttcgttgttaccgcccttgatgagatcgcgtggttgttcaacctgagagggagcgacgttgagcataaccctgtgtttttttcttacgcaatcattggcctcgagacaatcatgctgtttatcgacggagatcgaatcgatgccccgtccgttaaagaacatctgctgctcgacttggggctggaggcagaataccgtatccaggtccatccttataagtccatcctcagcgaactgaaggctttgtgtgcagatctgtctccacgtgagaaggtgtgggtttcagacaaggcttcatacgccgtctccgagaccatccccaaagatcatcgctgctgcatgccttacaccccaatctgcattgcgaaggcagttaagaactcagctgagtctgagggaatgcggcgggcacacattaaagacgccgtggctctgtgcgagctgttcaattggctagaaaaagaagttccaaaaggcggtgtgactgagatttctgccgccgacaaagcagaagagtttaggcggcaacaggctgacttcgtggacctgagctttcccacgatcagcagcacagggcccaacggcgccatcatccactatgcccctgtgccagagactaataggactctcagcttggatgaggtctacctcattgactccggggcacaatacaaagacggtacaacagacgtaactcggacgatgcattttgggacacctaccgcctacgagaaagaatgctttacctatgtgctcaaaggacatatcgcagttagcgctgccgtgtttcccaccggtacaaagggacatctcctcgactccttcgccagatccgcgctgtgggactccgggctggactatctgcatggcaccggtcatggtgtgggatctttcctgaatgtacacgaggggccgtgtgggatttcttataagacattcagtgatgagccacttgaggctggaatgattgtcactgatgagccaggatattacgaagacggcgccttcgggatcaggatagaaaatgttgttctagtagtgccagtaaagacgaagtacaacttcaataatcggggttctttgacattcgagccactgactctagtgcccatacaaactaaaatgattgatgtggactccctgaccgataaggagtgcgactggttgaacaattatcatttaacgtgtcgcgatgtcatcggaaaggagctgcagaagcaaggacggcaggaggctctagaatggctgatccgcgagacgcagcctatctctaagcagcactag

SEQ ID NO: 140826 - DNA, 1659 bp, Artificial Sequence
  Description of Artificial Sequence: Synthetic coding sequence
atgtggacagacggacgatactttctccaggctgccaagcagatggattctaattggacactaatgaaaatgggcctcaaagatacccccacacaggaggactggctcgtaagcgtgctgcccgaaggcagccgagtgggtgtggaccctttgattattcctaccgattattggaagaaaatggccaaagtgttgcggtctgcgggccatcacttgatccctgtaaaagaaaaccttgtggacaaaatctggacggatcgacccgagaggccctgtaagcctctgctgaccctcgggctagattataccggcatctcgtggaaggacaaagtcgccgatttgagactgaaaatggcagagcggaatgtgatgtggttcgtggttaccgctcttgacgagatcgcttggctgtttaatctgcgcggcagcgatgtcgaacataatcccgttttcttcagttatgctattattgggctggaaacgatcatgctgttcatcgatggcgaccgtatcgatgccccttctgtgaaagagcacctgctgttagatttgggcttggaagcagaatacagaatccaagtgcacccatacaaatcaattctgagtgagctgaaagccctatgcgcagatctgtcaccgagagagaaagtgtgggtatccgataaagccagttatgctgtaagtgagacgattccaaaggatcatcgttgctgtatgccttatacacccatatgcatcgccaaggctgttaagaattctgcagaatctgagggcatgaggagagcccacattaaggatgctgtcgccctgtgcgaactgtttaactggctggagaaggaggtacctaaggggggggtgacagagatctccgctgctgataaggcagaagagttcagacgtcagcaggccgatttcgtcgacctgtctttccctaccatatcttccaccggcccgaacggggctatcatccattacgcccctgtgccagaaactaatcggaccttgtccctcgatgaggtgtaccttatcgactccggggctcagtacaaggacggaacaacggacgtcacacggacaatgcacttcggaaccccaaccgcatatgagaaggagtgtttcacttacgtgctcaaaggacatatcgccgtgtccgccgccgtttttccaaccggcaccaaaggccaccttctcgacagtttcgctcgcagcgcgctctgggattccgggctggactacttgcatggtactggacacggcgttggctccttcttaaacgtacacgaaggcccctgcggcatttcgtataaaactttctcagacgagcctctagaggctggcatgatcgtaaccgatgagccagggtattatgaagatggggcctttggcatccgtatcgaaaacgtagtcttagtcgtccctgtcaaaacgaaatacaattttaataatcggggctctctcacctttgagccactgaccttagttcctatccagaccaagatgatcgacgtggattctttgaccgacaaagagtgcgactggctcaacaactaccacctaacatgtcgtgatgtgatcgggaaggaactgcagaaacagggtaggcaggaggccctggagtggctcatccgcgaaacccagcccatatcaaagcagcactag

SEQ ID NO: 140827 - DNA, 912 bp, Artificial Sequence
  Description of Artificial Sequence: Synthetic coding sequence
atgccccccaaggtgacctccgaacttctgaggcagctgcgccaggccatgcggaacagcgagtacgtcacagaacccatccaggcgtacattatcccaagtggggacgctcaccagtctgagtacatcgcaccatgcgactgccgccgcgcctttgtgtctgggtttgatgggagtgccgggaccgccataattaccgaagagcatgcagccatgtggactgacggccggtactttctccaggcagctaagcagatggactcaaattggacactgatgaaaatggggctcaaagacactcctacgcaggaggactggctggtcagtgttctgcccgagggatctcgagtgggggtggatccactcatcatccccacagactactggaaaaaaatggcgaaggtactgagatcagccggacatcacctgatacccgttaaagagaatcttgttgacaaaatatggactgaccgccccgaaagaccgtgcaagccacttctcacgcttgggctggactatacagggatttcttggaaagacaaggtcgcagatctccggcttaagatggctgaaagaaatgtgatgtggtttgtcgttactgcactggacgagatagcctggctatttaacctgagagggtcagatgtggagcacaatcccgtgttcttttcatatgcaattattggcctggagaccatcatgttgtttatcgatggcgacagaatcgatgctccctctgtgaaggaacacctcctccttgacttgggattggaggctgagtatcgtattcaagtgcatccctacaagtctattttgtctgagctgaaggcactgtgcgctgatctgtccccccgtgaaaaggtctgggtttccgataaagcctcttacgccgtgtccgaaacaattccttag

SEQ ID NO: 140828 - DNA, 2001 bp, Artificial Sequence
  Description of Artificial Sequence: Synthetic coding sequence
atggcggcctctcgcaagcctccccgggtgcgcgttaaccaccaagacttccagctcaggaatctccgaatcattgagcccaacgaggtgacccatagtggggacaccggtgtcgaaaccgatggtcgcatgccgcctaaagttacaagtgagctcctcaggcagttgcgccaggctatgcggaactcagagtatgtgaccgaaccaatacaggcctatattatcccctctggggatgcacaccaatctgagtatattgctccctgcgactgtcggcgggcttttgtttcggggttcgacggaagtgctggcaccgctatcatcactgaggagcatgccgctatgtggactgacggccgctacttccttcaagccgccaaacagatggatagcaattggactctcatgaaaatggggctcaaggatactcctacacaagaggactggctggtgtctgttctgccggaggggagccgggtgggcgtcgacccattgatcataccaacagactactggaagaagatggcaaaggtgctgcggtccgccgggcaccacctgattcctgtgaaggagaatcttgtcgacaagatttggacggatagacctgagcgtccttgcaaaccgttactgacgcttggactagactacaccgggatttcatggaaggacaaagtcgccgacctgcgactgaaaatggctgaacgtaacgtgatgtggtttgtggtaacggccctggacgagatcgcttggctcttcaacctgagggggtccgatgtcgaacacaatcctgtatttttcagctatgccataataggcctggagaccatcatgctctttattgacggggataggatcgacgcaccttccgtcaaggagcacctgctgcttgacctgggcctcgaggctgaatatcgaatacaagtgcatccctataagtcaatcctctcggaattaaaagcactttgcgccgatcttagtccgagggaaaaggtgtgggtttcagacaaggccagttatgctgtgagcgagacaattccgaaggatcatcgctgttgcatgccctataccccgatttgtatagccaaagccgtcaaaaacagtgctgagagtgaggggatgcggagggcccacattaaagatgccgtggcactgtgcgagctctttaattggctggagaaggaagtcccgaagggaggcgtcacagagatctctgcagctgataaagctgaggagtttaggaggcaacaggccgactttgtggacttatccttccctacaatctcgtcaactggacctaacggcgccatcattcattacgcccctgtgcccgagactaatcgcaccctttcccttgacgaggtttatctcatcgattccggcgcccagtacaaggatggcacgacagatgtgactcgcactatgcacttcggtactcccaccgcatacgagaaggagtgtttcacctatgtgctgaagggacacatcgcagtctccgccgcggtgttcccaacagggacaaagggccatctccttgacagcttcgcccgcagcgccctttgggacagcgggctggactatctgcatggaactggacacggggtgggatcttttctgaacgtgcatgaagggccctgcggcatcagctacaagactttctctgatgaaccactggaggccggaatgattgtcactgatgagcccggatactatgaagacggagcttttgggattcggatcgagaacgtagttcttgtggttccagttaagaccaaatacaacttcaacaaccgagggtctctgacctttgaacctctcactctggttcccatccaaacgaagatgatagacgtggattcgctcactgacaaggaatgcgactggctgaacaattatcacctcacttgtagggatgtgatcggcaaggagctgcagaagcagggcaggcaggaagcactcgagtggctgatcagagagacgcagccaattagtaagcagcactag

SEQ ID NO: 140829 - DNA, 552 bp, Artificial Sequence
  Description of Artificial Sequence: Synthetic coding sequence
atggccagggctcattggggctgttgtccctggctggtactgctttgtgcctgcgcctgggggcacaccaaacctgttgatcttggcgggcaggacgtcaggaactgctcaaccaatccgccctacttaccagtgaccgtcgtcaacacaactatgagcttgacggctcttcggcaacagatgcagacccaaaacctgagcgcctatatcatcccagggacagacgcgcacatgaatgagtatattgggcagcacgacgagcggcgtgcatggatcactgggttcaccgggagtgctggcaccgctgtcgtcaccatgaagaaggcagccgtctggaccgactcgaggtactggacccaagcagagcgccagatggattgcaactgggaactacacaaggaggtcggcaccactccaatagttacctggctgttgacggaaatcccggctggcggcagggtgggatttgatcctttcctcctcagcataggaatgctgtttctccaatcactgaatctgtctatgctgacacgcgtcacccagctgccatag

SEQ ID NO: 140830 - DNA, 2025 bp, Artificial Sequence
  Description of Artificial Sequence: Synthetic coding sequence
atggcacgtgcccattggggctgttgtccttggttggtccttctgtgcgcctgtgcatggggtcacaccaaacccgttgatctgggcgggcaggacgtccggaattgtagcaccaacccaccttacttgcccgtgactgtggtaaacactacaatgagcctgactgcgctgcgtcagcagatgcagacacagaatctgtcagcctacattattcccggaaccgacgcgcacatgaacgagtatatcggccaacacgacgagcggagggcctggataacaggttttacgggctctgctgggaccgccgttgtcacaatgaaaaaagcagcagtgtggacagattcccggtattggacccaggctgagcgacaaatggactgcaactgggaattgcataaggaggtgggaactacaccaatcgtgacgtggcttctgacagagatcccagccgggggaagagttggcttcgaccctttcctgctgtcgatcgacacatgggaatcatacgacctggccctccagggatcgaacaggcagctagtatcgatcaccaccaacttggtggacctggtgtggggcagcgagagacctcctgtccccaaccagcctatttatgcgctgcaggaggcattcaccggatctacatggcaggaaaaggtgagcggagtgcggtctcagatgcagaagcatcagaaggttcctacggctgtgctgctgtcagctctggaggagactgcatggctgttcaacctgcgcgccagtgatatcccctacaatccatttttctattcttatacactgctcaccgactcctctattcgtcttttcgccaacaaatccagattctccagcgaaacactttcctatctcaactcaagctgtactggccccatgtgcgtgcaaattgaggattattctcaggttcgagactcgatacaggcctacagcctaggcgatgtgcggatttggatcggaactagctacaccatgtacggtatctatgagatgatccctaaggaaaaactggtgactgatacttactcacctgtgatgatgaccaaggccgtgaagaactccaaggaacaagcgttgctgaaagctagccacgtccgagacgctgtcgctgttatacggtatctggtgtggctggagaagaacgtcccaaaaggaaccgttgacgaattttcaggagccgagattgtggataagtttcggggcgaggagcagtttagtagcggaccttcctttgagaccattagtgcctctgggctgaacgccgccctggcccattattcccccactaaagaattgaaccggaagctttcgtccgacgaaatgtaccttctagattccggaggtcaatactgggacgggaccacagatatcacaagaaccgtacattgggggaccccctctgcgtttcaaaaggaggcttatacccgagttttaatcggcaatattgatctgtcccgcctgatattccccgccgcgacatccggaaggatggttgaagcttttgctagaagggcgctttgggacgctggtttgaattacgggcacggaactggccatgggatagggaatttcctgtgcgtccatgagtggccagtcggctttcaaagcaataacatcgcaatggccaaagggatgtttacatcaatcgagcccggctattacaaagacggagagttcggtatccgccttgaagacgtagcactggtggtggaggctaaaacaaagtacccaggttcgtacctgacgttcgaggtggtgtccttcgtcccctacgacagaaatctgatcgatgtgtctctgctctctccagagcacctgcagtacctcaacagatattaccagactatccgggagaaggtgggcccagaacttcaaaggaggcagctgttggaggagttcgaatggttgcaacagcacaccgagccactggctgcccgggctcctgatactgcctcatgggcatctgtgcttgtggtcagcactcttgccatcctgggctggtctgtatag

SEQ ID NO: 140831 - DNA, 1524 bp, Artificial Sequence
  Description of Artificial Sequence: Synthetic coding sequence
atgccatggttgctttccgcccccaaattagtgccggctgtggctaacgttagaggcctgagtggctgcatgctttgttcacagcgccggtacagcctccagcccgtgcctgagagacggataccaaatcgctacctcggccagcccagtccctttactcacccacatctgctgagaccgggagaggtaaccccaggcctaagccaggttgaatatgctctgcgccggcacaagctgatgtcgctgatccagaaggaggcgcagggccagagtggcactgaccagacagtggtggtgcttagtaaccctacgtactacatgagcaacgatatcccgtacacatttcaccaagacaacaacttcctttatctgtgtggcttccaggaacctgacagcatactcgtgctgcaaagtcttccgggcaagcagttgccatctcacaaagccatactctttgttccccgcagagatccaagtcgcgagctgtgggacggacccagaagtggtaccgacggggccattgcactgaccggcgtggacgaggcgtacactctagaggagttccaacacctcctgcctaaaatgaaggctgagaccaatatggtttggtacgattggatgagacctagtcacgcccagcttcactctgattacatgcagcccctgactgaggccaaggccaagtccaagaacaaggttagaggtgttcagcagctgattcagcgcctgaggctaatcaagagcccagccgagatcgagcgaatgcagatcgccggaaaacttacatctcaggccttcattgaaaccatgttcacttccaaggcgcctgtggaggaagccttcctttatgctaaatttgaatttgaatgtagagcgcgtggagctgatattctcgcctaccctcccgttgtggccgggggaaacagatccaataccttgcattatgtgaaaaacaatcagctcatcaaggacggtgagatggtgctgctggatggcggatgcgaatcatcctgttacgtgtccgacataacacgcacatggccagtcaacggcaggttcactgccccccaagccgagctgtacgaggctgtcctggagattcaacgcgactgtttggctctttgctttcctggcacatctctggagaacatctacagcatgatgctaacccttatcggtcagaagctgaaggacttgggtatcatgaagaacattaaagaaaataatgctttcaaggccgcccgcaaatattgtccacatcatgtgggacactatcttggtatggacgttcatgataccccggatatgcctcgatcactccccttacagcccgggatggtcataactattgaacctgggatttatattcctgaagatgacaaagacgctcctgagaagtttcgtggcctcggggtgagaatcgaagatgatgtggtcgtcacccaagatagcccgctaattctgtctgccgattgcccaaaggagatgaacgacattgaacaaatttgctcacaggccagctag

SEQ ID NO: 140832 - DNA, 837 bp, Artificial Sequence
  Description of Artificial Sequence: Synthetic coding sequence
atgccatggctgcttagtgcccccaagctcgtccccgctgttgccaatgtcagaggactctctggttgtatgctgtgcagccaaagacgatactcgctgcagccggttcccgaaagacgcatccccaaccgctatctgggccagccttcacctttcactcacccccacctgctgagacccggggaagtcacccctggactgtcacaggtggaatatgctttacgccggcacaaactgatgagcctgatccagaaggaggcccaaggccaatcgggtacggatcagactgtggtggttctttccaatccgacttactacatgagcaacgatattccttatactttccatcaggacaataacttcctatacctgtgtgggttccaggaacccgatagcatcctggtccttcaaagtctgcccggaaaacagttgccatctcacaaagctattctttttgttccacgccgagacccctcccgagaactctgggacggtccgcgctcaggcactgatggtgctatagcgcttaccggtgtcgatgaagcgtacaccctggaggagttccagcacctcttacctaaaatgaaggccgaaacaaacatggtgtggtacgattggatgagaccgtctcatgcccagcttcattctgactacatgcagccgctgacagaagcaaaggccaagagcaagaataaggtgcggggggtccagcagctgatccagcggctgcgtttaattaaaagcccagcagaaattgaaagaatgcagatcgcaggcaagctgacatctcagcgccaggggttctcagtactttcacgcctggtttcaaactcctag

SEQ ID NO: 140833 - DNA, 867 bp, Artificial Sequence
  Description of Artificial Sequence: Synthetic coding sequence
atgccttggctattgtccgctccaaagctcgtaccagccgtcgctaacgtccggggactgtccggatgcatgctctgtagccagcgcaggtattcgcttcaacctgttcccgagaggcggattccgaatcgttacctggggcagccttcccctttcacacatcctcacctgcttagaccgggggaggtgacacctggcctatcccaggtggaatacgcactgcggcgccataagctcatgtccctgatacagaaggaggcgcagggtcagagcgggactgaccagactgtcgtcgtgctttccaatccaacctattacatgagcaacgatatcccctatacattccaccaagacaataattttctgtacctgtgcggttttcaggagcccgacagcatcctggtgctgcagagcttgcctggcaaacaactgcctagccataaagccatcctcttcgttccaagaagagacccatcacgcgaactgtgggatggcccaagaagcgggacagatggggctatcgcgctgacaggagttgacgaggcatacactctggaggagtttcagcacctgctacccaagatgaaagccgagaccaatatggtttggtacgattggatgcgcccctcccacgctcagctccattccgactacatgcagccactcacagaggcaaaggccaaatccaagaataaagtacggggcgtccagcaactcattcagaggttacgacttatcaaatcccctgctgagatcgaacgcatgcaaattgcaggaaagctaacatctcaaaaaagcgtgctgttggctcgccacggcggctcacgcctgtattctcaccacttcggccgccccaggctgtcctag

SEQ ID NO: 140834 - DNA, 1455 bp, Artificial Sequence
  Description of Artificial Sequence: Synthetic coding sequence
atgctgtgctcccagcgcaggtatagtctgcagcctgtgcccgagcggagaatacctaatcggtacctcggacagccatccccattcacccaccctcatctgctgcgccccggggaggtgactcccggtctatcccaagtggaatatgccctgcgacgccataagctgatgagtctgatccagaaggaggcacaaggtcagtccggcaccgaccagacagtggtcgttctctctaatccaacatattatatgtcaaacgatattccttatactttccatcaggataataacttcctttatctctgtggttttcaggaacccgacagtatcctggttctccagtctctgcccgggaagcaactcccgtcgcacaaggctatactgtttgtcccccgcagggacccatctcgggagctgtgggacggtccccggtctggaacagacggcgctatcgcactgaccggagtagacgaagcttacacactggaagaatttcagcatctacttccaaaaatgaaggctgaaaccaatatggtgtggtacgactggatgcgcccaagccatgcacagctgcattcagactacatgcagccacttacagaggctaaagcaaaatcgaaaaacaaggtgaggggggtgcaacagttgattcagcggctgcggctgatcaagtccccagcagagatcgagcggatgcagattgcagggaagctcacttcccaggcttttatcgagacaatgtttacctctaaagccccagttgaggaggcctttctgtacgcaaagttcgaattcgaatgtcgtgcccgcggcgcggacatattagcctaccccccggtcgtcgccgggggcaaccggtccaacaccctgcattatgtgaaaaacaatcaactgatcaaggatggggagatggtgcttctggatggaggatgcgaaagctcttgttacgtctccgacattaccagaacctggcctgtaaacgggagatttactgcaccacaagccgaactttacgaagccgtcctggagatccaacgcgactgcctcgccttatgcttcccaggcacaagccttgagaacatctattctatgatgctgacactaataggccagaaactgaaggatctgggaattatgaagaacattaaggagaataacgccttcaaagcggctagaaaatattgcccacaccacgtcggtcactatctggggatggacgtccacgatacccccgacatgcccagatccctgccactgcagcccggaatggtgattactattgagcctggtatctacattccagaggacgataaggatgctccggagaagttcaggggattgggcgttaggattgaggatgacgtggtggtgactcaggacagcccacttatactgtccgccgattgccctaaggagatgaatgacatcgagcagatttgttcccaggcgagctag

SEQ ID NO: 140835 - DNA, 2379 bp, Artificial Sequence
  Description of Artificial Sequence: Synthetic coding sequence
atggctttctcgggtatctacaaacttgacgacgggaaaccttacctgaacaattgtttccctgcccgaaacctcctgcgggtgcctgaggaaggtcagggacactggctggtcgtccagaaggggaacctcaaaaaaaagcccaagggcttggtgggcgctcaagcggagcgtagggagagtctgaaagccacatccttcgagttcaagggcaaaaaggaatcccgtagagagaaccaagttgacctccccggccacatcttagatcaggccttcctccttaagcaccactgcgtaagaaaaccctccgacctgtgtacaattaatgctaaggagaacgattttaaacatttccatagtgttatctacattaacgccagcgagaacctcctgccactcgaagcatttcacaccttccccgcactgaaggagttggatctcgccttcaacgggattaaaaccatctatgtaaagtatggggattttaagctcctggaatttctcgatctgagtttcaattcactgacagttgaagcgatctgtgatctcggcattctccctcacttaagagtgcttctgctgacagggaacggcctaacatctctgcctcccaacctagccgtggccgaacaggaggcgtcagtgacatccctgactagcaaacgctatatcctgcgttttccagctctggagacgctgatgttagacgacaacagactcagcaatccctcttgtttcgcctccttggccggcctgcgacggctgaaaaagcttagcctagacgaaaacaggatcattagaattccttatctgcagcaagtgcaactttacgatgagagcgtggactggaatgggggcagaggcagcccccacaaggaaccccagttcatgctgcaatccaaaccacggatgctggaagattcagacgagcaactcgactacacagtcctccccatgaagaaggacgtcgataggaccgaggtagtgtttagctcataccctggattctcaacgagcgagaccactaagatatgcagcctccctccgatctttgaaatcctcccagtgaagtctcttaaagcccgcaatcagacattggcacccccatttcctgaactccgctatctctccctggcatacaataagatagcaaaagaggacgcagtcctaccggttgccctgtttccatccctgtgcgagtttgtcttccataataatcctctggtggctcacacgcgtggcgttccccctttgttaaaatccttccttcaggaacggctggggatccatctgatccgaagaaaaatagtaaaacccaaacaccacgttctgatgagtcgaaaggagtcctggaaagttaagtccgagattccaaaagtgcccaagcagcccttggttttgcaccaccctaggatgaccactacaaagagcccctctaaggacatgctggaacctgaagccgaactagccgaagacttacccaccactaaaagtacaagcgttgaatcagagatgcccaccgaaaatttagagggccatagcccctcttgcaggacatttgtaccgttaccaccaatttgttcaaattccaccgttcactccgaggagacactttcacacctgtcagatactacagttcgcttgagccccgaacggcctagcgacgaggacagcaaatcaacggagtcaatctttctcacacaggtttccgagttgccgtcatctgttatccacaaggacgatctcgaacttaaagaaaaagaccagaaaaagcctcccacagctcccagggaagtgaaagggacaagacggaaactgcctactgccttcctccctagcaaataccacggctacgaggaattgctcaccgccaaaccggaccccgccttcatcgagccgaagggcattcagaagaatgcacaggccttgcagcagatgctgaagcatccattgctatgtcactcttccaagccaaagctcgatacccttcagaaaccctatgtacacaaggagaagagggcccagagaatacccatcccacccccaaagaagacacgggcacagctcctggacgatattttcatcaggctgcgcgatcctcgcaacatcactgaggctcctctaggagctgtactgcaccagtggactgagagacgcctcgtgaaccacaagcagtacttggaagccaagagacttttgaaggagttccaggcaaggtacagacagctggtctcaggtagcttgcggacagtcttcgggaccaccccactgcccatggcatgtcctgccctgtccgaatcacagcccaagtttggtcatttcctggagtttatggatgagttttgccaagaacctaccgcttccgacagtcagggttag

SEQ ID NO: 140836 - DNA, 2337 bp, Artificial Sequence
  Description of Artificial Sequence: Synthetic coding sequence
atggcgttcagtggcatttataaactcgacgatgggaagccctatctcaataattgtttccctgctaggaatctgctcagggtccctgaggaaggacagggccactggctcgtagtgcagaagggaaacttgaaaaagaagccaaaaggactagtgggcgcgcaagctgagcgaagagagtcacttaaggctacgtcgtttgaatttaaggggaagaaggaaagcagacgcgaaaatcaggtggatctgccgggacatattctggaccaggcattcctgctgaaacaccactgtgtaagaaagcccagtgacctctgcacgataaacgccaaggaaaatgacttcaagcactttcacagcgttatttacatcaatgcctctgaaaatttacttccactcgaggctttccatactttccccgccctgaaagagttggacttggccttcaatggcattaagacaatctacgttaaatacggtgactttaagttattggaattcctggatctgtcctttaatagcttgacagtcgaagcgatttgtgatctcgggatccttccgcacctccgcgtattgctactcaccggaaacggcctcacatctctgcctccaaatctggcggtcgccgaacaggaggcctcggtaacgagcctgaccagtaagcgatatattctcaggtttcctgctttagaaactctgatgctggatgataatcgcctaagcaacccctcctgctttgctagtctagcgggactgcgccgactcaagaaactctctctggatgagaacaggatcatccgaattccctatctgcagcaggttcagttgtacgacgagagcgtagattggaacggcgggaggggcagcccacacaaggagcctcagttcatgctccagtccaagccgaggatgttggaggactccgatgagcagttagattataccgttctgcctatgaagaaagacgtcgatcgtaccacaacaaagatctgtagcctgccccctatattcgagatcctgcctgtgaagtctctgaaggctagaaaccagacattggcaccgcctttccctgaactgagatatttgagtttagcatacaataagatagctaaagaagacgcagtgctcccagttgccttgtttcctagtctgtgtgaattcgtttttcacaacaatccactggtagcccacacaaggggcgtccctcccctgctgaaaagctttctacaagagaggctggggatccatcttataaggcggaagatcgtcaagccaaagcaccacgtgctgatgtccaggaaagagtcgtggaaagtgaaaagtgagattcccaaggtccccaagcagccactggtgctccaccaccctagaatgactacaaccaaaagcccgagtaaggacatgctcgaacctgaggctgaacttgcagaggatttgcccacgacgaagagcactagcgtggagtcagagatgccaactgaaaatctcgaaggccactctcccagctgtcgaacttttgtaccactgcccccaatatgttccaactccacagtacactccgaggaaaccctcagccacctcagtgacaccaccgtgaggttatctcctgaacgtccctctgacgaggattccaagagcaccgagtctattttcctgactcaggttagtgagttgccaagtagtgtcatccacaaggacgatctggagcttaaggagaaagatcaaaagaaaccgcctacagcgcccagagaggtaaaaggaacaagaaggaagctgcctacggccttcttgcctagtaaatatcatggctacgaggaactcctgacagcaaaacctgatcctgctttcatcgagccaaaagggattcagaaaaacgcacaggcacttcagcagatgctcaagcatcctttactttgccatagcagcaaacctaaactggatacacttcaaaaaccctatgtacacaaggagaaaagagctcagcgaatcccaatccctccccctaaaaaaactcgggctcagctccttgacgacattttcatcagactgcgagatcctcgcaatattaccgaggcacccctcggagccgttctacaccaatggaccgaacgtcgactggtcaaccacaaacaatacttggaggcaaaacgtcttttgaaggagttccaagcaagataccgccaactagtgagtggctccctgaggactgtttttggaactactccgctacctatggcttgtcccgcattgagtgaatctcaaccgaagttcggccacttcctggagttcatggatgaattttgccaggagcccactgccagtgatagtcaaggctag

SEQ ID NO: 140837 - DNA, 2211 bp, Artificial Sequence
  Description of Artificial Sequence: Synthetic coding sequence
atggcattttctgggatctataaattagatgacggcaagccttatctaaataactgctttcctgctcgaaatcttctgcgcgtacccgaagaaggacagggacactggctcgtcgtgcagaagggtaatctcaagaaaaagccaaaaggtctggtgggggctcaggccgagcggcgggagtcactgaaagccacgtccttcgagttcaaaggcaaaaaggaatcccggcgcgaaaaccaggtcgatcttcctggccacatattggatcaggcattcctgctgaaacatcattgcgtgagaaagccgagcgacttgtgcaccatcaatgcaaaagaaaacgattttaaacatttccatagtgtaatttatataaacgccagcgagaatctgctccccctggaagcctttcacacattccccgctctcaaagagctcgacttggcattcaacggcataaaaaccatttacgtcaaatacggcgatttcaagttgctggagtttctggacctttccttcaatagcctgactgtagaggctatctgtgacctcggaatcctgcctcatttgcgagtcttacttctgaccggcaatggcctcacttccttgcctcccaaccttgctgtggccgagcaggaggctagtgtgacgagcctcacatctaaacgatatatcctgaggttccctgccctcgaaaccctgatgctggatgataaccgcctcagcaatcctagctgtttcgcatctctggctggtctgcgtagactgaagaagctgtctctcgacgagaaccgcatcatcagaatcccctatctgcaacaggtgcaattgtatgacgaatccgttgactggaacggaggtaggggatcaccacacaaggaaccccaatttatgctgcagtccaaaccccggatgcttgaagattctgatgaacagctggactacaccgtcttgcctatgaagaaagacgtggatcggacaattgctaaagaggatgcagtgttgccggtcgccctgttcccttctctgtgtgagtttgtgtttcacaacaacccactggtggcccacacacgaggagtaccccctctgctcaaatccttcctgcaagagcgattaggaatccatttaattcgaaggaagatagttaagcccaaacaccatgtacttatgtcccgcaaggaaagctggaaagtcaagtcggaaatccctaaagttccgaaacaacctctggtgttgcaccatcctcggatgaccacaactaaatcaccttcaaaagatatgcttgagccagaagccgaactcgccgaggatcttcccaccactaaaagtacgagtgtggaaagcgaaatgcccaccgaaaatctcgaggggcattccccgtcctgtcggacctttgtaccccttccgcctatctgctctaacagcacagtacactcagaggagacgctttcccacttgtcggatacaacagtgcgcctcagtcccgagcgaccaagtgacgaagactccaaatccaccgagagtatcttccttacgcaggtgtccgagttacctagttcagtcattcacaaggacgacctggagttaaaagagaaagaccagaagaagccaccgaccgcacctagagaagtcaaaggcacccgcaggaagcttcccaccgcctttttgccctcaaaatatcacggctatgaggaactgctgactgctaagcccgatcccgcttttattgaacccaagggtatccagaaaaatgctcaagccctccaacagatgctgaagcacccattactgtgtcattccagtaagccaaagctggatacgctgcaaaaaccctatgtccataaggagaagcgggcacagcgtatcccaatccccccaccaaaaaaaacccgcgcccaacttttggacgatatttttattagactgcgggatcctcgaaacatcacggaagcgcctctcggcgcagtgctccatcagtggactgagcgccgattggtgaatcacaaacagtatctggaggccaaaaggctgttgaaagagttccaggctcgataccggcagctggtatcagggagcttgcgcactgtctttgggactactcctcttccaatggcctgtccagcactgagtgagtcccagccgaagtttggccattttctagagtttatggacgagttctgtcaggaaccaacggctagcgatagccagggttag

SEQ ID NO: 140838 - DNA, 891 bp, Artificial Sequence
  Description of Artificial Sequence: Synthetic coding sequence
atggccttcagcggcatatataaactggatgacggcaaaccctatctgaacaactgttttcccgccaggaatctcctacgcgtgcctgaagaggggcagggtcattggcttgtcgtgcagaagggcaacctaaaaaagaagcctaaagggctcgtgggcgcacaggctgagaggagagaatccctgaaagcgacctcctttgagtttaagggaaagaaggagtctaggcgagaaaaccaggttgacttgcccggacacatactcgaccaggctttcttgctcaaacatcattgcgtccgtaagccgagcgatctatgcaccattaacgtttcagggctgaagtttagtaaggcgaaagaaaatgactttaaacatttccattctgtgatttatattaatgccagtgagaacctattgccgctggaagccttccacaccttccccgcccttaaggagctcgacctcgcttttaacgggatcaagacaatctatgtcaaatatggcgatttcaagcttctcgaattcctcgatctctcgtttaacagtctgacggtcgaggcgatttgcgacctggggatcctgccccatctgagagtcctgctgttgaccggtaatgggctaacctctttgcccccaaatctggccgtagccgagcaggaggctagtgtgacttctctgacgtccaaacgatacatccttcggttcccagccctcgagacacttatgctggatgataaccgactgagcaaccccagttgctttgcatccctagcgggactgcgcaggctaaagaaactgtcactggacgaaaatcggataattagaattccctatctccagcaggtgcagttgtatgatgaatcggtggattggaacggcgggaggggttag

SEQ ID NO: 140839 - DNA, 1797 bp, Artificial Sequence
  Description of Artificial Sequence: Synthetic coding sequence
atggcgttcagtggcatctataaactagatgacggcaaaccctatctcaataattgttttcccgccagaaatcttctacgggttcccgaggaggggcagggacactggttggtggtgcagaagggaaatctcaagaagaaacccaagggtctggtcggcgcacaggccgagagacgagaatccctaaaagctacttcattcgaatttaagggaaagaaagagagtcggagggaaaatcaggtggacctccctggacacattttggaccaggccttcttgttaaaacaccactgtgtcagaaaaccaagtgacctttgcacgataaacgctaaggagaatgatttcaaacacttccacagcgtcatctatatcaatgcatccgaaaatctattgccacttgaggcctttcacacatttccagcacttaaagaactcgatcttgcattcaatggtatcaagactatatatgtgaagtacggggattttaaattgctggaattcctcgatctcagttttaatagtctaacggtggaggccatctgcgaccttggtatcctgccgcatctgagagtgttgctgctgaccggcaacggcctcacttcccttccaccaaatttagcagtcgccgaacaagaggcctccgttacttccctgacgtccaagaggtatatcctgaggttccctgcattagagactctgatgttggacgataaccgactgagcaatccaagttgcttcgcgtctctggcaggtctccgacgcttaaagaaacttagtcttgacgagaacaggatcatccgtatcccctacctccagcaggttcaactgtacgacgagagcgtggactggaacggcgggcgtgggtccccccacaaagagccccagttcatgctacagtccaaaccgagaatgttggaggactctgacgagcaactcgattacacagtactgcccatgaagaaagacgttgatagaactggagtgccgccgctacttaagtcattcctgcaggagcggctcggaattcatttgatcagacgaaagattgtgaaaccaaagcaccatgtgctgatgtcacgaaaggaaagttggaaggtcaagtccgagatcccgaaagtcccaaaacagcccctggttctgcaccatcctcgcatgacaaccacgaaatccccaagtaaagacatgttggaacctgaggcagaactggcagaggaccttcctacgaccaagtcaacgtccgtcgagtctgaaatgcccacagagaacctcgagggacactctccctcctgtcggacttttgttcctctcccacctatctgttctaactccaccgtccactctgaggagacgctatcgcacttgagcgatacaactgtacggctgagcccagaacggccatctgacgaagattctaaatctacggaatcaatcttcctgacccaggttagcgaattgccgagctctgtgatacacaaggatgacttggagctgaaggaaaaagaccagaagaagccaccaaccgcaccaagagaggtcaaggggacaagaaggaagctgcccactgctttcttaccttccaaataccacggctatgaagaattactgactgccaaacccgacccagccttcatcgagcccaagggaattcagaagaatgcacaggccctgcagcaaatgttgaagcacccgctcttgtgtcatagcagtaaacccaagttggataccctacaaaaaccttatgtccataaagaaaagagagttctgtcttgcactagtggccaaaatggaggatggtag

SEQ ID NO: 140840 - DNA, 1554 bp, Artificial Sequence
  Description of Artificial Sequence: Synthetic coding sequence
atgttggacgataacaggctctctaacccatcatgttttgcgagtctcgccggtctccgaaggctcaaaaagctgtctttagacgagaaccgaataatcaggatcccctatctccagcaggttcagctctatgacgagagtgtcgactggaacggcggacggggatcaccacataaggaaccccagttcatgctccaatcgaagcctagaatgctcgaagattctgacgagcaactggattataccgttctgccgatgaagaaagatgtggaccgcaccgaggtggtctttagctcctatcccgggttctccacctctgagatcgctaaagaggacgctgtgctgcctgtcgcactcttccctagcttgtgtgagtttgtgttccataacaaccccttagtcgcgcataccaggggcgtacctcctcttttaaagtcatttctccaggagagactgggtattcatttgatccgccgaaaaatcgtcaaaccaaagcatcatgtcctgatgagccgtaaggagtcgtggaaggttaaatctgaaatccccaaagtgcccaaacaaccgctcgtgcttcatcatccccggatgaccacaacaaaaagccctagtaaggatatgctggagcccgaagcggaactggctgaggacttacccacgactaagtcgacctctgtggaatccgagatgcccaccgagaacctggagggtcattctcccagctgcaggaccttcgtgcctttgccaccaatttgcagcaacagtaccgtccactcagaggaaacgctctcacatttatcagacacgacagtgaggttatcaccagagagaccatccgacgaagattcaaagtcaactgaatctatctttctgacacaggttagcgagctgccaagcagtgtgattcataaggatgatctggagttgaaggagaaggaccagaaaaaacctccaactgcccctagagaggtgaagggtacgcgacggaagttacccaccgcctttctcccatcgaagtatcacggctatgaggagctcttgacggcaaagcccgaccctgcgtttatcgagcccaagggaatacagaagaatgcccaggccttgcaacagatgctgaagcaccccctcctttgtcactctagcaagcctaagcttgatacgctccagaagccttacgtccataaggagaagcgagctcaaaggattccaattccaccccccaaaaaaactcgagcacagctgctggatgatatctttatccggttgcgcgaccctcgaaacatcacagaagctccgctaggcgcggtactgcaccagtggaccgaaagaaggctcgtcaatcataaacagtacctagaggccaagcgccttctcaaggaatttcaggctcggtatcggcagctggtatccggctccttgcgtactgtcttcggcaccactccactacccatggcttgtccagccctgagcgagtcccagcccaaattcggccactttctggaattcatggacgagttttgccaggagcccaccgccagcgactcccagggctag

SEQ ID NO: 140841 - DNA, 984 bp, Artificial Sequence
  Description of Artificial Sequence: Synthetic coding sequence
atgttcccctctcgccggaaggccgcccagctcccctgggaggacggcaggtcaggactgctctccggcgggttgccaagaaaatgttctgtgttccatctgtttgtagcttgcttatctctggggttcttcagcctgctgtggctgcagctgtcatgttcaggagatgtggctcgggctgtgcggggccagggtcaggaaacctccggtccaccgcgggcatgcccacctgagcccccacctgagcattgggaagaggacgcctcctggggaccccacaggctggcagtcctggttccattcagggagagatttgaagagctcttggtattcgttccccatatgcggagattcctgagtcggaaaaagatcagacaccacatctatgtgctcaaccaggtcgaccatttccgcttcaatcgcgccgccttaatcaacgtcggctttctcgagtcctccaatagcaccgactacatcgctatgcacgatgttgacctattaccgctcaatgaggaactggattacggcttccccgaagccggacctttccacgtggcctcccctgaactgcaccccctgtatcactataagacttatgttggcggtattctgctgctctcaaagcaacattatagactgtgcaacggcatgagtaatcggttctggggatgggggagagaggatgacgagttttatcgaaggatcaaaggagccgggctacagctcttccgaccctcagggatcaccactgggtacaagacgttccgccacctccatgatcccgcctggaggaagcgcgatcagaaacgaatcgcggcacagaaacaggaacagttcaaggtggaccgggaaggaggacttaacaccgttaagtatcatgtggcatccaggaccgccctgagtgtgggcggagcaccttgcaccgtgctgaatattatgctcgattgtgataaaaccgcgactccatggtgcacattttcgtag

SEQ ID NO: 140842 - DNA, 642 bp, Artificial Sequence
  Description of Artificial Sequence: Synthetic coding sequence
atgagaagattcctgtcacgcaagaaaattagacaccacatatacgttctcaaccaggtcgaccatttccgatttaatagagctgctttaatcaatgttggttttcttgaatccagcaatagtacggactacattgccatgcacgacgtcgatctgctccccctgaacgaggaactggattacgggttcccagaggctggaccctttcatgtggccagtcccgagctgcatccactataccactataaaacttatgtcgggggaatcttgcttctatccaaacagcattaccgcctgtgtaatggcatgagtaacagattttggggttggggacgggaagacgatgagttctatcgcagaatcaagggtgccgggcttcagctattcagaccgagcggtataacaacgggttacaaaacatttagacacctgcacgaccccgcatggcggaaaagagaccaaaaaaggattgctgctcagaaacaagaacagtttaaggtcgacagggagggcggccttaacactgtgaagtaccacgtggcatcccgcacagcgctatccgtggggggcgcgccatgtaccgtcctcaacatcatgctcgattgtgacaaaactgctacgccctggtgtacctttagttag

SEQ ID NO: 140843 - DNA, 2880 bp, Artificial Sequence
  Description of Artificial Sequence: Synthetic coding sequence
atggtggccgccccatgcgctcgacgcttggcacgtcgctctcattctgctctgctcgctgcccttaccgtgttgctgcttcaaaccctggttgtctggaatttttcaagcttggattctggcgccggtgagaggcggggcggtgcggccgtgggcggcggcgagcagcctcctcctgctcctgccccaagacgtgagcggagggacctgccggccgaacctgcggctgcgagaggaggggggggaggtggtggcgggggcgggggaggacgtggtccacaggccagggctagaggggggggccctggggagcccaggggccaacagccggcctctcgtggcgcgcttcctgctcgcgcccttgacccccatcccagccctctcattacattagaaacgcaggacggttacttctctcatcgcccaaaggaaaaggtgagaactgactcaaacaacgaaaacagcgtgcccaaagattttgagaacgtagacaattctaattttgctccaaggacccagaaacagaaacatcaacccgaactggctaaaaagccacctagcaggcagaaagagctcttaaaaagaaagctggagcaacaggagaaagggaaggggcacaccttcccgggaaagggtcctggggaggtgctcccaccaggcgaccgggcagccgctaactcgtcccatgggaaggatgtctctcgacccccacatgctagaaaaacaggcgggtcaagcccagagactaaatacgatcagcccccgaagtgcgatatttccgggaaggaggcaataagcgctttatcgcgggctaagagcaagcattgcaggcaagaaatcggtgaaacttactgccgacataagctcggcctactgatgccagaaaaggttacacggttttgcccccttgaggggaaggcaaataaaaacgtgcagtgggatgaagactccgtggagtacatgcctgctaaccccgtgaggatagcctttgtgctcgtggtccacggtcgagcatctcgccagttgcagcggatgtttaaggccatttaccacaaagaccacttttactacatccatgtcgacaaacgcagtaattatctacacagacaggtgcttcaggtctctaggcaatactccaacgtgcgagtgacgccctggcgcatggctactatttggggcggcgccagtcttctcagtacctacttgcaatctatgagagacctgctggagatgactgattggccatgggacttcttcatcaatttgagcgcggcagattaccctatccgcaccaatgaccagctggtggccttcctctctcggtacagggacatgaacttcttaaaatcacacggtagagacaatgcccggttcataaggaagcaagggctggataggttgttcctggagtgcgatgcacatatgtggagactgggcgaccggcgaatacctgagggtatagccgtcgatggcgggtctgactggttccttctgaaccgccgtttcgtagagtatgtgacattttccactgatgacctggtgaccaagatgaaacagttctattcttacaccttactgcctgctgagtctttttttcatacagttttggagaattccccccactgcgacacgatggtcgataataatcttcgaattaccaattggaacagaaaattgggatgcaagtgccaatataagcacatagtagactggtgtggctgtagccctaacgatttcaagccccaggacttccaccggttccagcagactgcacggcccaccttttttgccagaaaatttgaagcagtggtcaatcaagaaattataggccagttagactattacctgtacggaaactaccccgcgggaacccctggactgcgctcttattgggagaatgtctacgacgagcccgatggcatccattccctgtctgacgtcaccctgactctctatcacagcttcgccaggctggggctgaggagagcggagacctctctgcacactgacggagagaattcttgtaggtattatcccatgggacatcctgcatcagtgcatctgtactttctcgcagaccgattccaagggtttctcatcaagcatcatgctacaaatctggcggtttccaagctggaaacactcgaaacttgggtaatgccaaaaaaggtgttcaaaatcgcttcccccccaagtgactttggacgcttgcagttcagtgaagtgggtactgactgggatgccaaggagcgtctttttcgtaactttggcgggcttctagggccaatggatgagccagtggggatgcagaagtggggtaagggccctaacgtgaccgtcacagtcatctgggtggaccctgtcaatgttattgccgccacctacgatatcctgatcgagtccaccgccgaattcacgcactacaagccacccctaaacttgccacttcggcccggcgtctggacagtgaagatactccatcattgggtgcccgttgccgaaactaaatttctggtggctcctctcactttctcgaataggcaaccgattaagcctgaggaagctttgaaactgcacaacgggcctctaagaaacgcctacatggaacagtcttttcagtccctgaatccagtgctgtcactcccgattaatccggcgcaggttgaacaggccagacgcaacgccgcttctactggcaccgctcttgaagggtggcttgattctttggtgggtggtatgtggactgccatggatatttgcgctacggggccaaccgcctgccccgtgatgcagacttgttcacaaacagcctggtcaagcttttcaccagatcccaaaagtgaactgggggctgtaaagccagatggcagactgcgatag

SEQ ID NO: 140844 - DNA, 2598 bp, Artificial Sequence
  Description of Artificial Sequence: Synthetic coding sequence
atggtggcctccgcacgggtgcagaagttggtccgccgttataaactggctatcgccaccgctctggccattctgctgctgcaaggcctcgttgtgtggagcttctccggccttgaggaggatgaagctggggagaaagggagacagcgtaagccccgccccttggaccctggtgagggcagtaaagatactgatagttctgccggacgccgagggtccacgggcaggagacatggtcggtggcggggccgggccgagagtcccggagtacccgtagctaaagtagtacgggctgtcacaagcaggcaaagagcaagccgacgcgttccccctgctccaccccctgaggccccagggagacagaatttgtctggcgcagccgccggggaagccctggtcggggccgcaggttttccaccacacggagacactggttcagttgaaggtgcaccacagccaaccgataatggtttcacacctaaatgtgagatcgtaggaaaggacgcactctcggccctggctcgagccagtacgaagcagtgtcagcaagagattgccaatgtcgtttgcctgcaccaggccgggtccttgatgcccaaggccgttccacgccactgtcagttgaccgggaaaatgtctccaggcatacagtgggacgagtctcaagcacagcagccaatggacggacctccagtgcgaatagcctatatgcttgtggtgcatgggagggctattcggcagctcaaacgactgctcaaagcagtgtatcacgaacagcacttcttctatattcatgtggacaagagaagcgactatttgcatagagaagttgttgaactcgcccaaggctacgataacgttcgtgtgacaccatggaggatggtcacaatctggggcggggcaagccttctgcggatgtatttgagatcaatgagggacctgctggaagtcccaggctgggcatgggatttcttcattaacctgtctgccacagactacccgactcgtacaaatgaagaactggtcgcctttctatctaaaaacagggataaaaactttctgaaaagtcatggcagagacaactctaggttcatcaagaaacaaggcctggataggctgtttcatgaatgcgatagccacatgtggcgactgggagagaggcagatacccgctggtattgttgttgacggcggctccgattggtttgtgttaacaaggtcattcgtagagtatgtagtgtacacggacgaccccctcgtcgctcagttaagacaattttacacctacacactcctgccagccgagagcttctttcatacggtgttagaaaactcactggcttgcgaaactcttgtggacaacaacctcagagtgacaaattggaaccgaaaactcggctgcaagtgtcagtataagcatatcgtcgactggtgtggctgctccccaaatgacttcaaaccacaagatttcttacgtctgcagcaggtgagccgccccaccttctttgcacgcaagtttgagagtaccgtcaaccaggaagtgctggaaatactcgattttcacctttatggctcatacccgcccggcacccctgccctcaaagcctactgggagaatacttacgacgccgcagacggaccatccggcttatctgatgtaatgcttacagcttacactgcttttgcacgtctgtccttgcatcacgccgcaaccgcagccccgcctatgggcacccctctgtgcagatttgaacctcgggggctgccatcctctgttcacctctatttctatgatgatcatttccaggggtatctggtgacccaggctgtccagcctagcgctcagggccccgctgagacattagagatgtggttaatgccacagggtagtctcaagctcctgggtcgtagcgatcaggcatcccggctgcagagcctggaggtcggcaccgattgggatccaaaggagagactttttcgtaacttcggcggactcctgggacccttggatgaacctgtcgcggttcagcggtgggcgaggggaccaaaccttactgctaccgtcgtttggatcgaccccacttacgtggtggccaccagttacgacatcacagtggatactgagactgaagttacacagtataagccccctcttagccggccgcttcgtccgggcccatggaccgtgcggctccttcagttctgggagcctttgggggaaacaagatttcttgttctcccactgacttttaatcgaaagctgcctctgcggaaggatgacgcaagttggttgcacgccggcccgccacataatgaatacatggagcagagcttccagggattgagctctatactcaatctcccccagcccgaattagctgaagaagctgcccaacgacatacacagctgactggaccggctttagaggcttggactgatcgcgagcttagctcattttggtccgtggccggactctgcgccatcggtccctctccatgcccgagcttagagccatgccggctgacttcgtggtcctccttatcaccggatcccaaatcagagttggggcctgttaaagcagatggccgcttacggtag

SEQ ID NO: 140845 - DNA, 2031 bp, Artificial Sequence
  Description of Artificial Sequence: Synthetic coding sequence
atggtcgcatcagcacgagttcaaaagctagttcgtcggtataaacttgcaatcgccacggctcttgctatattgctcctccagggacttgtggtgtggagtttttccgggctggaggaggacgaggcaggggaaaagggcaggcagagaaagccccggcccctcgaccccggcgagggtagtaaggacacagatagtagtgcaggcaggaggggctctaccggtaggcgacacggacggtggcggggtagggctgagagccctggtgtacccgttgccaaggtggtgcgcgccgtgacctctcgtcagcgtgcctcacgcagggtgccccccgcacctccacctgaagcgcctggaagacagaacctgtccggcgctgcagccggtgaagcccttgtgggggccgcgggattcccgccgcacggcgatacaggctcagtggagggggcaccccagccaactgacaacggatttactccgaaatgtgagattgttggcaaggatgccctcagtgccctcgcccgcgcctctacaaaacagtgtcagcaggagatagccaatgttgtgtgtctgcatcaggccggaagcctgatgccgaaagccgtccctcgccattgccagttgaccggaaaaatgagccctggaattcagtgggacgagtcccaagcccagcagccaatggacggccccccggttcgtatcgcctacatgttagtggttcacgggcgagccattcggcaattgaagcggctgctcaaggctgtctaccatgaacagcacttcttctacattcatgttgataaacggagtgattacctgcatcgcgaagtagtggaactggcccagggatatgataacgttagagttaccccatggcgaatggtgaccatctgggggggagcctcactccttagaatgtacttgcggtcgatgagagatctcttagaggtgcctggttgggcctgggatttcttcattaatctgtctgctaccgactacccaactcgcacaaatgaagagcttgtggcattcttaagtaagaaccgagataagaacttcctgaaatcccatggccgcgataattcgcgatttatcaaaaagcagggcctggaccgccttttccatgaatgtgacagtcacatgtggcggctgggtgagagacagattcctgcagggattgtagtcgatggtggatcagattggtttgtcttaactaggagttttgttgagtatgttgtctacacagatgacccgctggtggcccagttgaggcaattttacacctacacactgctccccgccgaatcattcttccacaccgtcttggagaactcactggcctgcgagacactggtcgacaacaacttacgggtgaccaactggaatcgaaagctggggtgtaaatgccagtacaagcatatcgttgactggtgcgggtgctctcctaacgacttcaagccccaggatttcctgcgcctacagcaggtgtcgcgccccacattcttcgcccggaagttcgagtcaactgttaatcaggaggtactggagatactggattttcatctatatggctcttatcctcctggcactcccgctctcaaggcatattgggaaaatacttatgatgccgccgacggcccttcagggttgtccgatgtcatgctgactgcatataccgccttcgcgagacttagcttacaccacgctgcaacagcagccccaccaatgggaaccccgctatgtagatttgagcccagggggctgccaagtagtgtgcacctgtacttctacgacgaccacttccagggatatctcgtgactcaggccgtgcaacctagcgcgcagggccctgctgaaacacttgaaatgtggctgatgccacaaggttctctgaaactcttgggcaggtctgatcaagcatcacgacttcagtctttggaaaatcgtggactgtccatgttgcctcgcctcgtatcaaattcttggccccaggcggttcttccactgcagccccctaaagccttgggctag

SEQ ID NO: 140846 - DNA, 1503 bp, Artificial Sequence
  Description of Artificial Sequence: Synthetic coding sequence
atgatcatttcacactttccaaagtgtgtggcagtgttcgctctgttagctcttagtgtgggggccctggatacttttatcgcagcagtctatgagcacgccgtaattctgcccaatagaactgagacacctgtgtcaaaggaagaggcgctgcttttaatgaacaaaaacatcgatgttctggaaaaagcagtcaaactcgcggcaaaacagggcgcacacatcatcgtcaccccagaagatggaatttacggatggatattcacccgcgaatcaatttatccctacttggaagacattccagatcctggagtgaactggatcccatgccgtgacccatggcgatttggaaatacacctgtccagcagagacttagttgcttagccaaagacaacagtatttatgttgtggctaatatcggtgacaaaaaaccatgtaacgcttctgactctcaatgccccccggacggccgctatcaatataacaccgacgtggttttcgactctcagggtaaattgcttgcgcgctaccacaaatacaaccttttcgcccctgagatccaattcgactttccaaaagactcagaactcgtgacgttcgacacaccattcggcaagtttgggatatttacatgttttgatatcttttcccatgatcctgcagtcgtggtggtcgatgaaagtatcgactcaattttgtaccccactgcctggtacaatacactgccccttttgtctgctgtgcccttccactcagcatgggccaaggcaatgggcgtgaacctgcttgcggctaacactcacaacacctctatgcatatgacgggtagcggcatatacgctccagaggccgtgaaagtttaccactacgatatggaaacagaatcgggacaactactgctgtcggagctcaagtcccgaccccggcgtgaacccacttatcccgccgcagtggactggcacgcttatgcaagtagtgtaaagccatttagcagtgagcagagtgacttcctgggcatgatttacttcgacgaattcaccttcacgaaactgaaacgcaacacaggaaactatactgcctgccagaaggatctctgttgccacctcacctataaaatgagcgagaagcgcaccgatgagatctacgccctaggagcctttgacgggttacatacagtggagggccagtactatctccaaatttgtgctctcctgaaatgtcagaccacagatctcgaaacctgtggagaacccgtgggtagcgcgtttacaaagttcgaggatttctctctgtcaggaaccttcggaactcggtacgtgttcccccagataatcctctcaggctctcagttggcacccgaacgccattacgagataagcagagacggacggctgcgctcccggtctggcgcccccttgccagtgctcgttatggcgctgtatggtcgggtctttgaaaaggaccctcctcgattaggacagggttccggaaaattccagtag

SEQ ID NO: 140847 - DNA, 1200 bp, Artificial Sequence
  Description of Artificial Sequence: Synthetic coding sequence
atggatagcagcacaacggcccagtgtcggcagttggaggccgcggttggaggcgcccaggctctatcatgtctgacgggcagccgggcctatgagagatttaccggcaaccagatcgctaagatttatcaacagaatcctgaggcatatagtcacaccgaaagaatctccttggtttcctccttcgctgctagcctattcctcggaagttatagtcctatcgattactccgatggatcaggaatgaacctcctgcagatccaggacaaggtatggtctcaggcatgcctcggcgcatgtgcacctcatcttgaagagaaactgagtccccctgtccctagttgctctgtcgtcggcgccatctcatcttactacgtgcagagatatggcttccctcccgggtgcaaggttgttgcattcaccggggacaacccagcttccctggctggtatgcgactggaagaaggagatattgctgtgtcactgggtactagcgacaccctgtttctgtggttgcaagagccaatgcccgccttggagggacatatcttttgtaaccccgtagattctcaacactatatggctctgctctgtttcaaaaacggttcacttatgcgtgagaaaatccgcaacgagtcggttagcagatcctggtctgacttttccaaagctttacaatccacagagatgggaaatgggggcaacctgggattttatttcgatgttatggagattacaccagaaatcatcgggcggcataggttcaacaccgagaatcacaaggtggctgctttccctggcgacgtggaggtgcgcgcactgatcgagggacaatttatggccaagaggatacatgccgagggtctcgggtatagggttatgtcaaagaccaagatactcgcaaccggcggcgctagccacaatagggaaattttgcaggtgctggcggacgtgtttgatgctcctgtttatgtcatagatactgctaattctgcctgcgtgggtagcgcctacagggcattccacggtctggccggcggcaccgatgtgccttttagtgaagttgtaaagctagccccaaacccccggctggcggccaccccttctcccggagcctctcaggtgtatgaagccctactaccgcagtacgcgaagctcgagcagagaatcctcagtcagactcgtggacctcccgaatag

SEQ ID NO: 140848 - DNA, 4269 bp, Artificial Sequence
  Description of Artificial Sequence: Synthetic coding sequence
atgagtggaataaagaggaccatcaaggaaactgatcccgactatgaggatgtctcagtggcactcccaaataaaagacacaaagcgatcgagaattccgctcgcgacgccgccgtccagaagatcgagacaatcatcaaagaacagtttgcactggagatgaagaacaaagaacacgaaatcgaagtcatcgaccaacgcttgatagaagcgcgcaggatgatggacaagctcagggcttgtatagtggctaattattacgcgagtgcaggcctgctcaaagtcagtgagggcagcaagacgtgcgacacaatggtattcaatcacccagctatcaaaaaattcctggaatctccatctcggtccagcagccccgccaaccagagagccgagactccctcagccaatcactctgaaagtgattcactgtctcagcataatgacttcctttctgacaaagataataactcaaacatggacatcgaggagcggctatctaacaacatggagcagagaccttcgcggaataccgggagggacacgagtagaattacagggagccacaaaacagagcagaggaatgcagacctgacagatgaaaccagcagattgttcgtcaagaaaactatcgtggtagggaatgtgagcaaatacatccctcccgataaaagagaagagaacgatcaatccacacacaagtggatggtgtacgtgcggggctcccggagagaaccttcaatcaaccacttcgtgaagaaggtgtggttttttctccatccatcttataagcctaatgacctagtggaagttcgggagcccccttttcatcttacacggcgcggatggggcgagtttccagtgcgcgtccaagtgcactttaaggacagccagaacaagcgaatcgatatcatacacaacttaaaattggatcggacctacactggactgcagacactgggtgcggaaacagtggtggacgtggaactccatagacactctctcggcgaggactgtatatatccacagagctctgagagtgatatcagcgacgctcctcctagtctgcctctgaccatacctgcccccgtaaaggcgtcttctccaattaagcagtcccatgaaccagtgcccgacacctccgtggagaaggggttccccgccagtactgaggccgaaagacataccccattttacgccctgccaagctctctagagagaacccccactaagatgactactagccagaaagtgaccttttgttcccacggtaacagtgcatttcagcctatcgcgtcctcatgcaaaatcgttcctcagagccaggttccgaatcctgagtcacccggtaaaagctttcagcccattacaatgtcctgtaaaatagtttccggatctcccatcagtacgcctagtccctcacctctgcctagaactcctacctccaccccggttcatgtcaaacaaggcaccgctggaagcgtcatcaacaatccttacgtcatcatggataagcaacccggccaagttattggagcaaccacgccgtcgaccggatctccaacgaataaaatcagcaccgccagtcaggtaagtcagggcaccgggagcccggtgcccaagatccatggatccagtttcgtgacaagtacggtgaagcaggaagactctctgttcgcctctatgcctcctttgtgtccaattggcagccaccctaaagtgcaatccccgaaaccaattacgggtggacttggggctttcactaaagtgataattaagcaggagcctggggaggcaccccatgtacctgcaaccggggctgcctcccagagccctctgccacaatacgttacagtaaaggggggtcacatgatcgctgtaagtccccagaagcaagtcatcacacccggagaaggaatcgctcagtccgctaaggtgcaaccaagtaaggtggtgggagtgccagtgggaagcgcgctgcccagcacagttaagcaggcagtggcaataagtggcgggcagatcctggtcgccaaagcatccagcagcgtctctaaggccgtgggccctaagcaggtcgtaacacaaggagttgcaaaagcgatcgtatccggcggcggcggaacgatcgtcgcacaacccgtgcagacattgactaaggcccaagtgacagccgctgggccccagaagagcgggtcccaggggagcgtgatggcaactctgcaactgccagccacaaatctcgccaatcttgctaacctgccccctggaacaaaactctacctgacaactaactctaaaaacccttccggcaaaggcaagctgctgctgattcctcagggtgctatcctccgcgcgaccaataacgccaacctgcagtccggtagcgccgcctctgggggtagcggggccggagggggtgggggcggaggaggcggaggtgggagtggatccggaggaggaggtagtactggggggggaggcggaaccgccgggggcggcacgcaatcgaccgcaggtcccgggggaatctctcaacatctaacatacacatcatacatcctgaagcagactccgcagggcacttttctggttgggcagccctccccacagacttctggaaaacagttgactaccggcagcgtggtccaggggaccctgggagtgtcaactagctcagcacaaggacagcagactctgaaggtgatttccgggcagaagacaacgctatttacccaggccgcccacggtggtcaagcctctttaatgaaaatatctgactcaactcttaagactgtgccagctacatcacagttaagcaagcccgggacgaccatgcttcgagtggcaggcggcgtgatcacgaccgcaaccagccccgctgtggctctttcggcaaatggtccggcacagcaatcagaaggcatggccccagtgagcagctcgacagtgtcttctgtgactaagacaagcggccagcagcaggtgtgcgtatcccaggcgaccgtggggacttgcaaagcagcaacacccactgtcgtgtcggccaccagcctcgtgcctaccccaaatccaattagcggcaaggccaccgtgagcgggttactcaagatccatagctcccagtcctctccgcagcaggctgttctcaccatcccctctcagctcaaacccttatctgtgaatacctccggcggggtgcaaaccattctgatgccagtgaacaaggtagtccagagcttcagtacatctaaacctcccgctattttgcctgtggccgcaccaactcctgtcgtaccgtcctccgcaccagccgcagtggctaaggtgaaaaccgagcctgagacacctggacccagctgccttagccaggaaggacaaactgcagtgaagaccgaagagagctccgagctcggaaactacgtgataaaaatcgatcatttggaaactatacagcaattgctgacagctgtggtgaaaaagattcctctcatcaccgctaagtctgaggatgcaagctgttttagcgctaagtccgttgaacagtactacggatggaatataggtaagcgtcgcgctgctgaatggcaacgtgcaatgaccatgcgtaaagtgcttcaggagatccttgaaaaaaatccgagatttcaccacctgaccccactgaagacaaaacatatcgcccactggtgcagatgccacgggtatacacccccggatccggagagtctgcggaacgacggggattccattgaagacgtcctgacacagatcgactccgaaccggagtgtccaagctccttttctagcgctgataacctgtgcagaaaattagaggaccttcagcagttccagaaaagagaacccgagaatgaggaagaggttgacattctgtctctgtcagagcccgtgaagatcaacatcaaaaaagagcaggaagagaagcaggaggaagtgaagttctatttaccgcccacacccggctcagagtttattggcgacgtgacacagaagatcggcatcaccttgcaaccagtggcactccatcgaaatgtctatgcctccgttgttgaggacatgatccttaaagctacagagcaactcgttaacgacatacttcgacaagcgctcgctgtggggtaccagaccgctagccataaccgaatccccaaggaaatcacagttagcaatattcaccaggctatttgtaacataccatttctagattttctgacaaataaacatatggggatcctaaacgaggatcaatag

SEQ ID NO: 140849 - DNA, 4269 bp, Artificial Sequence
  Description of Artificial Sequence: Synthetic coding sequence
atgagcggcatcaagcgcaccattaaggagaccgatccggattacgaagacgtgagcgtcgcgttgccaaacaagaggcacaaggccatcgagaattcagcacgcgacgctgccgtgcagaaaatcgagactatcattaaggagcagttcgccttagaaatgaaaaacaaagagcatgagatcgaagtgatcgaccaacggctgattgaagctcgtaggatgatggacaagctgcgcgcatgcattgtggccaactactacgcctccgccggactcttaaaagtgtccgagggttctaagacctgcgatactatggtgtttaatcacccagctatcaaaaaatttctagagtctccatctcgttcaagtagtcctgcaaatcaaagggctgaaaccccttccgcaaaccactccgagtctgattcactgagccagcacaatgactttttaagtgataaggataacaattctaatatggatatcgaagaaagattgtctaacaatatggaacagaggccttctcgaaacacagggagggacacatccagaatcacaggcagccataaaacagagcagcgaaatgctgatctgaccgatgagacttcccggctgtttgtaaaaaaaacgattgtagtcggaaacgttagcaaatatatcccccctgacaagcgggaagaaaacgaccagagcacacacaaatggatggtttatgtgagagggagccgcagagagcccagcatcaatcactttgtgaagaaggtgtggttttttctgcacccttcctacaagcccaatgatctggtagaagtccgagagcctcccttccacctgacccgcaggggatggggcgaatttccagtgagggtccaggtccattttaaggactcccagaacaagcgtatcgacatcatacacaacctgaagctggatcgcacttatacggggctccaaacactcggagccgaaactgtggtggatgtcgaactgcacagacacagcctgggagaggactgtatttatccacaatccagcgagtctgacatttctgacgcaccaccatctctacccctcaccattcctgcccctgtgaaggctagctccccaataaaacaatcacatgaacccgtacctgacacaagcgtggagaaaggatttccagctagtactgaggctgaaagacatacccccttttatgctttgccgtcttctctagaacgcactcccaccaaaatgacaacgtcccaaaaggtgaccttttgcagtcatggaaacagcgctttccagcccatcgcctcctcctgcaaaatcgtacctcagagtcaagtccctaaccccgagtcgcctggaaagagcttccagcccattacgatgtcatgcaaaatcgtctctggcagtcccatctcaactcccagcccgtccccactgcctcgaaccccgacgagtactcctgttcatgtcaagcagggcactgcaggtagcgtgatcaataacccctatgtgatcatggataagcagccaggacaggtcatcggggcgaccactccatccactggcagccctaccaataagataagcacagcgtcccaggtgtcacagggaacgggctctcctgtgcccaagattcatggatcatcctttgtaaccagcactgtaaagcaggaggactccctcttcgcctcgatgcccccactgtgcccaatcggctcccaccctaaggtgcagagcccgaaaccaatcactggagggctcggggcatttaccaaagtgatcataaagcaagagcccggagaggctccacatgtccctgccaccggagccgcatcacagagcccactgccacagtacgtgacggttaagggcggccacatgatagcagtctcaccgcaaaaacaggtcatcacccccggcgagggcatcgctcagtcagccaaggtgcaaccatctaaggtagttggcgtgcccgtcggatccgcccttccttccaccgtaaagcaggcagtagctatctccggaggccagattcttgtggccaaagcctcttcttcagtgagtaaagccgtgggcccaaagcaggttgtgacgcagggggtggcgaaagccattgtgtccggaggaggtggtacaatcgtagcccagccggtacagacactgaccaaggcccaggttacagccgccggtccacagaagagcgggagccaggggtctgttatggcaactctgcagctgcccgcaacaaatctagctaatctggccaacctgcctcctgggacaaaactttatctgaccactaattcaaagaaccccagcggaaagggcaaactgctgctcataccgcagggcgcgatactccgggccaccaacaacgcgaacttgcagtccgggtcagcagcctcagggggatctggggctggcggggggggcggtggtggcgggggtggcggaagtggcagcggtggaggcggcagcacaggtggcggagggggcacggccggtggtggcacacagtctacggcagggcctggcggtattagtcagcatttgacatatacttcttatattctcaaacaaacccctcagggaacattcctggtcgggcaaccaagtcctcagacttcagggaaacagcttactacggggtccgtcgtgcaaggtacactgggggtttcaacttctagtgcccaggggcagcagactctgaaagtgatctcgggccagaagaccacccttttcactcaggctgcgcatggagggcaggcgtccctgatgaagatctccgactctacattgaagaccgtgcccgcaacaagccagctgtccaagccagggaccacaatgctgcgggtcgctggcggggtcatcaccacggctacctcacctgccgtcgccttgtccgctaatggacctgctcagcagtcagagggtatggcacctgtgtccagctccaccgtgtctagtgtgaccaaaacctcaggccagcagcaggtatgcgtttctcaggcaacggtgggtacttgcaaggccgccactccgaccgtagtgtcagccacatcccttgtccccacccctaatccgattagcgggaaagccaccgtttctggcctactgaagattcatagcagccagtcctcgccccagcaggctgtgcttactatcccctcccaacttaaacccctgtcagtcaacacgtccggcggagtgcaaacaatcttaatgcccgtgaacaaggttgtccaatcgttctccacctccaaaccgccagctattcttccagtggccgctccaacccccgtagtgcccagcagcgcccccgcagcagtggcgaaggtgaaaacagaacccgaaacccccgggccatcctgcctgtcgcaagagggacagaccgctgtgaaaacagaagagtctagcgagctgggaaactacgtgattaagattgaccatctggaaaccatccaacagctgttgaccgcagtagtcaagaaaatacctctcatcaccgccaagtctgaggacgctagctgttttagcgctaagtcagtggaacagtactacggttggaatatcggcaagcggcgggccgccgaatggcagcgcgcaatgacaatgaggaaggtgctgcaggaaatactggaaaagaatccgcggttccatcacctgacacctttgaagacaaagcacatagcccactggtgccggtgtcacgggtatacccccccggatcccgagtcgctcaggaatgacggagactccatcgaggacgttctcacccaaatagattctgagcccgaatgtccatcctcattctcaagtgccgacaatctgtgtcgcaaactggaggatctgcaacagtttcagaagagagaacccgaaaacgaggaggaagtggacattctctccttgagcgaacccgtgaagattaatatcaaaaaggaacaggaggaaaaacaggaggaagttaaattttacctgccaccaactcccggcagtgagtttattggcgatgtgacccaaaagatcgggataacccttcagcccgtggctttacatcgaaacgtttatgcatcggtcgtggaggatatgattttgaaggccacagaacagctcgtgaacgacatattgcggcaggcgctcgcagtcggctatcagacagccagtcataatcgtatcccgaaggaaattactgtaagcaatattcatcaggctatttgcaatatcccgttcttagacttcctgacaaacaaacacatgggtatactgaacgaagatcagtag

SEQ ID NO: 140850 - DNA, 684 bp, Artificial Sequence
  Description of Artificial Sequence: Synthetic coding sequence
atgttcaaacgtatggcagaatttggccctgacagcggagggcgggtcaaaggagtgacgatagttaagccaatcgtgtatggcaatgtggccagatattttggtaagaaaagagaagaggacggtcatacccatcagtggacggtctacgtgaagccatatagaaatgaggatatgtcggcttacgtaaagaagattcaattcaagctgcatgagtcctacggcaatccattgagggtcgtgacgaaacccccatacgagatcacagaaactggttggggcgagtttgaaatcattatcaagattttcttcattgatccaaatgagaggcctgtcaccttataccatctgctcaaactgttccagagcgataccaacgccatgctgggcaaaaagacagtggtctccgagttttatgacgagatgatcttccaggacccaacggctatgatgcagcagcttcttactaccagtaggcagttgacactgggcgcctacaagcatgaaactgaattcgccgaactggaggtgaagacacgggaaaagctggaggcagccaaaaaaaaaacctctttcgagatagcagaactcaaggaacgcctaaaagcatcccgggagaccatcaattgtctgaagaatgaaattcgcaagttggaggaggatgaccaggcaaaggacatctag

SEQ ID NO: 140851 - DNA, 1053 bp, Artificial Sequence
  Description of Artificial Sequence: Synthetic coding sequence
atggccactactgcagctcccgcagggggggctcgtaatggcgccggtccggagtggggtggttttgaagaaaatattcaaggaggcggcagtgctgttatcgacatggagaacatggatgacacttcagggtcatccttcgaggacatgggagagctgcaccagaggctccgggaagaagaggttgatgctgatgccgccgatgcagcagcagcagaagaggaagacggagagttcctcgggatgaaaggcttcaaaggtcaactgagccgtcaagtggccgaccagatgtggcaggccggcaaacgccaagcaagcagggctttttccctgtatgctaacatcgacatactgagaccttactttgacgttgagccagcccaggtgcgcagcaggctgctggaaagcatgataccgattaagatggtaaactttcctcagaaaattgctggagagctctacggacccctgatgctggtcttcacgctcgtggccatactgttgcacggcatgaagacaagcgacactatcattcgtgaagggactttgatgggcacggctatcggaacctgtttcggctactggttgggggtgtcatctttcatctacttcctggcatacctctgcaacgcacaaattacaatgctgcagatgctagccctgctgggatacgggttgttcgggcactgtatcgtgctgtttattacctacaatatccatctgcacgcactgttctatctcttttggctgctggtgggggggctgagcacattgagaatggtggctgttctggtgtcacgaaccgttggccctacccagaggctattgctatgcggaacactggccgcactgcacatgttgttcctcctgtacctccactttgcttaccacaaagtggtggagggcattcttgacacacttgaaggaccaaatatcccccccatccagcgagtgccacgtgatattcccgctatgctgcctgcagccagactgcctacgactgtgctcaacgcaaccgccaaagctgtggccgtgaccctgcagtcccactag

SEQ ID NO: 140852 - DNA, 774 bp, Artificial Sequence
  Description of Artificial Sequence: Synthetic coding sequence
atgtccggatttgagaatctgaatactgatttttatcagacatcatattccattgatgatcaatcccagcaatcttatgactatggggggtctggcgggccttactcgaagcagtacgctggatatgactattcccagcaagggcgatttgtgccccccgacatgatgcagccacagcaaccctatactggacagatctaccagccgacacaggcatacaccccagctagtcctcagcctttctatggaaataatttcgaggatgagccgcctttgctggaggagctggggatcaactttgaccacatttggcagaaaacacttaccgttctgcatccacttaaggtcgccgacggctctattatgaacgaaaccgacctcgctggtccgatggtgttttgcctggctttcggtgctacacttcttctggcaggtaagattcagttcgggtacgtgtacgggatctccgctatcggatgtcttggtatgttttgcctgttgaacctcatgtccatgaccggagtcagctttggttgcgtcgcctctgtcttgggctactgcctgctgccaatgatcttgctgtctagcttcgccgtcattttttcgctgcaaggcatggtcgggatcatcctcaccgccggaattatcgggtggtgcagtttctccgcatctaagatattcatctcggcattggccatggaaggccaacagctcttggtggcgtacccatgcgctctcctgtacggcgtgtttgcacttatctctgtcttctag

SEQ ID NO: 140853 - DNA, 798 bp, Artificial Sequence
  Description of Artificial Sequence: Synthetic coding sequence
atgtccggctttgagaatctcaacacggatttttaccagacttcatattcaatagatgatcagtctcagcaaagctacgattacggaggttctggcggcccttattcaaagcaatacgcaggatatgattactcacagcaggggcgcttcgtgccccctgatatgatgcagcctcagcaaccatatactggtcagatatatcagcctacccaggcgtacacacccgcaagccctcagcctttctacgggaataatttcgaagatgagcctccgctgttagaagagttgggcataaatttcgaccacatatggcagaaaacgctgacagtgctccacccgctgaaggttgccgatggcagcattatgaatgagactgacctggcaggaccaatggtcttctgtctagcattcggcgcaacccttctgctggctggaaaaattcagttcgggtacgtttatgggatctcagctataggctgtttaggcatgttttgtctcctgaatctcatgagtatgactggtgtgtccttcgggtgcgtggccagcgtgctcggctattgcctgcttcccatgatcttactgagctctttcgccgtgatctttagtcttcagggcatggttggaatcatcttaactgccgggattatcggttggtgttcgttctccgcaagtaagatttttattagtgctcttgcgatggagggtcagcaattgctggtagcactgcagcccaatatcacttacggtagcaactatttcttgttttgctgcctgccctacccccagcaacacttttag

SEQ ID NO: 140854 - DNA, 774 bp, Artificial Sequence
  Description of Artificial Sequence: Synthetic coding sequence
atgtccgggttcgagaatctaaacaccgacttttatcagacgtcctactccatcgatgaccagagccagcagagctatgactacggagggtccggaggcccttactccaagcaatacgcagggtatgattatagtcagcagggacgtttcgtgcccccagacatgatgcaaccccagcagccttataccggacagatctatcagccaacacaagcctatacccccgccagccctcagcccttctatggcaataattttgaagatgaaccaccgctgctagaggaactcggtattaatttcgaccatatctggcagaagaccctaactgtattgcacccgcttaaagttgccgacgggtctattatgaacgagactgacttagcaggcccgatggtcttttgcctggcttttggcgctacactgctcctagcgggcaagatccaattcggttacgtgtacggtatttctgctatcggatgtctggggatgttttgtctgctgaacctaatgagcatgacaggcgtgagctttgggtgtgtcgccagcgtgctgggctactgcctcttgcctatgatccttttgtcctccttcgccgtcatcttttctctccagggtatggtaggcattattctaaccgccgggattattgggtggtgcagtttctctgccagtaagatctttatttctgccctggcaatggaaggccagcagctcctcgtggcatacccttgcgctttactgtatggagtgttcgccctaatctccgtattctag

SEQ ID NO: 140855 - DNA, 612 bp, Artificial Sequence
  Description of Artificial Sequence: Synthetic coding sequence
atgatgcaaccccagcagccttatactggacagatataccagccgacccaagcctataccccagccagcccacagcccttctatggcaataattttgaagacgagccccctttgttggaggaactcggtatcaattttgatcacatttggcagaaaactctgactgtgcttcatccactcaaagtggccgatgggtctatcatgaacgagactgatctagccggccctatggtgttctgtttagcctttggagccactctgctgctcgcagggaagatccaatttggttacgtgtacgggatctcggcaattggttgtttaggcatgttttgtttgctgaacctgatgtccatgacaggagtgtcgttcgggtgcgtggcctccgtcctgggatactgcctactgccaatgatactgctctcaagttttgctgtgatatttagcctccagggaatggtgggcataatcttgaccgcagggattatcggctggtgcagcttctccgcttctaagattttcattagcgcactggctatggagggccagcagctgctggtggcctacccatgcgctttgctttatggtgtgtttgctttaatcagcgttttttag

SEQ ID NO: 140856 - DNA, 534 bp, Artificial Sequence
  Description of Artificial Sequence: Synthetic coding sequence
atgatgcagccacagcagccttatacagggcagatctaccaacctacacaggcttacacacccgcctcccctcagcccttttacggcaacaattttgaggatgaaccaccccttctagaagagctgggtatcaacttcgaccacatctggcaaaagaccttgacggttctccaccccctgaaagtggcagatggctccatcatgaacgaaacagatctagcaggccccatggtcttctgcctcgcatttggggcaaccctactgctggctggtaaaatccagtttggatatgtgtatggaatttctgccatcggatgtctgggaatgttttgccttttaaatcttatgtcaatgaccggcgtgagctttggctgcgtagctagcgtcttgggatattgtctcttaccaatgatcctgctgtccagcttcgcagtcatcttttcactgcagggaatggtggggatcatattgacagccggtatcataggttggtgcagcttttcagcttccaaaatctttatttcagccctgtag

SEQ ID NO: 140857 - DNA, 306 bp, Artificial Sequence
  Description of Artificial Sequence: Synthetic coding sequence
atgatgcagccacagcaaccttataccgggcagatctaccaacccactcaggcttacacgcccgctagcccacagcccttctatggcaacaattttgaagatgagccaccactgcttgaagagctgggcattaatttcgatcacatatggcagaagaccctcaccgtcctgcatcctctgaaggttgctgatggctcgattatgaacgaaaccgacctggcagggccaatggtcttttgcctggcgtttggcgctacccttctgctggccggtaaaattcaatttgggtacgtctacggaatctag

SEQ ID NO: 140858 - DNA, 429 bp, Artificial Sequence
  Description of Artificial Sequence: Synthetic coding sequence
atgtccggatttgaaaatctcaacaccgatttttaccagacgtcttacagcatagacgaccagtcccagcagagctacgactatggtggttcagggggcccctacagtaagcagtacgcaggctatgattatagccagcagggccggttcgtcccacctgacatgatgcaaccgcagcagccttatactgggcagatctatcagccaacgcaagcttatacgcctgcctctccccagccgttctatggaaacaattttgaggatgaaccccctctcctggaggagctcgggatcaactttgaccacatctggcagaagacgctgaccgtcctgcacccgctcaaggtcgcggacggctcaataatgaatgagacagatctggcacagtggttctttgctttactgctggaaccgcactgttactggtag

SEQ ID NO: 140859 - DNA, 882 bp, Artificial Sequence
  Description of Artificial Sequence: Synthetic coding sequence
atggcctatcactccggctacggcgcccacgggtcaaagcatcgggccagggccgcccctgaccccccgcctttgtttgatgacacctccgggggctactcatctcagcctgggggctatcccgcaactggggccgatgtggcctttagcgttaatcacctcttgggagatcctatggcaaatgtagctatggcttacgggagctcgatagccagtcatggtaaagacatggtccacaaggaactgcaccggttcgtctctgtcagcaaacttaagtacttctttgccgtcgatacggcatacgtagctaagaagttaggcctactggtgttcccttacacacatcagaactgggaggtgcagtacagcagagacgcccctttaccgccacggcaagacctgaatgccccggacctatacattcccaccatggccttcattacctacgtgctgttagctgggatggctttaggaatccagaagcgtttctccccagaagtgctgggactgtgcgcgagtacagccttagtgtgggttgtgatggaggtcttagcccttctgctcggcctgtatttagcgactgtcaggtcagacctgtctaccttccatttactggcatattcggggtataagtatgttggaatgatcctaagcgtcctgaccggcctactgtttgggtccgacggatattatgtagctctagcctggacctccagcgccctgatgtactttattgtacgaagcttgcgcaccgcggcgctcggacccgactctatgggcggcccagtcccccggcagaggctgcagctataccttacgctgggggctgccgcattccagcctctgattatctattggcttaccttccaccttgtgcgatag

SEQ ID NO: 140860 - DNA, 360 bp, Artificial Sequence
  Description of Artificial Sequence: Synthetic coding sequence
atggttaagatgactaagtccaagacctttcaggcttatctccctaactgtcaccgaacctacagctgcattcactgtcgggcacacctcgcaaatcatgatgagctaatctctaaatcctttcaaggcagccagggcagagcctacctgtttaactcagttgtcaacgtgggatgcggccccgccgaggagcgagtgttgctgacaggcctgcacgccgtcgccgacatatactgcgaaaattgtaaaaccactctaggctggaagtatgagcacgcttttgagagctcacagaaatataaggaaggtaagtttataatcgagctggcccacatgatcaaggataacggatgggaatag

SEQ ID NO: 140861 - DNA, 360 bp, Artificial Sequence
  Description of Artificial Sequence: Synthetic coding sequence
atggtcaagatgacacgctcaaagacttttcaggcttatctcccatcatgtcatagaacgtactcctgcatccactgccgcgctcacctggctaatcacgatgagctgatttctaaatcctttcaggggagtcaggggcgagcttatctgttcaattccgtcgtcaacgtgggttgcggccctgccgaggagagggtgctgctgacaggtcttcatgccgtggccgacatttattgtgaaaactgcaagaccacgctggggtggaaatacgaacatgcctttgaaagcagccaaaagtacaaagaagggaagtatatcattgagctagctcacatgatcaaggataacggatgggattag

SEQ ID NO: 140862 - DNA, 360 bp, Artificial Sequence
  Description of Artificial Sequence: Synthetic coding sequence
atggtgcgtattagcaaacccaagacttttcaggcatacctggacgattgccacaggagatactcgtgtgcgcattgtagggcccacctggctaatcatgacgacctcatatccaaaagttttcaaggatcccaagggcgcgcctatctgttcaactcagttgtgaacgtgggttgtggacccgccgaagaacgggtcctactgacgggattgcacgctgtcgccgacatccattgcgagaactgtaagacaactctgggttggaaatacgaacaggccttcgagtcgtcacagaagtacaaagaaggcaagtatattattgaacttaaccacatgatcaaagacaacggttgggactag

SEQ ID NO: 140863 - DNA, 474 bp, Artificial Sequence
  Description of Artificial Sequence: Synthetic coding sequence
atgtgtgtagcccaggtactcactgctcatctgttgccacccagacaggccctgggatccctatgttccccctgggccgcgcctcgcgtgggtccgctgcctccagccccagccatggtccgaatctccaagccaaaaacatttcaagcttacctggacgactgccaccgccggtattcgtgtgctcactgtagggctcacctcgcgaatcacgacgacctcatctccaagtctttccagggatcccagggcagggcctaccttttcaatagcgtcgtaaatgtaggctgcggccctgccgaggagcgggtcctcctgaccggactgcatgccgtggccgacattcactgcgaaaattgtaagacaactctgggctggaagtacgagcaggcatttgaatcatcccagaaatacaaagaaggcaaatacatcatagagcttaaccatatgataaaggataacggatgggactag

SEQ ID NO: 140864 - DNA, 384 bp, Artificial Sequence
  Description of Artificial Sequence: Synthetic coding sequence
atgccatcttgtgatccaggacccgggccagcctgccttcctactaagacatttaggtcatatcttcccaggtgccatagaacgtattcctgcgtgcactgccgagcccacttggctaaacatgacgaactaatctcaaagtctttccagggcagtcatggacgagcctatctcttcaattcagtcgtgaacgtcggctgcggccctgctgagcagagactgcttctcaccggcctccactccgtagccgatatcttttgtgagtcgtgcaagacgacactaggatggaaatacgagcaggcgttcgagacgtcccagaaatacaaagaggggaaatatattatcgagatgtctcatatggtgaaggataatggatgggactag

SEQ ID NO: 140865 - DNA, 384 bp, Artificial Sequence
  Description of Artificial Sequence: Synthetic coding sequence
atgccttcttgtgatcccggccccggaccagcctgtctacccacgaagaccttcaggagctatttacccagatgccacaggacatattcatgcgtgcactgtagggcccatctggctaagcacgatgaactgatcagtaaatccttccagggaagccatggaagagcctatctttttaatagcgtcgtgaatgtgggctgtggaccggccgagcagcgcctgttgctaaccggactgcatagcgtggcagatatcttttgcgagagctgcaagacaaccctgggatggaaatacgaacaagcctttgagacaagtcagaaatacaaggaaggaaaatacatcatcgaaatgtcccatatggtgaaggacaatggctgggactag

SEQ ID NO: 140866 - DNA, 384 bp, Artificial Sequence
  Description of Artificial Sequence: Synthetic coding sequence
atgccaagttgcgaccccggccccggtccagcctgtctgcctaccaagacgttcaggtcctacctgcccaggtgccatcgtacctacagctgtgtgcactgccgtgcgcacctggcgaagcatgatgagctgatttctaagtccttccaaggctcacacgggagggcctatctgttcaattccgtcgtcaacgtgggctgcgggcctgcagaacagaggttgttgcttacgggactccacagtgtggccgacatcttttgcgaatcctgcaagaccactctgggctggaaatacgagcaggcattcgagacatcccagaaatataaggaaggtaagtatattatagagatgtcgcacatggtgaaggataacggatgggactag

SEQ ID NO: 140867 - DNA, 243 bp, Artificial Sequence
  Description of Artificial Sequence: Synthetic coding sequence
atgccttcttgcgaccctggtcctgggcccgcctgcctccctactaagacctttcggtcttatttgccccgttgtcataggacttacagctgtgttcattgcagagcccatctcgcgaagcacgacgaactgatatcaaagtcctttcaggggtcccatggtcgggcatacctgtttaatagcgtggtgaacgtaggatgcgggcccgcagagcagcgtctgctgctgactggtctccattag

SEQ ID NO: 140868 - DNA, 384 bp, Artificial Sequence
  Description of Artificial Sequence: Synthetic coding sequence
atgccaagctgcgatcccggccctggtcctgcttgccttcctaccaagacattccgctcgtatttacctagatgtcataggacatatagttgtgtgcattgcagggcccacctcgctaaacatgatgagcttatcagcaagtctttccaaggctcccacggacgagcatacttgtttaacagcgtagtgaacgttggatgcggaccagccgaacagagactgctgctaacaggtctacactcagtagccgacattttctgtgagagctgcaagaccactcttggctggaaatacgaacaggccttcgagaccagtcagaagtacaaggaggggaaatatattattgagatgagccatatggttaaggacaacggatgggactag

SEQ ID NO: 140869 - DNA, 366 bp, Artificial Sequence
  Description of Artificial Sequence: Synthetic coding sequence
atgggccgcatctttctggaccatatcggcgggaccaggctcttttcttgcgcaaattgcgataccattttgactaaccggtccgagctgatctctacgaggttcaccggagctactggacgagccttcttgtttaataaggttgttaatttgcaatactcagaagtacaggatcgtgtgatgctgactggccgccacatggtgagagacgtatcctgtaagaattgcaactccaagctgggctggatctatgaatttgcgacggaagattctcaaagatataaggagggccgagttattctggagcgagcactcgttcgtgaaagcgaaggcttcgaagagcacgtgccatcagacaactcttag

SEQ ID NO: 140870 - DNA, 366 bp, Artificial Sequence
  Description of Artificial Sequence: Synthetic coding sequence
atgggcaggatcttcttggatcatatcggagggacgcggttattctcatgcgcaaattgtgatactattctcactaatagaagcgaactcatttcaaccagatttaccggcgcgactggcagggcctttttatttaataaagtggttaacctgcaatattccgaagtccaggaccgggtgatgctgaccggcaggcacatggtgcgggatgtgagctgtaagaattgtaactctaagctcggctggatctatgagttcgccaccgaggactcccagcggtataaagaaggacgcgtcatcctggaacgtgctctggtgcgggagtcagagggattcgaggaacacgtgccatccgacaatagctag

SEQ ID NO: 140871 - DNA, 366 bp, Artificial Sequence
  Description of Artificial Sequence: Synthetic coding sequence
atgggcaggatctttcttgatcatattgggggcacgcggctgttctcttgcgccaactgcgataccattcttaccaaccgatccgagttgatcagcacccggttcaccggggctactgggcgcgcctttctcttcaacaaggtcgtgaacttgcagtacagcgaggtacaggatcgggttatgctgactgggaggcacatggtccgggacgtgtcttgcaaaaattgtaattccaagctgggctggatctatgaattcgctaccgaggatagccagcgctacaaggagggcagggtgattctggagagggctctggtgcgggaaagcgaaggatttgaggaacacgtccccagcgataacagttag

SEQ ID NO: 140872 - DNA, 366 bp, Artificial Sequence
  Description of Artificial Sequence: Synthetic coding sequence
atgggtaggatttttctcgaccatatcggaggaaccaggctgttctcgtgtgctaattgcgacactattcttaccaatcgaagcgagttaatcagcacgcgcttcaccggggccaccgggagggcttttctatttaataaagttgtgaacttacagtactcagaagtgcaggatcgtgtcatgctaacgggccggcatatggtgagagacgtgagctgtaagaattgtaatagcaaactaggttggatctacgaattcgccaccgaagacagtcagcgctataaggagggaagagtcatcctcgaaagggcccttgtgagagaatcagagggctttgaggagcacgtgccaagtgacaactcatag

SEQ ID NO: 140873 - DNA, 366 bp, Artificial Sequence
  Description of Artificial Sequence: Synthetic coding sequence
atgggccgcattttcctcgatcatattggcgggacccggctgttcagctgtgctaattgtgatacaatactgactaaccgatccgaactcatctctacccggttcaccggtgcaaccggaagagccttcctgtttaataaggtcgtcaatctgcaatattcagaggtgcaggatcgtgttatgctgacggggcggcacatggttcgagatgtctcatgtaaaaactgcaacagtaaacttggctggatttatgagttcgcaactgaggacagtcagaggtataaagaaggccgggtgatcttggaacgcgctttggtgcgagaaagcgagggctttgaggagcacgtgccttctgataatagctag

SEQ ID NO: 140874 - DNA, 2322 bp, Artificial Sequence
  Description of Artificial Sequence: Synthetic coding sequence
atgttctctttgagttcaacagttcagccacaagtgaccgtgcccctttcccacctgataaacgccttccacactcccaagaacaccagtgtctcgttatcaggggtttcggtttcccaaaaccaacacagagacgtggtcccagaacacgaagctccatcttcggagtgtatgttttcagactttcttacgaaattaaacatcgtgagtatagggaaagggaagatctttgaaggatatcgtagtatgtttatggagcctgcaaagaggatgaaaaagtcattagacacgaccgataattggcacatcaggcctgagccattctcactgtccatccctccgtccctcaaccttagggacctcgggttgtctgaattgaagattggacagatcgatcagctagttgagaatctcctgcctggattctgtaagggcaagaatatctcttctcattggcataccagccacgtaagcgcccagtctttctttgaaaataaatacggtaacttggacatcttctcaactctcagatcctcttgcctgtaccgccatcattccagagccctgcagtcaatttgttccgatctgcagtactggcctgtattcatccagagcaggggattcaagaccctcaaaagccggacccggaggttgcagagcacttctgagaggctggctgaaacccagaacatcgccccctccttcgtgaaagggttcctgctgcgggatcgtgggagcgatgtggagagtctggacaagcttatgaagaccaaaaacatccctgaagcccatcaggacgccttcaagaccgggttcgcagagggctttctgaaggcccaggctctgacgcagaagacaaacgattccctgagaagaacaaggctgatcttgttcgtgctgttgctgttcggaatttacgggttgctgaagaatcccttcctgtcagttcggtttcgaaccactacaggtctagactctgctgttgatcctgtccagatgaagaatgtaacttttgagcacgtaaagggggtggaagaggccaaacaggaactgcaagaggtagtggagtttttaaaaaatccacagaagttcactatactcggtgggaaactgccgaagggaattcttctagtgggaccgccgggtaccggcaaaacattactggctcgcgcagtggctggtgaggcagacgttcctttttactatgcgagtgggagtgagtttgacgagatgttcgtgggtgtgggggctagcaggattaggaacctgttcagagaggctaaggcaaacgctccgtgcgtgatttttatcgatgaattagatagtgtgggcggcaaacgcatcgagagccccatgcacccttacagcagacagacgatcaatcagctgctcgcggagatggatggatttaagcccaatgaaggtgtaatcatcattggcgccaccaatttcccggaggccctagataacgcactcatccgccctggtcgcttcgatatgcaagtgacagtgcccagacccgatgttaaagggcgcaccgaaatcttgaaatggtatttgaataagattaagtttgatcagtccgtggatcctgaaatcattgcaagaggtacggtgggattttccggtgctgagctcgagaacttggttaatcaagccgccctcaaagcagctgtcgacggcaaagaaatggtaaccatgaaggaacttgagttcagtaaggacaagatacttatgggacccgaacgccgcagcgttgagatcgacaacaaaaacaaaactattaccgcctatcacgagtccggccacgcaatcatagcttactacactaaagatgctatgcccatcaacaaggcaaccattatgccaagggggcctacgttagggcatgtttccctcttacctgaaaatgaccgctggaacgagacccgggcccaattgctcgcccaaatggacgtgagtatgggtggccgggtggctgaggaactcatttttggaactgatcatatcacgaccggagcatccagcgacttcgacaatgcaactaagatagccaagagaatggtcacgaagtttggcatgtccgagaagctgggggttatgacttacagcgacaccgggaagctgagcccagagacacaatccgccatcgagcaagagattcgaatcctcctgcgcgatagctatgagagggcaaagcacattctgaaaacacacgccaaagaacacaaaaacctggctgaggctctactgacttacgaaacattagacgcaaaggagatccagattgtgctcgaggggaagaagctggaggttagatag

SEQ ID NO: 140875 - DNA, 2223 bp, Artificial Sequence
  Description of Artificial Sequence: Synthetic coding sequence
atgttctctctgtctagtaccgtgcaacctcaggtgacagttccactgagccacttgattaacgccttccacaccccaaagaacacctcagtgtctctgtccggtgttagcgtgtcccagaaccagcatagagacgtggtacccgagcacgaggcgcccagctccgagtgtatgttttcggattttctgactaagctgaatatcgtgtccatcgggaaaggtaagattttcgagggctaccggtcaatgtttatggaacccgccaaaagaatgaaaaaatccctcgataccaccgacaactggcacatccgacctgaaccattttcactgtccatcccaccttccttaaacttaagggacctggggctatcggagctgaaaatcggccagatcgatcagttagtcgagaacttgctcccgggattttgcaaaggaaagaatatctcatcccactggcacacatctcacgtctccgcccagagcttctttgagaacaagtacggtaatctggacatttttagcactctcaggtcaagctgtctttaccgtcaccattctcgagctctgcaaagcatctgttctgaccttcagtactggcccgtcttcatccaaagccgggggtttaaaacgttgaagagccggaccaggaggctgcagtctacctcagaacgtctcgccgagactcagaacatcgctccctccttcgtcaaaggctttcttctcagagaccgaggatctgacgtggaaagcctcgataagctcatgaaaacaaaaaatatccctgaagcccatcaggacgcattcaagactggattcgccgaaggatttttgaaggcccaggctctaacacagaagacaaatgactcactgaggcgcaccaggctcattttatttgtcctactcctatttggtatttatggcctgctaaagaatccatttttgagcgtgaggttcagaaccaccactggcctggactcagcagtggatcctgtccaaatgaaaaacgtgacctttgaacacgttaaaggcgttgaagaagccaaacaggagcttcaggaggtggtggagttcctcaagaacccccaaaaattcacaatccttgggggcaaattgcccaaaggcattctcctggttgggccacccggaactgggaagactcttctcgctagggccgtggcaggcgaggccgacgttcccttttactacgccagcggatccgagttcgatgaaatgttcgtcggcgtgggcgcatcccgaattaggaacctttttagagaggctaaggcaaatgccccttgcgtgatcttcattgacgagctagattccgtgggtggcaaaagaattgagtcccctatgcacccatactccagacagacgatcaatcagctattggccgaaatggacggattcaagcccaacgagggcgtgattataatcggcgcaactaacttccccgaggctctggacaatgccctgattagacctggcaggttcgatatgcaagtaaccgtcccccgccctgatgtcaaaggccggacagagatattaaaatggtatctgaacaagatcaaatttgatcaaagcgtagaccccgaaattatcgcccgcgggacagtcggattctccggggctgaactagaaaatctggttaatcaagctgccctgaaggccgctgtggacggtaaagagatggtaaccatgaaagaattggagttcagcaaagacaagatcctcatgggtccagagagaagatccgtagagattgataataagaataagaccatcacagcgtatcacgagagtggccacgccatcatcgcctactacacaaaagatgcgatgcccatcaataaagccactataatgccgagagggcccacacttggccacgtttctttattacctgagaacgataggtggaacgaaactagagctcagctgttggcacagatggacgtctccatggggggtcgtgtggcagaagaactaatttttggcactgatcatattacaacaggggccagttctgatttcgataatgccaccaagatcgctaaacgaatggtgaccaagttcgggatgagcgaaaaacttggcgtcatgacatacagtgataccggaaagctctctccagagacccaatccgctatcgagcaggagattcggatcctgctccgcgactcatacgagcgtgccaagcatatactcaagactcactcctag

SEQ ID NO: 140876 - DNA, 2052 bp, Artificial Sequence
  Description of Artificial Sequence: Synthetic coding sequence
atgttttcactttccagcactgtgcagcctcaggtgacagtgccactgtctcacttgatcaatgccttccacacacccaaaaacacatcagttagcctgtctggcgtctcagtgtcccagaatcaacacagagacgtggttcctgaacacgaagcgcctagcagcgagccatcactcaacctgagggacctgggccttagcgaactaaaaattggccaaattgatcagcttgttgagaacctgctcccgggtttttgcaaaggaaaaaatatcagttcccattggcacacatctcacgtcagcgcccagtccttctttgaaaacaagtacgtgtttattcaatcccggggcttcaaaaccctaaagtcaagaactcgacgcttgcaaagcacctcagagcgccttgccgaaactcagaacattgcaccatctttcgtgaagggctttttgctgcgggatcgtggttcagacgtagagtcactggacaaactgatgaagaccaaaaatatccctgaggcacaccaggatgcgtttaagacagggtttgccgagggctttctgaaggcacaggccttaacccagaaaaccaatgactctttaagacggacacgcctgatactttttgtgttgcttttgtttggtatctacgggctgttgaaaaatccttttttatccgtccggtttaggaccactaccggactcgattccgccgtggaccctgtgcagatgaagaacgtgacctttgagcacgtcaagggagtcgaggaggcgaaacaggagctgcaagaagtggttgaattcctgaagaacccacagaagttcacgatcttagggggcaaattgcctaaaggcattctgctggtcgggccccccggcacagggaaaaccctcctggctcgcgccgtagccggagaagccgacgtacccttctactatgctagtggaagcgagtttgacgaaatgtttgtgggcgtgggagccagccgcatccgtaacctgtttagggaggccaaagcaaacgctccttgcgtgatcttcattgatgaactggatagcgtgggcggcaaacgcattgagagtccaatgcacccatattcacgtcagaccataaaccaactgctggcagagatggacggctttaagcctaatgagggggtcattatcattggggcgacgaacttcccagaagcattggataatgctctgattcgaccagggcgctttgatatgcaggtgaccgtgccacggcctgatgtcaagggaagaaccgaaatcctcaaatggtatctgaataagataaaattcgatcaatcagtagacccggagatcatcgcccggggcaccgtgggattcagcggggcagagctagagaatctggtgaatcaggctgcgctgaaagccgctgtcgacggcaaggaaatggttacaatgaaagaactggagttcagtaaagataaaattctgatgggcccggaacggcgcagtgttgagatagacaacaagaacaaaacgatcaccgcgtaccacgagagtggacatgccatcatcgcgtactatacaaaggacgctatgcccatcaacaaggccacgattatgccccgaggtcccacacttgggcatgtctctcttctcccagaaaatgatcgctggaatgaaacaagggcccagctgctcgcacagatggacgtatccatgggggggcgagtggcagaggaattgatcttcggcaccgatcacatcacaaccggggctagctccgacttcgataacgctaccaaaatagctaaaaggatggtaaccaaattcggcatgagcgagaaactgggagtgatgacttactccgataccggaaaactgagtccagaaactcagagcgctattgagcaggagattagaatcctactcagagatagttacgagcgggcgaagcacatcctgaagactcacgccaaggaacacaagaatctggctgaagctcttctgacatacgaaaccctggacgcgaaggagatccaaatagttttagagggtaagaagctggaagtgcgctag

SEQ ID NO: 140877 - DNA, 2151 bp, Artificial Sequence
  Description of Artificial Sequence: Synthetic coding sequence
atgttcagcttgtccagtacggtgcagccacaggtgacagtcccactttcccatttgatcaacgcattccacacccccaagaatactagcgtgagcctgagcggagtttctgtttcccagaaccagcatcgcgatgtggtcccagagcacgaggcccctagctcagaacctagcctgaatttacgcgaccttggtttgagtgagcttaagatcggacagattgaccaactcgtagagaacttgttacccggcttctgtaaaggcaaaaatatcagcagccactggcacacctctcacgtgagcgcacaatcattttttgagaataagtacggaaatctggacattttctcaactttgaggtcctcctgtctctataggcaccattcaagagcgctccagtccatatgttctgacttacaatactggccagtattcatccagagcagagggtttaaaactcttaagagcaggactcgccggctccaaagtacgtccgaacgcctggctgaaactcagaacatcgcgccttcattcgtcaaggggttcctgctccgggaccggggcagcgacgtcgagtcccttgacaaactgatgaagaccaaaaacatacccgaggcgcaccaagacgcgtttaaaaccgggtttgcagaaggtttcctgaaggcacaggccctcacacagaaaacaaatgattccctgaggcggacccggctcatcctctttgtgttgttactctttgggatttatgggttactaaagaatccctttctgtctgtgcggtttaggaccacgaccggactggattccgccgtggaccccgtgcaaatgaaaaacgtgacatttgaacatgtcaagggagtagaggaggcaaaacaggaacttcaggaggtggtagagttccttaagaatccccaaaaatttaccattcttggcggcaagttgcccaaaggtattctgctggtggggcctcctggcactggcaagaccttgctggctagggccgtggccggcgaggccgacgtccctttctactacgcgtcaggatcagaattcgacgaaatgttcgtgggcgtgggcgcaagcaggatacgtaatctgttccgcgaggctaaggcgaatgccccttgcgtgatttttatcgatgagttagatagtgtgggcggcaagcgcattgagtcccctatgcacccatacagccgacagactattaaccagctcctggctgagatggatggttttaagcccaatgagggagtgatcatcatcggggctactaattttccggaggccttagataatgccctgatcagacccggaagatttgacatgcaggtcaccgtcccccgaccagacgttaaaggtcgcactgagatactgaaatggtatctcaataaaattaaattcgaccagagcgtggatccagagataatcgctagaggcacagtggggtttagcggtgccgagctggagaatcttgtgaatcaggccgctctgaaggcagcagtcgacggcaaggaaatggtgactatgaaggagctggagttcagcaaagataagattttgatggggcccgaacgccggtctgtggagattgacaataaaaataagaccattaccgcttaccatgaatcggggcatgccatcatcgcttactacaccaaagacgccatgcctatcaacaaggccaccattatgccgcgaggtccaacccttggacatgtgagtttgctcccagagaacgaccggtggaatgagaccagggcccagttgttggcgcagatggacgtgtctatgggtggtcgcgtcgcagaagaactcatctttggtaccgatcatattacaactggagcctcatctgactttgataacgccactaagatcgcaaaacggatggttaccaagtttggtatgagtgagaaattgggggtaatgacatacagcgatactgggaaactgagcccagagacacagagcgctattgagcaggaaatacggatcttactcagagactcatatgagagggccaagcatatcctgaaaactcacgcaaaagaacataaaaatcttgccgaggccctgttgacctacgagacactggacgccaaggaaattcagatagtgcttgagggtaaaaaactggaggtcaggtag

SEQ ID NO: 140878 - DNA, 747 bp, Artificial Sequence
  Description of Artificial Sequence: Synthetic coding sequence
atgtatcaggttacggtgccactctctcatctgattaacgctttccacactcctaaaaacaccagcgtcagcttatcgggggttagcgtgtcccagaatcagcacagagatgttgttcccgagcacgaggccccctcaagcgagccttcattgaatctgcgcgatctagggctatcagagctgaagatcggacagattgaccaactcgtggagaacttgttaccagggttttgcaaaggcaaaaatatctcctcccattggcatacctcccatgtcagtgcccagagtttctttgagaataagtatgggaatctcgatatatttagtacactcagatccagctgcctgtaccggcaccactctcgtgccctgcaatccatatgtagcgatttgcagtactggccagttttcattcaatcgcgtggcttcaagacacttaagtcaaggacaagacgccttcagtccacttctgaacgtctggcggagactcagaatatagctccaagcttcgttaaaggatttcttcttcgcgacagaggctcagacgtagagtccttagacaagctcatgaaaaccaaaaatattcccgaggctcaccaggatgctttcaaaaccggatttgccgaaggatttttaaaagcccaggccttgacgcagaagaccaacgatagcctacgaagaacccgcctgatcctctttgtgctcctcctgttcggcatttacggactactcaagaatcccttctag

SEQ ID NO: 140879 - DNA, 762 bp, Artificial Sequence
  Description of Artificial Sequence: Synthetic coding sequence
atgttcagcttatccagtacggtccagccacaggttacggtgccgctctcccatctgattaatgctttccacacgcccaagaatacatctgtgtcactcagtggtgtttcagtgtcacaaaaccagcaccgggacgttgtccctgaacacgaagctccaagtagtgaaccatcactgaatctccgcgatctgggtttaagcgagctgaagatcgggcagatcgaccagcttgtcgagaatttgctccccggtttttgcaaaggaaaaaacatctcttcccactggcacacatcccacgtgagcgcccagagctttttcgagaataagtatgtgttcatccaatccagagggtttaagacccttaagtccagaactcggagacttcagagtacgtctgagagactagccgaaacccagaatatcgctccatctttcgtgaaggggttcctgctaagggatcgcgggtcagacgtggagagcttggataaactaatgaagacaaaaaatatacctgaagcccatcaagacgccttcaagactggttttgccgagggctttctaaaagcccaagccctgacacagaagactaacgattctctgcggagaacccgcctcattctattcgtcctcctgctgtttggcatctatggtctgctaaagaacccttttctttcagttaggttccgcaccaccaccggattggactctgctgtggatccagtccaaatgaagaacgtcacctttgaacatgtgaaggggtag

SEQ ID NO: 140880 - DNA, 1551 bp, Artificial Sequence
  Description of Artificial Sequence: Synthetic coding sequence
atgaagactaagaatatcccagaggcccatcaggacgcgttcaagacaggctttgcggaagggttcctgaaggctcaggctctcacccagaagaccaacgactcactgaggcgcactcggttaattctgttcgtgctccttttgtttggtatctatggtcttctcaagaatccattcctctctgtacgctttcggacaaccaccggcctggactcagcagtcgatcccgtgcaaatgaagaatgttaccttcgagcatgtgaaaggagtggaggaagcaaaacaggaactacaggaggtagttgaatttctgaagaatccacagaagtttacgatcttgggagggaaactccctaagggcattctgctggttgggcctcccggaaccggtaaaactctgctagcgagggccgtagctggcgaggccgatgttcccttctattacgcctcggggtccgagttcgacgagatgttcgtgggggtgggagcatctcgcatcagaaacctgtttcgcgaggcgaaggcaaatgctccttgtgtaattttcattgatgagctggactctgtaggggggaagagaatcgaaagtccaatgcacccttattcccggcaaactataaaccagttgctggctgagatggacgggttcaaacctaatgagggcgtcatcatcattggcgcaactaactttccagaagccctggacaatgcactgattaggccaggccgtttcgacatgcaggttaccgtccccaggccagatgtgaaaggaaggactgagatactaaaatggtacctgaataagatcaagtttgatcagtctgtggacccggagataatcgccaggggcactgtgggattctctggcgctgaacttgaaaatctcgtgaaccaagcagctctgaaagcagctgtagacggcaaagaaatggtgactatgaaagagttggaatttagtaaggataaaattctcatggggcccgaacgtcgatctgttgaaatcgataataagaacaagacgattactgcctaccacgagtccggacatgcaattattgcctactacacaaaggacgccatgcccataaataaagctactattatgcctagaggccccaccttgggccacgtctctctcttgcctgaaaacgatcggtggaacgaaaccagagcacagctgctcgcgcagatggacgtaagtatgggaggtcgggtcgcagaggagctcatctttggaaccgaccacattacaaccggcgcctcttctgacttcgataatgccacaaagatcgctaaacggatggtcacaaagtttgggatgtcggaaaaactgggggtgatgacctacagcgacaccgggaagttgtctcccgaaacacaatctgctatcgagcaggaaatcaggatcctcctgagggattcctacgaaagggctaagcacattcttaaaacccacgccaaggagcacaaaaacctagccgaggccctgctcacttatgaaactatgcccaagcgtttcaaactatttttacgcggtaagtcctggaaatag

SEQ ID NO: 140881 - DNA, 1047 bp, Artificial Sequence
  Description of Artificial Sequence: Synthetic coding sequence
atgtttggccccgcgaaggggagacactttggcgtgcacccagccccgggattccctggcggagtgagccagcaggccgcaggcactaaagcaggccccgcaggtgcatggcctgttggctcacgaactgatacgatgtggaggcttcggtgtaaagctaaggatggtacacatgtcctgcagggactgtcctccaggacccgggtccgggaactccaaggacagatagccgctatcaccggtatagctcctggcgggcagagaatcttggtaggctaccccccggagtgcctggatctgagtaacggggatacaattctggaagatctcccaatccagtcaggtgatatgctgatcatcgaagaagaccaaacccgaccacggagttcccccgcttttacaaagagaggcgcatcatcctacgttcgtgagaccctgccagtcctcacacggacagtcgtgcctgcagacaattcctgcctgtttacgtctgtttattacgtggtggaggggggcgtgctgaatcccgcctgcgcacctgagatgcgtaggctcatagcgcagatcgtagccagcgacccagacttctactccgaagcgatcttaggaaaaacaaatcaggagtattgcgactggattaagcgcgacgacacatggggaggtgccatcgagatttcgatcctctccaagttttaccaatgtgagatttgcgttgtggatactcaaaccgtgcgcatcgaccgcttcggtgaggatgccggctacacaaaacgggtactgttgatctatgatgggatccattacgatccattgcagaggaactttcccgacccagatacgccgcccctgacaatttttagctctaatgatgacatcgtgttggttcaggcactagaactcgccgatgaggccagacggcgtaggcagttcacagatgtgaacaggttcaccctgcgctgtatggtgtgccagaaggggctcacgggtcaggccgaagcaagagagcacgcaaaagagaccggccacaccaactttggtgaggtttag

SEQ ID NO: 140882 - DNA, 915 bp, Artificial Sequence
  Description of Artificial Sequence: Synthetic coding sequence
atggagactctgcacattatttactccgaagccaaatctttcaccgtggaaggactaagctcaaggaccagggtgagagagttgcaagggcagattgctgcaatcaccgggattgcaccgggaggccagcgaattctcgttggctatccacctgaatgcctggacttaagtaacggggataccatactagaagaccttccaatccagtcgggagacatgctcataatagaggaagatcagactaggcccaggtcttctcccgcgttcacaaaaaggggggcctccagctacgtcagagagaccttgccagtcctcacacggaccgtggtcccagccgataatagttgccttttcacttcagtctattacgtggtggaaggcggtgtgctcaaccccgcatgcgctccagagatgcggcggctgattgcacaaatagtagcctcagatcctgatttttactctgaagcaattctcggaaaaactaaccaggaatactgcgattggatcaaacgtgacgacacttggggtggagccattgagattagtatcctgagcaaattctaccagtgtgagatctgtgtggtggatacccagaccgtaagaatcgataggtttggggaggacgctggttacaccaaacgtgtcctcttaatctatgacggcattcactatgaccctctccagcggaatttccccgacccggatacacctccactcacaatcttttcttccaatgacgatatcgtcctggtgcaagcactggaactcgccgatgaggcccgtaggaggagacagtttaccgacgtgaacaggtttacactgcggtgtatggtttgtcagaaaggactcacgggccaggctgaagcaagggagcatgccaaagagactggtcacaccaactttggcgaggtgtag

SEQ ID NO: 140883 - DNA, 915 bp, Artificial Sequence
  Description of Artificial Sequence: Synthetic coding sequence
atggaaaccctgcatatcatctactccgaggcgaagagttttacggttgaagggctcagctccaggactagggtgcgggaactgcagggccagattgcggccatcactggcattgcgcccggcggccagcgtatcctagtcgggtatccgccagagtgtttggacctctcaaatggagatactattttagaagacctgcccattcagagtggggacatgctcattatcgaggaagatcagacccgccctaggagttcccctgcttttactaaaaggggcgcaagttcctatgtgcgtgagaccctgcccgtgctgactcgcacggtcgtaccagcagacaacagttgcctgtttacaagcgtatactacgtggttgaagggggggtgctgaatcctgcttgcgccccagagatgcggcgccttatcgctcagatcgtggcttcagatcccgacttctacagcgaagctatcctgggcaagaccaatcaagagtactgcgactggatcaagcgagacgacacgtggggcggtgccatagaaatttccattctttcaaaattttatcagtgcgagatttgcgtcgtggatacgcagaccgtgagaatcgataggttcggagaagatgctggatatacaaagcgcgttctgctgatctatgacgggatacactatgatccactgcagagaaattttcctgacccagatacgcctccactgactatcttctcttcaaacgacgacatcgttctggttcaggcactcgaactcgccgacgaagccaggagacgaaggcagtttacggacgttaaccgcttcaccttgcgatgcatggtctgtcagaaaggattgacaggccaggcagaggcaagggagcacgctaaggagaccggacacacaaattttggcgaagtgtag

SEQ ID NO: 140884 - DNA, 840 bp, Artificial Sequence
  Description of Artificial Sequence: Synthetic coding sequence
atgagtcccgcccgacggtgcagaggaatgcgggccgctgtggcagcttccgtcggcctcagcgaggggcctgcaggcagccgatccgggcgactgttccggcctccatctcctgcccccgccgccccaggtgcccgcctgttgagactgcccggttctggcgcagtgcaagcagcatctcccgagagagccggttggacggaagcgttgcgagccgcagtcgcggaactgagggcaggtgcagttgtggccgttcctaccgacacattatatgggctggcctgtgcagcatcatgtagcgcagctctccgagcagtctaccgcctgaaggggcggtccgaagcaaaaccattggcggtgtgtcttggtcgtgttgccgacgtgtaccgctattgcagggtgcgggttcctgagggtctcctgaaggacctccttcctggtcccgttacgcttgtcatggagagaagcgaagaactgaataaggacctgaatccctttactccccttgtgggaattagaattcccgaccacgcatttatgcaggacttggcccagatgtttgagggccctcttgcgcttacttccgccaacctgtcctctcaggcttcttctctgaacgtggaagaatttcaagatctgtggccacagttaagcctggtgatcgacggcggccagatcggcgacggccagagccctgaatgtcggctgggttccaccgtcgtggacttaagcgtgccaggcaagtttgggattatcaggccaggttgcgcgctggagagcaccaccgccatcctgcagcaaaagtatggcctactgccttcacatgcttcctatctctag

SEQ ID NO: 140885 - DNA, 1740 bp, Artificial Sequence
  Description of Artificial Sequence: Synthetic coding sequence
atgtccgcttcaagcttactcgagcagcgcccaaaggggcaagggaacaaggtgcaaaatggaagcgtgcatcagaaggatggcttgaacgacgacgattttgagccttatctttcaccacaggcccgacctaataatgcttataccgccatgtccgattcttacctgccctcatactattctccatcaatcgggttcagctacagcctgggcgaggccgcatggagcacgggcggtgacaccgcgatgccctatcttacatcctatggccagctctctaatggcgagccccatttcctccctgacgcaatgtttggccagcccggcgccctcggtagcaccccattcctgggacagcatggtttcaatttctttcccagcggcatcgatttcagcgcctgggggaacaattccagtcagggacaatctactcagtcttctgggtacagcagcaattatgcatacgcgcccagttccctgggtggagctatgattgacggtcagtcagcatttgcaaatgagaccttgaacaaggctcccggtatgaatacaatcgaccagggcatggcggccctgaaactggggagtactgaagtggctagcaacgtcccaaaagtagtggggtctgctgtcggcagcggctcaatcacttctaacattgtcgcctctaatagcctcccgccagccacgatcgctccgcccaaaccagcgtcctgggctgacattgcctcaaagcctgccaagcagcagcccaaactaaaaaccaagaacggaattgccgggtcttcactgcctccgccacccatcaaacataatatggacatcgggacttgggataacaagggaccagttgcaaaggctccctcgcaggccctggtacagaatatcggacagccaacccaggggagcccacagcctgtgggtcagcaggccaataactccccaccggtggcacaagccagcgtggggcagcaaacccagcctttgccaccaccaccacctcagccagcacagcttagcgtacaacaacaagccgcgcagccgacccgatgggtggcccccagaaacaggggaagtggtttcggccacaatggcgtggatggaaacggcgtgggccagtctcaggccggcagcggaagcactcccagcgagccgcatccagtgctggaaaagctccggtccatcaataattacaaccctaaggattttgactggaacctgaagcacgggagagtatttattatcaaatcgtactctgaggacgatattcataggtccattaagtacaacatttggtgttccactgaacatggcaacaagagacttgacgctgcttaccgaagcatgaatggcaaagggcccgtctaccttttattctctgtgaacggtagcggccatttctgcggagtcgccgaaatgaaaagtgccgtggactacaatacgtgtgcgggggtttggagtcaggacaaatggaaaggccgcttcgacgtccggtggatatttgtaaaagatgtgccaaattcgcagctgcgtcacattcgactggaaaacaacgaaaacaagccagttacgaactcacgggacacccaggaagtcccgctcgaaaaagcaaaacaggttcttaagattatagcttcttacaagcatacgacatccatattcgatgatttctcccactatgagaagagacaggaggaagaggagagcgtgaaaaaagagcgacagggcaggggtaagtag

SEQ ID NO: 140886 - DNA, 1710 bp, Artificial Sequence
  Description of Artificial Sequence: Synthetic coding sequence
atgtccgctagctctctgctcgagcagcggcctaaaggtcaaggcaacaaagtgcagaatggttccgtccatcagaaggatggcttgaatgatgacgatttcgagccttacctgtcccctcaagcaaggccgaacaatgcgtataccgcaatgtcagacagttacctgccctcatattattctcctagtattggcttttcttatagcctcggggaggcagcctggtccaccggtggagatactgctatgccttacctcacatcatatggccagctttccaatggcgaacctcactttctcccagatgccatgttcggacagcctggggctctgggctccacaccattcctcgggcagcacggtttcaatttttttccctctggtatcgatttttcggcttgggggaacaacagctcacaggggcaaagcactcagtccagtgggtactcttccaattacgcttatgccccatcatcactcgggggagcgatgattgacggacagtcggcattcgcgaatgagacactgaacaaagcccctggtatgaacaccatagatcagggaatggccgctcttaaattgggatccacggaagttgcttctaatgtccccaaagtcgtggggtctgctgttggctctggcagcataacttccaacattgttgcctcaaactcgctacccccggccactatcgccccacccaagcccgcaagctgggcggacattgccagtaaaccggctaaacagcagccaaaattaaagactaagaatggaatcgccggttccagcttgcccccgcccccgattaagcataatatggacatcggcacatgggataacaaaggccctgttgccaaggcacccagccaggccttggtgcagaatatcggacagccaacccaaggcagcccccagccagtcggccagcaagctaataattctcccccagtggctcaggcaagtgtaggtcagcagacccagcccctgcctccgccccctccacagcccgcacagctgtccgtgcaacagcaagccgctcagccaacacggtgggtggcacctcgcaatcggggctccggtttcggccacaacggagtcgacggcaatggggtgggccagagccaggccggatctggcagtaccccgtcagagcctcatccagtactcgaaaagcttcggtccattaacaattacaacccgaaggactttgattggaatctgaagcacgggcgcgtctttatcattaagtcctactccgaagacgatatacacagaagcattaagtataacatctggtgcagtactgaacatggtaataaacggttagatgcagcatatcgcagcatgaatgggaaagggcccgtctacctccttttcagtgttaatggcagcggtcatttctgtggagtcgctgaaatgaaaagcgcagtggattacaacacctgtgccggggtgtggtcccaagataagtggaagggccgttttgatgttcgatggatttttgtcaaggatgttcccaatagccagctgcggcacattcggctggagaataacgaaaacaagcctgtgacaaacagccgagatacacaagaggtacctctggagaaagccaagcaggtcctgaagatcattgcaagctacaagcacactacgtcaatctttgatgatttctcccattatgagaagcgccagggtaggcgtaagtgttag

SEQ ID NO: 140887 - DNA, 1590 bp, Artificial Sequence
  Description of Artificial Sequence: Synthetic coding sequence
atgtcagactcgtatctcccatcctattactctccatcaattggtttttcttattccctcggcgaggcagcctggtccaccggtggagatacggctatgccctacttaacaagttacggccaactgtcgaatggagagccccatttcctgcccgacgcgatgttcggccagcctggcgccctggggagtaccccatttctcggacagcacggttttaacttcttccctagcggtattgacttcagtgcttggggcaataatagcagccagggccagtccactcagtcgagcggatacagcagtaactatgcatacgcgccttccagtctcggcggggcaatgattgatgggcagagcgctttcgctaacgagacacttaacaaggcccctggtatgaatacaatcgaccaggggatggccgcactgaaactcgggtctaccgaggtcgcttctaatgttcccaaggtagtgggctcagctgtgggatccggctctattacctccaatatagttgctagcaatagcttgccacccgccaccattgcgccacccaaaccggcaagttgggccgatattgccagtaaacccgcaaaacagcagccgaagctgaagacgaagaatggtattgccggctctagcctcccacctcctccgatcaaacataatatggatatagggacttgggataacaaagggcccgtagctaaggcgccttctcaggcactcgtccagaatatcggacagcccacccaggggtccccacagcctgtcggccagcaagccaataattccccacctgtggctcaggctagcgtggggcagcagactcaacccctcccaccaccaccccctcagcctgcccagttgtctgtgcaacagcaagcagcgcagcctacccgctgggtggcgcccagaaacaggggatctggattcgggcacaacggagtggacggaaacggcgtcggacagagccaagccggcagcggaagcactccatcagaaccccatcccgtcctggagaagcttagatcaatcaataactataatcccaaggattttgactggaacctgaagcacggtcgtgttttcattatcaaatcctattccgaggacgatatccacaggagcatcaaatacaatatttggtgttcaacagagcatggcaacaaaaggctcgatgccgcctatcgatccatgaacgggaaaggtcctgtctacctgctgttctccgtgaacggaagtgggcacttctgtggagtggccgaaatgaaaagcgcggtggactacaacacttgcgccggcgtatggtcacaggataaatggaaaggccgatttgatgttagatggatttttgtcaaggacgtcccaaactctcaactgcgacacatccgtttggagaacaatgaaaacaagcctgtcaccaactcacgtgacactcaggaggtcccattagagaaagccaaacaagtgctgaaaatcattgcctcttacaagcatacaacgagtatctttgacgactttagccattacgagaagcggcaggaagaggaggagtctgttaagaaagagaggcaaggccgtgggaagtag

SEQ ID NO: 140888 - DNA, 1740 bp, Artificial Sequence
  Description of Artificial Sequence: Synthetic coding sequence
atgtctgccagctctttgctggagcagagacccaaaggtcagggaaataaagtgcagaacggaagtgtccaccagaaggacggactcaatgatgatgatttcgagccttacctctccccacaggctcggccgaataatgcctataccgcgatgagcgattcctatctcccttcctattattctccctctatcggtttcagctattctctgggagaggctgcgtggtctaccgggggcgacaccgccatgccttatctgacttcatatggtcagctcagcaatggggagcctcacttcttgcccgacgccatgttcggacaaccaggcgccctgggctcgaccccttttctgggccagcacggctttaacttctttccatcgggcatcgattttagcgcctggggtaacaatagttcccagggccagagcactcagagcagtggatacagctcaaactacgcctacgccccaagtagcctgggcggggcaatgatcgatggacaaagcgccttcgccaacgaaactctaaataaagcccctggcatgaacactattgatcagggaatggccgcactgaagctcggaagcactgaggtggcatcaaatgtgcctaaagtggtgggcagcgcggtaggctctggatctataactagtaacatagtggcttccaactccttaccgccggccactatagcccccccaaagcctgccagttgggcagatatcgcttcaaagccggccaagcaacagcctaagctgaaaactaaaaatgggatcgcgggctccagcctgcctccaccgcctatcaagcacaatatggacattggcacctgggataataaggggcccgttgccaaagcgccttcccaagcactggtgcagaatattggacaaccgacacaggggagcccgcagccagtggggcagcaagccaacaattcacccccagtagcccaagcgtccgtgggacagcagacacagcctctgccaccaccaccccctcagcccgcccagctgtccgtgcaacagcaggccgctcagcctactcgctgggtcgcgcctagaaatcggggctccgggttcgggcataatggggtagatggcaatggggtggggcaatcccaggccggcagtggctctaccccctccgagccccatcctgtcctggaaaaactaagatccattaacaattataatcccaaagatttcgattggaaccttaagcacggaagggtgttcattataaagtcatactctgaggacgacatacatcgttcgatcaagtacaacatttggtgttccactgagcacggcaataaacggctggacgccgcctatcgctcaatgaatggcaagggtcctgtgtacctcctgtttagtgtgaatggcagcgggcacttctgtggggttgccgagatgaaatctgccgtggattacaatacctgtgccggtgtgtggtcccaggataaatggaagggcaggtttgacgtgagatggatatttgttaaggacgtgccaaattcccaactccggcatattcgcctggagaacaacgagaataaacctgtgacaaactcgcgggatacccaagaagtccctctcgagaaagccaagcaagtattaaagattatagcctcatacaagcataccacttctatctttgatgacttctctcactatgagaagcgccaggaggaagaagaaagcgtaaaaaaagagcggcagggacgcggtaagtag

SEQ ID NO: 140889 - DNA, 1245 bp, Artificial Sequence
  Description of Artificial Sequence: Synthetic coding sequence
atggcgtctggagataccctgtatatcgccaccgatggctcagagatgccggctgaaattgtagagctgcacgagatcgaggtggaaacaattcccgttgagactatagagactaccgtcgtgggcgaggaggaggaagaggacgacgacgacgaggacggcggcggcggagaccatggcgggggcggggggcacggacatgccgggcaccatcatcatcaccaccaccatcaccatcatccacctatgatcgctctgcagcccctggtgacagacgatcccactcaggtccaccatcaccaggaggtgatcctcgtgcagacccgggaggaagtagtgggaggggatgattccgacggcctcagagccgaagatgggttcgaagaccagatccttatcccggtccccgccccggcaggaggcgacgacgattatatagaacagacattggtcacagtagcggccgctgggaaaagcggcggaggtggaagtagctcctctggcggcggcagggtaaagaagggcggcggcaagaagagcggaaagaagtcatacctgtcaggcggcgcaggtgcagcgggaggaggcggagccgaccctggaaataaaaaatgggaacagaagcaggtgcagataaaaactttggagggggaattctccgttaccatgtggtcttccgatgagaagaaagatattgatcatgagaccgtcgtagaagaacaaatcatcggcgagaactcacctcccgattattcagaatacatgacaggtaagaaactcccgcctggaggtattcccggtattgatttgtctgaccccaagcagttggcagaattcgctcggatgaaaccgagaaaaatcaaagaggacgacgcccccagaacaatagcttgtcctcacaaaggctgtaccaaaatgttccgagacaattccgccatgaggaagcacctgcacacccatggtccacgcgttcacgtttgtgctgaatgcggtaaagcatttgtggagtccagtaaacttaagcgccaccagctcgtacataccggtgaaaagccattccagtgcacattcgaggggtgtggcaagcggttcagcctggatttcaacttgagaactcatgtgcggatccatacaggagacagaccttatgtatgccccttcgacggctgcaataagaagtttgcccagtccacgaacctgaaaagtcacattctaacacatgccaaggcgaaaaataaccagtag

SEQ ID NO: 140890 - DNA, 105 bp, Artificial Sequence
  Description of Artificial Sequence: Synthetic coding sequence
atggctagtggcgatactttatatatagcaactgatggttctgaaatgcctgccgaaatcgtggaacttcacgaaatcgaggtcgaaactatccctgtcgagtag

SEQ ID NO: 140891 - DNA, 1221 bp, Artificial Sequence
  Description of Artificial Sequence: Synthetic coding sequence
atggcccaggcccctgccgaccccggcagggagggacatctggaacagaggatcctgcaggtgttgaccgaggcagggtcccccgtgaagctagcacagctggtgaaagagtgccaggctcccaagcgagagctgaatcaggtgttgtaccgcatgaagaaggaactcaaagtgagcctgacgtcaccagccacatggtgtcttgggggcacagatcccgaaggcgaagggccagctgaattagcccttagctccccggaggaggacatctatcgcttcctcaaagataacgggccgcagagagcgttggtgatcgcgcaggcccttggcatgaggaccgcaaaagatgtcaatagggacttatatagaatgaagtcgcgccatctgcttgacatggatgaacagtctaaggcatggaccatctatcgaccagaggatagtgggcgccgggctaagagcgcatcaattatttaccagcataatccaataaacatgatatgtcagaatggacctaactcttggattagcatcgccaatagtgaagccatccaaataggacacggcaacattatcactagacagacagtgagtcgagaggacggatcagctgggcccagacacctgccttcaatggcccctggagacagctccacatggggaacattggtagacccttgggggcctcaggatattcacatggagcagtctatcctacgccgggttcagctgggccacagcaatgagatgcggttgcacggcgtgccttccgagggtccggcgcacatcccgccaggcagccctccagtcagcgctaccgcagccggcccagaagccagctttgaggcgcgcattccctccccagggacccacccagagggcgaggcagcccagcgtattcacatgaagtcttgttttcttgaagatgcaaccataggaaattcaaacaagatgtcgatctccccaggagtggccggcccgggcggggtggccggatctggagaaggcgagcccggtgaggacgccggacggagacccgccgatactcagagccgcagccactttccaagagatattggacagcccatcacgccgtcccacagcaaactcacccccaaactggagaccatgaccctaggcaacagatcccacaaggccgccgaaggctcccactatgtggatgaggccagccatgagggttcctggtggggaggcggtatctag

SEQ ID NO: 140892 - DNA, 1341 bp, Artificial Sequence
  Description of Artificial Sequence: Synthetic coding sequence
atggcccaggctcccgctgatccaggcagagaaggccatttagaacaacgaatcttgcaggtgctgacagaggctggttccccggtcaaacttgctcagctggtgaaggagtgtcaggccccaaaaagagagcttaatcaagtgctatatcgaatgaaaaaggaactgaaagtttccctcacaagccccgcaacatggtgccttggtggcactgacccagaaggagaaggcccagccgagctggctctttcctcccccgctgaaaggccccagcaacatgccgccaccattcccgaaacacccggcccacagttttcgcagcaaagagaggaggacatctacaggttcctgaaagataatgggcctcaacgagctttagtgatcgcccaggcactgggaatgcggacggctaaggatgtaaaccgcgacttatacaggatgaaaagcaggcacttgttggatatggatgaacagtcaaaagcatggacaatatatcgcccagaagattctggacgacgagctaaaagcgcctcaattatctaccaacataatcctataaacatgatatgtcaaaacgggcctaactcctggataagtatcgcaaattctgaggccattcaaattggtcatggaaacattatcacaagacagaccgtatctcgcgaggacggatcagccgggccccggcatctgcccagtatggcacccggggactcaagcacttggggaacccttgtggatccctggggcccccaagacatccacatggagcaaagcatcttgagaagagtgcagctgggccacagtaacgagatgcgactgcatggtgtgccttctgagggccccgcgcatataccacctggtagcccgccagtctcagctaccgcagccgggcccgaggcatcattcgaagctcgcataccctctcccggcacccatcccgagggggaggccgctcagaggattcacatgaaatcctgctttctggaggatgccaccattgggaactctaataagatgagtatatcgccaggagttgctgggccaggcggagtggcggggagtggtgagggagaaccaggagaagacgctgtggccgcctttactgaggtgttgaatccatctaaatcctttatgaaattcggcatcaatttctttcagacgcctgtcaatgttgactctctcacctcttcccacgagtcccagatgtttctcaccgcatgcagactggtcatcttcagccgccgcttttctacatatttcgcccaaattcacctaaggaaccattcagtgctgcacctgtgcccacataaaatttatctgctgaaaaataagaaatag

SEQ ID NO: 140893 - DNA, 1143 bp, Artificial Sequence
  Description of Artificial Sequence: Synthetic coding sequence
atggcacaggctcccgcagatccaggccgggaggggcacctggagcagcgtattctccaggttttgaccgaagctggtagccccgtgaaacttgcccaattggtcaaagagtgtcaggcccccaagcgggagctgaaccaggtgctataccggatgaagaaagaactgaaagtgtctttgacaagtcccgccacatggtgcctgggcgggaccgatcccgaaggtgaagggccagcagaactggctctgtcgagccccgcagaaaggccacaacagcacgctgcgaccataccagagactccgggccctcaattcagccagcagcgggaggaggatatctacaggtttctgaaggacaacggccctcagcgagctttggtgattgcccaggcactgggcatgcggaccgcaaaggacgttaaccgggacctgtaccgcatgaaatcccgccatctgttagatatggatgaacagtccaaggcctggacaatatatcgtccagaggattccggccggcgagctaagagcgcttccattatttaccagcataatccaatcaacatgatctgccagaatggaccaaatagctggatcagcattgccaattcggaagcaatccagatcggccacggaaacattatcaccagacaaacagtgtcccgcgaggatgggtccgcgggtcctcgccacttaccctccatggccccaggtgattcctccacttggggcacgctcgtggatccatgggggccacaggacattcatatggagcagagcatcttgaggcgggtgcagctgggacatagcaatgagatgagattgcacggcgtgccctccgaggggcctgcacatataccacccggctccccacctgtctctgctactgcagccgggccggaagcctccttcgaagcccggataccatccccaggcacgcatcctgaaggggaggctgcccaacggatccatatgaagtcctgctttcttgaggacgcgaccatcgggaattctaacaaaatgtccattagccccggcgtcgcaggaccaggtggagtggccggtagtggtgaaggagaacctggggaggacgccggtcgaaggcccgccgacacccaggctcggtcctttgacggtcaggaatag

SEQ ID NO: 140894 - DNA, 1290 bp, Artificial Sequence
  Description of Artificial Sequence: Synthetic coding sequence
atggctcaggcccccgccgaccctggacgggagggacacctggaacagagaatcctacaggttctgactgaggcaggtagtcccgtcaaacttgctcaactcgtgaaagaatgtcaggcccccaagcgggagctgaatcaggtgctgtatagaatgaagaaggagttgaaagtgtctctcaccagtccggcaacatggtgcttaggcgggaccgatccagagggggagggacctgccgagctcgccctgtctagtcctgccgagcgacctcagcagcacgccgctactattcccgagacacctggaccgcaattttcacaacagcgggaagaagatatctaccgctttctgaaagacaatgggcctcagcgggccctggtgatcgctcaggctctgggcatgcgaacagccaaagacgttaatcgcgacttatatcgcatgaaaagtaggcacctgctggatatggacgaacagagcaaagcctggacgatctacaggcccgaggattcggggcggcgtgctaaaagtgcttccatcatataccagcacaaccctataaacatgatctgtcagaacggccccaacagctggatatcaattgcaaacagcgaagctattcaaatcggtcatggaaatatcataacaagacagacggtgagtcgagaggacggatctgcaggaccccgtcacctgccctctatggcaccgggcgatagcagtacatggggtaccctggtcgacccctggggtccccaagacattcacatggagcagtctatactgagacgagtgcagctgggccacagcaacgagatgcggcttcacggagttccttctgagggtccagcgcatatccccccagggagccctcccgtgagtgccacagcagccggtcctgaggctagcttcgaagcacgtattcctagccctgggactcatcccgagggcgaggccgcccaacggatccacatgaagagctgcttcttagaggatgccacaatcggtaatagtaataagatgtctatttcgccgggcgtggcgggccccggcggcgtcgccggcagcggggagggggagcctggagaggacgctgggcgtagacccgctgatacccagtccagaagccactttcccagagatatcgggcaacctattacaccgtctcattcaaaactgactccaaaactggaaacaatgaccttaggaaacagatcgcacaaggcagcggaggggtcgcattatgtggacgaggcatcacacgagggaagctggtggggtgggggcatctag

SEQ ID NO: 140895 - DNA, 747 bp, Artificial Sequence
  Description of Artificial Sequence: Synthetic coding sequence
atggcacaggccccagccgatccaggccgagagggacacctggagcagcgaatcctgcaggtcctgaccgaagccggaagcccggtgaaattagctcagctagttaaggagtgtcaggcacctaagagggaactgaatcaggttttgtatcgtatgaaaaaggaacttaaagttagccttacaagtccggctacctggtgtcttgggggtacagacccggaaggagaggggccagcggagctggctcttagcagcccagctgaacgtccacagcaacacgccgcgaccattcccgagacccctgggccacagttttctcagcagagagaagaagacatttatagattcttgaaggacaacggtccccagcgcgcccttgtcatcgctcaggcacttggtatgaggactgcaaaggacgttaatagggatctgtataggatgaagtcaaggcatctgctggatatggatgagcaatctaaggcctggactatttatcgcccagaggacagtgggagacgagccaagtcagccagcataatttatcagcacaatcctatcaacatgatctgccaaaatgggcctaattcctggattagtatcgcaaacagcgaggctatacaaataggtcacggaaatattatcacccggcagaccgtgagccgagaggatgggaagtcccccaagagagcgcaaggaggggatctgggtggagagcctccagatcctttgggtggaggaaaaggctag

SEQ ID NO: 140896 - DNA, 1065 bp, Artificial Sequence
  Description of Artificial Sequence: Synthetic coding sequence
atggcgcaggcccctgctgacccaggtcgggaagctgaaagacctcagcagcacgcggctaccattcccgagaccccaggtcctcagttcagtcagcagagagaggaggatatctaccgtttcctgaaagacaatggcccccaacgagccttggtgatcgctcaggctctgggcatgcggactgccaaagatgtcaaccgggatttgtaccgcatgaaatcacgccacctactcgatatggacgagcagagtaaggcatggactatttaccgtcccgaggattctgggcggagagcgaaaagtgcctcaatcatttaccaacacaatcccatcaacatgatatgtcagaacggcccgaactcatggatctccatcgcaaactccgaggccatccagatcggccatgggaatataataacccgccagaccgtgagtcgcgaggacgggtccgcgggccccagacatcttccatcgatggcccccggcgattcaagcacttggggcactctcgttgatccttgggggccccaggacatccacatggagcagagcatcctgaggagagtccagttagggcacagcaatgaaatgcgactccacggcgttccttcagaggggcctgcgcacattcctccaggttcccccccagtatccgccactgctgcaggcccggaggccagttttgaagctcgaatccccagtccaggcacgcatcccgaaggagaagcagcccagagaattcatatgaagagttgcttcctcgaagatgctacgatcgggaactctaataagatgtcgatctcccctggcgtggccggacctggaggggtagcaggatcaggggagggagagcctggggaggatgccgggagacggccagcagacactcagtcccgatcgcattttccaagagatataggacagccgattacgccaagtcactcaaagctgacccccaaactcgaaaccatgacactcggcaaccggagtcataaagccgcggaggggagccattacgttgatgaagcatcacacgagggctcctggtggggtggcggaatctag

SEQ ID NO: 140897 - DNA, 1860 bp, Artificial Sequence
  Description of Artificial Sequence: Synthetic coding sequence
atgcccgatccagctgctcacctgcccttcttttatggttcaatctccagagccgaggccgaagaacacttgaagttggctggaatggcagatggtctcttcctgcttcggcagtgcctgcggtctcttggcggatatgtcctctccctcgtgcacgatgttcggttccaccactttccaatcgagaggcaattgaatggaacatatgctatcgcaggaggcaaggcccactgcggtcctgcagaactgtgtgaattctactccagggatcccgatggactgccgtgcaatctgaggaaaccctgtaaccgcccaagcggcctcgagcctcagccgggcgtctttgactgcttgcgggatgctatggtccgtgattatgtgcgccagacgtggaagctggaaggcgaggccctggagcaagccataataagccaggcccctcaggttgagaagctcattgccaccaccgcgcatgagcgtatgccctggtaccattctagccttactagagaagaagcagaaagaaaactatatagcggcgcacagacagatggtaaatttttactgaggcctaggaaagaacagggtacttacgccctgtcccttatttacggaaaaacggtgtaccattacctaatttcccaggacaaggctggcaaatattgtatccctgagggcactaagttcgatacactctggcaactggttgagtatctgaagttgaaagctgacggtttgatctactgtctgaaagaggcctgtccaaatagctccgctagtaatgcatcgggcgccgccgcccccacgctgccggcccaccccagtaccctaacccacccacagagacggatagacactctgaactcagatggatacactcctgaacctgccagaataacaagtcccgataagccaagaccaatgccaatggatacttcagtttacgagtcaccatattcagacccggaggagttaaaagacaaaaagcttttcctcaagcgcgacaatctgctgatagccgatatcgagcttggctgcggtaactttggatctgtgcggcagggggtttatagaatgcggaagaagcagatcgacgtcgccattaaggtcctcaaacagggtaccgagaaagctgacactgaagagatgatgagagaagctcagattatgcatcaactggataacccatatattgtgcgcctaatcggggtgtgccaggcagaggccttgatgctcgtcatggagatggcgggcggagggccactacataaattcctcgtgggcaagagggaagagatacccgtcagcaacgtggccgagctgcttcatcaggttagcatgggcatgaagtaccttgaggaaaagaacttcgtgcaccgagaccttgccgcacgcaacgttctgttagttaatagacactatgccaagatctctgactttggcttgtctaaagctctcggggcggacgactcctactatactgccagatcagcaggtaagtggccactgaagtggtatgcccccgagtgcataaatttccgtaagtttagctctcgatccgatgtttggagttacggagtgaccatgtgggaagccctatcatacggtcagaagccctacaagaagatgaagggccctgaggtgatggctttcattgaacaggggaagaggatggagtgccctcccgaatgtccacctgaattatacgccctgatgtccgactgttggatctataagtgggaagatcgcccagactttctgaccgtggagcaaaggatgagggcttgctattacagcttagcctccaaagtggaaggcccccccgggtcgacgcaaaaagctgaggccgcctgcgcttag

SEQ ID NO: 140898 - DNA, 1482 bp, Artificial Sequence
  Description of Artificial Sequence: Synthetic coding sequence
atgcgtctggggccacggtggaaaggcgaggccctggagcaggcaattatcagccaggcaccccaagtggaaaagttgattgcaacaaccgctcacgagcggatgccttggtatcactcaagtctcactagagaggaagcagaaaggaagctgtactcaggggctcagaccgacgggaaatttctgctgagaccacgcaaggaacaaggaacgtatgccttgtcgctcatttatggaaagactgtgtaccattatctgatctcccaggacaaggccgggaagtactgcattcctgaaggcaccaagtttgataccctgtggcaacttgtggagtaccttaaactgaaggcagatggacttatctactgcctcaaagaagcttgtcccaacagcagtgcctctaacgccagtggcgcggccgcccccactctgcccgcccatcccagcaccttaacgcatccacagaggcgcattgacactctgaattcagacggatacactccggaacctgccagaattacatctcccgataagccgcggccgatgccaatggatacatccgtgtacgagtccccatactcagatcctgaagagctgaaagataaaaagctcttcctgaaaagagataacttactcatcgctgatatcgagctgggatgtggcaactttggatccgtacggcagggcgtctatagaatgcggaaaaaacagatcgacgtcgcaattaaggtcctcaagcagggaacggaaaaggctgataccgaggagatgatgcgcgaggcacaaattatgcaccaattggacaatccctacatcgtgcgcctgattggggtgtgtcaggctgaagccctgatgctggtcatggagatggcaggcggaggtcccttacataaattcttggtaggtaaacgggaggagatacccgtgagcaatgtggccgaattgctgcaccaggtgtcaatggggatgaaatatctcgaggagaaaaatttcgtgcacagagacctggctgcgaggaacgtgctgctggtgaatcgccactatgcgaaaattagtgattttggtctcagcaaggcactcggcgcagacgatagctactataccgcccggagcgccgggaagtggcctttaaaatggtacgcgcccgaatgtatcaattttagaaaattcagctctagaagcgacgtgtggtcatacggggtgactatgtgggaagccttaagctacgggcagaaaccctacaagaagatgaagggaccagaagtgatggcctttatcgaacaggggaagcggatggagtgccctcctgaatgcccccccgagttatacgcgctaatgagtgactgctggatctacaaatgggaggaccgccccgacttcctgaccgttgagcagcgcatgcgtgcctgctattattctctggcctctaaggtagaggggccccctggaagcacccaaaaggcggaggctgcttgcgcctag

SEQ ID NO: 140899 - DNA, 939 bp, Artificial Sequence
  Description of Artificial Sequence: Synthetic coding sequence
atgcctatggacacctccgtgtatgaaagcccctattccgacccagaggagctgaaggacaagaagctttttctgaaacgagacaacctacttattgctgatatcgaactgggctgcggcaacttcggaagtgtgcgccaaggggtatatagaatgcggaagaaacagattgatgtggcgatcaaggtgctgaagcagggtacggagaaagctgataccgaggagatgatgcgggaggcccagataatgcaccagcttgataacccatacattgttcgactgatcggagtatgtcaggcagaagcccttatgctggtcatggagatggctggaggaggtcccctgcataagtttctggtcggcaaacgggaagaaattccggttagcaatgtagccgaattactgcaccaagtgagtatgggtatgaagtatttggaggaaaagaactttgtgcacagggatctggccgcccgcaacgtcctgctggtcaataggcattacgctaaaatttccgacttcggattgagtaaagccctcggagcagacgactcctactataccgccaggagcgctggcaaatggccactaaagtggtatgctccagagtgcataaacttccggaaattttcctcgaggagtgatgtgtggtcttacggtgtgaccatgtgggaggctctctcctacggacaaaagccatataagaagatgaagggcccagaggtgatggcattcatagaacaagggaagcgtatggagtgcccaccagaatgtcctccagaattgtacgcgctcatgtcagattgttggatctataaatgggaagaccgaccagacttcctgacggtggaacagcggatgcgcgcttgctattacagtttggctagcaaggtggaggggccgcctggtagcacccagaaggctgaagctgcttgtgcctag

SEQ ID NO: 140900 - DNA, 1344 bp, Artificial Sequence
  Description of Artificial Sequence: Synthetic coding sequence
atgttactggacgccggtcctcagtatcctgcgattggagttaccacgtttggcgcctctcgacaccactctgccggcgatgttgccgagcgagatgtcggccttggaattaatccatttgcagacgggatgggggcctttaaattgaatccctcttcacatgagttggcctctgcgggacagaccgcattcacatctcaggctccaggctacgccgctgcggcagccctcggccatcatcaccaccctggccatgtgggttcttacagctccgctgcctttaatagtacgagggatttcctttttcgcaaccgggggttcggagacgccgcggctgcagccagcgcccagcattctctctttgcagctagcgctggtggctttggtggcccacacggccatacggatgccgccgggcacctgctcttcccaggcctgcatgagcaagcggccggacatgcatcccctaacgttgtcaatggccagatgagattggggttctctggtgacatgtatccaaggcctgaacagtatgggcaggtcacttctcccagatccgaacattatgctgcgccacagctccatggctatggcccaatgaacgttaacatggctgctcatcatggtgcaggagccttcttcagatacatgcgccagcccataaagcaggagctaatctgcaagtggatcgagccagaacagctggctaacccaaaaaagtcatgtaacaagaccttctccacaatgcacgaactggtgacccacgttaccgtggaacatgtgggcggccccgagcagagcaatcatatctgtttctgggaggaatgccctagggaaggcaagcctttcaaggccaagtataagcttgttaatcatataagggtgcacactggcgagaagccattcccctgcccttttccaggttgcggcaaagtgtttgcacgcagcgaaaatctgaaaatccacaagagaactcataccggagagaagcccttcaaatgcgaattcgaaggatgtgataggcgctttgctaattcatctgatcggaaaaagcacatgcacgttcacacgtccgacaagccgtacctgtgtaagatgtgcgacaagtcgtatacgcatccatctagtctcagaaaacacatgaaagtacatgagtcctcctcacaggggagccagccctcgcccgcggccagctccggatacgagagcagcacaccccccactatcgtgagccccagtaccgataacccaaccacctcttcgctgagcccctcttcctccgctgtacaccataccgcgggtcactccgcgctgtccagtaatttcaacgagtggtacgtgtag

SEQ ID NO: 140901 - DNA, 1599 bp, Artificial Sequence
  Description of Artificial Sequence: Synthetic coding sequence
atgctgttagacgctgggcctcaatttccggcgatcggcgtagggagcttcgcgcgtcaccaccaccactccgcagctgccgcggcagccgccgcagcagagatgcaagatagagaattatcactggctgcagcacagaatgggtttgtggactctgcggctgcacacatgggggcttttaaactgaacccaggtgcacatgaactgtcccctgggcaatcttctgccttcacatctcaggggcccggtgcctatcccggcagcgccgctgcggccgcagctgcagcagccctgggcccacacgctgcacacgttgggagctactccggccccccattcaactccacgcgcgatttcctgttccgatctcgaggcttcggcgattcagcccccgggggaggtcagcatgggctcttcggaccaggcgccggtggacttcaccacgctcacagcgacgcacagggccatttactgtttcctgggctcccagaacagcatgggccccacggcagccagaacgtgctgaatggccaaatgagactgggcttgcccggggaagtctttggtcggtccgagcagtacaggcaggtggcttcgccccggaccgacccctatagtgcagcacagcttcacaaccagtacggtcccatgaacatgaacatgggaatgaatatggccgccgcggccgcacaccaccaccaccaccatcaccaccatcccggggccttttttcgctatatgaggcagcagtgcatcaagcaggaactgatttgcaagtggatcgatcctgagcagctctccaatcctaagaaaagctgtaacaagaccttcagcaccatgcacgagttagtcacacacgtgtctgtcgagcatgttggagggcctgagcaaagtaaccacgtctgcttttgggaagaatgccctcgggaaggaaagccctttaaagccaaatacaagctggtgaaccacatccgggtgcacaccggcgaaaaaccgttcccttgtccttttccgggatgtggtaaggttttcgcccggtctgaaaacctcaaaatccacaaaagaacacatacaggcgaaaagcctttccagtgtgaattcgagggctgtgacagacgtttcgctaattcctctgatagaaaaaaacacatgcatgtccatacaagcgataagccctatctgtgtaagatgtgcgataagtcctacactcatccatcatccctgcgcaagcacatgaaggtgcatgagtcctccccgcaagggtccgagtcttcaccagcagcctcaagcggctatgagagcagcactcctccaggcctggtctccccatccgccgagccccaatcgtcgtcaaatctttctcctgcggctgccgctgccgctgccgccgccgcggccgccgcagccgcggtgtcggcagtccaccgaggaggcggctccggatctggcggggccggcggcggctccggcggcgggtcaggaagcggtggtgggggcggcggagcgggaggcggaggaggagggtcctccggcggtgggagtggcaccgcaggcggtcactcgggattatcctcaaacttcaatgagtggtacgtttag

SEQ ID NO: 140902 - DNA, 489 bp, Artificial Sequence
  Description of Artificial Sequence: Synthetic coding sequence
ccgccccctcccccgcccccgcctgcaccacccccccctccaccactgaacccaaaaaaaagttgcaacaaaaccttcagcaccatgcatgagctggttacacacgtgtccgtggaacacgtggggggcccagagcagagcaatcacgtatgtttttgggaagagtgtccgcgtgagggcaaaccttttaaggccaaatacaagcttgttaatcacatcagagtccacaccggagagaaaccatttccttgcccattccctggatgcggcaaagtcttcgcccgctcagagaatttgaagatccacaagcggactcatacaggcgaaaaacccttccagtgtgagtttgaggggtgcgatcgcagatttgctaactctagcgacagaaaaaaacatatgcatgttcatacaagcgacaaaccgtatctgtgtaagatgtgcgataagagttatacacatcccagctcattgagaaaacatatgaaatag

SEQ ID NO: 140903 - DNA, 783 bp, Artificial Sequence
  Description of Artificial Sequence: Synthetic coding sequence
atgttactggacgccgggccacaatttccagcgatcggggtgggcagttttgctcggcatcaccaccacagcgccgctgcagctgccgctgccgctgccgagatgcaagatcgggaactctcccttgcagcagctcaaaacggcttcgtggactctgctgctgcccatatgggcgcgttcaagctgaacccaggggcacatgagctgagtccagggcagtcttctgctttcactagtcaaggaccaggggcctatcctggtagcgctgctgctgcggcagccgctgctgcactcgggccacacgccgcacatgtcggatcctactccggcccaccgttcaatagcacgcgagatttcctgttccggtcccgaggcttcggggatagcgcccccggagggggacagcacggactgttcggacctggcgcaggcggcctgcatcacgcgcatagcgatgcacaaggccacctgttgttccctggattgcccgagcaacacggtccacatgggtcacaaaacgttttgaacggtcagatgcgccttggattgcccggggaggtgtttggaaggtccgagcaatacaggcaagtcgcaagcccccgtaccgacccatattctgcagcacagctgcataaccagtatggccctatgaacatgaatatggggatgaacatggcggcagcagccgcccaccaccatcaccaccaccatcaccctgtcccctcactactcaccaattgcgtacatagcggtctcctactgtctcctccacggtggttttag

SEQ ID NO: 140904 - DNA, 1404 bp, Artificial Sequence
  Description of Artificial Sequence: Synthetic coding sequence
atgaccatgctcttggacggtgggccgcagtttcctggcctgggagtgggcagttttggggcaccaaggcatcatgagatgcctaatcgagaaccggcaggcatgggtctgaaccctttcggagatagcacccacgcagccgctgcagcggccgccgcagcggcctttaaactgtctccggccgccgcccacgatctgtcttccggacagagtagtgccttcacaccccagggatcgggttacgcgaatgccctcgggcaccatcatcatcaccatcaccaccaccatcacacatcccaggttccatcatacggcggggccgcatccgctgccttcaattctacccgggaatttttattcagacagcggtcttctggactgtccgaagctgccagcgggggaggccagcacggattattcgccggcagtgcaagtagcctgcacgcccctgcaggcattccagaacccccttcctatctcctttttcccggtctgcatgaacagggagcgggacacccaagtcctaccggccacgtggataacaatcaggttcacctgggcctgagaggggagctattcggccgagccgatccatacaggcccgtcgccagtccacggaccgacccttatgccgcaggagcccagtttccgaactattcccccatgaacatgaacatgggcgtaaatgtggcagcccatcatggacccggagcattctttcggtacatgcgtcaaccaattaagcaagaactttcctgcaagtggatcgacgaagcccagctgtcgcgccccaaaaaaagctgcgatagaaccttttcaacaatgcatgagctcgtgacacacgtgaccatggaacacgtgggaggacccgagcaaaataaccacgtttgttattgggaggaatgcccgcgcgagggcaagtcgtttaaagcgaaatacaagctggtgaaccatatccgagtgcacacaggagagaaaccattcccttgcccgttcccaggatgcgggaaaatctttgcccggtcagaaaatcttaaaattcacaaaagaacacatacgggcgagaaaccctttaagtgtgaatttgaaggctgtgaccggcgttttgccaactcctctgaccgcaaaaaacatatgcacgttcacacttctgataaaccttacatctgtaaggtgtgtgacaagtcatacacccatccctcctctctcaggaagcatatgaaggtccacgagtcacagggctctgactcaagccccgcagcttcatctgggtacgaatcctccacacctcccgcaatagcatccgctaactcaaaggatacaacaaagactcctagtgctgtccagacttctactagccacaatcccggtctcccacctaacttcaatgaatggtacgtctag

SEQ ID NO: 140905 - DNA, 1374 bp, Artificial Sequence
  Description of Artificial Sequence: Synthetic coding sequence
atgaccatgttactcgacggcgggcctcagttccccggactgggtgtgggttcatttggcgcaccacgacaccacgaaatgcccaaccgggaaccagccgggatgggattgaatccgtttggcgactctactcatgcggcagcagcagcagctgctgctgcagcttttaaactgagtccggccgccgctcacgatctgagtagtggccagtccagtgcgttcacaccccaagggtccggctacgccaatgcactgggtcatcaccatcaccaccaccaccatcaccaccacacatcacaagtgccgagctatggtggcgccgcttccgcagcctttaatagcactagggagttccttttcagacagagatcttccggattgagcgaggcagccagcggcggcggccaacacggcttattcgccgggtcagcatcctcgctgcatgccccagccggtattccggagccacctagttacttactgttcccgggcctacacgagcagggggctgggcaccccagccccacagggcatgtagataacaatcaagtgcacctgggtctaaggggggaactatttgggagagcggacccatatagacccgtagctagcccgaggaccgatccctacgcagccggtgcccaatttccgaattactctccaatgaacatgaacatgggggtgaatgtcgcggcccaccacggacctggagctttctttaggtatatgcggcagcctataaaacaggagctgtcatgcaagtggattgatgaagctcagctgagtagaccaaaaaagtcctgcgataggaccttcagtaccatgcatgagctagtgactcatgtcaccatggagcacgtgggtggcccagaacaaaacaaccatgtgtgttactgggaggagtgtccccgcgagggcaagtcctttaaagccaaatataaactcgtaaatcacatccgggtccatactggggagaaaccctttccatgtccctttcctggctgcggtaagatatttgctagaagcgagaacctcaagatccataagcgcactcatacaggcgagaagcctttcaaatgcgagtttgaggggtgcgaccgcaggttcgcgaacagctccgatcggaaaaaacacatgcacgtgcacacatcagataagccttacatttgtaaagtgtgcgacaaaagctacacacatccaagcagcttgcgcaaacacatgaaatgttgtcctgcatggtatcctggccagagcctaattcctgatgaggaactcgacacagatgttggcatgcagcaacccgctctgcacaacactacttatccaaaatgtcgcgtcaatgccgaacctaccgtgcaagaaatgatatattag

SEQ ID NO: 140906 - DNA, 1005 bp, Artificial Sequence
  Description of Artificial Sequence: Synthetic coding sequence
atgcgttataagactagtctagttatgaggaagaggctgcggctgtatcgcaacacgctgaaggagtccagctcgtcctctggacaccacggcccccagttaactgcagccagctccccctctgttttccctgggctgcatgaggaacctccccaggcaagtccgagccggcctttgaatgggcttctgaggctgggcctcccgggcgatatgtatgctcggcccgaaccatttccaccggggccagccgctcggtcggatgccttagcagccgccgcagcgctccatggatatggcggaatgaacctaaccgtaaacttggccgcaccacacggaccaggtgcattttttagatacatgcggcagccaatcaagcaagagctgatatgtaaatggctggcagccgacggcacggctacaccgtctctttgctccaagacattctctaccatgcacgagttggttactcatgtgacagtcgagcatgtcggtggacccgaacaggcaaaccatatctgtttttgggaggaatgcccaaggcagggtaaacctttcaaggcaaagtataaattggtgaaccatatacgagtgcacacgggcgaaaagccatttccctgtcccttccctggttgcggtaaagtgttcgcacgcagcgagaatttgaaaatccacaaacgcacacatactggcgagaagccatttcggtgcgagttcgaagggtgtgaacgacgttttgccaatagctccgatagaaaaaagcatagccatgtccacacgtctgacaaaccgtatacttgcaaggttcggggctgtgacaaatgctatacccaccctagcagcctgcgcaaacatatgaaggttcacggcaggagccctccgccttcttccggatatgatagcgctacccctagtgcactggtgagtccctcttccgactgtgggcataaatctcaagttgcctccagtgcagctgtagcagccaggacggcggatttgtcagaatag

SEQ ID NO: 140907 - DNA, 1119 bp, Artificial Sequence
  Description of Artificial Sequence: Synthetic coding sequence
atgaacggtccctgtcagtctctgagaaaggcagaggggctgttggaaggttgcacttcagcagtaaccgtgtttaggaagctacctctggattcaaaagcgcagtcacagaagatgcggtataagacatccctggtcatgaggaaaaggctgcggctgtatcggaacacgctgaaagaaagtagttcatcttccgggcatcatggtccccagttgaccgcggccagcagcccaagcgtgttcccaggcctacatgaggagccaccgcaagcaagtcctagtagacctctcaatgggttgctgaggttgggcctccccggagacatgtacgcccggcccgagccatttcctcctggaccagccgcacgtagcgatgctttagcggccgccgctgcacttcacggctatggaggcatgaatctgacagttaatctggccgcgcctcatggaccaggtgctttctttcgatatatgcgccagcccatcaagcaggaactcatatgcaagtggctggctgccgatggcaccgcaacgccttcattgtgttccaagacatttagcaccatgcatgaacttgtaactcacgttactgtggagcacgtgggcggccccgagcaggcgaaccacatctgtttctgggaagagtgtccccggcagggtaaaccattcaaagccaagtataaacttgttaaccacatcagggtgcatacaggagagaagccgttcccttgtccctttcccgggtgcggaaaagtcttcgcaaggtctgagaatttaaagatccacaaaaggacccacactggggagaagcctttcaggtgtgagtttgagggctgcgagcgcagatttgccaattccagcgacagaaagaaacacagccacgttcacacgtccgataagccatacacatgcaaggttagagggtgcgacaagtgttacacccaccccagctccctgcggaaacacatgaaggtccacggacgttctccccccccatcctctggctatgattcagcaaccccaagcgccctagtaagtcccagtagtgactgcggacataagagccaggtggcgtcaagtgctgctgtcgccgcacggactgccgatttaagtgaatag

SEQ ID NO: 140908 - DNA, 690 bp, Artificial Sequence
  Description of Artificial Sequence: Synthetic coding sequence
atgagatacaaaacaagcctagttatgcggaaacgattgagactctatagaaatacactcaaagaatcatcatccagcagcgggcatcacggacctcagctgactgcagcatctagcccatccgttttccctggtctgcacgaagagcctcctcaggcctctccctcaagacccctcaacggacttctacggctgggcctccccggggatatgtacgccagaccggagccctttcctcccggccccgccgctaggtccgacgctctcgctgctgccgcagccctgcatggttatggggggatgaatctcaccgtcaatctcgcagcccctcatgggcccggagcttttttcagatacatgcgccaacccataaaacaggagttaatctgcaagtggctggccgccgatggcacggctaccccctccctctgcagcaaaacctttagtacgatgcacgaactggtcactcacgtaactgtagaacatgtcggggggccggaacaagccaatcatatttgtttttgggaagagtgtccgcgacagggcaaacccttcaaagcaaagtataaactggtgaaccacatacgcgtgcacactggcgaaaagcctttcccttgcccattccccgggtgtggaaaggtgttcgcccggagtgagaatttgaaaatccacaaaagaactcacacatag

SEQ ID NO: 140909 - DNA, 207 bp, Artificial Sequence
  Description of Artificial Sequence: Synthetic coding sequence
atgagatacaagacatcactcgtgatgagaaagcgtttgcggctgtacagaaacaccctcaaagagtccagctcaagctcgggacaccatggcccacaattgaccgcagcctcaagcccgagcgtgtttccgggtcttcacgaggagcctccccaggcttcaccatctcggcccctgaatggcctgttaaggctaggcttgccgtag

SEQ ID NO: 140910 - DNA, 1005 bp, Artificial Sequence
  Description of Artificial Sequence: Synthetic coding sequence
atgagatacaagacatccctggtcatgagaaaaagattgaggctgtaccgcaacacccttaaagagtcttcaagttcatcaggccatcacggccctcagctgactgcagcatcctcccctagtgtgtttcccgggttgcacgaggagccaccccaagcatcacccagccggcctctcaacgggctcctgcgcctgggattgcctggagacatgtacgcccgccctgagcctttccctccaggccccgcagctcggtctgacgccttagccgctgccgccgctcttcacggctacgggggtatgaacctcaccgttaacctcgccgccccccacgggcctggcgcgttctttcggtacatgcgacaacctatcaagcaggaacttatctgtaagtggctcgccgcagatgggacggccacaccttccttgtgctccaagacattcagtaccatgcacgagcttgtcacccatgtgaccgtggagcacgtgggcggccctgagcaagccaaccacatctgtttttgggaagagtgtccccgccagggtaagccctttaaagctaaatataaattggtgaatcatattagagtacacacaggggagaaaccatttccctgccccttccctggatgtggtaaggtgtttgcacgcagcgaaaacctcaagattcataaaaggacacacaccggcgaaaagcctttccgatgtgaatttgagggatgcgagagacgctttgcaaactcatcggacagaaaaaaacattcccatgtgcatacgtcagataagccttatacatgcaaagtccgggggtgtgacaagtgctacactcatccatcctctctgcgcaagcacatgaaggtgcatgggcgcagccctccgcctagttcgggctacgactccgctacaccctccgctctggtttctcctagtagcgattgtggacacaagagccaggtggcaagttcggctgctgtggccgcacgaactgctgacctgtctgagtag

SEQ ID NO: 140911 - DNA, 1005 bp, Artificial Sequence
  Description of Artificial Sequence: Synthetic coding sequence
atgaggtacaaaacaagcttggttatgcgaaagcgtctccggctgtatagaaacactctgaaagagagctcgagttccagcggacatcatgggcctcagctcacagccgctagttctcccagcgtatttccaggtttacacgaggagcctccgcaggcttcaccttctaggccgctcaatgggctccttaggctcgggctgcctggagacatgtatgccaggccagagcctttcccaccgggcccggcagctagatccgatgctctggccgctgccgctgcgctgcatggatacggtggcatgaacttgactgtgaacctcgccgcaccgcacggccctggtgcgtttttcagatacatgagacagcctattaagcaggaactgatctgtaagtggcttgccgccgacggaaccgccacgccctccctctgttctaaaactttttcaactatgcatgagttggtgacgcatgtgaccgttgaacatgtgggaggcccagaacaggcaaaccatatctgtttttgggaagagtgtcctagacagggtaagccctttaaagcaaagtataagctcgtcaaccatattcgggtgcatacaggagaaaagccattcccatgtccgtttcccggatgcggcaaggtgtttgcacgcagcgagaatctaaagatccataaacgtacacacacgggggagaaaccgtttagatgtgagtttgagggatgtgagaggcggttcgcaaattcatcagaccggaagaagcactctcacgtgcacacatccgacaaaccatatacctgtaaagtgcgcggatgcgataagtgttacacacatccgagttcacttagaaaacatatgaaggtgcacggaaggtctcctccgccatccagtgggtatgacagcgccacgcccagcgccctcgtgtccccctcctcggattgtggacataagagtcaggtcgcctcatccgccgcggtcgccgcccgcacagcagatctcagcgaatag

SEQ ID NO: 140912 - DNA, 234 bp, Artificial Sequence
  Description of Artificial Sequence: Synthetic coding sequence
atgaggtataagaccagcttggtgatgcgcaagcggcttaggctctaccgtaatactctcaaggagagttccagctcaagcggacatcatgggcctcagcttactgccgccagttctccttccgtcttccctggcttgcacgaagaacctcctcaggcatccccaagtcgccccctgaatggcttactcaggttaggcctgccaggagacatgtacgcacgcccagagccctag

SEQ ID NO: 140913 - DNA, 1155 bp, Artificial Sequence
  Description of Artificial Sequence: Synthetic coding sequence
atgccacctttttgcagaaacgctaaattagggctgttgagcttcctaatctgcgcaggccggtctcttcttcctttaggcaaaaacgcattctggttggaacggatcgaaaataacaataccctatgggagaaagcccaaagccagaagatgcggtataaaacatccctcgtgatgaggaagcgactgcgcctgtacaggaacaccttgaaggaatccagtagcagcagcggtcaccacgggccgcagctcactgccgcatcatctccgagtgtctttccaggactgcatgaggagccacctcaggcctccccttcccgacctctaaatgggctgttaagacttggcctcccaggcgatatgtacgcccggcctgagcctttcccaccgggccccgccgcccggtcagacgcactggctgctgcggcagccctgcacggctacggagggatgaacctgactgtgaacctagcagctcctcatggtcccggggcctttttccggtatatgcggcagcccattaaacaggagctcatctgcaaatggcttgcagcggacgggacagccacgccctcactgtgttcaaagacattctccaccatgcacgagctggtgacacatgtaacagtggaacacgttggaggcccagaacaagccaatcacatttgcttctgggaagagtgcccccgtcaggggaagccattcaaggcaaagtataaactggtaaatcacataagagtgcacactggagagaagcccttcccatgccctttccctggctgcgggaaggtgttcgccaggtcagagaacttgaaaatacataaacgcacccacaccggtgagaagccattcagatgcgagtttgagggctgtgaacgtaggtttgcgaattcaagcgatcggaaaaaacatagccacgtccacacgagtgacaaaccttatacttgcaaagtcagggggtgcgataagtgttatacacacccgtcctccctgcgcaagcatatgaaagttcacggccgtagtccaccaccctcaagtgggtacgattctgccacaccctctgccttggtctccccgtcttcagattgtggacacaagagccaggtggccagcagcgcagctgtagctgcaagaactgcagacctgtccgaatag

SEQ ID NO: 140914 - DNA, 684 bp, Artificial Sequence
  Description of Artificial Sequence: Synthetic coding sequence
atgggaggcaagcaatcaaccgccgcaagatctagaggcccattcccaggcgtgagcaccgacgacagtgctgttcctccccctggcggagcaccgcatttcggacattacagaactggaggaggcgccatggggcttcggtctagatctgttagttcggtcgctgggatgggaatggacccgagcaccgctggtggggtgccttttggcctgtatacacctgcatccagaggtaccggggactccgagcgagcccccggcgggggaggtagcgcttctgattctacgtacgctcacggcaatggctaccaagaaaccggaggcggacaccacagagacggtatgctctacctgggttccagggctagcctagcagacgccctgccactgcacattgcccctcgctggttttccagccacagtggcttcaaatgtcctatctgtagcaagtccgtggcttcagatgaaatggaaatgcacttcatcatgtgtctgtctaaaccacgactgagctacaacgatgacgttctcactaaggatgctggagagtgtgttatttgtttagaagagctgctgcaaggagatacaattgctaggctgccatgcctttgtatttaccacaagtcttgtattgactcatggtttgaggtgaaccggagttgtcccgagcatcctgcagattag

SEQ ID NO: 140915 - DNA, 543 bp, Artificial Sequence
  Description of Artificial Sequence: Synthetic coding sequence
cagagaggggttccggcagccggcactcccagctcccctcgactgttagtgtcaagatcactcggcggcgcggttggatcagtggcttctggcgcccgggcggcccagtcgcctttctccatccctaacagctcgtctgggccctacggatcccaggatagcgtgcattcttccccagaggatggtgggggaggtcgggatagacctgtgggaggatcaccaggtggccctcgtttggtcatcggcagcctgcctgcacatcttagtccacacatgtttggaggctttaagtgtcccgtgtgctctaaatttgtcagctctgatgagatggatctgcacttggttatgtgcctgaccaagccgaggatcacctacaatgaggatgtgttatcaaaagacgcaggcgaatgtgccatatgtctagaagagttgcagcagggggataccatcgcacgacttccatgtctttgcatataccacaaagggtgcatcgatgagtggttcgaggtgaatagatcttgccctgagcacccttcagactag

SEQ ID NO: 140916 - DNA, 729 bp, Artificial Sequence
  Description of Artificial Sequence: Synthetic coding sequence
atgggagcaaagcagagtggacctgcagcagccaatggccgcaccagggcctatagcgggagcgacctgccgtcatcatcctccggaggagccaatgggacggccggcggcggagggggggcccgtgccgcagcggccgggcggttccctgcccaagtaccatccgcccaccagccttcggccagcggtggcgctgcggctgctgcggccgcacccgcagccccggctgcccccagatcaaggtcactaggcggcgccgtcgggagcgttgctagcggggccagagcagctcagtcgcccttctctatccctaactcctcctcagggccctacggatcacaagacagcgtgcacagctccccggaggatgggggtggcggccgtgacaggcccgtcggaggctctccaggcggaccaagactcgtgataggctcactgccagcccatcttagtcctcacatgttcggaggctttaagtgcccggtgtgctcaaagtttgtcagctcagacgagatggatctacacctcgtgatgtgtctgactaaacccagaattacctataatgaggacgtcctgtcaaaggacgccggggagtgtgccatttgcttggaagagcttcaacagggggacaccatcgcacgactgccatgtctatgtatctaccataaggggtgcatcgacgagtggtttgaggtgaatcgcagctgcccagaacatccctctgattag

SEQ ID NO: 140917 - DNA, 2511 bp, Artificial Sequence
  Description of Artificial Sequence: Synthetic coding sequence
atgcatcccctagggttgtgcaacaacaatgacgaagaagatctctatgaatatggctgggtaggtgtcgtgaagctggagcagcccgagttggacccaaagccctgtctaaccgtcctcgggaaggctaaacgcgccgtccagagaggggcaaccgccgtcatcttcgacgtatccgaaaatccggaagctatcgatcagctgaaccagggcagcgaagaccctctcaaaagaccagttgtttacgtgaagggcgctgatgcaataaagctgatgaacatcgtcaacaagcaaaaagtagcgagggctagaatccagcatcgccccccccgtcaaccgacagaatattttgacatggggatcttcctggccttcttcgtggtcgtgtcactggtgtgcctgatccttctggtgaagattaaattaaagcagcgacgtagccagaattcaatgaataggctcgccgtgcaggcactggaaaagatggagactcgaaagttcaattccaagagcaaaggaagacgggaaggatcctgcggcgctctggacaccttatcatcctcttccactagcgactgtgctatatgtctggagaagtatatcgatggcgaagagctacgcgtgatcccatgcacccacaggttccacaggaaatgtgtcgacccatggttgctgcagcatcacacctgtcctcattgcagacataatataatcgagcaaaagggtaacccatccgccgtgtgtgttgagaccagcaatctcagcaggggtcgccagcaaagagtgactcttcctgtgcattaccctggcagagtccaccgcaccaacgcaattcccgcttatcctacaagaacatccatggactctcatggcaatccagttacattgttgacaatggataggcatggcgagcaatctctgtactctccacagacaccggcctacatccgaagttacccacccctgcacttagaccacagcctcgccgcgcacaggtgtggattagaacacagggcttattctccagcccacccttttcggaggccaaaactgagcggcaggtcctttagcaaagcagcctgtttcagccagtacgaaaccatgtatcagcactactatttccagggactgtcctaccctgaacaggaaggccagagcccacctagtctggcgccacgggggcccgccagggcatttcccccctctggctccggcagcctgctcttccccacggtcgtccatgtggctccacccagtcacctggagtcgggtagtacatcttctttcagctgttaccacggacatcgctctgtgtgtagtggctatttagccgattgtccaggatctgactcctcgagttcttcctcgtcaggacagtgtcactgcagttcatcagactccgtcgtcgactgcaccgaggtttccaaccagggggtttatggtagctgttctacttttaggagttcactcagttctgattacgacccgttcatttacaggagcagaagtccatgcagagcatcagaagctggaggcagtgggagctccggcaggggacctgctttgtgttttgaaggctctccgccacccgaggagctcccggctgtgcattcgcacggggccgggagaggtgagccatggcctggccctgccagtcccagcggcgaccaggtgtctacttgttcactagagatgaactatagcagcaatagttcccttgaacacaggggccctaattcctcgacgtctgaggtcggcttagaggcatctcccggtgccgcacctgatctgagacgcacttggaaaggaggacacgagctgcctagctgtgcttgctgctgtgagccccagccgtcccccgccggaccatccgcaggggctgcaggaagcagcacactgtttctagggccccacctgtatgagggctccggcccagcaggaggcgaacctcaatcaggcagttctcaggggttgtatggtctgcacccagaccatctcccaagaaccgatggggtgaagtatgagggcctgccctgctgcttttacgaagaaaaacaagtagccaggggtggggggggcggctctggatgttacacggaagactattcagtctccgtgcagtacactctgactgaggagccccctcccgggtgctatcccggcgcgcgcgatttaagccagcgcattcctatcattccggaggacgtggactgcgatctgggcctgccctcagactgtcagggaacgcatagtctaggttcctgggggggaacgaggggaccagacactcctaggcctcatagaggattgggcgcgaccagggaggaagagcgtgctctttgttgccaggccagagccttgctgcgccccggttgcccacctgaagaggcaggggctgtacgtgccaactttccaagtgccttgcaagacactcaagaatccagcactaccgctaccgaagccgcaggaccgcgttctcactctgctgactcaagttcacccggcgcatag

SEQ ID NO: 140918 - DNA, 2511 bp, Artificial Sequence
  Description of Artificial Sequence: Synthetic coding sequence
atgcacccactgggcctgtgcaacaataacgatgaagaggacctctacgaatatggatgggtcggcgttgtaaagttggagcagcccgagttggacccaaaaccgtgccttaccgttctgggaaaggctaagagagccgtgcaacgcggtgccaccgcagtgatctttgacgtgagcgagaaccctgaagctattgaccagctgaatcaaggttcagaggatcccctcaagcgacccgtggtttacgtcaagggagctgacgcaattaagctgatgaatatagtgaacaagcaaaaagtggcacgggcgagaatccaacaccgtcctcccaggcaacctactgaatactttgacatgggcatcttcctcgccttctttgtggtggtcagtttggtatgtcttattctgctggtcaagatcaagctgaagcaacggaggtcacagaactccatgaatcgcctggcagtacaagctcttgaaaaaatggaaacccgcaagttcaactccaaatcaaaggggagaagagaggggtcgtgtggggctttggataccttaagcagctcaagtacaagcgattgcgccatatgtttggaaaagtacattgacggggaggagctgagggtgattccttgtacccatcgcttccatcgcaagtgcgtggacccgtggttgctgcaacatcacacatgcccccactgccggcataatattattgagcagaaggggaatcctagtgctgtatgcgtagagaccagtaatctgagtcgcgggagacaacagagagtgactctgcccgtccattatcctggccgggttcacagaacaaatgctatccccgcatacccaacacgcacatctatggattctcatggaaatcctgttacactcttaaccatggatcgccatggcgagcagtcactgtacagcccacagacccctgcttatatcagaagttaccctcccctgcatctggaccattcactggccgcacaccggtgcggtctggaacatcgagcttacagcccggcccaccctttcaggaggcccaagctgtccggcagatcgttcagcaaggccgcatgcttcagtcagtatgaaactatgtaccagcactattactttcagggtctctcctacccggagcaggagggccagtccccccccagtctggcaccccgcggtccggcacgcgctttccccccttccgggtcaggaagtctgcttttccctaccgtcgtccatgttgcacccccttcacatctggagagcgggagcactagctccttctcatgctatcatgggcatcggagcgtctgtagcggctacctcgccgactgcccaggatcggatagcagttcttcttcatcttcaggtcaatgccattgttcctcaagcgacagtgtggtggactgtaccgaagtttctaaccagggcgtgtacggcagctgttcaacattccgtagctcattgagctcagactacgatccctttatctataggtccaggtctccttgtcgggcctccgaagccggcggttcaggtagtagtgggcgggggcccgctttgtgttttgagggttcgcccccgccagaggagctgcccgccgtccattctcacggggcaggccgtggtgagccctggccgggtcccgcatccccctccggtgaccaggttagcacctgcagtcttgagatgaattatagctctaacagttccctggaacacagagggcccaacagctccacatctgaggtcggattggaggccagcccaggggccgctccggacctacgtcggacatggaaaggtggacacgagctgcccagctgtgcgtgttgttgtgaaccacagccgtcgcccgctggtcccagcgcgggggccgccggttcttcaacactcttcctgggcccgcatctgtatgaaggatcaggtcctgcagggggggaaccccagagcggctcctctcaggggttgtatggactacaccctgaccacctgccacggaccgatggtgttaagtacgagggtttgccatgttgtttttacgaagagaaacaggttgcccggggaggaggcggcggatccgggtgctatacagaggactattctgtttctgtgcagtatactctcacggaggaaccaccacccggctgttaccctggagctcgagatttaagccagcgcatacctatcatcccggaggatgtggactgcgacttgggcctgccttctgattgccagggcacacacagtctgggcagctggggcggcactcggggaccggatacaccccgccctcataggggccttggagctacccgggaagaagaacgcgctctgtgttgtcaggctcgcgcccttttacgcccaggctgcccacctgaggaggcgggtgccgtccgagccaattttccgtcggctttacaggatacgcaggaatcatccaccaccgctaccgaggccgctggccccagaagccactctgctgactcctcctcccctggcgcgtag

SEQ ID NO: 140919 - DNA, 2511 bp, Artificial Sequence
  Description of Artificial Sequence: Synthetic coding sequence
atgcatcccctgggtctctgtaataacaatgatgaggaggacctgtatgagtacggttgggttggcgtcgtcaagctggaacagcctgaattggatcccaaaccatgcctcacagtgctcggtaaggccaagagagccgttcagagaggagcaacagctgtcatcttcgacgtaagcgaaaaccctgaagcaatagatcagttaaatcaggggagcgaggacccactaaaacggcccgtggtttatgtcaaaggcgctgacgccattaagcttatgaatatcgtgaacaaacagaaggtagcgcgggctcggattcagcacaggccacctcggcagcctaccgagtacttcgatatgggcatttttctcgccttcttcgttgtcgtgtcactcgtgtgtctcattctgctggtaaaaataaaactcaaacagcgtaggtcccagaactcgatgaatcgcctggccgtacaagcactggaaaaaatggagactaggaaatttaattcaaagagcaagggcagaagagagggctcttgtggagcacttgatacactgtcaagctcttcaacttctgattgtgctatttgtctcgaaaaatacatcgacggggaggagctgcgggtgattccttgcacacaccgatttcacagaaagtgcgtggacccttggctactccagcaccatacttgtcctcattgtcggcacaatattatcgagcagaaggggaacccatctgctgtgtgtgtggagactagcaacttgagccgtggacgtcagcagagggtaaccctgcccgtgcattacccagggagggtgcaccgaaccaacgcgatcccagcttatcccacgcgcacctccatggactcacatggaaatccagtgacgcttttgactatggaccgacacggcgagcaaagtctgtattcccctcagacaccagcttatattaggtcctaccctcccctgcacctggatcacagcttagccgcgcatcgctgcggcctggaacatagggcgtacagccccgcacatccttttcgacgccctaagctgtcaggcaggtccttttcaaaggctgcgtgtttcagccaatatgagacgatgtatcagcactattacttccagggacttagttatccagagcaagaggggcaatctcctccatcgctcgcacccaggggtccggcccgagcattcccccctagtgggtctggctctcttctattccctaccgtcgtccacgtagcacctccatctcatctggagagtggaagtacttccagtttcagctgctaccatggccaccgaagtgtctgctccggttatttggccgactgtcctggtagcgactccagcagtagctcctcctctggccagtgtcattgctcctccagtgactccgtggtggattgtaccgaggtgtcaaaccagggcgtgtacggttcctgtagcaccttccgatcatccttgagctcagactatgacccctttatttacaggtcccgaagcccgtgccgagcgtccgaagccggaggcagcggcagtagtggccgggggcccgcattatgctttgaggggagtccacctcccgaagaacttccagcagttcactcacatggcgcaggaagaggtgaaccctggccgggccccgcatcgccctccggcgatcaggtgtctacatgctccctcgagatgaattacagtagtaacagcagtctggagcacagaggccctaactcctcaactagcgaagtgggattagaagctagccctggcgccgcgcccgatctgcggcgaacgtggaagggagggcacgaattgccaagttgcgcctgctgttgtgagccacagccttctccagccggccctagcgcgggcgctgccggcagtagcactctgtttctggggccccatttgtacgaggggtcaggccccgcggggggcgagccccaaagtggctctagccagggcctctatggcctgcatccggatcatctgccaagaacagacggggtgaaatacgaagggctcccatgttgcttctatgaagagaagcaagttgccagaggaggcgggggaggatctggatgctacactgaggattactccgtgtctgttcaatatactcttacagaggaaccaccccccggctgctatcctggggcgcgagatttatcccagagaatccccatcatccctgaggatgttgattgcgacctcggcctgccctcagattgccaggggacccactcgctcgggagctggggcgggacgaggggccccgacacccctcgaccacaccgggggctgggcgccaccagggaggaagaacgggccctttgttgccaggcccgagctctgcttagacctgggtgtccccctgaggaggctggagcagtgcgggctaattttccctcagcgttgcaggacacacaggaaagctctacgactgccacagaagcagccgggccacggtcacactcagctgatagttcttcccctggggcgtag

SEQ ID NO: 140920 - DNA, 1932 bp, Artificial Sequence
  Description of Artificial Sequence: Synthetic coding sequence
gtgccatcagtgtggcggtccaccctaatggaacgttcctgtggatccagtccagtcttgaccggatttaccggctctgcatggactcctctgctgcagcaccatacctgccctcactgcagacacaacattattgaacagaagggaaacccctctgcggtttgtgtggaaacgtccaacttgtctcgcggccgccagcagagggtgacactgcctgttcattaccccggcagagttcaccgcaccaatgcaatcccggcatatccgacacggacttctatggactcccacgggaaccccgtaactctgctgaccatggaccgtcatggggagcagtccctgtacagcccgcaaacccctgcctacatacgctcgtacccccctctgcaccttgatcatagcttggccgcccatcggtgtggccttgagcatagggcatattcccccgctcaccctttcaggcggcctaagttatcgggtcgcagtttcagcaaagcagcctgcttcagtcagtacgagaccatgtatcagcactactacttccaaggactatcataccctgagcaggagggtcagtcgccaccttccctggctccaagagggccagctcgcgcattccctccgtccggcagtggatcactactgttcccaactgtggtccacgtggcgcccccctcacacttagaaagcgggagcacgagtagcttcagctgttaccacgggcaccggtctgtctgcagcggctacctggccgattgtcccgggagtgactcttcttcctcatccagctctggccagtgccactgcagctccagtgactccgtggtggattgcaccgaggtttcaaatcagggcgtttacgggagctgtagcacctttcggagcagcctgagctccgactatgacccattcatttataggagccggtccccatgtcgagcaagcgaggccggaggttcgggatcctcaggacggggaccggctctctgtttcgagggaagtcctcctcccgaggagcttcctgctgtgcactcgcacggggctggaagaggcgaaccatggccaggtccagcttcacctagtggcgatcaggtgtcaacttgttcactggagatgaattattcaagcaacagcagcctagaacatcgaggccctaactcttccaccagcgaggtcggactcgaggcgtcacccggcgccgcgcctgatctgagaaggacgtggaaagggggacacgaattgccatcatgcgcctgctgttgcgagccacagccctctcccgcagggccttccgccggggccgcaggatcttcaactctgttcctggggcctcacctctacgaaggctccggaccagccggtggcgaaccccaaagtggttccagccaggggctttacgggcttcatcccgaccacttaccacgtacagacggcgtgaaatatgaaggacttccctgctgcttttatgaagagaaacaggtagcccgcggcggcgggggcggctctggctgctacactgaggactattccgtgtccgttcagtatacccttactgaggaacccccgcctggctgctaccccggggcccgcgacttgagccagaggattccaatcatcccagaggacgtcgattgtgacctcggtctaccctccgactgccagggcacccattcactgggttcttggggtggaactcgaggcccagacaccccacggccacacagaggcctgggggccacaagggaggaggagagagccctctgttgtcaagcccgcgccctgctccggcccgggtgcccacctgaggaggcgggggccgtacgagccaatttcccgtccgctctacaggatacccaggagtctagcaccaccgctaccgaagctgctggccctcgttctcactccgccgattcatcttctccgggagcttag

SEQ ID NO: 140921 - DNA, 2811 bp, Artificial Sequence
  Description of Artificial Sequence: Synthetic coding sequence
atgcggcctagaagtgggggtcgccccggagctacgggccgacgcaggcggagactccgaaggagaccccgggggctgcgttgctcccggctgcctccccctcctcctctcccgcttctgctgggtctcctcctggcggccgccggacccggagcagctagggccaaggaaacagcatttgtggaggtagtcctgttcgagtcctcaccatcgggcgactacactacctacaccaccggcctgacgggccgtttctcacgtgccggagctactctatcagctgagggcgaaatagtgcagatgcatccactgggcctctgcaataataatgacgaagaagacctgtacgaatacggatgggtgggagtagtaaaacttgaacaacccgagctagatcctaaaccgtgtctgaccgtcttgggaaaagccaagcgggcagtgcaaagaggcgcaaccgccgtgattttcgacgtgagcgaaaaccccgaggcaattgatcagttgaaccaggggagtgaggaccccctaaagcggcctgtggtgtacgtgaaaggtgcagatgcgatcaaactgatgaacatagttaacaagcagaaggtggcacgcgccagaatccagcaccggcctccaagacagccaaccgagtattttgatatgggtatctttttggcctttttcgtcgtggtatccctcgtgtgtctgatcctccttgtgaaaattaagctgaaacagcggaggtctcagaactccatgaacaggctcgctgttcaggccttggagaagatggagactcgaaagttcaacagcaagtccaaaggccggcgggaaggaagctgcggcgctctagatacactctccagctcatccacttccgattgtgccatatgcctggagaagtacattgatggggaggagttaagagtgattccgtgcacacaccggtttcaccgcaagtgtgtggatccatggctgctccagcatcatacatgtccccattgtagacacaacattattgagcaaaaagggaacccctccgccgtgtgcgtggagaccagtaatctttctagaggtaggcagcagcgcgtgactctgcctgtgcactacccgggaagggtccaccgcacaaacgccatccctgcctacccgactaggacttcgatggacagtcacggtaaccctgtcacactcctaactatggatcggcacggcgagcaatccttatactcgccccagacgcctgcatatatccggagttatccgcccctacacttggatcactccctggctgctcatcggtgtggccttgagcatcgtgcctacagcccagcccatccattcagacgtcctaagctttcaggccgcagcttttcgaaagcggcatgtttttcccagtatgaaactatgtaccaacactactactttcaaggactgagctaccctgaacaggaagggcagagccctcctagcctggcaccacgtggtcctgctcgggctttccccccgagcggtagcgggtcccttctgttcccaaccgtcgtgcatgttgcaccaccttcccacttagagtccggctcaacatctagcttcagctgctatcacggtcatagaagtgtctgcagcggctatttggcggattgccctggcagcgacagtagcagtagctctagctcaggtcagtgccactgctccagttctgacagtgttgtggactgcactgaggtctccaaccaaggagtgtacggctcttgctccactttccgtagttccctgtcctccgactacgacccttttatttatcggagtcgatctccctgtcgcgcttcagaggcgggcggctccggaagctctggccgcggccccgctttgtgtttcgagggaagccctccaccggaggagctccctgccgtgcactcacatggcgccggaaggggtgagccctggccgggcccagcctctccttcaggtgaccaggtcagcacctgtagtttggaaatgaactatagctctaacagtagcctggagcacaggggacccaattcttctacatctgaggtcggcttggaggcatcaccgggagccgccccggacctgcgtagaacttggaagggagggcatgagttgcccagctgcgcttgttgttgcgagccacagccatcaccagccggaccatctgctggcgccgctggctcttccaccttatttcttggtccccatctctacgagggatccggccccgccggaggtgaacctcagtccggctcctcacagggactgtatgggctccatccagaccacctcccaaggaccgatggcgtcaagtatgagggtcttccctgctgtttttatgaagagaagcaggtggcccgcggcggcggcgggggatctggctgctacacggaggattacagcgttagcgtgcagtatacacttactgaagagcccccacctggttgttacccaggggcccgggatctgtctcagcggatacctattatccctgaagacgtggactgtgatttgggtctgcctagcgattgccaaggaacccactccctgggcagctggggcggcactcgcggcccagatacaccacgtcctcataggggactgggagcaacgagagaggaggagagagctctttgttgccaggcgagagccctcctgcggcctggctgtccccccgaagaagctggtgctgttagagccaatttcccctctgcgcttcaggacacgcaagagtcctccactaccgcaaccgaagcagcgggtccacgctcacattcagctgactccagttcccctggtgcctag

SEQ ID NO: 140922 - DNA, 339 bp, Artificial Sequence
  Description of Artificial Sequence: Synthetic coding sequence
atgtcatatcctgtgacaagccagccccagtgcgccaccacttcctgctaccaaacacagctttcggactggcacaccgggctcaccgattgttgcaacgacatgcctgtgtgcctgtgtggtacattcgcaccactctgcttggcctgtcgcatcagtgatgattttggggagtgctgttgcgcaccatacctgccaggcggccttcacagcatccgtacaggcatgcgagagaggtaccacatacaggggtcagtcgggcatgactgggcagccctaacattctgtctcccatgcgcgttatgtcagatggcacgcgagctgaaaatacgcgagtag

SEQ ID NO: 140923 - DNA, 1440 bp, Artificial Sequence
  Description of Artificial Sequence: Synthetic coding sequence
atggctgccttggagaaaatgactttccccaaaaagatgaccttccctgaaaagccatcacacaaaaaatacagggctgcactcaagaaagagaagcgtaagaagcggcgccaggaattagcacgactccgggacagcgggctgtcacaagaagaagaggaagatactttcattgaggagcaacagttggaagaagaaaagctgctggaacgagagcgcgaaagactgcatgaagaatggttactgcgggagcagaaagcccaggaagagttccggatcaaaaaagagaaggaagaggccgccaaaaaatggctggaggagcaggaacggaagttgaaggagcagtggaaagagcagcagaggaaggagagagaagaagaggagcagaagcagcaagaaaaaaaggaaaaagaggaagccgtccagaaaatgctggaccaggccgagaacgaccttgagaacagcactacctggcagaacccagagccaccagtcgacttcagggtcatggaaaaggatcgagcaaattgtccattctatagcaagactggcgcttgtcggtttggagatagatgctcccgcaagcacaattttcctacttccagcccaaccctacttataaaaagcatgtttactacattcggcatggagcagtgccgccgggatgattacgaccccgacgccagcctggagtactccgaggaggagacttaccagcagttccttgacttttatgaggacgtgcttccagaatttaaaaatgttgggaaggtgattcagttcaaggtgtcgtgcaatcttgaaccccatctgcgtgggaacgtgtatgtgcagtaccagagcgaggaggagtgtcaggccgccctgtcgctgtttaatgggaggtggtatgcgggaaggcagctgcagtgtgagttttgtcctgtcactagatggaagatggcaatctgcggacttttcgagatccaacagtgcccccgtgggaaacactgtaatttcctccatgtcttcaggaatccaaacaacgaattttgggaagcaaacagggacatctacctctcctctgaccagactggctcatcattcggcaaaaattccgagcggagggagaagatgggacaccacgatcactattactctcgtcagcggggacgccgaaatccttctcccgaccacacatacaagagaaatggcgagagtgagcgtaagaaatcctcccaccgcgggaaaaaaagccacaaacggacttccaaatcccgtgaacggcacaattctccttccaggggtaggaacaggcacaggagctgggaccaagggcggcgatcccagtcaagacgctctcaccgctccagatcgcagagttcatcgcgctgccgatcacgggggaggcgtaaatctggaaatcgtgatcggactgtgcagtctccacaaagtaagtag

SEQ ID NO: 140924 - DNA, 1449 bp, Artificial Sequence
  Description of Artificial Sequence: Synthetic coding sequence
atggcggcaccggagaaaatgaccttcccagagaagcctagccataaaaaatatcgtgcagcgctgaagaaggagaaaaggaaaaaacgtaggcaggaattggcccgcctgcgagattccggccttagtcagaaggaggaagaggaagacacatttatagaggaacagcaactggaagaagaaaaattgctcgagagagaacggcagcgattgcatgaggagtggctgctgagggaacagaaggcgcaggaagaattccgcattaaaaaggaaaaagaagaagccgctaagaagaggcaggaagagcaagagaggaaactgaaggaacagtgggaggagcagcagcgaaaagagcgcgaagaggaggaacaaaagcggcaggagaaaaaggaaaaggaggaagctctgcaaaagatgcttgatcaggcagagaacgagctagaaaacgggacgacctggcagaaccctgagccccctgttgattttcgggttatggaaaaagatcgggccaactgccccttttattcgaaaacaggagcctgccgttttggcgacaggtgcagcagaaaacataactttcccacatcgagcccaaccctcctcatcaagtctatgtttactacattcggcatggagcagtgccggagggacgactatgaccctgatgcatcactggaatactccgaggaggaaacctaccagcaattcctggacttctatgaggatgtcttgcccgaatttaagaatgtggggaaagttatacaattcaaggtgtcatgtaatttagaaccacacctcaggggcaatgtctacgtgcagtatcagtcagaggaagagtgccaggctgctctttctcttttcaacggtcgctggtatgccggaaggcagttgcagtgcgagttctgtcccgtgacccgatggaaaatggccatctgcggtctgttcgagatccagcagtgtcccagaggaaagcattgcaactttcttcacgtgttcaggaatcccaataacgagttctgggaagctaacagagatatatatctgagtccagaccgaaccggcagtagtttcggtaaaaatagcgaacggcgggagaggatgggccaccatgacgactactactcccgactacgtgggcgcaggaacccaagtcctgaccattcatacaagcgcaatggtgagagtgaaaggaagtcctcaaggcaccgaggcaagaaaagtcacaaacggacctctaaaagccgggagcgtcacaacagcagatccagaggccgaaatcgggacagatcgcgggacaggtcccgggggcgcggttcccggagccgttcccgctctcgtagtcggagatcaaggcggtcacgcagccagagttcttccagatcaaggtctcgcggaagaagaagaagcggaaacagagaccggacagtgcaaagccctaaatccaaatag

SEQ ID NO: 140925 - DNA, 444 bp, Artificial Sequence
  Description of Artificial Sequence: Synthetic coding sequence
atggctgctcctgaaaagatgaccttccctgagaagccatcacacaagaagtacagggctgccctgaaaaaagaaaagagaaagaagagacggcaggagctagcaaggctgagagactctggactctctcagaaagaagaagaagaagacacatttatcgaagaacagcagttagaagaggaaaagctgcttgaacgggagaggcttgaatgctcgggggtcatttccgcacatagaaatctccatctacccggaagccatgacagtccagcctccgcttcacgggtcgcagggataacaggcacacatcggcacacgcagctgattttcttctgcacattttccagagacggcgttagcccctgctggccaggatggtcccgtagtctggatctgatgatttgcccacccagacctcataaggttcttaggctgcaggtgtag

SEQ ID NO: 140926 - DNA, 3438 bp, Artificial Sequence
  Description of Artificial Sequence: Synthetic coding sequence
atgtgcaaatgctgtaacctgttctccccaaaccaatctgagctgctgtctcatgtgagcgaaaaacacatggaggaaggcgtgaacgtcgacgagatcataatcccactgagaccgttgagtactccagagccccccaattcgtctaaaactggcgacgaatttctggtgatgaagaggaagaggggacggcccaaagggtccacgaaaaaatctagcacggaggaggagcttgctgagaacatcgtctcccctaccgaagattcgcccctcgcacctgaggaggggaattcgctgccacccagtagtctggaatgtagcaaatgttgccgaaaatttagcaacacacgccaattacgaaagcatatatgcatcatagtgcttaacctcggcgaggaggagggtgaagctggcaacgagagtgatctggagctggaaaagaagtgcaaggaagatgatcgcgaaaaagcctctaaaagaccacggtcgcagaagaccgagaaggtccaaaaaatcagcgggaaagaggccaggcagctgagcggggccaagaagcccatcatctccgtggttctaactgctcatgaggcaattccgggtgccaccaaaatagttcccgtggaagcaggacccccagagactggggccacaaattccgagactaccagcgcagatctggtgccaagacggggttatcaagagtacgctattcaacagacaccttatgaacagcctatgaaatccagcaggctgggaccaactcagctgaaaattttcacatgcgaatactgcaacaaagtgtttaaattcaagcactctttgcaggcccacctgcggatccataccaacgagaaaccttacaaatgtccccaatgcagttacgccagcgctatcaaggctaacctgaatgtgcacctgcgtaaacataccggtgagaagttcgcctgtgattactgtagttttacatgtctgagcaaaggacacttaaaagtacacatcgagagagtccacaagaaaattaaacaacattgtagattttgtaaaaagaaatacagtgacgtaaaaaacttgattaaacatatccgcgatgcacacgaccctcaagataaaaaggtgaaagaagccctggatgaactctgcctgatgacccgcgaagggaagcgccaactcctctacgattgccatatatgtgagagaaaattcaaaaacgaactggaccgtgacaggcacatgctggtgcatggtgacaagtggccatttgcgtgcgaactgtgcggtcacggtgcgaccaaatatcaggccctggagcttcatgtaaggaagcacccttttgtgtacgtatgtgccgtgtgtcgaaagaaatttgtctcgtctatacgactcaggacccacatcaaggaggtgcacggcgctgcgcaggaagcactggtctttacctctagtatcaatcagagcttctgtctgcttgagcccggaggcgacattcagcaggaggcgttgggcgaccagctgcagctggtggaagaggagttcgctctgcagggggtgaatgccctcaaggaagaggcgtgccccggcgatacgcagctggaggaaggaaggaaggaacccgaagctccgggcgaaatgcctgcccctgcggtgcacctcgcatctccccaggcagagtctactgctctgcccccatgtgagttggaaacaaccgtggtgtcatcctcggacctccatagtcaggaagtcgtctcagacgacttcctgttgaagaatgatacgtcctctgcggaggctcacgctgctccagaaaagccacccgacatgcagcatcgatcctccgtgcaaacccagggcgaggtgattacactcctgctatccaaagcccagagtgcaggttccgaccaagagtcacatggagcccagtcgcctctgggcgaaggtcagaatatggcagtgctttccgccggggatccggacccaagccgctgtctgaggtccaatccagctgaggcatccgacctgctaccaccagtcgcaggagggggcgataccattacccatcaaccagatagttgtaaagcagctccggagcatcgtagtggaatcaccgcgtttatgaaggtgctcaatagtctgcagaaaaagcagatgaatacaagtttgtgtgaacgcatcaggaaggtttatggggacttggaatgcgagtattgcgggaagctgttttggtaccaggtgcacttcgatatgcatgtcagaactcacacgagagaacacctttactattgtagtcagtgtcactattcatctattacaaagaactgtctcaagcggcacgtcattcaaaaacattccaacatcctgctgaaatgccccaccgacggatgcgactatagcacgcccgacaagtataagcttcaggcccacctgaaggtgcacactgccctcgataaacgtagctacagctgtccagtgtgtgagaaaagctttagtgaggaccggctgatcaagagccatataaaaactaaccatccagaggtgtcaatgtctacaatcagtgaggtgttaggccgcagggtgcagctcaaggggctgattggcaagcgggccatgaaatgcccgtattgtgatttctattttatgaagaacgggtctgacctgcagaggcacatttgggcacatgagggggtcaagcctttcaagtgctctttgtgtgaatacgctactagatcaaagagcaatctcaaggcgcatatgaaccgacacagcacagaaaagacccacttgtgcgacatgtgtggtaaaaagtttaagtctaagggtactcttaaatcccataagctgttacacaccgccgatgggaaacagtttaagtgcacggtgtgcgattatactgctgcccagaagcctcagttgctcaggcacatggagcagcatgtctcctttaaaccgttccggtgcgcccattgtcactattcatgtaatatcagtggcagcctcaaacgccattataatcgcaagcatccaaatgaggagtacgctaatgtgggaactggtgaactcgcggcagaggtcttaatccagcagggtggacttaaatgcccggtctgcagtttcgtttatggcaccaagtgggaattcaatcgccacttgaagaataaacacggcttgaaggtagtcgaaatcgatggcgaccccaaatgggaggttaccgaagaggagccttcctccaatcacactgtcatgattcaggagactgtgcaacaggcatccgtagaactcgccgagcaacaccacttagttgtgtcctctgacgacgttgaaggcatcgagacggtcactgtgtatacccagggcggtgaagctagtgagttcatcgtgtatgtgcaggaggctatgcaacccgttgaagaacaagctgttgagcagcctgcgcaggaactctag

SEQ ID NO: 140927 - DNA, 3546 bp, Artificial Sequence
  Description of Artificial Sequence: Synthetic coding sequence
atggagaccagggccgccgaaaacaccgcaattttcatgtgcaagtgctgcaacttgttctctccaaaccagagcgagctgctgagccatgtgagcgagaaacacatggaggagggggttaatgttgatgaaatcattatcccgctccggcccctaagcaccccggagccacccaactcctccaaaacgggggatgaatttctcgtcatgaagcgtaaacggggaagacccaaaggatcaaccaaaaaatccagtacggaggaggagctggctgagaatatcgtgagtcctaccgaagacagccctttagcgccggaggagggaaattcccttccgccttcttccctcgagtgcagcaaatgctgccggaaattctctaatactagacaactgcgcaagcatatctgcattatcgttcttaaccttggagaggaggaaggtgaggccggtgcaactaagattgtccctgttgaggcaggtccaccagagacgggcgccaccaattccgaaacaacaagcgccgatcttgtccccagacggggttaccaggagtacgccattcagcagaccccatacgagcagccaatgaaaagtagtagactcggtcctacccaactcaagatctttacgtgtgagtactgcaataaagtgttcaaatttaaacactctttgcaggcccacctgagaatccatacaaatgaaaaaccgtacaagtgtccgcaatgtagctatgctagtgccatcaaagctaatctgaacgtccatctccgcaagcacactggtgagaaattcgcctgcgattattgcagtttcacttgcctgagcaaagggcatcttaaggtccatatcgagagggtacataagaaaattaaacaacactgcagattttgtaagaaaaagtattctgatgtcaaaaatctgatcaagcacattagagatgcacacgaccctcaggacaagaaggtcaaggaggccctggatgaactttgcttgatgacccgggaagggaagcgacaactgttgtacgattgccatatctgcgagcgaaaattcaaaaacgagctggatagagataggcacatgctggttcacggagacaagtggccctttgcatgtgaactgtgcggtcacggcgcgactaagtaccaggcactggagctgcacgtgagaaagcacccctttgtttatgtttgtgcagtctgtagaaaaaaatttgtcagctcgatacggctgcgcacacacataaaggaagtccacggcgccgcccaggaagccctggtcttcaccagctctattaatcagagcttctgcctgctggaaccagggggcgacatacaacaggaagcacttggcgatcagctgcagttagtcgaggaggaatttgcacttcagggggtcaacgctttaaaggaggaggcctgccccggtgacacacagctggaggaagggcgcaaggaacctgaggcccccggcgaaatgcccgcgcctgcagtgcacctggcttccccccaggcggaatctacggcccttccaccctgcgaactggagacgacagttgtaagctcgagtgatttgcattcccaggaggtcgtgtcagatgatttcctgctgaagaacgacacaagttccgccgaggcccatgccgctcctgagaagcccccggatatgcagcaccggagttctgtacagactcagggcgaggtgataacgctcctgttgagcaaggctcagtcagccggcagcgatcaggagtcccacggcgcccaatccccactgggtgagggccaaaatatggccgtgttatcggcgggggaccctgatccgagtcgctgcctacgctccaatcccgccgaggcttccgatctcctgcctcctgtcgccggaggcggggacaccatcacccatcagccagactcctgtaaggccgcaccggagcatcgctctgggattaccgcctttatgaaagtgttaaactccctccagaagaaacagatgaacactagcctttgtgaacggatacgcaaggtttacggagatttggagtgtgagtactgcggcaagctgttctggtaccaagtccacttcgacatgcacgttcgtacccacacaagggaacacctctactattgtagccagtgtcactactcaagtattaccaagaattgcctgaagcgccatgtgatccagaaacactctaacatactcctgaaatgtcctactgacggttgcgattacagtacacccgacaaatataagctccaggcgcatcttaaagtccacaccgccctggataagcgatcctattcatgccctgtttgcgaaaaatcctttagcgaagatcggctcattaagtcccatatcaagaccaaccatcctgaagtgtctatgagcaccattagcgaggtgctgggaaggcgggtgcagctcaagggattaattggcaagcgcgccatgaaatgcccatactgcgatttttattttatgaagaacggcagtgacttacagagacacatttgggcacacgagggcgttaagccattcaagtgctctctttgtgagtatgcaactaggtcgaagagcaatcttaaggcccacatgaacaggcattcaacagagaaaacccatctttgtgatatgtgtggaaagaagttcaaaagcaaaggtactctgaagtcacacaaacttcttcacaccgcagacggcaagcagttcaaatgcactgtgtgtgactatactgccgctcagaagccgcagctcctgcggcacatggaacagcatgtttcctttaaaccattcagatgtgcccactgtcattattcttgtaatatttccggatcgttgaaacgacactacaaccggaagcatcctaacgaggagtatgccaacgtgggaaccggggaattggccgccgaagtgctgatccagcaaggagggctgaagtgtcctgtctgcagttttgtgtacggtaccaagtgggagttcaatcgccacttgaagaataagcacgggctgaaagtggtcgagatcgacggagacccaaaatgggagacagctactgaagcccctgaggagccctccacacagtatctccacattacggaggcagaagaggacgtgcaggggacacaggcagctgtggccgcattgcaggacttgaggtatacctccgagtccggcgacagattggatcctaccgccgtcaacattctccagcagattatcgagctgggagctgagactcatgacgccaccgcccttgccagtgttgttgccatggcgcccgggaccgtcactgtggttaaacaggtgaccgaagaggagcctagtagcaaccatacggtgatgatccaggagacagtccagcaggcctctgtggagctcgccgagcagcatcacctcgtcgtgtcttcagatgacgtcgagggcattgagacggtgaccgtgtacactcaaggcggagaagctagcgagtttattgtgtatgtgcaggaagcaatgcaacctgttgaggagcaggccgtcgagcagcccgcccaggaactctag

SEQ ID NO: 140928 - DNA, 177 bp, Artificial Sequence
  Description of Artificial Sequence: Synthetic coding sequence
atggaaacgcgtgcggctggcctcctcgagttcgctggcggtcctctgcacactctatttgcctgggtgtcacctgtggaagccgccgagcagcaaagactgttgcctgtccccgccagcggtagcttcgtgcccgaagggcacctaccagacgctagccaaagctcgcccgtgtag

SEQ ID NO: 140929 - DNA, 1653 bp, Artificial Sequence
  Description of Artificial Sequence: Synthetic coding sequence
atggaccttaccaagatggggatgatccagctgcagaatcccagtcaccccaccggcctattgtgcaaggccaatcagatgcggctggccggaacactttgtgacgtggttattatggttgacagccaggagttccatgcccaccgcaccgtattggcttgtacgtccaagatgttcgagatacttttccatcggaatagccagcattacaccctggatttccttagtcctaagacttttcagcaaattctggaatacgcatacacagccacactgcaggccaaggctgaggacctggatgatctgttatacgcagcagagatcctggagatcgagtatctggaggagcagtgcctcaagatgttggaaacaattcaggcaagtgacgacaacgatactgaagctaccatggctgatggcggcgccgaggaggaggaggacagaaaggctcgatatttaaaaaatatcttcatctctaaacacagtagtgaggagtctggttatgcttcagtggcaggacagagcctcccaggccccatggttgatcaatcgcctagtgtgagtacatcattcggactatcagcaatgtcccccactaaagcggctgtcgattctctgatgactataggacaatcgctcctccagggcaccctgcagcctccggcaggccccgaagaacccactctcgctggtggtgggcggcatccaggggtggcagaggtgaagacagagatgatgcaggtcgacgaagttccttcccagggatttattcagcgggaactgttttcgaaactcggcgagctcgcagtgggaatgaagagcgagtctcggaccatcggggagcaatgtagcgtgtgtggggtggagttgcctgacaacgaggctgtcgaacaacatcggaagctgcatagcggaatgaagacctacggatgcgaactctgtggcaaaaggttcctggatagtctgcgccttcggatgcatcttctggcccactctgcaggtgcaaaggcttttgtctgtgaccagtgcggagcccaattctcaaaggaggacgcgcttgagacgcaccgccagacccacaccgggacggatatggcggttttttgtctactatgtggcaagcggtttcaagctcagtccgcactacagcagcatatggaagtacatgccggcgtcaggtcctacatttgttccgagtgtaatagaacgttccctagtcacactgccctcaagcgacacctcagatcccacacaggggaccatccctatgagtgcgagttctgcggaagttgcttccgggatgagtctacgcttaagagccacaaacgaatacatacaggagagaagccgtacgagtgtaatggctgcggaaaaaagttctcccttaagcaccagctggaaactcactatcgggtgcacacaggggagaagcccttcgagtgcaagctgtgtcatcagcgtagccgagactacagtgctatgatcaaacatctacggacacacaacggggctagcccttaccagtgcacaatttgcacggaatactgcccgtccctgtcctctatgcagaagcacatgaaaggccacaagcccgaggagatacctcccgattggcgcatcgagaagacgtacctttacctctgctatgtgtag

SEQ ID NO: 140930 - DNA, 2022 bp, Artificial Sequence
  Description of Artificial Sequence: Synthetic coding sequence
atggacctcacgaagatgggaatgatccagctgcagaacccctcccatccgacaggcctcctctgcaaagctaaccagatgagactagccggtaccctctgtgatgtggtcataatggtggatagccaggaattccacgcacacaggactgttcttgcttgtacatccaagatgtttgagatattgttccatcgaaactctcagcactatactctcgactttcttagtccaaaaacgttccagcagatactcgaatacgcatacaccgctacacttcaagcaaaggccgaggatctcgatgacctgctgtacgccgcggaaatactggaaattgagtatcttgaggagcagtgtctgaaaatgctggaaaccattcaggctagcgatgataatgataccgaggccacaatggcggatggtggggcagaggaagaggaggatcgcaaggcaagatatctcaaaaacatcttcatatcgaagcacagctctgaagagtcagggtatgcctctgtggctggtcaatctctgcccggtcctatggttgaccagtcccctagcgtgagtacctctttcggactgagcgccatgtcacctactaaggcagctgtggacagcctaatgactataggccagagcctcctccagggaaccctgcagcctcctgcggggcctgaagagccgaccttagcaggcggcggcaggcatccaggagtggctgaggtgaaaacggagatgatgcaggtggatgaagtgccatcccaggactccccaggagcagccgagagctccattagcggcggaatgggagataaagtggaggaacgcggcaaggagggaccaggtacccccacccgttcttcagttatcactagcgcacgcgaacttcattacgggcgggaagaaagtgcagaacaggtgcctccccccgccgaagccggccaggcgcctacaggtcggcctgaacacccggctcctcctccagagaagcatctcggaatatactccgtcctccctaaccataaagctgatgctgtgcttagcatgccgagctccgttactagtgggctacatgttcaacctgccctggccgtgagcatggacttttcaacgtatgggggcttactgccccagggttttatccagcgcgaactgtttagcaaattaggcgagcttgccgtgggcatgaaaagtgaatcaaggactattggcgagcagtgctctgtctgtggagtcgagctacctgacaacgaggctgtggagcagcatcgtaagcttcacagtggtatgaaaacatacggctgtgaactctgtggaaagcgattcctcgattccctccgtctgcggatgcatctgctggcccattcggcaggtgcaaaagctttcgtctgcgaccaatgtggggctcagttctccaaagaggatgccctggagactcatcggcagacccatacaggaaccgacatggccgttttttgtctgctgtgcggaaaaagattccaggcccaaagcgcactccagcagcacatggaggtccacgctggcgttcgttcatacatctgttcagagtgtaataggactttcccaagccacacagccttgaaaagacacctccggtcacataccggagaccacccttacgagtgtgagttttgcggcagctgctttagggatgaaagtaccctgaagtcacataagcgaatccacaccggggagaaaccctacgagtgtaatgggtgcgggaagaagttctctctgaagcaccaactggagactcactacagggtccacactggcgaaaaaccttttgagtgcaagctctgtcatcagaggtcacgtgattactcagcgatgatcaagcaccttcgcacccataatggagccagcccttatcagtgcacaatctgcacggagtattgcccctccctgtcttcgatgcaaaagcatatgaagggtcacaaacctgaggagatccctcccgactggaggatagagaaaacctacttgtacctgtgctacgtttag

SEQ ID NO: 140931 - DNA, 2022 bp, Artificial Sequence
  Description of Artificial Sequence: Synthetic coding sequence
atggatttgacaaagatgggtatgatccagctccaaaacccatcccaccctactgggctgttatgcaaagccaatcagatgagactggctggaactttgtgtgatgtggtgattatggtggactcccaggaatttcacgctcatcggacagttcttgcatgtaccagcaaaatgttcgaaatcctgttccacaggaacagccagcattacactcttgattttttgtcaccgaaaacctttcaacagattctcgagtatgcctatacagcaacactgcaggctaaagctgaagatttggatgaccttttgtacgcagcggagatactggagattgagtatctggaggagcagtgcctcaaaatgctcgagacaatacaggccagcgacgataacgacactgaagcaaccatggctgatggcggcgccgaggaagaagaagaccgtaaagctcggtatctgaagaacatcttcattagcaagcattcctccgaagagtccggttacgcttctgtggctggacaatctctgccaggacctatggttgaccagtcaccatccgtatctacaagtttcggcctgtcagccatgtcacccaccaaggctgctgtggattcgcttatgacaataggccagtctttactccagggcacattgcagccccccgcaggcccagaagagccgacactggcaggaggtggccgccacccgggggttgccgaggtgaaaaccgagatgatgcaagtggatgaggtgcccagtcaagattcccccggcgcagctgagtcatctatcagcggcgggatgggcgacaaagtggaagagcgcggaaaggagggtccagggacgcccactcgatcctcagtcataacatcagctagggaactgcactacgggcgcgaggagtctgccgagcaggttccacctcctgccgaggccggccaagccccaacaggccggccagagcacccggctcctcctcctgagaaacatctaggtatctactcggtgctccccaaccacaaggctgacgccgtattatcgatgccgagcagcgtaacgtcaggattgcacgtccaaccagccttagctgtgagcatggacttctctacgtacggcggcctactgccacagggctttatccagcgtgagctgttctccaaactgggagagctggcagtgggtatgaaaagcgaaagccgcacgatcggtgaacaatgcagcgtttgcggcgttgaattgccagataacgaagcagttgaacagcatagaaaactgcattcagggatgaaaacttatgggtgcgaactgtgcgggaagaggtttctggatagtttacgcctcaggatgcatctcctcgcccatagcgctggagccaaggcgttcgtctgcgatcagtgcggagcacagttcagtaaggaagatgcgctcgagactcaccgacagacccacaccggtacagatatggccgtgttctgcctgctctgcggtaagagattccaagcacagtcggctttgcagcaacatatggaagtgcatgccggagtgaggtcctatatttgttcagagtgtaaccgaacgttcccaagccacaccgcgctgaagcggcacctgcgatctcacaccggcgatcatccatacgagtgtgagttctgtggcagttgttttcgagatgagagcacattgaaatctcacaaacgaattcacacaggagagaagccgtacgaatgtaacgggtgcggtaagaagttcagtctgaagcatcagttggaaactcactatcgtgttcatacgggcgagaagccgttcgaatgcaagctgtgccaccagaggagtcgagactattcagccatgatcaaacacttgaggacccacaatggggcaagcccgtatcagtgtaccatttgcacagaatattgcccttctttgtcttcaatgcaaaaacacatgaaagggcataagcctgaagagattcctcctgattggagaattgagaagacctatctgtatctatgctacgtctag

SEQ ID NO: 140932 - DNA, 447 bp, Artificial Sequence
  Description of Artificial Sequence: Synthetic coding sequence
atggacctgaccaaaatgggtatgattcagcttcagaatcctagccatcctacaggtctcctgtgtaaagcaaaccagatgaggctggccgggaccctgtgcgacgtggtaatcatggtcgactcccaggagtttcatgcccatagaaccgtcctagcttgcacctctaagatgtttgagatcctttttcatagaaatagccagcattacacccttgattttcttagtccaaaaaccttccagcaaatactggagtatgcttacacagccacccttcaggcaaaagccgaggatttggacgacttgctgtacgccgctgaaattttagaaatcgaatacttggaggaacaatgccttaaaatgcttgaaacaattcaagcttcagacgataacgacacagaggccaccatggccgacgggggtgcagaggaggaggaagatcgctag

SEQ ID NO: 140933 - DNA, 348 bp, Artificial Sequence
  Description of Artificial Sequence: Synthetic coding sequence
atggacctgacaaagatgggaatgattcagttgcaaaatccctcacatccaacggggctgctttgcaaggccaatcagatgaggctagctggaactctctgcgatgtggttatcatggttgatagccaagaattccacgcccacaggacggtcctcgcatgtacttcgaaaatgtttgagatcctgttccaccgcaattcacagcactatactttggacttcttgtcccctaaaacattccagcagatccttgaatacgcatacactgccaccttgcaagccaaggccgaagatttggatgatttactgtacgcagccgagattctggaaatcgagtacctcgaatag

SEQ ID NO: 140934 - DNA, 723 bp, Artificial Sequence
  Description of Artificial Sequence: Synthetic coding sequence
gaagcactgccagtgcggctactgcgtcccctgctgctgagaccgcattttcaggacgctccccccggagatccaagacacggccagggtgctcaggttcctacgttgcggcaggaagtgcagccgggaaatcttaagcggcacctgcgtattcactccggagaaaaaccatatgtgtgtattcattgccagcgacagttcgcagacccaggtgcattgcagcggcacgtccgaatccacactggtgagaagccatgtcagtgtgtaatgtgcggtaaggcatttacacaggcctcttccctgatcgctcacgtccggcaacacactggggagaagccttatgtctgcgaacgctgcggaaagcggttcgtgcaaagctctcagcttgcgaatcacatcaggcaccatgataacatcagaccacataaatgttctgtgtgttccaaggcgtttgtgaatgtcggtgacttatcaaagcatatcataattcataccggagagaagccctacctttgcgacaaatgcggacgcggttttaaccgcgtcgacaacctgcggagtcacgtcaaaacagtgcaccagggtaaggcgggtatcaaaattctggagccagaggagggttccgaagtctcagtggtcacagtggatgacatggttaccttggcaaccgaggcattagccgctactgcggtgacacaactgaccgtggttcctgtcgggtag

SEQ ID NO: 140935 - DNA, 2433 bp, Artificial Sequence
  Description of Artificial Sequence: Synthetic coding sequence
atggactttcctcaacatagccagcacgtcctggagcagctcaatcagcagaggcaactgggcctgttatgcgactgtacattcgtggtcgacggagtacactttaaggcacataaggccgtgctggcagcctgttctgagtacttcaaaatgctgttcgtggatcagaaagatgtggttcacctcgacatttcgaacgctgccgggctagggcaggtcctagaattcatgtacaccgccaagttaagcctgagcccagagaacgttgacgacgtacttgcggttgccacgttcctgcagatgcaagacatcattactgcctgccacgccctgaaaagtttagctgaacctgccaccagtccaggtggcaatgccgaagcgttagctactgagggtggcgacaagagggctaaggaggagaaagtggctacttccaccctgagcagactcgagcaggcgggacggagcacccccattggaccttcacgcgacctgaaggaggaaagaggaggccaggcccaatctgccgcatccggcgctgaacagaccgaaaaggctgacgccccaagagaacccccaccggtggagctgaagcctgatcctaccagtggcatggcagccgcagaggccgaggccgcactgagtgagtcaagcgagcaagaaatggaagtcgagcctgcgagaaagggagaggaagagcaaaaagagcaagaagaacaagaagaggagggtgccggacctgctgaagtcaaggaagaagggtcacagctggaaaacggcgaagcacccgaggagaacgaaaacgaggagagtgctggaacagattcagggcaggagctgggatctgaggctagaggcctgcggagcgggacctatggcgaccggacagagtccaaggcctatggatccgtgattcataaatgtgaagactgcggaaaggaattcacacacacaggcaatttcaagcgtcatatacggatccacaccggagagaaaccattttcgtgtagagagtgctccaaggctttctccgacccagccgcttgcaaggcacacgagaaaacgcattcccccctcaagccttacgggtgtgaagaatgtggcaagagctaccggctaatttctctgctgaacctgcataagaagaggcattcaggtgaagcccggtaccgctgcgaagattgcggcaaattgtttacaactagtgggaatctcaagcgacaccaactggtgcactccggggagaagccatatcagtgcgactactgtggtaggagcttttctgaccctacaagcaaaatgagacatttagaaacccacgataccgataaggaacataagtgtcctcactgcgataagaagtttaaccaggtcggtaatctcaaagctcacctgaagattcatatcgctgatggacctctcaaatgcagagaatgcgggaaacaatttaccacgtctggcaatctcaaacgccatctccgaatccactctggggagaagccctatgtctgcatacactgccagaggcagtttgccgaccctggggctctccaacggcatgtgaggattcacacaggtgagaagccatgtcaatgcgttatgtgtggcaaagcctttacccaagcaagctccctgattgctcatgtgcgccagcacacaggggaaaaaccttacgtgtgtgaaagatgcggaaaacgatttgtccagtcgtctcagctcgctaaccacattcgacatcatgataatatacggcctcacaaatgctccgtatgttccaaagcctttgtcaatgttggcgatctgagcaaacacatcatcatccatactggtgaaaagccgtacctgtgcgataagtgcggaagagggttcaacagagttgataatttgagatctcatgtcaaaacagtacaccaggggaaggccggcattaaaatcttggagcccgaggagggatcagaggtgtctgtcgtgaccgtcgatgacatggtaactctggcgacggaagcattggccgcaacagctgtgacacagttgactgggccagctacactaccagctgtggtccccgtgggcgcagcggttacagcagacgaaactgaagtgcttaaggcggagattagcaaagccgtgaaacaggtgcaggaggaagatcctaacacccacatactgtacgcgtgcgattcctgcggggacaagttcctggacgctaatagcctggcacagcatgtgagaatacacactgcacaagctttggtgatgttccagactgatgccgacttttatcagcagtacgggccaggaggaacttggccggctggccaggtccttcaggccggagagctcgtattccggccccgcgatggagccgagggccaaccagctctcgcggagacaagtcccactgccccagagtgtccacccccagccgagtag

SEQ ID NO: 140936 - DNA, 2412 bp, Artificial Sequence
  Description of Artificial Sequence: Synthetic coding sequence
atggacttcccacaacacagtcagcacgttcttgagcagttaaaccagcagcgtcaactgggactgctgtgcgattgtaccttcgtggttgacggcgtgcactttaaagcccataaggctgtgctagctgcctgttccgaatacttcaaaatgctttttgtcgatcagaaggacgttgtccacctggatatcagtaacgcagcaggtctgggacaggtgttggagttcatgtacaccgcaaaactgagcctgagccctgagaacgtcgatgacgtgcttgccgtcgccaccttccttcagatgcaggatatcatcactgcctgtcatgcattaaaaagtctagcagaacctgccacttctcctgggggaaacgcagaagcactcgctacagaagggggggataagcgagcaaaagaggagaaggtggccacttcaactttgtcccggctggagcaggcaggccgttctacgccgataggtcccagccgggaccttaaggaggaaaggggcggtcaggcccaaagcgccgcatccggggctgaacagaccgaaaaagcagatgcccctcgtgagcctcccccagtggagctaaaacccgatcctaccagcggtatggccgccgctgaggcagaggcagccctgtcagagagcagcgagcaggaaatggaagtagagcccgccagaaaaggcgaggaggagcaaaaggaacaagaagaacaggaggaggaaggcgctggaccagcagaagttaaggaggaaggttcccagctggagaacggcgaggcacccgaggagaacgaaaatgaagaatcagctggaaccgattcagggcaggagctgggcagcgaagcacgtggccttcggagcgggacatacggggataggacggagagcaaggcctacgggtccgtgatacataagtgcgaggactgcggcaaagaattcacccatactggaaacttcaagcgacacatccgcatacacaccggcgaaaaaccattttcctgcagggaatgctcaaaggcgttcagtgatcccgctgcttgtaaagcacacgagaaaacccacagtcctttaaaaccatacgggtgcgaagagtgtggcaaatcgtataggctcatctcattattgaatttgcacaaaaagcggcactcaggcgaggctcgctacaggtgcgaggattgcgggaagctttttacaacgtctggaaaccttaagcgtcatcaattggtgcacagtggcgagaagccatatcaatgcgattattgcgggaggtccttctccgatcccacaagcaaaatgcgacatctggaaacgcacgacaccgataaagagcacaaatgcccacactgtgataaaaagtttaaccaagtcggaaatttgaaggctcatcttaaaattcacattgccgacggaccgcttaagtgcagggaatgcggcaagcagttcacaactagtggcaatttgaagcgtcatcttcggattcactcaggagaaaaaccctatgtgtgtatccattgtcagaggcagtttgcagatcctggagctctgcagcggcacgtgagaatccataccggtgaaaaaccctgccagtgcgtcatgtgtggtaaggcgttcacccaggctagctcgctgatcgctcacgtccgtcagcatacaggtgagaagccttatgtttgcgagaggtgcggaaagcgcttcgttcagtcatcacagctggctaaccacattcgccatcatgataacattaggcctcataagtgctcagtttgctcaaaagcatttgtgaatgtgggtgatctaagcaaacacatcattattcacactggagagaaaccttacctgtgcgataaatgtggacgggggttcaaccgcgtagataacctgagatctcacgtgaagactgtgcaccaaggaaaggcagggatcaaaattctggagcctgaagagggctccgaggtgtcagttgtgaccgtggatgacatggtcacccttgccacagaggccctggcagcaaccgctgtgactcagttgaccgttgtcccagtaggggcagccgtgacagcagatgaaacagaggtgcttaaggccgaaatctcgaaggccgtgaagcaggtccaggaggaggaccccaatactcatattctttacgcatgtgattcctgcggcgataagttcctggacgcgaactcacttgcgcagcacgttcgtatacacaccgcacaagctctggttatgttccagacagacgcggatttttatcagcaatacggacccggaggcacatggcccgccggacaagttctgcaggccggggaattggtgtttagaccaagggacggcgctgaagggcagcctgctctggcagagacgtccccaacagccccagagtgcccaccaccagctgaatag

SEQ ID NO: 140937 - DNA, 633 bp, Artificial Sequence
  Description of Artificial Sequence: Synthetic coding sequence
taatccaaacacatcatcattcacaccggcgagaagccttacttgtgtgacaagtgcgggcggggtttcaatagagtcgacaatttgcgtagtcatgtgaagacggtccaccaagggaaagccgggattaagatccttgagccggaagagggcagcgaggtaagcgtggtgacagtcgacgacatggttactctcgccaccgaagcattagctgccaccgcagtgactcagctgacaggcccggccactctgccagccgtggtgccggtgggagcagcagtgacagctgacgagaccgaggtgctgaaggcggagatttctaaagcagtcaaacaggtgcaggaggaagaccctaacacccatatcttatatgcatgtgattcttgcggtgataagttcttagatgcgaattcattggcccagcatgtccggatacatacagcacaggctctggttatgtttcagaccgatgccgacttctaccagcagtatggcccaggaggaacttggcccgctgggcaggtgcttcaggcaggcgaactcgtttttcgaccccgggacggtgccgagggtcagccagcactggcagagacatcccccactgcccctgagtgcccgcctccagccgagtag

SEQ ID NO: 140938 - DNA, 726 bp, Artificial Sequence
  Description of Artificial Sequence: Synthetic coding sequence
taagaagcactgccagtgcggttgctgagaccattactcttgcgaccacattttcaggacgcccccccaggagatcctcggcacggtcaaggcgcccaagtccccacacttcggcaagaagtgcaaccgggaaacttaaaacgacacctgcgcatccacagcggtgagaagccatacgtatgcatacactgtcaaaggcaatttgcagaccccggcgcccttcaacgccacgtacgtattcacactggggagaaaccgtgccagtgtgtcatgtgcgggaaagcgttcactcaggcctcaagcctcattgctcatgtccgtcagcatactggcgaaaagccctacgtctgtgagagatgtgggaagcggtttgtccagtctagccaactggcgaaccacatccggcaccatgacaacatacggccacataaatgtagtgtgtgctccaaagcctttgttaatgttggagatttgtctaaacacatcatcatccatacaggcgagaaaccctacctgtgtgacaagtgtggtcgtggatttaaccgcgtagataacctgcgttcccacgtgaagactgttcatcaagggaaggccggcatcaaaattctcgaacccgaagaagggtccgaggtctccgtggtgacagttgacgacatggtgactctggccactgaggccttggccgctaccgcagtcacacagctcactgtggtgccagtggggtag

SEQ ID NO: 140939 - DNA, 2169 bp, Artificial Sequence
  Description of Artificial Sequence: Synthetic coding sequence
atggacttcccacagcattcacagcatgtactcgagcaattgaatcagcagagacagctgggtctgttgtgcgattgtacattcgtggttgacggagtgcactttaaagcccataaagcagtgcttgcggcatgcagcgagtacttcaagatgctattcgtcgatcaaaaggatgtggtccatctcgacataagtaatgctgcaggtctgggtcaggtgctggagtttatgtataccgctaagctctctctgtcgcccgaaaacgtcgatgatgtcctggcagttgcgcctggggccgagcagaccgagaaagccgacgcccccagagaacccccaccagtcgaactgaagcctgaccctacaagcgggatggccgcagctgaggccgaggccgccctatcagagtcatccgaacaagagatggaggttgagcctgctaggaaaggcgaggaagagcagaaggagcaagaagagcaggaggaagaaggcgctgggccagccgaagtcaaggaggagggctcacagctcgaaaacggagaggctcctgaggagaatgagaatgaggagtctgcagggactgatagcgggcaggagctgggctcagaagcaagagggctccggagtggcacgtatggagaccgcaccgaaagtaaggcttacggcagcgtcatacataaatgtgaagattgtggcaaggaatttacccatacgggaaattttaaaagacatattagaattcacacaggagagaaacccttctcctgtcgcgagtgtagcaaagcattctccgaccctgccgcttgcaaagcacacgaaaagactcacagtcccctcaagccctatggttgcgaggaatgcggtaaatcctaccgcttgatatccctccttaatcttcataaaaaacgtcacagtggtgaggcccgatatagatgcgaggattgcggtaagctgtttacaacaagcggcaacctcaaacgtcaccaattggtgcactccggggagaagccttaccaatgcgattattgtggcaggagcttcagcgatcctacctctaaaatgcggcacctggaaactcacgacaccgataaagagcataaatgtccacattgcgacaaaaaattcaatcaagttggcaacctcaaggctcatcttaaaatacatattgcggacggacctctcaagtgtcgtgagtgcggaaaacagttcacgacctcaggcaacctgaagaggcacctgagaatacatagtggagaaaagccctatgtgtgcatccattgtcagcgacagtttgcagatcctggagcacttcagaggcacgtcagaattcacaccggtgaaaaaccctgtcaatgcgtgatgtgtggtaaggcatttacccaggcttcgtctcttatcgcgcacgtgagacagcataccggcgaaaaaccctatgtatgtgaaaggtgcggcaaacggttcgtgcagtcatcacagctggcaaatcacattcgacaccacgacaacattcgcccccacaagtgttctgtttgctccaaggctttcgttaatgtgggcgatctgtccaagcacatcatcattcataccggagaaaaaccatatctttgtgataaatgcggccgcggtttcaatagggttgacaatctccgcagccacgttaaaaccgttcatcagggcaaggcaggcatcaagattctcgagccagaggagggatcagaggttagtgtggtcaccgtcgatgacatggtcaccctggcgactgaggccctcgcagcaacagccgttacacagctgacagtggtgcccgttggagctgctgtcactgccgatgaaaccgaggtgctgaaggcagagatcagtaaggccgtcaagcaagtacaggaagaagatcccaatacgcatatcttgtatgcctgcgactcttgtggcgataagttcctggacgccaattctctagcacagcacgtacgaattcacactgcgcaggccctcgtcatgttccagactgatgccgacttctatcaacaatacggacccggcgggacatggcctgccggccaggtgctgcaagcaggggaactggtgttcaggccaagagatggggctgaagggcaaccggctctggctgaaacgagtcccacagcccccgagtgcccgccacctgcagagtag

SEQ ID NO: 140940 - DNA, 1530 bp, Artificial Sequence
  Description of Artificial Sequence: Synthetic coding sequence
atggatttcccacagcattcacaacatgtgttggagcaattgaaccagcagaggcagctggggctactctgtgattgtacatttgtggttgatggtgtgcacttcaaggcccataaggccgtgctggcagcgtgctcagagtacttcaaaatgctgttcgtggaccagaaggatgtggtgcatttggacatcagcaatgctgcgggcggggacaagcgagctaaggaagagaaggtagccacctctaccctgagccgtctagagcaggccggcagatctacgcccatcggcccctcgcgggacttgaaagaggagagggggggccaggctcagagtgccgcatctggcgccgaacaaaccgaaaaggccgacgccccccgggagccccccccagtggagcttaaaccggacccgacgtccggtatggctgccgctgaagccgaggctgctctctcggagagttctgagcaggaaatggaggtggaacccgcacgcaagggcgaggaagaacagaaggagcaggaggagcaagaagaagagggagctggacccgccgaagtaaaggaagaaggatcccagctcgagaacggagaagctcccgaggaaaatgagaacgaggaatcagcaggcacagactccggacaggaacttggcagtgaggccagaggattgaggagtggaacctacggagacaggaccgagtctaaagcttacggctccgtaatccataaatgtgaggactgcggcaaagaatttactcacacaggtaatttcaaaagacacataagaatacacactggagaaaaaccattctcatgccgagagtgttctaaagcattctctgaccccgccgcctgcaaggctcacgaaaagacacattcacctctcaagccttatggatgtgaggagtgcggcaagtcctataggctcatcagcttgctaaatctccataagaaacggcacagtggagaagcccgatacaggtgtgaagactgcggaaagctctttacgacatctggcaacctgaagaggcaccagcttgtacactcgggtgaaaaaccttaccagtgtgattattgtgggaggtccttctccgatccgactagcaaaatgcgacacctggaaacccacgacaccgacaaggagcacaagtgcccacactgtgacaaaaaattcaatcaagtttgcggcccattaccggagcctgcccccggatcgagacgttggcctcagccccacgcttgccacgtggtgggcagggcaggctccacagcccctgcttcgagaagctcgtcagcctgttctccccgcaagcaagcccagcgggaacccctgccacgggggagtagcagactgctgtgcggcggccaggctgactccggccgaggactagttctcaaaaagtggggaggggcagcctacctctccccattaggacctggcaccagcccagaccccggcgaaattgagccgtttacagacccaggcaagccagagtcgcaattgtttctatgcggacgggggcgctag

SEQ ID NO: 140941 - DNA, 2166 bp, Artificial Sequence
  Description of Artificial Sequence: Synthetic coding sequence
atgatgtgttggccttggccactgtctagcaagtgccggaccagcagccggcctgctatgccttcatcccacctgctgagtcgcctgcccgccctcggagaaatgcgccgaccttggcctcagaaggtgtgccccgtgcctagccccgggggggataagagggcaaaggaggagaaagtagccacaagtaccctttctaggctggaacaggccggtcgatctacacctatcggtccatcccgtgacctgaaagaggaacgcggtggacaagctcaatccgctgctagcggagccgaacagactgagaaggcagacgcgcctcgcgagccacctccggttgagttgaaaccagatccaacctctgggatggctgccgcagaggctgaggcagcactgtctgagagttcggagcaggaaatggaggtggaacctgcgagaaagggcgaggaggaacaaaaagagcaggaggagcaggaagaagagggagctgggccggccgaggtgaaagaggagggttcgcagttagagaatggagaggccccggaggagaatgaaaatgaggaatctgccggcaccgacagcgggcaggaactgggcagtgaggctcggggtctcagatccggtacttatggcgacagaaccgagtccaaggcatacggctctgtaatacacaaatgcgaagattgcggtaaggagtttacacatactggcaacttcaaacggcatatacgcatacatacgggggaaaagccattctcgtgtcgggagtgttccaaggcattctcggacccagctgcttgtaaggcgcatgaaaagactcatagtcccctcaagccctatggctgcgaagaatgcggcaaaagttatagactaatcagtctattaaacttgcacaagaaacggcacagtggcgaggcgcgctatcggtgtgaagactgcggaaagttattcaccaccagtggcaatttgaagagacaccaactggtgcactcgggagagaagccgtaccagtgcgattactgtggccgtagcttttcggatccaactagtaagatgcgccatctggagacgcatgacacggataaggagcataagtgcccccactgtgacaagaaatttaatcaggtggggaacctcaaagctcatttgaaaatacacatcgcggacggcccgctgaaatgtcgcgagtgcggaaagcaattcactacatcggggaacctaaaacgacatctccgtatacatagcggggaaaagccatacgtgtgtatccactgtcagcgccaattcgccgatcccggcgctctccagagacacgtgaggattcacactggggaaaaaccatgtcagtgcgtgatgtgtggaaaagccttcacacaggcctcgagtttgattgctcatgttaggcaacatactggcgaaaagccttacgtgtgcgagcggtgtggcaagaggttcgtacagtctagccagcttgcaaatcacatcaggcaccacgataatatacgaccacataagtgctccgtgtgtagtaaggcatttgtcaacgtcggcgatctttctaaacatatcatcatccataccggggagaaaccctacctatgtgacaagtgcggtaggggatttaacagagtggataacctaaggagccacgtaaaaactgtccatcagggtaaagccgggatcaaaatccttgagcccgaggagggcagtgaggtctctgtggtcactgttgacgatatggtcactctggcaaccgaggcactggccgccaccgccgtgacacaactgactgtcgtcccagtgggtgccgccgtgactgccgatgagaccgaggttcttaaggccgaaatctccaaggctgttaagcaggtacaggaggaggacccaaacacacacatcttatatgcctgcgatagttgtggagataaatttctggatgctaattcactcgctcagcatgtacgcattcatacagctcaggcactcgtcatgtttcagacggatgctgatttttaccaacagtacgggccgggcgggacttggccagctggacaggtcctccaagccggtgagttagtgttcagaccgcgcgatggggcagaagggcaacccgctctggccgaaaccagccccactgctcctgagtgcccacctcccgctgagtag

SEQ ID NO: 140942 - DNA, 2007 bp, Artificial Sequence
  Description of Artificial Sequence: Synthetic coding sequence
atgactgagcgaattcattccataaacttgcataacttttccaactcagttctcgagaccctgaatgagcagcgaaatcggggccatttctgcgacgttactgtccgcatccacggatcaatgctccgcgcccaccggtgcgtactcgctgcgggaagtcccttcttccaggacaagctgctgttaggctattccgacatcgaaatcccctctgtagtcagtgtgcagagcgtgcaaaagctcattgattttatgtatagtggtgtattgagagtgtcccagtcggaggcgttacagatactcactgccgcgagcatcttacaaatcaaaacagtgattgacgagtgtacaagaatagtcagccagaatgtgggcgacgttttccctggaatccaagacagtgggcaggacactcctagagggacacctgagagtggtacaagcggtcagagctccgacactgaatccggatatttacagagccacccgcagcattccgtagatcggatttacagcgccctgtacgcctgttcgatgcagaacggaagcggcgaaagaagcttctactcaggcgctgtagtaagtcaccacgaaacagccctcggattgcctcgggatcaccacatggaggaccctagctggattaccagaatccatgaacggtcacagcaaatggaaagatatttaagtaccactccagagacgactcactgccgtaagcagcctcgacccgtgcgaattcagaccttagtgggaaatatccacatcaagcaggaaatggaagatgactacgactactacggccagcagcgagtgcagatcctcgaaaggaatgagtccgaagagtgcaccgaggatacggaccaggctgaaggcacggagtctgagcctaaaggcgagagctttgacagtggcgtctcctcctctatcggaaccgagccagattccgttgagcagcagttcggccctggtgccgccagagatagccaggccgagcctacccagccggaacaggcagccgaggcccccgccgagggggggcctcagacgaaccagctggaaacgggcgcatctagccctgagcgatccaacgaggtcgaaatggattccacagttattaccgtatcgaacagttctgacaagagcgtgttacagcagccatccgtgaacacttcaattggtcagccactgccctccactcagttgtacctgagacagaccgaaactttgacttctaacctgagaatgcccttaacgttgacctccaacacacaagtaatcggtacggcaggtaatacatatttaccggccctcttcaccacccagcctgccggtagcgggcccaagccatttttgttcagcctgccccagcccctggccggacagcaaactcagttcgtgaccgtgagtcagccaggattgagcaccttcaccgctcagctgcccgctcctcagccactcgcatcatccgctggccatagcaccgcgtctggtcagggcgagaagaagccctacgaatgtacattgtgcaataaaacttttaccgctaagcagaactatgtaaagcatatgttcgtgcacacgggcgagaagcctcaccagtgctctatctgctggcgatccttctccctcaaagattatctgattaaacacatggttacacataccggggtccgcgcctatcagtgttccatttgcaataagcggtttactcagaaatcatcactgaatgtccacatgagactacaccggggggaaaagagctatgagtgttatatctgtaaaaaaaagttttcccacaagaccttgctcgagcggcacgtggctctccactcggcatcgaacggcacccctcccgccggaacccctcctggagcacgagcaggcccacctggtgtcgtagcgtgcacagaaggtaccacttatgtgtgctctgtgtgtccggccaagtttgatcaaatagaacagtttaatgaccacatgcgaatgcatgtgtccgatggctag

SEQ ID NO: 140943 - DNA, 2007 bp, Artificial Sequence
  Description of Artificial Sequence: Synthetic coding sequence
atgacagagcgtatacatagtattaatctccataactttagcaatagtgttcttgagactctgaacgagcagcggaaccgcgggcacttctgcgatgtgacagtgcgaattcacggttcaatgttgcgagcccatcgctgtgttctggctgctgggagcccatttttccaggataagttacttctgggatactccgatattgaaattcctagcgtcgtgtctgtccagtccgtacagaagttgatcgacttcatgtattccggagtcctgcgggtttcacagagcgaggccctgcagatcctgactgctgcttcaattctgcagattaagaccgtaatcgacgagtgcacacgcatcgtgtcacagaacgtgggtgacgtctttcccgggattcaagactccggacaggacacgccccggggcactcccgagtctggtacctctggccagtcaagcgacaccgagtctggatatttacagtcccaccctcagcactccgttgacagaatctactccgcgctctatgcttgtagcatgcagaacggcagtggggaaagaagcttttactccggcgcagtcgtttcccaccacgagaccgcccttggcctgcctagagaccaccatatggaagacccaagctggatcacacggatccacgaacgttcacaacagatggaacgataccttagcaccacccccgagacaacccattgtcgcaaacagccaaggcccgtaagaatccagactctggtaggcaatatccacataaagcaagaaatggaggacgactacgactactatgggcagcaacgggtccagattctggagcggaatgagtccgaagagtgtactgaagacacggaccaggctgagggcacagagtccgagccgaagggcgagtcctttgactcaggtgtttcttctagcattggcaccgagcctgattccgtcgaacagcagttcgggccaggcgcagcacgggattctcaggctgagccgacgcagcccgaacaggcagctgaggcccctgccgagggcggtccccagacgaaccagttagagacaggggccagctctccagagaggtccaacgaagttgagatggacagtaccgtaatcacggtctcaaactctagcgacaagtccgtgctgcaacagcccagtgtcaacacatctataggccaacccctgccatccacacagctgtatcttcgtcagaccgagaccctgacttctaaccttcggatgcctctgactctgacttcaaacacgcaagttattggtacggccgggaatacgtaccttcccgcgctcttcaccacccagcctgccgggagcggcccaaaaccttttttattttcactgccacaaccactcgccggccagcagacacagttcgtgaccgtatcgcaacccggcctatctacctttacagcccagcttccagcgccccagcctctggcctctagcgccgggcatagcaccgcaagtggacagggcgagaagaagccatacgaatgcacactctgtaataaaacattcacagccaagcaaaattatgtgaaacacatgttcgtgcatacgggggagaaaccccaccaatgctccatttgctggcgaagcttcagcttaaaggactacctcattaaacatatggttacccacacaggtgtccgagcttaccaatgttccatctgcaataaaagattcactcagaaatcttcacttaatgtacatatgcgcctgcaccgtggcgaaaaaagctatgagtgctatatatgcaaaaaaaaattttctcataaaactcttctggaacgccacgtggcactgcatagcgccagtaatggaactccacctgctggaactcctcccggcgctagggccggcccaccgggtgtagttgcgtgtactgagggtacaacatacgtgtgtagcgtttgtccagcaaagttcgatcaaattgaacagtttaatgatcacatgcgcatgcacgtgagcgatggttag

SEQ ID NO: 140944 - DNA, 2007 bp, Artificial Sequence
  Description of Artificial Sequence: Synthetic coding sequence
atgaccgaaaggatccacagcatcaatcttcataacttctcgaattcagtgctagagacgcttaatgagcagcgcaaccgcggacatttttgtgacgtgaccgttcgcattcatggctctatgttacgagcccacaggtgtgtgctggccgccgggtctccattctttcaggacaaacttctcctagggtactctgatattgaaatcccttcagtggtatctgttcaatccgtgcaaaaactgatcgatttcatgtactctggcgtactgcgcgtcagccagtctgaggctctccagatattaaccgccgcctccattctgcagatcaagacagttattgatgagtgcaccaggatagtctctcagaacgttggtgacgtattccctggcatacaggattcaggccaggacaccccccgggggactccagaatccggaaccagtggacagagttccgacaccgaatccgggtacttgcaaagtcacccgcagcactcagtggaccggatctattcagccctgtatgcctgctcaatgcagaacggttcgggcgagagatcgttttactccggcgctgtggttagccatcacgaaaccgccttaggtctccccagagaccaccatatggaggacccatcatggattacacggatccatgagcgtagtcagcagatggagaggtacctgtctacgacccctgaaactacccattgtcggaaacagccccgtccggtgcggatccagactcttgtcggcaatattcatatcaagcaggagatggaggacgactacgactactatggacagcagagggttcagatcttggaacgtaatgaatctgaggagtgcactgaagacaccgaccaggctgagggcaccgaaagtgagccaaaaggggagagctttgactccggggtcagctcctcgatcgggaccgagcctgacagtgttgagcagcagtttggtccgggcgcagcacgcgacagtcaggctgaacctacccagcctgaacaggcggcggaagctccggcggagggtggccctcagaccaatcagcttgaaacgggggcttcctcacccgaacgttcgaatgaggtggagatggactccacagtgattactgtctccaactccagtgataagagtgtactgcaacagccaagcgtcaatacctctattggacaaccgctgcccagtactcagttgtacctgcgacagacagagacgctgacgtcgaatctccggatgcctctgacactgacctccaacacgcaggtgattgggacagctgggaacacatacctccctgctctattcaccacgcagcccgctggctcaggcccaaagccgtttttattcagcctgcctcagccactggcaggtcagcaaactcaattcgtgaccgttagccagcccggattaagcacgttcacggctcagttacccgctccacagccacttgcttctagcgctgggcatagcaccgctagtggtcagggagaaaagaagccctatgagtgcaccctctgtaacaagacttttaccgctaaacagaactacgtgaagcatatgtttgtgcacaccggagaaaaaccccatcagtgctcaatttgctggcgcagcttctctctcaaggattacctgattaaacacatggtgactcacactggagtgagagcctatcagtgctctatttgcaacaagcgatttacccagaaatctagtctgaacgtccacatgagattacatcgaggagagaaaagctacgagtgctacatatgcaagaagaagttctctcataagactcttctagaaagacatgtggccctgcactcagctagtaatgggactccacccgctggcacacctccaggtgctagagccggccctccaggtgtggtggcctgcaccgagggtactacatatgtgtgttcggtttgtcccgccaaattcgaccagatagagcagtttaacgaccatatgcggatgcacgtcagcgatgggtag

SEQ ID NO: 140945 - DNA, 2007 bp, Artificial Sequence
  Description of Artificial Sequence: Synthetic coding sequence
atgaccgagcggatccattccataaatctgcacaacttctccaactctgtattggagactctcaatgaacaaaggaataggggacatttttgcgacgtgaccgtacgaatccacgggagcatgttgagggcacacagatgcgttttagccgcgggctccccattctttcaagacaagttgctgcttggctattccgatattgagatcccctccgttgtctctgtgcaatcagtccagaaactgatcgatttcatgtactccggcgttctgcgtgtgtctcagtctgaagccctgcaaattctgacggcagcctcaatcctgcagatcaaaaccgttattgatgaatgtactagaatcgtatcccagaacgttggagacgtctttcctggtatccaggattccggtcaggacacaccccgaggcaccccagaatcagggaccagcggacagagctccgacacagagtccgggtatctgcagagccacccccagcatagcgtggatagaatttactctgccctctatgcctgcagtatgcaaaacggctcaggcgagcgcagtttttactcaggcgccgtcgtgtctcatcatgagacagcccttgggctaccacgggaccatcatatggaggacccatcttggattaccaggattcacgagcggtctcagcaaatggaacggtatctcagcacgacacctgagacgactcattgtcgtaagcagccccgccccgtccggattcagactctggtcggcaacatccatatcaagcaggaaatggaggatgattacgattactatggacagcagagggtgcagatccttgaaagaaatgaatctgaagagtgtactgaggatacggatcaggccgaagggacagagagcgaacctaagggtgagtccttcgacagcggggtttcatctagtattgggaccgagcccgacagcgtggaacagcagttcggaccaggcgccgccagggacagccaagctgaacccactcagccagaacaggccgccgaagcaccagcagaagggggcccccagaccaaccagctggagacaggagccagctctccagaaaggagcaacgaggtggagatggatagcaccgttatcaccgtttcgaacagttccgataagagcgtcctgcagcagccaagcgtgaacacctcaataggccaacctttacccagcactcagttatacctccggcagacagaaactctaacatccaacctgaggatgccactgacgctgacttctaacactcaggtgattgggaccgccggtaatacctacttacccgcactctttacaacacagcctgcaggttctgggccgaagcctttcctgttctcgcttccacagcccttggcggggcagcaaactcaatttgttaccgtcagtcagcccggcctcagcacatttactgctcagctcccggcccctcagccactcgctagctccgccggtcattcaacagcgtccggtcagggtgagaagaagccttacgagtgtaccctttgtaataagacctttactgccaagcagaattatgtgaagcatatgttcgtgcacactggcgaaaagccacaccagtgcagtatttgttggcgtagcttctccttgaaagactatctgataaagcatatggtaacgcacactggcgtccgcgcctaccagtgtagtatctgcaataagcgatttactcagaagtcctctctgaacgtgcacatgcggcttcatagaggggagaagtcctacgagtgctatatctgtaagaagaaatttagtcacaagacactgctggaaaggcacgtggctcttcactctgcatcaaatggaacacctcctgccggaaccccaccaggagcccgagcaggacccccgggagtggtcgcgtgcacggaagggacgacctacgtgtgcagtgtgtgtccagctaaatttgatcagattgagcaatttaatgatcatatgcggatgcatgtgtctgatgggtag

SEQ ID NO: 140946 - DNA, 174 bp, Artificial Sequence
  Description of Artificial Sequence: Synthetic coding sequence
atgactgagcgtatccacagtatcaatctgcacaatttttctaactccgtcttagaaaccctgaacgagcagagaaacagaggccacttctgcgacgtaacagtccgcatccatgggtcaatgctgagggcgcatcgctgcgtcctcgcggccgggagccctttcttccagtag

SEQ ID NO: 140947 - DNA, 2007 bp, Artificial Sequence
  Description of Artificial Sequence: Synthetic coding sequence
atgacagaacgtatccattcaattaatctgcataatttctccaattcagtcctcgagacgttaaatgagcagaggaatcggggacatttctgtgatgtaacggtgaggatccacggttctatgctcagagcccatcggtgcgtactggctgcaggcagcccgttcttccaagataaactgctgctaggatacagcgacatcgaaatcccatcagttgtgtccgtgcaatccgtccagaaactgatagattttatgtactccggggtgctgcgggtcagccagtctgaagccttacagattctcacagccgcgtccattttgcaaatcaagaccgtaattgacgagtgcactcgtatagtgagccagaatgtcggcgatgtatttcccggaattcaggactctggccaggacactcctagaggcacccctgaatctggaacaagcggccagagttccgacacagaaagtgggtacctgcagtctcaccctcaacactccgtggacaggatttacagtgccctgtatgcttgtagtatgcagaatggatccggagaaagaagcttttacagtggggccgtggtgtctcaccatgagaccgctttgggcctcccacgggaccaccacatggaggaccccagctggataaccagaattcacgagagatcgcagcagatggagagatacctcagcaccaccccagagaccacgcactgccggaaacagccccgcccggtccggatccaaactttggtcggtaatattcatatcaaacaggaaatggaggacgattatgattactatgggcaacagagagtgcagatcttggagagaaacgaaagcgaggagtgtaccgaagatactgaccaggctgaggggactgagtcagagccgaaaggcgagagctttgacagcggggtaagtagttctatcggaacagaacctgactctgtcgagcaacaattcggacccggcgctgccagggattcccaggcggagcctacacagccagagcaggcagcagaggccccagcagagggcggccctcagaccaaccagctcgagactggggcttcaagcccagagcggtccaatgaagtggagatggattccactgtgattactgtttctaactccagcgacaagagcgtacttcagcagccctcagtaaacaccagcataggtcagccactgccctcaacgcagctgtacctgaggcaaacagagacactcacaagtaacttacggatgcctttaactttaacaagcaacactcaggtgatcggcaccgccggaaacacatacctccctgctctcttcacgacacagcccgcgggcagcgggccaaagcctttcctgtttagcttgccccagccgctcgccggacagcagacgcagttcgttaccgtgtcgcagcctggattgagcaccttcacagcacaactccctgccccccagccgctcgcctccagtgctggacatagtacagcttctgggcaaggagaaaaaaagccctacgagtgtacactctgcaacaaaaccttcaccgcaaaacagaactacgtgaagcacatgtttgtgcatacaggcgaaaagccccatcagtgcagcatctgttggagatccttttcactgaaggattatttaatcaaacacatggtgacacacactggagtccgcgcctaccagtgctcaatctgcaacaaaaggtttacccagaagagttccctgaatgtgcatatgcggttacataggggcgagaagagttatgagtgctacatctgcaagaagaagttctcccataaaaccttgcttgagcggcatgtcgcactgcattctgcctctaacggtacaccaccagccggaaccccgcccggcgcccgggcaggacctcccggcgttgtggcgtgtaccgaaggaaccacatatgtgtgcagcgtctgcccggcgaaatttgaccagattgaacaattcaatgaccacatgcgtatgcatgtctcggacggttag

SEQ ID NO: 140948 - DNA, 2226 bp, Artificial Sequence
  Description of Artificial Sequence: Synthetic coding sequence
atgctggagcgcaagaaacccaagaccgccgaaaaccagaaggcaagtgaagagaacgagatcacccagccaggaggttctagcgctaagccggggctgccatgtttgaattttgaagcagtgttgagtccggatccagcactgatccactccacgcattctctcacaaatagccacgcacacactggctcttcagattgcgatatctcttgcaaggggatgactgagcggatccattccatcaacctccacaacttcagcaactcagtgctggaaactttgaacgagcagcgtaaccggggccacttttgtgatgtcaccgttagaatccatggctcaatgcttagggctcacaggtgtgtcctagcagccggatctccgtttttccaggataagcttctactgggctattcagacattgagattccatcggtggtgagcgtgcagagcgtgcagaagctgattgactttatgtacagtggggtgctgagggtttcacagtccgaggctctgcaaatacttaccgctgcttccatcctccagatcaaaaccgtgatcgatgaatgtacccgcattgtcagtcagaatgttggtgacgttttcccagggattcaggacagcgggcaagatacccctagagggacaccggaaagtggaacctcgggtcaatcttctgataccgaatctggatacttgcagtctcatcctcagcactcagtggaccggatctattctgctctgtacgcttgcagtatgcagaatggttccggggaacgaagcttttattccggagcagtggtctcgcatcatgaaacggcgctcggccttccccgagatcatcacatggaagatccaagttggatcactcggatccacgagagatcacagcagatggagcggtaccttagcaccacacccgagacaacacactgccggaagcagccacggcctgtgcgaatccagactttggtgggtaacattcatataaaacaagagatggaagatgattacgactactatggccaacagagggttcaaattcttgaacgcaatgagagcgaggaatgcactgaggatactgatcaggctgagggtactgaatcagaaccgaaaggggaaagtttcgacagcggcgtgtcaagctcaatcgggaccgaacccgatagtgtcgaacagcaattcggccccggcgctgcacgtgatagccaggccgagccaactcagccggaacaggcagccgaagccccggcggaaggggggccacagactaaccagctcgagacgggggcctcaagtcccgagcgctctaatgaagtggagatggattctactgttatcacggtgtccaactcatcagacaaatcagtcttgcagcagccaagcgtgaacacctccattggccagcctctcccatcaacacaactttatttgagacagaccgagactctcacctccaacctgaggatgccactgactctcacctccaatacgcaagtcatcggcaccgcggggaacacctatttacccgccttgtttactacacaacctgccggaagtggaccaaagcctttcctcttttctttaccacaaccactggctgggcagcagactcaattcgtcaccgtcagtcaaccgggcctaagtacctttacagcccaacttcccgcaccccagcccttagccagcagcgccgggcatagcactgcgtcaggacagggcgagaagaaaccatatgaatgtacactgtgtaataaaactttcaccgctaagcagaactacgttaaacatatgtttgtccataccggtgagaaaccacatcagtgtagtatttgctggagatcctttagcttgaaggactatctgattaagcacatggttacacacaccggagtccgggcataccagtgttccatttgcaacaaaagatttacccaaaagagtagtcttaacgtgcatatgcgattgcacagaggagagaagtcatacgaatgttacatctgtaagaagaagttctcccacaaaaccctgcttgagagacatgtggccctgcattccgcttcaaatgggacaccgcctgccgggaccccccccggcgcccgagccggccccccaggggttgtggcatgtacagaaggaacgacttatgtttgctctgtttgccctgccaagttcgaccaaattgagcagttcaatgatcacatgaggatgcatgtctccgacggttag

SEQ ID NO: 140949 - DNA, 2007 bp, Artificial Sequence
  Description of Artificial Sequence: Synthetic coding sequence
atgaccgagcgaatacacagcatcaacttacacaatttctccaactctgtgctcgagacactgaatgagcagcggaaccggggacacttttgcgacgtgaccgtcaggattcatggctctatgctcagagctcataggtgtgtgcttgccgcgggaagcccattttttcaggataagctgctgctcggctactccgacatcgagatcccatctgtggtgtccgttcagtccgttcagaagctgatcgatttcatgtacagcggggttctgcgggtctcccagtccgaagcattgcagattctcactgctgctagcatcttgcagataaaaactgtcatcgacgagtgtaccagaatcgtcagtcagaacgtgggggacgtcttccctggtatccaggattctggacaggatacaccacgcggaacaccagagagcggcacttccggccagtcttccgacactgaatctggatatcttcagagccacccccagcacagcgtggaccgcatctatagcgcactgtatgcctgttctatgcaaaacggaagcggggaacgtagtttttattctggagccgttgttagtcatcacgaaactgctctgggactgcctagggatcatcatatggaggatcccagctggataaccagaattcacgaacgatcccagcaaatggagaggtacctgagcacgacccctgaaactactcattgcagaaagcagcctagaccagtcagaatccagacactagtcggcaacatccacataaagcaagaaatggaggacgattatgattactatggtcagcagcgtgtgcagatccttgagaggaatgagagtgaagaatgtactgaggacaccgatcaggcagaaggcaccgagagcgagccaaagggagagtcattcgacagtggggtgtcgtcatcaatcggcaccgaacccgactctgtcgaacagcaatttggacccggtgctgcgcgggattctcaggcggagcccacccagccagagcaggccgccgaggctcctgcagaaggaggccctcagaccaaccagctagaaacaggagccagctccccagaaaggtcaaacgaagtggaaatggactctactgtgatcactgtgtccaatagctcagacaaatcagttctgcagcagccaagcgtgaacacatccatcggacagccacttccctctacacagctgtatcttagacagacagagacgctgacgtccaacttacggatgcccctgacgcttacgtctaatacacaagtcatcggaaccgccggaaatacgtatctgcccgcactgttcactacccaaccggctgggtccggcccaaaaccgttcctttttagcttaccccaaccattggctggacaacagacacaattcgtcaccgtttcccaacctggcctgagcaccttcaccgcgcagctccccgctccacagcctctagcctcatcggcaggccactcaacagcgtcgggacagggtgagaaaaagccctatgagtgcacactctgcaacaaaactttcacagcaaaacagaattacgttaagcacatgttcgtgcacacaggagagaagccccaccagtgcagtatctgctggaggagcttcagtctgaaggactaccttatcaaacacatggttacccacaccggcgtgcgtgcctaccagtgtagtatatgtaacaagaggtttacccagaagtcttctctgaacgtacatatgcgcctgcatcgcggtgaaaaaagctatgagtgctacatctgcaaaaagaaattcagccataagactctgctcgagcggcatgtggctctgcattccgcttccaacggaacgccacctgcaggcactccacccggtgccagggctggaccgcccggcgttgtggcctgcaccgaagggactacttacgtgtgtagtgtctgccctgctaagtttgatcagattgaacagtttaatgaccatatgagaatgcatgtcagcgatggctag

SEQ ID NO: 140950 - DNA, 60 bp, Artificial Sequence
  Description of Artificial Sequence: Synthetic coding sequence
atgctggagcggaagaagcccaaaactgccgagaaccagaaggcctcagaggaaaattag

SEQ ID NO: 140951 - DNA, 489 bp, Artificial Sequence
  Description of Artificial Sequence: Synthetic coding sequence
atggccgaaacggtagcagatactaggcgactcatcacaaagccccagaacttgaatgatgcatatgggcccccatctaattttctggaaattgacgtgtctaaccctcagaccgttggcgtgggacgtgggagatttaccacctacgaaatccgcgtgaagactaacttgcctatctttaagctcaaggaaagcacagtgaggcgccgatatagcgattttgagtggcttagatctgagttagaacgagagtctaaggtggtggtgccgcctctcccaggaaaggccttcctgcggcagctccctttccggggcgatgacggcatttttgatgacaatttcatagaggagcgcaagcaggggcttgaacagttcattaacaaagtcgcaggacatcccctggctcagaacgaacgttgcctgcatatgttccttcaggacgaaataatcgataaatcctataccccttctaaaatccgacacgcatag

SEQ ID NO: 140952 - DNA, 1308 bp, Artificial Sequence
  Description of Artificial Sequence: Synthetic coding sequence
atggataccgcatcacacagtctggtactgctgcaacaactgaacatgcaacgcgagtttgggtttctgtgcgattgcactgtggcaattggcgatgtgtacttcaaggctcatagggcagtccttgccgcctttagcaactatttcaagatgatattcatccatcaaacatctgaatgtatcaaaatccagcctactgatatccaacctgacatatttagctacttactgcatattatgtacaccggaaagggtcctaagcagatcgttgatcactctcgcctggaggaggggattcgcttccttcacgcagattatctttcccacattgctactgaaatgaatcaggtcttctcccccgagaccgtgcaaagttcaaatttgtatggcattcagatctcgaccactcagaaaacggtcgtcaaacagggcttggaggtgaaggaagctccctctagtaattccgggaaccgggctgcagtgcagggggaccacccccagctccagcttagcctcgcgataggcctggacgacggcacagcagaccagcagcgtgcttgcccagcaactcaagctctcgaggaacaccagaaaccccccgtgtcaatcaagcaggagagatgcgatcccgagtcagttatcagtcaatcacacccctctccttccagcgaagtcacagggccaactttcaccgagaattcagttaagatccacttgtgtcactactgcggtgagcggttcgattcacgtagtaatctccggcaacaccttcacacacatgtgagtggcagcctcccattcggggttcccgcgagtatcctcgagagtaatgacctgggagaagtacaccctcttaatgagaattcagaggctctggaatgtcgacgcctttccagtttcatcgtcaaggagaacgagcagcagcccgatcacactaaccggggcactacagagcctcttcagatcagtcaagtgagcctcatcagtaaagatacggagccagtagaactgaactgtaacttttctttcagcaggaaaagaaaaatgtcctgcacaatttgcggccacaagtttcctagaaaatctcaattgctcgaacatatgtatacccacaagggtaagtcctatagatataatagatgtcagcgatttggaaacgccttagcacagagattccaaccctactgcgactcctggtctgacgtatctctcaagagctctcgcctgtcccaggagcacctagacctgccatgtgctctcgagtcagagctcacacaggagaatgtggatactatccttgtagagtag

SEQ ID NO: 140953 - DNA, 1308 bp, Artificial Sequence
  Description of Artificial Sequence: Synthetic coding sequence
atggacaccgcgtcacacagtctggtgctactacaacagcttaatatgcagagggagttcgggtttctctgcgattgcaccgtcgctattggagacgtgtattttaaagcccatcgggcagttttagccgccttctcaaactactttaaaatgatcttcatccatcagacttccgaatgcattaaaatccagccaacggatatccagcccgacatattctcatatctgttacacatcatgtacactggaaaaggacccaagcagatagttgaccactcccggctggaagagggcatccgattcctgcatgcagactatttgtcacacatagcaactgagatgaaccaagtgtttagtcccgagaccgtacaatcttccaacctttacggcatccagataagcacaacacagaagaccgtcgtgaagcagggtctggaagttaaggaagccccttcctccaattcaggcaaccgagcggctgtgcagggcgaccacccacagcttcagctgagcctggctataggcctggatgatgggacagccgatcagcagcgagcttgcccagccacacaggctcttgaagagcatcagaaaccccccgtgtcaatcaagcaggagcgctgtgaccctgagtctgtcatcagccagtctcatcccagcccttcctccgaggtgacagggcccacattcactgagaatagcgttaaaatacatctgtgtcactactgcggtgaacgattcgattcacggagcaatcttcgccaacacctgcacactcatgtttccggaagcctgccattcggggttccggcatctattctggagagcaatgacctgggagaagtgcatcccctgaatgagaatagcgaggctttagagtgccgccgcctcagctcatttatcgttaaagaaaacgaacagcagccagatcatacaaaccgaggcaccaccgagccgctgcagatcagccaggtaagcctgataagtaaggacactgagccggtggaattgaactgtaacttcagctttagcagaaaacggaaaatgtcttgtactatttgcgggcacaaattccctcggaagtctcagctgttggagcacatgtacacccacaaaggtaagtcataccgatataatcgctgtcaacgcttcgggaatgctctggctcaacgatttcaaccatattgcgacagttggagcgacgtgtcattgaagagctcaaggctttctcaggagcacttggacttaccatgcgctctggaatcagaactgacccaggagaacgtggacactatcctcgtagagtag

SEQ ID NO: 140954 - DNA, 1464 bp, Artificial Sequence
  Description of Artificial Sequence: Synthetic coding sequence
atgtccctgcctcctataaggctgcccagtccttacggttccgacagactggtgcaactggcagcccgtctgcgacccgccttgtgcgatacattgatcacagtaggaagccaggagttcccggcccactctctcgttcttgccggcgtatcgcaacagctgggcaggcgaggacagtgggccctgggcgaggggatttctccctcaacctttgcacagctgttgaattttgtgtacggagaatccgtggagctgcaacctggcgaactgagaccgttacaggaagccgcgcgggcactaggcgtacaatcactggaggaggcctgttggagggcgcgcggagatcgtgctaaaaagcctgatccaggcctgaaaaagcaccaggaagagcctgaaaaaccttcccgtaaccctgaacgggagcttggagacccaggagagaagcaaaagcctgagcaggtctctaggaccggcggacgggagcaggagatgctgcataaacactccccaccgagaggccggcccgagatggccggcgccacacaggaggctcagcaagagcagacccgatctaaggagaaacggctgcaagcacctgtagggcagcggggtgccgatggtaaacatggtgtcctaacttggctgcgcgagaatcctgggggctccgaggagagtctccggaagcttcctggccctttgcccccggccggaagcttacagaccagtgtaacccctcggccctcctgggccgaggccccctggctagtagggggtcagccggcgctctggagcattctcctcatgccaccacggtatggcatcccattctaccattccacacccaccactggggcttggcaggaggtttggcgcgagcagaggattcctctgtccttgaacgcacccaaggggctgtggagccagaatcagctggcaagctcttcgcccactcccggctcactgccccaggggcccgcccagttgtcacccggtgagatggaggagtccgatcagggacacacgggagccttagccacatgcgcggggcacgaggacaaggcaggttgccctccacggccgcatccccctccagcacctcccgcccgcagccggccctacgcctgctcggtatgtggcaagagattctccctcaagcatcagatggagactcattatcgggtgcacaccggcgaaaaacccttctcatgcagtctttgtccacagcgatctcgcgatttcagcgccatgactaaacaccttagaacacatggggctgccccatatagatgttccctgtgcggggccggatgcccaagtttagcaagtatgcaggcccacatgcggggacatagtcccagtcaactgccaccaggctggacaattcgctctacattcctgtattcctccagccgcccaagtcggcctagcacatccccatgttgtccaagctcttctacaacttag

SEQ ID NO: 140955 - DNA, 1464 bp, Artificial Sequence
  Description of Artificial Sequence: Synthetic coding sequence
atgtcgctgcctcctattcgccttccatcaccatatggctcagaccggctggtgcagctagccgcacggctgcgccccgcgctttgcgataccctgatcacagtcgggagccaggaatttccggcgcattcactggtgcttgctggtgtgagccagcaactggggagacgtgggcagtgggccctcggagaagggatatctccttcaactttcgctcagctcctgaatttcgtttatggagaatccgtggagcttcaacctggtgaactgcgccccttacaagaagccgccagagccctgggcgtgcaatcgctcgaggaagcatgctggagagctcgaggagacagggcaaaaaaaccagaccctgggctgaagaaacaccaggaagagcccgagaagccctctagaaaccctgagagagaattgggggatcccggcgaaaaacagaaaccagagcaggtttccaggactggcggaagagaacaggagatgctgcacaaacactccccccctcgtggaagaccagagatggctggggcaactcaggaggcccagcaagaacagacacgaagtaaagagaagcgtctccaggcccctgtcggtcagagaggggccgacggtaaacatggcgtactgacttggctgagagaaaatccagggggatccgaggagtctctgcggaagctgccagggcctctacctcctgccggatccttgcagacctccgtaacaccacgaccctcatgggcagaggctccatggctcgtgggcggtcagcccgcactctggagtattttgttaatgcctccccgctatggaatcccgttctaccatagtacgccaacgacaggtgcctggcaagaggtttggcgcgagcagaggatccctctgagtttgaatgcacccaaaggcctgtggtcccagaatcagctggcctcctctagccctactccaggaagtttgccccagggtccagctcagctcagtccaggagaaatggaggaatcagaccagggccataccggcgctcttgccacatgcgccggccacgaggacaaagctgggtgtcctcccagaccacatccgccacccgcccctcctgctaggtcgaggccatacgcatgttctgtctgtggaaagcggttctcgttgaagcatcagatggagacgcactatcgggtgcacacaggtgagaaacctttttcatgttccctctgtcctcaaagatccagagattttagtgcaatgacaaaacaccttaggacacacggcgccgccccctacaggtgcagtctctgcggggcaggttgcccgagcttggcgtccatgcaggcacatatgagggggcactctcccagccagctgcctcccgggtggaccatcagaagtacattcctgtattcttcctcccggccaagtcgaccctctacctctccgtgttgcccctccagctctacaacatag

SEQ ID NO: 140956 - DNA, 2019 bp, Artificial Sequence
  Description of Artificial Sequence: Synthetic coding sequence
atggaaagcaggaagctgatcagcgccaccgatatccaatactccgggtctcttctgaattctctgaacgagcagcgagggcacggactgttctgtgacgtaactgtgatcgttgaagaccggaagttcagagctcacaagaatattctgtctgcatcctcaacatacttccatcaactgttctccgtggcaggacaagtggtagaactttcatttattcgcgcggagatttttgcagagatcctgaattatatctactccagtaagatcgttcgcgtccggtctgacctgttagacgaactcattaagagcgggcaactcttgggagtgaagttcattgcggagctgggtgtgcctctgtctcaggtgaagagcattagcggcaccgcccaggacggtaacacagagccactccctcctgacagcggcgacaagaacttggtaatccaaaagagcaaggacgaggcgcaggacaacggcgcaactataatgcccatcatcactgaatctttttcattgagtgcagaggactacgagatgaagaaaattattgttactgactccgatgacgatgatgacgatgtgattttttgctctgaaatccttcctactaaagaaacgctgcccagtaataacacggttgcccaggttcagtccaacccgggtccagtggcaatcagcgacgttgcgccctctgcgagtaacaatagtccacctctgaccaatataacgcccactcagaaactgccaacaccagtcaaccaggcaaccctctcccaaacacaagggtccgaaaagctccttgtctcttcggcgccaacccaccttacccccaatatcatcctcctcaatcaaacacctttatccacacctcctaacgtgtcttcaagccttcccaatcacatgccaagctcgattaatctcctggtgcagaatcaacagacacccaattccgctattttgacagggaacaaggctaatgaggaagaggaagaagagattattgacgatgatgacgacacgatctcctcgagtccagatagtgccgtttccaataccagtctggtccctcaagctgatacatcacagaacacgagtttcgatggctccttgattcagaagatgcaaatacctacactgttgcaggagcctttaagtaactccctgaagatcagcgacataatcacgcgcaataccaatgaccccggagtgggcagcaaacaccttatggaaggccaaaagatcatcacccttgatactgcaactgagattgaagggttaagcaccgggtgcaaagtctacgctaatattggggaagatacctatgatattgtgatccctgtgaaggatgaccctgacgaaggcgaagccaggctagaaaatgaaatccctaagacctccggctccgaaatggctaataaaagaatgaaagttaagcacgatgaccactatgagctgattgtggacgggcgcgtgtactacatatgcatagtctgtaaaagatcatacgtctgcttgacttccctaaggagacacttcaatatccattcttgggaaaagaagtacccttgccgctactgtgagaaggtgtttcctcttgctgaatatcgcaccaagcatgagatccaccacactggggagaggcgttatcagtgtctagcttgtggaaaatctttcatcaactatcaattcatgtcctcacatattaaaagcgttcattcgcaggatccttctggcgattccaagctctataggctgcacccgtgccgatccctgcaaattagacagtacgcgtatctgagcgatcggagttcaacgatacctgccatgaaagacgatgggataggatacaaagtagacaccggaaaggaaccaccagtaggtactaccaccagtacccagaataagcccatgacctgggaagacatttttattcagcaggaaaatgattctatcttcaagcagaacgtgacagatggttcaactgagttcgagttcattatccccgagtcttactag

SEQ ID NO: 140957 - DNA, 2019 bp, Artificial Sequence
  Description of Artificial Sequence: Synthetic coding sequence
atggagtccagaaaactgatctctgccaccgatatccagtatagtgggtctttactcaactctctgaacgagcagagaggacatgggctcttctgcgatgtaacagttatcgtggaagatcgtaaatttagggcacacaagaacatcctctctgcgtcctctacgtattttcaccagttgttcagcgtggcaggacaagtagttgagctcagttttatcagggctgaaatctttgctgagatcttgaattatatctattcatcgaaaatagtgcgggtgcgctccgacctactcgatgagctgataaagtcagggcagttgctgggtgtcaaatttatagccgaacttggagtgcccttgtcacaagtcaagagcatcagcggcaccgcacaagacggtaatacggaacccctgccccccgactcaggcgataagaatcttgtgatacagaaatctaaagatgaggcccaggacaatggtgctaccatcatgcctatcataactgagtccttcagcttatcagccgaggactatgagatgaagaaaataatcgtaactgattctgatgatgacgacgatgatgtgattttctgcagcgagatattgccgactaaagagacattgccctccaacaataccgtggcacaagtgcaatcgaaccccggaccagtagccatctccgatgtggctccatcagccagcaataattccccaccacttaccaacatcacacctacccagaagctccccactcccgtcaaccaggccaccctgagccagacccaaggaagcgagaaactgctcgtttcaagtgcacctacacatctgacacccaatatcatcttgttaaatcagactccattgagcactccacctaacgtatccagttccctccccaatcatatgccctccagcatcaacctgctagtgcagaaccagcaaacacccaattctgctatactgaccgggaacaaggccaatgaggaggaagaagaggagattatcgacgacgacgatgacaccatcagctcgtcacctgattcggccgtgtctaacacatccctcgttccccaggcagacacatcacaaaatacttcctttgacggatcacttattcagaaaatgcagattcctacgctgttgcaagagccactgagtaactctctcaaaatttcagacattatcacaaggaataccaatgaccctggcgtgggatcaaaacatttgatggaggggcagaagatcataaccctggatactgctacagagatcgaggggctgtctaccggatgtaaggtctatgcaaatataggggaggacacctacgatatcgtaatccctgtcaaggatgaccccgatgagggggaagcaaggctcgaaaacgagatcccaaagacgagcgggagtgagatggcgaataaaagaatgaaagtgaaacatgatgaccactacgagctgatagtggacggccgggtatactatatatgtattgtgtgcaagaggagctatgtctgtctcacctcattacggcgccacttcaatatccactcgtgggaaaagaaatacccgtgcagatattgcgagaaagtgtttccacttgccgagtacaggaccaagcatgagatccatcataccggggaacgccgatatcagtgcctggcatgcgggaaatcctttatcaattatcaatttatgtcttcccatattaaaagcgtacactcacaggatcctagcggagacagcaagttataccggctgcacccatgccggagcctgcagataagacagtacgcctatctctccgaccggtcaagcaccatcccagccatgaaagatgatggaattgggtacaaggtggacacaggtaaagagcctcccgtgggcacaacaacaagtacacagaacaagcctatgacgtgggaagatattttcatccagcaggagaatgattccatctttaagcagaacgtgactgacggcagtactgaattcgaattcattatcccagagagctattag

SEQ ID NO: 140958 - DNA, 2019 bp, Artificial Sequence
  Description of Artificial Sequence: Synthetic coding sequence
atggagtccaggaagttaatcagcgcaacagacattcaatattccggcagcctcttaaattccttaaacgagcagagaggacatgggcttttttgcgacgttacggtgatcgtagaagatcggaagtttcgagcccataaaaacattctgtccgcgtcatccacatatttccatcagctgttttctgtggcgggacaggtggtggaactctcatttattcgagcggaaatattcgcggagatcctgaattatatatattcaagcaaaattgtaagggttcggtccgatctactcgatgaactcataaaatccggtcagttgctaggtgtgaaatttatcgctgagctgggcgtcccactctcgcaggttaagtcaataagcgggaccgcgcaggatggcaataccgaacccctaccaccggattcgggggacaagaacctcgtcatccagaaaagcaaagacgaggcccaggataatggagccacgatcatgccgattatcaccgaaagcttttctctcagtgccgaggattacgagatgaagaagattattgtgactgatagtgacgatgacgacgatgacgtcatcttctgctcagaaatactaccgacaaaggaaacacttcctagcaataataccgtggcccaggttcagagtaatcctggccccgtggcgatttccgatgtggcaccaagtgccagcaacaattcaccaccgctcactaatattactcccacgcagaagctgcctacccctgtgaaccaagccacactgagccagacacagggatccgaaaaattactcgtttcctctgccccaacccatcttaccccaaacatcatcctgcttaaccagaccccactgtcaaccccacctaatgtgtcgtcaagtcttcccaatcatatgcctagctccataaacctgctggtccagaatcagcaaacgcccaattcagcaattctgactggcaacaaggccaatgaagaggaagaagaagagatcatcgacgatgatgacgacaccatcagcagctctcctgactccgccgtctccaacacatctttagttccccaggccgacacatcccagaatacatcctttgacggaagtcttatccagaagatgcagatcccaactcttctgcaggaaccgctgagcaattctttgaagatctctgatatcattacccgtaacactaatgaccctggggtgggcagcaagcatctgatggagggccagaagattattacgctggatactgcaaccgaaattgagggactgtctacagggtgtaaagtctatgctaacattggcgaggatacctatgacatcgtgattccagtgaaggatgatccggacgagggcgaggcaaggttagagaatgagatcccgaaaacttctggatctgaaatggcaaataagcgaatgaaggtgaagcatgacgaccattatgaactgatcgttgacgggagagtgtactatatctgtatagtgtgtaagaggagctacgtctgcttgacttccctgcggcgccactttaatatccacagctgggagaaaaagtacccctgccgctactgtgagaaggttttcccgctggccgaatatcggacgaaacatgaaatacaccataccggtgaaagaaggtaccagtgtctggcctgtggcaagtcttttataaattatcagttcatgtcctcccacatcaaatccgtgcactctcaagatccaagtggagacagcaaactgtacagattacacccttgcaggagtctgcagataagacagtatgcgtaccttagcgataggagcagcactatcccggcgatgaaagacgatgggattgggtacaaagtagacacggggaaagagccaccggttgggactacaacctctactcaaaataagcccatgacatgggaggatatttttattcagcaggaaaatgatagcatatttaaacagaacgtaacagatggaagcactgaattcgaatttatcatccccgagtcttattag

SEQ ID NO: 140959 - DNA, 1515 bp, Artificial Sequence
  Description of Artificial Sequence: Synthetic coding sequence
atgtccgttgagatggattcctcatccttcattcagttcgacgtgcccgaatattcctccacagttttgtcccaactcaatgaacttagattgcaagggaaactgtgcgatattattgtgcatatccaaggtcaacctttccgggcccacaaggctgtccttgcagcaagcagtccttatttcagggatcactctgcgctcagcaccatgagcggcctttctatttcagtgataaaaaatcctaatgtgtttgaacagctattaagcttttgttacaccgggcggatgtctctgcagttgaaggatgtggttagttttttgacagccgctagctttctgcagatgcagtgcgtgatcgataagtgcacacagattttagaaagtattcatagcaaaatctcagttggagatgtggactctgtaactgtcggcgctgaagaaaacccggaaagcaggaacggggtgaaagacagttcgttctttgccaatccagtcgaaataagccccccttattgttcccagggtcgtcaaccaactgcctcatccgatctgcggatggagactactccctctaaagcactccgttctcgcctccaggaagagggccatagtgatagggggagtagcggatccgtttccgaatacgaaatccagatagagggcgaccatgagcagggggatctgcttgtccgggaatctcagataacagaggtgaaggtcaagatggagaaaagtgaccggccctcatgttcagatagctcttcactgggagacgatggttatcacactgagatggtcgatggggagcaagtagtggccgtcaacgtggggagctacgggtcagtgcttcagcatgcatacagttactcccaggcagccagccaaccgacgaacgtgtccgaggcttttggatctctatctaatagttctccgtccagaagtatgctgtcatgttttcgggggggcagggctcgacagaaacgagctctgtctgtccacctccactccgatctgcagggactggtacaggggtcagattctgaagcgatgatgaataaccccggctatgaaagttcacctcgagagcgatctgcaagaggccattggtatccttacaacgaacggctgatttgcatttattgcggaaagagcttcaaccagaaaggttccttagaccgccatatgaggctgcacatgggcataacgcctttcgtctgtaagttctgcgggaagaagtatactaggaaagatcagctcgaatatcacatcagagggcacactgacgacaaaccgtttcgctgtgaaatctgcggaaagtgcttcccttttcagggaacacttaaccaacacctgaggaagaaccacccaggagtcgccgaggtgcgctctcgcatcgagtctcctgaaaggaccgatgtctatgtcgagcaaaagctcgagaatgatgctagcgcttctgaaatgggcctggactctcgtatggaaatccacactgtctccgatgcccccgattag

SEQ ID NO: 140960 - DNA, 1503 bp, Artificial Sequence
  Description of Artificial Sequence: Synthetic coding sequence
atggattcatccagttttattcagtttgatgtgcccgaatactccagtacagtgctgtcccagctaaatgaactgcggcttcaggggaagttgtgcgacatcatcgttcacatacagggccagcctttccgggcacacaaggccgtgctcgcggcctcctcaccctatttcagggatcatagtgcactctccacgatgagcggactgagcatcagcgtgatcaagaatcctaatgtttttgagcagctcttaagcttttgctacaccggacgaatgtccctgcagcttaaggatgtcgtgagcttccttactgctgcctcctttctgcaaatgcagtgcgttattgataaatgtactcagattctggaatcaattcattccaagattagcgtaggggacgtcgactccgttacggttggcgctgaagaaaatccggagagcaggaatggggttaaggatagtagtttttttgcaaatccagtagaaatctcgccaccatactgttctcagggcagacagcccaccgcttcctccgacctgcgcatggaaaccactccaagcaaggcactccgctcccggctgcaggaagagggccattccgaccgcggctcgagtggcagcgtttcggaatacgagatccagatcgaaggagaccatgaacagggagaccttctcgtcagggagtcacagataaccgaggtcaaggttaagatggagaaatctgaccgaccaagttgttccgattcatcttctctgggagatgacggctaccacacggagatggtggatggcgagcaggtggtcgccgtcaacgtgggatcctacgggtcagttttacagcatgcctactcatactcccaagccgcctctcagcccactaacgtctccgaggccttcggaagcttgtccaacagttcccctagccgctccatgttgagttgttttcgggggggcagggccaggcaaaagcgcgccctgtctgtgcacctgcactctgacttacaggggctggtgcaagggtccgattccgaggccatgatgaacaatcccggatatgagtccagcccccgggaaagaagcgctcgcggacactggtacccttataacgaacgcctgatttgcatctattgtggtaaaagcttcaatcagaaaggcagcctggatcgccacatgagactccatatgggcattaccccgttcgtctgcaaattctgcggaaaaaaatacacacgcaaagatcagctcgagtatcatatacgtgggcacactgatgacaaaccctttcggtgtgaaatctgcggcaaatgcttcccattccagggtaccctcaaccagcatctccgcaagaatcatccgggagtcgccgaagtaagatctagaatcgagagtcctgagaggaccgacgtttatgtcgaacaaaaactggagaatgacgcaagcgccagtgagatgggattggactcaagaatggagatacacacagtgagcgatgctcctgactag

SEQ ID NO: 140961 - DNA, 3591 bp, Artificial Sequence
  Description of Artificial Sequence: Synthetic coding sequence
atgatgactgttatgtcgttatctcgagatctgaaagacgatttccattccgatacagtgttgagcatcctcaatgagcaacggatccgcggcatcttatgtgatgtgacgattatcgtggaagatactaaatttaaagctcatagtaatgtgctggcggcctcttcactgtattttaaaaatatattttggtctcacactatctgcatttcatcccacgtgttggagcttgatgacctgaaagccgaagtgttcactgagatcctcaactacatatactcttccacagttgtggtcaagcggcaggagacggtgacggatcttgccgccgccggaaagaagcttgggatctcctttctggaagacttgactgatagaaacttcagtaattcccccgggccctacgttttctgtatcaccgaaaaaggagtagtgaaagaggaaaagaatgaaaaaagacacgaagagcctgcgattaccaacggccctagaatcacaaatgcattttctatcatcgaaactgaaaactccaataacatgttctcaccattggatctgcgagcatcatttaagaaggtgagcgatagcatgaggacagcttctctttgtcttgagcggacagatgtatgtcacgaagctgagcctgtgcggaccctagccgagcattcgtacgccgtgtcaagtgtcgccgaggcgtacagaagccaacctgtccgggaacatgacggctcaagccccggtaacactggaaaagagaactgtgaggcgttggccgctaagcccaagacatgtagaaaaccaaagaccttcagcatcccgcaggatagcgattccgccacagagaacatcccccccccacccgtctccaatctcgaggtcaaccaggaacggtcaccgcaaccagccgcggtgctgaccagaagcaagagtccaaacaatgagggagatgttcactttagccgggaggatgaaaaccagagttccgacgtccctggcccccccgccgctgaggtgccgccgctcgtatacaactgttcgtgctgtagcaaggcgttcgattcatcgacactgctatccgcccacatgcaacttcataagccaacccaggaaccccttgtttgcaaatattgtaacaagcaatttaccactctgaaccgcttagataggcacgaacagatatgtatgcgctcttcccacatgccaatcccaggcggtaatcagaggttcttagagaattaccctactattggacagaatggtggatcgttcactggacctgagcccctgctctctgaaaacagaatcggcgaattcagctccaccggatccactctcccagacacggaccatatggtaaaatttgtcaatggtcagatgttgtactcctgtgtggtatgcaaaagatcttatgtcaccctatctagtctgaggcgccacgccaacgtccattcatggcgaagaacatacccttgtcactattgcaacaaggtgttcgctctggcagagtatcgaacccgccacgaaatctggcatactggcgagaggagatatcagtgcatcttctgcctggaaacttttatgacctattatattcttaaaaaccaccaaaaatcgtttcacgccatagaccataggctgtcaatctcaaagaaaaccgcaaatggcggcctgaaaccgtccgtttacccttataaattataccgtctcctcccaatgaagtgcaagagagccccatacaagtcttatcggaattcctcatatgagaatgctcgagaaaactcccagatgaacgagtccgcgccaggtacctatgtcgtgcagaacccacactcctctgagcttccaactctcaatttccaggatacagtgaatactctgaccaattcacctgcaattcctctagaaacttcagcatgccaggacattccaacatccgccaacgtccagaatgctgaggggacaaaatggggcgaagaggcactgaagatggatctggataacaacttttattctacagaagtttctgtgtcctccacagagaacgccgtgagctccgacctgagggcgggcgacgtgcctgttctttcactgtccaactcctctgagaatgcggcgagcgttatctcatatagtggttcagctcctagtgtgattgtgcattcttcccagttcagtagtgtgataatgcactccaacgcaattgccgcgatgacaagttccaaccatcgggcctttagcgaccccgccgtctcacagtctctaaaagatgactccaagccagagccagataaggtagggaggtttgcctcacgacctaaatcaataaaggagaaaaaaaagaccacttcacacacaagaggggaaatccccgaagagagtaattacgtggccgaccctggcggctccctttcaaagaccaccaatattgccgaagagacctccaaaatcgaaacatacatcgctaagccagcgttgcccgggacctccacaaacagtaatgtagcccctctgtgccagatcaccgtgaagattgggaatgaagccattgtcaaacgacatattctcggcagcaagctcttctacaagcgaggaagaagaccaaagtaccagatgcaggaagagccactgcctcaggggaacgatcctgagccttcaggcgattccccactgggcctttgccagagcgagtgcatggagatgagcgaggttttcgatgatgcgtcggaccaggatagcactgacaagccgtggcgaccatactacaattataagccaaaaaaaaaaagtcggcagctgaagaaaatgcggaaggttaattggagaaaggaacacgggaaccgatctccaagccacaagtgcaaatatcccgcagaactagactgtgcagtggggaaggcaccacaggacaaaccatttgaggaagaggagactaaggaaatgcctaaactccaatgtgagctgtgcgacggcgataaggcggtgggcgccggtaaccaggggagaccccatcgtcacctaacctcccgcccatatgcgtgtgagctctgtgctaagcagttccagtcaccttccactctgaagatgcacatgagatgtcatactggagagaaaccttaccaatgcaaaacctgcggccggtgtttttcagttcaaggaaaccttcagaagcacgaacgaatccacctgggtctgaaggaattcgtgtgtcagtactgtaataaggcatttacactcaatgaaacactaaagattcatgagcgaattcacacgggagaaaaacgataccactgccaattttgcttccaaagattcctctacctgtctacaaaaagaaaccacgagcagcgccatatccgtgagcacaacgggaaaggctatgcatgtttccagtgcccaaaaatctgcaaaacggcggcggcactgggcatgcatcaaaagaagcatctttttaaatcgccatctcaacaggagaagatcggggacgtatgccatgagaattccaaccctctggaaaatcagcactttatcggttccgaggataatgaccagaaggacaacattcagactggggtcgagaatgtcgtgctgtag

SEQ ID NO: 140962 - DNA, 3588 bp, Artificial Sequence
  Description of Artificial Sequence: Synthetic coding sequence
atgactgtcatgagtctttctcgggacctgaaagacgattttcacagcgacacagtcctgtctatcttgaatgaacagagaattcggggaattctgtgcgatgttactatcatcgtcgaggatacaaagttcaaggctcactctaacgtattggcggcctctagtctctatttcaagaatatattttggtcacataccatctgtatctctagccacgtgctggagctcgatgatctgaaagcggaggtatttactgagatactgaactacatttactcttcgacggtggtagtaaagaggcaggagactgtaactgacctggccgccgcggggaagaaactcggcatttcattccttgaggacctgactgatagaaacttctccaattcacctggaccctacgtattctgcataacagagaaaggggtggtgaaggaggagaagaatgaaaaaagacatgaagagccggccattactaatggcccacgcattactaatgcattctctatcattgaaactgagaacagcaacaatatgttttcaccgctggatcttagagcatcttttaagaaggtgtcagacagtatgaggactgcctccctgtgcttggagcgtacggacgtgtgtcacgaggcggagcccgtgcgtactctagccgagcattcctacgctgtgagtagcgtcgctgaggcataccggagtcagcccgtgcgggagcacgatggctcgtcacccggcaatacgggaaaggagaattgtgaagccttggccgcaaagcccaaaacgtgccgaaagcccaagacctttagtattccccaggatagtgacagcgccacagagaatatacccccccctccagtcagcaacctggaggtgaatcaggagagatctccccagcctgctgcagttctcacaaggagcaagtcccccaataatgaaggcgatgtgcacttctcaagagaggacgaaaatcagagtagcgacgtgcctggcccccctgctgctgaggttcccccactggtttataattgctcgtgctgttccaaagcctttgatagcagtaccctgcttagcgcgcatatgcagcttcataaaccaacacaagagccccttgtgtgcaaatactgcaacaaacaattcactacgcttaacagactggataggcatgagcaaatctgcatgcggtcgagtcacatgcctatacctggagggaaccagcgattcttggagaactatcccactatcgggcagaacggtggatcatttacaggccccgaacccctgttaagcgagaaccggattggggagttctcttctaccgggagcaccctgcccgacaccgaccacatggtcaaatttgtgaacggtcagatgctttactcttgtgttgtctgcaagcgcagctacgtgacactgtctagcctacgccgacatgcaaacgtgcattcttggcggaggacttacccctgccactactgtaacaaggtgttcgcgctggccgaatataggacacgccacgaaatatggcataccggagaacggagataccagtgtattttctgtctggaaacctttatgacttactatatcctgaagaatcatcagaagagcttccacgctattgaccatcgtctttccatttccaagaagactgcaaatggagggttaaagcctagtgtgtatccatataagttgtatcgtctgttgcctatgaagtgcaaaagagctccatataagagctaccgcaatagttcatatgagaatgcccgcgaaaacagtcagatgaacgaaagtgctcccggaacctacgtggtccagaatcctcattcatctgagttgccaactctaaatttccaggacacagtgaatacactgactaatagtcctgctattcctctggaaacctcagcctgtcaggacatccctacctccgccaacgtgcagaacgccgaaggcactaaatggggcgaagaagcgctgaaaatggacctggataacaacttctacagcactgaagtttctgtgtcaagcactgaaaatgccgtgtcctccgacttaagggccggcgatgttccggtcctatctttaagtaactccagcgaaaacgccgccagcgtaatatcttatagtgggtccgcacccagcgtgattgtgcacagctcacagttcagtagcgttatcatgcattcgaacgcgatcgccgctatgacctcctctaatcacagagctttctcagatccagccgtaagtcaaagcctcaaggacgacagtaaacccgaaccagataaagtgggtcgcttcgcttcgcggccgaaatccatcaaggagaagaaaaaaactacatctcacacaaggggtgagatccctgaagaaagtaactatgtggccgacccaggcggcagtctgagtaagacaacaaatatcgcagaggagacaagcaagatagagacatacatcgcaaagcccgcgctcccagggacctctactaacagcaacgtggctcccttatgccaaattactgtgaagataggtaacgaggctattgtgaagaggcacatcctggggtcgaagttgttctacaaaagaggccggagacctaagtaccagatgcaggaagagcccctacctcagggcaatgatccagagccaagtggagacagccctctgggcctttgtcagtccgagtgcatggagatgagcgaagtcttcgacgatgccagcgaccaagattcgacggataagccgtggcggccatattacaattataagccgaaaaaaaagtccagacaactgaaaaaaatgcgaaaagttaattggcgcaaggaacatggcaacagaagtccctcacacaaatgcaaatacccggccgaactggattgcgcagtgggaaaagcgccccaggataaaccattcgaagaggaggagaccaaagagatgcccaaacttcagtgcgagttgtgtgatggggacaaggctgtgggggcaggaaaccaggggagaccccacagacacctcacttctagaccctacgcttgcgaattgtgtgcaaagcagttccagtcaccgtccactctgaagatgcatatgagatgccatacaggggagaagccataccagtgtaagacatgcggtcgctgctttagcgttcagggcaacttacagaaacacgaaaggattcatctggggcttaaggagtttgtgtgtcaatactgcaacaaagcattcacattgaacgaaaccctgaaaattcatgaaagaatccatactggagagaaaaggtaccattgccagttttgcttccaaaggtttctatacttgtcgacaaaacgcaatcacgaacagcggcacattagggagcacaacggcaaaggatatgcttgttttcagtgccccaagatttgcaaaaccgccgcagcactgggcatgcaccagaagaagcatctttttaagagtcccagccagcaggagaaaatcggagatgtgtgtcatgagaatagtaaccctctggaaaatcagcatttcatcggctcagaggacaacgatcaaaaggacaacattcagacaggagtggaaaatgtcgtgttgtag

SEQ ID NO: 140963 - DNA, 105 bp, Artificial Sequence
  Description of Artificial Sequence: Synthetic coding sequence
atgaccgttatgtccctctctagagaccttaaggacgactttcattcagacacggtgctcagcatcttgaacgaacagcggatcagaggcattctgtgcgactag

SEQ ID NO: 140964 - DNA, 285 bp, Artificial Sequence
  Description of Artificial Sequence: Synthetic coding sequence
atgacagtgatgtccctcagccgagacctcaaggacgattttcattccgataccgtgctctccatcctgaacgaacagcggattcgcggcattctctgcgacgtcacaataattgtcgaagatacgaaatttaaggctcacagtaacgtgctagcagcctcctctttatatttcaaaaacattttctggtcacatactatttgtatttctagtcacgtgttggaacttgatgacttgaaggcggaggtgtttactgagattctaaactacatttattcaagctag

SEQ ID NO: 140965 - DNA, 357 bp, Artificial Sequence
  Description of Artificial Sequence: Synthetic coding sequence
atgacagtcatgtccctcagccgcgatcttaaggatgactttcacagtgatactgtcctttccatactaaacgagcaacggattagagggatcttatgtgacgtgaccatcattgtggaagacacaaagttcaaagcacatagtaacgtcctcgccgcatcctcactgtacttcaaaaacattttctggagccacaccatctgtatctcatctcacgtcctagagctggatgacctgaaggccgaagtatttaccgagatcttgaactacatctattcttctactgtcgttgttaaaaggcaggaaactgttacggacctcgctgctgcaggtaaaaaactgggcatctctttttag

SEQ ID NO: 140966 - DNA, 336 bp, Artificial Sequence
  Description of Artificial Sequence: Synthetic coding sequence
atgacagtgatgtccctgagtagggacctgaaagatgatttccactcagacactgtgctgtctatcttgaacgagcagcgaattcggggaatattatgcgatgtgactattattgtagaggatactaaattcaaggcgcacagcaatgtgctggctgccagttccctctactttaaaaacatcttctggagtcatacaatatgcatctcttcccacgtactagagctggatgacctcaaagcagaggtgtttacagagattctaaattacatatattcaagcactgttgtagttaagagacaggagactgtgacagatttggccgcagctggatag

SEQ ID NO: 140967 - DNA, 453 bp, Artificial Sequence
  Description of Artificial Sequence: Synthetic coding sequence
atgactgtcatgtcgctgtcacgggacttgaaagacgatttccactccgataccgttctctccatcttgaatgagcagcggattcggggcattctgtgcgatgtgacaataatagttgaagacaccaaattcaaggcacacagtaacgtcctggccgccagcagtctgtacttcaaaaatatcttttggagccataccatatgcatctcctcccacgtgctggaactggatgacctaaaagcagaggtcttcacagagatcctgaactacatctacagtagcacggtagtggtcaaacgtcaggagacagttactgatcttgccgctgccggcaaaaagctgggaatctcatttctggaagacctgacagataggaacttctccaacagccccggtccatatgtgttctgcatcactgagaaaggtgtcgtcaaggaagaaaagaacgagtag

SEQ ID NO: 140968 - DNA, 2316 bp, Artificial Sequence
  Description of Artificial Sequence: Synthetic coding sequence
atgaccgtgatgtcactgtccagagaccttaaggacgatttccactccgacactgtgctgagcattctgaacgagcagagaatccgaggtatcctctgcgatgtgactatcattgtcgaagataccaaatttaaggcccactctaacgtgttggcggcatcttccttgtactttaagaacatcttttggagtcacacaatctgtattagctcacacgtcttagagctggatgaccttaaggccgaggtgtttaccgaaattttgaattatatctactcatccacagtggtggtcaagaggcaggagacggtgacagatctggcagctgccgggaagaaactgggcatttcctttctggaagatctcactgaccgcaattttagtaatagcccagggccatatgtgttttgtatcaccgagaaaggagtggtcaaggaagaaaagaatgagaaacgacacgaagaacctgcgattaccaatggtccacggatcactaacgcctttagcatcattgaaaccgaaaatagcaataatatgttcagtcccctggacttaagggcctccttcaaaaaggtctccgacagtatgagaaccgcttctttatgtttggaacggacagatgtctgccacgaggctgaaccggtgcgcactctggccgaacacagctacgcagtgtcatcggtggccgaggcataccgaagccaacctgtgagggaacacgacggatcatccccagggaacactggaaaagagaactgcgaggctctggcagcaaaacctaagacctgccgcaagccaaagactttcagcattccccaagactccgacagcgctacagaaaatatacccccacctccggtttctaatcttgaggttaaccaggaacggagcccccagcctgcagctgtcctgacaaggtctaaaagccctaacaacgaaggagacgtacatttctcccgcgaggatgaaaatcaatcatccgacgttccggggcctccagccgcagaggtcccaccactcgtatataattgttcatgttgctctaaggctttcgattcttcaaccctgttaagcgcgcacatgcagttacataaaccaactcaggagcccctggtgtgtaaatactgcaacaaacagtttaccacgctgaataggctagatagacacgagcagatatgcatgcgtagctctcacatgcccattccgggtggcaatcagcggttcttagaaaattatccaacaatcgggcagaacggtggcagctttaccgggcccgaaccattactgagtgaaaatcggataggggaattcagctccacagggagcacattgccagataccgaccatatggtcaagttcgtcaatgggcaaatgctttactcctgcgtagtgtgcaaacggagttatgtgaccttgagttctctccgcaggcatgcaaacgtgcattcgtggcgcaggacctatccttgtcattattgcaacaaggtgttcgcgctagcagagtaccggaccaggcacgagatttggcatactggcgaaagacgctaccagtgcatcttctgcctggaaacattcatgacatactacatcctgaagaaccatcagaagtcttttcacgccattgaccaccgcctttcgatatctaaaaagacagccaacggtggactgaaaccttccgtttacccttataagctatataggctactaccaatgaaatgtaagagagctccttataagtcttataggaatagttcctacgagaacgctcgtgagaactcacagatgaatgaatctgcccctggcacctatgttgtccagaaccctcattcatctgagttgccaacattgaatttccaggacacggtaaacactttaaccaattctccggccatcccattggaaacatccgcatgccaggatatcccaacctcagcaaacgttcaaaatgccgaagggacaaaatggggtgaagaggccctcaaaatggacctggacaacaatttctattccaccgaggtgtctgtcagctcgaccgaaaatgcagttagcagcgatctgcgcgccggggacgtcccggtactgtctctttcgaactcctctgaaaacgcagctagcgttatctcctacagtggttctgccccctctgtgattgtccattcatctcagttctcttccgtgatcatgcactctaatgctatcgctgctatgacgtcttctaatcaccgcgcgttcagcgacccggctgtatcacaatctctgaaggacgatagcaagcccgagccagacaaggtgggcaggttcgcttcacgcccctag

SEQ ID NO: 140969 - DNA, 441 bp, Artificial Sequence
  Description of Artificial Sequence: Synthetic coding sequence
atgaccgtgatgtctctgtctcgggatctgaaggatgacttccatagtgacacagttctgagcattttgaatgagcagagaattagaggaattctttgtgacgtcactatcatagtggaagataccaaattcaaagcccattcaaacgtgcttgctgcaagcagcctgtattttaagaatatcttttggagccataccatctgtatctccagtcacgtgctcgaattagatgacttgaaggccgaagtttttacggaaatcttaaattacatctacagcagcaccgttgtggtgaagcgccaggagacggtaacggaccttgccgccgcgggaaagaagctgggcatttcattcctggaggatttgactgacaggaatttctccaactcacccggcccctacgtgttttgtatcactgagaagggagtggtaaaggagtag

SEQ ID NO: 140970 - DNA, 633 bp, Artificial Sequence
  Description of Artificial Sequence: Synthetic coding sequence
atgactgtaatgtccttatcaagagacttgaaagatgatttccatagcgacaccgtgctgagcatcctcaatgaacaacggattaggggcatcttatgcgacgtcaccataatagtagaagacacgaagtttaaagcccattccaacgtgctcgccgcctctagcttgtacttcaaaaatatcttctggagccacactatttgtataagtagccatgtgctggagctcgatgacctgaaagccgaggttttcacggagatcctcaattatatttacagctcaacagtcgtggtgaagagacaagagaccgtgacagacctcgctgcagctggaaaaaagttgggaatcagcttcctggaggacctgactgacaggaattttagcaactccccgggaccctatgtattctgcatcaccgagaagggcgtcgtgaaagaggaaaagaacgagaaacggcacgaagaaccagcgatcacaaatggtcccagaataaccaacgcattctcgatcatcgaaacggaaaacagcaataacatgttttcccctctggacctgagagcttcttttaaaaaggtttctgactcaatgagaactgcgagcctttgcttggaaaggacagatgtttgtcactag

SEQ ID NO: 140971 - DNA, 327 bp, Artificial Sequence
  Description of Artificial Sequence: Synthetic coding sequence
atgacagtcatgtcactgtctagagacttgaaagatgattttcacagcgacaccgttttgtctatcctcaatgagcagaggatccgcggcatcctatgcgacgtgactatcatagtagaagacactaagtttaaagctcatagcaatgtactggccgcctcctctctatattttaagaacatcttttggtcccataccatctgtatctcgagtcatgtccttgaactcgacgatctcaaggctgaagtgttcactgaaatcctgaactatatatatagctctacggtggtagtgaaaagacaggagactgttaccgatctcgcttag

SEQ ID NO: 140972 - DNA, 213 bp, Artificial Sequence
  Description of Artificial Sequence: Synthetic coding sequence
atgaccgttatgagcctcagcagggatctcaaagatgacttccactcggacactgtgctgagtatcctcaatgagcagcgcattcgcggaattctctgcgacgtcacaatcatagtcgaggatacgaaattcaaggcccactcaaatgtgctggcagcaagcagcctgtatttcaagaacatattttggagccatacaatatgcatctcatag

SEQ ID NO: 140973 - DNA, 3588 bp, Artificial Sequence
  Description of Artificial Sequence: Synthetic coding sequence
atgactgtgatgtctcttagccgcgatcttaaggatgatttccacagtgacaccgtgctgtcaattctgaatgaacaaagaatccggggaatactctgtgatgtgaccatcatagttgaagacacaaaattcaaggctcactctaatgttctcgcggcttcttccttgtattttaagaacatcttttggagtcatactatatgtatctcaagccatgtgttggaacttgatgatctcaaggcagaagttttcaccgagattctcaactacatctattcttccacagtggtggtgaaacgccaggagaccgtaacagacctcgcagccgccggcaaaaaactggggatatccttcctggaagatctcaccgaccgcaacttcagcaacagcccaggaccttatgttttttgcatcaccgagaagggcgtggtgaaggaggaaaagaatgagaagagacatgaggaacccgcgattactaatggaccccgtattacgaacgccttcagcataattgagacggagaactccaataatatgtttagcccactcgatcttagggcctcctttaagaaagtgagcgacagtatgcgcacagcatccttgtgcctggaaagaaccgatgtctgtcacgaagccgagccagtgcggacattagctgagcactcctatgcggtgagctcagtggccgaagcttataggtctcagccggttcgagaacatgatgggtcttcacctggcaataccgggaaggaaaactgtgaagcgctggcagcaaagcctaagacctgtcgtaaaccgaaaaccttcagtatcccccaggactctgattccgcgaccgagaacattcctcctccacctgtgtcaaacctcgaagtcaaccaggaacgaagtccgcagcccgccgctgtgctgacaaggtctaaaagccctaacaatgagggcgatgtgcattttagccgagaagatgagaatcagtcaagcgacgttcccgggccccctgcagctgaagtgcctccactggtgtacaactgctcttgctgctctaaagctttcgactcttcaaccttactttctgcgcacatgcagctccataaaccaacacaggagcccctggtgtgtaagtactgtaacaaacagttcaccaccctgaaccgattagaccgccatgaacagatttgcatgagaagcagccacatgcctatccccggcggaaaccagaggttcctagagaactaccccacaatcggccagaatggtggatcttttacaggacccgaaccactactctcagagaatcgaatcggggaattttcatccacggggtccacattgccagacacagaccatatggtcaagtttgtcaatggacagatgctgtattcctgcgtagtctgcaagcgctcatatgtcaccctttcttcgctgcgccgccacgccaacgtccactcatggagacgtacttacccctgccactattgcaataaagtgttcgccctcgccgaataccgtacacggcatgagatatggcacaccggcgagagaaggtaccagtgtatattttgcctggagactttcatgacctactatatactgaaaaatcaccagaaaagcttccatgccattgatcaccggctgagcattagcaagaaaacagcgaatggcgggctgaaaccctccgtctatccctataaactgtatcggcttctgcccatgaagtgcaaacgcgcaccgtacaagtcatacaggaactcaagttatgaaaacgctagggagaatagccagatgaatgagagcgccccgggcacttatgtcgtacagaatcctcacagcagcgaacttcctaccctgaactttcaggacaccgttaatacgttaactaatagccccgcaatcccacttgaaacctccgcctgtcaggatattcccaccagcgccaacgtccaaaacgcagaaggtacaaagtggggtgaagaggctctgaagatggatttagacaacaatttctattccacggaggtgtccgtgagcagtacggagaacgccgtgtcctccgatttacgcgcgggggacgtgcccgtactgagcctaagcaactcttctgagaacgctgctagcgtgatctcttattccggttctgccccaagtgttatcgtccattctagccagttttctagcgtgatcatgcattctaacgctatcgcagccatgacttcaagcaatcaccgagcatttagtgatcctgcagtatcccagagccttaaagacgactccaagcccgagcccgataaagttggtagattcgcctctagacccaagtccatcaaggaaaagaaaaaaaccacaagtcacactcgaggtgaaatcccggaagagtctaactatgtggctgaccctggcggctccctgtctaaaactacaaatatcgctgaggaaacctcaaagatcgaaacatatattgcaaagcccgcgttacccggcacttctaccaattccaacgtggcaccactgtgtcagatcacagtcaaaattggcaatgaggcaatcgtcaaacgtcacatcctgggaagcaaacttttctataaaagaggtcgccggccaaagtatcagatgcaagaggagccccttccacaaggaaacgaccccgagccttccggcgattcgccactgggtctctgtcagtctgagtgtatggagatgtctgaggtgtttgatgatgcttccgatcaggacagcactgataagccctggagaccctattataattataagccaaagaagaagagccggcagctgaagaagatgaggaaagtgaactggcgcaaggagcacgggaaccggtctccatcacacaagtgtaaatacccagccgagctagattgcgccgttggtaaggcaccccaagataaacccttcgaagaggaggaaaccaaggagatgccgaagcttcagtgcgaactatgcgatggcgataaagctgtcggcgccggcaaccaaggaagaccacatcgtcacctcaccagtaggccttacgcatgtgagctgtgcgctaagcagttccagagcccaagcactctgaagatgcacatgcggtgtcatacaggtgagaagccctaccagtgcaaaacatgcggccgctgcttctcagttcaaggaaacttacagaagcatgaacgcatccatctcgggttgaaggaattcgtgtgccaatattgtaacaaggctttcactcttaacgaaaccctcaaaatccacgagcgcattcatactggcgagaagcgctaccactgccaattctgcttccagaggtttctttacttgtctacgaagaggaaccacgagcagcgtcacatacgcgagcacaacggcaagggatatgcctgttttcaatgccccaagatatgtaagactgctgctgcactggggatgcaccaaaagaaacacctgttcaaatctccatcgcagcaggaaaagattggagatgtgtgccacgaaaactccaatccattggaaaatcagcatttcattggcagcgaggacaatgaccagaaggacaatattcagactggggtcgagaacgtggttctctag

SEQ ID NO: 140974 - DNA, 3042 bp, Artificial Sequence
  Description of Artificial Sequence: Synthetic coding sequence
atgcctcctcccgcggaagttacggatccatcacatgcacctgctgttcttagacagctgaatgagcaaagattgcgaggcctcttttgcgatgtgactttaattgccggggacaccaagtttcccgcgcaccggtctgtgttggctgctagctcgccctttttcagggaggcccttctgactagcgctcctttgcccttgccgccagccaccggaggcgctgcccctaatcccgccactaccacagccgcttcatcttcctcttcaagctcctcgtcttccagctcctcttcaagttctgccagttctagcagttcgagtagttcctcctcccctcctcctgctagtcctcccgcctcatcacctcctcgcgtcctcgagctgcccggggtcccggccgcggctttctcggatgtcctgaactttatctatagcgcgcggttggctctcccaggaggagggggtgacggcgccgcagttgctgagatcggcgctctgggacgaagactcggcatcagtagactgcagggcctgggtgagggcggagatgcctgggtcccacccaccccagctccaatggctaccagtcagccggaagaagactcattcggtcccggcccacgcccagcaggagaatgggagggggatagagctgaggcccaggcgcctgacttacaatgcagtcttccccgcaggccactcccttgccctcagtgtggtaaatcgtttattcatcctaagcggctgcagactcatgaggcccaatgtaggcggggagcatcaacacgggggtctactggtctcggcgctggcggggcaggcccaggtgggcccgctggtgtcgacgcgagtgccctgcctccccctgtgggattcaggggcgggccagagcacgtggtgaaagtagtggggggacacgtcctctacgtctgtgctgcgtgcgaaagaagctacgtgacccttagttctctgaaaaggcattctaatgtgcacagctggcgtaggaagtatccatgccgttactgtgaaaaagtgtttgcattagctgagtacaggacgaagcatgaggtatggcacacgggggagcgtagatatcagtgcattttctgttgggagactttcgtaacctactataatctcaaaacacatcagcgggctttccatggaattagccctggcttgctggcttctgagaaaaccccaaatggcggatacaagcccaagctgaacacccttaagttgtatcggctgctgcctatgcgggccgccaaaaggccctacaagacctattctcagggtgcacctgaggcgccccttagccctaccttgaacactcctgcacccgttgccatgccagccagtcccccacctgggcctccacccgcccccgaacccgggccacctccatctgtgataactttcgcccaccctgcaccaagcgttatcgtgcatggcgggtctagtagtgggggagggggaagcgggacagcgtccactggcgggtcgcaggctgccagcgtgattacatatacagcccctccccgtccacctaagaagcgagagtaccctcccccgccccctgaaccggctgctacacccacatcccccgccaccgcagtttccccggccacagcagctggaccggccatggcgaccacaactgaggaagccaaaggtcgaaaccctcgagctgggcggaccttgacctataccgccaagccagtagggggaatcggtggcggcgggggacctccgactggtgctggaagaggccctagtcagctacaggctcccccacccctctgccaaatcaccgtgcggattggggaagaagccatcgtgaagaggaggattagcgaaaccgatctccgaccaggcgagcttagtggtgaggaaatggaagagtctgaagaagatgaggaggaggaggacgaggaagaggaggaggaagacgaggaggagagcaaagcaggtggtgaggatcagctgtggagaccctattactcatataagcctaaacgaaaggccggggcagccggtggcgccagtgtcgggggcagcgggctgcctcgggggaggcgaccaccccgttggcggcagaagcttgaaaggcgtagctgggaagagacccctgccgccgagagcccagccggaagagctcgcacggagcgtagacacagatgtggggattgtgcacagacattcaccaccctgcgtaagttgaggaagcaccaggaggcccacggcggtgggtctcactcaagcagagctgggcgccgccctagcacccggttcacatgtccacactgtgcaaaggtatgcaagacggcggccgccctctctagacacggtcagagacacgccgcagagcggcccggcggtacaccaacccctgtgattgcatatagcaagggctcagccggcacccgcccaggcgatgtgaaggaggaagcccctcaggaaatgcaagtttctagcagcagcggagaggctgggggcggaagcactgccgccgaggaagcatccgagaccgcctccctgcaagatcccatcatatcaggcggggaggagcctccagtcgtggcctcaggggggtcttacgtgtacccacccgtccaggaattcccattagcattgattggaggaggcagggaacctggggggggtagaggaaagagcggatctgaggggcctgtgggagccggtgaaggcgatcggatggaagggataggagctgccaaggtcacattttatcccgaaccctaccccttggtgtacggcccccagctgctggccgcctatccctataatttctctaatctagcagccctgcctgtggccttaaatatggtgctacccgatgagaagggcgccggagctttgccattcttgccaggcgtgtttggctacgcagtgaatcctcaagccgctcctcccgcaccccccaccccaccgccaccgacacttcccccaccaattcctccgaaaggcgagggtgaaagagcaggcgtggaacgtacccagaaaggggatgttggctag

SEQ ID NO: 140975 - DNA, 3042 bp, Artificial Sequence
  Description of Artificial Sequence: Synthetic coding sequence
atgcctcctccagcagaggtaaccgacccaagtcatgctcctgccgtgcttcggcagctgaatgaacagcgcttgcgcggccttttttgtgacgtgaccctgatcgccggggatacaaagttccctgcgcatcgatctgttctcgccgcctcctccccctttttcagggaggccttgcttacatcggcgccattgcctcttcctcccgccacagggggggctgctccaaatccagctaccacaaccgctgcttcttcctctagctcttcatccagtagtagtagctcatcctcatcttccgcatcatcgtccagttctagctcctcgagctcccccccgcctgcctctccacctgcctctagccccccccgcgttcttgagctgcccggcgttcctgcagcagctttctccgacgtgcttaacttcatttacagcgctcgtttggccttgcccggaggtggaggtgatggcgcagcggtggcggagattggcgcactcggtagacgtctgggtatctcccggctacaaggactcggtgagggcggggatgcttgggtgccccctacccctgctcccatggctacatctcagccggaagaagattctttcggcccggggccccgaccagcaggcgagtgggaaggagatcgcgcagaggcccaggcgccagatttgcagtgctctctcccacgccggcccttaccttgtcctcaatgcgggaagtcatttatccaccctaaacgactgcagacccacgaggctcagtgccgaagaggcgcatccacaagaggatccacgggattaggggccggtggggccggacctggaggccctgccggggtcgatgcaagcgcccttccaccacctgtggggtttaggggcggccccgagcatgtggttaaggtggtcggaggtcacgttctatatgtttgtgcggcctgcgagaggtcatacgttacgttgtcaagcctcaaacgccatagtaacgtccactcctggcgccggaagtacccgtgtcgctattgcgaaaaggttttcgcactggctgaataccgaaccaagcacgaggtgtggcacaccggagaacgaagataccagtgcatcttctgttgggaaacatttgtaacatactataacttgaaaacccaccaacgtgctttccacggcatttcgccaggtctgctggcctcagagaaaacccccaatggtgggtacaaacctaaactcaacacccttaaactctatcgactgcttcccatgcgtgctgctaagcgtccttataagacatactcccaaggcgcccctgaagcgccgctctcccctaccttaaacacccctgcacctgttgccatgcccgcctcacccccaccagggccacccccagcccctgagccaggaccccctccctctgtcattacattcgctcaccccgccccttctgttatcgtgcacggcggcagctcaagcggcggtggggggagtgggactgctagcacagggggatcgcaggctgccagtgtgatcacctacacagcacctccaaggccacccaagaaacgggagtatccgcctccgcctcctgagccagcagctaccccgacatcgcccgctaccgcagtgagtccagctaccgccgccggcccagcaatggctacaacaactgaagaagcaaaagggcgtaatccgcgggccggccggactctgacatacaccgcaaagccagtgggtggcattggaggtgggggaggtccacccactggtgccggacgagggccttcacagctgcaggctcctccacccctctgtcagatcaccgtgagaataggcgaagaggcgatcgtgaaacggcgcatatccgagaccgacctaagaccaggcgagctctccggggaggagatggaggaatcagaggaagacgaagaagaagaggatgaagaagaagaagaagaagacgaagaggagtctaaggctggaggcgaggaccagctatggagaccatattactcatataaaccaaagcgcaaggcgggagcggccggcggtgcctcagtggggggaagtgggctgcctcggggaaggcgaccacctcgatggagacagaagctggagagacgctcctgggaggaaaccccagccgctgaatcccctgcggggagagctaggactgagcgtcgccatagatgcggggattgtgcccaaaccttcacaacactgagaaaactgcgcaagcaccaagaagcacacggagggggatctcactctagccgggccggaagacgtcctagcacacgctttacctgtccacactgcgcgaaggtatgcaaaacagcggctgctctctcccgacatggccagcggcacgcagcagaacgccccggtggaacaccaactcctgtgattgcctattctaaaggcagcgcaggaaccaggcccggcgacgtgaaggaggaggccccacaggaaatgcaggtttcaagctcctccggggaggccgggggtggaagtacagccgccgaagaggcatccgaaacggcatcactccaagaccctatcatctcgggcggagaggaaccaccggttgttgcgtctggaggttcatacgtatatccacccgtgcaagaatttcccctcgccctgatcggcggcggccgggagcccggcgggggaagaggaaaaagtggcagtgagggaccagttggagcaggggagggagatcgcatggaggggatcggggcagctaaagtgacgttttatcctgaaccctaccccctggtgtacggccctcagctcctcgctgcctatccctacaatttctcgaacttggccgccttgcctgtagccctgaatatggtcctccccgacgagaagggcgccggcgccctgcccttcttgccaggtgtgtttggctacgcagtcaatccccaagccgctccgcctgcgccaccaactccgcctccccccactctgcctccaccaattccccctaaaggcgaaggcgagagagcaggtgtcgagcggactcaaaaaggtgatgtcggctag

SEQ ID NO: 140976 - DNA, 708 bp, Artificial Sequence
  Description of Artificial Sequence: Synthetic coding sequence
atggagcttccaaattattcccgccagctgctgcagcagctctacacattatgtaaagaacaacagttttgtgattgcacaatctccatcggtactatctacttccgcgcacacaagctggtactcgcggctgcgagtctgttattcaaaacactgctggataatactgacacgatcagcattgatgcatccgtcgtctctcctgaggagtttgcattgttgctcgagatgatgtacacaggcaaactccccgtgggcaagcataacttcagcaagataatcagtctggcggactccttgcagatgtttgatgtcgccgtatcttgcaaaaacttacttacatcccttcttgccgcaaccccgggcgggcctgttaaggcagagaccgaggaggccgctcactcagtttcacaggagatgagcgtcaactccccaacggcccaggagagtcaaagaaacgcagaaacccccgcggagacccccaccacagcagaggcctgttccccaagtccagcagtacagacattcagtgaagcaaaaaagaccagcacagagccggggtgcgaaagaaagcactatcagctcaactttctcctggagaacgaaggcgtctttagtgatgccctgatggttacgcaggacgtgctgaaaaagctggagatgtgtagtaactgttgcgtccctgttgaagcagtgcctatattttag

SEQ ID NO: 140977 - DNA, 3384 bp, Artificial Sequence
  Description of Artificial Sequence: Synthetic coding sequence
atggagctgcccaattatagccgccagctgctgcaacagttgtatacgttatgtaaagagcagcagttttgtgattgcaccatatccattggaaccatctattttcgcgcgcacaagctcgtcctggcagcagcctccctgctgtttaagacacttttggataacacggacacaatctcaatcgacgctagcgtagttagtccggaggagttcgcgttactcttagaaatgatgtacacaggcaaactccctgtgggcaagcataatttcagtaaaattattagcctggcagactctctgcagatgttcgacgtggcggtctcctgcaagaacctactgacctccctagtcaattgcagcgtgcagggacaagttgtgcgagacgtgtcagctccatcaagcgaaactttccgcaaagagccagaaaagcctcaggttgagattctaagctcagaaggagctggcgagcctcacagctcccctgagcttgccgctacccccggagggcccgtgaaggctgaaactgaggaagcggctcattcagtgagtcaggagatgtctgtgaatagcccgacagcacaggagagtcagcgcaacgctgagacaccagcagaaacgccgaccacagcagaagcctgttctccaagcccagccgtacagaccttcagcgaggccaagaaaacaagtactgagcctggctgtgagaggaagcactaccagctcaactttctgctggagaatgagggcgtgttttcagacgcccttatggtgacccaggacgtcctgaagaagcttgaaatgtgtagcgagatcaaggggccgcaaaaagaggtgatccttaactgttgcgaaggccgtactcccaaggaaacaatcgaaaacctgttacaccgtatgaccgaggaaaagacactgacagcagaggggttagtgaagttgttgcaggcggtgaagacaacatttcccaatcttggtttgcttctggaaaaattgcaaaagtccgctacgcttccaagtacaaccgtgcagcctagccctgacgactacggaaccgagctgttacgcagatatcacgaaaatctcagcgaaatttttacggacaaccagattctgctgaagatgattagtcatatgacttctctggcccccggtgagagagaagtgatggaaaaacttgtaaaacgtgactccgggtccgggggatttaatagtttaataagtgcagttctcgaaaagcagaccttatccgctaccgcgatttggcagctgctattggtggtacaggagactaagacttgcccccttgacctcctcatggaggagattaggagggagcccggagccgatgccttcttcagggctgttacaacaccagaacacgcaaccctggagactattctgcggcacaaccagctgatcctcgaagcaattcagcagaagatcgagtacaagctgttcacttctgaggaagagcatcttgccgagacagtcaaggagatcctgagtatcccaagtgaaacagcaagcccagaggcttcactcagagccgtcctgtccagggccatggaaaagagcgtcccagccattgagatttgccacctgctgtgttctgtgcacaagtccttccccgggctgcagccagtgatgcaggagctcgcctacatcggggtccttactaaggaggacggcgagaaggagacttggaaagtgagcaacaagtttcacctcgaggcaaataataaagaggacgaaaaagccgccaaagaagactcccagccaggagagcagaacgatcaaggagagactggctccctcccagggcagcaagaaaaagaggcgagtgcctcccctgatccggctaagaaatcattcatttgtaaggcttgcgacaagtcgttccacttctactgtcgattaaaggtgcacatgaaaagatgtagagtggccaaatcgaagcaggtccaatgcaaggagtgcagtgaaaccaaggattcaaaaaaggagctggacaaacaccagctggaggcccacggggcaggcggggagcctgacgctcccaaaaaaaaaaaaaaaaggctgcctgtaacttgtgatctatgcggcagagagtttgcacacgcttctggaatgcagtaccataaacttacggagcatttcgatgagaagccttttagctgcgaagagtgcggggcaaagttcgctgccaacagcacactgaagaaccatcttcgactgcacacgggggatagaccatttatgtgcaagcattgtctgatgacttttacgcaggcgagcgccctcgcataccacaccaaaaagaagcattccgaagggaagatgtatgcatgccaatactgcgatgccgtgttcgcgcaatcaatcgagctctcaaggcatgtgcgcacacacaccggcgacaaaccgtatgtttgccgagattgtgggaagggttttcgccaggcgaatgggttgagcattcatctgcacacatttcacaacatcgaggacccttatgattgtaagaagtgccggatgagcttccctacattacaggatcatcggaaacatatccacgaggttcactccaaagagtaccatccttgtcccacatgtgggaaaattttttccgctccttctatgctggagaggcacgtggtgacccacgtcggcggtaagcctttctcttgtggtatctgcaataaagcataccagcaactctctggtctatggtatcacaatcgcacccaccatccagatgttttcgctgcccagaaccatagaagttccaaatttagctccctgcagtgtagttcctgcgataaaacgtttcccaatacaattgaacataaaaagcacattaaggctgaacatgccgacatgaaatttcacgaatgcgaccagtgtaaggaactatttcccacccctgctctgcttcaggtccacgtcaagtgccagcactcaggctcccaaccattccggtgtctctactgtgccgccactttccgcttccctggagctttacagcatcatgtgacaaccgaacactttaaacagagcgagacaacattcccctgcgagctctgtggcgaactattcacatcacaggcccagctggattctcatttggagtccgagcatcccaaagtgatgtcaactgaaacccaggccgccgcatctcagatggcccaggtaatccagacacccgaacccgttgcaccaacagagcaggtgataacgctagaggagactcagctcgccggttcacaagtgtttgtgacactgcccgattctcaggccagccaagctagctcggagttagtcgctgtgactgtggaagacctcctggacggcaccgtgactctgatctgcggcgaggcaaaatag

SEQ ID NO: 140978 - DNA, 3720 bp, Artificial Sequence
  Description of Artificial Sequence: Synthetic coding sequence
atggagctgccaaactattcccgccagctgctgcagcagctgtataccctgtgcaaagaacaacaattttgcgattgcaccatatccatcgggaccatttattttagagctcataaactagtgttggcggccgcctcactgctttttaaaacactgctagacaacactgacaccatcagcattgacgcttccgtggtgagccctgaggagtttgccctcctgctggagatgatgtatacagggaaacttcccgtggggaagcataactttagtaagatcatctcgctggccgactccctgcagatgtttgacgtggcagtatcatgcaaaaacctgctaacctctctggtgaactgttccgtgcagggccaagtcgttcgcgatgtcagtgcacccagctctgagaccttccggaaagagccagagaagccccaggtggagatattgagttccgagggcgcaggcgagccccacagctcacctgagttggccgctacacctgggggcccagtgaaggccgaaaccgaggaggcagcacattcagtgtcacaggagatgagtgttaactcacccaccgcacaggagagtcaacggaacgccgagacacctgctgagacccctactactgctgaagcctgctctccgtcaccagcggtgcaaaccttctcagaggcaaagaaaacctcgaccgagcccggctgtgaacggaagcattaccagttgaacttcctcttagagaacgagggggttttctccgatgcactaatggtgacgcaagatgtgctgaaaaaactcgaaatgtgttcggagattaaaggtccacagaaggagatgattgtgaagtgttttgagggggaaggaggccacagcgctttccagagaatcctcggtaaagttcgtgaggagagcctagatgtccagactgttgtttcattgttgaggctgtatcaatattctaacccagccgtgaagactgccctgctcgacagaaagcccgaggacgtggacacagtgcagccaaaaggaagcaccgaggagggcaaaactttgagcgtgctccttttggagcataaggaagaccttatccagtgcgtgactcagctgagaccaattatggaatctctcgaaaccgctaaagaggaatttttaaccggtacggagaaacgggtgattctgaactgctgcgaggggcgcacgccaaaagagactatcgagaatctgctgcaccgcatgaccgaggaaaaaaccctcaccgccgagggacttgtgaaattactccaggcagtgaagaccacctttcctaacctgggcttattgctcgaaaagctccagaagagcgccacactgccgtcaacgacagtgcaaccttcacccgacgactacgggactgagcttctgcgcaggtaccatgagaatctttctgagatcttcactgacaaccagattcttctaaagatgatttcacatatgacttcattggctccgggcgaacgagaggtcatggaaaaactggttaagcgcgactctgggtccgggggcttcaactctttgatcagtgcagtgctcgaaaagcagaccctatcagccaccgctatctggcagttactccttgtggtgcaggagacaaaaacctgcccgttagatcttctcatggaggagattcggcgggaacccggcgcagacgcttttttccgagctgtcacaacaccagaacacgccaccctcgagacgatcctgagacacaatcagcttattctggaggccatacaacaaaagattgagtacaaactgttcaccagcgaggaggaacacttggcagaaacggtcaaggagatcttgtccatcccttcggaaaccgccagccctgaagcctctttacgcgccgtgctgagccgggccatggagaagtctgtaccagccattgaaatttgccatttgctctgcagtgtccacaagagttttcccgggctacaaccggtcatgcaggagttggcctatattggggtactaactaaggaagatggagaaaaggagacatggaaagtgagtaataaattccacctggaagccaacaataaggaagatgaaaaagccgcgaaagaggacagccagccgggagagcagaatgaccagggcgaaacaggctcactgccagggcaacaagaaaaagaagcttctgccagccccgatcctgccaaaaagtccttcatttgtaaggcgtgtgacaagtccttccatttttattgccgactgaaggtccacatgaagcggtgccgggtagctaagtccaagcaggtgcaatgtaaagaatgtagtgaaaccaaggattctaaaaaagaacttgataagcaccaactggaggcgcatggggccgggggggaaccagacgctcctaagaagaaaaaaaaaagactgcctgtcacatgtgatctgtgcgggcgcgagttcgctcatgcaagcgggatgcagtaccataaactgaccgaacacttcgatgagaagccattcagctgcgaggagtgcggtgcaaagtttgctgccaatagcaccctcaaaaaccacctccgcctgcacacaggtgaccggcccttcatgtgcaaacactgtctcatgaccttcactcaagcctctgccctggcctatcacactaagaagaagcatagtgaaggtaaaatgtatgcttgccagtactgtgacgccgtgttcgcccaatctatcgagttgtctcgacacgtccggacccacacaggagacaaaccttacgtttgccgagattgtggtaaaggtttccgtcaggccaacggcctgagcatacatcttcacacattccacaacatcgaggatccctacgactgcaagaagtgcaggatgtcatttcctacactacaggatcacaggaagcacattcacgaggtgcactcaaaggaataccacccatgccctacctgcggaaaaatcttttctgcaccttccatgttggagagacacgtggtcacccacgtgggaggcaagccattctcttgtggtatttgtaataaggcctatcaacagcttagcggcctgtggtaccacaatcggacccatcatcctgacgtctttgccgcccagaaccacaggagttccaagttctcatccttacagtgctcctcctgcgacaagacctttccaaatactatcgagcacaaaaagcacatcaaagcagaacacgccgacatgaagttccacgagtgtgaccagtgtaaggagcttttcccgacgcctgcacttctccaggtgcacgtcaagtgtcagcatagcgggtcacaacctttcaggtgcctgtactgcgcagcgaccttccggttccccggcgccctccagcatcacgtaacaacagagcacttcaagcagagtgaaacgacatttccctgcgagctgtgcggcgagctgttcacttcccaggcccagctcgattcacacttggaatctgagcatcccaaggttatgtccaccgaaactcaggcagcagccagccaaatggcccaggtcattcagacccccgagcctgttgcccccactgaacaggtgattacccttgaagaaacacagcttgccggttcccaagtgttcgtcacactcccggattctcaggcctctcaggcctcttcagaacttgtggctgtgacggtggaggacctcttagacggcacagtcacccttatttgcggcgaagcaaaatag

SEQ ID NO: 140979 - DNA, 1362 bp, Artificial Sequence
  Description of Artificial Sequence: Synthetic coding sequence
atggaactgcccaattattcacgtcagctactccaacagctctatacgttgtgcaaagagcagcagttctgtgactgcaccatcagtattgggactatttattttcgggcacataagctggtgctggcagccgccagcctgcttttcaagacgctgctggataatacggatactatttctatagacgctagtgttgtcagccccgaagaatttgccctcctcctggagatgatgtacacaggcaagctccccgtgggtaaacataatttctccaagatcattagcctcgccgacagcttgcagatgtttgatgtcgccgtctcttgtaagaatctccttacctcccttgtgaactgctcagttcagggccaggttgtacgggacgtcagcgctccctcttccgagacatttcggaaagaacctgaaaagcctcaggtcgaaattctgtctagtgagggggctggagaaccacacagctcccccgaactggctgctacacctggcggacctgtcaaggccgagacggaggaagctgcccacagtgtgtctcaggagatgtccgtgaatagccccactgcccaggaatcgcagcggaatgctgaaaccccagccgagacacccactaccgccgaagcatgcagcccttcaccagccgttcagactttttcggaggcaaagaagacttcaacggaacctgggtgcgaaagaaagcattaccagctgaattttctgctggaaaacgagggcgtctttagcgatgcattgatggtgactcaagacgtgctcaaaaagctagagatgtgttctgaaatcaaaggacctcagaaggagatgattgttaagtgctttgagggggaaggcggacacagcgcctttcagaggattctgggaaaagtgcgggaagagtccctggacgtgcagactgtagtgtcactgctgcgtttgtatcaatacagtaatcccgctgttaagaccgcactcctggatcggaagccggaggacgtggacacagtccagcctaaggggagtaccgaggagggaaagacactgtcagtcctcctactggagcacaaagaggacctgatccagtgtgtgacccaattgcggcccatcatggaatccctggaaaccgccaaggaggaatttctgacggggactgaaaaacgagtgatcctcaactgttgtgaaggacgcacccctaaagaaaccatcgagaaccttctgcacagaatgacggaagagaagacgctgacggctgagggtcttgttaagctcctgcaggccgttaaaaccacctttcctaatttgggcctcttgctggagaaactgcagaagtccgcaaccctccccagcacaacatag

SEQ ID NO: 140980 - DNA, 3720 bp, Artificial Sequence
  Description of Artificial Sequence: Synthetic coding sequence
atggagctgcccaactacagtaggcagctcctccagcagctgtataccctctgtaaggaacagcagttctgcgactgtaccatatccattggcactatttattttagggctcacaagctggtgctagccgccgcctccttacttttcaaaactctgctcgacaacacagacacaatctccatcgatgcttctgtggtgtcacctgaagagttcgccttacttctcgagatgatgtacactggaaagcttcccgtcgggaaacataacttttccaaaatcatttccctggcggacagtctccaaatgttcgacgtggccgtctcttgcaagaatctgttaacctctttggtgaattgcagtgtgcaggggcaggtggtcagagacgtgtctgctccatcaagcgagacattcaggaaggaaccagagaagccccaggttgagatccttagcagcgagggcgccggggagccccacagctcgcctgaattagcagccactcccgggggaccagtcaaggcggagacagaggaggcagctcattcagtctcacaggagatgagtgttaacagtcctaccgcgcaggaatcccagaggaatgcggaaacaccggcagaaacaccaaccaccgcagaagcttgttctcccagtcccgccgtacagaccttctccgaggccaaaaagacaagcacagagcctggatgtgagcgcaagcactaccagttgaacttcctgttagagaatgaaggcgtcttcagcgacgccctcatggtaacccaggacgtgctgaaaaagctggaaatgtgttccgaaataaaggggccacaaaaggagatgatagttaagtgctttgaaggcgagggcgggcactccgccttccagaggatactggggaaggtccgggaagaatctctagatgtgcagaccgtcgtatcactcctgcgcctgtatcagtattccaaccccgctgtgaagaccgctctgctcgatcggaagccagaagacgtggacaccgtccagcccaaaggatctaccgaggaaggcaaaactctgtccgtcttactgctggaacataaagaggatttgatacagtgcgtaacacagttgagacctatcatggaatcacttgagaccgcaaaagaagagtttttgactggcacagaaaaacgcgtgatcctgaactgctgtgagggacggactcccaaagaaacgatcgagaatctcctgcatcgtatgactgaagagaaaacccttacagccgagggacttgtgaagttgctgcaagccgtaaagaccacatttcctaatctcggacttctcctggaaaagctccagaagagcgccacgcttccatctactaccgtccaaccatcccctgatgattacggcacggagctgctgcgaaggtatcacgagaatctgtctgaaatcttcaccgacaaccaaatactgcttaagatgattagtcatatgaccagtttggccccaggcgaaagggaggtgatggagaaacttgtgaagagggactccggcagcgggggcttcaactcactgatctcagccgtcctggaaaaacaaaccctgtcagccacggccatctggcagctgctcttagtggtgcaggaaaccaaaacctgtcctttggatctgctgatggaagaaatccgccgcgagccgggagcggatgccttctttcgggccgtcactacccccgaacatgctacacttgagaccattttaagacacaatcagttaattttagaagcaatccagcaaaaaatcgagtataagttatttactagtgaagaggagcatctggctgaaacagttaaggagatcctgtctattccttctgaaacagcttcccctgaggcaagccttcgggccgtgttaagtcgcgctatggaaaaatccgtgcctgccatcgagatatgccacctgctgtgctccgtgcataaatcattcccaggtctgcaacctgtgatgcaagagctcgcctatatcggcgtgctgacaaaggaagacggtgaaaaggaaacttggaaggtgagtaacaagtttcatctggaggccaataacaaggaggatgaaaaggccgccaaagaagacagccagccaggagagcagaatgaccagggggaaacaggcagcctgcccgggcagcaggagaaggaagcctccgcttctcccgaccccgcaaagaaatcctttatctgtaaagcttgtgataaatcgttccacttctactgtaggctgaaggtccatatgaaacgctgtagagtggcaaaatccaagcaggtacaatgcaaggagtgcagtgagactaaggactccaagaaagaactagataaacatcagctggaggcccatggtgctggtggcgaaccagacgcgcctaagaaaaaaaagaagaggctgccggtcacttgcgatttgtgcggacgggagtttgcacacgcctccggcatgcaataccacaaattgaccgaacacttcgacgagaaaccttttagctgcgaggaatgcggcgcaaagttcgctgccaacagcacactgaaaaatcacctgcgcctacacaccggcgacagaccttttatgtgcaagcactgcctcatgaccttcactcaggctagcgctctggcatatcacactaaaaagaagcacagcgaggggaaaatgtatgcctgccagtattgtgatgccgtctttgcacagagcatcgagttgagccgccatgtgcgaacacatacaggggacaagccctacgtctgcagagactgcggcaaaggcttcaggcaagcgaacggtctctctattcatttgcacacctttcataatattgaggacccgtacgactgtaagaaatgcaggatgtcctttcctactcttcaagaccaccggaagcacatccacgaagtccactccaaagaataccacccatgtcccacatgtggcaagatcttctctgcccctagcatgctcgagcgtcatgttgtgacccacgtgggcggcaagcctttctcttgtggtatctgcaataaggcttaccagcagctttccgggctgtggtaccataacagaactcaccaccccgatgtttttgcggctcagaaccacagatcctccaaatttagctccttacagtgctcaagctgtgataagacctttcccaataccatcgaacataagaaacacattaaagcagaacacgctgacatgaaatttcatgagtgcgatcaatgcaaagagctttttcccactcccgctttactgcaggtccatgtgaaatgccagcattccggtagtcagcccttcaggtgtctctattgcgcagccaccttccggtttcccggcgcacttcaacatcatgttacaacggagcactttaaacagagcgagacaaccttcccgtgcgagttgtgcggcgaattattcacgagccaggcccagctggacagtcatcttgaatctgaacacccaaaagttatgtcaaccgagactcaggccgcagcttctcagatggctcaagttattcagacgccggagcccgtggctccgaccgagcaggtgatcacactggaagaaactcagctggccggttcccaggttttcgtgacgctgcctgactcccaggcctctcaagcgtcctctgagcttgtcgcagtgacagtcgaagacctcttagatggaaccgtaaccctaatctgcggagaggctaaatag

SEQ ID NO: 140981 - DNA, 1269 bp, Artificial Sequence
  Description of Artificial Sequence: Synthetic coding sequence
atggaattcccagagcatggtggacggctgctcggacgtctgcgtcagcaacgagagcttggattcctgtgcgactgcaccgtgcttgtgggcgatgcacgttttcctgcacacagggccgttctcgcagcgtgctccgtatactttcacctcttctacagagataggcccgccggctcccgcgatactgtcaggcttaacggggatattgtaaccgctcccgcctttgggcggctactagactttatgtatgagggcagattggacctgcgcagtctgccagtcgaagatgtgcttgctgccgccagttacctccacatgtacgatattgtgaaggtctgcaagggacgcctacaggaaaaggacaggagccttgaccccggcaaccctgctccgggcgcggagccagcccagcccccatgcccctggcccgtgtggactgccgatctctgccctgccgcccgcaaggctaaattgcccccgttcggcgttaaggcagccctaccaccgcgcgcctcagggcctccaccatgccaggtacccgaggagtctgatcaggcactggacctttctctcaagagcggtcccaggcaagagcgggttcatcccccatgtgtccttcagactcccctgtgctctcaacgccagccaggcgctcagccactcgtcaaggacgaacgcgatagcctctcggagcaggaggagagtagtagcagtcgctcaccacactcgccccctaagcctccaccagtgccagcggcaaagggactcgtcgtcggtttgcagccattacctctatctggcgagggctcgcgagagctagagctgggcgcgggaaggctggcatctgaggacgagttggggcctggcgggcccctctgcatttgcccgctttgtagcaaactttttccctcatctcacgtactgcagctacacctgagcgcccacttccgggaacgggactctactcgggcccggctgagccctgacggagttgccccaacatgcccgctgtgtggtaagacctttagctgcacctatacgctcaaacgacacgagagaacccactccggtgagaagccttacacttgtgttcagtgcggaaagagcttccaatatagtcacaacctgagtcgacacaccgtggtgcacacgagagagaagcctcatgcatgtcgctggtgcgaaaggcggtttacccagagtggtgatctatatcgccacgtcaggaaatttcactgtgggcttgttaagtccttacttgtgtag

SEQ ID NO: 140982 - DNA, 1269 bp, Artificial Sequence
  Description of Artificial Sequence: Synthetic coding sequence
atggagttccccgagcatggcggccgcctgctgggcaggctgcgtcagcagcgagagctggggtttctgtgtgactgcacagtgctggtgggcgacgcgcggtttcccgcccacagagccgtccttgccgcttgttccgtttacttccacttgttttatcgggatcggcctgctggcagtagagacaccgtcagactgaatggggacattgtcaccgcgcctgcctttggacgactactcgacttcatgtacgaaggccgcctagacctgcgcagcctacccgtggaggacgtgctcgcagcagcttcctatctgcacatgtatgacattgtcaaagtgtgcaaaggcaggttgcaggagaaggatagatctctcgaccccggcaatccagccccaggtgctgaaccagcccagcctccatgcccttggccagtatggaccgccgacctctgcccggctgcccgaaaggccaagctacctcctttcggagttaaggcagccttacctcctcgtgccagcggccctcccccttgccaagttccagaggaaagcgaccaggcacttgatctgtctttaaagtcggggccaagacaggaacgtgtgcacccgccctgcgtgctgcagacaccactttgcagccagcgacaaccaggggcacagccacttgtgaaggacgagcgcgactcacttagtgagcaggaggagtctagttcatctcgttccccacattcaccaccaaagccaccgccagtccctgccgccaaaggactcgtggtggggctacagccactgccactctctggggaagggtccagagaactcgaactcggggccggcaggctggccagtgaagatgagctcgggccaggcggacccctttgcatttgtccgctttgtagtaaattgttcccatcatctcatgtcctgcagctgcaccttagtgcacatttcagggagagggactctacacgggcccggctcagccctgatggggtcgcacctacttgccctctgtgcggtaagacgttctcatgtacttacacactgaagcgccatgagagaactcattcgggcgaaaaaccatacacctgtgtacagtgtgggaaaagtttccagtattcccataacctcagccgccacactgtcgtccacactagggagaagccacacgcctgtcgctggtgtgagaggaggttcacacagtcaggtgacctttacagacacgtccgaaaatttcattgcgggctggtcaagtccctgttggtctag

SEQ ID NO: 140983 - DNA, 1815 bp, Artificial Sequence
  Description of Artificial Sequence: Synthetic coding sequence
atggcctccacctgggctattcaggcccacatggaccaggacgaacctctggaggtgaaaatagaggaggagaaatatactacgcggcaggattgggatctccgcaagaataatacccacagcagagaagtctttcggcaatacttccggcagttctgctatcaggaaacaagcggccctagagaagcactatcccgcttaagagagctttgccaccagtggctgcggccagaaactcacacaaaagaacagatcctagagttgctggtgctggagcaattcctgactatccttcctgaggaactgcaagcttgggtgcaggagcaacacccagagagtggggaagaagtggtgaccgtgctcgaggatcttgaaagagagcttgatgaacccggggagcaggtgtccgtgcatacaggggaacaggagatgttccttcaagagaccgtccgcttaagaaaagagggagagccaagtatgtccctacagagcatgaaggcccagccaaagtatgagagcccagagttagaaagtcaacaggaacaggtgttagacgttgagactggaaatgagtacggtaacctaaagcaggaagttagtgaggagatggaaccacacggcaaaacatccagtaagtttgagaacgacatgagtaagagcgccagatgtggagagacccgagagcccgaggaaataactgaggaaccctccgcttgctcccgcgaagacaaacagcctacttgtgacgagaacggagtgagcctgacagaaaatagcgaccacacggaacaccagaggatttgccccggagaggagtcctacggttgtgacgactgcgggaaagccttctcacagcattcccacttaatcgaacaccagaggatccataccggcgataggccttacaaatgcgaggaatgcggtaaggcttttcggggccggaccgtgctgatacgccataagattatccataccggagagaagccctataaatgcaatgaatgcggcaaagccttcggtagatggagcgcgttgaaccagcatcagcgcctgcacacaggcgaaaagcactatcactgtaatgattgcggcaaggcattttcccaaaaggctggactatttcaccatattaaaattcatactcgcgacaaaccttaccagtgtacccagtgcaacaaatcttttagtcggcgttccattttaacacagcaccagggcgtccacacaggggccaagccatatgagtgcaatgagtgtggaaaagcgtttgtctataatagctcactggtgtcacatcaggaaatccatcacaaggaaaaatgttatcaatgcaaagaatgtgggaagtcgtttagccagagcggactaattcaacaccaacgaatccacacaggcgaaaaaccatataagtgtgacgtgtgcgagaaagcatttatccagagaaccagcctgacggagcatcagcggattcataccggtgaacggccctataagtgcgataagtgcggaaaggcatttactcagagaagtgtgctcactgagcatcagagaatccataccggtgagcgtccttacaaatgtgatgagtgcggcaatgctttccgtgggatcacatcccttattcaacaccaacgaattcacacaggtgagaagccctaccagtgtgacgagtgtggaaaggcatttagacaacgaaagaaaacttcctacaaagagatattgttgaaaaatcattctgagccgcaggcgggggtgaatttactgctgagttctctgataccagaatggcagagctgcttccgccgggacctgtag

SEQ ID NO: 140984 - DNA, 1815 bp, Artificial Sequence
  Description of Artificial Sequence: Synthetic coding sequence
atggcttctacctgggctatacaggctcatatggaccaggacgagcctctggaggtgaaaatagaggaagaaaagtatacaacacggcaggattgggatctgagaaagaataatacccatagccgagaagtatttcgccagtactttagacagttttgttatcaggagacttctgggccccgagaggcactgtcaagactccgcgagctctgtcaccagtggctgcgacctgaaactcatactaaggaacagatcctggagcttttggtgctagaacagtttctgactattcttccagaggaacttcaggcatgggttcaggaacagcatccagagagtggagaggaggtcgtgactgtgttagaggatttggagagagagcttgacgagcccggcgagcaggtctcagtgcacactggtgagcaggaaatgtttctgcaagagacagtccggctcagaaaggaaggtgagccctccatgtctctacagagcatgaaagcccaaccaaagtatgagtctcccgaactggagtcccaacaggaacaggtgttggacgtcgagaccggcaatgagtatggtaatttgaaacaggaggtgtccgaggaaatggaaccccatggcaaaactagtagcaaatttgaaaatgatatgagtaaatcagctagatgcggcgagaccagagagcctgaggagatcactgaggaaccttccgcatgctctagggaagacaaacagccaacttgtgatgagaatggcgtatccctgaccgaaaatagcgaccataccgagcatcagcgcatctgccccggtgaagagagctacgggtgcgatgactgcggcaaggcattcagccaacactcccatcttatcgagcaccaacggattcacaccggcgatagaccttataaatgtgaggagtgcggaaaggccttccgcggcaggactgtgctcatcaggcacaagatcatccacactggtgagaagccctacaagtgcaatgaatgcgggaaggccttcgggcgttggtctgctctcaaccaacaccagcgactgcatacgggtgaaaagcattaccactgtaatgattgtggcaaagccttcagtcagaaggccgggctgttccaccacattaaaatccatactcgagataagccataccagtgcacgcagtgtaacaaatcttttagcaggcgtagcatcctgacccaacaccagggcgttcacactggcgccaagccctacgaatgcaacgagtgtggaaaggcctttgtatataacagctcactggtctcgcaccaggagatccaccacaaagaaaagtgctaccaatgcaaggagtgcggaaagtcctttagtcagagcggtctcatccagcatcaaagaatccacaccggtgagaaaccctacaagtgtgacgtctgcgaaaaggcctttattcagaggacatccctgacagaacatcagagaattcatactggagaacggccttataagtgcgataaatgcggaaaagcttttacccagaggtccgtgcttactgagcatcagcggatacacacaggagaacgcccgtataagtgtgatgagtgcggcaatgccttccggggaattacgtcactgattcaacaccaaaggattcatactggagaaaagccatatcagtgtgatgagtgcggcaaagcctttagacaacgtaagaaaactagctacaaagagatactcctaaagaatcattccgagccacaggctggagttaacttgcttctgagctcactaataccagagtggcagtcgtgcttccgaagggacttgtag

SEQ ID NO: 140985 - DNA, 1476 bp, Artificial Sequence
  Description of Artificial Sequence: Synthetic coding sequence
atggccattccaaagcactctctgtctcccgtgccctgggaggaggattcttttctgcaagtgaaggtggaggaggaggaggaagcttcattgtctcagggtggggagagttcacatgatcacatcgcgcacagcgaggcagccagattgcggttcaggcacttcaggtatgaggaggccagcggaccccatgaagcccttgcacatttacgtgcactgtgttgtcaatggctgcagcccgaagctcactctaaggagcaaattctcgagttgctagttctagagcagtttctgggagctctgccgcccgaaatccaagcatgggtcggggctcagagcccaaagagcggcgaggaagcagctgtgttggtcgaggatcttacgcaggtactggacaaacgagggtgggatccaggggcggagcccaccgaagcgtcatgcaagcagagcgatctcggagagtcagagcctagtaatgtgactgagaccttgatggggggggtgtctctaggacccgcctttgtaaaagcctgtgaaccagagggtagctccgagagatctggactctctggcgaaatttggacaaaatcggtcactcagcagattcactttaaaaaaacttctggcccttataaggacgtccccacagaccagagggggcgggaatcgggagcttcccggaatagttcctcagcgtggcccaacctcacttctcaggaaaagcccccctctgaggataaattcgatttggtggacgcttacggcacagagcctccttatacctattccggaaagcgatcgagtaagtgtcgagagtgtcgcaagatgttccagtcagcttctgcgctggaggcccaccagaaaacacactcaaggaaaactccgtacgcctgctccgagtgtggaaaggcattctccagaagcacacaccttgcccaacatcaggtcgtgcacacaggcgccaagcctcacgagtgcaaggagtgcgggaaagcttttagccgcgttacacaccttacgcagcaccagagaatacacacaggggagaaaccgtacaagtgcggagaatgcgggaagacctttagcagaagcacccatctaacccagcaccagagggtgcatacgggcgaaaggccatatgaatgtgatgcttgtggcaaggcatttagccagagtacccatcttacccagcaccagcggattcatacaggcgagaagccatacaagtgtgacgcttgcgggagagcgttctcggactgttctgccctgattaggcatctacgtatccacagtggggaaaaaccgtatcagtgtaaagtgtgtccgaaagcattcgctcagagttccagtttaattgagcaccagaggatccacactggcgagaagccttataaatgttcagactgcgggaaggccttttcaagatcgtccgcactcatggtgcatctccggatacacattacggtgctgcagtag

SEQ ID NO: 140986 - DNA, 1302 bp, Artificial Sequence
  Description of Artificial Sequence: Synthetic coding sequence
atggctctggacctgcgcaccatctttcagtgcgaacccagcgaaaacaatctcggctcggaaaactctgccttccaacagagtcaagggccagccgtgcaaagggaagagggcattagtgaattttccaggatggtgctcaattcttttcaggactcaaacaattcttacgcccggcaggaactgcaaaggttgtaccgcattttccatagttggctccagcccgagaagcactctaaggatgaaatcatcagcctgctcgtactcgagcaattcatgatcggcgggcattgcaacgataaggcctccgttaaggaaaagtggaaatcatctggtaaaaacctggagcgcttcatcgaggatctcaccgacgatagcatcaatcctccagctctcgtccacgtccatatgcagggacaggaggccctgttttcggaagacatgccactgagagacgtgatcgtgcatctcacaaagcaagtgaacgctcaaactacacgcgaggccaatatgggtactccctcacaaacaagtcaagatacaagcctggaaactggccagggatacgaagacgagcaggatggttggaactcctcttccaagactactcgggtcaacgaaaacatcacaaatcagggaaaccagatcgtttcactaatcatcatacaagaggagaatggccccaggcctgaggagggcggggtctccagcgataacccctataacagcaagcgggcagaactagtcacggctcggtcgcaagaagggtcaattaacgggattacctttcagggcgtccctatggtgatgggggctggctgtattagccagccggagcagagttcccctgagagtgccctgacgcaccagagcaacgagggtaacagcacatgcgaggtgcaccagaagggcagccacggggtgcagaagtcctacaagtgtgaagaatgtccaaaggtctttaaatatctgtgtcacctgctggcccaccagcggaggcaccgaaacgagcggccttttgtctgtcctgagtgtcagaagggctttttccaaatcagcgacctgagagtgcaccagatcattcataccggcaaaaaaccattcacctgcagtatgtgcaaaaaatctttctctcacaaaacgaacctgaggagtcatgagcggatacacacgggggagaaaccctatacgtgcccgttctgtaaaacctcgtacagacaaagcagcacctaccacagacacatgcgcacacacgagaagataacgctgccttccgttcctagcacaccagaagcaagctag

SEQ ID NO: 140987 - DNA, 2433 bp, Artificial Sequence
  Description of Artificial Sequence: Synthetic coding sequence
atgccgaatcagggtgaggattgctattttttcttttattctacctgtacaaaaggggattcatgcccattcagacactgtgaagctgctataggtaacgagacagtctgtacgctatggcaggaggggcgctgcttccgccaggtctgtcgcttcaggcatatggagatagataaaaaacgttctgagattccatgctattgggagaaccagcctaccgggtgtcagaagctgaattgcgcgtttcaccacaaccgaggacggtacgtcgacggcctatttttgccaccaagcaaaacggtcctgcctaccgtgcccgaatcccccgaagaggaggttaaggcctctcaactatcggttcagcagaataaactctcagtgcagtccaacccaagcccacagctaaggagcgtgatgaaagttgagtctagtgagaacgtcccaagcccaactcatccacccgtcgtgatcaacgctgcagacgatgacgaagatgatgacgaccaattctccgaggaaggcgacgaaaccaagacccctactcttcaaccaacacctgaggtgcacaacggtctgagagtgaccagcgtgagaaagcctgcggtaaatatcaaacagggagagtgcttaaactttgggatcaaaaccctggaagagataaagtccaaaaagatgaaagagaagtccaaaaagcaaggtgaagggtcttccggggtttcttcattgttgctccaccctgaacccgtgcccggccctgaaaaagaaaacgtgagaaccgtcgtcaggacagtgaccctaagtaccaagcaaggtgaggagcctctggtacgcctctctcttactgagcgcctgggaaaaagaaagttttctgccggaggtgattcagaccctcccctcaaacgcagcctcgcacagcggctggggaagaaggtggaagcacctgaaacaaatatcgataagactcccaaaaaagcccaggtgagcaaatcacttaaagagagactggggatgtccgctgatcctgacaatgaagacgccacagataaggtgaataaagttggcgaaatccatgttaaaaccctcgaggaaatcttgctggagagagctagtcagaaacggggtgaactgcagactaagctcaagactgagggcccttcaaagacggatgattctacatctggcgcgagaagttcatctaccataaggatcaagaccttttctgaagttctggctgaaaagaaacacagacaacaagaggcagagaggcagaagtccaaaaaagacacaacctgcattaagcttaagatcgactccgagattaaaaaaaccgtcgtgctgcctccaatcgttgcctctagaggccaaagcgaggagcctgcaggaaaaactaagagcatgcaggaggttcatatcaaaaccctggaagagattaaactggagaaggcactccgcgtccaacagagcagcgagtcttccacttccagtccgagccaacacgaggcaacacctggggcacggcggcttctgcgtatcacaaaaaggactggcatgaaagaggaaaaaaatttacaggagggaaatgaagttgatagtcagtcttcgatcaggacggaggctaaagaagccagcggggagactactggcgttgacataactaagatacaggttaagaggtgcgaaactatgcgagagaagcacatgcagaaacagcaggagcgggagaagagtgtgttgactccactccggggcgacgtcgcatcctgcaacacccaggttgccgagaagccggtgctgactgccgtgccaggcattacacgtcatctcacaaagcgcctgccaaccaaaagttcacaaaaggtggaagtggaaacttcaggaattggggactctttgttaaatgtgaaatgcgccgcacaaacgttagagaagcggggcaaagccaaacctaaagtgaacgttaaaccaagcgttgttaaggtagtgtcttctcctaaactggctccaaaacgaaaagcagtggagatgcatgccgctgtgattgccgccgtgaaacctcttagttctagttccgtcctgcaagaaccaccggccaaaaaggccgctgtggcagtcgttccactggtcagcgaggataagtccgtcaccgtcccggaggccgagaacccgcgggactctctggtcctcccacccacacagtcctcctcagactcctcaccaccggaagtatccggcccctcgtcgagtcagatgtcaatgaagacacgccgacttagtagtgcctcgacagggaagccaccactcagcgtcgaagatgattttgaaaagttaatctgggaaatctcaggcggcaaactcgaagctgaaatcgatctcgaccctggaaaggacgaagatgacctgttgcttgaactctcagagatgatcgattcttag

SEQ ID NO: 140988 - DNA, 2433 bp, Artificial Sequence
  Description of Artificial Sequence: Synthetic coding sequence
atgccgaatcaaggcgaggactgctacttcttcttctattctacgtgtaccaagggcgatagttgccctttcaggcactgcgaggcagctattggtaacgaaacagtgtgcacgctctggcaagaaggcagatgcttccggcaggtgtgccgtttccgacacatggagattgataagaagcgctccgagattccatgttactgggaaaatcaacctactggctgtcagaagctgaactgcgcatttcatcataatcgcgggcggtacgtcgatggattgttcctcccaccctccaagactgtgcttccaactgtaccggaatctcctgaagaagaggtcaaagcctctcagctctctgttcagcaaaacaagttgtcagtgcagtccaaccccagcccccaattgcgtagcgtaatgaaagtcgagtcgagcgaaaatgtgcccagtcccacgcatcctcctgtggtgatcaatgcagccgatgacgacgaggacgatgacgatcaattcagcgaagaaggggatgagactaaaacacctacacttcagccaacccccgaggtacacaacggtctccgagtgacaagcgtccggaagccagccgtgaacattaagcagggagaatgtctgaactttggtatcaagacattagaggagatcaagagcaagaaaatgaaagagaagagcaagaagcagggtgaagggtcttccggggtctcgtccctcctcctgcacccagagcccgtcccgggtcccgagaaggagaacgttcggaccgtcgtaagaacagttaccctctcaacaaaacagggggaagagcccctagtccggctgagccttaccgaaaggctagggaagcggaagttttctgctgggggagactccgacccaccactgaagcggagtcttgcccagagattgggcaaaaaagtggaggccccagagaccaatattgacaagacacccaagaaagcccaggttagcaagtctctgaaagagcgcctgggcatgtccgcggaccccgataacgaggacgcaacagataaagtgaataaggtgggagaaattcacgtgaagacattggaagagattctgctcgagcgagcttcccaaaagagaggtgaactacagactaagctaaaaactgagggaccctctaagaccgatgactccacctccggggcacggtccagctccacaatcagaatcaaaactttttccgaagtgctggccgagaagaaacacaggcagcaagaggctgaacgccagaagtccaagaaggatactacttgtattaagctcaagattgacagtgaaatcaagaagacagtggtattgccccccatagttgcgagcaggggtcagtctgaggagcccgccggaaagaccaagagcatgcaggaagtacacatcaaaaccctggaggaaatcaagttggagaaggccctgcgagtccagcagtcctcagaatccagtacatcaagtcccagccaacacgaggcaactcccggagccaggcggttgctgcgtataacgaaacgaactggaatgaaagaagaaaagaatttacaggagggcaatgaagtggactcacagtcatctatcaggactgaggcaaaggaagctagcggagagactactggtgttgatataacaaagattcaggtaaagcgctgcgagacaatgcgggaaaaacatatgcagaagcagcaagaacgggagaaaagcgtgctgacccctttgagaggcgatgtggcgtcttgcaacactcaggttgcagaaaagccagtcctgaccgccgtgcctggcatcaccaggcatcttacaaaaagactgcccaccaagagctcccagaaggttgaagtagagacgagtggtatcggcgattcgctgctcaacgtgaaatgtgccgcccaaacactggagaagagaggtaaggccaaacccaaagtgaacgtgaaaccttccgtagttaaggtcgtaagttcccccaagttggcccccaagcggaaagctgtcgaaatgcatgccgcagtgattgcagctgttaagccactctcctcgtcttccgtgttacaagaaccccctgctaagaaggcagccgtcgcagtagtgcccttggtgtctgaggacaagtcggtaacggttccagaagctgaaaaccccagagatagtcttgtgctgcctcccacccagagcagcagcgacagctcgccacccgaagtgagtggaccctcctcaagccagatgagcatgaaaacgcgccgccttagttctgcgagtaccggcaagcccccactgtccgtggaggacgacttcgaaaaactgatctgggagatttctggcggtaagttggaagcagagatagacctagacccaggcaaggatgaagatgatttactgctggaactctctgagatgatcgactcttag

SEQ ID NO: 140989 - DNA, 2433 bp, Artificial Sequence
  Description of Artificial Sequence: Synthetic coding sequence
atgcccaatcagggggaggactgttactttttcttttatagtacctgtaccaagggagactcatgtcctttccgccactgcgaggctgcaataggcaacgaaactgtatgcaccctatggcaagaaggacgatgttttcgacaggtgtgtcggttccgtcatatggagatcgacaagaagagatcggagatcccgtgctactgggaaaatcaacctactggctgccagaagctcaattgcgcatttcaccataacagggggagatatgtcgacggcctcttccttccaccgtcgaagacagtactgccaaccgttccagaatcaccagaggaagaagtgaaggcttcccagctctccgtgcagcagaacaagctcagcgtgcagtctaatcccagtccgcaactcagatcagtcatgaaagttgaatcttcagagaacgtcccaagcccaacgcaccctccggtggtgatcaatgcagcagatgacgacgaagacgatgatgaccagttttccgaggagggggatgagactaagactcccacactgcaacccacccctgaagtccataacgggcttcgcgtaacaagtgtgagaaagcctgctgtgaacataaaacagggtgagtgcctgaacttcgggataaagacgctagaggaaatcaagtcaaagaagatgaaagagaaaagcaagaagcagggggaaggatcttcaggtgtgtccagccttttactccaccccgagccagtgcccggaccagagaaagagaacgtgcgcaccgtagtgcgcaccgtaaccctgagtaccaagcagggtgaagagccgctcgtgcggctaagcctgactgaacggttagggaagaggaaattctcagcaggcggggattccgacccccctctgaaaaggtcccttgcccagcgcctggggaagaaagtcgaggcccccgagacaaacattgacaagactcccaagaaggcacaggtttctaagtcactgaaggagcggctgggcatgtccgctgatcccgacaacgaagatgctactgataaagtgaacaaggtcggagaaatccacgtcaagactctggaagaaatcctcttggaacgtgcttcccagaagagaggcgaattacaaaccaagctgaaaacagaaggaccttccaagactgatgattcaacctccggggcgaggtcttctagtacaatccggatcaaaactttctcagaggtcctagccgaaaaaaagcatagacaacaggaagccgaacgccagaaaagtaagaaagatactacttgtatcaagctgaagatcgatagtgaaatcaagaagactgtggtcctgccccccatcgtcgccagtcgcggtcaatctgaggaaccagcgggcaagacaaagagtatgcaggaggtgcacattaagaccctggaggaaataaagttagagaaggcattgcgtgtacaacaaagctctgaatccagcacaagctccccttctcagcacgaggcgacaccgggggcccgccggctgctcaggattaccaaaaggacaggtatgaaagaagagaagaacctgcaggagggaaatgaagtggactcacagagttcaatcagaaccgaagcaaaagaagcttcaggtgagactacaggcgttgacatcacaaagatccaggtgaagagatgcgaaaccatgcgcgagaaacatatgcagaagcagcaggagcgggaaaagtctgtgttgacccctctgcgcggagatgtcgctagttgtaacacccaggtagcagagaagcctgtgctgacagccgtgccaggcatcacacggcatttgactaagcgactccctaccaaatccagccagaaggtggaggtggagacctcaggtattggggattctttattgaatgtcaaatgcgcggcccagaccttagagaaaagagggaaggccaaaccaaaagtcaatgtaaagccttctgtggtcaaggtcgtctcttcacccaagcttgcacccaagaggaaggccgttgagatgcacgccgccgtcattgccgcagtcaagcctttgagctcttcatccgtcctccaagagccccctgcaaaaaaggctgcagtggccgtagtcccgctggtttctgaggataagtctgttacagtgcctgaggcagagaacccaagagacagcctcgtactgcccccaacccaatccagctcagactcaagccccccagaagtgagcggccctagtagcagccagatgtcaatgaaaaccagaaggctgtccagcgcttccacaggaaaaccaccactcagcgtcgaagatgattttgagaagttgatttgggaaatcagcggcggcaagctggaggcagaaatagacttggacccggggaaagatgaagacgatctcctcttagagctctccgagatgattgattcttag

SEQ ID NO: 140990 - DNA, 2433 bp, Artificial Sequence
  Description of Artificial Sequence: Synthetic coding sequence
atgccgaatcagggggaggattgttacttctttttctacagcacctgcactaagggcgacagttgccctttccggcattgtgaggctgccatcggaaatgagactgtgtgcacattatggcaggagggcaggtgttttcgacaggtgtgtcgctttaggcatatggagatcgacaagaagcgaagtgagattccatgctactgggaaaatcagccaactggctgtcagaagctgaattgtgcctttcatcataacagaggccgttacgtggatggtctattcctgccaccttctaaaacagtgctgcccaccgtcccagagagtccagaggaggaagtaaaggctagccagctttccgtgcagcagaataagctcagcgtgcagagcaatccctcgccccagctcaggtccgtcatgaaggtcgagagctcagaaaacgtgccatcacccactcaccccccagttgtgatcaacgccgccgatgacgatgaggatgacgatgatcaattctctgaggaaggcgatgaaactaagacaccgactctccagccaacacctgaggtgcataatgggctgcgtgttacatcagtacgtaaaccagcagtgaacataaaacagggggaatgccttaactttggcatcaagacacttgaagaaatcaagtctaagaaaatgaaggagaaatcaaaaaaacagggcgaaggtagcagtggcgtgtccagcctgctgttgcatcccgagccagtcccagggcctgagaaggaaaatgtaaggaccgtcgtacgcacagtcacgttgtcgacgaagcagggcgaggaacccctggtgagattaagcttgactgagagacttggcaagaggaaattctccgccgggggagactccgaccctccattgaagaggagcttggcccagcgtttgggcaaaaaggttgaggcaccagagacaaacattgacaagacccctaaaaaggctcaggtcagcaaatctctgaaggagaggttgggtatgtcggcggaccctgacaacgaagatgcgaccgataaggtgaacaaggtcggagagattcatgtgaaaaccctagaggagatccttcttgagagagcatcacaaaagcggggcgagctccaaaccaaattaaagactgagggaccatctaaaacagacgactctacttccggcgcccgaagctcttccactattcgaattaagacattttctgaggtgctggccgaaaagaaacaccggcagcaggaagcagaacgtcaaaagtccaagaaggataccacttgcattaaattaaaaattgatagcgaaattaagaagacagttgtgctgcctccaatcgtggcctctcgtgggcagagtgaggagccagccggtaaaaccaagtctatgcaggaagtacacattaaaacgctcgaggagataaaactggaaaaagctctacgtgtgcagcagtcgagtgagtcttccaccagtagtccttcccagcatgaagcgacgcctggcgccaggaggctgctccggatcaccaaacgaacagggatgaaggaagaaaaaaatctgcaggagggcaatgaggtggactctcagagctcgattagaacagaagctaaggaggccagcggcgaaactactggcgtggatataaccaagatccaggttaaacgttgcgagacaatgcgggaaaaacacatgcagaaacagcaggagcgagagaaaagcgtgttgactcctctgcggggagacgtcgctagctgcaatacccaggtggccgagaaaccggtgttaacagctgtgcccggcattaccagacatttgactaaaaggctgccgaccaagagctcgcagaaggtggaagtggaaacttccggcattggcgattctttgcttaacgtcaaatgcgcagcccagacactggaaaaaagagggaaagccaagcccaaagtgaatgtcaagcccagtgtggtgaaagtcgtttcatcacccaaactggcccctaagcgcaaggcggtcgagatgcatgcagcagtgattgctgccgtgaaaccactctccagttcgtctgttctacaggaaccacccgctaaaaaggccgcagtggccgttgtccctcttgtctctgaggataagagcgtgacagtgccagaggcagaaaatccacgcgacagcctcgtgctaccacctactcaatcaagctccgacagcagtcccccagaagtatccggaccttccagcagccaaatgtctatgaagacaagaaggctctcatcggcctctactggaaaaccgcctttatccgtggaggatgatttcgaaaaactgatatgggaaatctcagggggcaaactcgaagcagagattgatctggatccggggaaggatgaagacgatctgctcctggagttgagtgaaatgattgattcgtag

SEQ ID NO: 140991 - DNA, 153 bp, Artificial Sequence
  Description of Artificial Sequence: Synthetic coding sequence
atgcccaatcaaggcgaagactgttatttcttcttttattccacttgtactaagggtgatagctgcccttttcggcactgcgaagcagctattggcaatgagaccgtgtgcacgctttggcaggagggacggtgctttaggcaggtgtgctag

SEQ ID NO: 140992 - DNA, 1548 bp, Artificial Sequence
  Description of Artificial Sequence: Synthetic coding sequence
atgcccaatcagggggaggattgctattttttcttttattcgacttgtacgaaaggagatagctgccctttccgacattgtgaggctgccatcggaaacgagacagtctgcacgctgtggcaagaaggtaggtgttttcgccaggtttgcagattcagacatatggaaatcgataaaaagcgaagcgagattccttgctattgggaaaaccagcccaccggatgtcagaagctgaattgcgcttttcaccataaccgcggcagatacgtggacggtctcttcctcccacctagcaaaaccgttttgcccactgtaccagagtcccccgaagaggaggtgaaagcgagccagttatccgtgcagcagaataaactctccgtgcaatctaacccttcccctcaacttcggtcagtaatgaaagtggagagttctgaaaatgtgcccagtcctacacatccacccgtcgtgatcaatgccgctgatgacgatgaagacgacgacgaccagttttcagaggagggagatgaaactaaaacaccaactttacagcctacgcccgaggtgcacaatggcctaagggtgacaagtgttaggaagcccgccgtgaacattaagcagggtgagtgtctaaactttggtatcaagaccctcgaggagatcaagagtaaaaaaatgaaagagaaatctaagaagcagggcgagggtagcagcggggtgagctctctgctgctccaccctgagccggtgccgggacccgagaaagaaaatgtccgtacagtcgtgcggacagtcaccctcagcaccaagcagggcgaggagccactggttcggctttccctgacagagcgcctcgggaaacgcaagtttagtgctggtggagactctgatccgccactgaaaaggagcctggctcagaggctggggaaaaaagttgaagcccctgaaactaatattgacaaaacacccaagaaagcccaggtctccaagtcacttaaggagcgcctcggcatgagtgccgaccctgataatgaggatgctacggacaaggttaataaggtaggcgagattcacgttaagaccctggaggaaatcctccttgagcgtgcaagccagaagcgcggcgaactgcagacaaagttgaaaaccgaaggccccagcaaaaccgatgattccacctcaggtgcaaggtccagttccactattaggatcaaaaccttctccgaggttttggccgaaaagaaacatcgccaacaggaggccgagcgccagaaatctaagaaggacactacgtgtattaagcttaagattgattcagaaatcaaaaagacagtggtgctgcccccaattgtagcctcccgggggcagtccgaagaacccgctggaaagactaagtcgatgcaagaggtgcacattaagaccttggaggagataaagttagagaaagcactgagagtccagcagtcaagtgaaagctccacttcctccccatctcagcacgaagccacacctggggctcgaaggctcctgcgaatcacaaaacgtacttag

SEQ ID NO: 140993 - DNA, 2271 bp, Artificial Sequence
  Description of Artificial Sequence: Synthetic coding sequence
atggagatcgataagaagcgtagtgaaataccttgctattgggagaatcaacccaccgggtgccagaagcttaattgtgcttttcatcataaccgtgggcgatacgttgacgggctgttcctgccgccctctaaaactgtattgccaaccgtaccagagagccctgaagaagaggtcaaagcgagtcagctgagtgtgcagcaaaacaagctgtcagtccaatctaatccctctccacagctcaggtcagtcatgaaggttgaatcgagcgaaaacgtgccctcccctacccatccccctgtggtcatcaatgctgcagatgacgatgaagacgatgacgatcaattctccgaggaaggcgatgagacgaaaacacccaccctccagccaaccccagaagtgcacaatggccttcgagttaccagtgtccggaagccagcagtgaacataaagcaaggagaatgcctgaactttgggataaaaacgctggaagaaataaagagtaagaaaatgaaggaaaaaagcaagaagcagggggagggcagttccggcgtgtcatctcttctactgcatcccgaaccagttcctgggccggagaaggaaaacgtaagaaccgtggttagaacagtcactctgtccaccaaacagggcgaagagccattggtgcggctgtcactcacagaacggctgggcaaacggaaattttccgctggaggtgatagcgaccccccactaaagcgcagtctcgcccagcggttaggcaaaaaggtggaagcaccagagacaaacatcgataagaccccaaagaaggctcaagtgagcaagtctctaaaagaaaggctcggaatgtcagcggaccccgataatgaagacgctaccgacaaggtgaataaggtcggcgagattcacgtgaagactctggaggaaattctcctggaacgagcttcgcaaaagaggggcgaactgcagacaaaactgaaaactgaaggaccttccaaaaccgacgattcaaccagcggcgctaggtcctcatccacgattcgtatcaaaaccttttctgaagttttggctgagaagaagcaccggcaacaggaggccgagaggcagaaatccaaaaaggataccacctgtataaagctgaaaatcgactcggagatcaaaaagaccgtcgttctgcctccaattgtcgcaagtaggggacagtctgaagaacctgcaggaaaaacaaaatctatgcaggaagttcatattaaaactctggaggaaatcaagttagaaaaagctctgcgtgtgcaacagtcaagtgagtctagcacttcaagccccagtcagcatgaagctacccctggagcacggagactgctgaggattacaaaaaggacagggatgaaggaagaaaaaaacctccaggagggtaacgaagtcgacagtcagtcctctatccgcaccgaggcaaaggaggccagtggagagacaacgggcgtggatatcaccaagatacaagttaagcggtgcgaaacaatgagagagaaacacatgcaaaaacagcaagaacgggaaaagagtgtgctaacgcccctccgtggggatgtggctagttgcaacacccaggtggccgaaaagccagtactcaccgccgtgccaggtattaccaggcatctgacgaagagattgcctaccaagagtagccagaaggtagaagtagagacttctggaattggtgattctcttttgaatgtgaagtgtgcagctcagactctagagaagcggggcaaggctaaaccgaaggtcaacgtcaaaccatctgtcgtaaaggtcgtttctagtcctaaactggcaccaaagcggaaagctgtggagatgcacgctgctgtgattgctgctgtaaaaccgctcagtagctccagtgtgttgcaggagccgccagctaagaaggctgctgtagccgtggttccgcttgtttccgaagacaaatccgtaacagtacctgaggcagaaaatccaagagattctttggtcctgcccccaactcagtcgtcctccgactccagtcccccagaagtttcgggtccaagctcatcgcagatgtctatgaaaaccagacgcttgtcttcagcttcgaccgggaaaccacctctgtcggtagaggatgattttgaaaaacttatctgggagatatcggggggcaaactggaagccgaaattgacctggatccagggaaagacgaggatgacctgctgctggagttgtcagagatgatagattcatag

SEQ ID NO: 140994 - DNA, 2433 bp, Artificial Sequence
  Description of Artificial Sequence: Synthetic coding sequence
atgccaaatcagggagaagactgctattttttcttttacagcacttgcacgaagggcgattcttgtccctttcgtcattgcgaggccgcaattggaaacgaaaccgtctgcacgctctggcaagaaggacggtgcttccggcaggtgtgccggtttcgacatatggaaatcgacaagaaaaggtcagagattccctgttactgggaaaaccagcccacaggctgccaaaagctgaattgcgcattccaccataatagaggacgctatgtggatggtctgtttctccccccctccaagacagtccttcctacagtccctgagtccccagaggaggaagttaaagcctcacagctttccgttcagcagaacaaactgtcagtacagtcaaacccatctcctcagctccggtccgtgatgaaggttgagagttccgaaaacgttccgagccccacccaccctcccgtcgttattaacgccgccgacgacgacgaagacgatgatgaccaatttagcgaggagggagacgaaaccaaaactccaacattgcagcccacacccgaagtgcataacgggttgagggtgacctctgtcagaaagccagccgtaaacattaagcagggggagtgtctcaactttggtatcaaaactctcgaggaaatcaaatccaagaaaatgaaggaaaaaagcaaaaaacagggcgagggatcgagtggcgtctccagtctgctgttgcatcctgagcccgtgcccggacctgaaaaggagaacgtgagaacagtcgttagaacagtaacgctttctactaagcaaggggaagaacctcttgtgcgcctcagccttactgaaagactggggaagaggaagttctctgcaggaggcgactctgaccctcccttaaagaggagccttgcgcagcggctgggcaagaaggtggaggcacccgagactaacatagataaaacccctaagaaggcacaggtttctaagtctttaaaagagaggctgggcatgtcagctgaccctgataatgaagatgccacggacaaggtgaacaaggtgggggagattcacgtgaaaaccttggaggaaatacttcttgagcgagcctctcagaaaagaggcgaattacagactaaacttaaaacagaaggtccatccaagacggacgatagcacctctggtgcccggagttcgtccaccatcaggataaagacgttcagcgaagtgctcgcagagaagaaacacaggcagcaagaagcagagcgccagaaatctaagaaagacaccacttgcatcaagctcaagatagactctgagataaagaagactgtcgtgctccccccgatagtggccagtagaggccaaagtgaagaaccagcaggcaaaacaaagtccatgcaggaggtacacatcaagacgttagaggagatcaagctcgagaaagccctgagagtccagcagtcgtcagagagttctacgtcctccccctcacaacacgaggcaaccccgggcgcaaggcggctgcttagaataactaagaggactggaatgaaggaagaaaagaacctgcaggagggcaacgaagtggacagccagagcagtatcaggaccgaggccaaggaggcatccggagaaactaccggggttgacatcactaagatccaagttaaaaggtgtgagacaatgagagaaaaacatatgcaaaagcagcaggagagggagaagtcggtgctgacacccttacgcggcgatgtggcttcatgcaatacacaggtggcagagaagcctgtgttaacggctgtccctggaattacgcgacacctgacaaaacggctgcccactaaatcctcacagaaggtcgaggtcgagaccagcggtatcggagactccctgctgaacgtgaagtgtgccgcgcaaacactggagaagcgtggcaaagctaagcctaaagttaacgtcaagcccagcgtggtgaaagtagttagttcacctaaactggccccgaaacgaaaagccgttgagatgcacgcggccgtgattgccgcagtaaaacccctgtccagttccagtgtgttacaggaacctccagctaaaaaggccgcagtggccgtggtgcctttggtctctgaggacaaaagcgtgactgttccggaggctgagaatcctagagacagcctggtactgcccccaacacagtctagttctgactcatcccctccagaagttagcggcccttctagcagtcagatgagtatgaaaacgaggcggctgtcttcagcttcaactgggaagccccctttatcagtggaggatgattttgaaaagctgatctgggagatctctggcgggaagcttgaggctgagatcgacctggacccgggaaaagacgaggacgaccttttattggagctgtccgagatgattgactcttag

SEQ ID NO: 140995 - DNA, 1584 bp, Artificial Sequence
  Description of Artificial Sequence: Synthetic coding sequence
atggaacacccgagcaagatggagttctttcagaagctcgggtatgaccgggaggacgtgcttcgggtgttgggaaaactgggcgagggcgccctcgttaatgatgtactacaggagttgatacggacaggctcacgcccaggcgccctggaacaccccgccgccccgcgactcgtgccaagaggaagctgtggggtgcctgatagtgcccaaaggggaccaggcaccgctctggaagaagattttaggactttagccagtagcttacggcctattgtgattgatggatcaaacgttgccatgagtcacggcaataaggaaaccttctcttgcaggggtatcaagctggccgtggactggttccgagacagggggcacacctatattaaagtgtttgttccctcatggagaaaggaccccccccgggcggacacacctattcgggaacagcacgttttagcagaactggagaggcaggctgttctggtgtacacccctagcaggaaagtgcacggcaaacggctcgtgtgttacgatgatagatacatagtcaaggtcgcatatgagcaagacggggtcatagtctcaaacgacaactaccgtgacttgcagtccgagaatccggagtggaagtggttcattgagcaacgtctgctgatgttcagttttgtaaacgatcgtttcatgccaccagatgaccccttgggtcgtcacggaccgagcctgtctaacttcctgtctcgcaagccaaaaccaccagagcctagttggcagcactgcccctatgggaagaaatgcacgtacgggatcaagtgcaagttctaccacccagaaaggccccatcatgcccagctggcggtagctgacgaactgagggccaagacaggagccagacccggtgctggtgctgaagagcagcgccccccacgggcccccggaggctcagctggcgctagggcggccccccgggagccgtttgcccacagcctgccaccggctcgcggatcaccggacctggccgcattacgcggatctttctcacgactggcctttagcgatgatctgggtccactaggtcccccacttcctgtgcccgcttgtagcctgacaccgcgcctcggcggccccgattgggtttctgcaggcggtcgggtgcccggcccactgtctctgccgagccctgagtcgcagttcagtcctggcgacctgccacctccccctggcttacaacttcagcctagaggcgagcatagacctagagatctgcacggcgatcttttgtctcctcgaaggcctcccgatgatccctgggcccgtcctccccggtccgaccgctttccaggcaggagcgtctgggctgagcctgcatggggagatggtgctactggggggctcagcgtgtacgccaccgaagacgatgagggagatgcgcgcgcccgcgcccgtatcgctttgtactcagttttcccccgagatcaagtcgaccgcgttatggcagcatttccggaattgtccgatttagcccgattgatcttactcgtccagaggtgccagtctgccggagcacccctgggcaaaccttag

SEQ ID NO: 140996 - DNA, 1584 bp, Artificial Sequence
  Description of Artificial Sequence: Synthetic coding sequence
atggaacacccttccaagatggaattctttcagaagctagggtatgacagggaggatgtattacgggtcctaggcaagctgggagagggcgcccttgtgaacgatgtgctccaggaactgattcgaactggatctcggccgggggccctagagcaccccgcagctcccaggctagtacccaggggtagttgtggggtacccgactccgcacagcgcgggcccggaactgccctggaagaggatttccggactcttgcgtcttcattgaggcctatagtcatcgacgggagcaacgttgccatgtcacacggaaacaaggagacctttagttgtcgcggcattaaactcgctgttgactggtttagagaccggggacacacctatatcaaagtattcgtgccaagctggcgcaaagaccccccgagagcagatacgcccattagagagcagcatgtactggctgagcttgagagacaggccgtactggtctacacccctagtcgcaaggtgcatggcaagcgtctcgtgtgctacgatgatagatatatcgttaaggtcgcctacgaacaggacggtgtgatcgtctcaaacgataactacagagacctgcagtcagaaaatccagagtggaagtggttcatagaacagcgcctgcttatgtttagcttcgtgaacgatagattcatgcccccagacgatccattgggcagacatggcccatcgcttagcaacttcctgagcaggaaacctaagccaccagaacccagctggcaacactgcccttatggcaaaaaatgtacctatgggattaagtgtaaattctatcacccggaacggccgcatcacgcccaactggctgttgcggatgaactaagggcaaaaaccggcgctcggccaggcgctggggcagaagagcagaggccaccgagagcccctggtgggagcgcaggcgcccgagctgctccaagggaacccttcgcccattctctcccacctgcaagaggctcaccggatctggctgccttacgcgggagtttcagtaggctggcattctctgacgacctgggacccctcggtcctcccctgcccgtccccgcttgttcactcactcctcggctcggtgggccagactgggtctcagccggtgggcgtgtccccgggcccctgagccttcctagtccagagagccagttctcccccggggaccttccgccaccacccggactccagcttcagccaagaggggagcacagaccacgagatttgcatggagaccttctgtcgcctcggcgccctcccgacgacccatgggcccgaccaccgaggtcggatagatttcccggaagatcagtgtgggctgaacccgcatggggcgatggggccactgggggactgagcgtgtatgccactgaggatgacgagggggatgcccgggcacgcgccaggatcgcactttatagtgtgttcccaagagatcaagtggacagggtcatggctgcctttcccgagctctctgatctcgctcggctgattctgctcgtccagcgatgccagtccgccggagcccccttgggaaaaccatag

SEQ ID NO: 140997 - DNA, 966 bp, Artificial Sequence
  Description of Artificial Sequence: Synthetic coding sequence
atggagcatccatctaagatggaatttttccagaaacttggctacgatcgcgaagacgtattgcgagtgctgggcaagctcggagaaggagcactagtcaacgatgttcttcaggaactgattaggactggaagtcgacctggtgccctcgaacaccctgccgctccccgcctagtgcctagaggatcttgtggggtgcctgactccgcccagagggggcctggaacagcgctggaagaagatttcaggacactagccagctctctgcgtccgatcgtaatcgatgggtctaatgtggctatgtcacatggcaacaaagaaactttcagctgtagaggtattaagctggcggttgattggtttagggaccgcggccatacttacatcaaagtgtttgtgcctagttggcgtaaggatcctccaagggcagacactccaatacgggaacaacacgtgctagcagaattagagcgccaggccgttctggtttacacacccagtcggaaggttcatggcaaacgcctcgtgtgttacgatgatcggtacatcgtgaaagtcgcttatgaacaggatggagtcatcgtcagtaatgacaattatcgtgatttgcaatccgaaaatccagaatggaaatggttcattgaacaaaggttgctcatgttcagtttcgtaaacgacagatttatgccccccgacgatccgttgggacgccatggtccatctctgtccaatttcttgtcacgcaaacctaaaccccctgagccttcctggcagcactgtccttacggtaagaagtgcacgtatggaatcaagtgcaagttctaccaccctgagcggccgcatcacgctcagttggctgtggctgacgaacttcgtgctaagacgggtgctcggctgggcgtgagaggtagaccccctgcctccgctcgcccggcagctccagctgcaggtcgaaccccgccctag

SEQ ID NO: 140998 - DNA, 966 bp, Artificial Sequence
  Description of Artificial Sequence: Synthetic coding sequence
atggagcacccaagtaagatggagtttttccagaaactcggctatgatcgtgaggatgtattgcgagtcttaggtaagctgggagaaggcgctttggtcaatgatgtgctgcaagaactcatccggacgggctcaaggccaggagcccttgagcaccctgcggcgccaagactcgttcctcgcggaagttgtggggtgccagattcagcccaacgtgggcctggcaccgccctggaagaagactttaggacattagccagctcactcagacctatcgtgattgatggctcaaatgtagccatgtcccacggcaacaaagaaactttttcatgtcggggaataaaattggctgttgactggtttagagatcggggccatacttatattaaagtgttcgtgccttcttggcggaaagacccgcccagggccgacacccctatccgcgagcaacatgtgctggcggaactggaacgtcaagctgtgctagtctatacacccagtcggaaggtacacgggaaaagactagtttgctacgatgacaggtacatcgtcaaagtggcttatgagcaggatggcgtgatagtcagcaacgacaactaccgggatctgcaatctgagaatccggagtggaaatggtttatcgaacagagattgctgatgttctccttcgtaaatgaccggttcatgccgcccgacgatcccctcgggaggcatggaccttcactgagtaactttttatcgagaaaacccaagccacccgagccgagctggcagcactgtccgtacggcaagaaatgcacctacggcattaaatgcaagttctaccaccctgagcgcccgcatcatgcccaattggctgttgcagatgagcttagggccaaaactggggccaggccagttctgcctggtaggccccccgcaagcgctcggcctgcggcccccgcggccggaaggacacccccctag

SEQ ID NO: 140999 - DNA, 2211 bp, Artificial Sequence
  Description of Artificial Sequence: Synthetic coding sequence
atggaaataggcacagagatctcacggaagattaggagtgcaattaaaggtaagctgcaggagctgggagcatacgttgatgaggagctgcctgattacatcatggttatggtggccaacaagaagtctcaggaccagatgaccgaggaccttagtctgttccttggaaataataccattaggttcactgtatggctgcacggggtgctcgacaagctgaggtctgtgactacagaaccgagcagtctgaagagcagcgacactaacatctttgattccaacgttccgtccaacaaatcaaatttctctcgaggcgatgagcgaagacacgaggctgctgttcctcccctggccatcccttctgcgaggcctgagaagagggactctagggtttccaccagctcacaggaaagcaagacaaccaatgttagacagacctacgacgatggagccgcgacccgtctgatgtcaactgtcaagccgcttcgcgaaccagctcccagtgaggacgttatcgatataaagcctgagccagatgacctgattgacgaggacctaaacttcgtacaggagaaccccttgtcacaaaaaaaacctacggtgaccctcacatatggatcttcccggcctagcatcgaaatatacaggcctcccgcttcgcggaatgctgacagtggcgtgcacctgaatcggctacaatttcagcaacagcagaacagcatacacgcagccaaacagttggacatgcaatcatcttgggtctatgagacggggcgcttatgcgaacctgaagtactgaacagcctagaggagacatactctccattctttcggaataactcagaaaagatgagtatggaggatgaaaacttcaggaaacgcaaattaccagtggtgtcctccgtagtgaaggtcaagaaatttaatcatgacggcgaagaggaggaagaggatgatgattatggctcacgaaccgggtcaatctcgtccagcgtaagtgtgcccgcgaaacccgagcgccgtccatccctgcccccatctaagcaggccaataagaatctaattcttaaggctatctccgaggcccaggaaagcgttaccaaaacaacaaattatagtacagtgccacaaaagcagacattgccagtggccccacgaactaggacaagccaagaggaactcctcgctgaagtggtgcaggggcaatccagaacgcccaggattagccctcctatcaaggaagaagagactaagggggactcggtggaaaagaatcagggaacacagcagcgacaactgctcagtaggctccagatagacccagtgatggctgagacactccagatgtcacaggactattacgatatggaatcaatggtccacgccgataccagatctttcattctaaaaaagccgaagctgtccgaggaagtggttgtcgcacctaaccaggaatcaggtatgaagacggccgatagcttaagggtgctcagcggacacctaatgcagacaagggatttagtgcagccagacaagcctgcatctcccaaatttattgtcaccctcgatggggtcccatcgcccccggggtacatgagcgaccaggaggaggacatgtgtttcgaaggaatgaaaccagttaatcaaacagccgcctccaataagggacttcgcgggctcttgcaccctcagcagctgcatctattgtctcggcagttggaggacccaaacggtagcttcagcaatgccgaaatgtcagagctgtctgttgcccagaagccagagaagctgcttgagagatgtaagtattggcccgcctgtaaaaacggtgacgaatgcgcctaccaccatcctatctccccctgtaaagcattccctaactgcaagtttgctgagaagtgtctgttcgtacatccaaattgtaagtacgatgccaaatgcaccaagcctgactgtccattcacgcacgtgtcacggcgcataccagtactttcaccaaaacccgcagtggctccccccgccccaccatcctcttcacagctgtgtcggtacttccccgcctgtaaaaaaatggagtgtccattttatcatcctaaacattgccgcttcaatactcagtgcacaagaccggattgcacgttttatcatcccactattaacgttcctccccggcacgccctgaagtggattcgccctcagacctctgagtag

SEQ ID NO: 141000 - DNA, 1740 bp, Artificial Sequence
  Description of Artificial Sequence: Synthetic coding sequence
atggagatcggaacagagatctccaggaagattaggagtgctatcaaaggtaagctgcaggagttgggagcatatgtcgatgaagaactgccggattacatcatggtgatggttgctaacaaaaagtcccaggatcagatgaccgaagacctgtcacttttccttggcaacaacactatacgctttaccgtttggttacacggggtcttagataaactgagatctgtgacaactgagccttcttccctgaagagtagcgacactaatattttcgactcaaatgtccctagcaacaaaagcaatttttccaggggcgacgagagacgccacgaagccgccgttccaccgctggccatcccctcagcacggccagagaaaagggattctcgagtctctacctcctcacaggagtccaagaccactaacgtgcggcaaacgtatgacgatggagctgccactcgcctaatgtctaccgtaaagcctcttcgagagccagctcccagcgaagatgtcatcgatatcaagcctgaaccagatgacctcatagatgaagacctgaacttcgtgcaggaaaaccccctcagtcagaagaagccaacagtaactctgacctatggctctagccgaccctcaattgagatttaccgaccacccgcctctcgcaatgctgacagcggagtccacttgaatcggttgcagttccaacagcaacagaatagcattcacgcagccaagcagctggatatgcagtcctcctgggtttacgagacggggaggttgtgcgaaccggaagtgttaaacagcttagaggagacatactcacctttctttaggaacaactctgagaagatgtctatggaggatgagaacttcaggaagagaaaattgcctgtggtaagctctgtggtgaaagtcaagaaattcaatcacgacggtgaagaggaggaagaggatgatgattacggaagcaggactggcagtatcagcagctcagtgtcagtgccagccaaaccggagcggaggcccagccttcccccctctaagcaggccaacaaaaatctgatactgaaggccatcagcgaagcccaggagtcagtgacaaagactacaaattattctacagttcctcagaagcagacactgccggtcgctccaaggactcgcacatctcaagaggagttgctcgctgaggtcgttcagggccagtcgcgcacacctaggatatctccacccatcaaggaggaggaaaccaagggggactcagtagaaaaaaatcaggcggagatgtcagagctttcagtggcacaaaagcctgaaaaactgcttgagagatgtaaatactggccggcttgtaagaacggggacgaatgcgcataccaccatcccatctctccatgcaaggctttccctaattgcaaatttgcggaaaaatgcctgttcgtgcaccccaactgcaagtatgacgcgaagtgtaccaaacccgactgtccttttacacatgtatccagaaggatccccgtgctgagccccaagcccgtggccccccccgcaccacccagctcgtcacaactgtgccggtacttccccgcctgcaaaaaaatggagtgccctttctaccatccaaagcactgccggttcaatactcaatgtacccgccctgattgcacgttttaccaccccactattaacgtccctcctcgtcatgccctcaaatggattcgtccccagacatctgagtag

SEQ ID NO: 141001 - DNA, 921 bp, Artificial Sequence
  Description of Artificial Sequence: Synthetic coding sequence
atgagaatgtccagcaaattcccatctccaccgctccctatcttcctccctccagaacctgttgacctcggctccatcacaagttcgtcgtgcagcctcaatgagttagataatatctcgcatctcttaagaaaaatcagtgcggacattaacgagatcaagggcatgaaagccgcaattcttacagtggaggctaatctgtttgacctgaacgtccgggtgagtaagaatgaggctaaaatttcctcattggaggttaaaatgaatgaatactccaccacatatgaatgtaacaggcaatttgaagaccaagaggaggacacagagtcgcagtccagaacaactgacgtcaaaatcattggttttttacgaaacgtggaaaaggggacccagcagcgccagctgctctcaagactgcaaattgatcccgtgatggcagaaacattgcagatgtcgcaggcagaaatgtcagagctcagcgtggctcaaaagcccgaaaaattgctggagagatgtaagtactggcctgcttgtaagaatggggacgagtgtgcctaccatcatcccatcagtccttgcaaagcttttcccaactgtaagtttgccgaaaagtgccttttcgtgcatcccaactgtaaatacgatgctaaatgcactaagccggattgtccatttacccacgtaagtagacggatccctgtcctaagtcccaagcccgttgcccccccagcaccacccagctcaagtcagctttgccggtacttcccggcctgtaagaagatggagtgtcctttttatcaccccaaacattgtagattcaatacccagtgcacacggccagactgcacattttatcaccccacaatcaacgtgccccctcgccacgccttgaaatggattcggccacagacatcggaatag

SEQ ID NO: 141002 - DNA, 1716 bp, Artificial Sequence
  Description of Artificial Sequence: Synthetic coding sequence
atggtgatggtggcaaataagaaaagccaggaccagatgacggaggaccttagcttattcctcgggaataatacaatccggttcacggtctggctgcatggcgtactggacaagttaaggagcgtgactacagagccttcaagcctgaaatcatccgatacaaatatatttgatagtaacgtgccttctaataaatccaatttcagtaggggcgatgaaaggcgccatgaggccgccgtaccgccattggccataccctccgccaggcctgaaaaacgtgacagtcgcgtctcgacatccagtcaggagtccaagactacgaacgtaagacagacatatgacgacggagcagcaacccgcctgatgtctaccgtgaaaccgctgcgagaaccagcaccctcagaggacgtcattgacattaaacctgaacccgacgatctaattgatgaagacctcaacttcgtgcaagaaaaccccctgtctcaaaagaagccaactgtgacgctaacgtacgggtcttctcgcccttctatcgagatttaccggccacctgcgtcccgtaacgcagattccggcgtgcaccttaatcggttacagtttcagcaacaacaaaacagcatccatgcggctaagcagctcgacatgcaatcctcgtgggtctatgagacaggaagactgtgcgagcccgaagtgctgaacagtttagaggagacttactcccccttttttagaaacaacagtgaaaagatgtccatggaggacgaaaactttagaaagaggaaactgcccgtggtgtcttccgtcgtgaaggtgaagaagtttaatcatgatggagaagaggaagaagaggatgatgattatgggagccggaccggctccattagctcatcggtgagcgtgccagccaagcccgaaaggcggccctctctgcccccatccaagcaagccaataaaaacctgatccttaaggccatctccgaagcccaggaatccgtcactaaaacgaccaattattcgaccgttccacagaaacagactctgcctgtggccccaaggacacggacaagccaagaggaactactggccgaggtggtgcagggacagtcccggacccctcgaataagcccccccattaaagaagaggaaacaaaaggcgattcagtagaaaagaatcagggcacccagcagcgccagctactgagtcggttgcagattgaccccgtgatggcagaaacacttcagatgagccaggccgagatgagtgagcttagcgtggctcagaagccggagaagctcctagagagatgtaaatattggccagcctgtaaaaatggcgatgaatgtgcctaccaccatcctatttcaccctgcaaggccttccccaactgcaaatttgcggagaaatgtctgttcgtacatcccaactgtaaatatgatgccaaatgcactaagccagactgtccatttacacatgtgagccgcagaatcccggtcctctctccaaagccggctgtcgcccccccagcccctccaagcagctcccagctatgcagatatttcccagcctgtaagaaaatggaatgtcccttctaccatcccaagcattgccggtttaacactcagtgtacaaggcctgattgcaccttttatcatccgacaatcaatgtccctcctagacatgcactcaaatggattagacctcagacaagcgagtag

SEQ ID NO: 141003 - DNA, 2022 bp, Artificial Sequence
  Description of Artificial Sequence: Synthetic coding sequence
atggagatcggcacggaaatctcacgcaaaatcagatcggcaattaagggaaagctgcaagaactgggagcatatatcgacgaggaactgcccgattacataatggttatggttgctaataaaaagagccaggaccagatgacagaggatctatcgctgttcctgggcaacaacacaattcggtttacagtgtggctgcacggcgttctggataagctacgatcggttaccacagagccgtcctctctcaaatcctctgatacaaatatctttgacagtaatgtgcccagcaataaaagcaattttagtaggggagatgagaggaggcacgaggcagctgtgccgccactggcaatcccatcagccaggccagaaaagcgcgactcccgcgtgtcaacctccagccaggaatcaaaaacaacaaatgtgcgacagacatacgatgacggtgcagcaacccgcctgatgtctacggtaaaacccttgagagagccggcccctagtgaagacgtgattgatatcaagcctgaaccggacgacctgattgatgaggatctcaactttgtgcaggagaatccactttctcagaagaaacccaccgtcaccttaacatacggttccagtagaccttcaattgaaatttatcggcccccagcctcacggaacgccgactccggcgtgcacctaaacagacttcaatttcagcagcagcagaacagcattcatgccgccaagcagctcgacatgcagtcctcgtgggtgtacgaaaccggcagactatgtgagccggaggtgctcaactctttggaggaaacttattcgccattcttccggaacaattctgaaaaaatgtcaatggaagatgaaaatttcagaaaaaggaagctccccgtagtgagttctgtcgtcaaggtgaagaaatttaaccatgatggagaagaagaggaagaagacgatgattacggttcccgcaccggcagcatttcctcaagtgtgtcagttcccgcgaagcccgagcggcgtcctagcctgcccccctccaaacaagccaacaagaatctgatattgaaggccattagtgaagctcaggagtcagtcactaagacgaccaattacagcaccgttccccagaagcaaacactccctgtcgcacctaggacccgcacatcccaagaggagctgctggccgaagtcgtgcaagggcagtcgagaactcctcgcatcagcccacccatcaaggaggaggagactaagggcgactccgttgagaaaaaccaagggacccaacagcgccagctgctgtcccggcttcagatcgaccccgtgatggcggaaactctccaaatgagccaggattactatgatatggagtcaatggtccatgctgacacccgaagttttattctaaaaaagccgaagctgtccgaagaggttgtagtggcacccaatcaggaatctggcatgaagaccgcagacagtttgagagttctgagtggccacctgatgcagaccagagatttggttcagcccgataaacctgcttctcctaagttcattgtaacactcgatggcgtgccatcaccacccggctacatgagcgaccaagaagaagacatgtgcttcgagggaatgaaacccgtgaaccagaccgccgcctcaaacaagggtctgcgcggcctactgcacccccagcagttacacttgctcagccgccaactcgaggatccaaactgtaaatacgatgcaaaatgtacgaagccagattgtccattcacccatgtctctcgtaggataccagtgttgtctcccaagcctgctgtcgctccccccgcccccccttcttcatctcagctgtgccgttactttccagcatgtaaaaagatggaatgcccattttaccaccccaagcattgccgtttcaacacccagtgtacccgcccagactgtacattctaccaccccactattaatgtcccgccacgccacgctctgaagtggattcgcccacaaacctctgagtag

SEQ ID NO: 141004 - DNA, 1716 bp, Artificial Sequence
  Description of Artificial Sequence: Synthetic coding sequence
atggtcatggtcgcaaataaaaaatcacaagatcagatgacagaggacttgtccctgttccttgggaataacactatccgcttcaccgtgtggctgcatggcgtgctcgataagctgaggtccgtaactactgagccctcttccctgaagtcctccgatactaatatcttcgattctaacgtcccctctaataagtcgaatttcagcagaggcgatgagcggaggcacgaggcagctgtccccccgctcgctatcccctccgccagacctgaaaaaagagacagcagagtatcaacttctagccaggagtcaaagacgacgaatgtgaggcagacatacgatgatggagctgcgacaagattaatgtccacagtaaagccattgcgcgaacctgccccatccgaagatgtaatcgatataaagcccgaaccggacgatctgatcgacgaggatctgaactttgtgcaggagaatcctttatcccagaaaaaacctactgtgactctcacctatggcagttccaggcctagcattgaaatctatagacctcccgccagtcgaaacgccgactctggcgtacacctgaatcgccttcagttccagcagcaacagaacagtatacacgctgctaagcaactcgacatgcagagcagctgggtttatgagactggccgcctgtgcgagcctgaagtgctgaacagtttggaagagacttatagcccattttttagaaacaattccgagaagatgtctatggaagacgaaaatttccggaaaagaaaactgcccgtcgtcagttccgtcgtcaaggtcaaaaaattcaatcacgacggcgaggaggaagaagaagacgacgactacggaagccggacaggttccatttcttcctctgtatcagtgcctgctaagcctgaacgcaggccatcacttcctccatctaagcaggcgaacaaaaatctaatactgaaagctatctcagaggctcaggagtcggttacaaagacaactaactattcaactgtgccacagaagcagaccttacctgtcgctccaagaacacggaccagccaggaggagttgttagccgaagtagtccagggccagagcagaaccccaagaatatcccctcccataaaagaggaggaaaccaagggggattcagtggagaagaaccagggaacacagcaaaggcagctgctgtccaggttacagatagaccctgtgatggccgagaccctccagatgtcccaagcagaaatgagcgaactgagcgtggcgcagaaaccggagaagctgctggaacggtgcaaatactggcctgcatgtaaaaacggtgacgagtgtgcataccatcaccctatatcaccttgcaaagcctttcccaattgtaaatttgccgaaaaatgcctcttcgttcatcctaactgcaagtacgatgccaaatgcaccaaacctgactgtcccttcactcatgtatcgcgccgcatccctgtgctgagcccgaaacccgccgtggctcctcccgctcccccatcctcctcacagctttgcaggtattttcctgcctgcaaaaagatggagtgtccgttttatcacccaaagcattgccgctttaacacccagtgcacccggcccgactgcacattttaccatcccacaattaatgtgcccccccggcacgcacttaaatggatcaggccccaaactagcgaatag

SEQ ID NO: 141005 - DNA, 1758 bp, Artificial Sequence
  Description of Artificial Sequence: Synthetic coding sequence
atggagatcgggactgagatcagccgcaaaattcgaagtgccataaaagggaagcttcaggagctaggcgcttacgtggacgaagagttgcctgactatattatggttatggtggccaacaaaaaaagtcaagatcagatgactgaagatctgtccctgttcctcggcaacaataccatacggttcaccgtctggttgcacggtgtgctcgataagttacggtccgtcacgacagagccctcctccttaaaatcttctgacacaaacatcttcgactccaatgttccgcccctggctatcccgtctgcccgacctgaaaagagagacagtcgcgtgtccacatcttcacaagagtcgaaaactaccaatgttcggcagacctatgatgatggtgccgctaccaggcttatgtcaaccgtgaagcctctgcgggagcccgctccctcagaagacgtgatagacatcaaacctgaacccgacgatctcatcgacgaagaccttaacttcgtacaggagaacccactttctcaaaaaaaacctactgtcaccctgacttacggttcttcccggccttctatcgaaatttaccgaccacccgcctcaaggaatgcagatagtggcgtacatctcaacaggctccagttccaacagcagcaaaattcaattcacgcggctaagcagctcgatatgcagtcatcctgggtttatgagacaggacgcctgtgcgaacctgaagttctcaatagtctggaagagacctattctcccttcttccgcaacaactcagagaaaatgtctatggaggacgagaactttaggaaaagaaagttaccggtagtgagttccgtcgtcaaggttaagaagttcaaccacgatggcgaggaagaggaggaagacgacgactacggttcccgtacaggctctatcagcagctccgtatcggtgcccgccaagcctgaaaggcggccgtccctgccaccctccaagcaggcaaacaaaaatcttatcttaaaggcgatctctgaggctcaggagtcagtgacaaagactaccaactatagcacagtgccccagaaacaaacccttcccgtggctcctcgaacccgaacaagccaggaagaactcctggcagaagtcgtgcagggccagtcgaggacacccagaatcagtcctcctatcaaagaagaggagaccaaaggcgattcagttgagaaaaaccagggtacacagcaacggcaactgctgtccagactccagatcgatcctgtcatggccgaaaccctgcagatgagccaggctgagatgtcagagctgtcagtggcacagaagcctgagaaactcctggagagatgcaagtactggccagcttgtaagaatggggatgagtgcgcataccatcatccaatctccccatgtaaggctttccccaattgtaagttcgccgagaagtgcctgtttgtgcatcctaattgtaaatacgacgcaaaatgcactaaaccggactgcccttttacccacgtgtcccgcagaattcccgtgcttagcccaaaacctgtggccccacctgccccgccttcctcatcccagctgtgtcgctatttccccgcgtgcaaaaaaatggaatgcccattctatcaccccaaacactgtcggttcaatacccagtgtactagacccgactgcacattctaccaccctaccattaatgtacccccccgacacgccctgaagtggatacgcccacagaccagcgagtag

SEQ ID NO: 141006 - DNA, 2136 bp, Artificial Sequence
  Description of Artificial Sequence: Synthetic coding sequence
atggagattggaacagaaatctcgcgcaagatccgctccgccatcaaagggaagctacaggagctcggagcctacgtggacgaggagttgccagactacatcatggtcatggtcgccaacaagaagagccaagatcagatgacagaagacctgtctttattcctcggcaacaacactatccggtttaccgtctggctccacggcgtgctggacaaactgaggtccgtcacaacagagccatcaagcctgaaatcctccgacactaatatcttcgatagcaacgttccaagcaataagtccaatttcagcagaggcgatgaaagaaggcacgaagcggctgtcccacctttagctattccctccgccaggccagaaaaaagggactctagggtttctactagctcacaggaaagcaagacgactaatgttcggcagacatacgacgatggggccgcaacccgcttgatgtcaactgtcaaaccccttcgggaacccgccccctctgaggatgtgatcgatatcaaaccagaacccgacgatttgatcgacgaggatctgaacttcgtgcaggagaaccctctctctcagaagaaaccaactgtgacactgacatacggatcttccaggccatccatcgagatatatcggcctccagcaagtcgcaatgccgatagcggtgtacatctgaacaggctacagtttcagcagcagcagaactccatccatgccgccaaacagttggacatgcagtcatcctgggtctatgaaactgggcggctttgcgagcctgaggtcctgaatagtctggaggaaacctactcacctttttttagaaataattccgagaaaatgagcatggaggatgagaattttcgcaagcggaagctcccagtggtatcttccgtggtgaaggtgaaaaagttcaaccatgatggtgaggaggaggaagaagatgacgattacggcagcagaactgggtccatctcctcctccgtgtccgtgcccgcgaagccagagagaagaccaagtctgcctccatcaaagcaggccaacaaaaatttgattctcaaggcaatctccgaggcacaagaaagtgtgacaaaaactacgaactattcaaccgtgccacaaaaacagactctgccagtcgcgccaaggacccgaacaagtcaagaggaactgctcgctgaagtggtacaaggtcagtctcggacaccacgaattagcccccccatcaaggaggaggaaacaaaaggggactccgtcgagaagaatcaggactactatgacatggaatcaatggtacacgccgacacccgttcatttatcctgaaaaaacctaaactgtctgaagaggtcgtcgtcgcaccaaaccaggagtcaggtatgaaaactgccgatagcctgcgtgtgctcagtgggcatcttatgcagacaagggatctggtacagccagataaacccgcttctccaaagtttatcgtaacccttgacggcgtgccctcgccaccagggtacatgagcgaccaagaagaagatatgtgctttgagggcatgaagcctgtgaatcagactgctgccagcaacaagggactgcggggtttgctccatcctcagcaactgcatctcctttcccggcagttggaggatccgaatggatctttttcaaacgctgagatgtctgagctctctgtagcacagaaacctgagaaattgctggagagatgtaagtattggccggcttgtaagaacggagacgagtgtgcctaccaccacccaatctctccttgtaaagcctttcccaattgcaagtttgctgaaaaatgtcttttcgtgcaccccaattgcaaatatgatgcgaaatgcacaaagccagattgcccctttacccacgtgtctcgccggatccccgtgctcagcccgaaacccgccgttgcaccacccgcccctccatcttctagtcagctgtgtagatacttccccgcttgcaagaaaatggaatgtccgttttaccaccccaaacactgtcggttcaatacccagtgtactagacccgactgcacattctaccatccaactattaatgtgccgcctcgccacgcgttgaagtggattcgcccccagacatctgagtag

SEQ ID NO: 141007 - DNA, 2136 bp, Artificial Sequence
  Description of Artificial Sequence: Synthetic coding sequence
atggagattggtacggaaatctctagaaagatcaggagtgccatcaaagggaaactgcaagagctgggggcatacattgacgaagagctgcccgactatattatggtcatggtggctaataagaagtcccaggaccagatgacagaagatttgtcactttttctggggaacaacactataagattcaccgtttggcttcacggggtgctggacaagctgcggtctgtcaccaccgagccgtcatcgctcaaaagctccgacaccaacatcttcgactcgaatgtgccctcgaataagtcgaacttcagcagaggggatgagagacggcatgaggccgccgtccctccactggcgattccctcagctcggccagagaaaagggattcccgggtgagtacctcctctcaagagtccaagaccacaaacgttagacagacgtatgacgacggcgcagcgacgcggcttatgtccacggtcaagcctctacgggagcctgctccttccgaggacgtgatagacatcaaacccgagcctgacgacttaatcgacgaggaccttaatttcgtgcaggagaaccccctcagccagaagaaaccaactgtcactttgacgtatggttcttcgcgcccctcaatcgaaatatatcggccgccggcttcaaggaacgcagatagtggggtacacctgaaccgcctacagtttcagcagcaacaaaattccatccatgcggccaaacagctggacatgcagagctcctgggtgtacgagactggtcgtctttgcgaacctgaagtgctgaactcgctcgaagagacttatagcccatttttccgcaataattctgagaagatgtcaatggaggatgaaaacttccgcaagaggaagctccccgtcgtgtcatccgtcgtgaaggttaagaagtttaaccatgacggcgaagaagaggaggaagatgatgactacggctcccgcacagggagtattagtagcagcgtttccgttcctgccaaacccgaaagacgcccatctttgcctccaagcaagcaagctaacaagaacctgattttgaaggctatctccgaggcacaagagagtgtgaccaaaaccacaaactattcaacagttccccagaaacagactctcccagtggcaccaaggacccggacaagccaggaggaactgttggcagaggtcgtgcaggggcagagcagaaccccgcgcatttctccccctattaaggaggaggagacgaagggtgactccgtggagaaaaaccaggactactatgatatggagtctatggtccatgccgacacaaggagctttatcctgaagaagccaaagctgagcgaagaagtggttgttgcaccgaaccaggaatccggcatgaaaacagccgatagtctacgcgtgctgtctggccatctgatgcaaacccgggatttggtgcagcccgacaaacctgctagtcctaagttcatcgtgaccctggatggggtgccaagccctccaggttatatgtccgaccaggaggaagatatgtgcttcgagggcatgaagcccgtgaaccagacagcggcttctaataaaggcttgcggggactgctgcacccccaacaactgcacctattgagtcgacagcttgaagacccgaatggttcgttcagtaacgcggagatgtcagagctgtctgtcgcgcagaagccagagaaacttctggagcgctgcaaatactggcctgcctgcaagaatggggacgagtgcgcctatcaccatcccatttccccatgtaaggcgtttcccaattgcaaattcgctgagaaatgtctgttcgtccacccgaactgtaagtacgatgccaagtgtaccaagcccgattgtcctttcactcatgtaagtcggcggattcctgttcttagcccgaaacccgctgtggctcctcccgccccccccagcagctctcagttgtgtcggtatttcccagcttgcaagaagatggaatgcccgttctaccacccgaagcattgtagatttaacacccaatgcacacggcccgactgcaccttttatcaccccactatcaacgtaccacctcgccacgctctgaagtggattaggccacagacctccgaatag

SEQ ID NO: 141008 - DNA, 849 bp, Artificial Sequence
  Description of Artificial Sequence: Synthetic coding sequence
atgagaatgagcagtaagtttcctagccccccgctgcctatctttctcccccccgagcctgttgacctaggaagcatcacaagctcctcctgttctctcaatgagcttgataacataagccatctgctgagaaaaatttcagccgacatcaacgagattaaaggcatgaaggcagccatcttgacagtggaagcaaacctattcgacctgaatgtaagggtgagtaaaaatgaggccaaaatttcatctttggaagtgaagatgaatgagtactctacaacttacgaatgtaaccggcaattcgaggaccaagaggaagacaccgagtcccagtccaggaccacggacgtgaagataatcggatttctgcggaatgttgaaaaggcagagatgtccgagctaagcgtggcacaaaagccagagaaattgctggagaggtgcaaatattggcctgcatgcaaaaacggggacgagtgcgcatatcatcatcccatatcgccatgcaaggcgttccccaactgcaagtttgcggagaaatgcctattcgtgcaccctaattgcaaatatgacgcaaagtgtaccaagcctgattgccccttcactcatgtgtcacggcgaatccccgtcctcagtcctaaacctgctgtcgctcccccggctccgcccagttcctcacaactgtgtaggtattttccagcatgtaaaaagatggaatgccccttctatcaccctaaacactgccggtttaacacccagtgcactaggcccgattgcactttttaccatcctacaatcaatgtgccaccaaggcacgccctgaagtggatccggccacagacgtccgagtag

SEQ ID NO: 141009 - DNA, 219 bp, Artificial Sequence
  Description of Artificial Sequence: Synthetic coding sequence
atggtcatggtcgcaaacaaaaagagccaggaccagatgaccgaagatctgtctctcttcctaggaaataacacaattcgcttcacggtatggcttcatggcgtcttggacaagctacgctccgtcacaacggagccttcttcactcaagtccagcgataccaacatattcgactcaaatgtgccatctaacaagagcaatttctcccgtggcgactag

SEQ ID NO: 141010 - DNA, 285 bp, Artificial Sequence
  Description of Artificial Sequence: Synthetic coding sequence
atggtgatggtagctaacaaaaagtcccaggaccagatgacagaagacctgtccctgttcctggggaataatactatccggttcactgtgtggctccacggcgtactcgataagttgcggagtgtcacgacagagccttccagtctgaagagctctgatacaaatatcttcgactctaatgttcctagcaataaatcaaatttcagccgaggggatgaacgccgacacgaagccgctgtccctccattggctatcccaagtgcaaggcccgagaagcgagattag

SEQ ID NO: 141011 - DNA, 648 bp, Artificial Sequence
  Description of Artificial Sequence: Synthetic coding sequence
atggttatggttgccaacaaaaagtctcaggaccaaatgacagaagatctgagcctattcttgggaaataataccatcagatttactgtctggttgcacggcgttctcgataagctgcggtctgtcaccacagagccaagctcactgaagagttctgacaccaacatttttgatagcaatgtgccatcgaataaaagtaacttcagccgtggggatgagaggcggcacgaggccgccgtgcctccattggctatccccagtgcacggccagaaaagagggacagccgcgtgtctactagctctcaagagagcaagactacaaatgtccgacagacttacgatgatggggccgctactcgcctgatgtccaccgtgaagcctctcagagaaccggctcccagcgaagatgttattgatatcaaacccgagccagacgatctgattgatgaggatctgaactttgtccaggaaaatcctctgtctcagaagaagccaactgtaaccttgacctatggctcatcacgcccatcaattgaaatttaccggccacctgcctctcggaatgcagatagtggagtgcacttgaaccggttgcaatttcaacagcagcaaaactcaattcatgccgctaaacaactggacatgtag

SEQ ID NO: 141012 - DNA, 1956 bp, Artificial Sequence
  Description of Artificial Sequence: Synthetic coding sequence
tgaagcgacacgaacattttcgactcaaacgttccgtctaataaaagcaattttagcaggggggacgaaagaagacacgaggcagcggtgccccccctggcaattccaagcgctaggcctgaaaagcgagattctcgggtgtctacatcgagccaggaaagtaagactaccaacgtccgccagacttatgatgatggcgccgctacacggctgatgtccaccgtgaaacccctcagggagcctgcaccgtctgaagacgtaattgatatcaaacccgagccagatgatctgatcgacgaggacctcaatttcgtccaagaaaaccccctttctcagaaaaagccaaccgtgaccttgacttatggtagctctagaccctccatagagatctacagaccacccgcctccagaaatgctgactccggggtgcacctgaacaggctccagttccagcagcagcagaattcaatccacgccgcgaagcagctcgacatgcagtcctcctgggtgtatgagactggccgattgtgcgagccagaagtgctgaattccctggaggagacgtacagtccttttttccggaacaacagcgaaaagatgagtatggaggacgagaacttccgtaagaggaagctcccggtcgtgtcatcagtggtcaaggtaaagaagttcaaccatgatggcgaggaggaggaagaagatgacgactacgggagtcgaacaggtagcattagcagtagcgtgtctgtacccgcgaaacctgaacgccggccatccctccccccgagtaagcaggccaataaaaacctgattttaaaagcaattagcgaagcacaagaatccgtgaccaagaccacaaactacagcacggttcctcaaaaacaaactctgccggtggctccccggactcgtaccagccaggaagagttgctcgccgaggtcgtccaaggccaatcccgcactcctcggatttctccaccaatcaaggaggaggagactaagggagatagtgtggagaagaatcaaggcactcagcagaggcagctgctgagccgactccagattgaccctgttatggcggagaccctgcagatgtcccaggactattacgacatggagtccatggtacatgcagacacacgctcttttatcctaaagaaacccaaactgagcgaggaagtggtagtggctcccaatcaggaaagcggcatgaaaaccgccgattctctgcgggtactgagtgggcacttaatgcagacccgcgatctcgtgcagccagataagccggcgagtcccaaattcatcgtcactctcgacggagtacctagtccacctgggtacatgagtgaccaggaggaggacatgtgttttgagggcatgaaacccgtgaaccaaacagctgcatccaataagggtctccgggggttgctgcaccctcagcagcttcacctgctgtcgcgacagctggaggatcctaatggaagcttctctaacgcggagatgtcagagttaagcgtcgctcaaaaacctgaaaagctgctggaaagatgtaagtattggccagcatgcaagaatggagacgaatgcgcctatcatcaccctatcagtccatgtaaagctttccccaattgcaagttcgccgagaagtgtctgtttgttcatcctaactgcaaatatgacgccaaatgtaccaaaccggactgcccatttacccacgtgtcgcgccggatccctgtgctgtctccaaagccagtggccccgcctgcccccccatcctcgagccagctttgtcgctactttccagcatgcaagaagatggaatgccccttctaccaccccaaacactgccggttcaacacacagtgtactcggcccgactgcaccttctaccacccgactattaatgttccccctaggcacgcgctgaaatggatccgtcctcagaccagtgagtag

SEQ ID NO: 141013 - DNA, 402 bp, Artificial Sequence
  Description of Artificial Sequence: Synthetic coding sequence
atggttatggtggcaaataagaaatcacaagaccagatgacggaggatctgagcctcttcctgggcaacaacaccataaggtttactgtgtggctgcacggcgttctcgataagctcagatccgtgaccacggagccatctagtctgaagagctccgataccaacattttcgactctaacgtgcccagcaataagtcaaacttctcacgtggtgacgagcgtagacacgaagccgccgtcccaccgctggcaataccctctgctcggcctgagaaaagggacagtagggtttccactagttctcaggagagcaaaactacgaatgtcaggcagacctacgatgatggggcagcaaccagactgatgagcacagtgaagccattgcgggaacctgccccctag

SEQ ID NO: 141014 - DNA, 2193 bp, Artificial Sequence
  Description of Artificial Sequence: Synthetic coding sequence
atggagataggaactgagatctctaggaagattaggtctgccattaaggggaagcttcaggaactgggtgcgtacgtagacgaggaactcccagattatattatggttatggtggcaaataaaaagtctcaagaccaaatgaccgaagacctgtctttatttctcggtaacaacaccattaggtttaccgtctggctgcatggtgtgcttgacaagctgcgaagtgtcaccacagagccatcatctcttaaatcaagtgacaccaacatttttgattctaatgtgcctagtaacaagtctaacttcagtcgaggggacgagagaagacatgaggccgctgtcccaccgctggcaatcccaagtgcacgccctgagaaacgcgactcccgtgtgagtaccagctctcaagagtccaaaaccaccaatgtgagacagacatatgatgatggtgccgcaacccgcctgatgtccactgtgaaacctttacgtgaacccgccccctcagaagatgtcattgatatcaaacccgaacctgatgaccttattgatgaagacctgaacttcgttcaggagaatccgctctcacagaaaaaacccactgtaacactaacctacggcagttctcgccccagcatagagatttatcgtcctccagcttcccgcaatgctgatagcggagtgcacctgaatcgattgcagttccaacaacaacaaaactcaatacatgctgcaaaacagctcgatatgcagagctcatgggtgtatgaaacagggcggctgtgtgaaccagaagtgcttaactctctggaagagacttattccccgttctttcgcaataattccgaaaagatgtccatggaagatgaaaattttcggaaaagaaagctgccagtcgtttccagcgtagtcaaggttaaaaaatttaatcacgacggcgaggaggaagaagaggatgacgattatggctcccggacaggtagcatctcgtcgtcagtgagcgtacctgcaaaacccgagcgcagaccgtccctcccccctagtaaacaagctaataaaaacctgattttgaaggccatcagcgaagcccaagagtctgtgacaaagacaacaaactattccactgtcccccagaagcagacccttcccgtggccccgcgcacgcgtacctcccaggaggaacttctagccgaggtggtacagggacaatctaggactcctcggatcagtccccctattaaagaggaagaaacaaagggagactccgtagaaaagaaccagggcacgcagcagcgacagttactgagccggctccagattgacccagtgatggctgaaaccctgcaaatgagccaggactactatgacatggagtccatggtccatgccgatacccgatcatttatcctgaaaaagccaaaacttagcgaggaggtcgtcgtggcacctaatcaagagagcgggatgaagaccgcagatagtcttcgcgtactgagcggccacctgatgcaaacaagggaccttgtgcagccagataagcctgccagtcctaagttcattgtgaccctagatggcgtgccaagccccccgggatacatgtctgaccaggaggaggatatgtgcttcgagggaatgaaacccgtcaatcaaaccgccgcatctaacaaaggtcttagagggttacttcatccacagcagctccatttgctctcccgacagttggaagacccgaacgctgagatgtccgaattaagcgtggcccagaaacctgagaaacttctagaacgatgcaagtattggcccgcctgtaaaaacggcgatgaatgcgcatatcaccaccctatttccccctgcaaggctttccctaactgtaagttcgcagagaagtgtctgtttgtgcatccaaactgcaagtatgacgccaaatgtacgaagcccgattgtcctttcacccacgtatctagaaggatccccgtcctgagtccgaagcccgtggcgccacccgcacctccgtcatcttctcaactatgccgatatttccctgcctgcaagaagatggagtgtccgttctaccaccctaaacactgcagattcaacacccaatgcacccgtccagactgcactttttatcaccccactatcaacgttccaccacgacacgcccttaaatggatacgtccccagacctcagaatag

SEQ ID NO: 141015 - DNA, 2709 bp, Artificial Sequence
  Description of Artificial Sequence: Synthetic coding sequence
atggccgatcccgaggtttgctgttttatcaccaagattctgtgtgctcacggaggccggatggcattggatgctctgttgcaagagatcgccttgtccgagcctcaactttgcgaagtactgcaggtcgctgggcccgaccgattcgtagtcctcgagactggcggcgaggctggaatcactcgaagcgtggtagccacaactagggctagggtgtgccgccgcaaatactgccaacgaccttgcgacaacctccacctctgtaagctgaacctccttgggagatgtaattatagccaatcggagcgcaatttatgtaaatacagccacgaggtactgtccgaggagaatttcaaagtactcaagaatcatgagctgtccggcttgaacaaggaagaactcgctgtgctgctactgcagtcggatccattctttatgcccgaaatatgcaagtcttataagggagaagggagacagcagatttgcaaccaacaacccccatgcagtcgcttgcatatctgcgatcacttcaccagaggcaactgccgatttcccaattgcctccgatcacataatctgatggacagaaaagtcttagccatcatgcgcgaacatgggctcaaccccgacgtcgtacagaatatacaggacatttgcaattctaaacatatgcagaaaaaccctcctgggccacgggcaccttcctctcaccgacgtaatatggcatacagggccagaagcaagagtcgcgataggttctttcagggcagccaggaatttctcgcatccgctagcgcatcggccgagagaagttgtacccccagcccagaccagatctcccaccgcgcctctttagaggatgccccggtagacgaccttacccgcaagttcacgtacctgggatcccaagatcgggcgaggccacccagtggcagctctaaagcaacagacctaggcggcaccagtcaggccggtacaagtcaaaggtttcttgaaaatgggagccaggaagacttactccacggaaatccaggctccacctatctagcttcaaactctacctccgctcctaactggaagtcgctgacatcgtggacgaacgatcagggggccagacgaaagaccgtattctcccctacattaccagcagcaagatcatccttgggatccttgcagacgcctgaggctgtaacaacacgcaaagggaccggcctgctgagctctgattatcggattatcaatggaaaaagcggcacgcaggacattcaacctggccccctattcaataacaacgccgacggagtggccactgacatcaccagtacaaggtcattgaattacaagagcacaagctcaggtcaccgcgaaatatctagcccccgcatccaggacgctggtcctgcgtcgagggatgtccaagctactggacgtatagccgatgacgcagatcctagagttgcactggtgaatgattccctgagcgatgtcacctctactacaagtagccgtgtggatgatcacgattccgaagagatctgtctcgaccacctgtgcaaaggctgccctttaaacggctcctgctcaaaggtgcattttcatcttccttacaggtggcaaatgctcatcggcaaaacctggacagattttgaacacatggaaacaatagaaaagggatactgcaaccctgggatacacctgtgcagtgtggggtcatataccattaattttagggtcatgagttgcgattccttccccatccgcaggctgtctaccccaagtagtgtgacaaagcctgctaattcagtctttacaaccaaatggatttggtactggaaaaatgagagcgggacctggattcagtatggggaggagaaagataaacgcaagaacagcaacgtggattcatcttacctggagagtttgtatcagtcatgcccccggggggtggttccgttccaggcgggcagcagaaactacgagctgtctttccagggtatgattcagactaacattgcctccaagacgcagaaggatgtgatcagacgacctactttcgtgcctcagtggtatgttcagcaaatgaaacggggcccagatcaccagccagccaaaacttcttcagtctcgttgactgctacattccgcccccaggaggatttttgtttcctgtcatctaaaaaatacaagctgtcagaaatccatcatctgcacccagaatatgtgcgggtgagcgaacactttaaggcaagcatgaagaactttaaaatagaaaagataaaaaagattgagaactccgagctgttggacaagttcacttggaaaaagagtcagatgaaggaagaggggaaacttctgttctacgctacatcaagggcctatgtggaatccatatgctccaataattttgattccttccttcacgaaacccatgagaataaatatggcaaaggaatttatttcgccaaagatgctatttattcacacaaaaactgcccctacgacgcaaaaaatgttgtgatgtttgtcgctcaggttctagtgggcaaattcaccgaggggaatattacgtacacctcaccgcccccacagtttgattcgtgcgttgatacaaggtcaaacccttcagttttcgttatattccagaaagatcaggtgtatccgcaatacgtgatagaatacactgaagacaaggcatgcgtgatcagttag

SEQ ID NO: 141016 - DNA, 2100 bp, Artificial Sequence
  Description of Artificial Sequence: Synthetic coding sequence
atggcggaccccgaagtgtgttgttttataacaaaaatcctttgcgcccacggcggccggatggctcttgacgcccttctccaagaaatagcactgtctgagccgcagctatgtgaggtgctccaggtggcgggtcctgatcgtttcgtcgtgctggaaaccggtggtgaggctggtatcacccgcagtgtcgtggcaacgaccagggcccgggtttgcaggaggaaatactgccagagaccatgtgataaccttcacctttgtaaactgaacctcttgggaaggtgcaactactcccagagtgagcgcaacctgtgcaaatatagccacgaggtgctgtcagaggagaattttaaagtgctgaagaaccatgagctgagtggactcaataaggaagaactagctgtgctgctgttgcaaagcgaccccttctttatgcccgagatctgcaaaagctacaaaggcgaaggtaggcagcagatctgtaatcagcagcctccgtgttcccgtttgcacatatgtgaccatttcaccagagggaattgccgtttccccaactgtttgcgctcccataacctgatggataggaaagtgctcgcgatcatgcgagaacacggcctgaatcctgatgtcgttcagaatattcaggatatctgcaattcaaaacatatgcagaagaatccgcccggcccaagggccccttcctcacaccgccggaacatggcataccgcgctcggagtaagagccgggacaggttctttcagggctcacaagagttccttgcctcggcgtcagccagcgctgagaggtcttgcacaccctctccagaccagatcagccaccgggcaagcctggaagatgctcccgtggatgacctgaccaggaaattcacttacctaggttctcaggacagagctcggcccccctccggttccagcaaagccaccgacctgggcggtacaagccaagcggggacgagccagaggtttcttgaaaatggtagtcaggaggatctgctacatggaaatcctgggagcacttaccttgcctcaaactcgaccagcgctcccaactggaagagtctaacttcttggacgaacgatcaaggagctcgccgaaaaacagtgtttagccctaccttgcccgctgcaaggagttctctgggttcgctgcaaacgcctgaggcggtgacgactcgaaagggtactgggttattgtcctctgattacaggatcattaacgggaagtccggcacccaggatattcagcccggccccctttttaacaataatgccgatggagtagccaccgacataacctcaacaaggtccctcaattacaaatctacgtccagcgggcacagggagattagctcacccaggattcaggatgctggaccagcctctagagacgtccaagctaccgggagaatagcagacgacgcagatcctagagtcgccttagtaaacgattctctcagcgacgttaccagtacaaccagttccagagttgacgaccacgacagtgaagaaatttgccttgatcatttatgcaaaggctgcccactgaatggctcttgtagtaaggtgcattttcacctgccttacagatggcaaatgctgattggaaagacatggaccgatttcgagcacatggagaccatcgaaaaaggatactgtaatccgggcattcatttgtgctctgtgggatcgtacactatcaatttcagggtgatgagttgtgactcattcccgatcagacgcctgtcaacaccttccagcgtcaccaaacccgcaaattccgtatttacaacaaaatggatttggtattggaaaaacgagtctgggacttggattcagtacggagaagagaaagacaaacgaaaaaatagcaatgtggactcctcatacttggagtcactttatcagtcttgcccaaggggagtcgtgccctttcaggctggaagcagaaattacgagttatcatttcaagggatgattcagacaaatatcgcgagtaagacacaaaaggacgtgattagaagacctactttcgtcccgcagtggtatgtgcagcagatgaagcgcggccctgagtag

SEQ ID NO: 141017 - DNA, 1521 bp, Artificial Sequence
  Description of Artificial Sequence: Synthetic coding sequence
atggcctatagggctcgctccaagagtagagaccgcttctttcaaggctcccaggagtttctagcctcagcaagcgcctccgctgagcggagctgcaccccctcacctgatcagatcagtcaccgcgccagtcttgaggacgcgcccgttgacgacttaactcgtaagtttacttatctcggatcccaggacagagcaaggcctccttctggcagctctaaagcaactgacttggggggcacatcgcaggcaggaacaagccagaggtttctggagaacggcagccaggaagacctgctgcacggtaatcccggatcaacatatcttgcatcaaacagtaccagcgcccccaactggaagtctttaacttcttggaccaacgaccagggcgcccgcagaaagaccgttttctcccccacgctgcctgcagccaggtcttccctgggaagtctgcagacaccagaagccgtgacgacaaggaagggtaccgggctccttagctccgactatagaataatcaacgggaaaagtggtactcaggacatacagcccgggcctctgtttaacaacaacgcggatggagttgcgaccgacatcacctccacccgatctcttaactacaaatccacatcttcaggacaccgcgagatttcctctccccgtattcaggacgctggtcccgctagtcgggatgtgcaagcaactggaagaatcgccgacgatgctgaccccagagtggccttagtcaacgactctcttagcgacgtgacgagcaccacttcatcacgggtggatgaccatgactccgaggaaatctgcctagaccacctgtgtaagggatgcccactgaatggctcttgttccaaggttcacttccaccttccttaccggtggcagatgctgattggcaagacgtggaccgacttcgaacacatggagacaatcgagaaggggtactgcaacccagggatccacttatgtagtgttggcagctacaccatcaactttcgcgtgatgagctgtgacagctttcccattagaaggctgtcaacaccaagcagcgtcacgaagcctgccaactcggtgtttactactaagtggatttggtactggaagaatgaatctggaacatggattcaatacggcgaagagaaggacaaacggaagaattcaaacgttgacagctcctatctcgaatctctctaccaatcatgtcctcgcggcgtggtccccttccaggcaggctcccgcaattacgagctcagcttccagggtatgatccagacaaacattgcaagtaaaacccagaaggatgtgatccgacggcccacctttgttccacagtggtacgtgcaggaggagagggcgcgcgtgtctgtgcttaagcaactgtttgcagatagatgcctacgctgcagctgtccaggccttataaaatcccttgtcaatctagagcctgtttttcttaagagtagctgtctgcactattccgcagtctccatatgtattatcgacgaatag

SEQ ID NO: 141018 - DNA, 654 bp, Artificial Sequence
  Description of Artificial Sequence: Synthetic coding sequence
atgtctgggggcctggcccctagcaaaagcaccgtttatgtatccaatttgccttttagccttactaataacgacctgtacagaatttttagcaagtacgggaaggtggtcaaggtgactattatgaaagataaggatacaagaaagagcaagggggtggcgtttatattattcctggacaaagactcagctcaaaactgcacgagggcaatcaacaacaagcagctgtttggaagagttatcaaggcgtccatcgctatcgataacggtcgagctgcggagttcattcggcgacgtaactacttcgacaagtctaaatgttatgagtgcggggagtccggtcatttatcctatgcctgcccaaaaaacatgttaggggaaagggagcccccaaagaaaaaagagaagaaaaagaagaaaaaagccccagagcccgaggaagagatcgaagaggtggaagagagtgaggacgagggagaagacccggctctggattctctgtcacaggccatcgccttccagcaggctaaaatcgaggaagaacaaaagaaatggaagccgtcctccggagtgccatcaacctccgacgattcgaggaggccgaggatcaaaaagtcgacctatttttcggacgaagaggagctcagcgattag

SEQ ID NO: 141019 - DNA, 501 bp, Artificial Sequence
  Description of Artificial Sequence: Synthetic coding sequence
atggccatgtctcaagagtctttgacgtttaaggacgttttcgttgacttcacgctcgaagagtggcagcagctcgacagtgcacagaagaatctctacagagacgtgatgctggagaattacagtcacctcgtatccgtcgggtatctggtcgcgaaacctgacgtgatttttagactgggccctggcgaggagagctggatggccgacggcgggacacctgtcaggacttgcgccgaggtgtggcaggtggacgagcagattgatcactataaggagtctcaggacaagctgccatggcaggccgcctttatcggcaaagagaccttgaaggacgagagcggacaggaaagccgaacatgcaggaaaagcatttacctgagtacggaatttgactctgttcggcaaagattgcccaagtactacagttgggaaaaagccttcaagacgtcttttaaactgtcttggagtaaatggaaactctgtaaaaaggaacggtag

SEQ ID NO: 141020 - DNA, 516 bp, Artificial Sequence
  Description of Artificial Sequence: Synthetic coding sequence
atggccatgagccaagagtctttgacgttcaaagatgtgtttgttgacttcaccctggaagagtggcagcaactcgactctgcgcagaagaacctgtacagggatgtgatgctggagaattactcacatctcgtcagcgtgggctatcttgtggccaaacctgacgttatctttcgtctcggtccaggggaggagtcctggatggcggatggcggtaccccagtgcggacctgcgcgggtgaggatcgcccggaggtgtggcaagtagatgagcagatagatcactataaggaatctcaggataagctcccttggcaggccgcctttatcgggaaggagactctcaaagatgagtctggacaggaatccagaacttgcaggaaaagcatatacctgagtactgagttcgactcggtccgccagaggctccccaaatactacagttgggaaaaagcattcaagacatctttcaaactctcctggtcaaagtggaagctgtgcaagaaggaacgttag

SEQ ID NO: 141021 - DNA, 297 bp, Artificial Sequence
  Description of Artificial Sequence: Synthetic coding sequence
atggccatgtcgcaggagtcactgacgttcaaggacgttttcgtggacttcactttagaagagtggcagcagctcgatagtgcgcagaaaaacttgtacagggacgtgatgctggaaaactacagtcatctcgtatcggttggctacctggttgcaaaaccggacgttatatttcggttgggtccaggagaggagtcctggatggctgatggcggaacccctgtgagaacttgtgctggggaagatagacctgacgttagcattttcgcatcttgcatcctcaagtgctgttattag

SEQ ID NO: 141022 - DNA, 297 bp, Artificial Sequence
  Description of Artificial Sequence: Synthetic coding sequence
atggccatgtcccaggagtccctaactttcaaggatgtatttgttgacttcaccttggaagagtggcagcagttggattccgcacaaaaaaatctgtatcgagacgtgatgctggagaattacagtcatctggtcagcgttggttacctggtggctaagcccgatgttatttttcgattaggccccggagaagagtcttggatggccgatgggggcactccagtgcggacatgtgctggagaggataggcccgacgtctcaattttcgcatcctgtatactgaagtgctgttactag

SEQ ID NO: 141023 - DNA, 516 bp, Artificial Sequence
  Description of Artificial Sequence: Synthetic coding sequence
gttgcaatgagccaagaatctctgacctttaaggacgtgtttgtggattttacactcgaggagtggcagcagcttgatagtgcgcaaaaaaacctgtacagagacgtaatgctcgaaaattattctcacctcgtgagcgtcggctatcttgtcgccaagcctgatgttatttttaggcttggcccaggagaggagagctggatggcagacggcggtacacccgttaggacttgcgcgggtgaggacagacccgaggtgtggcaggtagacgagcaaatcgatcattacaaagaatcccaggacaaactgccctggcaggcagcctttattggtaaggaaacgctgaaagacgaatcgggccaggaatctcgaacctgccggaaatcaatttacctctccacagagttcgattccgtgcggcagagactaccaaaatattattcttgggaaaaagcatttaaaacatcgttcaagctaagttggtcaaagtggaagctttgtaaaaaagaaagatag

SEQ ID NO: 141024 - DNA, 297 bp, Artificial Sequence
  Description of Artificial Sequence: Synthetic coding sequence
atggctatgagtcaggagagccttacgttcaaggatgtattcgtggactttacattggaggaatggcagcagcttgactccgctcagaagaacttgtatcgggacgtgatgttggagaactacagtcatctagtgagtgtgggctaccttgtggccaagcccgacgtgatctttaggctgggccccggggaagaatcgtggatggcagacggtggaactcccgtccggacctgcgctggagaagaccgtcctgacgtctcaattttcgcgtcctgcattctgaaatgttgttattag

SEQ ID NO: 141025 - DNA, 864 bp, Artificial Sequence
  Description of Artificial Sequence: Synthetic coding sequence
atgatgaaccggtttcggaaatggctgtacaagcccaaacggagtgaccctcagcttctggctcgcttttattatgccgatgaagaactgaaccaggtggcggccgaattggattcactggatgggcggaaagacccccagaggtgcaccttgctcgtcagccagttccgttcttgccaggataacgtcctcaacatcataaatcagatcatggatgagtgtatcccccaggatagggctccaagggacttctgtgtcaaatttcctgaggagatcaggcatgataacctggctggacagttgtggtttggggctgaatgtcttgccgctggatcaattataatgaacagagagcttgaaagcatggccatgaggccgctcgccaaagaactcacgagatccctggaggatgtgagaggggcactgagagaccaggcgcttagagatctgaatacatataccgaaaaaatgcgggaagctctgcggcatttcgatgtgttattcgctgagtttgagttaagctacgtgagcgctatggtacctgtaaagtccccgcgggagtactacgttcaacaggaagtgatagtactgttttgtgaaacagttgagcgggctctggattttggctatctgacccaggatatgattgacgattatgaaccagccctgatgttctctattccacgtctcgcaatcgtttgcccacttctgccggctcacccccgcacacgagctggcgctactgcgcatgttgcctgtcgcatggtagcgggatcatcttcaggcgcattgacacatccccccgtctctaaacaaggagtcatctccgcattgcttcgccccctgccggagcttcccccctag

SEQ ID NO: 141026 - DNA, 519 bp, Artificial Sequence
  Description of Artificial Sequence: Synthetic coding sequence
atgatgaacagattccgcaaatggctttacaagcctaaggacaacgtgttaaacattatcaaccagataatggacgagtgtataccacaggaccgagccccccgagatttctgtgttaagttcccagaggagatccgacacgataatctcgccggacagttgtggttcggggctgaatgtttagctgctggaagtattattatgaatagagaactggagtccatggccatgcggcccttggcaaaggaacttacccgctcattggaggatgtgcgaggcgcgctaagagatcaggctcttcgggatctcaatacatacaccgagaaaatgagagaagccctgcgtcacttcgacgtgttgtttgctgagtttgaactcagctatgtgtccgctatggtgcccgtgaagtccccccgggagtactacgtccagcaggaagtcatcgtcctgttttgtgagaccgtggaaagaaatgggaagggagtcctcaaatttatgtggaattgtaacggaccatag

SEQ ID NO: 141027 - DNA, 492 bp, Artificial Sequence
  Description of Artificial Sequence: Synthetic coding sequence
atggatgaatgcatccctcaggacagggcgcctcgcgacttctgcgttaagtttccagaggagatcagacacgacaacctggcaggacagttgtggtttggtgccgaatgtcttgccgcaggctccattatcatgaaccgcgagctcgaatccatggccatgcgccccttggccaaagagctaacacgcagccttgaggacgtacgaggcgctcttagagaccaggcccttcgcgatctgaatacctacacggagaagatgagagaggcccttagacatttcgatgttctgttcgccgagtttgagctcagttatgttagcgcaatggtgcccgttaagtctccacgagagtactatgtacagcaagaagtaattgtgctgttttgcgagacggtggaacgggctctggacttcggctacctgactcaggatatgatagatgactacgaaccagcgctcatgttttccatccctagattggccattgtctag

SEQ ID NO: 141028 - DNA, 11112 bp, Artificial Sequence
  Description of Artificial Sequence: Synthetic coding sequence
atggagggatgtgactcgcctgtggtgagcggcaaagacaacggctgtgggattcctcagcaccaacaatggaccgagctgaactccacccaccttccagataagccttcttctatggaacagtcgacaggggaatctcacggccccctcgactcactcagagctccgttcaatgaacggttggccgagagcactgcatcagctgggcctccaagcgagcctgcatccaaggaggtgacatgcaatgagtgctctgcgtccttcgctagcttgcagacctatatggaacaccactgcccatccgcccgccctcctcctccactcagggaagagagtgcttctgacaccggtgaggagggcgatgaagaatccgacgtggaaaacctggcaggagagatagtctaccagccggacgggtcggcctatatcgttgaatcactgagccagctcactcagggcggaggagcgtgcggttccggctcgggcagcggtcctctgcctagcttatttctgaatagcctgcccggggctggaggcaagcagggcgaccctagctgtgctgctcccgtttacccgcagattatcaatacatttcacatcgccagctcatttgggaaatggttcgagggtcctgatcaggccttccctaatacatcggctctcgcgggcctgtccccggtcctgcactctttcagggtgttcgacgtccgacataagagtaacaaagattatctcaactccgatggatccgcaaagtcgtcctgcgtctccaaggatgttccaaataacgtcgacctgtcaaagtttgatggcttcgtactgtatgggaagaggaagcctatacttatgtgtttcctctgtaagctttcctttgggtacgtgaggtcttttgttacgcatgccgttcacgatcaccgtatgacactaagtgaagatgagcgaaagatactaagtaacaaaaacatctcagctattatacagggcatcggcaaggataaagaaccactggtcagctttttagaacccaagaataagaacttccagcacccactcgttagtactgctaacctgattggcccaggtcatagcttttatggcaagttttcaggcatacgaatggagggtgaagaggccctccctgccgggtccgctgctggtcccgagcagcctcaggcaggtctgctgacgccatcaaccctgctcaacctcggcggcctgacgtctagtgtgcttaaaactccaataacgtctgttcccctggggccactggcctcatcccccacaaaaagttccgagggcaaggactcgggggctgcagagggggaaaagcaggaggtgggcgatggtgactgtttcagcgagaaggtggaacctgctgaggaagaggccgaagaagaagaggaagaggaagaggctgaggaagaagaggaagaggaggaggaagaggaagaggaggaggaggacgaggggtgtaaagggctttttccaagcgagcttgacgaagaattagaggatagaccccatgaggagcccggcgccgcagccggtagcagctcaaaaaaagatctcgctctctctaatcagagcatttcaaactcccccttaatgccaaacgtgctgcaaactcttagtagagggaccgccagcacatcctccaactctgcctcttcttttgtggtgttcgatggcgctaatcgcaggaacaggctctcatttaacagcgaaggcgtaagagctaacgtggctgaagggggccgccggctggactttgccgacgagtctgcaaataaagataatgcgaccgctcccgaaccaaatgagtctacagagggagatgacggagggtttgtgcctcaccatcagcatgccggatctctctgcgagctcggcgtcggagagtgcccctctgggtctggcgtggagtgccctaaatgtgacaccgtgctgggttcaagtcgcagtcttggcggacacatgaccatgatgcactcacgcaactcgtgtaaaactctgaaatgcccaaagtgcaactggcattacaaataccagcaaacactggaagcacacatgaaagagaaacacccagagccggggggatcatgcgtgtactgtaaaagtgggcaaccacatccccgactggcccgtggagagtcctacacctgtggttataaaccatttcgttgtgaggtgtgtaattacagtaccaccaccaagggtaacttgagcatccatatgcagagtgataagcatctgaacaacatgcagaacctgcagaacggtggcggggagcaggtattttcacataccgccggcgccgctgccgctgccgtggcagctgctgccgctgcagccaatataagttccagctgtggagctcccagccccacaaagccaaaaactaagccgacatggaggtgtgaagtctgtgactatgagaccaacgtcgcccgaaacctcaggatccacatgacatcagaaaaacatatgcataatatgatgctgcttcagcagaatatgactcaaattcagcacaaccgtcacttgggactgggaagtttgccgtccccagcagaggccgagctctaccagtactatctggctcaaaatatgaatcttcctaatcttaagatggacagtgctgcttccgatgcccagtttatgatgtcaggcttccaactagaccccgctggaccaatggctgccatgacacccgcactagtgggcggagagatacctttggacatgcgtctgggcggggggcaactcgtctctgaggaactgatgaatctgggggagagcttcattcaaactaacgatccatctcttaagctgttccagtgcgcagtgtgtaacaaatttaccactgacaacctggacatgctaggactgcatatgaacgtagagagatctctatcagaggacgaatggaaggccgtcatgggcgatagttatcagtgcaaactgtgtcgttacaacacccagctcaaggcaaacttccagctccattgtaagacagacaaacacgtccagaagtaccagctggtagctcacatcaaggagggcggcaaggccaacgagtggcgcctgaaatgtgtcgcgattgggaatccagtccacctgaagtgcaacgcgtgtgattactacacaaactcactagagaaactcaggcttcatacagtgaattccagacacgaggcctcgctgaagttgtacaaacacctgcaacagcacgaatcaggcgtggaaggagagtcatgctactaccactgtgttctgtgtaactactctaccaaagcgaaactgaacctgatacagcacgtccgcagcatgaagcatcaacggtccgagagcctgagaaagctccagaggcttcagaaaggcctgcccgaggaggatgaggatctggggcagatttttactattcgccgctgtccttctacagatcccgaggaagccattgaggacgtcgaggggccaagcgagacagctgccgaccctgaggaattggctaaagaccaggaaggtggtgccagcagtagccaggcggaaaaagagctcaccgattctccggcgacctcaaagagaatttctttccctggaagctctgaatcacccctatcctccaaacgtcctaagaccgctgaggagattaaacctgagcagatgtaccagtgtccatactgcaaatacagcaacgcagatgtgaataggctgagggtgcacgctatgactcagcactctgtccagcctatgctcagatgccctctgtgccaagacatgctgaacaataaaatccatctccaacttcatctgactcacctgcatagcgtcgcaccagattgcgtagaaaaactcattatgacagtcactacacccgagatggtgatgcccagctcgatgttcttgccagcagcagttccagacagagacggcaatagtaatctcgaagaggcagggaaacagcctgagacatcagaagatctgggcaaaaacatactccctagcgcatccacagagcagtccggcgatctgaagcccagtcccgcagaccccggatccgtcagggaggattcaggctttatctgctggaaaaaggggtgcaaccaagtgtttaagacctctgctgcattgcaaactcattttaacgaggtccacgccaaacgaccccaactgccggtttctgacaggcatgtgtataaatacaggtgcaaccagtgttcactagcatttaaaacgatcgagaagctacagctgcacagccaataccatgtcattagagccgcaaccatgtgttgtctctgccaaaggagttttcgcaccttccaggccctgaagaaacatctcgaaacctcccacttagaactgagtgaggcagatatacagcagctttatggggggctgctggctaacggcgatctacttgcgatgggagatcccacgttggccgaggaccataccattatcgtggaggaagacaaggaggaggagtcagatctggaagacaagcagtcacccaccggcagtgactccggttccgtacaggaggactccggatctgaacccaagagagctctaccattccgaaaaggtccaaattttactatggaaaaatttttggacccatcccgaccttacaagtgtacagtctgtaaagaatcttttactcagaagaatattctcctggttcattataatagtgtctcccacctgcacaaactgaaaagggccctacaagagtctgccactgggcagccagaaccgaccagttcaccggataataagccctttaaatgcaatacatgtaatgtggcatacagtcagagcagtacactggaaattcatatgagaagtgtgctgcatcagaccaaggcgagggcagccaaactagaggctgcctctggcagttcaaatggcacaggaaacagcagttccataagtctgtcttcttctacccctagtccagttagcacaagtggcagcaacacgttcacgactagcaatcccagttctgcaggcatagccccaagctctaacctcctatcccaagttcccaccgaaagtgtcgggatgcctcccctgggcaatcctattggcgccaatattgctagtcccagcgagcccaaggaggcaaatcgcaaaaaacttgcggatatgatcgcttcccgccagcagcagcagcaacagcagcagcagcagcagcagcagcagcaacagcaacaacaggctcaaacactggcccaggctcaggcccaggtacaagctcatctccagcaagagctgcagcagcaggcagcattaattcagtcccaactgttcaatcccacattattaccccattttcccatgacaactgaaaccttactccaactccagcaacagcagcatctcctgtttcccttctacatccctagcgcggagttccagttgaacccggaagtgagtttgccagtcacaagcggcgcgctgaccctaaccggcaccggcccgggactgctcgaggaccttaaggctcaggtgcaggtccctcagcagagccaccagcagattttgccacagcagcaacagaaccagctgtcaattgcccagtcacattccgcccttttacagccttcccagcaccccgaaaagaaaaacaagcttgtcatcaaggagaaagagaaagaaagccagagggagagggatagtgccgagggaggcgaggggaatacgggccctaaagagacactgcccgatgcgttgaaggcgaaagaaaagaaagagctggcaccaggtggaggctccgaacctagcatgttgccccctcgaatagcctctgatgcaaggggaaatgcaaccaaagccctcctggagaactttggtttcgaactcgtcatccagtataatgagaataaacaaaaggtccaaaaaaaaaacggcaaaacagatcagggcgagaacctcgaaaaactggaatgtgactcctgcggtaaactcttcagtaacatattgattctgaaaagccatcaggagcacgtgcaccagaactacttcccgtttaagcagctagagcggttcgctaaacagtatcgagatcattatgacaagttatatcctctgcgcccacaaacgccagagcctccacctccaccgcccccccctccacccccccctctgcccgccgcacccccccagccagcttctacccctgctataccggcctcagccccacctataacaagcccaaccattgctcctgcccaaccatcagttccactgacacagctgagcatgcctatggagttgcctatcttcagcccgctcatgatgcagacaatgcccctgcagacactacctgcccaactgccccctcaactgggtccagtcgaacctctgccagctgatttagctcagctataccaacaccagctaaaccctaccctcctgcaacagcagaacaagcggccacggactaggataactgacgaccagctcagagtattacgccagtattttgatattaacaactcacctagtgaggagcagatcaaagagatggctgataagagtggtttgccccaaaaagtaattaagcattggttcagaaatacgttgttcaaggagaggcagagaaataaagactccccctacaacttcagcaaccccccaattacaagtctggaggagcttaaaattgactcccgtccaccatctcccgaacctcccaaacaggagtactggggcagcaaacggtcatcacggacccgcttcaccgattatcaactcagggtgctgcaggacttcttcgacgctaacgcttatccaaaggacgacgagttcgaacaactgagtaacctattaaatttgccaacccgcgttatcgttgtctggttccaaaacgcccgccagaaagcccggaaaaactacgagaaccaaggagagggtaaagacggcgagcgcagagagctgactaacgacaggtacattaggactagcaatttgaattaccagtgcaagaagtgctcattagtgtttcagcggatcttcgatctcatcaaacatcagaaaaagttgtgctataaggatgaagatgaggagggacaggatgattctcaaaatgaggatagcatggacgccatggaaatcctcacacccactagctcttcttgttccacaccgatgccatcccaggcgtactctgcccccgctccatcggctaataacacggcctcatcagccttcctgcagctcacggctgaggcggaagagttggccacttttaattccaagaccgaggccggtgatgaaaagccaaagctggcagaagctccctccgctcagccgaatcagactcaagagaagcaggggcagccaaaacctgagctgcagcagcaggagcagcctgagcagaaaactaataccccccagcagaagctacctcagctggtttccctgcccagcctgccgcagcccccgcctcaagcaccgcctccccagtgcccccttccacaaagctctccaagtccatctcagttgtcgcatctacccctgaaacccctccatacaagtacgccgcagcagctggctaatctgcctccccagcttatcccataccagtgcgatcagtgtaagctggcatttccgtcttttgaacattggcaagagcatcaacagcttcatttcctgagtgcccaaaatcaatttatccacccgcagttcctggaccggtctctagatatgcctttcatgctgttcgacccctcaaatcctcttttggcatcacagttactgagtggcgccatccctcagattcccgcctcctctgctacatctccctctaccccaacatctactatgaacacacttaaaaggaaactcgaagagaaagcgagtgcgagccccggggagaatgattcagggaccggtggggaggagccacaaagagataagcgcctcaggacaacaatcacccctgagcaactcgagatcctataccagaaatatttactggattcaaacccaacaaggaaaatgctggatcacattgcgcatgaggtggggctcaagaaacgggtcgttcaggtttggttccagaacactcgcgcaagggaaaggaaggggcaattccgagccgtcggtcccgcacaggcccaccgtcgatgccccttttgtcgcgccctattcaaggccaagaccgcgctggaggcgcatatcagaagccggcactggcatgaggcgaagagggccggatacaatctgacactaagcgctatgcttctggattgtgacggtgggctccagatgaaaggagatatctttgacggcacgagtttctctcatctccctccaagttccagcgacggccagggagttcctctgtcccccgtctcgaaaaccatggaattaagtcctcgcacactgctgtcccccagctcaatcaaggtcgaaggcattgaagactttgagagtccctctatgtccagtgtgaaccttaatttcgatcagacaaagttagacaacgacgactgttctagtgtgaataccgctattacagatactaccacgggcgacgaaggcaatgccgataacgacagcgccacaggcattgccacggagacaaagtcctcatctgcacctaatgaaggacttactaaagcagctatgatggccatgtcagagtatgaggaccggctctctagcggcttggtcagtccggccccatccttctattcaaaggagtatgacaatgaagggactgtagattactccgagacatcaagcttggctgacccttgttctccctcacctggcgccagtggaagcgccggtaaatccggagactctggtgataggcctggccagaaaagatttaggacacagatgaccaacctccagctcaaggtgctcaaaagctgctttaatgattaccgcacccccaccatgcttgagtgcgaggtattagggaacgatattgggctcccaaaacgggtcgtgcaggtgtggttccaaaacgcaagggcgaaagagaagaaaagcaagctatcaatggcaaaacatttcggcattaaccaaacaagttatgaaggtccaaaaacagaatgcaccctctgtggtattaaatattccgccaggctgagcgtcagagaccacatcttctcccaacagcacatcagcaaggttaaggatactattggaagtcagttggacaaagaaaaagagtacttcgacccagctaccgtgcggcagcttatggcacaacaggaacttgatcgaataaaaaaggcaaatgaagtcctcggtcttgcagcacagcagcagggaatgttcgataacacgcccctgcaggctttgaatctcccgaccgcttaccctgcattacagggcattccaccagtcttgctgcctggcctgaattcaccttccctgcctgggtttacacctagcaataccgccctgacaagtcccaaacctaatctgatggggctgccatcaaccaccgtacctagcccaggacttccaacctctggcctgccaaataaaccctcaagtgcctctctgagttctccaacccccgcccaggctaccatggcgatggggccccagcagccgccgcagcagcagcaacagcagcagcaacctcaggtccagcagcccccccctcctccagccgcccagcctccccccaccccacaacttcctttgcagcagcagcaacaaaggaaagacaaggattcagagaaggtcaaagagaaggaaaaagcgcataagggtaagggggagccgctgcccgtacccaaaaaagaaaaaggcgaagcccctaccgcaacagccgccactatctcagctccgctgcccactatggaatatgccgttgacccggcccagctacaggctctccaagccgctctcacaagcgatcccaccgcactgctgacctctcagtttcttccatacttcgttcctggattttccccttactatgctccacagatcccaggcgcactacagagtggatacctgcagcctatgtacggaatggaggggctgtttccctactccccagccttaagtcaggcgttgatgggactctcacctggttcattattacagcagtatcagcagtatcagcagtctctgcaggaggccattcagcagcagcagcaacgccagctgcagcaacagcagcagcagaaagtccagcagcagcaacctaaagcctctcagaccccagtccctccaggagcaccgagccccgataaagatccagcaaaggaatcccccaaacccgaggaacaaaaaaatacccctcgagaggtgtcccccctcctgcccaagctgccagaggaaccggaggctgagtccaaatcggcagacagcctgtacgatcctttcatagtgcccaaggtgcagtacaagctcgtttgtcgaaagtgccaagcaggctttagtgacgaggaagcagcccgaagccatttaaagagtctctgttttttcgggcagtccgtcgtgaacctccaagagatggtcctacatgtgcccacaggtgggggcggcggtggctcagggggtggcggggggggcggaggtgggggtggcggaggtggatcataccattgcctggcttgcgaatctgctctgtgcggcgaagaggcgcttagccagcacctggaaagtgcacttcataagcatcggacgattaccagagctgcaaggaacgctaaggagcatccttctctgctgccgcacagcgcctgcttcccggacccatctacggctagcacctcccagtcagccgcgcattcaaatgattcacccccacccccctctgccgccgcacccagttccgcctccccacatgcttcacgcaaaagctggcctcaggtggtatcaagagcctcagcggcaaagccaccaagcttcccacctctgtcttccagctccacagtcacatccagcagctgttccactagcggtgtccagcccagcatgcccactgatgattattcagaggaatctgatacagatctgtcacagaagtccgacggacccgcttcccctgttgagggccctaaggatccatcctgtccaaaggattctggcctgacctctgtgggcactgacacttttcgtctgtag

SEQ ID NO: 141029 - DNA, 8370 bp, Artificial Sequence
  Description of Artificial Sequence: Synthetic coding sequence
atgagacttggagggggccagctggtgtcagaagagctgatgaatctgggcgaatcatttatccagaccaatgacccttccttaaagctgttccaatgcgccgtttgtaacaagttcactaccgacaacctggacatgctgggactccacatgaacgtggaacgttccctgagcgaagacgagtggaaggccgtgatgggagactcataccagtgtaagctgtgccgatataacacacaacttaaagccaactttcagctgcattgtaagacagataagcacgtccagaagtaccagttagtcgcccacatcaaagaaggtggaaaggctaacgagtggcggctgaagtgtgtggccatcgggaatcctgtccatttaaaatgcaatgcgtgcgattattatactaactccctggaaaaacttcggctgcacacggtgaattcgcggcacgaggcttcactaaagctgtataaacacctacagcagcatgaatcaggggtggagggcgagagctgctattatcactgtgtcctatgtaactactctacgaaagcaaagctcaacctgattcagcacgtaagatccatgaagcatcagaggtccgaatctttgcgaaaacttcagaggctgcagaaaggattgccagaggaggacgaggatctgggccagatttttacaatccggaggtgtccctctactgatcccgaggaggcaatagaggatgtagagggccccagtgaaaccgctgctgatcctgaggagctggctaaagaccaggaggggggcgcctcatcgtcacaggcagagaaagagttgaccgactcacctgctacctccaaacggatttccttcccagggagctcggaatcccctctcagctccaaacgtccgaagactgctgaggagatcaaacccgaacagatgtaccaatgtccctactgcaagtattctaatgcagacgttaatcgactcagggtccatgctatgacccagcactcagtgcagcctatgctgagatgcccactctgccaggatatgctgaacaataagatccatcttcaactgcacctgacgcatttacatagcgtggctcctgattgcgtggaaaagctgattatgacggtcaccaccccggagatggtgatgccttcctccatgtttctcccagccgctgtgccagatcgagatggtaactccaatcttgaggaagcggggaaacagcccgagacctcggaggatttggggaaaaatattctgccctccgcatcgacagaacaatctggcgacttgaagccgagtcccgcggatccaggtagcgttagggaggactcaggatttatctgttggaaaaagggctgtaatcaggtcttcaaaacgtccgcagcgctgcagacccattttaacgaggttcacgcgaagcgccctcaactgccagtctctgaccgccatgtgtacaagtatagatgtaaccagtgcagtcttgcgttcaagaccatcgagaaactacagttgcattctcagtaccacgttataagagcagccaccatgtgttgcctgtgtcagagatccttccggacattccaggcccttaagaaacacctcgaaaccagtcacctggaactctccgaggccgatatccagcagctgtacggaggtctactggctaacggggacttgctggctatgggagatcctacgctagcagaagatcatacaatcatagttgaggaggacaaagaagaggagagcgatctagaggataagcagtcccccactgggtcagactccggatccgtccaggaggatagtggctcggaaccaaagagagcattacctttccgcaaagggccaaactttaccatggagaaattcctggacccatctaggccgtataagtgcactgtttgtaaggaatctttcacacagaaaaacatcctcctcgtccactacaactccgtaagccacctccataagcttaaaagggccctgcaggagagcgcaacaggacagccggagcctacaagctcccccgacaataaaccattcaaatgtaatacgtgcaatgtggcctattcacagagttcaactctggagattcatatgagatctgttctccaccagactaaggccagagccgctaaactcgaggctgcttctggttcttccaatggcaccgggaactccagcagcatttctttgagctccagcaccccttcacccgtgagcacctctgggagtaacacctttaccacctccaatccatctagtgctggcatcgcaccatccagcaacctgctgagccaggtgcctaccgagtctgtgggtatgccccccctggggaatcctatcggcgcaaatatcgcctccccgtcagagcccaaggaagctaacagaaagaagcttgctgacatgatcgcaagtcgccagcagcagcagcaacagcagcagcagcagcagcaacagcagcagcagcagcagcaggcccagacattagcccaggcccaagcccaggtccaagcccacctccagcaagagcttcagcagcaagcagctttgattcagtctcaattgtttaacccgacactgctcccccatttccccatgactaccgagacactgttgcaattgcaacaacagcaacatctcctgtttcctttctatattccctcggctgaattccagcttaacccggaggtctccctcccagtcacaagtggggcgctcacactgactggtactgggcctggcctgctggaagacctgaaagctcaggtgcaagtgccccagcaatcccaccagcagattctgcctcagcagcagcagaaccagctcagcattgctcaaagccatagcgccctccttcagccctcccagcatcccgaaaaaaagaacaaattagtcatcaaagagaaggaaaaagaatcacagcgggagcgagacagtgctgaaggtggcgagggcaacactggtcccaaggagactctgccagatgcgctaaaggctaaggaaaagaaggagttggcccctggcggtggttctgaaccatccatgctgcctccccgaatcgcgagcgacgccagaggcaatgcgacaaaagccttgctggagaacttcggttttgaactggtgatccagtacaacgagaataaacagaaagtccagaagaagaatgggaaaacggatcagggcgagaacctcgagaagttagagtgtgattcttgcggcaaattgttctcaaacattttaattctgaaatcccatcaagaacacgtgcaccagaactacttcccctttaaacagctcgaaaggtttgccaaacaatacagggaccactatgataagttatatcctctacggccacagactcctgagcctccacctccacctcccccgcccccgccaccaccacttccggctgctcctcctcagccagcctctacgcccgctattccagcctctgccccgcctattacatcgcccacgatcgcaccggcccaaccatctgtgcctttaacacaattgtccatgccaatggaactcccaatcttcagccccctgatgatgcagacaatgcccctgcaaaccctgccagcacaactgccgccccagctgggtcctgtggaacccctgcctgcagacttggcacagctgtaccagcaccagttgaacccaaccctcctgcagcagcagaataagcgaccccgaactagaatcacagatgatcagctccgggtcctaagacagtacttcgatattaataactccccatctgaggagcaaatcaaggagatggccgacaagagcggcctaccacagaaggtgattaagcactggttccgtaacacgctctttaaagagcgtcagagaaacaaggattctccctataacttctctaatccaccaattacatcgctggaagaattaaagatcgatagtaggccaccaagcccagagcctccgaagcaggagtactggggttctaagcggagtagccggacacgattcaccgactaccagctgagggtgctgcaggatttttttgacgcaaacgcataccccaaggatgacgaatttgaacaactttccaatcttctcaaccttcccacccgggttatcgtcgtttggttccaaaacgctagacaaaaggccaggaagaactacgagaatcagggcgagggaaaagatggagagagaagagaattgactaatgaccgctacatccggacaagtaacctcaactatcagtgtaagaagtgttcccttgtgttccagcgaatctttgacctgataaagcaccagaagaaattgtgttacaaggacgaggacgaagagggacaggatgactcccaaaacgaggactccatggatgccatggaaattctgacacctacatcctcaagttgtagcactccgatgccaagtcaggcgtacagtgcaccagcacctagcgcaaacaatactgcatcctccgcctttctgcagctcaccgcagaagccgaagaactcgcgacattcaatagtaagacagaagcaggagacgagaaaccgaagctggcggaagctccgagcgcgcagcccaaccagacgcaggagaaacaggggcaaccaaaaccggaactgcagcagcaggagcagcccgagcagaaaactaacacaccacaacaaaagctgccccagctggtgagcctgcccagcctgcctcagcctcctccccaggcccccccaccacagtgtccattgccccaatcttctccaagccccagccagctaagtcacttacctttgaagcctcttcataccagcactccacagcagctggccaacctgccccctcaactgatcccttatcagtgtgaccagtgtaaattagcctttcctagctttgagcactggcaggagcatcagcagcttcatttcttgagcgcacagaaccagttcattcacccccagtttctggaccggtccctcgacatgccattcatgctgttcgatccctcaaatcctcttctggcaagtcaattgctgagcggggcaataccacagatacccgcctcaagcgccaccagtcctagcacccctacatctaccatgaacactttgaaacggaagctggaggaaaaggctagtgccagtcctggtgaaaacgacagtggcacaggcggcgaggagccacagcgggataaacggttgcgcacgactataacaccagaacagctggagatactgtatcagaagtacctgcttgattctaacccaactcggaaaatgcttgatcacattgcccacgaagtgggccttaagaaaagagtcgtgcaggtgtggtttcaaaatactcgggcccgggagcggaaggggcagttccgtgccgtgggccctgctcaggcacaccgcagatgccccttttgcagggccctctttaaggccaaaacagcattagaggctcatatacggagccgccattggcacgaggccaagagagcagggtataacctgactctgtcagccatgttgctggattgtgatgggggactgcaaatgaagggggacatctttgacgggacctccttctctcatttacccccatccagctccgatgggcagggcgtgcctctttccccagtctccaaaaccatggaactttctccccgcacacttctgagtccttcgtctattaaagtggagggcatcgaggattttgaatccccatcaatgagctccgttaacctgaactttgaccagacgaagctcgataatgatgattgcagtagtgttaacaccgccatcacagacacaacaacaggagacgagggcaatgctgataacgactctgccactggaattgccacagaaaccaaaagttcctcggcccctaacgaaggcctcacaaaggccgctatgatggcaatgtcagaatatgaggatcggctgtcttccggacttgtgtctccggccccaagtttttattctaaagagtacgataacgagggcacagtagattatagtgagaccagtagtctagccgatccttgcagtcctagtccaggtgcttcgggctctgctggaaaatcaggcgattccggggacaggcccggacagaaacgcttcaggacccagatgactaacctccagttgaaagtcctcaaatcatgtttcaatgactacagaacgcctaccatgctggaatgcgaggtattaggcaacgacatcggtttgcccaagcgcgttgtgcaggtctggtttcagaatgccagggccaaggaaaagaagtctaaactgtccatggcgaagcattttggcatcaaccagacgagctatgaaggcccgaagaccgagtgtacgctgtgtggcatcaagtattccgcaaggctgtctgtaagggaccatattttcagccagcagcatatttccaaggtgaaggacacaatcggaagccagttagacaaagagaaggaatatttcgatcctgccactgtgaggcagctgatggcccagcaggaactcgaccgcattaaaaaggcaaacgaggtgcttggcttggctgcccaacagcagggaatgtttgacaacactccactccaagccctgaacctccccactgcctaccccgcccttcagggaatacctcctgtgctcctgccaggactaaattccccatctttacctggtttcactccctcgaatacggccctgacatcacccaagccaaacctaatgggtttgccaagcaccaccgtgccatcccccggcttgcctacaagcgggttaccaaacaagcctagcagtgcctcactctcaagcccaacccccgcccaggccaccatggcaatgggcccccagcagcctccacagcagcagcagcagcagcagcagccccaggttcaacaaccgccgcctccacccgcagcgcagcccccccccacacctcaattacccctacagcagcaacagcaaagaaaagacaaggactctgaaaaggtcaaagaaaaggaaaaagcccacaaaggaaagggcgagccgctccctgtccccaaaaaagaaaaaggtgaagcaccaactgcaacggcagccaccatcagcgcgcccttaccaactatggagtacgccgtggacccggctcagctgcaggccctgcaggccgccctgacctccgatcctactgccctgctaacaagtcagtttctgccctatttcgtgcctggcttcagcccttactacgctccccagattcccggggccctgcagagtgggtacctgcagccaatgtacggtatggagggcttgttcccatactcaccagccctgtcacaggcgctcatggggctctccccaggctctctcttgcagcagtatcagcagtatcagcagtcattacaagaggcaatacagcaacaacaacaaaggcaactgcagcaacagcagcagcagaaggtccagcagcagcagcctaaagctagccagacacccgtacctcccggtgctcccagccctgataaggatccagccaaggagtcaccaaaacctgaagaacagaaaaacaccccaagagaagtatccccactattaccaaagctccctgaggagccggaagctgagtccaagtctgccgatagcctgtacgaccccttcatcgtgccgaaagtgcagtataagctggtttgtcggaagtgtcaggctgggttttccgatgaggaagccgcccgctctcacctgaagtccctctgtttctttgggcaatcggtagtgaacttgcaggaaatggttctgcacgttccaaccggaggtggtgggggagggtcaggtggtgggggaggaggcgggggaggcggcggtggtgggggctcatatcactgccttgcatgtgaatctgctctctgcggcgaggaggctctaagtcagcatctagaatctgctctacacaaacaccgcacaattaccagggccgctcgtaatgccaaagaacacccctccctcttaccccattcagcatgttttccggacccaagtactgctagtacctctcaatctgctgcccactctaatgattcaccaccccccccctcagccgccgctccatccagcgcttcaccgcacgcttcaaggaaaagctggccccaggtggtaagtcgagcctcggccgcgaagcctccttccttcccacccttgagcagctcatctacggtcacctcatcttcttgtagcacgagcggagtgcaaccttccatgcctactgacgactactccgaagagtccgacaccgatctgtcacaaaagagcgacggcccagccagccccgtcgaagggccaaaggatccctcttgtcccaaggacagcggtctgacatccgtgggcactgacacattccgcttgtag

SEQ ID NO: 141030 - DNA, 10704 bp, Artificial Sequence
  Description of Artificial Sequence: Synthetic coding sequence
atggagacatgcgacagccccccaataagccggcaggagaacggtcaatccactagcaaactctgtggcacgacccaactagacaacgaggtgcctgagaaagttgcgggaatggaacccgaccgagaaaatagctctactgatgataatctcaagacagacgagaggaagtccgaggcccttctgggattcagcgttgaaaatgccgcggcaactcaggtcacctccgccaaggaaattccgtgtaatgaatgcgcaacttcgttcccttccctgcagaagtatatggaacaccactgccccaatgcacgcctgcccgtgctgaaagacgacaacgagagtgaaatcagcgagctggaggattctgacgtggagaacctgacaggggaaatcgtgtatcaacccgacggctccgcctatatcattgaagatagcaaagagtctggtcagaatgctcaaacaggagccaactcgaagttgttctcaactgccatgtttctggacagcctcgcttctgccggcgagaagtccgaccagagcgcctcagcccctatgtccttttatcctcaaatcatcaatacatttcatatcgcgtcatccctcggaaagcctttcacggcagaccaagcctttcctaatacctcagcactcgcaggagttgggccagtgctgcacagttttagagtgtacgatcttaggcacaaaagagagaaagattacctcaccagcgatggtagtgcaaaaaattcatgtgtaagtaaggacgtacccaacaacgtcgaccttagcaaattcgatggctgcgtgtccgacggcaaacgcaaacctgtgttaatgtgctttctgtgcaaattgtctttcggatatatccggtcctttgtgacacacgccgtgcatgatcacagaatgacactaaacgacgaggagcagaagctcctatccaacaaatgcgtgtcagctattattcaaggtatcggcaaagataaggagccactaatctctttcctggaacccaagaaaagcactagtgtgtacccacacttcagcaccacaaaccttatcgggcctgatccgacctttcggggcctttggtctgcctttcacgtggaaaacggcgatagcctgccggcaggtttcgcgttcctcaaaggcagtgcttcgacaagctcgagtgctgagcagcctctgggcataacacagatgcctaaggccgaggtaaacctgggtggactgtctagcttagtcgttaatacacctatcacctctgttagtctgtcccattcaagcagcgagagctccaagatgagcgaaagtaaagaccaggagaacaactgcgagaggccaaaggagagtaatgtactccaccccaatggagaatgtccagtgaagtctgagcccacagaacctggagacgaagacgaagaggacgcctacagtaacgagctcgacgacgaggaggtcctgggagagcttacggatagcattggcaacaaggacttcccacttctgaatcagtcaataagccccttgagctccagtgttctaaaattcatagaaaaaggcacctctagcagctcagctaccgtgtccgatgacactgagaaaaagaaacaaaccgcggccgttcgagcgagtggatctgtagcctccaactacggcatctcaggaaaggatttcgcagatgccagcgccagtaaggactccgccacagccgcccacccctctgaaatcgcaaggggtgacgaagactcctcggcgaccccccaccagcacggcttcaccccttccactcctggaactcctgggccggggggggacggaagccccggttcaggcatcgagtgccccaagtgtgacacggttctcggtagtagtagaagtctgggggggcatatgacaatgatgcacagtcgtaacagttgcaagacattgaagtgtcctaaatgcaattggcactataagtatcaacagactcttgaggctcacatgaaggagaagcaccctgaaccgggaggtagctgcgtgtactgcaagaccgggcagccccacccaaggttggcgaggggagagagctacacatgcggatacaagcctttccgctgtgaagtgtgtaattactctacaaccaccaaagggaacctctccatccacatgcagtcagacaaacacctaaacaatgttcagaatctccagaacggcaacggcgaacaagtcttcggacacagtgcaccggcgcctaacacgagtctcagcgggtgtggcacgcccagcccgtctaagcctaagcagaaaccaacttggcgctgcgaagtgtgcgactatgaaactaacgtcgcacggaacttacggattcatatgacctccgaaaaacacatgcataacatgatgctcctacagcagaacatgaaacaaatccagcataaccttcatctgggcctggcaccagcagaagccgaattgtaccagtactatcttgcccaaaatatcggcttgacgggaatgaagttagaaaaccctgctgacccccaacttatgatcaatccgtttcagcttgatcccgcaacagccgccgcactagcccccggcctcggggagctgagcccctatatctctgatcccgctctcaaactgtttcagtgcgctgtttgtaacaaatttacaagcgatagtctggaggccctctcagttcatgtcagtagtgagaggtctctgcctgaagaggaatggcgcgcagttataggggacatctaccagtgcaagttgtgtaattacaacacccaactgaaagctaactttcagttgcactgcaagaccgacaaacatatgcagaagtatcagctggtcgcacatatcaaggagggcgggaagtccaatgagtggcggctcaagtgtatcgcaatcggaaacccggttcatttaaaatgtaacgcttgtgattattacacaaattctgtcgacaagctacgcctgcatactacaaatcatcggcatgaggcggcattgaaactttataaacaccttcagaagcaggaaggcgccgtaaatccagagagttgttactactactgcgctgtgtgcgattacacaactaaggtcaagctgaacctggttcaacacgttcgcagcgtaaagcaccagcagacagagggactgcgtaagctgcagcttcatcagcaggggctggctcccgaggaggataacctcagcgaaatatttttcgtcaaggactgcccacctaacgagttagagactgccagcctaggcgcacggacatgtgacgacgacttgacagagcagcatgaagaggcggagggtgccattaaacccaccgcggtggctgaagacgacgaaaaggatacaagtgagcgcgacaactcagaaggaaagaattctaacaaagactctgtgagcgtggcgggagggacacagccactcctcctggccaaagaagaggatgtcgcaaccaagcgaagtaagccaaccgaggacaataagttttgccatgaacagttttatcaatgcccatactgcaactataattcaagggatcagtccagaatccaaatgcatgtcctttcccagcacagcgtgcagccagtgatatgttgccctctgtgccaggacgtgctgtctaacaaaatgcacttgcagctccacctcacccacttgcacagcgtatcgccagattgtgtggaaaaactgctaatgactgtcccagtgccagatgtgatgatgcctaacagtatgctgttgcctgcagccgcatccgaaaagtccgagcgggatacccccgccgcagtcactgcggagggatcaggaaagtatagcggggagagtccaatggatgataagagcatggccggcctggaagacagcaaggctaatgttgaagtgaaaaatgaagaacaaaagccaacaaaagaacccctggaggtgtccgagtggaacaagaacagtagtaaagacgtcaaaattcctgatacacttcaagaccaactcaacgagcagcaaaaacgccaaccactgtcagtatccgaccgacatgtctacaagtatagatgtaaccattgcagcctggcatttaagacgatgcagaagctacagattcattctcagtatcatgctatccgtgctgctactatgtgtaacttgtgccagcgcagctttaggacatttcaggcgctcaaaaaacacctggaggcgggccatcccgaactgagtgaagctgaacttcagcagctgtacgcctctttacctgtcaatggggagctgtgggcagagtctgagaccatgagccaggatgatcatggactggagcaggaaatggagcgtgaatatgaggtggaccatgaggggaaggcgtcgccggtgggcagtgattcttctagcattcccgacgatatggggagcgagccaaagcggactctgccattccgtaagggcccaaactttacgatggaaaaattcctagatccatcccgaccttataaatgcacggtatgtaaggaaagcttcacccagaagaacatactgttagttcattataattccgtttctcacctgcataagttgaagaaggtcctgcaggaggcatcttcccccgtccctcaggaaactaattccaatactgataacaagccctataaatgcagtatatgtaatgtggcctactctcagagttctacgttggaaatccacatgcggagcgtgctccaccagaccaaagctagggccgcgaagttggagcccagcggacatgtggccggtggacactccatagctgcgaacgtgaatagcccgggccagggaatgctcgattccatgtcactcgctgctgttaactctaaggatactcatctcgatgcgaaggagctgaataagaagcagacccctgatctgatatctgcgcagcctgcgcaccaccctcctcagtcccccgcccagatccagatgcagctgcaacacgagctccagcagcaggctgcattctttcagcctcaattcctcaatccagcattcttaccacacttcccaatgactcccgaagctctgctgcaattccagcagcctcagttcttattcccattctacattcctggcaccgagttttccctgggccccgacctcggactccccggaagcgccacctttggtatgccaggcatgactgggatggctggaagtttgctggaggatctcaaacagcagatccaaacccagcaccacgtcggtcagacccagctccagatattgcaacagcaggcccagcaataccaggctacacaaccccagcttcagccccagaaacagcaacagcaaccgcccccgcctcagcaacaacagcagcagcaggcctccaagctgctcaagcaagaacagtcaaatatagtatcagccgactgccaaattatgaaagacgtgccgagctataaagaagccgaagacataagcgagaaaccagagaaacctaaacaggaattcatttcagaaggcgagggtctcaaggagggtaaagacacaaagaaacagaagtcacttgagccttcaatcccaccaccccgaatcgcatctggcgctagaggaaacgccgcaaaggccttgctcgaaaacttcggattcgagctcgtgatacagtataatgagaacaggcaaaaagtccagaagaaaggtaagtcaggcgaaggtgagaatacagacaagctagaatgcgggacttgcggtaagcttttctcaaacgtgctcatccttaaaagccaccaggaacatgtccatggccaattttttccctacgccgcgctcgagaaattcgcccggcaataccgagaagcatatgataaattataccctatttccccatcaagtcctgagacgcctcctccaccccccccgccccctcccctcccccccgcgccaccgcagcctagctcaatgggccctgttaaaattccgaacacagtgtcgactccgctgcaggcgcctccccctactccgccaccccctccacccccacctcccccgcctccacctccccctccacccccccctccttctgcgcccccccaagtccagctccccgtgtcactcgatctccccctgtttccctcaattatgatgcagcctgtacagcaccccgccctgccgccgcaactggcgctgcagctccctcaaatggacgcattgtccgctgatctcacccaactgtgccaacagcagcttggcctggacccgaattttctccggcatagtcaatttaaaagaccacgcacgcgcatcactgatgatcagttgaaaattctgcgcgcatacttcgacataaacaattcacctagcgaggagcagatacaagagatggcagaaaaatctgggctgagtcagaaagtgataaaacactggttccgaaacacgttgtttaaagaacggcaaagaaacaaagatagcccctataatttttctaatcctcctattaccgtgttggaggatattcgcatcgaccctcagcccactagcctggagcactataagagcgatgcgtcttttagcaaaaggagttccagaacccgctttacagattaccaactgcgcgtgctccaggacttcttcgacaccaacgcctatcctaaagatgacgagatagaacagttgtctacagtgttaaacttacctacgagggtcatcgtggtatggttccaaaatgcacgacaaaaagcccggaaatcttatgagaatcaggcagagaccaaggacaacgaaaaaagagagttgactaacgaacgctacatacgtacatctaatatgcagtaccaatgcaagaaatgcaatgtggtcttccctagaatctttgatctgattacacatcaaaaaaagcagtgctacaaggatgaggatgatgacgcacaggacgagtcccagactgaggactctatggatgctacggaccaggtggtgtataaacattgtacagtgagcggccaaaccgacgctgctaaaaacgcagccgcacccgctgcctctagtggatccgggacctctactcctctgataccatcccccaaaccagagcccgagaaaacctcaccaaagcccgaatatcccgctgaaaaacctaagcagagcgatccatccccacctagtcaaggcacaaaacccgcactgccattggcttccacctcttcagaccccccgcaggcttcaactgcccaacctcagccacagccgcagccacctaaacagccgcagttaatcggacgaccgccttcagccagccagaccccagtacccagctcacccttgcaaatttcaatgacatcactgcagaatagcctgccgccacagctgctgcagtaccagtgtgatcaatgtaccgttgcttttcctaccttggaactgtggcaggagcaccaacatatgcactttctggctgcccagaatcagttcttacacagcccgttcctggagaggccaatggatatgccctacatgatcttcgaccccaataaccctctgatgaccggccagctcctggggtctagcttgacacagatgcctccacaagcgtcttcttcccacaccacagccccaactaccgtcgccgctagtctgaagaggaaactggacgacaaagaggataacaattgttccgagaaggaggggggtaattccggagaggaccagcaccgggataagcgcctgaggacaaccattacccctgaacagttggaaatattgtacgaaaagtacttgttagacagtaaccccaccagaaagatgctggaccatattgctagagaggtgggcctgaaaaagcgcgttgtccaagtctggtttcagaacaccagggcgagggagcgcaaaggacagttccgcgctgtcggccccgcccagtcacataagcgttgtcctttctgtagagccttgttcaaagccaaatctgccttggaaagccacatccgcagtcgccactggaatgagggtaagcaagctggatattctctaccgccctccccactgataagtactgaggatgggggggaatccccacagaaatacatttactttgattacccgtctctgcctctgacaaaaatcgatctgagctctgaaaatgaactcgcaagtacggtctcaactcccgtgagtaagacagcagagctgtccccaaaaaatcttctatctccttcctcattcaaagctgagtgtagcgaggacgtggagaacttaaacgccccaccggcagaagccggttacgaccagaataagacagacttcgatgaaacctcttccattaacaccgccatctccgacgccactaccggagatgaagggaatacagagatggagtcaaccacaggatcttctggtgacgtcaagccagcacttagcccaaaggagcccaagacattggacacattacccaagccagctactacccctaccactgaggtgtgtgacgacaagtttctgttttcactgaccagtccctctattcattttaatgacaaggatggagaccacgaccagtccttctatattaccgacgatcctgatgacaacgccgacaggagtgagacctcctctattgccgacccatcctccccaaacccattcgggtccagcaatccttttaagtccaagtctaatgacaggccaggacacaagcgattccggactcagatgtcaaatcttcagctgaaggtgctgaaagcttgtttcagcgattatcgaacaccaacaatgcaggagtgtgagatgcttggcaatgagatcggactgccgaagagagttgtgcaggtctggtttcagaatgcccgcgcaaaagagaagaaattcaaaatcaatatcggcaaacctttcatgatcaaccaggggggaaccgagggcaccaagcctgaatgcacgctctgtggagtgaagtatagcgcacggctctcaatccgtgaccacatcttcagtaaacagcatatttcgaaagtgcgcgaaaccgtaggtagtcagctcgaccgtgaaaaggattacctcgcccccacgaccgtacggcagctgatggcccaacaagaacttgacaggattaaaaaagcaagcgacgtccttggccttactgtgcaacagccaggtatgatggactcctcctctttacatggcatctcattgcccacagcatatccagggctgcctggtttacctccagtgcttcttccaggcatgaacggaccttcctcactgcctggctttccgcagaacagcaacatcgcctctggcatgctgggctttcctacctcagccacatcaagcccggctctctccctcagtagtgcccccaccaagcccctgctgcagacccctcccccaccacctccacctccccctcctcctccttcttcctccctttctggccagcagacagaacagcagaacaaggaaagtgagaaaaagcaaaccaagccaaacaaggtgaagaagatcaaagaagaagagcttgaagccactaagccggaaaaacacccaaaaaaggaggaaaaaatctcatcagccctgagtgttcttggcaaggtggtgggtgagacccacgttgaccctatccagttacaggctctgcaaaatgcaatcgccggcgatcccgccagcttcataggcggtcagttcctcccctacttcattcccgggtttgctagttactttacaccacagcttcctggaacagtacagggcgggtatttcccacccgtgtgcggcatggaatccctcttcccttatggtccaactatgccccagacacttgccggtctgtcgcctggcgcactgctccagcaataccagcagtaccagcaaaatctgcaggaaagccttcagaagcaacagaagcagcagcaggagcagcaacaaaagcccgtgcaggcaaagacgtcaaaggttgaatctgaccagccccagaattctaacgacgccagtgagacaaaggaagacaaaagtaccgccacggagagcactaaggaggagccacagctcgaatctaagtccgccgacttttccgacacatacgtggtcccattcgttaaatacgagttcatctgcaggaaatgccagatgatgtttaccgacgaggatgctgcagtgaatcatcaaaagtcattctgctattttggtcagccactcatcgacccccaagagaccgttctaagagtccctgtatccaaataccaatgtctggcctgcgatgttgcgatctccggcaatgaagcattaagtcaacaccttcagtcaagcctgcataaggagaagaccattaagcaggctatgaggaacgccaaagaacacgttcggctgctccctcattctgtctgttccccgaatcctaacaccacctccacctcacagagcgccgctagctcaaacaacacatacccacacctgtcgtgtttttcaatgaagtcctggcccaatatactgttccaggccagcgcccgacgggctgcgagtcccccatcctccccgccatccttgtccctgccgtccacagtgacgtccagtctgtgctcaacctcaggtgtccagacctcgctccccaccgagtcttgcagtgatgaaagcgacagcgagctaagccagaagctcgaggacctggataactcgctagaggttaaggccaagccggccagcggcctcgatggcaactttaattccataaggatggatatgttttctgtctag

SEQ ID NO: 141031 - DNA, 10803 bp, Artificial Sequence
  Description of Artificial Sequence: Synthetic coding sequence
atggaaacatgcgattcaccgcctatttcacggcaagaaaatgggcaatctacttctaagttatgcggtactacacagctggacaacgaggtgccagaaaaagtcgcgggtatggagccggaccgggaaaacagtagcactgacgacaacctcaagacagatgagcgtaagtctgaggccctgcttggctttagtgtggagaatgcagccgccacccaagtgactagcgctaaagagataccctgcaatgagtgcgctacctcattcccctccctccagaagtacatggagcatcactgtcccaacgcaagattgcctgttttgaaggacgataacgaaagtgagattagtgagctggaagactctgatgtcgaaaacctaacaggcgaaatcgtctatcagccggatggctcggcttacattatagaagatagcaaggaatcagggcagaacgcgcaaaccggggccaactccaagctattttcaactgctatgtttctagattcactcgctagcgcaggcgagaagagcgaccagagtgcctctgctccaatgtcattctatccacagattattaacacattccacatcgcgtctagcttggggaagccctttaccgcggatcaggcattccctaataccagcgccctagccggcgtggggccggtcctgcattcttttagggtgtatgaccttcgacataaacgtgaaaaggactatcttactagcgacgggtctgcaaagaattcatgcgtttctaaggacgtgccgaataacgtagatctgtccaagttcgatgggtgcgtgagtgacggcaagcgcaagcctgttttaatgtgttttctgtgcaaactgtcttttggttatattagatctttcgtcacgcatgccgtgcatgatcaccggatgaccctcaacgatgaggaacagaagctgttatctaataagtgtgtctcagccattattcaggggatcggcaaggataaggagccattaatctcattcctcgagcccaaaaaatctacttccgtctatccacatttctctaccacgaatctcatcggccctgacccaacctttaggggcctgtggagtgctttccacgtggaaaacggcgactctctacccgccgggttcgcatttctgaaggggtccgcctctacgtcctcgagcgcagagcagcccttaggcataacacagatgccaaaggctgaagtaaacttgggcggactctcaagtcttgtggtgaacaccccaattaccagcgtgtccctgtctcacagttcctctgagagtagcaagatgagcgagagcaaggaccaagaaaataactgtgagagacccaaagagtctaacgtgctgcaccccaacggggaatgccctgtgaagtctgaacccacagaacctggcgatgaagatgaagaggacgcgtactccaatgaactggatgatgaggaagtgctaggcgagttgacagattctattggtaataaagattttcccctgttaaaccagagtatatcaccactaagctcatccgttctcaaattcatcgaaaaaggcactagttcctcatctgctacagtgtctgatgacactgagaagaagaaacagacggctgccgtgcgcgcgtccgggtctgtggccagcaactacggtatcagtggaaaagactttgccgacgcctccgcgagcaaggacagtgccacagcagctcacccctccgaaattgctcgtggagatgaggatagctccgcgaccccccaccaacatggctttacccctagcaccccaggcaccccaggccctgggggagatggatcgccaggatccgggatcgagtgccccaagtgcgatactgtacttgggtcgtctagatctctgggcggacacatgactatgatgcactcgcgtaatagctgcaagacacttaagtgtcccaagtgcaactggcattataaataccagcagacactggaggcccacatgaaagaaaagcaccccgagcctggcggctcatgcgtctactgcaaaacaggacagccccatcctcgcctggcccggggggagtcttacacatgcggatacaagcccttcaggtgtgaagtttgtaattacagcacaactaccaagggcaatttgtcaatccacatgcagtccgacaagcatcttaataacgttcagaacctgcagaatggtaacggtgaacaggtctttggccacagtgctccggcacctaatacaagcctttccgggtgcggaacaccttcacccagcaagccaaagcagaagcctacctggcgctgcgaggtttgcgactacgagaccaatgtggcgcggaatctcaggatacatatgacttctgaaaagcacatgcacaacatgatgctgctacagcagaatatgaagcagatccagcacaatttgcacttaggcttggcacccgccgaggctgagctctatcaatactatcttgcccagaatattggcctcactggcatgaaacttgaaaatcctgcagatcctcagctgatgatcaatccgttccaattagaccccgccacagccgctgcattggccccaggactcgtgaataatgaattaccccctgaaatcaggttagccagcggccaactgatgggggacgacctctcactgctgactgcgggggagctgtcaccgtatatctcagatcccgcactgaagctcttccagtgcgccgtctgtaacaagtttacctcggactcactggaagctctgagtgtgcacgtctcttccgagcgaagcctcccagaggaggagtggagggcggttattggggacatataccagtgtaagctgtgcaactataatactcaactcaaggctaacttccaactgcactgcaagactgacaagcacatgcagaagtatcaactggtggcacatattaaagagggtggcaagtctaatgaatggaggctgaagtgtatcgctatcgggaacccagtccaccttaagtgtaacgcttgcgattactacaccaactccgttgacaagctgcggctgcataccaccaaccaccgtcacgaggctgcgttgaagttgtacaaacatctgcagaagcaagagggtgccgtgaacccagaaagctgctactactactgtgcagtatgtgactacaccacaaaagtcaaactgaatctggtccagcacgtcagaagtgtcaaacaccaacagaccgagggtctgcggaaattacagctgcaccagcaggggctcgctccagaggaagataacttgtccgaaattttttttgtcaaagactgcccacctaacgagctcgaaacagcatcgctaggcgctagaacctgcgacgatgacttgacagagcagcagctgcgatctacttcagaggagcagagcgaggaggcagagggcgctattaagcctaccgcagtcgccgaggacgatgaaaaagatacttctgagcgcgacaacagtgaaggaaagaactcaaataaggactcgggcatcataacccccgaaaaggagcttaaagtctcggttgcaggcggaacgcagcccctactgctagcgaaagaggaggacgtcgcgacaaaaaggagcaaacctaccgaggacaataagttctgtcacgaacaattctaccagtgcccatattgcaactataacagccgcgaccagtcacggatccaaatgcatgtgctgagtcagcacagtgttcagccagtgatatgctgtccattgtgtcaggatgttctgtcgaacaaaatgcacctgcaactgcatctgacacacctgcatagcgtatcgcctgactgtgtggagaagctgttaatgacagtgcctgtacctgacgtgatgatgccaaactcgatgctactccccgcggccgccagcgagaaaagtgagagggacactcccgccgcagtaacagccgagggctcaggtaagtatagtggagaatctccaatggatgacaagtctatggccggtctggaggattcaaaagccaacgtggaggttaaaaacgaggaacagaagcctacgaaagagcccctggaagtgagcgaatggaataagaattccagtaaggacgtcaaaatacccgacacccttcaggaccaactaaacgaacagcaaaagcggcagcctttaagtgtatctgatagacacgtttataagtatagatgtaatcactgcagtctggcttttaagaccatgcagaagctgcagatccattcccagtaccacgcaatccgcgcggctacgatgtgtaatctgtgccaaagatcattccgcaccttccaggccctgaagaagcatctcgaagcaggccaccctgaactgtctgaggccgaactgcaacagctgtatgccagcttacccgtgaacggtgagctgtgggctgaatctgaaacaatgtctcaggatgaccacggactggagcaggaaatggagcgggagtatgaagtcgaccatgagggaaaggcctcccccgttggttctgatagcagctcaattccagacgacatgggatccgagccgaaaaggaccctgcccttcagaaaaggccctaacttcactatggaaaagtttctggacccctctcggccctataaatgcacagtctgcaaggaatccttcactcagaagaacatccttcttgtgcattacaatagcgtctcccatcttcataagttgaagaaggtgctccaggaggcaagttctcctgtgccacaggagaccaacagcaacactgataacaagccatacaaatgcagcatatgtaatgtggcctactcccagtcaagcaccctcgagattcatatgcggagtgtactccatcagacaaaagcaagggctgcaaaacttgaacctagtgggcatgtggcaggcggtcattccattgcggctaatgtaaactcgcccggccaaggcatgttagactccatgagcctggcagctgtcaacagcaaagatactcatctggacgcaaaagagctcaacaaaaaacaaacacctgacctgatctctgctcagcccgcgcaccacccaccacagagccccgcacaaattcaaatgcaactccaacacgagctgcagcagcaggcagcgttcttccagcctcagttcctgaatccagcattcctgcctcacttccccatgacccctgaagccttgctccagttccagcagccccaattcctcttccccttctacatacccggaacagagttctcgctggggccagacctgggcttgccaggcagcgccacgttcgggatgcccgggatgacgggaatggcagggtcactgttggaagatttgaaacagcaaatacagacccagcatcacgtcggtcagacccagctgcagatcttgcaacagcaagctcagcagtatcaggcaacccaaccgcagctacagccccagaaacagcagcagcaacctcctccgccccagcagcagcagcagcagcaagctagcaaactcctgaaacaggaacaaagtaacatagtctcagcagactgtcaaatcatgaaggatgttcctagctataaggaggctgaggatattagtgagaaaccggagaagcccaaacaggagttcattagcgagggtgaaggacttaaggagggtaaagataccaagaaacagaagtcactggagccatccattccccctcctcgcattgcaagtggagcaagaggtaatgcggctaaagcattgctggagaacttcgggtttgagctggtaatccagtataacgagaaccggcagaaggttcagaaaaaaggcaaatccggtgaaggcgaaaacactgataagctcgaatgcgggacttgtggcaagctgttttcaaatgttctgatccttaagtctcatcaagagcatgtccacggccagttctttccctacgcagccttggaaaaattcgcaagacaatatagggaggcttacgacaaactttatcctatctctccatccagccctgagactccaccccctccccctcctccgcctcccctgccacccgctccaccccaaccctctagcatgggcccagtcaaaattcctaacacagtaagcacacccttgcaggctccgccacccactcctccacccccgagcgccccgcctcaggttcagctgcccgtttcactggatcttcccctctttccgagtattatgatgcagccggttcaacatccagcactgcctcctcaattggcccttcagctgccacagatggacgcactgtcagctgatttaacccagctttgccagcagcaactaggtctggaccccaatttcctgagacactcccagttcaaacgcccaaggacacgaatcactgatgaccaactgaaaattttgcgcgcctacttcgatataaacaattcccccagtgaggagcaaattcaggaaatggccgaaaaatccggcctcagccaaaaagttattaagcactggtttcgcaatacacttttcaaagagaggcagaggaacaaggattccccatacaatttcagtaatccccccatcacagtgctcgaagacattcggatcgaccctcaaccaacgagcctggagcattacaagtccgacgcatctttttccaagcgtagctcacgcacccgatttaccgactatcaactcagggtcttgcaggacttttttgacacaaatgcctacccaaaggacgacgagatcgaacaattatcaacagtcttaaatctgcctacccgcgtaattgtggtgtggttccagaacgcaagacagaaagccaggaagagttatgagaatcaggcagagacgaaagacaatgagaagagagaattaacaaatgaaaggtatattaggaccagcaatatgcagtaccagtgtaaaaagtgtaatgtggtgtttccccgtatttttgacctcatcacgcaccagaagaaacaatgctacaaggatgaggacgatgacgcccaggatgagagccagaccgaagactctatggacgccacagatcaggtggtttataaacattgcactgtgtctggtcagaccgatgcggccaaaaatgcagcagcgccagctgcaagctccggaagtgggacgagtacccccctaattcccagcccaaagcctgaaccagaaaagacctcccctaagcccgagtacccggccgagaaacccaaacagtcagacccttctccaccttctcagggtacgaaacctgcccttcctctggcttcgacaagctccgacccaccccaggcctctacagcgcaaccccagcctcagccccagccacctaaacagcctcaactgatagggcgaccaccaagcgctagtcaaacaccagttccctctagtcctctccagatttccatgacttccttgcagaacagcctgcctccgcagctgctccagtaccaatgcgaccagtgcactgtggcttttccgacactggagctgtggcaggagcaccagcacatgcactttctggctgctcagaatcaatttctgcacagtcccttcctggagaggcccatggatatgccgtacatgatctttgatccaaacaaccccctaatgacaggacagctgctgggctcaagccttacacagatgcctcctcaagcatccagctcacacactaccgcccccacgactgtcgccgccagcttgaagcgcaagctcgacgataaagaggataacaattgcagcgagaaggaggggggcaactctggcgaggatcagcaccgagataaaaggctccggacaaccatcacccccgagcagctcgagatattgtacgaaaaatacttgctcgactcaaacccaaccagaaaaatgctcgatcatatcgctagggaggttgggctgaagaagcgggttgtccaggtttggttccagaatacccgggcacgagagaggaagggacagttccgcgcagtggggcctgctcaatcccacaagcgctgcccattctgccgagcattgttcaaagctaaaagcgcattggagtcccatatccgttccagacactggaatgagggtaagcaggccggctacagtctgcctccatccccactcatcagtacggaggatgggggagaatccccgcagaagtacatttattttgattacccatccctaccgctcaccaagatcgacttgtcgagcgaaaacgagctcgcctctacagtcagcacaccggtctcaaagacagccgagctgtctcctaagaacctccttagccccagctccttcaaggccgagtgctcggaggacgtggaaaatctgaacgctccgcctgccgaggctggctacgatcagaacaaaactgatttcgatgagactagctccatcaatacagctatctccgatgctaccacaggagatgagggtaataccgaaatggagagcactactggttctagcggcgatgttaagcccgcacttagccccaaagaacccaagaccttagacacattgcctaaaccagccactacacccacgacagaggtgtgtgatgacaaatttttattctccctgacaagtccatctattcacttcaatgataaagatggcgaccacgaccagtcgttctatataactgacgatccggacgataatgcagacaggtccgaaacctcatctatagcggacccatcaagtccaaacccattcgggtccagcaacccttttaagagcaagagcaacgatcgaccaggccataaaagattcagaacccagatgtcaaacctgcagctgaaagtgttaaaggcctgcttttcagactacaggactccgaccatgcaggagtgcgagatgttgggaaatgagatagggctgcctaagcgggttgtccaggtctggttccagaacgcacgggcaaaggagaaaaagtttaagatcaacatagggaaacccttcatgataaaccagggaggaaccgaaggaaccaaaccagagtgtaccttgtgtggggtgaagtatagcgctagactttccattcgcgaccatatcttttctaaacagcacattagtaaagttcgagaaactgtgggttcacaattggaccgcgaaaaagactatttggcccctactactgtgcgccagctgatggcgcagcaggagctcgatcgaatcaagaaggcctctgacgtgctaggcctgactgtgcagcagcctggaatgatggattctagctccctgcacggcataagcttaccaaccgcttatcctggacttcccgggttaccccccgttctgctccccggaatgaacggccccagttctctgccgggatttccacagaatagtaatactctaacacctcccggggccggtatgcttggtttcccaacctccgccacgtcctcgccagccttatccctgtcatcggcacctaccaagccattgcttcaaacccctccgcctccacccccacccccacctcccccaccctcttctagtctgagcggacagcagacagagcagcagaataaggagagcgaaaagaagcagacaaaaccgaataaggtgaaaaagattaaagaggaggagctggaagccactaagcccgaaaagcatccaaaaaaggaggagaaaatctcttcagctctgagtgtgttgggaaaagttgtgggcgagacccacgttgaccccatccaactgcaggcgcttcagaatgccatcgccggggaccccgcatcatttatcgggggccagttcctgccctatttcatcccaggctttgcctcatattttacaccccaactaccagggactgttcaaggcggctatttcccacctgtgtgtggcatggagtcactctttccctacggtcccactatgcctcaaacattggcaggcctgagtcctggcgctctcttgcagcaatatcagcaataccagcaaaacttacaagagtcactccagaaacagcaaaagcagcaacaggagcagcagcagaaacccgtacaagccaaaaccagcaaggtcgaatctgaccagcctcagaacagcaatgatgccagcgagaccaaggaggataagtctacagcaactgaatctaccaaagaggagcctcagctggaatccaagtctgccgacttttcagatacctacgtggtgccgttcgtgaagtacgaatttatatgccgtaaatgtcagatgatgtttaccgacgaagacgccgccgtgaaccatcagaagtccttttgctatttcggacagcctctgatcgaccctcaagagaccgtgctccgagttcctgtgtctaagtaccagtgcttagcatgtgatgtcgctatctctgggaacgaagccctttctcagcacctgcagagcagcctgcacaaggaaaaaaccattaagcaggctatgcggaatgcaaaggaacatgtgcgcctcttgccccactccgtgtgctcgcccaatcccaataccactagtacctcccagtcagccgcatcttcaaataatacctacccccatctctcttgtttttcaatgaagagttggccaaacattctttttcaagcttcggcaaggagagctgcctcacccccatcaagccccccctccctttccttgcccagcactgtaactagtagtctttgctccacctccggtgttcagacatcattgcctaccgaatcatgcagcgatgaatcggactctgaattatctcaaaaactggaggacctggacaacagtctggaggtgaaagcaaagccggcttcaggcctggatggcaacttcaactccattcggatggatatgtttagcgtgtag

SEQ ID NO: 141032 - DNA, 10716 bp, Artificial Sequence
  Description of Artificial Sequence: Synthetic coding sequence
atggaaacttgtgactccccaccgatctctagacaagagaacgggcagagtacttcaaaactatgcgggacgactcaattggacaatgaagttccggaaaaggtggcgggcatggaacccgatcgagagaacagttccaccgatgataatcttaagaccgatgaacgaaagtccgaagccctgcttggatttagcgtcgagaatgccgcagcaactcaggtgactagcgcgaaggaaatcccatgcaacgagtgcgctacaagctttccttccctccagaagtatatggagcaccactgcccaaacgctcgactgcctgtcctgaaagatgacaacgagtcagaaatctctgagctcgaagattccgatgtagaaaaccttactggggagatcgtgtatcagccggatggttcagcgtatattatcgaggatagcaaggagtctggccagaacgcccaaacaggagctaacagtaaactgtttagtaccgcaatgttcctggatagccttgccagcgctggagaaaaatctgaccagagcgcctccgcccctatgtccttttaccctcaaataatcaatacattccatatcgcttcgtctttaggcaagccatttactgccgaccaggcgtttcccaacacaagcgccctcgccggagtaggacccgtgctgcacagtttccgcgtttatgatctccggcacaaacgtgagaaggactacctgacatcagacgggtccgccaaaaattcttgtgtgagcaaagacgtgccaaacaatgtggatctctccaagttcgacggctgcgtgagcgacgggaagagaaagccagtgttgatgtgctttttgtgtaagctgtctttcggctatattaggagctttgttacccatgccgtgcacgatcatcgcatgacactgaatgacgaagagcagaagctgttatctaacaagtgtgtgagtgcgattatccagggaatcggcaaagacaaagagcccctgatctcattcttggagcccaagaagagcacatcagtgtatccacacttctccacaacaaatctcatcgggcctgacccaacattccgcggcctttggtcagcttttcacgtagaaaatggagattccctccccgctgggtttgcgttcttgaaaggcagtgctagcacctctagtagtgctgagcagccgctggggatcacccagatgcctaaggccgaggtgaatctcgggggactaagttctctggtggtaaacaccccaattacctccgtatccctttcccatagtagcagcgaaagcagtaagatgagtgaaagcaaagaccaggagaacaactgcgagcggccaaaggagtctaatgtgttacatccaaacggagagtgccctgtgaagtcagagcctactgaaccaggagacgaggatgaggaggacgcttatagcaatgaattggacgatgaggaagtgcttggagaattgactgactctatcgggaacaaggacttccccctgttgaaccagtccatctcccctttatcctcctctgttctgaagttcattgagaagggaacaagctcatcctcagccacggtgagcgatgacacggaaaagaaaaaacagacagccgccgtaagggcctcaggttcagttgcaagtaattacggcatcagcggtaaggactttgcagacgccagtgcctctaaggatagcgccacggctgcccatccgagcgaaattgccaggggtgatgaagattctagcgccaccccacatcagcatggcttcacaccgtccactccggggactcctgggcccgggggtgatggcagcccaggaagcggaattgaatgccctaagtgtgacaccgtgctgggctcttcccgcagcctgggtggacatatgacaatgatgcacagcagaaactcttgtaaaaccctgaagtgccccaaatgtaactggcactacaaatatcagcagaccctggaggcccacatgaaggaaaagcacccagaaccaggagggtcatgcgtctattgcaaaaccggccagcctcacccccggctagccaggggcgaaagctacacatgcggctacaaaccctttagatgcgaggtctgtaattacagtaccactaccaaaggaaatttgagcattcatatgcagagcgataagcacctcaacaatgtacagaacttacagaatggaaatggggagcaggtgtttggtcactcggctcccgctcctaatacgtctctgagtggctgtgggactccctccccttctaagccaaaacagaagccaacctggcgctgcgaggtgtgcgattatgagacaaatgtcgcccgtaacctgcgtattcacatgaccagcgagaaacacatgcataatatgatgttgctacagcaaaatatgaaacagatacaacataacttgcaccttgggcttgctccagccgaggcggaactctaccagtattacctcgcacagaatattgggcttacggggatgaaactcgagaatccagccgacccacaattgatgatcaatccatttcaactggacccagccaccgcagccgctctggctcccgggctgggtgagctgtcgccctatattagcgaccctgctttgaagttgtttcaatgtgccgtgtgtaataaatttaccagtgactctttagaagcattgagcgtgcatgttagctcagaaagaagcctaccagaggaggaatggagggcagtgattggggatatctaccaatgtaagttgtgcaattacaatactcagcttaaagctaacttccagttgcattgcaaaacggacaagcacatgcagaaataccagctggtggctcacattaaggagggcggtaaaagcaatgaatggcgtcttaagtgtatcgccattggaaatcccgtgcacttaaagtgtaatgcctgtgactattacactaatagtgtggacaagttgaggctccatacaacaaaccacaggcatgaggccgcactcaaactctataagcacctacaaaagcaggagggagcagttaatcctgaaagctgctactactattgcgctgtgtgtgattatacaaccaaagtaaaattgaacctggtgcagcacgtgaggtccgttaaacatcagcagaccgaggggttgagaaaactccagctgcatcagcaggggctggctccagaggaagataatctgagtgagatctttttcgtaaaggattgtccacctaacgagctcgagaccgcttcgttaggagctcgaacgtgcgacgatgacctcaccgagcagcatgaagaggcagagggggcaatcaaaccaaccgccgtcgcagaggatgatgaaaaggacacctcagagcgagataactcagagggtaagaattcaaacaaggattcggtgtcagtggcaggaggaacacagccgcttctactggcgaaagaagaagacgtagccactaagcgctccaagccaactgaagacaataaattctgtcacgaacagttctatcagtgcccatattgcaactacaactcacgggatcagtctagaattcaaatgcacgtgctgagtcagcactcagtccagcccgtgatttgttgccccctgtgtcaagatgtcctgtccaataagatgcatcttcagctccacttgacccacttacattcagtatcccccgactgcgtggagaagctcctgatgaccgtccctgttcctgacgtcatgatgcctaattcgatgctgcttcctgcagctgcttccgagaaaagcgaaagggatacgcccgctgcggtgaccgccgagggaagcggcaagtacagcggggaaagtcccatggatgataagagcatggcaggcctcgaggacagcaaggcaaacgtggaggtgaaaaatgaggagcaaaagcctacgaaggagcccttggaagtgagcgagtggaataagaatagctctaaggacgtgaagatcccagatacactgcaagatcagctaaacgaacaacaaaaaagacaaccactcagtgtgtccgatcggcacgtttacaagtatcggtgtaaccactgttctttggccttcaaaacaatgcagaaattgcagatacactcccagtatcacgccatacgcgccgcgaccatgtgtaatctgtgtcaacggtccttccggaccttccaggcccttaaaaaacatctggaggcaggtcaccctgagctcagtgaggccgagctgcagcaattgtacgctagtttgcctgtcaatggcgagctctgggcagaatcggaaacgatgtcccaggacgaccatggacttgagcaggaaatggaacgggagtacgaggtagaccatgagggaaaggcatctcccgtcgggtccgacagctcctccatccccgacgacatgggaagcgaacctaagagaaccctgccattcagaaaaggtccgaatttcacaatggagaagtttcttgatccttcgagaccctataagtgcaccgtgtgtaaagaatctttcactcaaaaaaacattctgttggtgcattacaactctgtgtcccacctccacaagctcaagaaggtccttcaggaggcaagttcacctgtcccccaggagacgaattctaacaccgataataaaccatacaaatgctctatctgtaacgtggcctacagccaatcctcaaccctggagattcacatgaggtccgtcctgcaccagacgaaggcacgcgctgccaagctggagcccagtggtcatgtggccggcgggcactctatagccgctaacgttaatagtccaggacaggggatgctggacagcatgtccctggcagcagttaacagcaaggacacccatctcgacgcaaaggaactaaacaaaaagcagaccccagacctgatcagcgcacagcctgcccatcacccaccccagagtccagcccaaattcagatgcagctgcagcatgagttgcagcagcaggctgcgttttttcagccacaattccttaaccctgccttcttgccccactttcctatgacgcccgaggcactcctgcagtttcagcagccccaatttttattcccgttctatattcccggcactgaattctctctgggacctgatcttgggctgcctggctctgctaccttcgggatgccgggcatgactggtatggctggctccctcctcgaggacctcaagcaacagatacaaactcagcaccatgtaggacaaacacagctgcagattttgcagcaacaagcccagcaatatcaggccacccagccgcagctgcaaccgcagaagcagcagcagcagccacctccgccacagcagcagcagcagcaacaggcatccaagctgctcaaacaggagcagtctaacattgtcagcgctgattgccagatcatgaaagatgtgccctcttataaagaggcagaggatatcagcgaaaagcctgagaagcccaagcaggaattcatctctgaaggcgaggggcttaaggaaggcaaagatacaaagaagcaaaagtcactcgagccatccattccgccgccccgcattgcgtccggcgcgcgaggtaacgctgccaaggccctattagagaacttcggatttgagctcgtcatccagtataatgaaaacagacaaaaggtgcaaaaaaaggggaagtctggtgagggagaaaacacagacaagctcgagtgtggtacttgcgggaagctgttctcaaacgtacttatcctcaagtctcatcaggagcatgtgcacggacagttctttccctacgccgcattagagaaattcgccaggcagtacagggaagcttatgataagctgtaccccattagtccaagtagccctgagacgccacccccaccaccgccacccccgccactccctcctgctcctccacagcccagcagtatggggcccgtgaaaatacccaacactgtctcaacccccctccaagccccaccgcccactcctccacctcccccgcctcccccaccgcctcctcccccaccccccccaccccctcctcctagtgcccctccccaggtacagctgcctgtatcccttgatctgccattgtttccttctattatgatgcaaccagtgcaacacccagcccttcctccacaactggcccttcaactgccacagatggatgccctgtcggcggacctgacacagctctgccagcagcaattgggcctggatcctaatttcctgcggcactcccaatttaaaaggcctcgcactcgcattactgatgatcagctgaagatcctgagggcttattttgacattaacaattcacctagcgaggagcagatccaggagatggctgagaagagcggactgagccagaaggtgattaagcattggttccggaatacactctttaaagaacgccagaggaacaaagactccccgtacaactttagtaaccctcctatcactgtgctcgaagacattagaatcgatccacaacccacttccttggaacactacaaatccgacgctagctttagcaaaaggagctctcgtacaaggttcactgactatcagctgcgggtcctccaggacttttttgacaccaacgcgtatcctaaggacgacgagatcgagcagctgagcaccgtcctcaacctcccaacacgtgtgatagtagtgtggtttcagaatgcaagacagaaggcccggaagtcttatgaaaaccaggccgaaacaaaagataacgagaaaagggagcttactaatgagcgctatatccggacttcaaacatgcagtatcaatgcaagaagtgtaacgtagtgttcccacggatctttgacttgattacacatcagaagaagcagtgttacaaggacgaggacgatgatgctcaggacgagtcacagacggaagattcaatggatgctaccgaccaggtcgtttataaacactgtacggtgtccgggcagaccgatgccgcaaagaacgctgctgcccctgctgctagcagcggttccgggacatccacgcccctcattcctagccccaaaccagagcccgagaagacatcccctaaacccgagtacccagccgagaagcctaagcagagcgacccttccccaccctcacagggcactaaaccagccctgccgctagctagtacctcttccgatccaccgcaggcaagcaccgctcagccgcagccacagccgcagcccccgaaacagcctcagctcatcggtcggccgccaagtgccagccaaacccccgttccaagttcacccctgcagatctccatgacgagcttgcagaactctctaccaccccagctactccagtatcagtgcgatcaatgtaccgtcgccttccccactctggaattgtggcaagaacaccagcatatgcattttttggccgcccagaaccagtttttgcacagcccgtttctggaacgacccatggacatgccatatatgatctttgaccctaacaaccccctgatgactggccagcttctcggctccagtcttacccagatgcctccccaggcgagtagctctcacacgaccgcaccaacaaccgtcgccgctagcctgaagcgtaagctggacgataaggaagacaataactgctccgaaaaggaaggaggaaacagcggagaggatcagcaccgcgataaacgattacgcacaaccataacccccgagcagctagaaattctctacgaaaaatatttattggattccaatcctacacgtaagatgctcgatcatatcgcccgagaagtgggcctgaagaagagggtggtgcaggtgtggtttcagaatacgcgggctcgtgagaggaagggccagtttcgggctgtcggcccagcccagtctcataagcgttgtccgttttgtagagccctcttcaaggcaaagtctgcactcgaaagccacataagaagtaggcattggaacgaaggcaagcaggccggttacagcctgccaccttccccactgatttccacagaggacggcggggagtcacctcagaaatatatctattttgattatccgtcactcccccttacaaagattgacctgtcgtcagaaaatgaattagcctcaaccgtgagtacaccagtgtccaagacagcagagctgagccccaaaaatttactaagcccctcatcgttcaaagctgaatgcagtgaggatgttgaaaaccttaatgcccctccagcggaagccggttacgatcagaataagaccgacttcgacgagaccagctcaatcaacactgctatctctgatgcaaccaccggggacgagggtaacacggaaatggaaagcactaccggcagttcgggggacgtgaaacccgcactttctcctaaggaacctaaaaccctcgatacactgcctaaacccgctacgacaccaactactgaggtgtgcgacgataagtttctgttcagcttgacttccccttctattcacttcaatgataaagacggtgaccacgatcagtcattctacattacagatgatcctgacgacaacgcagatcgcagcgaaacaagttctattgccgatccctcctcaccgaaccctttcgggtcctcaaacccgttcaaaagcaagtctaacgacaggccaggacacaaacgattccgcacccagatgagtaatcttcaattaaaggtactaaaggcttgttttagcgattaccgaacccctactatgcaggagtgcgaaatgctgggtaatgagatcggcttacctaagagagtggtccaagtttggtttcaaaatgcgagggctaaggaaaaaaagttcaagatcaatatcggtaaaccgtttatgatcaaccagggaggtaccgagggcactaagcccgagtgtaccctctgtggagtgaaatactccgctcggttatctatccgcgaccacatattcagtaagcagcacatttcaaaggttagggaaaccgttggatctcagctcgacagagagaaggactatctggctcctaccacagtacgccagctgatggcccaacaggagctggacaggattaaaaaggcatctgatgtgctgggactgaccgtgcagcagcccggaatgatggatagctcttcgttgcacggtatttctcttccaaccgcatatcctgggctacccggactgcctcccgtgctcctgccaggtatgaacgggccttcctcccttcctggatttccacaaaactcgaataccctcacccctccaggtgcgggcatgctaggctttcccacctctgccacgtcctctccggctctgtcactgtcgtcagcaccaaccaaaccactgctccagacccccccgccacctcctccccccccaccgccacccccctcttcctcactgagcgggcagcaaacagaacaacagaacaaggagtccgagaagaagcagactaagcccaataaggtgaaaaagattaaggaagaagaactcgaggctacgaagcctgagaagcaccctaagaaggaagagaagatttcttctgcattgagcgttctgggcaaagtggttggtgaaacgcacgtcgatccaattcagctgcaggcccttcagaacgccattgccggggatccagctagtttcatcggaggccagttcctgccttacttcataccgggcttcgcatcttattttacgccacagctccccggtaccgtccagggtggctattttcccccagtttgcggaatggaatccttatttccctacggacccacgatgccacagactctggcaggactttccccgggggcactgttgcagcagtaccagcagtatcaacagaatcttcaggagtcactgcaaaagcagcagaagcaacaacaggagcagcagcagaagcctgtgcaggctaagaccagcaaagttgaatccgatcagccacagaacagcaacgatgcttccgaaaccaaagaagataagagcacggctacagagagtactaaggaagagccacaattggagagcaaaagcgctgatttctcagacacatacgtggtcccattcgtgaaatacgagttcatttgccgcaagtgtcagatgatgttcacagatgaggacgcggcggtgaatcaccagaaaagcttttgctacttcggacagccactgatcgacccgcaagagacagtgttaagggttcctgttagcaagtatcagtgtctcgcctgcgacgttgccatatctggtaacgaagctttgagccagcaccttcagtcatcccttcataaagagaagacaattaagcaggcgatgcggaatgccaaagagcatgtgcggctgctcccacactcagtgtgcagcccaaaccccaataccaccagcacatcccagtccgccgcaagctccaataacacttatccccatctctcctgcttctctatgaagtcctggccaaatatcctgtttcaggcatccgcccggagggccgcctccccacctagcagcccgcccagcctgagcctgccttcgacagtaacctcttctctttgctctaccagcggggtgcagacttcactgccaaccgagagttgtagtgacgagtcagactctgagctatctcagaaattggaggacctagacaatagtcttgaagtcaaagcgaagcccgcttctggtctggacggcaatttcaactccattaggatggatatgttctccgtgtag

SEQ ID NO: 141033 - DNA, 468 bp, Artificial Sequence
  Description of Artificial Sequence: Synthetic coding sequence
atggagacctgcgatagcccaccaatctcccggcaagagaacggacagagtacgtccaaactgtgcggcacaactcagttggacaatgaggtgcctgagaaagtggcaggcatggagcccgatagagagaattcttccaccgacgataaccttaagactgatgagcggaagagcgaggctcttctgggcttctccgtcgagaatgccgccgctacacaagtcacctctgccaaggagatcccctgtaatgaatgtgcaacatcttttccctctctacagaaatacatggagcaccactgtcctaatgcccgccttcccgtgcttaaagacgataatgaatccgaaatttccgagctggaggatagcgatgttgagaaccttactggcgaaatcgtgtatcagcccgacggctccgcgtacatcatcgaagacagtaaggagtccggccagaatgctcaaaccgggtag

SEQ ID NO: 141034 - DNA, 10773 bp, Artificial Sequence
  Description of Artificial Sequence: Synthetic coding sequence
atggaaacatgcgattccccacccatttcccgtcaagaaaacggacagagtacttcaaaactatgcggaaccacacaacttgacaacgaagtcccggaaaaagtggccggtatggagccagaccgggagaacagctccaccgatgacaacctgaagacagacgagcgaaagagcgaggcacttctcgggttctcagttgagaatgctgccgctacccaggttacatcggcaaaggaaatcccatgcaatgaatgtgcaacatcattccccagcctccagaagtacatggaacaccattgcccaaatgcccggttacctgtcctcaaagacgacaacgaatcagagatttcggagctggaagattctgatgtggaaaacctgacaggggagatcgtttatcagcccgatggctccgcatacatcatcgaagactctaaggagtccggccagaatgctcagaccggtgctaactccaaactctttagcactgcaatgtttctggattctcttgcatcggcaggggagaagtctgatcagagcgccagcgcgcccatgagtttctacccgcagatcataaacacgtttcatattgcttctagtctcggcaagccgttcactgctgaccaggcgtttccaaatactagtgctctggctggagtgggcccggtcctgcactctttcagagtctacgatctgcggcataagagagagaaggattatttgacgagcgacggctctgctaaaaatagttgcgtgtcgaaggatgtgcctaacaatgttgacctgagcaagttcgacgggtgcgtgagcgatgggaagcgcaagcctgtgttgatgtgctttttgtgtaaactctccttcggttatattcggtcgttcgtaacccacgcggtgcatgaccatagaatgacccttaacgacgaggagcagaagctcctttccaacaagtgcgtctcggcaattattcagggaattggcaaggacaaagaacccctgattagctttctggaacctaaaaagtcgacaagcgtgtacccccatttcagcaccactaacctcatcggccccgatcctacgttccgcggtctttggtctgcttttcatgtggaaaatggagattctctccctgcaggatttgcctttttaaagggttcagccagtactagcagcagtgccgagcaacctctaggtatcacccaaatgcccaaggctgaggtcaacctcggcggactcagctccctggtagtcaatactcctattactagcgtcagcctgagccactcttcaagcgagtcctctaaaatgtccgaatcaaaagaccaggagaataattgtgagcggccaaaggaatcaaacgttctgcatccgaatggtgagtgcccagtcaaatctgagcccaccgagccgggcgacgaggatgaagaggacgcctattctaacgaacttgatgatgaggaagtgcttggcgaactcacagattccataggcaacaaagacttcccacttcttaaccaatccatttcaccactgagctcttccgtgctgaagtttattgaaaaaggcacaagttcttcctcagctacagtgtctgatgacacagaaaagaagaagcaaactgcagccgttcgcgcctcaggctctgtggcatcaaactatggcatatctggcaaagattttgctgacgcctccgccagcaaagattcagctaccgctgctcatcccagcgaaatcgcaagaggagatgaagatagctcggcaaccccccatcaacacggcttcacaccgtcgacccccgggacccctggtcccggtggagacggatcaccaggctctggtatagaatgccccaagtgtgataccgtgcttggctcaagccggtccctcggcgggcatatgacaatgatgcacagtagaaactcctgcaaaaccttgaagtgtcccaaatgtaattggcattataagtatcaacagactctggaagcacacatgaaggaaaaacaccccgagcccggtggaagctgcgtgtactgtaagacaggacagcctcatccccggctggcgcggggcgagagctatacttgcggctacaagcctttcagatgcgaagtttgcaattacagtaccaccacaaagggcaatctctcaattcatatgcagtcggataagcacctgaacaacgttcagaatctgcagaacgggaatggcgagcaagtgttcggtcactcagctcccgccccaaatacaagcctatcaggctgtggtactccaagtccaagtaaaccaaaacaaaaacccacttggcgctgcgaggtgtgcgattacgagactaacgtggcccgtaatttgaggattcacatgacgtcagaaaagcacatgcataatatgatgctgctacagcagaacatgaaacagatccagcataacctgcacctcggactcgccccagcggaagccgagctgtaccaatattacttggcccaaaacataggcctgactggcatgaagttggagaatcctgccgatccacagctcatgatcaacccatttcaactggatcctgcaactgcagcagcccttgcccctggcctcggcgagttgtcaccttacatcagtgaccctgcactgaaactgttccagtgcgccgtgtgcaacaagttcacgtctgactctttagaagccctgtccgtgcacgtgtcgagcgagcgctctctgccagaagaggaatggagggccgtcatcggcgacatctatcagtgtaaactctgcaattataatacccagctgaaagccaatttccagctccattgcaagacagacaagcatatgcagaaataccagctggtggcacatataaaagaaggcggaaagagtaacgaatggcgacttaaatgcattgcaataggaaatcccgttcacctgaaatgcaacgcctgcgactactacactaacagcgtcgataagctaaggctccatactacaaaccacagacacgaagccgccctgaaactgtacaagcatcttcagaaacaggaaggcgccgttaacccagaaagctgttattattattgcgccgtctgtgactataccactaaggtgaagctaaacctcgtccagcatgtgcgcagcgtcaagcaccaacagactgaggggttgcgtaagctgcaacttcatcaacaggggcttgctccagaagaggataatctgtctgagatctttttcgtaaaggattgcccgccgaacgagcttgaaacagcctctctgggggctcgtacctgtgatgatgacctcacagagcaacagctgcgttccacatcggaagagcagtcagaagaggcagaaggggccatcaaacctactgctgtggccgaggacgatgaaaaggatacatccgagagggacaatagtgagggaaaaaattcgaacaaggactcgggcatcatcaccccagaaaaggaattgaaagtgtctgtggctggcggaacccaacccctgctgctggccaaggaagaagatgttgctacaaagcgatctaaaccaacagaagacaataaattctgtcatgaacagttttaccaatgtccgtattgcaactacaacagtagagaccagagtcgcatccaaatgcatgtgctctcccagcattcagtgcagccagttatctgctgccctctgtgccaggatgtcctgtctaataaaatgcaccttcaactgcacctgactcacctgcactccgtcagccccgactgtgtggaaaagttactcatgaccgtgcccgttccggatgtcatgatgcccaacagcatgctgctaccagcagccgctagcgaaaagtcagaaagagacactcccgctgctgtcaccgcggagggatctggaaagtattctggagaatcccccatggatgacaaatccatggccgggctggaagatagcaaggcaaacgtcgaagtgaagaacgaagaacagaaaccaacgaaggagccactcgaggtttctgagtggaacaagaattcatccaaagatgtgaaaatccccgatacattacaagaccagcttaacgaacagcagaagcgacagcctctcagtgttagtgacaggcacgtttacaagtaccgatgcaatcattgcagtctggctttcaaaactatgcagaagctgcagatccattctcagtatcatgctatcagagctgctacaatgtgcaatctgtgtcagaggagctttcgtacatttcaagctctcaagaaacacctggaagctgggcaccctgaactatccgaagccgaactccagcaactttacgctagtctgccagtgaatggggagctttgggccgagtccgaaactatgtctcaagacgaccacggtctcgagcaagaaatggaaagggagtatgaggtagatcatgaaggcaaagcatcccctgtggggagtgatagtagtagcattcccgacgacatgggcagcgagccgaagcggaccctccccttccggaaggggccaaacttcactatggaaaagttcctcgatcccagtcgcccatacaagtgcactgtgtgtaaggaatcattcacccagaagaacattttacttgtacactacaactccgtatcccacctgcataagctgaagaaggtcctgcaggaagcctcctctccggtgccgcaggagacgaatagcaataccgacaacaaaccatacaagtgttcaatctgcaatgtcgcctacagccagtccagtacccttgaaatccacatgcgatctgtgctgcaccagaccaaagcccgcgccgcaaagctggagccgtcaggccacgtcgctggcggacacagcatcgctgcaaatgtaaattcacccggtcagggcatgctggatagcatgtctctcgccgccgtcaacagcaaagacacacacctcgacgcgaaggagctgaataaaaagcagacaccggatttaatctctgcacagccagctcaccacccgccacagagtcctgcacagattcagatgcaactccagcatgagctccagcagcaggctgcattttttcaaccccagttccttaaccctgcattcctccctcacttcccgatgacaccggaggctcttcttcagtttcagcagccccagttcctgtttcctttttatataccggggaccgagttcagcctgggccctgaccttggtttgccaggctcagctacatttggcatgccaggtatgactggcatggcagggagcttgctggaggatctcaaacagcagattcagacgcagcatcatgtgggtcagacacaactccagattcttcaacaacaggcccagcaatatcaggccacccagcctcagctccaaccccagaagcagcagcagcagcccccaccaccgcaacaacaacagcagcaacaggccagcaagctgctcaaacaggaacagtccaacattgtttccgcggattgccaaatcatgaaggatgttccttcttataaagaggcagaagacatcagtgagaagcccgaaaaaccaaagcaggaattcatcagtgagggagagggcttaaaggagggcaaagacacaaagaaacagaaatccttggagccatccataccaccccctaggattgcctcaggcgccagaggaaacgcagcaaaggctctcctggagaattttgggttcgaactggtcatccaatataatgaaaacaggcagaaggtacaaaaaaaaggcaagagtggcgaaggtgagaacaccgacaagctagaatgtgggacatgcggtaaactcttctcaaacgtcctcatactgaaatcccaccaagagcacgttcacggtcagttcttcccctacgccgcccttgagaaatttgctcgccagtatagggaagcctacgataagctctatcccatatctccgtccagtcctgagacaccgccacctccacctcctccaccaccgttgccacccgcacccccccaaccatcgagcatgggaccagtcaagatcccaaataccgtcagtacacctctacaagcaccccctcctactccaccaccccctcctcctccccccccaccccctcccccccctccccccccaccaccccctagtgcgccaccccaagtgcagcttccggtgagtctggacctacctctgtttccttcgatcatgatgcagcctgtccagcatcctgccctgcctccacaactggccctccagctcccccagatggatgctctgtccgctgatctgacccagctgtgccagcagcagctaggtcttgacccaaattttttgcggcacagccagttcaaaagaccaagaaccaggatcactgatgaccagttgaagatccttagggcgtatttcgacattaataacagcccaagtgaggagcagattcaggaaatggctgaaaagtctggactgtcccagaaggtgattaagcactggttcaggaacacactttttaaggaaagacagaggaataaggattccccatacaattttagcaacccacctattactgtgcttgaagatatccgaatcgatcctcagccaacttcactggagcactataagagtgacgcctctttctcaaaacgttcttctcggactcgtttcaccgactaccagcttcgggtcctccaagattttttcgacaccaacgcttatcctaaggatgatgagattgagcaactttccacggtgctaaatcttcccaccagagtgattgtggtttggtttcagaatgcccgacagaaagcaagaaaaagctacgagaatcaggcagagacaaaagacaacgagaaacgcgagcttactaacgaacgatatatcagaacctctaacatgcagtatcagtgcaaaaagtgcaatgtggtgttcccacgaatcttcgatcttatcacacatcaaaagaaacagtgctacaaagatgaagacgatgatgcccaggatgagtcacaaaccgaggactctatggatgctaccgatcaagtggtgtacaagcactgcactgtgtcgggccaaaccgatgccgctaaaaacgccgctgcacctgctgccagtagtggaagcggcacgagcaccccactgatcccctcacccaaacctgagcctgagaagacctctccaaaacccgagtatcctgccgagaagccgaaacagtccgatcccagccccccatcgcagggaactaagcctgcccttccactggctagtacaagctctgatccaccgcaggctagtaccgcccagcctcagcctcagcctcaaccacctaagcagccacagttaatcgggcggccgcccagtgcctcacagacgcctgttccttccagccctctgcagatatccatgacatctttgcagaacagcctgccccctcagttgctgcagtaccagtgcgaccaatgtactgtcgccttccctacactcgagctgtggcaagagcaccagcatatgcatttcctggccgctcagaatcagttcctgcactcacccttccttgaaagaccaatggatatgccttacatgatttttgaccccaacaacccccttatgaccggccaactcctcggcagtagcctgacccagatgccaccccaggcttcttcttcacacactacggcccctacaaccgtggccgcaagcctgaagcgcaagcttgacgacaaggaagataacaactgcagtgaaaaggagggcggaaattcgggggaagatcagcaccgggataagcgccttcgtactacaataacgccagagcagttagagattctatatgaaaaatatttgctggatagtaacccaactcggaagatgctggatcatattgcccgtgaggtggggctgaagaagcgggtggtgcaggtttggttccagaatactcgcgccagggaaagaaagggtcaattcagggcagtgggacccgcccagtctcataaaagatgtccgttttgtcgtgctttgtttaaggccaaatccgctctagaatcacacatccgcagcaggcattggaacgagggaaagcaagccggatattctcttcctcctagcccgctgatttctacggaagacggcggagagagccctcagaaatacatctatttcgattatccctcgctcccactgacaaagatcgatttatccagcgagaacgagctggccagtaccgtttctacacccgtgagtaaaacagctgagctatcccctaagaatttgctgtcacctagctcttttaaagccgagtgtagcgaggatgttgaaaacctgaacgcccctccggctgaagcaggctacgaccaaaataaaaccgattttgatgagacctcaagcatcaataccgcaatctccgacgccaccactggcgacgaaggcaatacagagatggagtcaacgaccggtagcagcggcgatgtaaaaccagctctttcccccaaggaacctaagaccctcgacacattacccaaaccagcgaccacaccgacaacggaggtctgcgatgacaagttccttttctcacttaccagccctagtatccactttaacgacaaggacggcgaccacgaccagagcttttacatcacagacgatcccgatgataatgcagatcggtcagaaacttcctccatcgccgatccttctagcccgaatccgtttggctcatctaacccatttaagtcaaagtcaaacgaccggcccggacacaaaagattcagaacccagatgagcaatctgcagttgaaggttttaaaagcatgcttcagcgattatcgcacccctacaatgcaggaatgtgaaatgttgggaaatgaaattggactgccaaaaagagtcgtccaggtttggttccagaacgctagagctaaggaaaagaagttcaagattaatatcggcaagccctttatgattaatcaagggggtaccgagggcactaagcccgaatgcaccttgtgtggggttaagtactcggctcggttaagtattcgggaccatatatttagcaagcagcatatatcgaaggttagagaaaccgtgggatctcagctggatagagagaaggactacctggcaccgacaaccgttcgacagctaatggcacaacaggaacttgaccgcataaagaaggcatccgacgttctgggattgaccgttcagcaacccgggatgatggatagctcaagcctgcacggcatatctcttcctaccgcctatcctggtctgccaggacttcccccagttctgttgcccgggatgaatggcccatcaagcctacccggcttcccacaaaatagcaacactttgaccccaccgggtgctggtatgctagggttccccacctccgcaacaagctcacctgcattgagtctgtcatctgcccctactaaacccttgttacagacaccccccccacccccaccacccccaccacctccaccctcatcctccctgagcggccagcagactgagcagcagaataaagagtctgagaaaaagcaaactaaaccaaacaaagtaaaaaaaattaaggaggaagaactagaggctactaaaccagagaaacaccctaagaaggaggaaaaaattagctccgccctgtcagtactgggcaaagtcgttggcgaaacgcacgtcgaccccatccagctgcaagctttgcagaatgctattgccggcgatcccgcgtctttcattggagggcagttccttccttatttcatcccaggcttcgcctcgtactttaccccgcagttgccaggtacggtgcaggggggatacttcccaccagtgtgcggcatggaaagtcttttcccctacgggccaactatgccacaaacactggccggtctgagccctggggccctcctccaacaataccagcagtatcagcagaacctgcaggagtcgttgcaaaagcagcagaaacagcaacaggagcagcagcaaaaacccgtgcaggccaaaaccagcaaggttgagtctgatcagccgcaaaacagcaacgacgcttctgagacaaaagaggataaatcgaccgcaaccgagagcaccaaagaagagccccagctcgaatccaagagcgctgatttcagtgacacttacgtcgtgccattcgttaagtacgagtttatctgcaggaagtgccagatgatgttcacagatgaggatgcggccgtgaaccatcagaagagcttctgctacttcgggcagccgcttatagatccccaggaaactgtgctgagggtgcctgtctcgaagtatcaatgtttggcatgtgatgttgcgatttccggcaacgaggcactgagccagcacctacagtcttccctgcacaaagagaaaaccattaagcaggccatgaggaacgcaaaagagcatgtgagactcctcccccattccgtttgctctcctaacccgaacacaacctcgacatcacagtccgccgcctcatccaataatacctacccgcacctgagctgtttctctatgaaatcttggcctaatatcctgtttcaggcttcggcaaggagagccgcctcgcccccgtcatcccctcccagcttgtccctgccatcaaccgtaaccagctctctatgttcaacaagtggggtgcaaacctcccttcccacagagtcatgctctgacgagagtgatagcgaactgtcccagaagttggaagacctcgataactctctggaagtgaaagccaagccagcttcaggccttgacggcaatttcaactccattcggatggacatgttcagtgtctag

SEQ ID NO: 141035 - DNA, 468 bp, Artificial Sequence
  Description of Artificial Sequence: Synthetic coding sequence
atggaaacttgtgactctcctcccatcagtcgtcaggagaatgggcaatctacgagtaagctgtgcgggactacccagctggacaatgaggtgccagagaaggtggcaggcatggagccagatcgtgagaattcctctacagacgacaatttgaaaacggacgagcggaagtctgaggcactcctcggtttttctgtggagaacgccgctgcaactcaggtgacctccgcaaaagaaattccttgtaatgagtgcgcgacaagttttccgtctcttcagaagtacatggagcatcattgcccaaacgctcgtctgcctgtcctgaaggatgataatgagagcgaaattagtgaactcgaggattcagatgtggagaacctgacaggcgagatcgtctaccagccagatggatcagcgtacatcattgaagacagtaaggaatccggccagaatgctcaaaccggatag

SEQ ID NO: 141036 - DNA, 10851 bp, Artificial Sequence
  Description of Artificial Sequence: Synthetic coding sequence
atggagacatgtgactcacctcccatttcaaggcaagagaacgggcaaagcaccagcaagctctgcggcacaacccagctggacaacgaggtaccagaaaaggtggcaggaatggagccggatcgggagaactcatcaacagatgataatctaaagacagacgagcgaaagtcagaggcgctgctcggcttcagcgttgagaatgcagccgccacccaggtcacaagcgccaaagagatcccctgcaacgaatgcgctacgtctttcccaagcttacagaagtatatggaacatcactgcccaaacgctaggctcccagttctgaaagacgacaatgagtccgagatttcagaactggaggatagcgacgttgagaacctgactggcgagatagtctatcagcccgacgggagtgcttacatcattgaggacagcaaagagagcggacagaatgcccagactggagcaaattccaaactgttctctactgcaatgtttctcgactctttggccagcgcaggagagaagtcagaccagtccgcgagtgcccccatgtcgttctacccacagataattaacacgttccacattgccagcagcctgggaaagccatttaccgcggatcaggcttttcctaacacatccgcactcgcaggagtgggtccagtactgcatagttttcgcgtgtacgatctgagacataaaagggagaaggactacttgacaagtgacgggagtgcgaagaattcctgtgtgagtaaagacgtgccaaacaacgtagatctctctaagtttgatggttgcgtgagcgatggtaagcgtaagcccgtgctgatgtgttttttgtgtaaactgtcgttcggctatataaggtcattcgtgacccacgctgtgcatgaccatagaatgacgctgaacgatgaagagcaaaagctgctgtccaacaagtgtgtgagcgcaatcatacaagggatcggcaaagataaggaacccctgatttcctttctggagcccaaaaagagcacttcagtgtatccccatttctccactactaacctaatcggccctgatccgacttttcgcggactgtggagtgcattccatgtggaaaacggcgatagcctacccgctggattcgcctttctgaagggctccgcttccacctcatcctctgccgagcagccgcttggcattacgcagatgcctaaggcagaagtgaacctagggggactgtccagtcttgtggttaacaccccaattacttcggtgtccctgagtcactcatcgtcagagtcctccaagatgtccgagtccaaggaccaggagaataattgcgagagaccaaaggagagtaatgtgctgcacccaaacggtgagtgtccggtgaagtccgaacctactgagccaggcgatgaagatgaggaggatgcatactccaatgaactcgatgatgaagaagtgctgggcgagctgactgattccatcggcaacaaagattttccattactcaatcaaagtatttcgcccctcagttcctccgtcttgaaattcattgaaaaaggtacatcttctagctcagcgaccgtctctgatgataccgagaagaagaagcaaaccgccgctgttcgggcctctgggtcagtagcttctaattatgggatttctgggaaagacttcgcggacgcgtccgccagtaaggatagcgccaccgcggcacatccttctgagatagctcgaggtgatgaagattccagcgccaccccccaccagcatggttttacaccttcgaccccgggaacacccggaccggggggcgacggcagcccaggctctggaatcgagtgccctaaatgcgacaccgtcctgggcagcagccgttctctaggcggccacatgactatgatgcactcgaggaacagctgcaaaactctgaagtgtcccaaatgcaattggcactacaaataccaacagactctggaagcacatatgaaggagaagcatcccgaaccaggaggctcttgtgtgtactgcaagacaggccagccacatcctcgacttgcccgtggagagtcttacacatgcggatacaaaccctttaggtgtgaggtgtgtaactattcaaccaccacgaagggcaatctgagtattcatatgcagtccgataaacatctgaataacgtgcagaacctacagaacggcaatggcgagcaggtctttggtcatagtgcaccagccccgaacacgagtctttcaggttgtggtaccccctcaccctcaaaaccgaagcaaaagccaacctggagatgcgaggtgtgtgattatgaaaccaatgtggctcggaacctgaggatccacatgacgtctgagaagcacatgcacaatatgatgctgttgcagcaaaatatgaaacagattcaacacaaccttcaccttggtctggccccagcagaagctgaattgtaccagtactacttggctcaaaacattggtcttacgggcatgaaattggaaaacccagctgaccctcagctcatgattaacccttttcagcttgaccctgccactgccgccgccctggccccagggctggtgaataatgagctccctcccgagattcggctggcttctgggcaactgatgggagacgatcttagtttgcttaccgctggagagctgtccccctacattagcgaccccgctctcaagctgtttcaatgcgccgtgtgtaacaaattcacctctgacagcttagaggccctgtcagtgcacgtctccagcgagaggtcccttcctgaggaggagtggagagccgttatcggagatatataccagtgcaaactctgcaactacaatacgcagctcaaagctaactttcagctgcactgtaagaccgacaaacatatgcagaagtaccagctcgtggcacacatcaaggagggagggaagagcaacgaatggagacttaagtgcatcgctatcggaaaccccgtccacctcaaatgcaacgcatgcgactactacacgaactcagtcgacaaactccgattgcacaccaccaaccaccgtcacgaggccgctctgaaattatataagcatctacaaaagcaggagggtgccgtgaatcctgagagctgttactattattgcgcggtttgtgactacactacaaaggtaaagctgaatctggttcagcacgtgcgcagtgtgaaacaccagcagacggagggcctgaggaagctgcagctgcaccagcaaggtctggcgcccgaggaggataatttatcggaaattttcttcgttaaagactgtcccccaaatgagttagaaaccgctagccttggtgcccggacttgcgatgacgacctgaccgagcagcaactccgctccacctctgaggaacagagcgaggaggcagagggcgctataaagcccacagcagtggcggaagacgacgaaaaagataccagtgaacgggacaactctgaggggaagaatagcaacaaagacagtggaattattacccccgagaaggaactcaaggtctctgtcgccggcggcacgcaacccctactgctggcgaaggaagaagacgtggctacgaagagatccaaaccaaccgaagacaataagttttgtcacgaacagttctatcagtgcccatattgcaattataatagccgcgaccagtcccgtatccagatgcacgtgctgtcccagcactctgtgcagcccgttatttgctgccccctgtgccaggatgtactgtctaacaagatgcatctccagctccatctgacacacctgcactctgtctcacccgattgtgttgagaaactccttatgaccgtgccggtcccagatgtaatgatgcctaatagtatgttattaccagcagctgcctcagagaaaagtgagcgagacactcccgccgcggtcactgctgagggctccgggaagtattcaggggaatcccccatggacgacaagtcaatggcaggcctagaagactccaaggctaatgttgaggtcaagaatgaggagcaaaagccaaccaaggaacccctggaagtgtcggaatggaataaaaattcttcaaaggacgtgaaaatcccagatacacttcaagatcagctgaacgagcagcagaagcggcagcctctgagcgtgtcggatagacacgtctacaagtacagatgtaatcattgtagcctagcatttaaaactatgcagaagctgcagatccattcacagtatcatgctatacgtgcagcaactatgtgcaacctgtgccagagatcttttaggacattccaagcccttaagaaacatctggaggcaggacatcctgaactttccgaggctgagctccagcagctgtacgctagtctcccagttaacggggagttgtgggccgaatctgaaacaatgtctcaagatgatcatggtctggagcaggaaatggagagagagtacgaggtggatcacgagggaaaggcctccccggtcgggtcggacagctcctctatcccagatgatatgggcagcgaacccaagagaacacttccatttagaaaagggcctaacttcaccatggagaaatttctggacccctccagaccgtacaagtgcactgtgtgtaaagagtccttcacacaaaaaaatattctgttggttcattataacagcgtgtcccaccttcataagctgaaaaaagtactgcaagaagcaagctctccagtgccccaagaaactaacagcaacacagataataaaccatacaagtgtagcatctgtaatgttgcatatagccagagctcaaccctggagatccacatgaggtcagtccttcaccagaccaaagcacgggcggcaaaactcgagcctagtggccacgtggcgggggggcacagcatcgctgccaatgttaatagtcctggacagggcatgctcgacagcatgtctctggccgccgtgaacagcaaagacacccacctcgatgctaaggagttgaataaaaagcaaaccccagatctgatctcagcacagcctgcgcatcatcccccccagtctcctgcccaaatccaaatgcagctgcagcatgagcttcagcaacaagcggctttcttccagccacagtttctgaatccggcatttttgcctcattttccgatgacccctgaagccctgctgcagttccagcagcctcagtttctctttccattctatattcctggcacagaattttctttgggaccagatctgggcctaccaggcagcgccacgtttggcatgcctgggatgaccgggatggctggatctttactggaggacctgaagcaacaaattcagacccagcatcacgtgggacagactcagctccagattctccagcaacaggctcagcagtatcaagccacacagcctcagctccaaccccagaagcagcagcagcagcctccacccccccagcagcagcagcagcagcaggcctccaagctgctcaagcaggaacaatccaacatcgtctccgccgattgtcagattatgaaagacgtacccagctacaaggaggcagaggacattagcgagaagccagaaaagccaaaacaggaatttatttctgagggagaaggactgaaagagggcaaagacacaaaaaaacagaagagcctcgaaccaagtatcccaccaccacggatcgcaagcggagccagggggaatgccgctaaggcgctactcgagaactttgggtttgagttagtgattcaatacaacgagaatagacagaaggtccagaaaaagggcaagtctggagagggagagaatacggataaactcgagtgcggtacctgcggcaagctgttctccaatgttctgatcctcaaaagtcatcaggaacacgttcacggccaattcttcccctacgccgccttagagaagtttgcccgacagtatcgcgaagcctatgacaagctgtaccccatcagccctagtagcccggagactccacccccaccgcctccccctccacccctgcctcccgcaccaccccaaccgtctagtatggggcccgttaagatcccaaacacagtgtccacacccctgcaggcccctcccccgactccccctcctccccccccaccgccccctccccccccaccacctcctccccctcctcccccgtctgcacctccacaggttcaattacccgtgagtcttgatttaccactgtttccatctattatgatgcagcccgtccagcaccctgcactgccaccacagctcgccttgcagcttcctcagatggacgcgctgtccgctgatctgactcagctttgtcaacagcagctgggcctcgatcccaatttcttacgccatagccagtttaagcgcccgaggacacgcattaccgacgatcagctgaaaatcctgcgggcttacttcgatatcaataattccccatctgaagaacagatccaggagatggccgaaaagtctgggttgtcacagaaagtgatcaaacactggtttcgcaatacattgttcaaggaaaggcagaggaacaaggatagcccatataatttttccaacccacccatcaccgtgctcgaagatatccgtattgatcctcagcctacgagtctggagcactataaatcagatgcttcttttagcaaacgctccagccgcacgcgatttacagattatcagctgagggttctgcaggatttcttcgataccaatgcttatcccaaagacgacgaaatagaacagctgagtacggtgctgaacttacctacccgtgttattgttgtgtggttccagaacgcgcggcagaaagcgcggaagtcatacgagaaccaggccgaaaccaaggataacgagaagagagaactgacaaatgaaaggtacatccggacgtcaaatatgcagtaccagtgcaagaaatgtaacgtcgtgtttcctaggatttttgacctgataactcaccagaaaaagcagtgttacaaggatgaggacgatgatgctcaggatgaaagtcagactgaggacagcatggacgctacagatcaggtagtttacaagcattgcaccgtatccggtcaaactgacgcagctaagaatgctgcagctcctgctgcaagcagcggaagcggcacctctacaccactgattccgagtccaaagccggagcccgagaagacctcacccaaacctgaatacccagcagaaaaaccaaaacaaagcgatccttcccctccatcccagggaactaagcccgctctgccattggcgtcaacaagcagcgatcctccccaagcatccactgcccagccccagccacaaccccaacccccaaagcagcctcagctgattggacgccctccttcagctagccagactccggtcccctcatcacctctccagatctcaatgacttcactgcagaacagtctgccacctcagctgctgcagtaccagtgcgaccagtgtacagtagctttcccgactcttgagctatggcaggaacaccagcatatgcactttctggctgcccagaatcaattcctccacagccccttcctggaaagaccaatggatatgccctacatgatattcgaccccaacaaccccctcatgacaggtcagctgctcggttcaagcctgacccagatgcctccccaggcttcttcctcacacaccaccgcccccaccactgtggccgcatcgctgaagcggaagcttgatgacaaagaggataataactgttctgaaaaggagggaggcaatagtggcgaagatcagcacagagacaaaaggctgaggaccacgattacaccggaacagctcgagatcctttatgagaagtacctgttagattcgaaccccacgagaaagatgctcgatcacatcgcgagagaagtcggcctgaaaaagagagtggtacaggtgtggttccaaaataccagggcccgggagaggaaaggccagttccgtgccgtgggtcctgctcagtcacataagaggtgtccgttttgccgagcactctttaaagccaagagtgccttggagtcgcacatcagatcacgccactggaatgaaggaaaacaggcaggatattctctacctccctctccccttatttccaccgaagatgggggggagtcaccccagaagtacatctatttcgactatccgagtctcccactaacaaagattgatctcagttcagagaatgagctcgcaagtactgtgagcacacccgtttctaagacagctgagctcagccctaagaatctcctatctccttcctcgtttaaggcagaatgcagcgaggatgtcgagaacctgaacgctccccctgcagaggccgggtacgaccagaacaagacagacttcgatgagacaagcagcatcaatacggcaatctccgacgccacaacaggcgacgaggggaacacggagatggaaagtacaactggcagttcaggagacgtgaagcccgccctaagcccgaaagaaccgaaaactctcgacactttgccaaagccagcaacaacacccacaaccgaggtatgcgacgataaattcctcttctctttaaccagcccgtcgatccatttcaatgataaggatggcgatcacgatcagagcttctatataaccgacgatcctgatgataacgcagacaggagcgagacctcatctattgctgacccatcctcgccgaatccatttggaagttctaacccttttaaatcgaaatctaacgaccggccaggacacaagcgcttccgcacacagatgagcaacctgcagttgaaagtcctcaaagcctgcttcagtgactacagaactccaaccatgcaggaatgtgagatgcttggcaacgaaatcgggttgccaaaaagggtggttcaggtctggtttcagaacgcccgcgccaaagagaaaaaatttaaaatcaacatcggcaagcctttcatgattaaccagggcggtactgaggggactaaacccgagtgtaccctgtgtggagtaaaatactccgccaggctgagcatccgggaccatatttttagtaaacagcacatctcaaaggtgagagagacagtgggctctcagttggatagggagaaggattatctggcacccaccactgtcagacaactcatggcacagcaggagctcgaccgcattaagaaagcgtctgatgtcctgggtctgacagtccaacaacccggcatgatggattcaagctcactacatgggatcagccttccaactgcttacccaggtttgccaggcttgcctcccgttctgttaccagggatgaacggacccagcagcttaccgggctttccgcagaacagcaacactcttaccccccctggggcaggtatgctgggttttcctaccagcgccaccagctcacctgctctctctctctcttctgctcctaccaaacccctcctacagactccccctcctccgcccccgcctccaccaccacctccctcgtcctctctgtcgggccagcagactgaacagcagaacaaggaatcagagaaaaagcagaccaagcccaacaaagttaagaagatcaaagaggaagaactggaggctacaaagccagagaagcatcctaaaaaagaagagaagatcagcagtgcgctgtcagtgctcgggaaggtcgtgggcgaaacgcacgtcgaccctatccagctgcaggctttacagaatgccattgcaggcgacccagcctcattcataggagggcagttcctgccctactttattccaggctttgcctcgtatttcaccccccaactgccgggtactgtacagggcgggtatttccccccggtgtgcggcatggagtcacttttcccctacggtcccacaatgccacagaccctcgccggcctttcacctggagccctactccagcaatatcagcaatatcaacagaatctgcaggaaagcctgcagaagcagcagaaacaacagcaggaacagcagcagaagcctgtgcaggccaaaacgtccaaagttgaatccgaccagcctcaaaacagtaacgatgcatcggagaccaaggaagataagtcaacagccacagaatccaccaaggaggagcctcagttagagtctaaaagtgcagacttcagcgatacttacgttgtgccatttgtcaagtatgagttcatctgcagaaagtgccaaatgatgttcacagatgaagatgcagccgtcaaccatcagaaaagtttctgctacttcggacagccactcatcgacccgcaggaaacagtgctacgggtcccagtttctaaataccagtgcctggcttgtgatgtggctatatctggcaatgaagctctctcgcaacacctgcagtcttcgctgcacaaagaaaagacaatcaaacaggccatgcgcaatgcaaaggaacacgtgagattactgccccatagtgtgtgctcaccaaatcccaacactacaagtaccagccagagcgctgcctcatctaataatacctatccacacctgtcctgcttttccatgaaaagctggccaaacattctgttccaagcgagcgccagaagggccgcttcacctccaagttcccccccgagccttagcctcccctccactgtcacgtctagtttgtgcagcacgtcgggcgtccagacatccttacccaccgagtcttgctctgatgagagcgatagcgagctgagccaaaagcttgaggacctggacaactccctggaggttaaagccaagcctgcgtctggtctggacgggaatttcaatagcattagaatggacatgttttcggtttag

SEQ ID NO: 141037 - DNA, 423 bp, Artificial Sequence
  Description of Artificial Sequence: Synthetic coding sequence
atggagacatgcgattcaccgccgatcagccggcaagaaaacggccagagtacgagtaaactgtgcggcactacacaactggataacgaagttccagagaaggtagctggcatggaaccagaccgggagaattccagcactgacgataaccttaaaacagacgaaagaaaaagtgaagcactactcggttttagcgtggaaaatgcagcggcaacccaagtgacctcagcgaaggaaatcccttgtaacgagtgtgccacatctttcccctccttgcagaaatatatggagcatcactgccctaatgcaagactccctgttttgaaggacgacaacgagtccgaaatctccgaactcgaggacagcgacgtggaaaacttgacaggtgaaatagtgtatcagcctgatggctcagcctactag

SEQ ID NO: 141038 - DNA, 306 bp, Artificial Sequence
  Description of Artificial Sequence: Synthetic coding sequence
atggaaacgtgcgactccccaccaatcagccggcaggagaatggccagtccacttccaagctctgcggcacaactcagttggacaatgaagtgccggagaaggtggcgggcatggagcccgacagagaaaattcttccacagatgacaatctcaagacagatgagaggaagtcggaggctctgttaggattttcagtagagaacgccgctgcaacccaagtgacgagcgccaaagaaatcccctgtaatgagtgcgccacgtcatttccttcgctccagaagtatatggagcaccattgcccgtag

SEQ ID NO: 141039 - DNA, 2253 bp, Artificial Sequence
  Description of Artificial Sequence: Synthetic coding sequence
atggaattcgtatctggataccgcgacgagttcttggacttcactgctctgctgtttgggtggttccgaaagtttgtagcggagcgcggcgccgtgggtacctccctggaggggaggtgtcgtcaactagaggctcagattcgccgtctccctcaggacccagcactctgggtgctccatgtgcttccgaaccacagcgtcgggattagcctgggacaaggcgccgagccaggaccgggccccgggcttggtacggcatggctgctaggtgacaatcctcctttgcatctgagggatctgagcccatatatctcattcgtatccctggaggacggcgaggagggcgaagaagaggaagaggaagacgaggaggaggagaaaagggaggacggtggcgcgggttcaacagagaaggtagaaccggaggaggaccgcgagctcgcaccgacatcaagagagagtccccaggagaccaatcctcctggtgaatctgaagaagccgcccgcgaggccgggggtggaaaagacggatgtcgtgaagatagagtagagaatgaaacaaggcctcagaagcgtaaaggccaaaggtcagaagcagccccgttgcacgtctcctgtttactgctggtcaccgacgaacatgggactatccttggcattgatttgctggtggatggggcacagggaacagcttcctgggggagcggtaccaaagaccttgctccatgggcctatgcactgctctgtcactcgatggcgtgccccatgggaagcggtgatccaagaaagcccagacagctcaccgtaggtgatgccaggctccaccgcgaactggaatctttggtgccccgcttgggcgtaaaactggccaaaacgcctatgcgaacatgggggccgcgccctggattcacctttgcctctctgcgggctcgaacctgccacgtctgccatcgtcactcattcgaagctaagcttactccctgtccccaatgcagcgccgtgttgtactgtggtgaggcatgtctgagggcagattggcagagatgtccggacgatgtgagtcaccggttctggtgtcctcggctcgctgcttttatggaacgtgccggggaacttgccacactgccattcacttacaccgctgaggtgacctctgagacctttaacaaggaggcctttctggccagcagaggcctgaccaggggttattggactcagttatccatgctgatccctgggcctgggttcagcaggcaccccagagggaacaccccctcactctcactgctgagagggggagatccgtatcaactcctgcagggagacgggactgctctgatgccacccgtacctccccatccgcccaggggagtcttcggctcctggcaagattattacacctggcgcgggctgagcctggactcccccatcgccgtgcttctcacatacccactgaccgtgtattatgtgattacccacctcgtccctcagtccttccccgaactgaatattcagaataagcagagtctgaaaattcatgtggtggaggctggcaaagaattcgacctcgtgatggtattctgggagctcctggttctccttccccatgtggcgctggaacttcagttcgttggcgatggccttccccctgaatctgatgagcagcacttcactttacagcgggactcacttgaagtgtccgtgagaccagggagtggcatttccgcacggccttcctcagggactaaggagaaggggggccgcagggatctgcagatcaaggtttctgcaaggccttaccacctgtttcaaggtcctaagccagacctggttatcgctagtccttcaagtctgagtgctggtttcaatagcggatttgctctgaaagacacatggttgcggtcccttccacgcctgcaatcgcttcgcgtgccagcgttcttcactgaatcttccgagtattcctgcgttatggacggtcagactatggccgtggcaaccggcgggggtaccagccctccgcagcctaatccattccgaagtccattccgtctgcgcgctgcagataattgtatgtcttggtattgcaacgccttcatcttccatttagtgtacaaacctgctcagggctcaggagccaggcccgctccaggaccaccccctccctctccaacgccttcagcaccgccagcccctacacgaagacggcggggtgaaaaaaaaccaggccgcggtgcaagaagaagaaagtag

SEQ ID NO: 141040 - DNA, 2112 bp, Artificial Sequence
  Description of Artificial Sequence: Synthetic coding sequence
atggagttcgtatccgggtaccgtgacgagtttttggacttcaccgcactgctttttgggtggttccggaagttcgtggcggagcggggtgcagtcggaacaagtcttgagggacgctgccgtcagttggaggctcagattaggagattaccacaggatcccgccctgtgggtactccacgtactccctaaccattctgttggcatctccctggggcaaggcgctgagcccggcccagggcccggcctgggaactgcctggttgctaggcgacaaccccccactacaccttagagatctctccccctacatttctttcgtatcccttgaagacggggaggagggagaggaagaagaggaggaggatgaggaggaggaaaagcgggaggatgggggagctggatccacagagaaggtggagccagaagaggatcgtgagttagcccctacctccagggagtcgcctcaagagactaatccccctggcgaaagtgaagaggccgcccgggaggctggaggcggtaaagacggatgcagggaggacagggtggagaatgagactcgaccgcagaaaaggaagggccagcgatccgaggcggccccccttcacgttagctgtcttcttctggtgaccgatgaacacggtactatcctcggaattgacctgctggtggatggagctcagggtaccgcatcctgggggtcaggtacaaaagatttggcaccttgggcctatgctttactgtgccattccatggcatgtcccatgggttcaggcgaccctcggaagcctcgccagcttaccgtcggggacgccagacttcaccgggagctcgaaagcttggtgcccagactcggcgtgaagcttgcgaaaacccctatgagaacctgggggcctaggcctggcttcacttttgcttccttaagagcaaggacatgtcacgtctgtcaccggcatagcttcgaggcgaaactgaccccttgtccacagtgcagcgccgttctgtattgtggagaggcctgtctacgcgccgactggcaacgatgtccagatgatgtgagtcatagattttggtgccccagactcgctgctttcatggaacgcgcaggagaacttgccacactcccctttacatacacggccgaagtgacaagtgaaacttttaataaggaggccttcctggcctctcggggcctaacgcgcggctactggactcagctctctatgctcattcctggcccgggctttagccggcatccgcgtgggaacactccttcgctgagtctgttgagggggggggacccgtatcaactgctgcagggcgatggcactgccctcatgccgccagtgccaccccatccgccccggggcgtcttcgttcccgagctgaacatccagaataaacaatcactcaaaatccacgttgtggaagccggtaaagaattcgatcttgtcatggtattctgggaactgctggtattattacctcatgtggcccttgagctgcagttcgtcggtgatggtctgcccccagagtcagacgagcaacactttacactgcagcgagacagcctagaggtctccgtacgacccgggagtgggatttccgcaaggccttcttcaggtactaaggagaagggtggcaggcgggatttgcagatcaaggtgtctgctcgcccctaccacttattccagggcccaaaacctgacttagtaattgggtttaactcgggctttgctctgaaggatacctggcttaggtctcttcctagactgcaaagtctgcgtgtgcctgctttcttcacagaaagtagcgagtattcatgcgtaatggacggccagaccatggccgtggccactggcggagggaccagtccacctcaacccaacccttttcgtagccccttcaggctgcgggccgccgacaactgtatgtcctggtattgtaatgccttcatcttccacctggtttataagcctgctcagggctccggggcgaggccggcccctggccccccccctccgagtcctactcctagtgcgccgcccgcccccacacgccgccggagaggggagaagaaacctgggcgtggtgcgagacgccgaaagtag

SEQ ID NO: 141041 - DNA, 1722 bp, Artificial Sequence
  Description of Artificial Sequence: Synthetic coding sequence
atggatgccaaatctctaaccgcttggagtcgcacactggtgaccttcaaggacgttttcgtggattttacccgtgaggagtggaaactgctggatacagcacaacagatagtctatcgcaacgttatgctggagaattataagaacctggtaagcctggggtaccaactaaccaaacctgacgtgatcctccggttggaaaaaggcgaggaaccgtggctggtagaacgtgagattcatcaggagacacatcctgattcagaaactgccttcgagattaagagttcagtctccagtcgctccatctttaaggataagcagtcctgcgatattaagatggagggcatggcccggaacgacctctggtatctgtcactagaggaagtgtggaagtgtagggatcagctcgataagtaccaggagaatccagaaagacacctgaggcaagtagcttttacccagaaaaaagttctgacacaggagcgagtcagtgaatccggtaagtatggcgggaactgcctgcttccagcgcaactggtcctgcgggagtattttcacaaacgggactcccacacgaagagcctgaagcacgatctggtcctgaatggacaccaggactcatgtgcgtctaattcgaatgaatgcggtcaaactttttgtcagaacatacatctcattcagtttgcacggacccacactggcgacaagagttacaaatgcccggacaatgacaacagcctaacgcatggcagctccttgggaatttcgaagggaatccatcgggaaaaaccttacgagtgcaaggagtgcgggaaattcttctcatggaggtcaaacctcacacgacatcagctaatccacacgggcgagaaaccatatgaatgcaaggagtgcggaaaaagtttcagccgttcctcccatcttatcggccatcagaagacccacacaggtgaggagccttatgagtgcaaagagtgcgggaagagctttagttggtttagccacctcgtgacccatcagcggacccacacgggcgataagctctatacctgcaaccagtgcggcaaaagcttcgtgcactccagccgcttaattaggcaccagcggacccacactggggagaagccttatgagtgtcctgaatgcggcaagagcttccgacagtctacccatctgattctccatcaaaggactcacgtccgagtgcggccgtatgaatgtaacgaatgcgggaagtcctactcccagcgaagtcatctggttgtgcaccaccggatacacacaggcctgaaacctttcgagtgtaaagactgcggcaagtgcttctcaaggagctcacatctctacagccaccagcgcacacacactggcgaaaagccttatgagtgccacgactgtggtaaaagcttttctcagtcttccgccttgattgtccatcagaggatccacaccggcgaaaagccgtatgaatgttgtcagtgcggcaaagcctttattagaaagaacgatctcatcaagcaccagaggatccacgtcggagaggagacttataagtgcaaccagtgcggaatcatcttcagtcagaactcgccttttatcgtgcaccagatcgcgcatacaggagaacagtttttgacatgtaaccagtgtggaaccgccctggtgaacaccagcaaccttattggctatcagacgaatcacatcagagagaatgcttactag

SEQ ID NO: 141042 - DNA, 1722 bp, Artificial Sequence
  Description of Artificial Sequence: Synthetic coding sequence
atggacgctaaatcgttgaccgcatggtcccgaacactggtcacctttaaagacgttttcgttgactttacccgggaggagtggaagctcctcgatactgcccagcagatcgtgtatcgcaatgttatgctcgagaattataaaaacttggtgtcacttgggtaccaactcaccaagcccgatgtgatcctgcggctggagaaaggggaggaaccatggcttgttgaacgggagatccaccaagagacacatccagacagtgaaacagctttcgaaattaagtcgtcagtttcctccaggtctatcttcaaagataagcagagctgcgatattaagatggagggaatggcacgcaacgacctttggtacttgtcactggaggaggtctggaagtgcagagatcagttagacaagtaccaggagaaccccgaacgccacttgaggcaagtggccttcactcagaaaaaagtgctcacccaggaaagagtgtcggaaagcggaaagtacggtggcaattgtctcctgcctgcccaactggtgttacgcgagtacttccataagcgggattcccacacaaaaagcctgaaacacgatctggtgctcaatggccaccaggatagttgtgcgtctaacagtaacgaatgcgggcaaacattctgccagaatattcacttgatccagttcgctcgcacccacaccggagacaaaagttacaaatgcccagacaatgataatagcctgacccatggcagctccctagggatcagcaagggcatccaccgcgaaaagccctatgaatgcaaagaatgcggaaagttcttttcctggcggagcaacctaacaaggcaccaactgatacataccggggagaaaccttatgagtgcaaggaatgtggtaaatcattctctcgcagttcccacttgatcggccaccagaagacacatacaggagaggagccatacgagtgcaaagagtgcggaaagagctttagttggttttctcacctggttacacaccagcggactcacactggggacaagctttacacctgcaaccagtgcgggaaatcttttgtccacagcagccggctgatccgccaccagcgaacacacacaggagagaagccatacgagtgccctgagtgcggaaagagcttcagacagtctactcatctgatcttacaccaacgcacccacgtacgggtgaggccatacgaatgtaatgagtgcggcaaaagctattctcagcggtctcacctggttgtacaccatcggatccacacaggactgaaaccattcgagtgcaaggactgcggaaaatgcttttcacgctcctctcacctatatagccaccagcggacgcacaccggggagaaaccatacgagtgtcacgattgcggaaagagcttttcccagtccagtgccctcatcgttcatcagcgcatccacaccggcgaaaagccgtacgaatgttgccaatgcgggaaagcctttatcaggaaaaacgacctgatcaagcaccagaggatccatgtaggagaagaaacttacaagtgtaaccagtgcgggatcatattttctcagaatagcccattcatagtgcatcagatcgcgcacaccggtgaacagttcctgacttgtaatcagtgcggtacagcactcgtaaacacttctaatctgataggataccagacaaaccacattcgggagaatgcttactag

SEQ ID NO: 141043 - DNA, 219 bp, Artificial Sequence
  Description of Artificial Sequence: Synthetic coding sequence
atggatgccaaaagcctgaccgcctggtcccgaacactcgtcacctttaaggacgtgtttgtggatttcactcgggaggagtggaagcttctcgatacagcgcagcagatcgtatacaggaacgtgatgctggaaaactataagaaccttgtttctttaggttatcagctgacaaagcccgatgttatacttagactggagaagggcgaagagccttag

SEQ ID NO: 141044 - DNA, 132 bp, Artificial Sequence
  Description of Artificial Sequence: Synthetic coding sequence
atggatgccaaaagtctcacagcatggtcacggacattggtgactttcaaggatgtgttcgtggacttcaccagagaagagtggaaattactggacaccgcccagcaaatcgtctataggaacgtcatgtag

SEQ ID NO: 141045 - DNA, 144 bp, Artificial Sequence
  Description of Artificial Sequence: Synthetic coding sequence
atggatgctaagagcctgacggcttggtctagaacattagttacctttaaggacgtattcgtagacttcaccagggaggagtggaagctgctagacactgctcagcagatagtgtatagaaacgtaatgctagaaaattattag

SEQ ID NO: 141046 - DNA, 1629 bp, Artificial Sequence
  Description of Artificial Sequence: Synthetic coding sequence
atggacgacccccggtacggcatgtgtccactaaagggggcatcaggatgccccggagctgagagatccttgttggttcagtcctacttcgaaaagggaccccttacatttagagatgttgccattgagttctcactggaggagtggcagtgcctggatagtgcgcagcagggcttgtaccgcaaggtgatgctggagaattatcggaacctggtttttcttgcaggcatagcattaaccaagccagatctcatcacctgtcttgaacaaggaaaggaaccttggaatatcaagagacatgagatggtcgcaaagccaccagtgatttgttctcattttccccaagatctatgggcagagcaggatatcaaggactcattccaagaagccattctgaagaagtacggcaagtacgggcacgataacttacagctccagaagggctgcaagtccgttgacgagtgtaaggtgcacaaggagcatgataataaactgaatcagtgcttgattaccactcagtccaacatctttcaatgtgatccgagtgctaaggtcttccataccttttccaatagcaatcgccataagattcgccacacccgaaaaaagccatttaagtgtaagaaatgtgagaaatcattttgcatgctcctgcatttgactcagcataagaggttccatatcaccgaaaacagctatcagtgcaaagactgcgggaaggcctttaactggttctcgacacttaccacacaccggcggattcacaccggggaaaagccttacaagtgtgaggagtgcgggaaggcttttaaccgctcatcgcacctcacaacccacaagatcatccataccggcgagaagccctatcgctgtgaagaatgtggaaaggcattcaatagaagttcccacctgaccacacacaagcgcatccacaccggcgtcaaaccttacaagtgcacggagtgtggaaaggctttcaatagaagcagtcacctcacgacccacaggataatacacacgggcgagaaaccttacaagtgtgaggaatgcggaaaggcatttaatcagagcagtaccttgaccacacacaaaatcacccatgcaggggagaagccttacaaatgtgaggaatgtggcaaagcattttatagattttcatatctgacaaagcataaaacctcgcacacgggagagaagttctacaagtgcgaggaatgcggaaagggtttcaactggagttccgcacttactaagcataagcgcattcacacaggcgagaagccatataaatgtgaggaatgcggaaaagcgttcaatgaaagctctaatctgactacccacaaaatgatccatacaggggaaaaaccctacaaatgcgatgaatgcggcaaggctttcaataggtccagccagctgaccgcccacaaaatgatccacactggcgagaaaccttacaagtgcgaggagtgcggaaaagcttttaaccggagcagcacactgacaaagcacaagattacacacacaggagaaaagagctataaatgggaggagtgtggcaaggacttcaatcagtcgctgtctctaataaagcagaataacagctactggagggaaactctgcagatgtag

SEQ ID NO: 141047 - DNA, 1311 bp, Artificial Sequence
  Description of Artificial Sequence: Synthetic coding sequence
atggattcagtggccttcgaagacgtggctgtaaactttacccaggaagagtgggctttacttagccccagccagaagaacctatatcgagacgtgaccttagagacttttcgaaaccttgctagcgtcgggattcagtggaaagatcaggacatagagaacctgtaccagaatcttggaatcaaactcagaagtctggtcgaaaggctttgtggcaggaaggagggcaatgagcaccgcgaaactttttctcaaatcccggattgccatctcaataagaaatcccagaccggggtgaagccatgcaaatgctcagtgtgcggaaaagtcttcttacgccacagtttcctggaccgacacatgagggcccacgcgggccacaaacggtcagaatgcggtggggaatggcgtgaaacaccccggaaacagaaacagcatggcaaggcctcaatcagccccagctccggtgccaggaggacggtgacccccaccagaaaaagaccctacgaatgcaaagtatgcgggaaagccttcaatagccctaacctttttcagattcaccagcggacacacaccggtaaacggtcatacaaatgtagagagattgtgcgggcctttaccgtgtcctctttcttccgtaagcacggcaagatgcatactggggaaaaaagatatgaatgtaagtattgtggtaaacccatcgactatccaagtctgttccagattcatgtacgtactcacactggggagaagccctacaagtgcaaacagtgtggcaaagctttcattagcgctggctatttacgaacacatgaaatccgcagccatgcactagagaagtctcatcagtgtcaagagtgtggtaagaagctgagttgctcatcctccttacatagacatgaacgaacccactccggaggaaagctctacgaatgccagaagtgtgccaaggttttcagatgcccaacatccctgcaggcgcacgagagagcccacaccggggaaagaccgtacgagtgtaataaatgcggaaagacgttcaattatcctagctgcttccgaaggcacaaaaagacccatagcggggaaaaaccgtacgagtgcacaagatgcggtaaagcgttcggctggtgctcctcactgcgacgccacgagatgacccataccggcgagaagcctttcgactgcaagcagtgcgggaaggtgtttacctttagcaactacctgagattgcatgaacgcacccacctggcgggtagaagtcagtgtttcggaaggaggcaaggcgatcacttaagcccgggggtctag

SEQ ID NO: 141048 - DNA, 1311 bp, Artificial Sequence
  Description of Artificial Sequence: Synthetic coding sequence
atggattccgttgcattcgaagatgtggctgtgaactttactcaggaggaatgggcactattaagcccttctcagaagaatctgtacagagatgtgactctcgagacatttcgtaatctcgcttctgtgggaattcagtggaaggaccaggacattgagaacttgtatcagaatttgggtatcaaactgcgctctctggtggaacgcctctgcgggagaaaagagggaaatgagcatagggaaacattcagccagattcctgattgccacctaaacaaaaaatctcagaccggggtcaagccatgcaagtgcagcgtgtgcggcaaagtatttttgcgccattccttcctagatcgccacatgcgagcccatgccggtcacaaaaggtctgagtgtggaggggagtggcgggaaaccccgcgtaaacaaaagcaacacggaaaagcgagcatctccccttcttctggcgcacgacgcactgtgacacctacacgcaagcgcccatatgaatgcaaagtgtgtggcaaggcgttcaactcccctaacttattccagatacatcagaggacacatactggcaagaggtcatacaagtgccgggagatcgtgagggccttcaccgtctcgagcttcttccggaagcacggtaagatgcatacaggtgaaaagaggtatgagtgtaagtattgcgggaaacccattgactatccctccctgtttcaaatccacgtcaggactcatactggcgagaaaccctacaaatgtaagcagtgtggaaaagcatttatctccgctgggtacttgagaacacatgagattcgcagtcacgcattggagaagtctcaccagtgtcaagagtgcgggaagaaattgtcctgctcatccagtctgcatcgacacgagcgcacccatagcggcggaaaactttacgagtgccagaaatgcgcaaaggtgtttaggtgcccaacctcattgcaggcccatgagcgcgcccatactggcgaacggccatatgaatgtaataaatgcggaaaaaccttcaattatccctcgtgctttcgcagacacaagaagactcatagtggggagaagccctacgagtgcacacgatgtggcaaggcgtttggctggtgctcttctttgcgcaggcacgaaatgacccacacgggggaaaagcccttcgactgtaagcagtgtggtaaagtgtttacattctcgaattatctgcgtcttcacgagagaacccaccttgctgggcgctcccagtgctttggccggcggcagggggatcacctgagtcccggagtgtag

SEQ ID NO: 141049 - DNA, 951 bp, Artificial Sequence
  Description of Artificial Sequence: Synthetic coding sequence
atgagagcccacgctgggcacaaaagatcagagtgcgggggtgaatggcgggaaacccctcgtaaacagaaacagcacggcaaagcctctattagccccagctcaggcgcacgtcggacagtgactccaacccgcaagagaccctacgagtgcaaggtgtgcggtaaggcattcaactctccaaacctgttccagattcaccaacgcacccatacaggtaaaaggtcctataagtgccgcgagatcgtgagggcatttacagtaagttcctttttcagaaagcacgggaagatgcacacaggagagaagagatatgagtgcaaatattgcggtaagcccatagattatccttcactgtttcagatccatgtgagaacccatacaggagagaaaccttacaagtgcaaacagtgcggcaaagcttttataagcgccgggtatctgagaacccatgagattagaagccatgcacttgaaaagtctcatcagtgtcaggaatgtgggaaaaagcttagttgctcatcaagcttgcatagacatgagcgcacacatagtggagggaaactttacgagtgccagaaatgcgctaaagtgttccggtgccccacatccttgcaggctcatgagagagcccataccggggaacgaccgtacgaatgtaataagtgcggcaaaacctttaattatccgtcttgttttcgcagacataagaagactcactctggagaaaagccctatgagtgtacaaggtgtgggaaagcattcggctggtgcagctccctgagaagacacgagatgactcacaccggggagaagcctttcgattgtaagcaatgcggaaaagtcttcacattttcaaactatctgcgactgcacgaacgcacccacctagcaggtagatctcagtgctttggccgtcgccagggcgatcacctatcacccggagtctag

SEQ ID NO: 141050 - DNA, 1311 bp, Artificial Sequence
  Description of Artificial Sequence: Synthetic coding sequence
atggactccgtcgcatttgaggatgtcgctgtgaatttcacccaggaggagtgggcgctgttatccccttcccagaagaatctctacagggatgtcacgttggagacatttagaaatctggctagcgttgggatacagtggaaggaccaagatatcgagaacctgtaccaaaacttgggcattaaactcagaagccttgtggagcgcctctgtggacgaaaagaaggcaatgagcaccgagaaacatttagccaaattcccgattgtcatcttaacaaaaagtctcagacgggggtgaaaccgtgcaaatgttcagtgtgtggtaaagtgttcctgcgacatagctttttggataggcacatgcgagctcatgccgggcataaacggagtgaatgcggcggcgagtggagagagacaccacgcaaacagaaacaacacggcaaagcctctattagtcctagctctggagcacgacgcaccgttacccccacccgcaagaggccttatgagtgcaaggtgtgcggcaaggcgttcaacagcccgaatctgttccagatacaccagaggacccatacaggaaagagatcgtacaagtgccgcgagattgtgcgcgcctttacagtgagctcctttttccgtaagcacggtaagatgcacacaggagagaaacggtacgagtgtaagtattgcggaaaacctattgattatccatctttgtttcagatccatgttcgaacccatactggcgaaaagccctataaatgcaaacagtgtgggaaggctttcatatccgcgggatacctaagaacccacgagattcggagtcacgctctggagaaaagccatcagtgtcaggaatgcggcaagaagctttcctgctctagttccctccaccgccatgagcgaactcattccggcggcaagctttacgaatgtcagaaatgtgctaaagtatttagatgcccaacctccctccaggcacatgagagggcccacacgggtgaaagaccgtatgaatgcaacaagtgtgggaagacctttaactacccaagctgttttagacggcataagaagacccatagtggcgaaaagccgtacgagtgcactcgctgcggtaaggcctttgggtggtgcagcagcttaagacggcacgagatgacacataccggcgagaaaccttttgattgcaagcagtgcggtaaggtttttactttctccaattacttgaggttgcacgaacggactcacctggccggcagatcccagtgttttggacgacgacaaggggatcacctaagccccggagtttag

SEQ ID NO: 141051 - DNA, 2352 bp, Artificial Sequence
  Description of Artificial Sequence: Synthetic coding sequence
atggtggctaaacctcccgttatgtcctttcattttgctcaggatctgtggcctgaacagaatattaaagatagctttcaaaaggttaccctgcggcgctatgggaaatgcgaatacgagaacctgcagctgcggaaggggtgtaaacatgtcgatgaatgtacaggtcacaaaggtggccacaacaccgtgaatcagtgcctgactgcaactccctcaaagatatttcagtgtaataagtatgtcaaggtgttcgacaagttttccaatagcaaccgatacaagagacggcacaccggcaacaaacattttaagtgcaaggaatgttccaaaagtttctgtgtgttgtcccagctaacacaacatcgcagaatccacacgagggtcaatagttataaatgcgaggagtgcggcaaagccttcaactggttctcaacactgacaaaacacaagcgaatacacacaggcgagaagccctataagtgtgaagagtgtgggaaagcctttaaccaaagtagccagctgaccagacacaagatcattcacacagaggaaaaacctaataagtgcgaggagtgtgggaaggcttttaaacaggcaagccatcttactatccacaaaattattcacaccggggagaagccatacaaatatgaggagtgtggtaaggtgttcagtcagagttcacacctcacaactcagaagatattacacacaggggaaaacctttacaagtgtaaggagtgtggaaaggcgtttaatctgtttagtaacctgaccaaccacaaaaggatacacgccggtgagaaaccctataagtgtaaagagtgtggaagagcttttaatattagctctaacttgaacaagcaggaaaagatacatacaggtggcaagctaaataagtgtgaggagtgcgacaaagctttcaatagaagcctcaaactgactgcccacaaaaagatcctgatggaggaaaagccctacaaatgcgaggagtgtggcaaagtgttcaaccagttttccacacttacacgtcataagatcattcacactggcgaaaagccctacaaatgcaaggagtgcgggaaggcttttaatcagagtagtaacctcacagaacacaagaagatccatacggccgaaaaatcttataaatgcgaagaatgtggcaaggccttcaaccagcactctaaccttatcaaccaccggaaaatctactctggcgaaaagccatataaatgtgaggagtgcggcaaggcattcaatagatcttcaacactgactcgccacaagaagattcatacaggtgagaagccatacaaatgcgaagagtgtgatagggctttctctcaatcaagcaacctcacggagcacaaaaagatccacacaggcgaaaagccatacaaatgtgaggagtgtggtaaggctttcaaccggttctctaccctgaccaagcataagaggatccacacgggagagaaaccatataaatgcgaggagtgtggtaaagctttcaaccagagctatcaactgactcgccacaaaattgtgcacaccaaagaaaagttaaacaagtgtgaagaattcggaaaggccttcaagcagtcatcacacagaactatacacaagatcattcataccggcgaaaagccatataaatgcgaagaacatgggaaggtgtttaaccagagttctaatctgacaacacagaaaatcatccatactggagagaatctgtataaatttgaggagcacggaaaagccttcaatctatttagcaatataacaaaccacaaaataatctatacaggagaaaaaccacacaaatgtgaggaatgtgggaaagcgtataaccgcttttccaacctgaccatccataaaagaattcacactggcgaaaagccctatcagtgcgccgagtgtgggaaggcatttaattgctcttctacactgaaccggcacaagatcattcatacaggcgaaaagccctacaaatgcaaagagtgcggaaaggccttcaacctgtcatccacactgactgcccacaagaaaatacatactggcgagaagccctacaaatgcgaggaatgtggcaaagctttcaaccagagttcgaacctgacaacccacaagaaaatacatacttccgaaaaaccatataagtgcgaagagtgcggtaagagctttaaccaattctcatccctcaatatacacaaaattatacacactggcgagaaaccctacaaatgcggtgattacggacgtgccttcaatctgagtagcaacttaacgacacataaaaagattcacacaggagagaaaccgtataaatgtgagtacggaaagacctag

SEQ ID NO: 141052 - DNA, 276 bp, Artificial Sequence
  Description of Artificial Sequence: Synthetic coding sequence
atggtcgccaagccgcccgttatgtcgttccattttgcccaggacctgtggcccgaacagaatattaaggattccttccagaaagtgacccttaggcggtatgggaagtgcgaatacgagaacctccagttacgaaaaggatgcaagcatgtggacgaatgcaccggccataagggcgggcacaataccgtaaaccagtgtctgaccgctacaccttctaagatcttccaatgtaataagtatgtgaaagttttcgacaaattcagcaactcctag

SEQ ID NO: 141053 - DNA, 2352 bp, Artificial Sequence
  Description of Artificial Sequence: Synthetic coding sequence
atggtcgcaaaacctcccgtcatgtctttccacttcgcccaggatctgtggcctgagcagaatatcaaagatagtttccagaaggttactctgcgccggtacggcaagtgtgagtacgagaatcttcagctccgcaaggggtgtaaacacgttgatgaatgcactggccataaaggcggtcacaataccgtgaaccagtgtctgactgcgactccttcgaaaatttttcagtgcaataaatacgtgaaggtgttcgacaaattttctaacagtaatcgttataaacggcgccacactggtaacaagcacttcaaatgtaaggagtgcagtaagtccttctgcgtgctttcacaactaacacagcacaggcgaatccacaccagggtgaacagctataaatgtgaagagtgcggcaaggccttcaactggtttagcacccttaccaagcacaagcggattcataccggggaaaagccctataagtgcgaggaatgcggcaaggctttcaatcagtcttctcagctgacccgtcacaaaatcatccacacggaagagaagcccaacaagtgcgaggaatgcggtaaggccttcaagcaagcatcccatctgacaatccacaaaatcatccatacaggtgaaaagccctataaatacgaggagtgtgggaaggtcttcagtcagagctcacatctgactacccagaagatactgcacacgggggagaacctgtataaatgcaaagagtgtggcaaggccttcaatctatttagcaatttaaccaatcataagcgtatccacgccggcgagaaaccctacaaatgcaaggagtgcggcagagcatttaatatttcatctaacctgaataagcaagaaaagatccacacaggtgggaagttaaacaaatgcgaggaatgtgacaaagccttcaatcgctccttgaagctaacagcacacaagaagatccttatggaggagaaaccctacaagtgtgaagagtgtggcaaagtgttcaaccagttttccactctcacacgacataaaatcattcataccggggagaaaccctacaagtgtaaggagtgtgggaaggccttcaatcagtctagcaatttaaccgagcacaaaaagatccatacagctgaaaaatcatacaagtgtgaagagtgcggcaaggccttcaatcaacattctaatctgatcaatcataggaaaatttattccggagagaagccctacaaatgtgaggagtgcggtaaggcatttaacaggtcatccactctcaccagacataagaaaattcacaccggagagaagccctataagtgcgaagagtgtgaccgagcgttttcccagagcagtaatcttaccgagcacaagaaaatccacacgggagagaaaccatacaagtgcgaagagtgtggcaaagctttcaacaggttctcaacacttactaaacacaagaggatacacaccggtgaaaaaccatacaaatgcgaggagtgcggaaaagcttttaatcagtcttatcagttgacacgccataaaattgtgcataccaaggagaagctgaacaaatgcgaagaatttggaaaggcctttaaacagtctagccatcggactattcacaagatcatccacaccggcgaaaaaccgtataagtgcgaggaacatggaaaggtttttaatcagtccagtaatctcaccacgcaaaaaatcattcacaccggggaaaatctgtataaatttgaagaacacgggaaagctttcaacctgttttcgaacatcaccaatcacaagatcatttatactggcgagaagcctcataaatgcgaggaatgtggtaaggcgtacaataggttttctaatttgacaattcataaaagaatccacaccggggagaagccctaccagtgcgccgagtgtggcaaggcctttaattgttcttctacactcaacaggcacaaaatcattcatacaggtgagaaaccttataaatgcaaggaatgtggcaaggcttttaacctgtctagtacacttaccgcccataaaaaaatccatacgggggaaaagccatacaagtgcgaagagtgcggcaaagccttcaaccagagctcgaatctgacgacgcacaagaagatccacacaagcgagaaaccatacaaatgtgaggagtgtggtaaatccttcaaccaatttagtagcttaaatatccataaaattattcatacaggggaaaagccctacaaatgtggggattacggtcgggcctttaacctatcttctaacctgaccacgcataagaaaattcatactggcgagaaaccctacaagtgtgagtacgggaagacatag

SEQ ID NO: 141054 - DNA, 2352 bp, Artificial Sequence
  Description of Artificial Sequence: Synthetic coding sequence
atggtggccaagccccccgttatgagttttcacttcgcccaggatttatggcctgagcagaatattaaggacagctttcagaaagtaactttacggagatatggcaagtgcgaatatgaaaatctgcagctgcgtaagggatgcaagcatgtagacgaatgcactggccacaaaggagggcacaacacagtcaatcagtgtctgaccgctaccccctctaaaatatttcagtgtaacaaatacgtgaaagtgttcgataagttttcaaatagcaaccgctacaaaaggagacatactgggaacaagcattttaaatgcaaggagtgcagcaagtctttttgtgtgctgtctcagcttacacagcataggcgcattcacaccagagtcaactcttataagtgcgaggagtgcggtaaagctttcaactggtttagtaccctaacaaagcacaaacgcatacacaccggtgagaagccttacaagtgtgaggagtgcggtaaagccttcaatcaaagctcgcagttgacaaggcacaaaatcattcataccgaggaaaaacctaataagtgtgaggagtgcggtaaagcttttaagcaggccagccacctgaccatccacaaaataatccatactggggagaagccttacaaatacgaagagtgtggcaaggttttcagtcaaagctcgcacctcacaacccagaagattctgcataccggggagaacctctacaagtgtaaagagtgtggcaaagctttcaacctgtttagcaacttgaccaatcacaagaggatacatgccggagaaaaaccatacaagtgtaaagagtgcggacgagctttcaatatctcctccaacctgaataaacaggagaagatacatacgggaggcaaacttaacaagtgcgaagaatgtgataaggcattcaatcgatcgctcaagttgacagcccataagaaaattctgatggaggaaaaaccctataaatgcgaagagtgcggtaaagtgtttaaccagttcagtaccctgacacggcataagataatacacactggggagaaaccatataaatgtaaagaatgtggcaaggctttcaatcagtcaagcaatcttacagagcacaaaaaaatacataccgccgaaaagagctataagtgtgaggaatgcggtaaggcctttaatcaacacagcaatctgattaaccatcggaaaatatactcaggagaaaagccttacaaatgcgaagagtgtggcaaagcatttaatagaagttccacactgacccggcacaaaaagatccacactggagagaagccttataaatgcgaggagtgtgatagagccttttctcagtccagcaatctgacggagcacaaaaagatacacactggggaaaagccgtacaaatgcgaagagtgcggcaaggccttcaatagattttctacactgaccaaacacaagagaatccacactggggaaaaaccgtataagtgcgaggagtgcggtaaggccttcaatcagtcttaccagttgacgcgccataagatagtccacacgaaagaaaaactgaataagtgtgaggaattcggcaaggccttcaaacagtcatcccacagaaccatccacaaaattatacatacgggtgagaagccctacaaatgtgaggaacatggtaaggtttttaatcagagtagcaacctgacaacccaaaagatcatacacacaggagaaaatctctataagtttgaggaacacggaaaagcctttaatctattcagcaacattaccaaccataagattatatacacaggagaaaagccacacaaatgcgaggaatgtggaaaagcgtacaaccgattctccaaccttactatccataagcgtatccatactggggaaaaaccttaccaatgcgccgaatgcggaaaggctttcaattgttctagtacgcttaatcggcataagatcatccacacaggtgagaagccatacaaatgtaaggaatgtggaaaagcattcaatctgtcatcaactcttaccgcacacaagaaaatccataccggagagaagccatacaagtgcgaggagtgcggaaaagcctttaatcagtcgagcaacttgaccacccacaagaaaatccataccagcgagaagccatacaagtgcgaagagtgcggaaaaagctttaatcaattctcatcactgaatattcataaaattatccacaccggggagaaaccctataaatgcggagactatggacgcgccttcaacctttcctcaaatttaacgacacataagaagatacataccggtgagaagccttacaagtgtgagtatggaaagacttag

SEQ ID NO: 141055 - DNA, 453 bp, Artificial Sequence
  Description of Artificial Sequence: Synthetic coding sequence
atggtggccaagcctccggtcatgagctttcatttcgcccaggacttatggccagaacagaatatcaaggattccttccaaaaggtgacactccgtcgttacgggaaatgtgagtacgagaatctgcagctgcggaaagggtgcaaacacgtcgatgaatgtaccgggcacaagggtgggcataacaccgttaatcaatgcctcacagctacgccctcaaaaatctttcaatgtaacaagtacgttaaagtgttcgataaattttcgaactcgaataggtataagcgaaggcatacaggaaataagcacttcaaatgcaaagagtgctccaagtcattttgtgtcctgtcccagctgacacagcacagaagaatccacactcgggttaacagctacaagtgcgaggagtgcggaaaggccatcatcatctgctctgatttcacacagcattag

SEQ ID NO: 141056 - DNA, 1254 bp, Artificial Sequence
  Description of Artificial Sequence: Synthetic coding sequence
atgtcccaggattccgtgacctttgctgacgtggcagttaatttcaccaaggaagaatggaccctgctagaccccgctcagagaaatctctatagagacgtgatgttggaaaactccaggaacctggcattcattgactgggctacaccctgtaaaactaaagacgccaccccacagcctgatatccttcctaaacgcacatttcccgaagctaatagggtgtgtctgacgtctatcagttcacaacacagcactctcagggaggattggcgatgtcccaagacagaagagccccacaggcagggcgtcaacaacgtaaaaccacccgcagtcgctcccgagaaagacgaatcacccgtcagcatttgtgaggatcacgagatgcgcaaccactctaagcccacatgtagactcgtaccctcccagggggactcaataagacagtgcatccttacccgggactcttctatcttcaagtacaatccagtgcttaacgactcccagaaaacgcatgagaataatgaagatgacggagtgctggggtggaatattcagtgggtgccgtgcggcaggaagacagaacttaaatccagcacatggacaggctcccagaatacagttcatcatatccgcgatgaaattgacacaggcgccaaccgccatcagaggaatccattcggcaaggctttcagggaggacgggtccctcagagcacataacactcacggtagggaaaagatgtatgacttcacacagtgcgagaatacgagcaggaataacagcatacacgccatgcagatgcaactgtacactgctgaaaccaataagaaagattgtcaaaccggggctacctcggccaacgccccgaactccggatcccataagtcacattgcactggtgaaaagacccataagtgtccagagtgcgggagagcatttttttaccaaagcttcctcatgagacacatgaagatccatacaggggagaaaccttatgaatgtgggaagtgtgggaaagcattcaggtactccttgcacctgaacaagcatcttagaaagcatgttgttcagaaaaaaccctatgaatgtgaggagtgtggcaaagttattagagaatcctcaaaatacacacatattagatcgcacaccggtgagaagccgtataagtgcaagacgtgtggtaaggattttgccaaaagctctggactgaagaaacacttaaagacccacaaagatgagaaaccatgcgaatag

SEQ ID NO: 141057 - DNA, 1254 bp, Artificial Sequence
  Description of Artificial Sequence: Synthetic coding sequence
atgtcccaggacagtgtgacatttgctgacgtcgccgtcaattttactaaggaagaatggactctgctagatccagcccaacgtaacttataccgagacgttatgctcgagaactctcgcaatctggcgtttatcgactgggctactccttgcaagaccaaggatgcgactcctcagccagatatcctccccaaaagaacttttcccgaggccaaccgggtttgtcttacatcgatctccagtcagcactccacacttagggaagattggaggtgccctaaaacggaggagccacaccggcagggagtgaataatgtgaaaccgccggcggttgccccagaaaaagatgagtcccccgtgtcgatatgtgaggaccatgaaatgaggaaccactccaagcctacctgtaggctggtgcccagtcagggtgattccattcggcaatgcattctcactcgagactcttccatctttaagtacaacccggttctcaatgacagccagaagacacatgagaacaacgaggacgatggggtcttgggctggaatatccagtgggttccctgcggcaggaagaccgaactgaaatctagtacttggacaggaagtcagaacaccgtccaccacatcagggacgagatagatacaggtgccaatcggcaccaacgaaatccatttgggaaagccttccgggaggacgggtcgctaagagcacataacactcatggaagggaaaaaatgtacgactttacccagtgcgaaaatacctcaagaaacaattccattcatgcaatgcagatgcaactttacacagccgaaacaaataaaaaggactgccagacgggggcaacttccgctaacgcgcctaactcaggatctcacaaaagccactgcaccggcgaaaagacgcataaatgccccgagtgcggtagggcatttttctatcagtcattcttgatgaggcatatgaagattcacaccggggagaaaccttatgagtgtggaaaatgcggtaaggccttcagatattctctgcacctcaataaacatctgaggaagcatgtcgtgcagaagaaaccctacgaatgtgaggagtgcggaaaagtgatccgtgaatcttctaagtacacccacatacgtagccacactggagaaaaaccatacaaatgcaagacatgcggaaaggatttcgcaaaatccagcggcctgaaaaaacacttgaaaacccataaagatgaaaaaccctgcgagtag

SEQ ID NO: 141058 - DNA, 1452 bp, Artificial Sequence
  Description of Artificial Sequence: Synthetic coding sequence
atgaagagacatgaaatggtggctaaacatctcgttatgttttattactttgcacaacacctctggcccgaacagaatatcagagactctttccagaaagtcacactgcgcaggtataggaaatgtgggtacgaaaatctgcagctccggaaagggtgcaagtccgtcgtagagtgtaagcagcacaaaggagattacagtggcctgaaccagtgcctgaaaaccactctgtcaaaaatatttcagtgcaacaagtatgttgaggtctttcataagatttcgaattctaatagacacaaaatgagacacactgaaaacaaacacttcaaatgcaaagagtgccggaaaacattctgcatgctgtcccatctcactcagcataagcgaattcaaacccgcgtgaatttttataagtgcgaggcgtatgggcgggcattcaactggtcaagtactcttaacaaacataagcgtatccacacaggggagaaaccctacaagtgtaaggagtgtggcaaggcctttaaccaaacctcacaccttataagacataagaggatccacacagaggagaaaccatacaaatgcgaggaatgtgggaaagcttttaaccagtccagcacactcacaacgcacaatattatccacactggcgagatcccatacaagtgtgagaagtgcgtgcgcgcttttaatcaggcttcaaagctcactgaacacaagctaattcatactggagagaagcgttacgaatgcgaagaatgcggcaaggctttcaaccggagcagtaaactgactgagcacaaatatattcatacaggcgagaaactctacaaatgcgaggagtgtgggaaagcttttaatcagtcgtcgaccctgacgacacacaagcgcatccatagcggggagaagccatataagtgtgaagaatgcggtaaggcttttaagcagttttccaatctgactgatcacaaaaagatccacacaggcgaaaagccatataagtgcgaagaatgcggcaaggcgtttaaccagttgtctaacctgacacgtcacaaggttatccatacaggcgagaaaccatacaaatgcggggaatgtggcaaggcattcaatcagtcttcggctcttaacactcacaaaatcatccatactggggagaatccccataagtgccgggagagtgggaaggtctttcaccttagttccaaactgtccacatgtaagaagatccatacaggcgaaaaactctacaagtgcgaggagtgcgggaaggcgttcaaccgctcttcaactctcatcggccacaagaggattcatactggtgaaaagccttacaagtgtgaggaatgcggaaaagcctttaatcaatcctcaactctcacaacgcacaagatcatccataccgaagaaaagcaatataagtgtgatgagtgcggcaaagcctcaacttag

SEQ ID NO: 141059 - DNA, 1152 bp, Artificial Sequence
  Description of Artificial Sequence: Synthetic coding sequence
atgaagcgtcacgagatggttgcaaagcatttagtgatgttttattacttcgcacagcacctgtggcctgagcaaaacatcagggacagttttcaaaaagtgaccctgcgccgctaccgcaagtgcgggtacgagaacctccaactgcgaaaaggctgtaagagcgtcgttgagtgtaagcaacacaagggggactactctggcctcaatcagtgccttaaaacaaccctctctaaaatttttcagtgcaacaagtatgtggaagttttccataagatctctaatagcaatagacacaagatgaggcacaccgagaataagcattttaaatgcaaggaatgccgcaagacattttgtatgctttctcatctcacccaacataagcgaatacagacacgcgtgaacttttacaaatgtgaagcgtatggccgtgcgtttaactggtcgtcaacactgaacaagcacaagcgcattcatactggcgagaaaccttacaagtgtaaggagtgtggcaaagccttcaaccagactagtcaccttattcgccacaaacggattcacacggaagaaaaaccctacaagtgcgaagaatgtggaaaggcatttaaccagtcaagcacactgaccacccataacataatccataccggcgagataccatataaatgtgagaagtgtgtgcgcgctttcaatcaggcaagtaaactgacagaacacaagcttatccacactggagaaaagcggtacgagtgcgaggaatgtggcaaggcatttaaccggtcttcaaaactcaccgagcacaaatatatccacaccggcgagaaactgtacaagtgtgaggaatgcggcaaggctttcaatcagagttccacgttgactacccacaagaggatccactctggcgagaagccatacaaatgtgaagagtgcgggaaggcatttaaacagttctcaaatcttaccgaccataaaaagattcatacaggcgagaagccgtataagtgtgaggagtgtggcaaggcctttaaccaactgtcaaatctgacacgacacaaagttatacacacaggagagaaaccatacaagtgcggagaatgcggcaaggccaatctgtcatcaactctgaccccccacaaaacaattcatatctag

SEQ ID NO: 141060 - DNA, 1368 bp, Artificial Sequence
  Description of Artificial Sequence: Synthetic coding sequence
atgctggaaaattacagtaacctcgtgagcgttggataccacatcatcaaaccagacgtgatctcaaagctggagcaaggcgaggaaccatggatcgtcgaaggcgagttcttgttacagagttaccccgatgaggtttggcagacagatgatttaatcgagcgtatccaggaggaggaaaacaagcctagccgacagaccgtgtttattgagaccctgatcgaggaacgcggtaatgtccctgggaagaccttcgatgttgagaccaaccctgtgccctcccgtaagattgcctacaagaactcactgtgtgattcttgtgaaaagtgcctgacgtcagtttctgagtatattagcagtgatggctcatacgctaggatgaaggcggatgagtgcagtggctgtggaaaatctttactgcatatcaaactggaaaagactcaccctggcgaccaagcgtacgaatttaatcagaacggcgagccttataccctgaacgaagaatcactttatcagaagatccggatcctggagaaacctttcgaatacatcgaatgccagaaggcctttcagaaggatacagtgtttgtaaatcacatggaagaaaaaccctataaatggaatggatccgaaatcgcttttctccaaatgtccgacctcaccgttcatcagactagccatatggagatgaaaccttacgagtgttcggagtgcgggaaatccttctgtaagaaaagcaagttcatcatacaccaaagaactcacactggcgagaagccctacgaatgcaatcagtgcgggaaatcgttctgtcaaaagggtaccctaaccgtgcatcagcggacccatactggcgaaaaaccatatgagtgtaatgaatgcggcaagaatttctaccaaaaattgcaccttattcagcatcagcgcacgcacagtggcgaaaagccgtatgagtgctcctactgcggaaagtctttctgtcagaagacccatcttactcagcatcagaggacacattcaggcgagcgaccttacgtatgccacgactgtgggccatcccggcgctcacagcacctcatgcaccagaaaatccacacgggtgtgaaattgtacaagtgctctgaatgcggcaagtgcttctgccgcaagtccactttgacaacacatctgagaacacatacaggagagaagccttacgaatgtaatgaatgtggaaagttttttagccggcttagttaccttacagtccactataggacacatagcggagaaaagccctacgaatgcaacgagtgcggtaagacattttacctgaactctgctctgatgaggcatcagcgcgtacacaccggcgagaaaccgtactag

SEQ ID NO: 141061 - DNA, 1980 bp, Artificial Sequence
  Description of Artificial Sequence: Synthetic coding sequence
atgaacaagagtttgggccccgtgagctttaaggacgtagctgtggactttactcaggaggagtggcagcagctggaccctgagcagaagatcacctaccgggatgtcatgttagaaaattattcaaacctcgtcagcgtaggataccatattattaaacctgatgtcatcagcaagttggaacagggggaggagccctggatcgtggagggggagtttttactgcagtcttatcccgacgaggtgtggcagactgacgacctcattgagcggattcaggaagaagaaaataagcccagccgtcagactgtcttcattgagaccttaatcgaagaacgggaatacattagctccgacgggtcatatgctcgaatgaaggcagacgagtgcagcggctgcggcaaatcactgctccatattaaactcgagaaaacacaccccggtgatcaggcttacgagttcaatcagaacggtgagccttataccctgaacgaggagagcctgtatcagaaaatacggattctcgagaaaccgtttgaatatattgagtgtcagaaggcttttcaaaaggatactgtctttgtgaatcacatggaggaaaaaccttacaagtggaatggaagcgaaattgccttcctacaaatgtctgacctcacggtccaccagacatcgcacatggaaatgaagccatacgagtgttccgagtgtggaaagtctttctgtaaaaaatcaaaattcataatccatcaaaggacacataccggcgagaagccatatgaatgcaaccagtgtggcaagtccttctgccagaagggtaccctcactgtgcaccagcgaacgcacacgggggaaaaaccttacgagtgtaatgaatgcggtaagaacttttaccagaagctccatctcatccagcaccagagaacacatagtggagagaaaccctatgaatgctcatactgtggcaaaagcttctgccaaaagacccatctgacccagcaccaacgcacccattctggggaaagaccttacgtctgccacgactgtgggaagaccttttcacagaaatccgccttaaacgaccaccagaagatacataccggagtaaaactctacaaatgctcagagtgcggcaaatgcttttgtcgaaagtccactctgaccacacatcttagaacacacacaggcgagaaaccctacgagtgtaacgagtgtggaaagtttttctcacgactgagctacctaaccgtgcactaccgcacccactccggagagaagccttacgaatgcaacgagtgtgggaaaacattctacctaaattcagctctgatgagacaccagagggtccatactggtgagaagccctatgaatgcaacgagtgtggcaagctttttagccagttatcttacctaaccatccaccatcggacgcatagtggagttaagccttacgagtgttccgagtgcggtaaaactttctatcagaacagtgccctgtgtagacacaggagaattcataagggtgaaaagccgtacgagtgctacatctgcggtaaattcttttcccagatgagttacctcacaattcatcaccgaattcattcaggcgagaagccttacgagtgctccgaatgtgggaagacattttgtcagaattcggcattgaaccgccaccagcggacccacaccggggagaaagcatatgagtgttatgaatgtggaaagtgtttctctcagatgtcctacctgactattcaccataggattcacagcggggagaagccattcgagtgcaatgaatgcgggaaagcgttcagtaggatgagctacctaactgtgcactaccggacacactcaggggagaagccttacgaatgcactgaatgtggtaagaagttctatcataaaagcgcctttaacagccaccaacggattcatagaagagggaatatgaatgttatagatgtgggaagattactatag

SEQ ID NO: 141062 - DNA, 2268 bp, Artificial Sequence
  Description of Artificial Sequence: Synthetic coding sequence
atgcgggctacagcactggtgcggtggaccggcagagatctcgcttcaagacgagctcccgctacggctattccacccaggcccgtaggatctgggggggctgaagctgccgagccgcaggaagacttacctcccttatctcagagcagtaggttttttcaagagcaacagaaaatgaataagtcgcttggacctgtgagttttaaagatgtggcagtggattttacacaggaggagtggcagcagttggacccagaacagaaaattacgtatcgagatgtaatgttagaaaactacagtaacctggtctccgtgggatatcacattataaaaccagatgtcatctccaagctagagcagggagaagaaccatggatcgtagaaggcgaattcttgctgcaaagttatcctgacgaggtgtggcagaccgacgacctgatcgaaagaattcaagaagaggagaataaaccatccaggcagaccgttttcatcgaaaccttaatcgaagaaagggggaacgtccccgggaagacctttgacgtagaaaccaacccagttccttcgcgaaagatcgcttataagaattccttatgcgacagctgcgagaagtgcctgaccagtgttagtgagtatatatctagcgacggcagctacgcacgtatgaaggcggacgagtgctcaggatgtggcaaatccctactccacatcaagctagaaaaaacacacccaggggatcaggcatacgagttcaaccagaatggggagccatacaccctgaacgaggaatctctttatcagaagatccgcatcttggaaaagccatttgagtacattgaatgccaaaaggctttccagaaagacacagtgttcgtgaaccacatggaagagaagccttataaatggaacggatcagagatcgcctttctgcagatgagtgacctgacagttcatcagacatctcatatggagatgaagccgtacgagtgcagcgagtgcggaaaaagtttctgcaagaaaagtaagtttataattcatcaaaggacccataccggcgagaaaccttacgagtgcaaccagtgcgggaaatctttttgtcagaaaggcactctgaccgtgcaccagcgcacacacacaggcgagaaaccatatgaatgcaatgagtgcggaaaaaacttttatcagaagctccatttgatccaacatcaacggacccactctggtgagaagccttacgaatgtagctactgcggtaaatccttctgccagaaaacccacctgactcagcaccagcgaacccacagtggggaaagaccctacgtttgccatgactgcggcaaaacctttagtcagaagagcgccctgaatgaccaccagaaaatacacacaggcgttaagctgtataagtgctcagaatgcgggaaatgtttttgccgcaagtcaaccctgacaactcatcttaggactcataccggtgagaaaccttacgaatgcaatgaatgtgggaaattcttcagtcgactctcctatcttaccgtccactaccgcacccactccggagagaagccttacgagtgcaatgagtgtggaaaaactttctatctgaattcggccttgatgcgccaccaacgcgttcatacaggggagaagccatacgaatgcaatgaatgtggcaaacttttcagccagctctcctacctgactatccaccatcggacacactctggggtgaagccctacgaatgctccgaatgtggcaagacgttctatcagaattcagctctgtgcaggcaccggcggatacataaaggggagaaaccttacgaatgctatatatgtggcaagttctttagtcagatgtcttatttgactatacaccataggatccactccggcgagaaaccttacgagtgttcagaatgtggaaagacattttgtcagaacagcgccctgaatcggcaccagcgaacacataccggggagaaagcatacgaatgctacgaatgcggcaagtgcttcagccagatgtcatatctgacaatccaccatagaatccactcaggggaaaaaccatttgaatgcaacgagtgcggaaaggcctttagtcggatgtcctacttgacagtacactacagaacccactctggcgagaagccatatgagtgtaccgagtgtggcaagaaattctatcataaaagcgcatttaactcccaccaaaggatccacaggagagggaacatgaacgtaatcgacgtggggcgattgctgtag

SEQ ID NO: 141063 - DNA, 2094 bp, Artificial Sequence
  Description of Artificial Sequence: Synthetic coding sequence
atgaacaagtctttgggccccgtctccttcaaggacgtggcagtggacttcacccaagaagaatggcaacagttagaccctgaacagaaaatcacttaccgcgacgttatgctggaaaattacagtaacctggtgagcgttggataccacataatcaaacccgacgtgatttctaagttagaacagggcgaagaaccttggattgtggagggcgaattcctcttgcagtcatacccagacgaggtgtggcagactgatgacttgattgagagaatccaggaggaagagaacaagccttctcgacagaccgtttttatcgagacactgatcgaggaacggggcaatgtgcctggcaaaactttcgatgtggaaacaaatcccgtacccagccgaaaaattgcatacaagaattcactgtgcgactcatgtgaaaaatgcttgactagtgtgtccgaatatatatccagcgacggcagctatgcacggatgaaggccgacgagtgttcgggctgtgggaagagcttactacatataaaattggaaaagacccatcctggggatcaggcctatgagtttaaccaaaatggtgagccctacaccctaaacgaggaaagcctctaccagaagattagaatcctagaaaaaccatttgagtatattgaatgtcaaaaagccttccaaaaagacaccgtctttgtcaatcatatggaggagaagccttacaaatggaacggttccgagatcgccttcctgcaaatgtctgacctcacagttcatcaaacatcacacatggagatgaaaccttacgagtgtagcgaatgcggtaagagcttttgtaagaaaagcaaatttatcatccatcagcggacccacaccggagagaaaccttacgaatgtaaccagtgtggcaagtcattttgtcagaaagggaccctgactgtgcaccagcgaacgcatactggcgaaaagccctacgagtgcaatgaatgcggaaaaaacttttatcagaagctccacctgatccaacaccaacggacccattcaggagaaaagccctacgagtgctcatactgtggaaaatcattttgccaaaaaactcatctgactcagcatcagcggacgcacagcggagagagaccctacgtctgccacgattgcggaaagaccttctctcagaaatcggccttgaacgaccatcaaaagattcatactggtgtaaaactgtataaatgctctgaatgcggaaaatgcttttgtcgtaaatctactctaactacacacttgagaacccatacgggcgagaagccgtacgagtgcaatgaatgtggaaaattcttctctaggctctcttatttaaccgtgcattatagaacccactccggagaaaaaccatacgagtgcaacgagtgcgggaaaactttttacctaaacagcgcacttatgaggcatcaaagagtgcatactggcgaaaagccatacgaatgcaatgagtgcgggaagctgttctcccagctatcttacctcactattcaccatcgtacacacagtggcgtgaaaccctatgagtgctcagaatgtggcaagacgttctatcagaactctgcactttgccgtcacagacgaattcacaaaggggaaaaaccatacgaatgctacatttgtgggaagttttttagccaaatgtcctatttgacaatccaccaccgcattcacagtggggaaaagccttatgagtgttctgagtgtggcaagaccttctgccagaacagcgctctgaaccggcatcagagaactcacacaggggaaaaagcatacgaatgctacgagtgcggcaagtgcttctcccagatgtcgtacctcactattcaccaccggatacactccggtgaaaaacccttcgaatgtaatgagtgtgggaaagcgttcagcagaatgagctacctcaccgtgcactataggacccattcaggtgagaagccctacgaatgtacggaatgcgggaagaaattctaccacaagtcagccttcaactcgcaccagcgcattcatagaaggggaaatatgaatgtgatcgacgtgggacgactgctttag

SEQ ID NO: 141064 - DNA, 1173 bp, Artificial Sequence
  Description of Artificial Sequence: Synthetic coding sequence
atggccgagatacacaatggcggcgagctttgcgactttatggaaaacggtgagatcttctccgaacattcttgcctcaatgctcatatgggtacagagaacactggtgatacttacgactgcgacgaatatggggagaatttccccatgctgcacaacagcgcccccgctggagaaacactgtctgtgctgaaccagtgtagaaaggcattttccctgcccccaaacgtgcaccaacgcacttggattggggataaaagcttcgaatatagcgattgtgaagaggccttcgttgatcagagccacctgcaggctaacagaattacccataacggagagacattatatgagcaaaagcaatgcggcagggcatttacctactctacttcgcacgctgtttcagtgaagatgcacacagtagaaaaaccatatgaatgtaaagagtgcgggaaattttttcgatactcaagctatctaaactcccacatgcgcacccataccggggagaagccttatgagtgcaaagaatgtggtaaatgtttcaccgtgtccagtcatctggttgaacacgtgcgaatccacactggcgagaaaccctaccagtgtaaggagtgcgggagggcctttgcaggcaggtccggcctcaccaagcacgtgcgcatccacactggcgagaaaccttatgagtgtaacgagtgcggaaaagcatacaaccggttctacctattgacagaacattttaagacccatacagaggaaaagcctttcgagtgcaaggtgtgtggaaaatcattcaggtctagttcttgcctgaaaaatcacttccgaatccacactgggatcaagccctacaaatgtaaggaatgcggaaaagccttcacagttagctcctcacttcacaatcatgtaaagatccacacaggtgaaaaaccttacgaatgcaaagattgtggaaaggcctttgccacctcttcccagttgatcgagcatatccggacgcatactggcgagaagccatatatttgcaaagaatgcggaaagacattccgggccagttctcatctccagaaacacgtcagaatccacacgggcgagaagccgtacatctgcaacgaatgtggaaaggcttataaccgtttctacttactgaccaagcatcttaaaactcattag

SEQ ID NO: 141065 - DNA, 1032 bp, Artificial Sequence
  Description of Artificial Sequence: Synthetic coding sequence
atggctgagatccacaacgggggcgagctttgcgactttatggaaaacggcgaaatcttctcggaacattcatgtcttaacgcgcatatggggaccgagaataccggtgacacatatgactgcgacgaatatggagaaaactttcccatgctgcacaatagtgcgccggctggagagaccctcagtgttttgaaccagtgtagaaaagccttctcactcccgccaaacgtccatcagcgcacctggataggggacaagagcttcgagtacagcgactgcgaggaagctttcgtcgatcagtcccatctgcaggcaaatcgcatcacccataacggcgaaactttgtacgagcagaagcaatgcggacgtgcatttacgtactcaacttcacacgccgttagcgtgaagatgcatacagtagagaagccttatgaatgcaaagaatgcggcaagttttttcgctacagcagttatctaaactcacacatgcgtacccatactggggaaaaaccatatgagtgcaaggaatgcggcaagtgctttaccgtgtcttcacacctggtggagcacgtgaggatccataccggtgagaaaccttatcagtgtaaggagtgcggccgcgcttttgccggacgctctggactgactaaacacgtgcgaattcacacaggcgagaaaccttatgaatgcaatgagtgcggtaaggcgtacaataggttttatctgttgacagaacacttcaaaactcacactgaagaaaagccctttgagtgcaaagtctgtgggaagtccttcaggtcttcctcttgtcttaagaatcatttcagaattcacacgggcatcaagccctacaaatgcaaggaatgcggcaaagcatttacggtttcttcctccctccacaatcacgtgaagatccatactggcgaaaaaccgtacgagtgcaaagactgcggaaaggcctttgccacctcctctcagctgatagaacacataagaacacacacatgcaatccctctaccttgagaggatag

SEQ ID NO: 141066 - DNA, 870 bp, Artificial Sequence
  Description of Artificial Sequence: Synthetic coding sequence
atgtcgggacatcccgggagttgggagatgaactccgttgcatttgaagatgtggccgttaactttacacaggaagaatgggcccttctggatccatctcagaaaaacctgtaccgggatgtaatgcaggagaccttcagaaacctagcctctatcggtaataagggcgaagaccagtccattgaagatcagtataagaacagctctcgaaatttaagctccttccagatccatcagagaaatcacacaggcgagaaaccttatgagtgtatggagtgcggtaaggccctcgggttttctcgatcactgaatagacacaagaggattcatacgggagagaaacgttatgaatgcaagcaatgtggcaaagctttttctcgctccagccacctcagagatcacgagagaacccatacaggcgagaaaccctacgagtgcaaacattgcggcaaggcctttaggtacagtaactgtctgcactatcatgagaggactcacacaggtgagaaaccctacgtgtgtatggagtgcggcaaggctttctcatgcctgagctccctccaggggcacattaaggcccacgctggcgaagagccatatccgtgtaaacagtgcggaaaagcttttcggtacgcctcatctcttcagaaacacgagaagacacacatagcccagaagccgtacgtgtgcaacaactgcggaaaaggctttcgttgcagtagcagccttcgggatcatgaaaggacccatactggtgagaaaccttatgagtgccaaaaatgtggaaaagccttcagtcgagcttctaccctctggaaacacaagaagacccacacaggcgaaaaaccttacaaatgtaaaaaaatgtag

SEQ ID NO: 141067 - DNA, 939 bp, Artificial Sequence
  Description of Artificial Sequence: Synthetic coding sequence
atgccaaacttcaacctgaacaagaagatcccagctcgggtcaagcctcatgagtgcattgtctgtgaaaaatttttcattagacatagcagtctccatagacacatcatttcacacagcggcaacaatccatatggttgcgaagaatgtggaaaaaagccttgcacatgcaagcagtgtcagaagacgtctctgtccgtcacccgcgtacatagagatactgtgatgcacactgggaatggacattatggatgtactatttgtgaaaaagtgttcaatatccccagcagtttccagatccatcagaggaaccatacaggggaaaagccatacgaatgcatggaatgcggcaaggctctgggcttttctcggtcactcaatcgccacaagcgcatccatactggcgagaaacggtatgaatgtaaacaatgtgggaaagccttttcccggagttctcatcttcgcgatcatgaacgaacccacacgggggagaagccctatgagtgtaaacactgcggcaaagccttcagatacagcaattgtcttcactaccacgagaggacccacacaggagagaagccttacgtgtgcatggaatgcggcaaggcctttagttgtctctcctctctgcagggccatatcaaagcccatgctggagaagagccctacccatgcaagcaatgcggaaaggccttcaggtacgcaagcagcctgcagaagcacgaaaaaactcacattgctcagaagccatacgtttgtaataattgcggaaagggcttccggtgttcttcctccctgcgcgaccatgagaggactcatacgggcgaaaaaccctacgaatgccagaaatgtggaaaggccttctctcgggctagcacgctatggaaacacaaaaagactcacactggagagaagccttacaaatgcaaaaagatgtag

SEQ ID NO: 141068 - DNA, 468 bp, Artificial Sequence
  Description of Artificial Sequence: Synthetic coding sequence
atgaatgctctatgtgttaagaactcctcctaccatagcagcttgcacagacacattatctctcatagtggcaacaacccctatggttgtgaagagtgtggcaaaaaaccatgtacatgcaagcagtgccagaaaacttcactatctgttacacgggtccatagagacacagttatgcatactggtaacggtcactatggctgtaccatatgtgagaaggtcttcaacatcccgtcctcgtttcaaattcaccaacgcaatcatacaggcgaaaagccatatgaatgtatggagtgtggcaaggcactcgggttttcccgctctctgaatcgacacaagaggattcatacaggtgagaaacgatacgagtgcaaaaagtgtggcaaggctttttcacgcgcctcaaccctgtggaagcacaaaaaaacacatacaggcgagaaaccttataaatgcaaaaaaatgtag

SEQ ID NO: 141069 - DNA, 888 bp, Artificial Sequence
  Description of Artificial Sequence: Synthetic coding sequence
atgaacgccttatgcgtcaagaatagctcctatcactcaagtctgcatagacatataatcagccatagtggcaacaatccatacggttgcgaagagtgtggaaagaaaccctgtacgtgcaaacagtgccagaagacatccctgagtgtgacccgtgttcatcgggacaccgttatgcatactgggaacggacactacggttgtacaatctgtgaaaaggtgttcaacatccccagctcctttcagatccaccaacggaatcatactggggaaaaaccatatgaatgcatggaatgtgggaaagctctaggatttagtcgatctctgaaccggcacaagcggatccatacaggcgagaaacgctacgagtgcaaacagtgcgggaaggccttctccagatcctcccacctaagagatcacgagcggactcatacaggagagaagccatacgagtgtaaacactgtggtaaagccttccgctattccaattgcctgcactaccatgaacgcacccatactggcgagaagccctacgtgtgcatggagtgcgggaaagcatttagctgtctttccagccttcagggccatataaaagctcacgctggtgaggaaccatacccatgtaagcagtgcggaaaggcattccgctacgccagtagtctccagaagcacgagaaaacccatattgcccagaagccgtacgtctgtaataactgtggtaagggattcagatgttcgtcctcgctgagagatcatgagcgtacccataccggcgagaaaccttacgaatgtcagaagtgcggcaaagccttctcgcgtgccagcaccctgtggaaacacaaaaaaacacacactggcgagaaaccctataaatgcaaaaaaatgtag

SEQ ID NO: 141070 - DNA, 222 bp, Artificial Sequence
  Description of Artificial Sequence: Synthetic coding sequence
atgtccggtcaccccgggagctgggaaatgaattccgtggcatttgaagacgtggctgtgaactttacccaagaggagtgggctctgctggacccttctcagaagaacctctaccgtgacgtgatgcaggagacgttcaggaacctggcctccatcggtaacaagggagaggaccagtcaatagaagatcagtacaagaatagcagcaggaatctgcggtag

SEQ ID NO: 141071 - DNA, 1770 bp, Artificial Sequence
  Description of Artificial Sequence: Synthetic coding sequence
atggaggcagaggagacaatggagtgcctgcaagagttcccggagcaccacaaaatgatattagaccggctcaacgaacagcgggagcaggaccggttcactgatattaccttgatcgtggacggacatcacttcaaggcccacaaagccgtcctagcagcatgcagcaaatttttctacaagttcttccaggagtttacccaagagcctctcgtggaaatagagggcgtcagtaaaatggcctttaggcacctgatagagtttacatacactgctaagctgatgattcaaggtgaggaagaagcaaatgacgtatggaaggcggccgagttcctgcagatgctggaggctatcaaagctcttgaagtgagaaataaggagaactcggctccactggaagaaaacacaacaggaaaaaacgaggccaaaaagagaaagatcgccgaaacctccaatgtgatcactgagtctctgcctagcgctgagtcagagcctgtggaaattgaagtggagattgcagagggcacaatcgaggtcgaagatgaggggattgaaaccctggaagaagtggcaagtgccaagcagagcgtaaagtacatccagagtaccggctcctctgacgacagtgccctcgccttgctagccgatatcactagtaaatataggcagggtgatcggaaaggtcagattaaggaggacggatgcccgagtgaccccacgagcaaacaagaacatatgaagagtcactctaccgaaagtttcaagtgcgaaatctgtaacaagcggtatttaagggaatcggcttggaagcagcacctgaattgttaccacctcgaggaagggggagtgagtaagaaacagaggaccggtaagaagattcacgtctgtcaatattgcgaaaaacagttcgaccacttcggtcatttcaaagaacatctgcggaaacacacaggagagaagccatttgagtgccctaattgccatgaacgcttcgcgaggaacagtaccctcaagtgtcacctgacggcatgtcaaaccggtgtgggagccaagaagggccggaagaagctatatgaatgtcaggtctgcaattctgtgtttaacagttgggatcagtttaaggatcacttagttatccataccggagacaagcccaatcactgcactttgtgtgacctgtggttcatgcaagggaatgagctgcggcgacatctctcagacgctcacaacatatcggagaggctcgtgaccgaagaggtactgtcggtggaaacccgagtacagactgagcccgtcactagcatgacaattattgagcaagtaggcaaggttcacgttctccccctgctccaggtgcaagtggatagcgcccaggtaaccgtggaacaggtccatcctgacctccttcaggatagtcaggtccatgacagtcacatgagcgagctgcccgagcaggtacaggtctcttatctggaagtcggacggatccagactgaggagggcaccgaagtgcatgtcgaagaattgcacgttgagagggtcaaccagatgcctgtggaagtgcaaacagagctgctggaggccgatctagatcacgtaaccccagaaattatgaaccaggaggagcgggaatcttcccaggccgatgcagccgaagccgctcgcgaagaccacgaggatgccgaagacctcgagacgaagcctaccgttgattccgaggcggaaaaggcggaaaacgaagaccggaccgccctgcctgtgctagaatag

SEQ ID NO: 141072 - DNA, 1872 bp, Artificial Sequence
  Description of Artificial Sequence: Synthetic coding sequence
atggaggctgaagaaacgatggagtgcctgcaggagtttcccgaacatcacaagatgatcctggaccggctgaacgaacagagggaacaggataggtttacggacattactcttattgtcgacgggcaccatttcaaggcccataaagctgtgctggcagcttgctccaaattcttttataagttctttcaggagttcactcaggaaccactggtggaaatcgagggtgtcagtaagatggcctttcggcacctcatcgagttcacttacaccgcgaagctgatgattcaaggcgaagaggaggccaacgatgtgtggaaggcggcagagttcttacagatgcttgaggccattaaagccctggaagttaggaacaaggaaaacagtgctccactggaagaaaataccaccggaaagaatgaagctaagaagaggaaaatcgcagagacctctaacgttattacagagagtttgcccagcgcagagtctgaacccgtcgagatcgaggttgagattgcagagggcacaatcgaggttgaggacgaaggaattgagactttggaggaggttgcatccgctaagcagtccgtgaagtatatacagtcgaccggtagcagcgacgacagcgccctcgcactgctggcggatataacatcaaagtaccggcagggagatagaaaagggcagataaaagaggatggctgccccagtgaccccaccagtaaacaggtagagggtatcgaaatcgtggaattacaactctcccacgtgaaagatcttttccattgtgagaagtgcaataggagctttaagctgttttatcacttcaaagagcacatgaagagtcattcaactgaaagttttaagtgcgagatatgcaacaagcgctatcttagagaatcggcgtggaagcagcatctgaattgctaccatctcgaagaaggaggtgtaagcaagaagcaaagaaccgggaagaagattcatgtctgtcagtattgcgaaaagcagtttgatcactttggccattttaaagagcatttgaggaagcataccggggagaagccattcgagtgcccaaactgtcacgagagatttgctcggaacagcaccctgaaatgtcacctcactgcctgtcagacgggagtgggcgctaagaaggggcggaagaaactttacgaatgtcaggtgtgtaactcagtgtttaacagttgggaccagttcaaggaccacttagtgatccatacaggggacaaacccaaccactgcacactgtgtgacctgtggttcatgcaaggcaatgaacttcgacgacatcttagcgacgcccataacattagcgaacgtctggttactgaggaggtgttgagcgtagagacccgtgtgcagacagaacctgtgacaagcatgacaatcatcgaacaggttggcaaagttcacgtgttacctcttcttcaggtgcaggtggatagcgcccaggttaccgtggagcaggtgcacccggatctactgcaagactcacaagtgcacgatagccacatgagcgagctgccagagcaagtgcaggtctcctaccttgaagtcggacgcattcaaacggaggaaggcacagaggtccacgtggaggagctgcacgtcgagagagtgaatcaaatgcccgttgaagtgcagacagagctcctcgaagccgaccttgatcacgtcacaccggaaatcatgaaccaggaagaaagagagagctcccaggcagacgcagcggaagccgcccgggaggatcacgaagatgctgaggatttggagaccaaacctactgtagacagtgaggcggagaaggccgaaaacgaggaccggacagctctgcctgtgctggagtag

SEQ ID NO: 141073 - DNA, 1770 bp, Artificial Sequence
  Description of Artificial Sequence: Synthetic coding sequence
atggaggccgaagaaactatggaatgtttgcaggagtttcccgagcatcataaaatgattctggaccgactcaatgagcagagggagcaagaccgattcacagatattacactcatcgtggatggacaccattttaaagcccataaggcagtgctggccgcatgcagtaaatttttctacaagttcttccaagagtttacccaggagccgctggtggaaatcgaaggagtgtcgaagatggcctttcgacacctaatagaattcacttatacggctaagctgatgattcaaggggaggaggaagctaacgatgtgtggaaggcggcagagtttttgcaaatgcttgaagccatcaaagccctcgaggtgcgcaacaaggaaaattctgcccccctggaagaaaacactaccggcaagaacgaggcgaaaaagagaaagattgccgagaccagcaatgtcataacagagagtctcccatctgcagagagtgagcccgtcgaaattgaggttgagatcgccgaaggcacaatcgaggtcgaagatgaaggcatcgagacactggaggaggtcgccagcgctaagcagagcgtcaagtacattcagagcactggtagtagcgatgactctgcgctggcattattggccgacattactagcaaataccgacaaggggatcgcaaaggtcaaattaaagaggacgggtgcccatccgacccaactagcaagcaggaacatatgaaatctcactcaaccgaatccttcaaatgtgagatttgcaacaagcgttatctgagggaaagcgcatggaaacaacaccttaattgttaccatctggaggagggtggcgtgagcaagaagcagcgaactggaaagaagatacacgtctgtcagtattgtgagaagcagtttgaccacttcgggcacttcaaggagcatctgagaaaacacaccggtgagaagcccttcgagtgcccaaactgccacgagcgatttgcgaggaacagcacactgaagtgtcaccttactgcttgccaaactggagttggggctaagaaagggcgtaagaaattatatgagtgtcaggtgtgtaattctgtgttcaattcttgggatcagttcaaggatcaccttgtaatccatactggtgataagccaaatcactgtactctgtgtgatctgtggtttatgcagggcaacgagttacgaagacacctgtcagatgcccacaacatatctgaaagactcgtgactgaggaggttctcagtgtcgaaaccagggtccagaccgagcctgttacatccatgacaatcattgagcaggtgggaaaggtgcacgtcctgccccttcttcaagtgcaggtcgacagcgcgcaggtgaccgtggagcaggtgcatcccgacttgttgcaggattcgcaggttcatgatagccatatgtccgaattgccggagcaggtgcaggtctcatatcttgaggtcggacggatccagacggaggaggggactgaagtgcacgtcgaagaacttcatgtggaacgggtgaatcagatgcccgttgaggtgcagaccgagctgctcgaggctgacctcgatcatgtaacacccgagattatgaatcaggaagagagggaatcctctcaggcggacgctgcagaggcagctagggaagaccacgaggacgctgaggatttagagactaaaccaacagtggattcagaggccgaaaaagctgaaaatgaagacagaacggctctgcccgtgctagaatag

SEQ ID NO: 141074 - DNA, 456 bp, Artificial Sequence
  Description of Artificial Sequence: Synthetic coding sequence
atggaggccgaggagactatggagtgtctacaggaattccctgaacatcataagatgatcttagatcgccttaatgaacagcgagagcaggaccgttttaccgacatcacactgattgtcgacgggcaccacttcaaggcccataaggcagtgcttgccgcttgttctaaattcttctacaaattcttccaagaattcacccaagagccgttagtcgagatcgagggcgttagcaaaatggcatttaggcaccttatcgagtttacgtacaccgctaagttgatgatccagggcgaagaagaggcgaatgacgtctggaaagctgcagagttcctccagatgcttgaagccattaaagcgctggaagtcaggaataaagaaaattctgcacctctagaggaaaacaccactggcaaaaacgaagccaagaagcgaaagattgccgaaacaagctag

SEQ ID NO: 141075 - DNA, 1872 bp, Artificial Sequence
  Description of Artificial Sequence: Synthetic coding sequence
atggaagcagaagagaccatggagtgtttacaggaattccctgaacatcataagatgattcttgacaggctaaacgaacagcgcgaacaggatcgattcaccgatataacacttatcgttgacggacaccatttcaaagctcacaaggctgtgttagcagcttgctctaaatttttctacaaattctttcaggaatttacacaggagccactcgtggagatcgaaggtgtctctaagatggcttttcgccatctgatcgagtttacctacactgcgaagctgatgattcagggcgaagaggaagccaacgatgtttggaaggcggctgaatttctccagatgcttgaagctatcaaagccctcgaggtgcggaacaaggagaactcagcacccctcgaggaaaacacaaccggaaagaacgaggcaaaaaaacgcaaaatagctgagacctccaacgtgataacggaatccctgccctccgctgaatcagaacctgtggaaattgaggtagagatcgccgagggtaccatcgaggtggaggacgagggcatcgagactcttgaggaggtcgcatccgctaagcagtcagtgaaatatatccagtcaaccgggtctagtgacgacagcgcactcgcattgctggccgacattactagtaaatacaggcagggagacagaaagggccagatcaaggaagacggctgtccaagtgaccctactagcaaacaggtggaggggatagagatcgtggaactgcagctgagtcacgtaaaggacttgtttcattgcgagaagtgcaatcgtagcttcaaattattttatcatttcaaggaacacatgaaatcccatagcaccgagtcatttaaatgcgaaatctgtaacaagcggtatctccgcgagagcgcctggaagcagcatcttaactgttaccatttggaagaaggtggggtgagcaaaaagcagcgcactggtaaaaagattcacgtgtgtcagtattgcgaaaagcaatttgaccattttgggcacttcaaggaacacttgcgcaaacacacgggagagaagcctttcgagtgtccgaattgtcatgaacgcttcgctcgaaatagcaccctcaagtgtcatctgacggcatgccagaccggcgtgggggcaaagaaagggcggaagaaactttacgagtgccaggtgtgtaacagcgtcttcaactcgtgggatcagttcaaagaccatttggttattcatactggtgataagcccaatcattgcactctgtgtgacctgtggtttatgcagggcaacgagctgcggcgacacttaagtgatgcccacaatatttctgagagattggtcaccgaagaggtcttatctgtggaaacacgggttcagacagaacctgtgacaagcatgacgatcattgagcaggttggcaaggtgcacgtgctgcccttactccaggtgcaagtcgattcagcgcaagtgacggtggaacaggtgcaccccgacctgttgcaggatagtcaagttcacgacagtcatatgagcgagttacccgagcaggtgcaggtttcttatctggaggtaggccgtattcagactgaggagggaaccgaggtccatgttgaagagctgcatgttgagcgcgtgaaccagatgcctgtggaagtacagaccgagttactggaggccgatctagaccacgtgacaccggagattatgaatcaggaggaaagggaatcttctcaagctgatgcagcagaggctgcaagggaggaccacgaagatgctgaggacttagagacgaaaccaaccgttgattctgaggccgagaaggccgaaaatgaggacagaaccgctttgccagtgctggagtag

SEQ ID NO: 141076 - DNA, 420 bp, Artificial Sequence
  Description of Artificial Sequence: Synthetic coding sequence
atggaagctgaggaaacaatggagtgcctgcaagagtttccagagcaccacaaaatgattttggatcggctgaatgagcagagagaacaggacagattcaccgatatcactcttatagttgatggccatcactttaaggctcataaagcagtcctggcagcttgctctaagtttttctacaagttcttccaggaatttacacaggagcccctcgtcgagatagagggggtttccaaaatggcatttcggcacctaattgagtttacatacaccgcaaagctgatgatccagggggaagaagaagcaaatgatgtatggaaggcagcggagtttttacagatgctcgaggcaattaaggccctggaggtgaggaataaagagaattctgcaccactggaggaaaatacaacgggcaaatag

SEQ ID NO: 141077 - DNA, 1770 bp, Artificial Sequence
  Description of Artificial Sequence: Synthetic coding sequence
atggaggcagaggaaacaatggagtgtctgcaagagtttcctgagcatcataaaatgatcctcgaccgcctcaatgagcagcgtgagcaagatcgtttcaccgacatcactctcattgtcgacggacatcacttcaaggcccataaagccgtgctagccgcatgttcaaaattcttttataaattctttcaagagtttactcaagaacccttggtggagattgagggagtctccaagatggcattccgccacctaatcgaatttacttacaccgctaagctcatgattcaaggcgaagaagaggcaaacgatgtgtggaaagccgcagagttcttacaaatgctcgaagccatcaaagcactggaagtaagaaataaggaaaactccgctcccctagaggaaaacacaacagggaaaaatgaggccaaaaagcgaaagatcgcagagacaagcaatgtaatcaccgagagcctcccatccgccgaatcagagcccgttgaaattgaggtcgagattgctgagggaacaatcgaggtggaagacgagggaattgaaacactggaagaagtggcctctgcgaaacagtcagtgaaatatatccagagtactggatccagtgatgacagtgccctggccctgcttgctgatattacgtccaagtaccgccaaggggatagaaaaggtcagattaaagaagacgggtgtccgagcgatcctacttccaagcaggaacacatgaagagccattcgaccgaatctttcaagtgtgagatttgtaataagcggtatttgagggagtcagcctggaaacagcaccttaattgctaccacttggaagagggaggagtgagcaagaaacagaggaccgggaagaaaattcatgtctgtcagtactgcgagaaacaattcgaccattttggacacttcaaagagcatcttaggaagcataccggtgagaaaccattcgagtgtccgaattgccacgaaagattcgccaggaattccaccctgaaatgtcatctgacagcttgtcaaacaggagtcggtgctaagaaaggacggaagaaactgtatgaatgtcaggtgtgtaactcggtgttcaattcatgggaccagtttaaagatcaccttgtaattcataccggcgacaaaccaaaccactgtacactctgcgatctttggtttatgcagggtaatgagctgcgacgccatctatctgacgcccacaacatatccgagagactggtaaccgaggaggtgctatcagtggaaactcgcgtgcagacagagccagttacaagcatgaccataatagagcaggtaggcaaggtgcacgtcctgcctttgttacaggtccaggtcgactccgcccaggtgaccgtagagcaggtgcacccagacctcctccaggactcacaggttcacgactcacacatgtcggagttgccagaacaggtccaagtgagctacctggaggtcggacggatccagaccgaggaagggacagaagtgcacgtggaagaacttcacgttgaacgcgttaaccagatgccggtggaggtacagacagagctgttggaagccgatctggaccatgtaacgccagagatcatgaatcaggaagagcgagaatcttcacaggccgatgccgccgaggcagcccgggaggatcacgaggatgctgaggacctcgagactaagcccaccgtcgactccgaggctgaaaaggccgagaacgaagaccggaccgctctgccagtcttagaatag

SEQ ID NO: 141078 - DNA, 798 bp, Artificial Sequence
  Description of Artificial Sequence: Synthetic coding sequence
atggaagcagaggagaccatggaatgtctgcaagagttccccgagcaccacaaaatgatcctagatcggctaaacgagcaacgggagcaggaccgttttaccgacattactctcattgttgatgggcaccacttcaaggctcacaaagccgttctggccgcttgttccaagttcttctataagttctttcaggaatttactcaggaacctctggtcgagatagagggtgtgtcgaaaatggctttccgtcacctcatcgaattcacctacaccgccaaactcatgatccagggcgaggaagaagccaacgatgtgtggaaggcagcagagtttttgcagatgttggaagccatcaaggccctcgaggtgcggaacaaggaaaattctgccccgttagaggaaaatactactggcaaaaatgaggccaaaaagcgtaagatcgccgaaacctccaacgttatcaccgaatctttgccgtcagctgagtcagagcccgtcgagatcgaagtggaaatagcagagggcactattgaggttgaagatgaggggattgagactttagaggaggtggcctccgccaagcaatctgtcaagtacatccagagcacaggcagctcagacgattctgctttagccctccttgctgacataacctctaagtataggcaaggcgatcgcaaggggcaaatcaaggaggacgggtgtccaagcgaccctacatccaaacaggagcatatgaaatcacattcgactgagtcttttaagtgcgaaatttgcaataagcgctatttaaggtag

SEQ ID NO: 141079 - DNA, 2121 bp, Artificial Sequence
  Description of Artificial Sequence: Synthetic coding sequence
atggctctgccttcaccccaagtgctgatgggtctgcccgctctgttaatgggtcccgcacaacacacctcttggccctgcggttccgctgtgcctacactgaaaagcatggtaaccttcgaggatgttgccgtgtatttttcccaggaggaatgggaattattggatgccgcccagcggcacctctaccacagtgttatgctcgaaaatctcgagctggtgacatcactgggaagctggcatggggtcgagggggaaggtgcccacccaaaacaaaatgtgtctgtcgaagtactacaggtgcggatccccaacgctgatccttccaccaagaaggccaacagctgtgacatgtgcggtccattcctgaaggatatcctacacctggccgaacaccagggaactcagtcagaagaaaagccctatacttgcggagcgtgcggtcgtgacttttggctcaacgctaatcttcatcagcatcagaaggaacactcaggcggcaaaccatttagatggtacaaagaccgcgacgcactgatgaaatcttcaaaggtgcacctgagtgagaacccatttacctgcagagaggggggcaaagttatccttgggtcgtgtgatttacttcagttgcaagccgtagattctggtcagaagccatactctaatcttggccagctgcccgaggtgtgtaccacacagaagctgtttgaatgcagcaattgtggcaaggcctttttgaagtcatccactttgccaaaccacctccggactcactctgaggaaattccttttacatgtccaaccggcgggaacttcttggaagagaagagcattctgggcaacaaaaaattccatactggggagatccctcatgtgtgtaaagaatgcgggaaagctttctcccactcttcgaagctgcgtaaacaccagaagtttcatactgaggtcaaatattatgagtgcatcgcctgtggaaagaccttcaatcacaaattgacctttgtccaccaccagagaattcacagcggtgaacgaccatacgaatgtgatgaatgcggcaaggcatttagcaaccggtcccacctcattagacatgaaaaagtgcacacaggtgagcgtccattcgagtgtctgaagtgcggtcgcgcatttagtcaaagtagtaattttttaagacaccagaaggtccatactcaagtgcgaccttatgagtgcagccagtgtggcaagtccttcagccggtccagcgccctgattcaacactggcgtgtgcacacaggagaacggccttatgagtgctcagaatgcggaagggcgttcaacaataattcgaacttagctcagcaccagaaagtgcacacaggcgagcgccccttcgaatgctcagagtgtggtcgggactttagtcagagcagccatctgctgcggcaccagaaggtacatacgggtgagcggccattcgagtgctgcgattgtggaaaagccttctccaacagcagcacactgattcagcatcagaaagtgcacacagggcaaaggccatatgagtgcagcgagtgccgtaaatcattctcccggagttcttctctgatccaacattggagaattcacaccggggagaagccgtacgaatgtagcgagtgcggcaaagcgttcgcgcatagctccaccctgattgagcattggcgggtccacaccaaggagcgtccctatgaatgcaatgagtgcggcaaatttttctcacagaatagtatccttatcaaacatcagaaagtgcacacgggagagaaaccctacaaatgctccgaatgcggcaagttcttctcaaggaagtcttctctgatctgccactggagggtccatacaggagaaaggccatacgagtgtagcgagtgcggaagggccttcagctccaactcacacctagtcagacatcaaagagtgcatactcaagaaaggccctatgagtgcatccagtgcgggaaggccttcagtgaacgatcaaccctagtacgacaccagaaggtacacacgcgagaacgcacgtacgagtgcagtcagtgtggtaaactgttcagtcacctgtgcaacttggcacagcataagaaaattcacacctag

SEQ ID NO: 141080 - DNA, 1191 bp, Artificial Sequence
  Description of Artificial Sequence: Synthetic coding sequence
ccaactctgaagagcatggtcacattcgaagatgtggcagtgtatttcagccaagaagagtgggagctactggacgccgcacaacggcacttatatcactcagtgatgcttgagaatttggaactggtcaccagcttgggtaatgctctgtcacaacacgtgtgccttttccccattgagtccagcgtgcaccctaaggccagatcctgggtgcttctcccctccagagtctcatgttgcagatgctggggcgccgaggtcctgttaggtgtagaaggcgaaggagctcacccaaaacagaacgtaagtgtagaggttctgcagcatcagaaagaacattccggaggcaaaccattccgctggtacaaagatagctccggtcagaagccatacagcaatctcggccagctgccagaggtgtgtacaacccagaagctatttgaatgtagtaactgcggcaaggccttcctcaagtcatcaacgctgcctaaccatctgcgaacgcattctgaggaaatcccctttacttgtcctacaggaggaaattttttggaagagaagagtattcttgggaacaaaaaattccatacaggagagatcccacacgtctgtaaagaatgcggcaaggcattctcacacagctctaagctgaggaagcaccagaagtttcataccgaggttaggccttatgaatgctctcaatgcggaaagtctttttctcgtagctccgctcttatccagcactggcgcattcacacaggcgagaagccgtacgagtgctccgagtgcggcaaagcgttcgcacacagctcgactctgatcgagcattggagagtgcacaccaaggaaaggccttacgagtgtaacgaatgtggcaaattcttctctcagaactccattctgattaagcatcagaaagtgcacaccggcgaaaaaccctacaaatgttcggagtgcgggaaattcttcagtagaaagagctccctgatctgccactggcgagtgcacacaggcgagaggccatatgagtgtagcgagtgcggtcgggcattctccagtaacagtcacctggtgaggcaccagcgcgtgcacacgcaggagcggccatatgaatgtatacagtgtggcaaggctttttccgagaggtccactctggtgcgacaccagaaggttcatacacgagagagatag

SEQ ID NO: 141081 - DNA, 1965 bp, Artificial Sequence
  Description of Artificial Sequence: Synthetic coding sequence
atggcgttcagagatgtggcggtggacttcacacaagacgagtggcggcttctcagccctgctcagaggaccctgtacagagaggtgatgttagagaactactctaacctagtcagtctgggcatctctttcagcaagccagaattaatcacccaactagagcagggcaaggaaacatggcgggaggagaagaagtgtagcccagctacttgtcccgccgaccctgagcccgagctttatctggacccattttgccccccgggtttctcctcacagaaattcccgatgcagcatgtgttgtgcaatcacccaccctggatatttacctgcttgtgtgctgaggggaacatccagccaggcgaccctggcccaggcgatcaggaaaagcaacagcaggcttccgaaggacggccctggagcgaccaggctgagggccccgagggcgagggtgcgatgcccttatttggtcgcaccaaaaaacgaacgttgggcgctttcagccgtccgcctcagcgccaacccgtgtccagtcggaacggcctcaggggagtggagctagaggcctcacctgcacaaagcgggaatccagaagagaccgataagctcctgaaacggatcgaggtgctggggttcggaacggtaaattgtggggagtgtgggctgtctttctctaagatgacaaacctcctttcacatcagcgaatacacagcggagaaaagccatatgtctgtggcgtgtgcgaaaaaggtttctccttaaagaagtcgctcgctcgccaccagaaagcccactcgggcgagaaacccatagtgtgccgggagtgcggaagggggtttaaccgcaaatctactctgatcattcacgagcgtacccactcaggagaaaagccctacatgtgtagcgaatgcggcaggggtttcagtcagaagagcaatctgatcattcaccagaggacccattcaggggaaaagccctacgtctgcagggagtgcggcaaggggttttcccagaaaagtgccgttgtcagacatcaacgcacccaccttgaggaaaaaacgatcgtttgctcagactgtgggctcggcttttccgatagatcaaacctcatatctcatcagcgtacccattcaggagagaaaccttatgcatgtaaggaatgtggcagatgtttcaggcagcgcacaaccctggtaaatcaccagagaacgcactcaaaggagaaaccatatgtctgtggggtgtgcggacactccttcagtcagaattccacattaatcagtcaccgtcgcactcacaccggagagaagccttatgtttgcggagtttgcggacgcggatttagccttaaatctcatctgaataggcatcagaatatccacagcggcgaaaagccgattgtgtgtaaagactgcggcaggggcttttctcaacagtctaaccttattcgtcaccaacgcacacacagtggtgagaagcccatggtgtgcggagaatgcggaaggggcttctctcagaagtctaacttagtcgcacaccagagaacgcattccggagaaaggccgtacgtctgtagagagtgcggtcgcgggtttagccatcaggccggattgatcagacacaaacggaagcactcaagggagaaaccttacatgtgcaggcagtgtggactcggattcggaaataaatcagccctgattacgcataagcgcgctcattccgaggagaagccgtgcgtgtgccgagagtgcggccagggtttcctccaaaaatctcacttgaccctccaccagatgacccacactggtgagaaaccttatgtgtgcaagacctgcggtcggggattctcattgaagtcgcatttatcccgccatcgaaagactactagcgtgcatcaccggctcccagtgcagcctgaccctgagccctgtgctgggcagccctcagactcactgtatagtctgtag

SEQ ID NO: 141082 - DNA, 300 bp, Artificial Sequence
  Description of Artificial Sequence: Synthetic coding sequence
atggcattccgagacgtcgccgtggactttacccaggacgagtggcggttgttatcccccgcccaacgcactctctaccgggaggtcatgcttgagaactattctaatctggtgtccctgggaattagcttctctaaacctgagctgattactcagctggaacaaggaaaggagacctggagggaagagaaaaagtgtagtcctgctacgtgccctgaccaccaagaatacggtaacaactgtgacttacagaaagaggccgaccctgaacccgagctgtatttggaccctttttgctag

SEQ ID NO: 141083 - DNA, 1962 bp, Artificial Sequence
  Description of Artificial Sequence: Synthetic coding sequence
atggctttcagggacgtggctgtcgatttcacacaggatgagtggcgattactctctccggcacagcgtactctgtacagggaagtcatgctggaaaattatagtaacctggttagcttaggaatcagcttcagcaagcctgaactcatcacacagctcgagcagggcaaggagacttggcgcgaagaaaagaagtgttcgcccgcaacctgcccagatcccgagccggaactgtacctggacccattttgcccacctggattcagctcccaaaagtttcctatgcagcacgttctgtgtaatcatcccccttggatcttcacgtgtctctgtgctgaagggaatattcaacccggagatccaggaccaggagaccaggaaaaacaacagcaggcgtccgaaggccgtccatggagcgaccaagctgaggggcctgagggcgagggtgcgatgcctctgttcggacggaccaagaaacgcaccttgggggctttctccaggccgccccagcggcagcccgtctcctccagaaacggactcagaggggtcgagctcgaagcaagtcccgctcagtccggaaacccggaggagaccgacaaactcctcaagcgtattgaggtgcttggatttggaactgtcaactgcggagagtgtggactgtcttttagtaagatgaccaatctcttgagccaccagaggatccactccggagagaagccttacgtgtgcggcgtgtgtgagaagggattcagcttgaagaaatcccttgcgagacatcagaaagctcattccggcgagaaacccatcgtgtgtagggagtgtgggcgggggtttaatcgcaagtccacgctgattatacacgaacgcacccactccggagagaaaccatatatgtgttcagagtgtgggcgcggcttttcacaaaaaagcaatctcattatacaccagagaacccactccggggaaaaaccttatgtatgccgagaatgcggtaaaggattttctcagaagtcagccgttgtgagacaccagcggacccacctggaggagaagactattgtctgtagtgattgtggcctgggcttctcagatagatcgaacctgatcagccatcaaaggacacatagcggggagaaaccctatgcctgtaaagagtgcggtcgctgctttaggcagcggactacactcgtcaatcatcagcgcactcattccaaggagaagccctatgtgtgtggggtttgcggccactcgttctcgcagaatagtacgctcatatcgcacagacgtacccacactggcgaaaaaccttatgtctgcggagtgtgtggacgaggcttcagtctgaaaagccacttaaaccgacatcaaaacatacactcaggtgaaaagccgatcgtttgcaaagattgcgggaggggtttttcccagcaatccaacctgatccggcaccagcgcactcactccggtgagaagcccatggtctgtggtgagtgtggtcggggtttcagccagaaaagcaatctcgtggctcatcagcgaacacatagcggagagcggccctatgtgtgccgggagtgcggacgaggattttcgcatcaggctggactcatcaggcacaaaaggaagcattcacgcgagaagccttacatgtgccggcaatgcgggttaggcttcggaaacaaatcagcactcattacacacaaacgagcccatagcgaggaaaagccttgtgtgtgtcgcgaatgcggccagggctttttgcaaaaatctcacctgacccttcaccagatgacccatacaggcgagaagccatatgtgtgtaaaacttgtggcaggggattctctttgaagtctcacctgtcaaggcatagaaagactacctccgtgcatcacaggctacccgtccaaccagaccccgaaccatgtgccggtcagccatccgatagcctgtatagtctgtag

SEQ ID NO: 141084 - DNA, 1974 bp, Artificial Sequence
  Description of Artificial Sequence: Synthetic coding sequence
atggctcatatggcttttcgcgacgtggcggttgacttcacacaggatgagtggcgcctgctcagccccgctcaacggaccctgtatagggaagttatgcttgagaactactctaatctggtaagccttggaatcagcttcagtaagccagagcttatcacccagcttgagcagggaaaggagacatggcgcgaggaaaaaaagtgttcccctgcaacatgccctgcagaccctgaaccagagttatatctggatccattctgtcccccaggattttcctctcaaaaatttcccatgcagcacgtgctgtgcaaccaccctccttggatcttcacttgcttatgtgccgaaggtaatattcagccaggtgaccctggcccgggcgaccaggagaaacagcagcaagcttccgaaggcagaccctggtccgatcaagcagaaggccccgagggcgagggggctatgccgttatttggaaggaccaagaagagaacactgggcgccttcagccggccaccacaaaggcaaccagtttccagcaggaacggactgcgtggcgttgaactggaggcatcacccgcccaatccgggaatcccgaagaaaccgacaaactgttaaagcgcattgaggtgttggggtttggtacagtgaactgtggcgagtgtggtctgagttttagtaagatgactaacctgctgtctcatcagagaatacattcaggagagaaaccatacgtttgtggcgtctgtgaaaaaggcttctccctgaagaaatcccttgccagacatcagaaggcccactctggagaaaagcccatcgtgtgccgcgagtgcggacgaggatttaacagaaaaagtacactcataattcacgaaagaacgcactctggcgagaagccatatatgtgtagcgaatgtggaagaggattttcccaaaaatccaacctgataattcaccagcgaactcatagtggggagaagccttatgtctgcagagaatgtgggaaggggttttctcaaaagagcgcagtcgtcagacaccagcggacgcacctagaggaaaagaccatagtgtgttctgactgtggtctgggcttctctgacagaagcaatctcatttcccaccagaggacacactccggggaaaaaccctatgcctgcaaggagtgcggaagatgcttcaggcaaaggacaacccttgttaatcaccagcgaacacactcaaaggaaaagccatacgtgtgtggggtctgcggacactcctttagccagaacagtacactaattagtcatagaagaactcataccggggaaaagccatacgtctgcggagtgtgtggaagggggttctctttaaaaagtcatctcaaccgacatcaaaatatccactccggagaaaagcccattgtctgtaaggactgcgggcgggggtttagccagcagtctaacctaatccgccaccagaggactcacagtggtgagaagcccatggtatgcggagagtgcggccggggatttagtcaaaaatccaatctagtcgctcaccaaaggacccactctggagaacgaccctacgtgtgtcgggaatgtgggagaggcttttcgcaccaggctggcctaattcggcacaagcgcaaacattctcgggaaaagccttacatgtgtcgacaatgcgggctcggtttcggaaacaagagcgcccttatcacacacaagcgggcccattcagaggaaaaaccctgcgtctgtcgcgaatgtggtcaaggattcctgcagaaatcccacctcaccctccaccagatgacacacacgggcgaaaagccttacgtgtgtaagacctgcggccggggtttcagcctgaaaagtcatttgagcaggcacaggaagaccacctcagtgcatcacagacttcctgtgcaacctgatccggagccttgtgccggacaacctagtgactctctctatagcctgtag

SEQ ID NO: 141085 - DNA, 1965 bp, Artificial Sequence
  Description of Artificial Sequence: Synthetic coding sequence
atggcgttccgcgacgttgccgtggatttcacacaggacgagtggagactgctgtcccctgctcagagaacgctctacagagaggtaatgctcgagaattacagtaacctggtgtctctggggatatctttttctaagccagaactgattacccaattggagcaagggaaggagacgtggagagaagaaaagaagtgttctcctgccacatgtcctgccgacccagagccagagctgtatttagacccattctgtcctcctggattttctagccagaagttccccatgcaacacgtgctttgcaatcatcctccatggatttttacatgcctgtgcgccgagggcaatatacagccgggcgatcctggcccaggggaccaagaaaagcaacagcaggcatcagagggacgtccttggagtgatcaggctgagggtcctgagggtgaaggcgccatgccactgtttggccggactaagaagcggacgttgggcgctttttcaagacctcctcaacgccaacccgttagctccagaaatggtctgcgcggtgtggaactcgaagcttccccagcccagtctggtaatcccgaggaaactgacaagcttctaaaaaggattgaggtgctcggatttggtacagtcaattgtggcgaatgtggtctttcgtttagcaagatgacaaacctcctgagccaccagcgaattcatagtggagaaaaaccctatgtctgcggtgtgtgtgagaaaggtttctccctgaaaaagagtcttgctcgacatcagaaggctcactctggagaaaagccgatagtgtgcagagaatgtggaagagggttcaacagaaaatctactcttatcatccacgagcgaacccactcaggggaaaagccctacatgtgcagcgaatgtggcagggggttttcgcaaaagagcaatttgatcatacaccagcggacccatagtggagagaagccgtatgtctgccgggagtgtggaaaggggttctcccagaagtcggccgtcgtgcggcatcaacggacccatcttgaggaaaagactatcgtgtgctctgattgtggcttagggttcagcgacagatctaatctaatttctcatcagcgtacccacagtggagaaaaaccatacgcatgcaaagaatgcggccgttgctttcgccagcgaaccactcttgtcaatcaccagcgtactcactcgaaagaaaaaccctatgtctgtggagtgtgcggccacagcttctcccagaattccaccctgatttctcacaggcggacgcacaccggagagaaaccatatgtgtgcggagtctgtggtcggggctttagcctgaaatctcacctgaacagacaccaaaacatccatagtggcgagaaaccaatcgtatgcaaggattgcggaagggggttctcccagcagtcaaatttgatcagacaccagagaacccatagcggcgagaagcccatggtgtgtggagagtgtgggagagggtttagccaaaagtcaaaccttgttgctcatcagcggactcatagcggagagcgcccgtatgtgtgcagagaatgcgggcgggggttttctcaccaggccggattgatccgccacaaacggaaacattcccgcgaaaaaccttatatgtgtagacagtgtggcttgggctttggcaacaagtccgcacttataacacataagcgcgcccattccgaggagaagccttgcgtttgtagagagtgcggacaagggtttctgcaaaagtcccacctaacgctccaccagatgacgcacacaggcgaaaagccatacgtgtgcaagacctgcggcagggggttcagccttaaatcgcatctctctcggcatcgcaagactacatctgtgcaccatcgtctgcccgtgcaaccggacccagagccatgtgctggacagccaagcgactcgctgtatagcttgtag

SEQ ID NO: 141086 - DNA, 1776 bp, Artificial Sequence
  Description of Artificial Sequence: Synthetic coding sequence
atgtgtaacggacgaaaaactgtgttggcagacccggaacctgaactatatttagatcctttttgccctccaggattttcatctcagaaattccctatgcagcatgtgctctgtaatcacccaccttggattttcacttgtttgtgcgccgaaggcaatattcaacccggcgacccaggcccaggggatcaggaaaagcagcagcaggcgtccgaaggccgtccatggagcgatcaggctgagggccctgaaggcgaaggtgcaatgcctctgttcggacgaacaaaaaagaggacattgggagcattcagccggccaccgcaacgccagccagtgtcctcacggaacgggctccgtggggtggagctggaggcgtcaccggctcaatctgggaacccggaggagacagataaactgctgaagcgaattgaggtattggggttcggaacagtgaattgcggagagtgcgggctaagcttctcaaaaatgaccaatctgctgagccatcagcgcattcactctggcgaaaaaccctatgtctgtggcgtgtgtgaaaaaggattctctctcaaaaaatcgctggcccgacaccagaaggcccactccggggagaagcccatcgtatgccgggagtgtggccgtggcttcaacaggaagtcgactttgatcattcatgaaagaacacatagcggcgagaagccttatatgtgctctgaatgcggtcgggggttctcacaaaaatcaaatctgattattcaccagaggacccactcaggagagaagccatatgtgtgcagagagtgcgggaagggcttttcccagaaatctgctgtagtgcgacatcagcgcactcatctggaagagaagaccatcgtttgttccgactgcggactaggattctccgatagatcgaaccttatttcacatcagcggacacattccggagagaaaccttacgcttgcaaggaatgcggacgttgttttcggcagaggacaacactggtgaatcatcagcgcacgcactctaaagaaaagccatatgtgtgtggtgtctgtgggcattccttctcccagaatagcacattgatatcacaccgccggacgcacacaggcgagaagccgtacgtgtgcggggtgtgtgggagaggattttcactgaagtcacacctgaaccgacaccagaatatacatagcggagagaagcctatcgtctgcaaggactgcggcaggggtttttctcagcagagtaaccttatccggcaccagagaacccatagtggtgagaagccaatggtttgcggagagtgtgggcgggggtttagccagaagagcaacctcgtggcacaccagcggacccacagtggcgagcgaccttacgtgtgccgagagtgcggcagagggttcagtcatcaggcagggctgatacggcataagaggaaacacagcagagagaaaccttacatgtgccggcaatgtggccttggctttgggaacaaaagcgcgctcattacacataagagggctcatagcgaagagaaaccttgcgtatgccgagaatgcgggcaggggttcctgcagaagtctcacctcaccctgcatcagatgacgcacaccggagagaaaccctacgtgtgcaaaacctgcggccgcggctttagtcttaaatcccacctgagcagacaccggaaaacaacatctgtgcaccacaggttacctgtacagcctgacccggagccttgtgctggccagccttctgacagcctctattccctctag

SEQ ID NO: 141087 - DNA, 540 bp, Artificial Sequence
  Description of Artificial Sequence: Synthetic coding sequence
atggcctttcgagacgtcgcggtcgattttacgcaggacgagtggcggctgctgtccccggctcagcgtaccctttaccgcgaggtcatgttggaaaattatagtaacctcgtgtctctggggatcagcttctctaaacccgagctcatcacccagcttgaacagggaaaagagacttggagggaggaaaaaaagtgcagtcctgcaacttgccccgccgatccagagccagaattatatctcgatcctttttgccccccgggcttttcctcccagaagtttcccatgcagcacgtgctgtgtaatcaccccccatggatctttacatgtttatgtgcggagggaaacatacagcccggggaccccggcccaggcgaccaagagaaacagcagcaggccagcgagggacgcccttggtcagaccaagccgagggacccgaaggggagggcgctatgcccctgtttggccgcacgaaaaagaggactctcggagccttttctcgaccaccacagagacagcctgtcagctctcgcaactag

SEQ ID NO: 141088 - DNA, 432 bp, Artificial Sequence
  Description of Artificial Sequence: Synthetic coding sequence
atggcttttcgcgacgtcgctgtcgattttacccaagatgagtggcgcctgctgtcacctgctcagcgcaccctctacagggaggtgatgctggagaactatagtaatctcgtctctctcgggatctccttttctaagcctgaattgatcacgcaattggagcagggcaaggaaacatggagagaagaaaaaaagtgctcgcctgcgacttgtcctgcggaccctgagcccgagctgtacctcgaccctttctgtccacctggttttagttcacagaagttcccaatgcagcacgtactgtgcaatcaccctccatggatcttcacatgcctctgcgcagaggggaatattcagccaggcgatccaggccccggggaccaagaaaaacaacagcaggcctctgaagggagaccttggtcagatcaggcctag

SEQ ID NO: 141089 - DNA, 1680 bp, Artificial Sequence
  Description of Artificial Sequence: Synthetic coding sequence
atgcaacatgtgctgtgtaatcaccccccctggatctttacctgtctgtgtgcggaaggcaacatccaacctggcgaccctggtccaggggatcaagaaaaacagcagcaggcaagcgagggcaggccctggtctgaccaggccgaggggcccgaaggagagggcgctatgcctctgtttggtcggactaaaaaacggaccctaggcgcttttagtcgccctccccaacgacaacccgtctcctcgcggaacgggctgagaggcgtcgagctcgaagctagcccggcccagagtggtaatccagaagagaccgacaagcttttgaaaagaatcgaggtactcggatttggcaccgtaaactgcggcgaatgcggtcttagtttctcaaaaatgactaatctgctgtcacatcaacggattcactctggtgagaagccttacgtctgtggagtgtgcgaaaagggcttcagccttaaaaagagtttggctcgccatcagaaagctcactcaggtgagaagcccatcgtctgccgggaatgcggacgggggtttaaccgcaagtccactctgataattcacgagaggacacacagcggagaaaaaccctacatgtgtagcgaatgcggccgtggattctcccagaaatcaaacttgatcattcaccaaaggactcacagcggtgagaaaccctacgtgtgcagagaatgcggaaagggcttttctcagaagagcgcagtcgttcggcatcagcggactcacctggaggagaagacaatcgtgtgctctgattgcggcttgggctttagcgataggagtaatctcatttcccaccaaagaacccactcaggagagaaaccttacgcctgtaaggagtgcggaagatgtttccgtcagagaaccacattggtcaatcatcagcggacgcactccaaggaaaagccgtacgtttgtggcgtctgcggccactccttctcccagaatagtacactgatttcccaccgacgcacccacacgggcgagaaaccctacgtttgtggagtctgcggcagaggtttttctctgaaatcccacctgaacaggcaccagaatatccacagcggagagaaaccaatcgtgtgtaaggactgtggtcgcggattttcgcaacagtcaaacttgatacgccaccagagaacgcattctggcgaaaaacccatggtgtgtggcgaatgtggtcggggattcagtcagaagagcaatctggtagcccatcagcgaactcactcaggcgaaagaccttacgtttgccgagaatgcggcagggggtttagtcaccaggccggacttattagacacaaacgtaaacactcccgcgaaaaaccatatatgtgtaggcagtgcggactaggatttggaaataaatcagcgttgataacccacaagcgtgcacactcagaagaaaaaccctgcgtgtgtcgggaatgtggtcaaggttttctgcagaaatcacacctgaccctgcaccaaatgacgcatactggagaaaagccatatgtctgcaaaacttgtggacggggcttttctttaaaaagccacctaagccggcaccgcaaaaccacatccgtgcaccacagactgccagtccaacccgaccctgaaccatgtgccggccagcccagcgatagtctgtactccctttag

SEQ ID NO: 141090 - DNA, 1680 bp, Artificial Sequence
  Description of Artificial Sequence: Synthetic coding sequence
atgcagcacgtgctgtgcaatcacccaccatggatattcacatgcttatgcgccgagggcaatatccagcccggtgatccagggcctggtgaccaggaaaaacagcagcaggcatctgagggacgaccctggtccgaccaggcagaggggcccgagggagaaggggcaatgccactctttgggaggacaaaaaaacggaccctcggtgctttttcacggccccctcaacggcagccagtatcctcaagaaacggcctgaggggagtcgagcttgaagcctccccagcccaaagtgggaatcccgaggagaccgataagctgcttaaacgcatcgaagtgctgggctttggtacagtgaactgcggtgagtgcggtcttagcttcagtaaaatgacgaatctgctgagccaccagcgtattcactctggcgagaagccctatgtgtgcggtgtgtgtgagaaaggattttctcttaagaaatcactggctaggcatcagaaagcgcacagtggagaaaagcccatcgtgtgtagggagtgcggccgcgggttcaaccgcaaatccactcttatcatccatgagaggacgcactccggcgaaaaaccctacatgtgcagtgagtgtggacggggatttagccagaaatctaatctaattatccaccagcgcacacattcaggggaaaaaccctatgtttgtagggagtgtggaaaaggcttctcgcagaagtccgctgtcgttagacaccagagaactcacctggaggagaagaccattgtttgtagcgactgtggtctgggtttttcagatcggagtaacctcatcagccatcagcggacacactcaggggaaaaaccgtatgcttgcaaggaatgcgggcgctgttttagacagcgcacgacattagttaaccatcagcgcacccattccaaagagaagccttacgtttgtggcgtttgcgggcatagtttctcccaaaacagtacactcatatcccatagaaggacacataccggcgaaaagccatacgtgtgcggtgtgtgcggaagaggattttcacttaagtctcacttgaatcggcaccagaacattcactcaggcgagaagcctatcgtgtgcaaagattgtgggagaggattttcccagcagagcaatctgattcgccatcagcgtactcactcaggagagaagcctatggtgtgcggtgagtgcggacggggattctcccagaagtccaatcttgtcgcccaccagaggactcatagcggagagcgcccctatgtctgtcgcgagtgtggacggggtttttcacatcaggcgggtttaatccgacacaagcgcaaacactccagagaaaagccctatatgtgcaggcagtgtggtcttggcttcggcaacaagtccgccctgatcacccacaaaagggcgcactctgaggagaagccatgcgtgtgtcgcgaatgtggccagggatttctgcagaaatctcacctgaccttgcaccaaatgacacatacaggagaaaaaccttacgtctgtaaaacatgcggacgaggattttcccttaaatctcatttgagcagacatagaaagactacaagcgtgcatcacagactgcctgtccaaccagatccagagccttgtgcaggccagccttcagactccctctactcactttag

SEQ ID NO: 141091 - DNA, 1284 bp, Artificial Sequence
  Description of Artificial Sequence: Synthetic coding sequence
atgaccctggtcacggcaggtggagcttggaccggacccggctgctggcacgaagtgaaagacgaagagagttcgagcgagcagagcataagcatcgcagtgtcacacgttaacacatccaaggccggcctgccagcccagacagccctgccctgcgacatctgtggccccattctgaaagacattctgcatctggacgagcatcagggaacacatcatggcttaaagctgcatacgtgcggcgcctgtggcagacagttttggtttagcgcaaatctgcaccaataccagaaatgttattcaatagagcaacctttaagaagagataagagcgaggcatctatcgtgaagaactgcaccgtgtcaaaagaaccccatccctctgaaaagcctttcacgtgtaaggaggaacagaagaattttcaggccacactcggcggctgtcaacagaaggcgattcatagtaaacgaaagacccaccgcagtacagaaagcggtgacgcatttcatggagaacagatgcattacaaatgttcagaatgcggcaaggccttttcacgaaaagatacactagtgcagcatcaacggatccacagtggagagaagccctatgagtgttccgagtgtggcaaagccttcagccgtaaggcaactctcgtccagcatcagcgcattcataccggcgagaggccatacgaatgctccgagtgcggcaaaactttctcaagaaaagataatctgacccagcataagaggatccacactggcgaaatgccctacaagtgtaacgaatgtggcaagtacttctcccatcactccaatttaattgttcaccagagggtccacaatggtgctaggccttacaagtgtagtgactgtggtaaagtatttcgccacaaaagcacactggtccaacacgaatctattcacacgggggagaatccctatgattgtagcgactgcggcaaaagcttcggacacaaatacaccctcattaagcaccagaggatacacactgagtctaaacccttcgaatgcattgaatgtggcaagtttttctccagaagcagcgactacattgctcatcaacgggtacacactggcgaaagaccctttgtttgctctaaatgcggtaaggattttattaggacgtctcatttggtgcgccaccagagagtgcacactggagagcgcccctatgagtgcagcgagtgtggcaaggcgtactcgctcagttcccacctgaacagacatcagaaggtgcacaccgcaggccgtctgtag

SEQ ID NO: 141092 - DNA, 1485 bp, Artificial Sequence
  Description of Artificial Sequence: Synthetic coding sequence
ctgcgttggaaccacaggagcaggtcttctgggttgttgggaggcagcgaggtgaccgaggcaggtggatgcggccgctctagatgctccctgtgcggcgtcgcccgccaaaggcggccccgcctgaggccgcggggacgcacgactgcagtcccgggtagtcgtgacctgggacccccacgcgggagcggttggtccacaaactgcgacggcggcggtagaggtgatggccccggggctggctgctggcacgaagtgaaggacgaggagagtagttccgagcagagtatctcgatcgcagtctcccacgttaacacatccaaggccggactcccagcgcagacggctcttccttgcgacatctgcggccctatccttaaggatatcctccacctggacgagcatcagggcacacaccacggattgaaactccacacgtgtggtgcatgtggcagacagttttggttctccgccaatctacaccagtatcaaaaatgctattcaattgagcaaccattgcggagggacaaaagcgaagccagtatcgtaaagaactgtacagtcagcaaagaaccccatccgagcgaaaagccgtttacatgtaaggaggagcagaaaaattttcaggctaccctgggcggatgtcagcagaaggctatacatagcaagagaaagactcaccggtctacggaaagcggcgatgcttttcatggagaacagatgcattataagtgtagtgagtgtggcaaggccttctcccggaaggacacactggtgcagcatcagaggatacactctggggagaaaccctatgaatgttctgagtgcggtaaagctttttcccgcaaggctaccttggtgcagcaccagcgcattcataccggagaacgtccatatgagtgctctgagtgtggaaaaacattcagtaggaaggataacctcacccagcacaaacgcatacacactggagagatgccctacaagtgtaacgaatgcggcaaatattttagccatcactcaaatctcattgtgcaccaacgtgttcacaacggggcacgaccctataaatgctcagactgcgggaaggtgttccgccataagagtaccctagtacagcacgagagcatccataccggtgagaacccatatgactgtagcgattgtggcaaaagcttcggtcacaagtacacccttataaaacatcagaggatacacactgaatcaaaacccttcgagtgcatcgaatgcggaaaattcttctcccgcagctctgattacatcgcacaccaacgagtgcacaccggcgagcggcccttcgtgtgctctaaatgcggaaaagattttataagaacaagtcacctcgtgaggcaccagagagtgcatactggagagaggccatacgaatgttcagaatgcggaaaggcatacagtctttcttcccatctgaatcgccatcagaaggtccacaccgccgggaggctctag

SEQ ID NO: 141093 - DNA, 1044 bp, Artificial Sequence
  Description of Artificial Sequence: Synthetic coding sequence
atgtggggcatgtgggaaactatcctggtccagtgtttgcaccagtaccaaaaatgttactcaattgagcagcctttgcgtcgagacaaaagcgaagctagtattgtgaagaattgcaccgtctctaaggaaccacatccaagcgagaagccatttacttgcaaggaggaacaaaaaaacttccaggccacattgggggggtgccagcagaaggccattcacagtaaacgaaaaacacatcggagcaccgaatctggcgatgcctttcatggtgagcagatgcattacaaatgttcagaatgtgggaaagcattttcacggaaagacactttagttcaacaccaacgtatacactccggcgagaaaccctacgagtgttctgagtgtggcaaggctttctcacggaaggctaccctggtgcaacaccagcggatccacacaggagaaaggccgtatgagtgcagtgaatgcgggaaaacattttcccgaaaggataacctcactcaacacaaaaggatacacactggggaaatgccgtataagtgcaacgagtgcggaaaatacttctctcaccattcaaaccttatcgtgcatcagcgggttcacaatggagcaagaccctacaaatgctccgattgcgggaaagtcttcaggcataagtctacgttagttcaacacgagagcatccacactggagagaatccttacgattgttccgactgtggaaagagcttcggccataaatataccttaataaagcatcaaaggattcacaccgagtctaaacccttcgagtgcattgagtgtggcaagttcttctctcggagcagcgactatattgcccatcaaagagtacacaccggcgaacgccctttcgtgtgcagcaagtgcggtaaggatttcatcagaacctcccatcttgtgagacaccagcgagtgcatacaggcgagcgtccgtacgaatgctctgagtgcggaaaggcgtacagtctcagttcgcacctcaatcgccatcagaaagttcacaccgccggcaggttatag

SEQ ID NO: 141094 - DNA, 1977 bp, Artificial Sequence
  Description of Artificial Sequence: Synthetic coding sequence
atgacccccggcgtgagggtttcaacagaccctgagcaggtcaccttcgaggacgtggtggtcggcttttctcaggaagaatggggacagttgaagccagcccaacgcacactgtatagggatgtcatgctcgacactttccggctgctcgtctccgttggacactggctgccaaagccaaatgtgatatcactcctcgaacaggaagccgagctctgggcagtcgaaagcaggctgccccaaggcgtgtaccccgacctggaaactagaccgaaggtaaagctgagtgtccttaagcaggggatatccgaggaaatttcaaattctgttatcctagttgaacggtttctgtgggacggcctctggtattgtagaggcgaagatacggaggggcactgggagtggagctgtgagagcctagagtctctggccgttccagtggccttcactcccgtcaagacccctgtcctcgagcagtggcaacgtaatgggtttggtgagaacatcagcctgaaccccgaccttcctcaccagccaatgacgcctgagcggcagtcaccacatacttggggcacccggggaaaaagggagaaaccagatttgaacgtcctgcagaagacctgcgtcaaggaaaagccttataaatgccaggagtgtggcaaggcattttcccatagctccgctctcatcgagcaccaccgtacccatacaggtgaacgaccttacgaatgccacgaatgtttaaaaggcttcagaaattcctctgctctcaccaaacatcagagaattcacaccggggaaaaaccctacaagtgtacccaatgtggccggaccttcaatcaaatcgccccactgattcagcaccagaggactcacactggcgaaaagccatacgagtgtagcgaatgcggaaagtccttcagctttagatcctccttcagccaacatgaacgaacccatactggcgagaagccatatgaatgttccgaatgcggcaaagcttttagacagagtattcacctgacacagcaccttcgcatacacacgggggaaaaaccctatcagtgtggggagtgcggcaaagcatttagccactcaagcagtttaacaaagcaccagaggatccacactggggagaagccctatgaatgccacgaatgtggcaaagctttcacccagatcactccacttatccagcatcagcgaacccataccggagaaaaaccctatgaatgcggtgagtgcggtaaggccttttcacagagcactctcctgactgaacatcgacgtattcataccggcgagaagccttatggatgcaacgagtgcggaaagacattttctcactcaagctccttgagccagcacgagcggacgcacacgggagagaaaccctacgagtgcagccagtgtggaaaggccttccgacagtccacccatctcacgcagcaccagagaatccacacaggggagaaaccctacgagtgcaacgactgtggaaaggcattctcacactcaagttccctaacaaagcaccaacggatccataccggtgagaaaccatacgaatgcaatcagtgtggacgcgcattcagtcagctagcccccctcatccagcaccagagaatccacaccggagagaagccctatgaatgtaaccagtgtggccgggcgttctctcagtcctctcttctcatcgagcaccaacgtatccacaccaaagagaagccctacggctgcaacgaatgcggaaagtcgttctcccattcttcatccctctcacagcatgagcgcacccacacaggggaaaagccatacgagtgccacgattgtgggaagtctttccggcagagtacgcacttaacacagcaccgacgcattcacactggagagaaaccctatgcttgtagagactgcggaaaggctttcactcactcttccagtcttacaaaacaccagagaacacatacaggatag

SEQ ID NO: 141095 - DNA, 1173 bp, Artificial Sequence
  Description of Artificial Sequence: Synthetic coding sequence
atggagctggggtcgagacgtcgctccgtcggctgcagatgccggggcctgtgcttggcggttcgacgcgaacaggttacattcgaagacgtggttgtgggattcagtcaagaagagtggggacagcttaagcccgcccagcgaacactgtatagagatgtcatgttagacacctttaggctccttgtttctgtggggcattggctccccaagccaaatgtgatcagtttgcttgaacaagaagccgagctttgggccgtggaatcccggctcccccagggtgtgtaccctgaccttgagacgaggcccaaagtgaagctttctgtcctgaaacaaggtatttccgaagaaatctccaattccgtgattctggttgaacgcttcctgtgggacggattgtggtactgccggggagaagacacggaaggacattgggaatggagttgtgagtcgctcgagagcctggcggtgcccgtggcctttactcctgtgaagacaccggtcttggaacagtggcagcgtaatgggttcggcgagaatatttcacttaatccagacctgccccatcaacccatgacgcctgagcgccaatcgccacacacctggggcacgagaggcaaaagagagaaaccggatcttaacgttctgcagaagacctgcgtgaaggagaagccctataagtgtcaagagtgcggcaaagctttcagtcacagctccgctctgatcgagcatcacagaacacatacaggagagcgaccctatgagtgccatgagtgcctaaagggttttcggaatagttctgccctcacaaaacaccaacgcatccacacgggcgaaaagccctacaagtgcacccagtgtggaagaacattcaaccaaatagccccgctgatacagcaccagaggacgcacactggggagaagccctacgagtgctctgaatgtggtaaatcattttcttttaggagtagctttagtcagcacgagagaacacacacaggagagaagccatacgagtgctcagaatgcggcaaagctttccgccagtctattcacttgacccaacacctcaggattcatacaggggaaaagccgtatcagtgcggagaatgtggtaaggccttcacacactcaagtagtttgacaaaacatcaacggactcacacaggctag

SEQ ID NO: 141096 - DNA, 2049 bp, Artificial Sequence
  Description of Artificial Sequence: Synthetic coding sequence
atggagctaggatctcgtcgacgcagcgtgggatgcagatgtagaggactgtgcctggcagtaagaagggaacaggtgacctttgaagacgtcgtcgtgggatttagccaggaagagtgggggcagctgaaaccagctcaaagaaccctctatcgggacgtgatgctggatacttttagactgttagtgagcgtgggccattggctgccgaaacctaacgtcatctctctgctggagcaggaagcagagctgtgggctgtcgaatctcggctgcctcagggcgtgtaccctgagataaaggggcatttccagtttcttttgctgagtgatctcgagactcggcctaaggtgaagctctcggtactaaaacagggcatctccgaggagattagtaactcagtgatcctggttgaaaggttcctatgggatggactctggtactgccgcggggaagacacagaggggcactgggaatggtcatgcgaatcactcgagagcctggctgtgccagtggccttcacacccgtgaagacgcctgtgctagaacagtggcagcggaacggtttcggtgagaacatctcgttgaatccagaccttccacatcagccgatgactccagagcggcagagtcctcacacctggggaacccgaggtaagcgcgaaaagcctgatctgaatgttctccagaagacatgcgtcaaggagaagccttacaaatgtcaggagtgcgggaaagccttttcccatagttccgctctgatagaacatcatagaacgcacaccggcgaacgtccctatgagtgtcatgaatgtctcaaagggttccggaattccagtgccctgacaaaacatcaaaggattcatactggtgaaaaaccctacaaatgcactcagtgcggcagaacttttaaccaaatcgcacccctgatccagcatcagcggacccatacgggcgagaaaccgtacgagtgtagcgagtgtggaaagagcttctcttttcgttcgagcttttcccaacacgaacggactcacaccggcgaaaagccctacgagtgttccgaatgcggcaaagcctttagacagtctatacacttgacccagcacctgcgcatacacaccggggaaaagccataccaatgcggcgaatgtggcaaggctttctctcatagctctagcctgaccaagcatcaacgcatccacaccggagagaagccctacgaatgtcatgaatgcgggaaggccttcacacaaatcacccccctcattcaacaccaacgcactcatacgggcgagaagccatacgaatgcggtgagtgcggcaaagcattcagccagtcaacactgctgaccgaacaccgtcgaattcataccggggagaaaccctacggatgtaatgagtgtggtaagactttcagccattccagctcgcttagccagcacgaaagaacccacactggtgagaaaccctacgaatgctcccagtgtggcaaagccttcagacaatcaactcatttaactcagcaccagcgcatccacacaggtgagaagccatatgagtgcaatgattgtggaaaagctttttcacactcctcctcgctgaccaagcaccagagaatacacacgggagaaaagccctacgaatgcaaccagtgtggccgagccttttcccagctggcgcccctgattcagcaccaaagaattcatactggtgaaaaaccctacgaatgcaaccagtgtgggagagccttttcacagtcaagcctactcattgagcaccagcgcattcatacaaaggaaaaaccttacggatgcaacgaatgcggcaagagtttcagccatagctcctctctctcgcagcatgaacgcactcacaccggggagaaaccctacgagtgtcatgactgtggaaagagttttcgccagagcacccatctgacacagcatcgcagaatacataccggcgagaagccttacgcttgcagggactgtgggaaggccttcactcactccagcagcttaaccaagcatcagcgcacccatactggttag

SEQ ID NO: 141097 - DNA, 1977 bp, Artificial Sequence
  Description of Artificial Sequence: Synthetic coding sequence
atgactcctggcgttcgggtgtcaacagatccagaacaggttactttcgaagatgtcgtggttgggttttcccaggaggaatggggtcagttaaagccagctcaacgcactttatacagagatgtaatgttggacacattccgcttgctggtctccgtgggacattggctgcccaagccaaacgtgatttcactgctagaacaggaagccgagctgtgggctgtcgagtctagactgccccagggcgtttatccagacctggagaccagacccaaagtcaaactttccgtgctcaaacagggaatttcagaagagatcagcaactccgtgattctggttgagcgattcctatgggacggcctctggtactgccggggagaggacactgagggacattgggagtggtcctgcgagagcctggagagtctggccgtccctgtggcattcacccctgtcaagaccccagtcctggaacaatggcaaagaaacggattcggggaaaacatcagccttaatcccgatttgccccatcagcctatgacaccagagagacagagtccacacacctggggtaccagggggaaacgggagaagcccgatcttaatgttctgcagaagacttgtgtcaaggagaaaccatataaatgtcaggagtgtgggaaagctttctcccattctagtgcactgattgaacaccaccgtacgcacaccggggaacgtccttatgagtgccacgaatgtcttaaaggatttcggaactcttccgcactcactaagcatcaaagaattcataccggcgaaaaaccgtataaatgtacgcagtgcggccggacattcaatcaaatcgcccctctgatccagcatcaacggacccataccggggaaaagccttatgagtgctccgaatgcggcaagtccttctcgttcagatcatctttctctcagcacgagcgcacgcatacaggagagaaaccctatgagtgttctgagtgcggaaaagctttccgccaatccattcacctcacacagcacctgcgcatccacactggcgagaaaccctatcagtgtggggagtgtggcaaggcttttagtcattcctcttccctgactaaacatcagcgtatacataccggcgagaaaccatatgaatgccacgagtgcggtaaggctttcacacagatcaccccactgatccaacatcagagaacccacactggagagaaaccctatgagtgcggcgagtgcggaaaagcgtttagccagtcaactctcctcacggagcacagaaggattcacactggggaaaaaccctacggatgcaatgagtgtgggaaaacttttagccatagctcatctctgtcccagcatgaaagaacccacactggcgagaagccctacgaatgcagccagtgtggcaaggcatttcggcagagtacccacttgacccagcaccagagaatacatacgggcgaaaagccttacgagtgcaatgactgcggcaaagccttctcccacagcagcagtcttacgaaacatcagcggatacatacaggtgagaaaccctacgaatgcaatcagtgtggacgggctttttcgcagctggcccctttgatccagcatcagagaatacacactggtgagaagccttatgaatgtaatcagtgcggacgcgctttctcacagtcttccctgttaattgagcaccaacgaattcatactaaggagaagccatacggttgcaacgaatgtggaaagtctttttctcattctagctccctgtcccagcacgagcgtactcatactggagagaaaccctacgagtgtcacgactgtggtaagagtttccggcagtccacccacctgacgcagcaccgacgcattcatactggagagaagccctacgcctgcagagactgcggtaaggcatttacacacagctccagtttgacgaagcatcagaggacacacactggctag

SEQ ID NO: 141098 - DNA, 1851 bp, Artificial Sequence
  Description of Artificial Sequence: Synthetic coding sequence
atgcttgataccttccggctgctcgtctccgtgggccattggctgcccaagccaaatgtgatctccttgttggagcaggaggcggaactctgggcagtagaaagccgactgcctcaaggggtgtaccctgatctagagacccgtccaaaggttaagttgtccgtgctgaagcaaggaatatctgaggagatcagcaatagcgtgattctggttgagaggtttctgtgggacggcttgtggtattgccggggtgaggatacagaaggacactgggaatggtcatgcgagagcctcgagtcacttgcagtccccgtcgccttcacaccagtgaagaccccagtcctggagcagtggcaaagaaatgggtttggggagaacatttcactgaaccctgacctccctcaccagcctatgactcctgaaaggcagtccccacatacctggggtactcggggaaaacgggaaaaaccagatctgaatgtcctgcagaagacctgtgtaaaggagaagccctataagtgccaggagtgcggaaaggccttcagccactcgagtgctctcatagaacaccaccggacgcacactggcgagcgtccgtacgagtgccacgaatgtttgaaaggtttcaggaattccagtgccttaaccaaacatcagcgaattcacactggcgagaagccctacaaatgtacccaatgcggaaggaccttcaaccagattgcccccctaatacagcatcagcgtacccacactggggagaaaccatacgaatgtagtgaatgcggcaaatcattcagcttccgcagtagtttctcacagcacgagcgcacgcatacaggcgaaaagccatacgagtgctccgagtgtgggaaggcttttagacagtccattcatcttactcagcatttgcggatccacacaggtgaaaaaccatatcagtgtggggagtgcggcaaggctttttcacactcaagctcattaaccaagcatcagcggattcacaccggcgagaagccatatgaatgccatgagtgcggcaaggctttcacccagattactccgctgattcagcatcagagaacccacactggtgagaaaccttacgagtgcggggaatgtggcaaagccttttcccagtcaaccctgctgaccgaacacaggcgcattcatacaggagagaaaccgtatgggtgcaacgagtgtggaaaaacattctctcactcatcttcactgtcccagcacgagcggacccacacaggggaaaagccttatgagtgttcccaatgcggcaaagcattcagacaaagcacacacctcactcagcaccagcgaattcatacaggggaaaaaccatacgagtgcaacgactgcggaaaggccttttcacatagttcctcgctgaccaaacaccagcgcatccacactggagagaaaccctacgagtgcaatcaatgcgggcgggcatttagccagctggccccactcatccaacatcagcgcatccatacaggggagaagccatacgaatgtaaccagtgcgggcgcgctttcagccaatcctcacttctgattgagcatcagaggatccacaccaaggagaaaccttatggatgtaacgaatgcgggaagagcttctcacatagttcctccttgtcgcagcacgaaaggacccacaccggcgaaaagccgtacgagtgtcatgactgcggaaagtctttccgccagtccactcatctcacacagcaccggcggattcacacgggagagaagccgtatgcgtgccgcgactgtggaaaagctttcacccactcttcctcgcttacaaaacatcagagaacccatactggttag

SEQ ID NO: 141099 - DNA, 2013 bp, Artificial Sequence
  Description of Artificial Sequence: Synthetic coding sequence
atgactcctggggtccgggtcagtaccgatcccgaacaggtcacattcgaagatgtcgttgttggtttcagccaggaggagtggggtcagctgaagcctgctcagagaactctgtaccgggacgtgatgctcgacacattccggttgctggtgtccgtgggacattggctccctaagcccaacgtcatttctctcctggaacaggaggccgagctgtgggctgtggagtcccgcctgccgcagggagtgtacccagagataaaggggcatttccagttccttcttctaagcgatctcgagacacgccccaaggtcaagctatccgtgctgaagcagggtatttcggaagagatctcaaatagtgtcattcttgtggaaaggttcctctgggatggactgtggtattgccgtggagaggatacagagggacactgggagtggtcatgcgaaagcctggaatctctggcagtcccagtggctttcactcccgtcaagacacccgttctcgagcagtggcaacggaatggcttcggcgagaatatttcgctcaacccagaccttccccaccagccgatgactcccgagcggcagtctccacacacttgggggaccagagggaaaagagagaagcccgatctgaatgtcctccagaaaacatgcgtcaaagagaagccttataagtgccaggaatgcgggaaagccttcagtcactccagcgccctgattgagcatcataggacccatacgggcgagcgcccctatgaatgccacgagtgcctaaaagggttcaggaacagctccgctctcaccaaacatcagcgtattcacacaggagaaaagccttataagtgcacccaatgtggccggacgtttaaccaaatcgctccactgattcagcatcagcgcacgcacacgggggaaaaaccctacgagtgcagtgagtgcggaaagagcttcagctttcgctcaagcttttcccaacacgaacgcacccatacaggggagaaaccatatgagtgctccgagtgcggaaaggccttccgccagtctattcaccttactcagcatcttcgaatccatacaggtgagaagccttatcaatgcggagaatgtggtaaggccttctcacactcatcttctcttacgaagcaccaacgaatccacacaggcgagaaaccttacgaatgccacgaatgtggtaaggcttttacccagatcactcctttgatccagcatcagagaacacataccggcgagaagccatacgagtgtggggagtgcggaaaggccttctcacagagcacattgctgactgaacacagacgaatccacaccggcgaaaaaccctacggctgcaacgaatgcgggaagaccttttcccactcatcaagtctgagtcagcacgagcgcacccatacaggtgagaagccatacgagtgttctcagtgtggcaaagccttcagacagagtactcacctaacccagcatcagaggattcatacgggcgaaaaaccatatgagtgtaacgattgcggtaaggcattctcgcacagtagcagcctcacaaagcatcagaggattcatacaggggagaagccatatgagtgcaatcaatgtgggagggccttttcccagctggcccctctcatccagcatcaaaggatccataccggcgagaagccatatgagtgtaaccagtgtggtcgggcgttttcacagtcctccctactgattgagcatcagaggatacataccaaggaaaagccttatggctgtaatgagtgtggcaaaagttttagccattcctctagcctgtcccagcatgagagaactcacacgggggagaaaccttatgaatgccacgattgtggcaaaagctttagacagagcacccacctaacccagcacaggaggattcacaccggcgagaagccatacgcatgtcgggattgcggaaaggcatttacccattcttcttccctgacaaagcatcagcggacccacaccggttag

SEQ ID NO: 141100 - DNA, 2031 bp, Artificial Sequence
  Description of Artificial Sequence: Synthetic coding sequence
tgaagatcggtgggatgtaggtgccgaggtctatgcctggctgtccggagggaacaggtaacgttcgaggacgtcgttgtcggtttctcacaggaagaatggggacagctgaagcctgctcagaggactctgtatcgggacgtcatgctggacacatttcgactgctggtgtctgtggggcattggctgccaaaaccaaatgtcatctctttgctagaacaagaggctgagctgtgggcagtggagagccgattacctcagggggtgtatccagagatcaagggacacttccagtttcttctgcttagtgatctggagactaggcctaaggtcaagctttcagtgctgaagcagggcattagtgaggaaattagtaactcggtgatccttgtggagcgattcctgtgggatggactgtggtattgtcgtggcgaggacaccgaggggcattgggagtggtcctgcgaatccctggagtctctcgcagtgcccgttgcttttacacccgtcaagactcctgtgctggagcagtggcagcgtaatggattcggggagaacatctcactgaacccagacctccctcatcaacctatgacaccagaacggcagtctccacatacctggggaactaggggcaaacgcgaaaagcccgacttgaacgtgctccagaagacatgcgtgaaggagaaaccttataaatgccaagagtgcgggaaggccttctctcatagttccgcgcttattgagcaccataggacgcacactggtgagcgaccatacgagtgccacgaatgtttgaaaggtttcagaaatagcagtgctctgaccaagcatcagcgcatccacaccggcgagaagccttacaaatgcactcagtgcggtagaaccttcaatcagatcgcacccttgatccagcatcaaagaacccacacaggcgagaagccatacgaatgttctgagtgtggaaaatccttttctttccgcagcagcttttctcaacatgagcggactcacacaggcgagaagccatacgaatgttcagaatgtggaaaagctttccggcagtccatccacctgacgcaacacctccgtatacacactggggagaaaccttaccagtgtggtgagtgcggaaaagctttttcccacagcagttcactgactaaacaccaacgcatccatacaggcgagaagccctatgagtgccatgagtgcgggaaagccttcacccagattactcccctcattcagcaccagcggactcacaccggcgagaagccttacgaatgtggggagtgtggtaaagcattttcccaatccaccctcctgactgagcacaggcgaatccatactggggagaaaccctacggctgcaacgaatgtggtaagacattttcacacagttcaagcctaagccagcatgagcgaactcataccggagaaaaaccctacgagtgcagccagtgtggcaaggcattccgccagtcaacacacctcacccagcatcagagaattcatacgggcgaaaagccgtacgagtgcaatgactgcgggaaagcgttttctcatagttcctctctgaccaaacaccagaggatccacactggagagaaaccatacgaatgtaaccagtgcggtcgtgctttcagccagctcgcccctcttatacagcatcagagaattcataccggggaaaagccctacgaatgtaatcagtgcggaagggcctttagccaatctagtctgctgatagagcatcaacgcatccatacgaaggagaagccctatggatgcaatgagtgtggcaagtcattctcccatagctcaagtctcagccagcacgagaggacgcacacaggagagaaaccttatgaatgccacgactgtggaaagagctttcggcaatctacgcatctcactcagcataggaggattcataccggcgaaaagccctacgcctgccgggactgcggaaaggcctttacacactcctcttctcttacgaaacaccagcgcacacacacagggtag

SEQ ID NO: 141101 - DNA, 1623 bp, Artificial Sequence
  Description of Artificial Sequence: Synthetic coding sequence
atggattcagtggcctttgaagacgtagatgtcaatttcacccaggaagagtgggccttgctggacccatctcagaagaatctatacagagacgtgatgtgggagactatgagaaatctggccagcatcggcaaaaaatggaaggaccagaacatcaaagatcattacaagcaccgaggaaggaacctgagatcccatatgctggagcggctgtaccaaaccaaggacggcagtcagagaggcgggatattctctcagttcgccaaccagaacctgtcaaagaagatcccaggagtcaaactatgcgagagcattgtgtatggcgaggtgtccatgggccagtccagcctaaatcgccacatcaaggaccactccggccacgagcccaaagagtatcaggaatatggggagaagcccgatacaagaaaccagtgctggaaacctttctccagccaccattccttccgcacacacgagattatccacacgggagagaaactgtacgactgcaaagagtgtgggaaaacatttttttccctgaagagaatccgaaggcatatcatcacacacagcggttatacgccttataaatgcaaagtttgcggcaaagcttttgattacccttctagatttcggacccatgagcggagtcacacgggagaaaagccatatgagtgtcaagagtgcggcaaggcttttacatgtattacaagcgtgcgaagacacatgattaaacacactggggacggaccgtataaatgtaaagtttgtggaaagccttttcattccttgtcgagctttcaggtgcatgaacggatccacaccggagaaaaacccttcaagtgtaaacagtgcggcaaggctttttcctgctcccctacccttcggatccacgagcggacgcacaccggcgaaaaaccctacgagtgtaaacagtgtggcaaggccttctcctatctaccttctcttagattgcatgagcgtatacacaccggggaaaaaccttttgtctgtaaacagtgcggtaaggcttttaggagtgccagcacctttcagatacatgaacgtacccacactggagaaaaaccctatgagtgcaaagaatgtggagaagccttctcatgcatcccgtcaatgagaaggcatatgattaagcacaccggcgagggtccctacaaatgtaaggtatgtggcaagccattccatagcctgtcccccttccgcatccacgagcgtacccacaccggcgagaagccttacgtgtgtaagcactgtggtaaggccttcgtgagctctacttctatacgtatacacgagagaactcatacgggagagaagccatatgaatgtaagcagtgcggtaaggcattttcctacctcaactcattccgaacgcacgagatgatccacacaggtgaaaagccctttgaatgtaagcggtgcggcaaggctttcagaagttcatccagttttcgtttgcacgaacgcacacacactggccagaaaccataccactgtaaggagtgcggaaaggcctactcttgccgggccagtttccagagacacatgctcacacacgcagaggacggtccgccctacaagtgtatgtgggagtccttatag

SEQ ID NO: 141102 - DNA, 1425 bp, Artificial Sequence
  Description of Artificial Sequence: Synthetic coding sequence
atgctggaacgcttatatcagacaaaagacggttctcagaggggcggaatttttagccagtttgccaatcaaaacttgagcaagaaaatacccggcgtcaagctatgcgagtccattgtgtatggagaagtctcaatggggcagtcctcattaaaccgtcacataaaggaccatagtggacacgaaccaaaagagtatcaggaatacggcgaaaaaccagacacacggaatcagtgctggaaaccattttcaagccaccactcatttaggactcacgagatcatccacaccggcgaaaagctgtatgactgcaaggaatgcggtaaaacattcttttcacttaagcgcataagacggcatatcatcacacactctggttataccccgtacaagtgcaaggtttgcggcaaagccttcgactatccttctcgatttaggacgcacgagcggagtcataccggcgaaaagccttatgagtgccaagagtgtgggaaagcttttacctgcattacatccgtgcgacggcacatgataaagcacaccggggatgggccatataaatgtaaagtttgtggaaagccctttcatagcctgtcctcctttcaggtgcatgaaagaatccataccggagagaaaccatttaagtgtaagcaatgtggcaaagcctttagttgttctccaactcttaggattcacgagaggacacatactggcgaaaaaccttacgagtgcaaacagtgtggcaaagctttctcatacttgccttcccttagactgcacgaacgtattcatacaggcgaaaaaccctttgtctgcaaacagtgcggcaaagctttccgatccgcgtctacatttcagatccatgagagaacccatacaggggagaagccctacgagtgtaaggaatgcggtgaggctttcagctgtattccgtcaatgagacggcatatgataaagcacacaggagaaggcccctacaagtgtaaagtgtgtggtaagcctttccacagcctttcccccttccggatccacgaacggacacacaccggtgagaaaccctatgtgtgtaagcattgcgggaaggcatttgttagctcaacatcaatccgcatccacgagcggacccacactggcgagaagccatatgaatgcaagcagtgcggaaaggccttctcatatctcaattccttccgtacccatgagatgatccacactggcgaaaaacctttcgagtgtaagcgatgtggaaaggccttcaggtcaagttcttcctttaggctgcacgagcgaacacacacaggccagaaaccttaccactgcaaggaatgcggtaaggcctacagttgccgcgctagctttcagcggcatatgctgacccatgctgaggatggtcctccctacaaatgcatgtgggaatcactgtag

SEQ ID NO: 141103 - DNA, 960 bp, Artificial Sequence
  Description of Artificial Sequence: Synthetic coding sequence
atgggcccactcaccttcatggacgtcgcaatcgaattttccctagaggagtggcagtgcctggacactgctcaaagaaatgtgtacaggcacgtgatgttagagaattatcgcaatctagtgttcctggacctcattacatgtctggagcaagggaaagaaccatggaatatgaaaagacacgaaatggtggtggccaaacactctgctttgtgttctcgattcgcacaagatctgtggctggagcaaaacattaaggattctttccagaaagttactctatctcgctacggaaaatatgggcacaagaatcttcagctgaggaaggggtgcaaatctgttgatgagtgcaagggacatcaggggggcttcaatggcctgaaccaatgtttgaaaatcaccacaagtaagatctttcaatgtaataagtatgtcaaagtcatgcacaaattcagcaactccaacagacataaaatccgacacaccgagaacaagcatttcaggtgcaaagaatgtgacaagtcactctgtatgttgagtcggctgacacagcataagaaaatccatacgcgcgaaaatttctacaagtgtgaggagtgtggcaagaccttcaattggtcaacaaatctgtccaaacccaaaaaaatacatactggggaaaagccttataaatgtgaagtttgcggtaaagcctttcaccagagctccatactaacgaaacataagataatccgaactggggagaagccgtataaatgtgcacattgtggcaaggcattcaagcagtcctctcacttgacgcgacataaaattattcataccgaggaaaaaccatacaagtgcgaacaatgtggaaaggtcttcaaacagagccccacactgactaagcaccagattatctacacgggcgaggaaccatacaaatgtgaagagtgtggcaaggccttcaatctctcatag

SEQ ID NO: 141104 - DNA, 789 bp, Artificial Sequence
  Description of Artificial Sequence: Synthetic coding sequence
atgaaaagacatgagatggtggtagccaagcactcagccctctgctctcggtttgcacaagatctgtggctcgaacagaacatcaaagattcattccagaaagttacgctgtcccgttatggtaagtatggccacaaaaacctccagctgcgtaaaggatgcaagagtgtcgacgagtgtaagggccatcagggaggcttcaacggcttaaaccaatgtctaaagattacaacaagtaagattttccagtgtaataagtacgtaaaggtcatgcacaaattctccaattcaaaccggcacaagattagacatactgagaacaaacactttcggtgcaaagagtgcgacaaaagtctgtgtatgctttctcggttaacacagcacaagaagatccacacaagagaaaacttctataaatgtgaggaatgcggtaagacatttaactggtcaaccaacttgtcaaaaccgaagaagatccacacaggtgagaagccatacaagtgtgaggtgtgtggcaaggctttccatcaaagtagtattctgaccaagcataagataatccgaaccggagagaaaccgtacaaatgtgcacactgtggtaaggctttcaagcaatcctcacatttaaccagacacaagatcatccataccgaggagaagccctacaagtgcgaacagtgcggcaaggtattcaaacagtccccgacactgacgaaacatcaaattatatacactggcgaagagccttataagtgtgaagagtgcggcaaggctttcaatctcagttag

SEQ ID NO: 141105 - DNA, 789 bp, Artificial Sequence
  Description of Artificial Sequence: Synthetic coding sequence
atgaaacggcatgaaatggtagtggctaagcactcagccttgtgttcgcgatttgcgcaggatctgtggttggagcaaaatattaaggattcatttcagaaggtgaccctttctagatacggtaagtacgggcacaaaaacctgcagttgcgcaaaggctgcaagtccgtggatgaatgtaagggtcaccagggaggttttaacggcctcaatcaatgcctcaagatcactacctcgaagatattccagtgtaataaatacgtgaaagtcatgcataaattcagcaactcaaaccgccataagatccggcatactgagaataagcactttcggtgtaaagaatgcgataaaagtctctgcatgctgagcagattaacccaacacaagaagatccacactcgtgaaaatttctacaaatgcgaagaatgcggcaagacatttaactggagcactaaccttagcaaacctaagaagatccatacaggggaaaaaccttataagtgtgaggtatgcggcaaggcttttcatcagagctccattttgacgaaacacaaaataatccggaccggagagaagccttataaatgtgcacactgtggaaaagcctttaaacagagtagccatctaacgcgtcacaagataatacacactgaggaaaaaccctacaaatgtgagcagtgcggcaaagtgttcaagcagtcacccactctgactaagcatcagatcatctatactggagaggagccttataaatgtgaagaatgtggtaaggcctttaatttgagctag

SEQ ID NO: 141106 - DNA, 864 bp, Artificial Sequence
  Description of Artificial Sequence: Synthetic coding sequence
atggatgtagctatcgagtttagtctcgaggagtggcagtgccttgacaccgcccagcgcaatgtgtatagacatgtaatgctcgagaactatcgaaacttagtctttcttgccttatgttctcggttcgcgcaagacctctggctagaacagaacatcaaggatagcttccagaaggtgacactcagcagatatgggaagtatggccataagaatctgcaactgagaaagggctgcaaatcagttgacgagtgtaaggggcaccaaggtggctttaacgggctaaatcagtgtctgaaaattacaacttcaaagatttttcagtgcaacaaatacgtgaaggttatgcataagttttccaacagcaacaggcacaaaatccggcacacggagaataaacatttccggtgcaaggagtgtgacaaaagcctatgcatgcttagccgtctcacacaacacaaaaaaatccacacaagagaaaatttttacaagtgtgaagagtgcggaaaaacgtttaattggtccacgaacctatccaaacccaagaaaatccacaccggagaaaaaccttataagtgtgaggtttgcgggaaagcctttcaccagtcaagtatcctgacaaagcacaaaatcattagaaccggggaaaaaccttacaaatgcgctcattgcggaaaagcctttaagcagagtagccatctgacccgccacaagataatccacaccgaggagaaaccttataagtgcgagcagtgcggaaaggttttcaaacagtcaccaactctgactaagcatcagattatctatacaggagaggaaccatacaagtgtgaagagtgcggaaaagcctttaatctaagttag

SEQ ID NO: 141107 - DNA, 882 bp, Artificial Sequence
  Description of Artificial Sequence: Synthetic coding sequence
atgggccccctcacctttatggacgtggcaatcgaattcagtctggaggaatggcagtgtcttgacaccgctcagaggaatgtatacagacacgtgatgctggaaaattacagaaatctcgtgtttctggctctgtgctctcggtttgcccaggacctttggctggaacaaaacattaaagatagcttccagaaggtcaccctgagtcgatatggcaagtatggccacaaaaatctgcaactgaggaagggctgcaagtcagtggacgagtgtaaaggacaccagggaggattcaacggccttaatcagtgtctgaagatcaccacctccaagatttttcagtgtaacaagtatgtcaaagtgatgcataagttctccaacagtaataggcacaagataagacatactgaaaacaaacatttcaggtgcaaggaatgtgacaagagcctgtgtatgctttcccgtctgacgcagcataaaaaaatccacaccagggagaacttctataaatgcgaggagtgtggcaaaactttcaattggtccaccaacttatctaaacctaagaaaatccatactggggaaaaaccatacaagtgtgaggtgtgcggaaaagccttccaccagtcatctatcctcactaagcataagatcatacgtaccggagagaaaccctacaagtgcgctcattgtggaaaggcttttaagcagtcaagtcacctgacccggcacaagatcatccacacggaggagaagccctacaagtgcgaacagtgcgggaaggttttcaaacagagccccacactgactaaacaccaaattatttacacaggagaggaaccatacaaatgcgaagagtgcggaaaggcattcaatctatcttag

SEQ ID NO: 141108 - DNA, 381 bp, Artificial Sequence
  Description of Artificial Sequence: Synthetic coding sequence
atggggccactcacgtttatggacgtagcaattgaattcagcctggaggaatggcagtgtctggatactgctcagagaaacgtgtatagacacgtaatgctggagaactatcgaaacctggtgtttctggaccttataacctgcctggagcaggggaaagagccatggaacatgaagagacacgaaatggtagtggcaaagcatagcgccgtggcctttacgtttgatctgtccgggctgaacatcctcagtttccagagcattctcccatttgtgtccgctttgtacgtaatgggaaatcgcaatcaatgcctccagaaacacctcgaagcccgcaacaaggatctctgcgtgctggtgctgcctaagacctttggctag

SEQ ID NO: 141109 - DNA, 1929 bp, Artificial Sequence
  Description of Artificial Sequence: Synthetic coding sequence
atggacagtgtctcctttgaggacgtggccgtgaacttcacactggaggagtgggccctgctggactccagccagaagaaactgtacgaagacgttatgcaagaaactttcaagaatctggtgtgcctaggtaaaaaatgggaagaccaggatattgaggacgaccaccgtaatcaggggaagaacagacggtgccacatggtggagcgtctgtgcgagagtagaagaggttccaaatgtggcgaaaccaccagtcagatgccgaatgttaatattaataaggaaacctttactggagccaagcctcatgaatgcagcttctgcggccgagactttatacaccactcctccctgaatagacacatgcgttcccacacaggacagaagccgaacgaatatcaggaatacgaaaagcagccctgtaaatgcaaagccgtagggaagacattctcctaccaccattgtttccggaaacacgaacgaactcacacaggagtaaagccttatgagtgcaaacaatgcgggaaagcatttatttactatcagccctttcagaggcacgagaggacccatgccgggcagaagccatacgagtgcaaacagtgtggtaagactttcatttattaccagtctttccagaagcacgcccacacgggcaagaaaccttatgaatgcaagcaatgcggcaaagcgtttatctgttaccagagttttcagcgacataagcggacccacacaggcgagaagccctacgagtgcaaacagtgtggaaaggctttcagctgcccaacatactttcgcacccacgagagaacccatacgggcgagaaaccatataaatgtaaagaatgtggaaaggccttctcatttttgagttcattccgtcgccacaaacgcacacacagtggggagaagccttacgagtgtaaagagtgcgggaaggcattcttttattccgcatcttttcgagcccatgtcatcattcacactggcgcaaggccttacaaatgcaaagagtgcgggaaggcattcaacagttcgaactcttgccgcgtccatgaaagaactcacatcggcgagaagccctatgagtgcaagagatgcggcaaatctttttcatggtctatctccctcagattgcatgaaaggacccacaccggagagaaaccttacgagtgtaagcagtgtcacaagaccttttcattttcgtcctctctcagggaacatgagacaacacatactggagagaagccttacgagtgtaaacagtgtggcaaaacgttcagtttttcctcgtctctccagcgtcacgagcgtactcacaacgccgaaaaaccgtacgagtgcaaacaatgtggcaaagcgttcaggtgctcttcttatttccgcatccatgagcgctcacataccggtgaaaagccatacgagtgcaaacagtgcggtaaggtttttattcgcagcagctcctttcggctccatgaacgcactcataccggtgagaagccctatgagtgcaaactatgcggaaaaacctttagttttagttcaagcctacgagaacatgaaaagattcataccggcaacaagcccttcgagtgcaagcagtgtggaaaggcctttttgaggagttcccagatcaggctgcatgagcgcacacacaccggcgaaaaaccataccagtgtaagcagtgtgggaaggccttcatctcaagttccaagttcaggatgcacgagcgcacccacaccggcgaaaaaccttaccggtgcaagcagtgcggtaaggccttcagattttcttcttccgtccggatacacgagcgcagtcacaccggggaaaagccatacgaatgcaagcagtgcggaaaggcgttcattagctcttcacatttccgtttgcatgaacgaacgcacatgggagagaaggtatag

SEQ ID NO: 141110 - DNA, 1374 bp, Artificial Sequence
  Description of Artificial Sequence: Synthetic coding sequence
atgagtcagggtagtgtcacttttagggatgtggcaattgacttctcccaagaggagtggaagtggttgcaaccggcacagagagacctttaccgatgcgtcatgctggagaattatggccatttggtatctctcggactttccatctccaagcccgacgtggtctccctcctcgagcaaggcaaagagccttggttgggaaaacgcgaggtcaaaagggacctgttcagcgtgagcgagagctccggcgaaattaaagatttttcgcccaaaaatgtgatatatgatgattcctcccagtacctgattatggaaagaatcctgagtcagggacccgtgtactcctcatttaagggcgggtggaagtgtaaggatcacactgagatgctgcaggagaatcagggctgcatccggaaagttacagtcagtcatcaggaggccttagctcaacatatgaacatctcaaccgtggaacggccctacggatgtcacgaatgcggtaaaaccttcggtcggagattctcactggtcctccatcaaaggacccacacaggtgagaaaccctatgcctgcaaggagtgtgggaaaaccttctcacagatctcgaacctggtcaaacatcaaatgatccacaccgggaaaaaaccacacgagtgtaaagattgcaacaaaactttttcatatctcagcttcctcatcgagcaccaaaggacccacacaggagaaaagccctacgaatgcactgaatgcggcaaggccttctctcgagccagcaatttaactagacatcagaggattcatattggcaaaaaacagtacatctgccgcaaatgtggaaaggcgttctcatccggctctgagctgattcgccatcagataacccacactggggagaagccgtacgagtgtatcgagtgcggtaaggcttttagaagattctcacatctgaccagacaccagtccatccacaccactaagaccccctatgagtgcaacgagtgtaggaaggccttcagatgccattcatttcttattaagcaccagagaatccacgcaggcgaaaagctatatgagtgcgacgagtgcggcaaggtgttcacatggcacgcgtctcttatccagcataccaaaagccacaccggtgagaaaccgtacgcgtgcgcagaatgtgataaagctttctcaagatccttcagtttaattctgcatcagaggacccacacgggagaaaagccctacgtgtgtaaggtctgcaataaatccttcagttggtcatccaaccttgcaaagcaccagaggacacatacactcgacaacccgtatgagtacgaaaattcattcaattatcatagctttcttactgagcaccagtag

SEQ ID NO: 141111 - DNA, 351 bp, Artificial Sequence
  Description of Artificial Sequence: Synthetic coding sequence
atgtctcagggaagcgtcacttttagggatgttgctatcgacttcagccaggaagagtggaaatggctgcagcccgctcagcgggatctgtataggtgcgttatgctcgagaactatggtcatctcgtttccctcggattatccatcagcaagccggatgtcgtaagcctgctggagcagggcaaggaaccttggctcggtaagagggaagttaagcgggatctcttctctgtgtccgaatcttccggcgagattaaggatttcagccccaagaatgtgatctacgatgatagcagccaatacctcataatggagaggattctgtctcagggacccgtgtacagttcttag

SEQ ID NO: 141112 - DNA, 684 bp, Artificial Sequence
  Description of Artificial Sequence: Synthetic coding sequence
acccacaccggggaaaagccgtacgcgtgcaaagaatgcgggaaaacattcagccagatctccaacctggtgaagcaccagatgattcataccggaaaaaaaccccacgaatgcaaggattgcaacaagaccttctcctatctctccttcctgatcgagcaccagagaactcacacaggggaaaagccttatgagtgcaccgaatgtggtaaagcatttagccgcgcatcaaacctgacccggcaccagaggatccatatcggcaaaaagcaatatatctgtcgcaagtgtggaaaggctttcagtagcggatccgaactaataagacaccaaatcactcacactggtgagaagccatatgagtgtatagaatgcggcaaggcctttaggcgctttagtcatctgactagacatcagcgaatccatgccggagagaagctttatgagtgcgacgaatgcgggaaagtgtttacatggcacgcgtcactgatccagcatacgaaatcgcacacaggtgaaaagccgtatgcttgcgccgagtgcgataaagctttctcccggtccttcagcctgatcttgcaccaaagaacacataccggtgaaaagccctacgtgtgcaaagtttgcaacaagagcttttcttggagttctaacttggccaagcaccagcggacccacacatag

SEQ ID NO: 141113 - DNA, 1065 bp, Artificial Sequence
  Description of Artificial Sequence: Synthetic coding sequence
atggagcggattttaagtcagggtcccgtttactcctcctttaagggcgggtggaagtgtaaagatcacacagagatgctgcaggagaaccaaggctgcatcaggaaggttacagtgtcacaccaggaagccctcgctcagcacatgaacattagtaccgtcgagcgcccgtacggctgccacgaatgtggaaagacattcggcaggagattctcgcttgtcctgcaccagaggactcacaccggagagaagccttacgcttgcaaagagtgtgggaagaccttttcacagatcagcaatttggtcaagcatcagatgattcataccgggaagaaacctcacgagtgtaaagattgcaataagaccttttcttatcttagctttctgatagaacaccagagaactcacacaggagaaaaaccttacgagtgtactgaatgcggtaaggctttcagcagagctagcaatctcacccgccaccaacgaattcatatcgggaagaagcagtatatttgtaggaagtgcggcaaggcttttagctccggtagcgaactgattagacatcaaatcacacacaccggagaaaagccttacgagtgtatcgagtgtggcaaggcctttaggaggttctctcacttgaccaggcaccagagcatccataccacgaagaccccttatgagtgcaatgaatgccggaaagccttccgatgccattcatttctgattaaacatcagaggattcatgcaggagaaaaattatacgagtgcgatgagtgcggcaaggtgtttacttggcacgctagcctcattcaacatacaaagtcacacactggcgagaagccatacgcttgtgccgagtgcgacaaggcattctcccggtcatttagcctgatcctgcaccagcggacacataccggtgaaaaaccgtacgtgtgtaaagtctgcaacaagtcatttagttggtcatccaacctcgcaaagcatcaacgcactcatactctggacaacccatatgagtatgaaaactcatttaattatcatagcttcctcaccgagcatcaatag

SEQ ID NO: 141114 - DNA, 1425 bp, Artificial Sequence
  Description of Artificial Sequence: Synthetic coding sequence
atggagctgctcacttttcgggacgtagccattgagttctcacctgaggagtggaagtgcttggatcctgaccagcagaacctctatcgggatgtgatgctggaaaattacaggaatcttgtgtcgcttggagtggccatttcaaaccctgacctggtaacgtgtctggaacagagaaaggagccttataacgttaaaatccacaagatagtggcccgtccaccagcgatgtgttcccacttcacccaggatcactggcctgtgcagggtattgaagactcttttcataaattgattttgaggaggtacgagaaatgtgggcatgataacctccagctccggaaaggctgtaagagccttaatgagtgcaaactacagaagggtgggtataatgagtttaatgagtgcctcagtacgacgcagtccaagatccttcaatgcaaagccagcgtaaaagtggtgtcaaaattttctaactccaacaaacgtaaaacccggcataccggcgaaaagcactttaaagaatgcgggaagagtttccagaagttctcacatcttacgcagcacaaggtgattcatgctggcgaaaagccatatacatgcgaagagtgcggaaaggctttcaagtggtcacttattttcaatgaacacaaaaggatacacacaggcgagaagcctttcacctgtgaggagtgcgggagcatctttaccacttcctcccactttgccaaacataagatcattcataccggtgaaaagccatacaagtgtgaggaatgtggcaaagcattcaatagatttaccacgctcacgaagcacaagcgaatccacgccggcgagaaacctattacctgcgaggaatgtaggaaaattttcacgtcttcaagcaatttcgctaagcataagcgcatacacacgggagagaagccttacaagtgtgaggagtgcggtaaagcgtttaaccgaagcacgacactcacaaaacataaaagaatccacaccggagaaaagccttacacgtgtgaagagtgcgggaaggcctttcgccaaagctcaaaactgaatgagcacaagaaggtccacactggcgagagaccatataagtgcgacgaatgtggaaaggcatttggacgctctcgagtgttaaacgagcacaaaaagatccacactggggaaaagccctacaaatgtgaggagtgtgggaaggcatttagaaggagcactgatagaagtcagcataagaagatccattcagcagataagccatacaagtgcaaggagtgtgataaggctttcaagcaattcagtcttctgagccagcacaagaaaatccacaccgtggataagccgtacaagtgtaaagattgtgacaaggcttttaaaaggttttcccacctgaataaacataaaaagatacatacttag

SEQ ID NO: 141115 - DNA, 606 bp, Artificial Sequence
  Description of Artificial Sequence: Synthetic coding sequence
atggagctgctgacatttcgggacgtggcaatcgagttctctccagaagagtggaagtgtctcgacccagatcaacagaatctttacagagacgtgatgctagagaattaccgcaatttagtcagcctgggtgtagccatctctaacccagatcttgtcacgtgcctagaacaaagaaaggagccctacaatgttaaaatccacaagatcgtggcaagaccaccggcaatgtgtagccacttcacacaggaccactggcctgtacaaggcatcgaggatagctttcataagttgatcctgcggcgatatgagaaatgcggccatgataatctgcagctgcggaaagggtgcaaaagcttaaacgagtgcaagctgcagaagggcggatataacgagtttaacgaatgtctatccaccacccagtccaaaatcctgcagtgcaaggcctctgttaaagtcgtgtcaaaattttctaatagcaataagaggaagacaaggcataccggtgaaaaacactttaaggagtgtgggaagtcatttcaaaaatttagtcatcttacccagcataagaactctagcatctccatgactacctccccattttag

SEQ ID NO: 141116 - DNA, 5064 bp, Artificial Sequence
  Description of Artificial Sequence: Synthetic coding sequence
atgaccgaccccctgttagattcacagccggcatccagcacgggggagatggacggcttatgccctgaactgctgctcatcccaccgccactgtcgaatcgcgggatcctcggtccggtgcagagcccttgtccctcacgagaccccgccccgatcccgaccgaacctggatgcctgctggtagaagccaccgcaactgaagaaggcccgggcaatatggaaatcatcgttgaaaccgtggccgggacactaactccaggggccccgggcgaaactcccgcccccaaacttccacccggtgaacgagagccatcacaggaggcaggaacgcccctgccgggacaggagaccgccgaggaagaaaatgtggagaaagaagagaaatccgacacccagaaggactctcaaaaggctgtagacaaagggcagggagcccagcgactcgagggcgatgtagtttctggcaccgagtccctctttaagacacacatgtgtccggagtgtaagaggtgcttcaaaaagaggactcacctggtggagcacctgcacctccactttcctgatccttctttgcagtgccctaattgccagaagtttttcactagcaagtctaagctcaagacccatctcctgcgggagcttggggagaaggctcatcattgcccactttgccactactctgcggtggaacgaaacgccctgaaccgccatatggcctctatgcacgaagacatctctaacttttacagcgacacctatgcctgtccagtatgtagggaggagtttcgcctatcccaggctctgaaggaacatctcaaaagccacacagctgctgctgcagccgaacctttgccccttcgatgttttcaagaaggatgcagctacgcagctcccgaccggaaagcattcatcaagcatctcaaagagactcacggcgttagagcagtggaatgccgtcatcattcttgtcccatgctgtttgcaacagcagaagcgatggaggcccatcataagtcacactatgcctttcattgtcctcattgcgacttcgcctgctccaacaaacacttgttccgaaagcataagaagcagggacaccccggatcagaggagctccgatgtacattctgtcctttcgccactttcaaccctgtcgcttaccaggatcacgtggggaaaatgcatgcacacgagaagatccaccaatgccccgagtgtaattttgcaaccgcccataaacgtgtacttatacgacacatgcttcttcacaccggggagaagcctcacaagtgcgagctttgcgacttcacatgtcgcgacgtgtcatacctgtccaaacatatgttgacgcattccaatacaaaggattacatgtgtacagaatgtggatatgttacgaaatggaagcactatctcagggttcatatgagaaagcacgcgggggacctgcgctaccagtgcaatcagtgctcttatcgctgccatcgcgccgaccagctgtcatcacataaactgcgacaccaggggaagagcctgatgtgtgaggtgtgtgcctttgcctgcaagagaaagtatgagctgcaaaaacatatggcctctcagcatcaccctgggactcctgctccactgtatccttgccattattgtagctatcagtcccgccataagcaagcggtgctttctcacgaaaattgcaagcatactaggctgagagaattccattgtgcactctgcgactaccgcactttttcaaacactactcttcttttccacaagcgtaaggcccacggttatgtgcctggcgatcaagcctggcagcttcgatatgcatctcaggaacccgaaggtgctatgcagggacccactccaccgcctgactccgagccatctaaccagttaagtgcccgcccagaagggcccggacatgaacccggcaccgtcgttgacccctctctggaccaggccctcccggagatgtccgaagaggtaaacacaggccgccaagaaggtagcgaggccccacatggaggtgacctcggcggttccccttcccccgccgaagttgaggaaggtagctgcacattacatttagaagcactgggggtagaattggaatccgtgactgaacctcctcttgaagaggtgaccgaaactgcgcccatggaatttaggcctctagggctggaagggccggacggccttgagggccctgagctctcctcatttgaaggcattggaacttccgatctgtcggccgaggaaaaccccctgttggagaaacccgtttccgaaccgtccacaaatcctccgtctctggaagaagctcctaacaactgggtgggaacctttaagaccacccccccagccgagacagccccgttgcccccgctgccagagtcagagagcctcctgaaggccctgagacggcaagacaaagagcaggcagaggcattagtcttggagggaagagtacagatggtggtgattcagggcgagggccgcgcattcagatgtcctcactgccctttcatcaccagacgggagaaggcgctgaacctgcactcacgaaccggttgccaggggaggagggagcccctgctgtgtcctgagtgtggtgcaagctttaagcagcagcgcggactctctacacacctgctcaagaagtgccccgtgttattgcgtaaaaataagggattaccgcgacctgactctccgatcccactccagcctgtgttgcccgggacccaggcttctgaggacacagagagtggtaagcccccccccgcctcacaggaggccgagctgcttttgcccaaggacgcgccactggagctgccccgcgagcccgaagaaaccgaggaacctctggctaccgtttccggaagccccgtgccaccagctggaaactcactgcccacagaagcccccaaaaagcactgctttgatccagtgcccccagccgggaatagcagccccacagaagcgccaaaaaagcatcaccttgaccctgtccccccggcgggcaactcatcccctacggaagccctgaaaaaacatcggttcgaacagggcaaattccattgcaacagctgccccttcctgtgctcccgactcagttctattacttcccacgttgccgaaggctgccgtggtgggagaggcggcgggggcaagcggggcacaccgcaaacccagccagatgtgtctccgctgtctaacggtgatagcgcacctccaaagaatgggtcaaccgaaagctcatcaggcgacggcgatacagtgctggttcagaaacagaagggcgcccggttctcgtgccccacatgccccttctcatgtcagcaggaacgcgcacttaggacccaccagattaggggctgtcccctggaagagagtggtgaactccactgctccttgtgtccattcaccgctcctgccgcaacggctttacgccttcatcagaagcgtcggcaccctacagcggcacccgcccgcggcccacggcctcacctgcaatgcggcgactgcgggttcacgtgcaagcagtcccgttgtatgcaacagcacagacgtttgaagcatgaaggcgtcaagccacatcagtgccccttctgtgacttcagcacaacacgccggtatagactggaggcccaccaaagcaggcacacaggaatcggaagaatcccctgttcctcttgtcctcagacttttggcacaaactcgaaactgagactccacagattaagagtgcacgataagacacctacccatttctgcccattgtgcgattactcaggatacctgcggcacgacattacgaggcacgtgaattcctgtcatcagggcactcccgcctttgcctgttcacaatgcgaagctcaattctctagcgagactgcattgaagcaacatgccctccgccgccacccagagccagctcagcctgctcccgggtcccctgccgagaccaccgaaggccctctgcattgctctaggtgcggtttactgtgtcctagtcctgccagccttagaggccacacccgcaagcagcaccctcgcctcgagtgcggtgcttgccaggaagccttcccgtcccgacttgccttagacgaacacaggagacaacaacacttctcacatagatgtcagctgtgcgacttcgctgctcgtgagagggttggactggtgaagcattacctggaacaacatgaggaaacaagcgctgccgtcgccgctagtgatggcgacggcgacgcagggcagcccccactgcactgtccattctgtgattttacatgtcggcatcaattggtactagaccaccacgttaaagggcacgggggaactcgactgtacaagtgcacagattgcgcttatagcaccaagaatagacaaaaaataacatggcatagtaggatccacaccggtgagaagccttatcattgtcatctatgtccatacgcttgtgcagatccatctcggttgaagtaccatatgaggatccacaaagaggaaagaaagtacctctgccccgagtgcggctacaagtgtaagtgggtaaaccaattgaaataccacatgacaaaacacacggggcttaaaccttaccagtgccctgagtgtgagtactgtacgaaccgagccgacgctctccgagttcaccaagagaccaggcacagggaggcccgtgccttcatgtgtgagcaatgtggtaaggcctttaagactaggttcctcttaaggacgcaccttcgaaaacatagcgaagcaaaaccatacgtgtgtaatgtgtgtcaccgggccttcaggtgggcggctggattgagacatcatgctttgacacataccgataggcatccattcttttgccgcttgtgtaactacaaggccaaacagaaattccaggtagttaaacatgtgcggcgacatcatcctgatcaggcagaccccaaccagggtgtggggaaagatcccactacgcccacagtgcacctccacgacgtacagctggaggatccttcccctccggctcccgccgcgccgcatacggggccagagggttag

SEQ ID NO: 141117 - DNA, 45 bp, Artificial Sequence
  Description of Artificial Sequence: Synthetic coding sequence
atgacggacccactgttggactcacagcccgccagttccacatag

SEQ ID NO: 141118 - DNA, 5064 bp, Artificial Sequence
  Description of Artificial Sequence: Synthetic coding sequence
atgaccgatcccctgctggactcacagccggcttcaagtacaggagaaatggatggcctgtgtcccgaactcctcctcatcccgccccctttgtcaaaccgcgggatcctcgggcccgtgcagtcgccctgtccctcacgggacccagcaccaatacccaccgagcctgggtgcctgcttgtggaggcgaccgctactgaggagggtccaggtaacatggagatcattgtcgagactgtggcagggacgctaaccccgggtgcccccggagaaactccggcacccaagctccctccgggagaaagggaaccgtcccaagaggcgggcacccctttaccagggcaggagacagctgaggaggaaaacgtggagaaggaggaaaagagcgacacacagaaggattcccagaaagcagtggacaagggccagggcgctcagcggctcgagggggacgttgtttctggcacagaaagccttttcaaaacacatatgtgtcctgagtgcaagcgctgtttcaagaaacggacccatctggtcgagcacctgcacctgcatttccccgacccaagtttacagtgtcccaactgtcagaaatttttcaccagtaagtccaaattaaagactcacttgttgcgcgaactgggcgaaaaagcccaccactgtcctctttgccactactcagcagtggaacgaaatgcactcaaccggcatatggcaagcatgcacgaagatataagtaacttctattccgacacctacgcatgccccgtttgcagagaagaatttcgcctcagccaggcattgaaggaacatctcaaaagccacacagcggccgctgccgcagagccacttccactgagatgcttccaggagggttgttcttacgcggctccagacaggaaggctttcattaagcacttgaaggagacgcatggtgttagggccgtagagtgtcgtcaccactcctgcccgatgctctttgccacagctgaggccatggaggcccatcataaatctcattacgcctttcactgcccccactgcgattttgcatgtagcaacaagcatctgttccgcaaacacaaaaaacagggacaccctggtagcgaggagctccggtgtacattctgtcccttcgcaacctttaatcctgtcgcttaccaggaccacgtgggaaagatgcacgcccacgaaaagatccaccagtgtccggaatgcaatttcgccacagcccataaacgagtcctgattcggcacatgctgctgcacactggcgaaaaaccgcacaaatgtgagttatgtgatttcacctgtagagacgtgtcatatttaagcaagcacatgctgacgcattcgaacacaaaagactacatgtgcactgagtgcgggtacgtgaccaagtggaaacattatctgagagtgcatatgagaaaacatgcgggtgacctccggtaccagtgcaaccaatgtagttatcgttgccatagggcggaccagttgagctcgcataaactgcgtcaccaggggaaatcactgatgtgcgaggtttgtgcgtttgcctgcaagcggaaatacgagctgcaaaaacatatggcatcccagcaccaccccggcacaccggccccactgtatccatgtcattactgcagttatcagagcagacataagcaggccgttctgagccatgagaactgcaaacacaccaggctgcgagagttccactgcgcactgtgcgattatcgcaccttcagcaacacaactctactgttccacaaacgtaaggcacacgggtacgttccaggcgatcaggcttggcaactgcgttacgcatcgcaggaacccgaaggagccatgcagggtcccaccccacctccagactcagagccatcaaaccagctctctgcaaggcctgaaggtccaggacacgagcctggaacagttgtcgacccatcattggaccaagcattgcctgagatgtccgaagaggtgaacacaggaaggcaggagggaagtgaggccccccacgggggagacctcggggggtctcccagtcctgccgaggtggaggagggctcatgcacattacacttagaggcacttggtgtggaactagaatcggtgaccgagccccccctggaggaagttacagaaaccgcccctatggaattcaggcctttggggttggaagggcccgatgggcttgaagggccagaactatccagttttgagggcatcggcacttccgatctgagtgcggaagagaatcctttgctggagaagccggtcagcgaacctagcaccaacccgccatctctggaggaggcgcccaacaactgggtaggaaccttcaagacaactccaccggcagaaactgcacccctgccacctctccccgagtccgagtccctgcttaaggccctgaggagacaggacaaagagcaggctgaagcactagtcctcgagggacgggtccagatggtggtgatccagggagaagggcgcgctttccggtgtccacactgtccatttatcacgagacgggagaaagcattgaacttacacagtcggaccgggtgccagggcaggagggagcccctcctatgtcccgaatgcggggctagtttcaaacagcagcggggtctttcaacgcacttactgaagaagtgcccggtacttctgagaaagaacaagggcctgcctcgtcctgactcccccatccctctgcaaccagttctgcccgggactcaggccagcgaagacaccgaatcaggtaaacctccccctgctagccaggaagcagaactcctgctgcctaaagacgccccccttgagttgcctagggaaccggaagagaccgaggagccactggccaccgtctcaggctcacccgtgccaccagcaggcaactcgttgcctaccgaagctcctaagaaacactgtttcgaccccgtgccgcccgccgggaattcatcccctactgaagcccctaaaaagcatcaccttgaccctgtcccgcccgcgggcaattccagtcccaccgaagccctgaagaaacacaggtttgagcagggaaagttccactgcaactcctgtccattcctgtgcagtcgtctctctagcattactagtcatgtagccgagggatgcagaggaggtcgggggggtggaggcaagcgcgggacacctcagacacagcccgatgtgtcccccctgagcaacggggatagcgccccccccaagaatgggtccaccgagtcttcctctggcgacggcgatacggtactggtgcagaagcagaagggtgcccgattcagctgtcctacctgccccttctcgtgccagcaagagagggcgctgaggacacaccagatacgaggatgtcccctggaggaatctggggaattacattgtagcctttgtccgtttaccgcacccgccgccaccgccctacggctgcatcagaaaaggcgccatcccactgccgcacccgcccgaggccccagacctcacttgcaatgtggggactgtggctttacatgcaaacagtcacgttgcatgcagcaacaccggagactaaaacacgagggagttaagcctcaccaatgcccgttctgtgatttcagcaccactagacggtataggctggaagcacatcagagtaggcatacaggaattggccgtatcccctgctcttcatgtcctcagaccttcggaacaaattccaaactgagactgcaccggctgagagtgcacgataagacccccacccacttttgtcccctgtgtgactattctgggtacttaagacacgacatcacccggcatgtgaactcttgtcatcagggcacacctgccttcgcatgtagccagtgtgaggctcaattctcatctgaaactgcgctgaaacagcatgctcttcgtcggcatcccgagcccgcccaaccagctcctgggagccctgccgaaaccacagagggaccgctgcactgcagcaggtgcggccttctgtgcccctcacccgcgtctctacgcggacacacgcgcaagcagcacccccggctggagtgtggcgcctgccaggaggctttcccttccagactcgctctggatgagcacagaagacaacagcatttttctcaccggtgccagctctgtgactttgccgctagagagcgtgtgggactggtaaaacactacctggagcagcacgaggaaacctccgctgcagtggcggcaagcgacggcgatggggatgcaggccagcctccgctccactgtcctttttgtgactttacctgtcggcatcaattggtgctcgatcaccacgtgaaagggcacgggggcactcgcctctataagtgtaccgactgtgcctattccacaaagaacagacaaaaaatcacctggcactctagaatccataccggcgagaagccatatcattgccatttatgcccctacgcgtgcgccgatcctagtcggctgaagtatcacatgcgtattcataaagaagaacgtaaatacctgtgcccagaatgcggatacaaatgcaagtgggtgaatcagctaaagtaccatatgacaaaacacacaggactgaagccttaccagtgtccagaatgcgagtactgcaccaaccgcgccgatgcattacgcgtgcatcaagaaacacgccatcgggaagctcgcgcattcatgtgtgaacagtgtggtaaggcttttaaaacccggtttcttcttaggacgcaccttagaaaacactccgaagcaaagccgtatgtgtgcaatgtctgtcaccgcgccttcaggtgggctgccggactgcgccaccatgcacttacacacactgataggcaccccttcttctgccggctatgcaattataaggccaaacagaagttccaggttgtgaaacatgtgcggagacatcatcccgaccaggctgacccgaaccagggcgtggggaaagatcctactacacctacggttcacctacacgacgtgcaactagaagacccatctccgcccgcccctgctgctccccataccgggccagagggttag

SEQ ID NO: 141119 - DNA, 81 bp, Artificial Sequence
  Description of Artificial Sequence: Synthetic coding sequence
atgacagaccctttacttgattcccagccggccagttccaccggcgagatggacgggctgtgcccagaattgcttctgtag

SEQ ID NO: 141120 - DNA, 1824 bp, Artificial Sequence
  Description of Artificial Sequence: Synthetic coding sequence
atgttgctggcccagatcaatagagactcacaggggatgactgaattcccagggggcggcatggaggcacagcatgtaacgctttgccttactgaggccgttacagtggctgacgcgaagctgattgacggccaagttattcaattggaagacggctctgcagcatacgtccaacatgttcccatacctaaaagcacgggggattccctgcgcctggaagatggccaggccgtccaactggaggatggaaccacagctttcattcaccacacttccaaggactcatatgatcaaagtgctttgcaggctgttcaattggaagatgggacaaccgcgtacatccatcacgcagtgcaggttccccagtccgacacaatcctcgctatccaagctgatggtacggttgccgggttacacacaggcgatgcgactattgaccctgataccataagcgctctggagcagtacgccgcaaaggtatctatcgatgggagtgagtctgtggctggcaccggaatgatcggggagaacgaacaggagaagaagatgcagatagtcctgcaggggcacgctacccgcgtcacggcaaagagccaacagagtggggagaaagctttccggtgcgaatatgacgggtgcggaaagctctacactacagctcatcatctgaaggtacatgaacgttcccacaccggagaccgaccttatcaatgtgaacatgctggctgcggcaaagccttcgccaccggctacgggttaaaatcacacgtgaggacccatacaggtgaaaagccttacaggtgttcggaggataattgtactaaaagctttaaaactagcggggatctgcaaaagcacatcagaacacatacaggggagcggccttttaagtgtccctttgagggttgtggacggtcctttaccaccagcaatattagaaaggttcatgtacgtacacacaccggcgagcgaccctactattgcaccgagcctgggtgcggccgcgcattcgcaagtgcaaccaactacaaaaaccacgtgaggatccacacaggcgaaaaaccttatgtgtgcactgtgcccggctgtgataaacgttttaccgaatatagttcattatataagcatcacgtcgtccacactcattccaagccatacaactgtaatcactgtggcaagacctacaagcaaatttccaccctcgcgatgcataaaaggacagcgcataacgacacagagcctatcgaggaagagcaggaggcgtttttcgaacccccacctggacagggagaggatgtcttaaaaggctcccaaatcacatatgtgacgggcgtcgagggagacgacgttgttagcactcaagtggctacagtcacacaatccgggctctctcaacaggtaacgctcatctcacaagacgggacccagcacgtgaatatttcgcaagccgacatgcaggctataggcaatactatcacaatggtcacccaggatggcaccccgataacggtgccggctcacgatgctgtgatcagttccgcgggaacacactctgtggcaatggtgaccgctgaaggcactgaaggtgaacaagtcgccatcgtagcccaggacctcgctgctttccatacagcatcttcggaaatgggccaccagcagcatagtcatcatcttgtaacgacggaaactcgcccactcacactggtggccaccagtaacggaactcaaatcgcggtccagctgggcgagcagccgtccctggaagaggcgattcgcatcgcctcaaggattcaacagggcgagacaccaggattggatgactag

SEQ ID NO: 141121 - DNA, 1917 bp, Artificial Sequence
  Description of Artificial Sequence: Synthetic coding sequence
atgctgctggcccagattaaccgtgactcacagggaatgaccgagttccccggtggcgggatggaagctcagcacgtcacactttgtctcaccgaggctgtcacggtggccgacggcgacaatctcgaaaacatggagggcgtgagcttacaggccgtaacactagcagacggctccactgcatacatccaacacaactcaaaggatgcaaagctgatcgatggccaagtgatacagctggaggatggaagtgcagcatacgtgcagcacgtacccattcccaaaagcactggcgattctcttcggttagaggacgggcaggctgtgcagctggaggatggaactactgcttttattcaccatacgtcaaaagatagctatgatcaatcggcattacaggccgttcagctcgaggacggtactacagcttatatacatcacgctgtacaggttccgcagtctgatacaatccttgctattcaggctgacggaacagtagccggccttcacaccggggacgccacgattgacccggatacaatctcagcactggagcaatatgcagctaaagtttcgatcgatggctcagagtccgtagcaggcaccggaatgataggtgagaacgaacaagagaagaaaatgcaaatagtcctgcagggccacgccacccgcgtgaccgcaaagtcccagcaatccggcgaaaaggctttcaggtgtgaatatgacgggtgcggtaaactgtacaccaccgcccatcacctaaaagtgcatgagcgctcgcacactggggacagaccttatcaatgcgagcatgcaggctgcggaaaagcgttcgccacgggatacggcctcaagagtcacgtgcgaacccacaccggagaaaaaccatacagatgttcggaagataactgtaccaagtcattcaaaacctccggcgaccttcagaaacatattaggacccacacaggagaacgcccgttcaaatgtccttttgaaggatgtggcagaagcttcacaacatctaacataagaaaggtgcacgtccgcacacatactggagagcgtccatactactgtaccgagcccggatgcgggcgcgcgttcgcctctgcaacgaactacaaaaaccacgttcgaattcatacaggcgagaaaccgtatgtctgcacggtgcctggatgcgacaagcgcttcacagaatattccagcttgtataagcaccacgttgttcacacccacagcaaaccgtataattgcaaccactgtggcaaaacttacaaacagatatcaaccctagcaatgcacaaacgcactgcccacaatgatactgagccaatcgaagaggagcaggaggcctttttcgaaccgcctcccggtcaaggcgaggacgttctgaaaggaagccagatcacctatgtcaccggggtggaaggagacgatgtggttagcacacaggtggcgacagtcacccagagtggcctgagccaacaggttacgctcatctcgcaagacggaactcagcacgtaaacatttcccaggccgacatgcaagctattggcaacaccataaccatggtgactcaggatggcacccccatcaccgtccccgcccacgatgctgtcataagtagcgcaggaactcactctgtcgcaatggtgactgcagagggcaccgaaggagaacaggtggccatcgtggcgcaggaccttgccgcatttcacaccgcttcgtccgagatgggtcatcagcagcattcccaccaccttgtgactacagaaaccagacccctgactctcgtggctacaagcaacggcacgcagattgccgtacagctgggggaacagccatcattggaggaagcaatcaggatcgctagccggattcagcagggagaaactccaggcctggatgattag

SEQ ID NO: 141122 - DNA, 429 bp, Artificial Sequence
  Description of Artificial Sequence: Synthetic coding sequence
atgctgcttgcccaaataaaccgggattctcaggggatgacggagtttcccggaggaggtatggaagctcaacatgttaccctgtgtctcaccgaggctgtgacagttgccgacggggataacctggaaaatatggagggagttagcttacaggctgtgacccttgcagatgggagtacggcgtacatacagcataactccaaggatgccaagctcatcgacggacaggttatccagctggaagatggaagtgcagcgtacgtacagcacgtgcccattccgaagtcccgcgacagcctcaggctcgaagatggtcaagctgtgcagctggaagacggcacaaccgcctttatccaccatacatctaaagattcttatgatcagtccgctctgcaggccgtgcaattagaagacggtactactgcttag

SEQ ID NO: 141123 - DNA, 255 bp, Artificial Sequence
  Description of Artificial Sequence: Synthetic coding sequence
atgcttctcgcccagatcaatcgcgactctcaggggatgaccgaattcccagggggcgggatggaggcacagcacgttaccctgtgtctcactgaagctgtcaccgtggcagacggcgataacttggaaaatatggagggcgttagcctgcaggctgtgacccttgccgatggttctacagcgtacattcagcacaattccaaagacgcaaagctcatcgacggccaggtgatccagctcgaggatgggagctag

SEQ ID NO: 141124 - DNA, 222 bp, Artificial Sequence
  Description of Artificial Sequence: Synthetic coding sequence
atgctacttgcgcagataaatcgagactcccagggaatgactgagtttcccggcggaggcatggaagcacagcatgttactctgtgcttgaccgaggccgttaccgtggctgatggcgataatcttgagaacatggaaggtgtatcccttcaagcagtgactctcgccgacggaagcaccgcctatattcagcataactcgaaagacgctaaacttatttag

SEQ ID NO: 141125 - DNA, 573 bp, Artificial Sequence
  Description of Artificial Sequence: Synthetic coding sequence
atgctcctcgcacaaattaatcgggattcccaaggcatgactgaattccctgggggtggcatggaagcccagcatgtgactctttgtctcacagaggcagtgaccgtggctgatggggataatcttgagaatatggagggggtgtccctacaggctgtgacactggcagacggatccaccgcctacatccaacataattctaaggacgcaaaactgatcgacgggcaggtgatccagctagaggacggctccgctgcgtacgtgcagcatgtccctatacccaaaagtaccggtgacagcctcagactggaggacggccaagcagtccagttagaggacgggactaccgcatttatacatcatacatccaaggatagttatgatcagtctgcgctgcaagcggtgcagctcgaggacggaaccactgcctatatccatcacgcagttcaggtgcctcagagtgacactatcctggcgattcaggcagatggcactgttgccggactacatacaggagatgcaacaatcgaccctgatacaatctctgccctggagcagtatgcggctaaatag

SEQ ID NO: 141126 - DNA, 411 bp, Artificial Sequence
  Description of Artificial Sequence: Synthetic coding sequence
atgcttttagcccagatcaatagagactcgcaggggatgacggaatttcctgggggtggcatggaggcgcagcacgtgaccctctgtctcaccgaagccgtcaccgttgcggatggcgataatctcgaaaatatggagggagtgtccctccaggccgttaccctcgctgacggcagtacagcctacatccagcacaatagcaaggacgccaagctgatagacggtcaggtgattcagctcgaagacggctcagccgcttatgtccagcacgtgccgatcccaaaatccacaggagatagcctgcgcctggaagatggccaggcggtgcagctcgaggacgggaccaccgcattcatccatcacacatcaaaggattcctacgaccagagcgcactacaggccgtccagtag

SEQ ID NO: 141127 - DNA, 528 bp, Artificial Sequence
  Description of Artificial Sequence: Synthetic coding sequence
atgctcctagcacagattaaccgtgatagccagggcatgacggaattcccggggggcgggatggaggcacagcatgttaccctctgtttaacagaggccgttacagtggctgatggcgacaacttggagaacatggaaggggtcagtctgcaggcagttaccctggcagatggatctactgcctatattcagcacaactccaaagatgccaaactgatagatgggcaggttatccagctagaagatggaagcgccgcttatgtgcagcacgtccccattcccaagtctaccggagattctctgaggctcgaggacggtcaggccgttcaactagaggatggcactacagcatttattcaccacactagcaaggattcctatgaccagtcggccctgcaggccgtgcagttggaggatggaactacagcgtacattcaccacgccgtacaagtgcctcaaagcgacacaatactagcaatacaagcagatggcaccgtggctggcctgcatactggcgatgccacatag

SEQ ID NO: 141128 - DNA, 879 bp, Artificial Sequence
  Description of Artificial Sequence: Synthetic coding sequence
atgagtcatctcagtcagcagaggatctatagcggtgaaaacccgttcgcatgtaaggtgtgcggtaaggtgttctcccacaaatctaatctcacggaacacgaacacttccacacaagagagaagccgtttgagtgtaatgagtgtgggaaagcttttagtcaaaaacagtatgtaatcaagcatcagaatacacatacaggcgagaaacttttcgagtgcaacgagtgcggcaagagcttctcacagaaagaaaacctgcttacacatcaaaagatccatacaggggaaaaaccattcgagtgcaaggattgtggtaaagcctttatacagaagtccaacctgatccgccaccagaggacgcatactggcgagaagccctttgtttgtaaggagtgtggcaagaccttctccggcaaatctaacctcaccgagcatgagaagatacacatcggcgagaaacccttcaaatgcagcgagtgcggcacagcatttgggcagaaaaaatatcttataaaacaccagaatattcacaccggcgagaaaccttacgagtgtaacgagtgcggaaaagcatttagtcagagaacctctctgatcgttcacgtgcggatccatagcggcgataaaccgtacgaatgtaacgtgtgcgggaaggctttctcccaatcttcttccctgactgtccacgtgaggtcccacaccggagagaagccttatggatgtaacgagtgcgggaaggccttcagccagttctcgactcttgctctgcacctgcgcatccataccgggaaaaaaccttatcagtgtagtgagtgcggaaaggccttctcacagaagagccaccacatccgtcaccagaaaatccacacacactag

SEQ ID NO: 141129 - DNA, 879 bp, Artificial Sequence
  Description of Artificial Sequence: Synthetic coding sequence
atgtcacatctctcgcaacagcgcatctacagtggagagaaccctttcgcctgcaaggtctgcggaaaggtattctcccataagagcaatctcactgaacatgagcactttcatactcgcgaaaaaccattcgagtgcaatgaatgcggtaaagccttctcccagaaacagtatgttatcaagcaccaaaacactcacaccggtgaaaagttgtttgagtgtaacgaatgtggtaaatcatttagtcagaaagagaatctattaactcaccaaaagattcacacaggggagaagcccttcgagtgtaaggattgcggcaaggcattcatccagaagtctaatctgattagacaccagagaactcacacgggcgaaaaaccttttgtctgcaaagaatgtggtaagacattttctggcaagtctaacctgaccgagcatgaaaagattcacattggggagaagccgtttaagtgctctgagtgcggaaccgcttttggacagaagaagtacctcattaaacatcagaatattcatactggcgaaaagccctatgaatgtaacgaatgcggcaaggctttcagccagagaacttctttgattgtccatgtgcgcatccattccggggacaaaccatacgaatgtaatgtctgtgggaaagcgttcagccagagctcttctttgacagtccacgtccgctctcataccggcgagaaaccttacggctgcaatgagtgcgggaaagcttttagtcagtttagcacactggcactgcatttgcgcatccacacgggaaagaagccctaccagtgctcagaatgtgggaaggctttcagccagaaaagtcatcacatcaggcatcagaagatacacacccactag

SEQ ID NO: 141130 - DNA, 2385 bp, Artificial Sequence
  Description of Artificial Sequence: Synthetic coding sequence
atgaatattgatgataagctggaaggcttgttcttgaagtgtggcggaattgacgaaatgcaatcatcccgcacaatggtcgtcatgggcggagtcagtggacagagcacagttagcggagaactacaggacagcgtgttgcaggataggagtatgccgcaccaggaaatcctcgccgctgatgaagtgctccaggaatccgagatgcgccagcaggatatgatctcacatgacgaactgatggtgcacgaggaaacggtcaaaaacgatgaagaacagatggaaacccacgaaaggctcccacagggattgcagtatgccttaaatgtccctattagtgtgaagcaagagatcacatttactgacgtgtcagaacagctcatgagggacaaaaaacaaatccgagaacccgtggacctccaaaaaaaaaaaaaaagaaaacaacgatctccagccaagatcttaactattaacgaggatggtagtctggggctgaaaactcccaagtctcatgtgtgcgaacactgtaatgctgcctttcgaacaaactatcaccttcagcgccacgtctttatccataccggcgagaaaccttttcagtgtagtcagtgcgatatgcgttttattcagaaatacctgcttcagaggcacgagaaaatacataccggcgagaagccattcagatgtgacgagtgcggtatgcggttcattcagaagtatcacatggaaagacataagcgcactcattcaggagagaaaccataccagtgcgaatattgtctccagtatttttccaggactgatagagtcctgaagcataaaagaatgtgccacgagaatcatgacaaaaagttgaacaggtgcgccatcaaaggaggcctgctgaccagcgaggaagatagtggcttcagcacatccccaaaggataatagtctccccaagaaaaagagacagaagacagagaagaaatcttccgggatggataaagagagcgctctggataaaagcgatctgaaaaaggataagaatgattacctgcccctctattcttcatcaacaaaagtcaaggacgaatacatggttgcggagtacgccgttgaaatgccccactcgagtgtgggaggctcacaccttgaagatgctagcggcgagatccaccctcccaagctcgtcctgaaaaaaatcaattctaaacggtcactgaaacagccgttagaacagaaccagaccatttcgcctctgagtacatacgaggaatccaaggtgtcaaaatatgcctttgagttagtcgataagcaggccttgctagacagcgaaggcaatgcagatattgaccaagtggataacttgcaggagggaccttccaaacccgttcactcctcaacaaactatgatgacgcaatgcagttccttaagaagaagcgctacctccaggctgcttctaataacagccgggagtacgccctcaatgtgggaactatcgcatctcagccctccgtcactcaagcagccgttgccagcgtcatagatgagagtactaccgcctctatccttgagtcacaggccctcaacgttgagatcaaatcgaaccatgacaaaaatgttatcccagatgaagttttgcaaacattgctggaccattattcgcacaaggcaaacggacagcatgaaatatccttttctgtggctgatactgaagtgacgtcatccatatctataaactcctcagaggttcccgaggttactccctctgagaatgttggctcctctagtcaagcctcttcatccgataaagctaatatgttgcaggagtactctaaattcctgcagcaagcccttgatcgaacttctcagaacgatgcctacctcaattccccatctttgaattttgtgacagacaatcagaccctacccaatcagcctgcattttcttctatcgataagcaggtttacgccacgatgcctattaattcctttcggagcggcatgaattcgcccctgcgcacgactcccgacaaaagccacttcgggctcattgttggagattctcaacatagcttccccttctccggtgacgagactaaccatgcttctgccacctccacccaagattttctggatcaggtgacctctcaaaaaaaggctgaagctcaacctgtgcatcaggcgtaccagatgtcatcattcgagcagccatttagggctccatatcatgggtcccgggcgggtatcgccacacaattctccactgcgaatggccaggtgaacctgagaggccccgggacaagcgcggagttctccgagttccctctcgttaacgtgaatgacaatagagccggaatgacatccagcccagacgccactacaggccagactttcggctag

SEQ ID NO: 141131 - DNA, 252 bp, Artificial Sequence
  Description of Artificial Sequence: Synthetic coding sequence
atgaacatagatgacaagctggaggggctctttctgaagtgcggaggcatcgacgagatgcagtccagcaggacaatggtcgtaatggggggcgtgtcaggccagtctaccgtcagcggtgaactgcaagactcggtgcttcaagatcgttctatgccgcaccaggaaatcttagccgccgacgaggttctgcaggagtccgagatgaggcagcaagatatgatttcgcacgatgaactgatggtgcactag

SEQ ID NO: 141132 - DNA, 435 bp, Artificial Sequence
  Description of Artificial Sequence: Synthetic coding sequence
atgaagggcgaaaagccgtttcagtgcagtcagtgcgacatgcggtttatccagaagtacctgctgcaacgacacgaaaaaatccatacaggggaaaagcccttcagatgcgatgaatgcggcgacgagaccaatcacgccagcgccacatctacacaagatttcctagatcaggtgacttctcaaaaaaaggctgaggcacaaccggttcatcaggcataccagatgtcaagtttcgagcagccctttcgggctccctaccatgggtcccgcgcagggatcgctactcaatttagcaccgctaatggacaggtcaatctgcgaggtccaggcacctctgccgagttttcagagttccctcttgtcaacgtgaacgacaatagggcaggcatgacatcaagccccgatgcaaccactggccagacttttgggtag

SEQ ID NO: 141133 - DNA, 78 bp, Artificial Sequence
  Description of Artificial Sequence: Synthetic coding sequence
atgaacatcgacgataagctcgagggtctgttcctcaagtgtggcggaattgacgagatgcagtcaagccgcacttag

SEQ ID NO: 141134 - DNA, 2385 bp, Artificial Sequence
  Description of Artificial Sequence: Synthetic coding sequence
atgaatattgacgacaagttggagggtttgtttctcaagtgcggcgggatcgacgaaatgcagtcgtccagaactatggtcgttatgggcggtgtgtcaggccaatcaacagtttcgggagaattgcaagatagtgtcctgcaggaccgctcgatgcctcatcaggagatactggcagccgacgaggtcttgcaggaaagcgaaatgagacaacaggacatgatctcccacgatgaactgatggtccacgaggagaccgtgaagaatgacgaagagcagatggagacccatgagcggctcccacaaggactgcagtacgctttaaatgtgccaatctccgtcaaacaagaaatcaccttcactgacgtgtctgagcagctgatgcgcgataagaagcagatcagggaacctgtcgacctgcagaaaaaaaagaaacgaaagcagcgtagccctgctaagatcttgactataaacgaagacggatctctgggactcaagaccccaaaatctcatgtatgcgaacactgtaatgctgcttttcggacaaattaccatctgcagcgccacgttttcattcatactggtgaaaagcccttccagtgcagccagtgcgacatgcgtttcattcagaagtatctgctccagcgccatgagaaaattcacaccggagagaagcctttcaggtgtgacgagtgtggaatgcggttcatccagaaatatcacatggagagacacaaaagaacccactccggggagaaaccatatcagtgcgagtactgcctgcagtatttcagcaggacagacagggttctaaaacacaaacggatgtgccacgaaaaccacgacaagaaactgaatagatgcgcaattaaaggcgggctgcttaccagtgaagaggattccgggtttagtactagccccaaggataactcattgcctaagaagaagcgccagaaaaccgagaaaaagagctctggcatggataaggagagcgcactcgataagagtgacctaaaaaaggacaagaacgattacctaccattatattcgtcaagcactaaggtgaaagacgaatatatggttgcagagtacgctgtggaaatgccacactcgagtgtgggcggctcgcatcttgaggacgcatcaggcgagattcaccccccaaaactggtccttaagaaaatcaacagtaagcgatcgctaaaacagcccctcgagcagaaccagaccatttcaccgctgtctacctacgaggaaagcaaggtgagcaaatacgccttcgagctggtggataagcaagccctgttagacagtgagggaaacgctgacatcgaccaggtcgacaatctccaggagggtccatccaagccggttcacagttcgaccaactacgacgacgccatgcagttcctgaagaaaaaaaggtacctgcaagctgccagcaacaattcccgggagtacgccctgaatgtggggaccattgctagccagccctccgtgacccaggctgctgtcgcttccgttatcgacgaatcaacaactgcctctatcctggaaagtcaggctctgaatgtggagataaagagcaatcacgacaagaacgtgatacccgatgaagtgttgcagactctgctggatcattactctcacaaggcgaatggacagcatgagatctcattcagtgtggcagacactgaagtcacctcatctataagtattaactcttccgaggtgcctgaggtgacccccagtgaaaacgtgggaagctcttcccaggccagctcctccgataaggccaacatgttgcaagagtatagcaaattcttgcagcaggctctggaccgcacaagccagaacgatgcctatctcaacagcccttctctgaactttgtaacagacaatcagactctcccaaatcagccagcattttcatccatcgataagcaagtctacgccacaatgcccatcaatagctttagatccggtatgaactcgcccttgagaaccacccccgataaatctcacttcggtttaatcgtgggcgattcacagcacagtttccccttttccggcgatgagacaaaccacgccagtgccacctcaactcaggatttcctggaccaagtcacaagccagaagaaggccgaagcccaacctgttcaccaggcatatcaaatgtcaagtttcgagcaaccctttcgagcaccataccatgggtccagagctgggattgctacacagtttagcactgccaatgggcaggtcaatttgcgcgggcccggcacctccgccgaattcagcgagttccccctcgtaaatgtaaacgacaatcgggccgggatgacgtcctcccccgacgccactacagggcagacttttggatag

SEQ ID NO: 141135 - DNA, 2385 bp, Artificial Sequence
  Description of Artificial Sequence: Synthetic coding sequence
atgaatatcgacgataaactggaagggttatttttgaagtgcggaggaattgacgaaatgcaatccagccggactatggtggttatgggtggagtcagcggccagtcgacagtgtccggtgagttgcaggatagcgtccttcaggatcgctctatgccccatcaggaaattctggctgcagacgaagttctgcaggagagtgagatgcgccagcaggatatgatttcccatgatgaacttatggtccacgaggagactgtgaagaatgacgaggaacagatggagacacacgaacggctcccccaaggcttacaatatgcattgaatgttcccatctcagtcaaacaggaaattaccttcactgacgtttcagagcagctgatgcgcgacaagaagcagatccgcgaacccgttgacctccagaaaaagaaaaaacgtaagcagcggtcccccgccaagatactcacaatcaacgaagatggcagcctgggcctgaagacaccaaaatcacatgtctgtgagcattgtaatgctgccttccgcaccaattatcatttgcagcgccacgtctttatccacacaggagagaagcccttccagtgcagtcagtgcgacatgagatttatccagaagtatctgttgcagcgtcacgaaaaaatccataccggggaaaaaccgttcagatgtgacgagtgtggcatgcgtttcatacagaaatatcacatggaacgccataaaaggacacacagtggcgagaaaccttaccagtgtgagtactgcctgcagtatttttcccgcacagacagagttctgaagcacaagcgtatgtgtcacgaaaaccacgacaagaagctgaaccgctgcgccattaaagggggccttctcactagcgaagaagatagcggctttagtacgtccccaaaggataattccttgcccaaaaaaaaaagacagaagactgagaaaaaatctagtggcatggacaaagaatctgcgttggacaagagtgacttgaagaaagataaaaacgactacctccccttatactcgagctcgaccaaagtaaaagacgaatacatggtggctgagtatgctgtggagatgcctcattccagtgtgggggggtcccatctggaagacgcctctggcgagatccatccacctaaattggtcctgaaaaaaattaatagtaagcgttctctcaaacagccgctcgaacagaatcagacaattagtcctttgtcgacctatgaagaaagtaaagtgtccaaatacgcattcgaactggtggacaagcaggccctgttagactccgagggcaacgccgacattgaccaggttgacaacttgcaggaaggaccaagtaagcctgtgcactcatcaaccaactatgacgatgcaatgcagtttctcaagaagaaacgctatcttcaagctgcgagcaacaatagtcgggaatatgctttgaacgtgggcactattgcatcacagccttccgtcactcaggccgccgtagcctcagtgatcgatgaatccacaaccgcttcaattctggagagccaagccctaaacgtggagatcaagagcaatcatgacaagaacgtcattcccgacgaagttctacagaccttgctggatcattacagtcataaagccaatggccagcacgagatatccttctctgtggcagacacagaggtgacgtcaagcatttccatcaatagctctgaggtgcctgaagtgacacctagcgaaaatgtgggatcgtccagccaggcctccagcagcgacaaggcgaatatgctccaagagtactcgaaatttttacagcaggcccttgaccggacttcgcaaaacgacgcgtaccttaattcccctagtttaaacttcgtgacagacaatcaaactctccccaatcagccagccttttctagcattgacaaacaggtctacgcaactatgcctattaattctttcagatcaggaatgaacagccccctgcggacaacacctgacaaaagccactttggactgatagtcggcgacagccagcactcttttcccttcagtggagatgaaacgaaccacgctagcgcaacttccactcaggactttttggaccaggtgacttcccagaagaaagctgaagctcagcctgtccatcaggcatatcagatgtcgagctttgagcagcctttcagagccccttaccatggttcaagagcaggtatcgccacccaattctctactgctaatggacaggttaacctgcgcgggccaggtacgagcgccgagttctccgagtttcccctagtcaatgtgaacgataacagagccggaatgacctcctcacccgacgccacaactggacaaacgtttgggtag

SEQ ID NO: 141136 - DNA, 2385 bp, Artificial Sequence
  Description of Artificial Sequence: Synthetic coding sequence
atgaacatcgatgacaagctagaagggctgttcctgaagtgtggtggcatcgacgaaatgcagtcctccagaacaatggtagtgatgggcggagtgagcggacagagcacggtgtctggagaactccaggacagcgtgctgcaagatagaagtatgcctcaccaggaaatcctcgcagccgatgaggtactgcaggagagtgagatgcggcagcaggacatgatttcccacgatgagctgatggtgcacgaggaaaccgtaaaaaacgacgaggaacagatggaaacccacgaacgtctgccacagggacttcagtacgctctcaatgtgcctatttcagtcaagcaggagatcaccttcacagatgtgtccgaacaactcatgcgtgataagaaacagatccgggaaccagtcgatctgcaaaagaaaaagaagcggaagcaaagaagccctgctaaaatcctgacaatcaacgaagacggatcgctcggcctgaaaactcctaagtcgcatgtctgtgagcactgcaacgccgcgtttcgcacaaattatcacttacaaagacatgtcttcatccacactggggagaaaccattccagtgttcccagtgtgacatgcgtttcattcagaaatatttattacagcggcacgaaaaaattcacacgggggagaaaccttttagatgtgacgaatgtgggatgagattcatccagaaataccacatggagagacacaagagaacacactctggagaaaagccttatcaatgtgagtactgtttgcagtacttctctaggactgacagggtcttgaagcataagagaatgtgtcatgaaaatcatgataaaaagctgaaccggtgcgccatcaagggaggtctactgacgtcagaagaggactccggtttttccacttccccgaaagataacagtcttcctaagaagaagaggcagaagactgagaaaaaatcctctggcatggacaaggaaagtgcattggataaatcagacctgaagaaggataaaaatgattatctacctctgtactctagcagcaccaaggtaaaggacgaatacatggtggctgaatacgcagttgaaatgccacattcaagcgtgggcggctcccacttggaagatgcctcaggtgaaattcaccctcctaagttagtgctgaaaaaaataaactccaagcgatctcttaagcagccactggagcaaaaccaaactatatcccccctttccacttatgaggagtcaaaagtgtcaaagtacgcgttcgagttagtggacaagcaagcattactggattcagaagggaatgcagatatcgatcaagtggacaacctgcaggagggaccatcgaaaccagtgcatagctctacaaactacgacgacgccatgcagtttcttaagaagaaaaggtatctccaggccgcctcaaacaattcacgcgaatacgcactcaatgttggaaccattgcaagtcagccatcagtcacccaagctgccgttgcatccgtgattgacgaatcgactacagcaagtatcctggagagtcaggctctgaacgtggagatcaaaagcaaccacgacaagaacgtgattcccgatgaagttctccagacattgctcgatcactactcccataaagcaaatggacaacacgagatttcattctccgtcgccgataccgaagtcacttccagcatctctatcaattcctcagaagtccccgaggttactccatctgagaatgtgggctctagctcccaagcatccagctccgacaaagctaacatgcttcaggaatatagtaaatttctgcagcaggccctggatcggacctcacagaatgacgcctacttaaattcaccttcgctcaatttcgttaccgacaaccagactctgcccaaccaacccgcgttctcctctattgacaaacaggtgtatgctacaatgccaattaactcctttaggtccggtatgaatagccccctacgaacaactccagataaaagtcatttcgggctgatcgttggcgacagtcagcactcttttcccttcagcggagacgaaactaatcatgcgtcagcaacgtcaactcaagactttctggatcaggtgacaagccagaaaaaagctgaggcccaacccgtccaccaggcctaccagatgtcttccttcgagcagcctttccgggctccctatcatggcagcagggctgggatcgccacacagttctcgactgcaaacggccaagttaatctgcgcggcccagggacatcagcagagttctctgagtttcctctggttaacgtgaatgacaatcgggccggcatgacatcatctcccgacgcaacaactggccagacatttggttag

SEQ ID NO: 141137 - DNA, 228 bp, Artificial Sequence
  Description of Artificial Sequence: Synthetic coding sequence
atgaacattgacgataaactggaagggctcttcttgaagtgcggcggtatcgatgaaatgcagtcttctcggacgatggtggtgatggggggagtcagcggacagtcaacagttagcggcgaactgcaggattcagtgcttcaggatcgtagtatgccacatcaggagatcctggccgcggatgaagtcctgcaagagagcgagatgagacagcaagacatgatttag

SEQ ID NO: 141138 - DNA, 1365 bp, Artificial Sequence
  Description of Artificial Sequence: Synthetic coding sequence
atgaacattgacgataagctagaaggcctgtttctcaagtgcggaggcatcgatgaaatgcagtctagtcgcaccatggttgtgatggggggggtcagtggtcagagcaccgtatccggggaactccaggactcagtcctgcaagatcggagcatgcctcatcaggaaattctggctgccgatgaggtactgcaggaatctgagatgcggcagcaagatatgatttctcacgacgagctgatggtacatgaggaaaccgtgaagaacgacgaagaacagatggagacccatgaacgactgccccaggggttgcagtatgctttgaacgttccgatttcagtgaaacaagaaatcactttcacagatgtctcagaacagcttatgagagataagaagcagatccgcgagccagtggatcttcaaaagaagaaaaaacgcaagcagagatcacctgcaaaaattctgactatcaacgaggacggctccctcggtctcaagacaccgaagagccatgtctgcgagcattgcaacgccgcctttcggacgaactaccacctccagcgtcacgtcttcattcatacaggggagaagcctttccaatgtagccagtgcgacatgcgtttcattcaaaaatacttgctccagaggcatgaaaaaatccacactggtgagaaaccctttcgatgcgacgaatgtggtatgcgctttatacagaaataccacatggaacggcacaagcgcacccactccggcgaaaaaccctaccagtgcgaatattgcctccaatactttagcagaaccgatcgtgtactaaaacataagcgcatgtgtcatgaaaatcacgataagaaattaaaccgatgtgccattaaggggggtcttctgacgtctgaggaagacagtgggttctcaactagccccaaagataactctttgcccaagaaaaaaaggcaaaagacagagaaaaaaagcagcggcatggacaaagaaagcgcacttgataagtcggatcttaagaaggataagaacgattatcttcccttgtattcctcatctaccaaagtgaaggatgaatacatggtggcagaatatgccgttgagatgccacatagcagtgtcggtggatcccacctcgaggacgccagcggagaaatccaccctccaaaactcgtgcttaagaaaattaactctaagaggtccctgaaacagccactcgaacagaaccaaacgatctccccactgtcaacatatgaggaatccaagttccagtcaatgcttctgaatctgtggattaacagactctactggacacagaaggctatgttgactctgattaggctgataatttgtcgcagggcacagtag

SEQ ID NO: 141139 - DNA, 396 bp, Artificial Sequence
  Description of Artificial Sequence: Synthetic coding sequence
atgcgattcattcagaaatacctgttgcagcgccacgagaagatccataccggggaaaagccatttaggtgtgatgagtgcggcgacgagacaaaccatgcctcagccacatcaactcaagattttttagatcaggtcacctcccagaaaaaggccgaggcacagcctgtgcatcaggcttaccagatgtcgtcatttgaacaaccctttagagctccttaccatggctctcgggccgggattgcgacccagttctctaccgctaatgggcaggtcaatctgagaggccccggaacctcagccgagttctctgagtttccactcgtgaacgtcaacgataatcgtgcggggatgacatcatcaccagatgctactactggacaaacctttggatag

SEQ ID NO: 141140 - DNA, 432 bp, Artificial Sequence
  Description of Artificial Sequence: Synthetic coding sequence
aaaacccactataactgtggtgaacataccaaggccttctccgggaagcacacacttgtgcagcagcagaggaccctgaccactgaacgatgttacatttgcagcgagtgcggtaaaagcttttctaacaaatcgaatctgatcaagcatcggagagtgcacactggagagagaccctatgaatgctcggagtgcgggaagagcttttcgcagcggagcgcactccttcaacacaggggcgttcacacaggggagcgtccttacgagtgttctgagtgtgggaagttttttacctatcattccagcttgattaaacaccaaaaggtgcactccggctctcggccatatgagtgttcggagtgtggcaagtcatttagtcaaaactccagcctcattgagcatcaccgtgtgcatacaggggaaagaccttag

SEQ ID NO: 141141 - DNA, 1314 bp, Artificial Sequence
  Description of Artificial Sequence: Synthetic coding sequence
atggccgccgccactttgcgaacgccgacgcaaggaacagtgactttcgaggatgtagccgtgcacttcagctgggaggagtggggcctattagacgaagcccagcggtgcctatatagagacgtgatgctggagaacctggctctcttaacatcactcgatgtgcatcaccagaaacagcacctgggcgagaaacacttccggagcaatgtgggaagagcactctttgtgaagacctgcacatttcacgtgagcggtgagccatctacttgtagagaagtgggcaaggattttctagccaagttagggtttctgcatcagcaggctgcacacactggcgagcagtcaaattctaagagtgacggcggcgccattagccaccgaggcaagactcactacaattgcggagaacacacgaaagcattttcaggcaaacacactctggttcagcagcagcggacactgactacggaacgttgctacatctgtagcgagtgtggaaaatcgttcagtaaatcttactctctgaatgatcattggcgccttcacactggagagaaaccttacgagtgcagggagtgcggtaagagtttcaggcagagctcttcccttattcagcatcgcagggtacacactgccgtacgccctcacgagtgcgacgaatgcggaaagttattcagcaacaagagcaacctgattaaacacagaagggtgcataccggggagcgtccttacgaatgcagcgaatgcggaaagagcttcagtcagagatctgccctgctccagcaccgcggggtccataccggcgagcgcccatacgagtgtagcgagtgtggcaaattttttacctaccactctagcctaattaagcatcagaaggttcactcaggctctaggccctatgagtgcagcgaatgcggcaaatcatttagtcagaactcaagcctcatcgaacaccatcgggtccacacaggcgagaggccctataaatgttcagaatgcgggaagagcttttcacagcgatctgctctgctccagcaccgcggtgtccataccggtgaaaggccctatgaatgttcagaatgtggcaagttcttcccatattcttccagcctgcgaaaacatcagcgtgtccacactgggtctcgtccttacgaatgttctgaatgtggcaagtcctttacccagaacagtggcttgattaaacatagacgtgtgcacaccggagagaagccttacgagtgcaccgaatgtgggaagagcttctctcacaactccagcttaattaagcatcagaggattcacagccgatag

SEQ ID NO: 141142 - DNA, 1314 bp, Artificial Sequence
  Description of Artificial Sequence: Synthetic coding sequence
atggcagctgctactctccgcacgccgacacagggcacagttacttttgaggatgtggctgtgcacttttcttgggaagaatggggactcctcgatgaagcccagcggtgcttatatcgagatgtaatgttagagaatctcgctttgctgacctcccttgatgtacaccaccaaaaacagcacctcggagaaaagcatttcagaagcaacgttgggcgcgccttatttgtgaagacgtgcaccttccacgtgagcggagaacctagcacatgccgcgaagttggaaaagattttctggcaaagcttgggttcctgcaccagcaggcagcacacacaggggaacaaagcaacagtaagtcagatggtggggcaatcagtcatcgtgggaaaacccactacaattgtggagagcacacaaaggcgtttagcggaaaacatacattggttcaacagcaaaggacattgacaactgagcggtgttatatttgcagcgaatgcggtaagagcttttcaaagtcttactcactcaacgatcattggcgcctgcatacgggcgagaagccgtacgaatgtcgggagtgcgggaagtccttccgtcagtcctcaagcctaatccaacaccggcgggtgcataccgccgtgcgtccacatgaatgcgatgagtgcggtaagttgttctctaataaatccaacctgatcaagcacaggcgcgtgcacaccggcgagcggccttacgaatgctccgagtgtggcaaaagcttttcccagcgctctgcactgctgcaacatcggggggtgcacacaggagaacggccctacgagtgttccgagtgcggcaaattttttacatatcatagttctctcatcaaacaccagaaagtgcactcaggcagccgtccttacgaatgctctgaatgtggaaagagtttctcacaaaattcaagtctgattgaacaccatcgcgttcacaccggcgagaggccttacaaatgttcagaatgtggaaaaagcttctcccagaggagcgccctgcttcagcacagaggtgtgcacaccggagaacggccctatgagtgctctgaatgtggaaaattttttccctactcctcctctttgcgcaaacatcagcgggtgcacaccgggagtaggccatacgaatgttccgagtgcggtaagagctttactcagaacagcggactcattaagcataggcgagtacatacgggtgagaagccatacgagtgtaccgagtgcgggaaaagcttctcacacaactcctctctcattaagcatcaaagaattcacagccgttag

SEQ ID NO: 141143 - DNA, 1617 bp, Artificial Sequence
  Description of Artificial Sequence: Synthetic coding sequence
atgacaacattcaaagaggccgttaccttcaaggatgtcgcggttgtcttcaccgaggaggagcttggattgctcgacccggcccagcgcaagctgtatcgcgacgtcatgctggagaactttagaaatctgctgtccgtgggccaccagccctttcaccaggatacctgtcattttctcagagaagaaaagttttggatgatgggtaccgctacccagcgggaaggaaacagcggaggaaaaatccagactgaactcgagagcgtacccgaagcaggagctcatgaagaatggagctgtcaacagatttgggaacaaatcgctaaggatttgacacggtcccaggattcaatcataaataactcccagtttttcgaaaacggtgacgtgccatcccaagttgaagcgggcttgccgacaattcacaccggccagaaaccaagccagggcggtaagtgtaaacagtccatctcggatgtccccatctttgaccttccccaacagctgtacagcgaagagaagtcttatacttgtgacgagtgcggtaaaagcatctgctatatttccgccttgcacgtgcaccagcgcgtgcatgtgggcgagaagctctttatgtgcgatgtgtgcggcaaggagttttctcagagctcgcatctgcaaactcatcaaagggtccataccggcgagaagccatttaaatgcgagcagtgcggaaagggatttagtcggcgctctgcactgaatgtccacaggaagctgcacaccggcgaaaaaccgtacatctgtgaggcttgtggaaaggcattcatccacgacagccagctgaaagaacacaaacgcattcacacgggcgagaagccattcaagtgtgatatctgtgggaaaaccttttactttagatcgcgtctgaagagccacagcatggtgcacactggagagaaaccctttcgctgtgatacatgcgataaatcattccaccagcggagtgcactgaacagacactgtatggtccacactggtgaaaaaccgtaccgatgcgagcagtgtggaaagggttttattggtcgcctggatttttacaagcatcaggtggtacatactggcgagaagccttacaattgtaaagagtgtggcaaatcattcaggtggagctcatgtctgttaaaccatcagagagtccattccggcgagaagagcttcaaatgcgaggaatgcggaaagggattctacacaaattcacagttgagctcacaccagaggtcacactccggggagaaaccttacaagtgtgaggagtgtggtaaagggtacgtgacgaaattcaacctcgatctacatcaaagagtgcataccggtgagcgcccctacaattgtaaagaatgtggcaagaacttcagtcgggcttctagtattctgaatcacaagcgacttcactgccagaagaaaccttttaagtgcgaagactgcggaaagaggctggtgcataggacatatagaaaggaccagccaagggactactccggagaaaatccatcaaaatgcgaggattgtggacggaggtacaagaggaggctaaacctcgatattctgctgtcgctgttccttaatgatacctag

SEQ ID NO: 141144 - DNA, 1650 bp, Artificial Sequence
  Description of Artificial Sequence: Synthetic coding sequence
atgataaaaaggagcaaggtcctagtcttctgtagcaaaattatggaggaagcagtcactttcaaagacgtcgccgttgtgttcacagaggaggaacttggcttactggaccctgcccagagaaaattgtacagagacgtcatgctcgagaactttaggaacctccttagcgtaggccatcagccttttcaccaggatacgtgtcacttcttgagagaggagaaattctggatgatggggactgccacccagcgtgagggaaattcgggcggaaagatccaaactgaacttgagagcgtgcccgaagcaggcgcccatgaagagtggagctgccagcagatctgggaacagattgccaaggatttgaccagaagccaggacagcatcattaataactcgcagttttttgagaacggggatgtccccagtcaggtagaggccggcttacctacaatccacaccgggcagaagccgtcacaaggggggaaatgcaaacagtccattagcgacgtaccaatttttgatctgccgcagcagttatatagcgaagaaaaatcgtacacatgcgacgagtgcggaaagtctatttgctatatctccgccctacacgtgcatcagcgcgtccacgtcggcgaaaaactcttcatgtgtgatgtatgtggcaaggagttctcccagagctcccatctccagacccatcagagggttcacactggtgaaaaaccgtttaagtgtgagcagtgtgggaaagggttctcccgcaggtctgctctaaatgttcatagaaagctgcacactggagagaaaccatatatctgtgaagcgtgcgggaaggccttcattcacgattctcagctcaaggagcacaagaggatacacacaggcgagaagccgtttaagtgtgacatctgtgggaaaactttctacttccgtagtcgcctgaaatcacactccatggtccacaccggtgaaaagccatttcggtgcgatacatgtgataagagctttcatcaaaggagcgcactcaatcgccattgcatggtgcatacgggggaaaaaccgtaccgctgcgagcagtgcggcaaaggattcatcggccgcctggatttttataagcaccaggtggtgcacaccggggaaaaaccctacaactgcaaagaatgcgggaaatcctttaggtggtcctcttgtctgctcaaccatcagcgcgttcattctggggagaaatcttttaaatgtgaagagtgcgggaagggcttctacacaaattcccagctgtcatctcaccagcgcagtcactctggggagaagccttacaagtgcgaagagtgtggcaaaggatatgtgacaaagttcaatctcgacctgcatcaacgggttcatactggcgagaggccctacaattgtaaggagtgcggcaagaacttctcgagagcttcatctatactgaatcacaaacgcctgcactgccagaaaaagccattcaagtgtgaggactgcggaaaacggcttgttcacagaacatacaggaaggatcagccccgagattatagcggtgagaacccaagcaagtgcgaggactgcgggagacgctataagcgtaggctgaatctcgatattctgctgtctctctttctgaatgatacctag

SEQ ID NO: 141145 - DNA, 693 bp, Artificial Sequence
  Description of Artificial Sequence: Synthetic coding sequence
atggtgatgtctccaccccgcctaaaacaagattacccccagttcatccaggatcgcaacctgcccagggttggatctgtcaacagcccctccgtaatgtttccttctctgatcttcctgtcttcctacactcagaagcgcagcctgatccacgtgatgtctgtggaaaaggccagtgtgacatcccagcttttcatgttcattcgagaatcaacatgggagagaaacagcttgtgtgttatgtgcgtggctcgcaatcttgtcaaagctcatatttgtaaactcattcgcgagtccacgttagaaaggaatcattccaatgtcagcaacgttgggaaggtatccgtggtggaccagcacctgatgtttattgtaaactacactcaggaaagaaacctgactttcgtgcggcatgtgggcagaccctcattcatgatcccgtccctgcgcaatatacgcgagagcatcctgggtcgtaatcacagcaacgtaatatacgttgtgcgtcctagtattctgggccaggatctgcgggctatcccttggtttacccaggagaagaatcacctgggagtgatccatgtcataagggcttttatccgcgatcagcatctcataggaatagcgtggtccactcaggagaggaatcgcaccgatgtgtccagtgtggaaaaggccctcctggtggggtag

SEQ ID NO: 141146 - DNA, 1521 bp, Artificial Sequence
  Description of Artificial Sequence: Synthetic coding sequence
atgccggctaatgggacttcccctcagcggtttcccgcgctaatccccggcgagccgggccgctcgttcgagggctcagtgtccttcgaggacgtggctgtggatttcaccaggcaggaatggcatcgcttagaccccgcccagcgcactatgcacaaagatgtaatgctggaaacgtacagtaatctcgccagcgtcggactttgcgtcgcaaagcccgagatgatcttcaaactggaaagaggtgaagagctctggatactggaagaggagtcatcagggcacggctactccggcagcttgagcctactgtgtgggaatggatccgttggcgataatgccctgcggcatgataacgaccttctccatcaccaaaagatccagacattggatcagaacgttgaatacaacggctgccgcaaagcattccacgagaagaccggctttgtgcggcggaaacggacaccccgtggcgacaaaaatttcgagtgccacgagtgcggcaaagcatattgtcgtaagtctaacttggttgaacatctgaggatccacacgggggagcgtccttatgagtgcggagagtgtgccaaaaccttttcggcaagatcatacttaatcgctcaccagaagacacacactggagagcgaccttttgagtgtaatgagtgtggcaaaagttttgggcggaaatctcagctgatactccacacacggacgcacaccggagagcgcccttatgaatgtaccgaatgcgggaaaaccttctcagaaaaagcaaccctgacgattcatcaacgcactcacaccggtgagaaaccatacgagtgtagcgagtgtggcaaaacctttcgtgttaagatatccctcacacagcaccaccgcacgcatacgggtgagaaaccgtacgaatgtggggaatgcgggaaaaattttagagccaaaaagtcgctgaatcagcatcagaggatccataccggggaaaagccttacgagtgcggagagtgcggaaagttttttcgcatgaaaatgacattgaacaatcaccagagaactcatacaggggaaaaaccttaccaatgcaacgagtgtggcaaaagtttcagagtgcactctagcctcggcattcaccagcggatccacaccggtgaaaagccctacgagtgcaatgagtgcggtaacgcattctatgtgaaggccagacttatcgaacaccagaggatgcactcaggcgagaaaccttacgaatgctcagagtgtgggaaaattttttcaatgaagaaatctttgtgccaacaccgccgaacccacacaggagaaaaaccctatgagtgtagtgaatgcggcaatgccttctatgtaaaagtgaggctgatagaacatcaacggatacacacaggagaacggcccttcgagtgccaggaatgtggcaaggcgttctgtcgcaaggcgcatctcaccgaacaccagagaacacacatcggatggagctggcgatgtacaatgaaaaaagcttcacattag

SEQ ID NO: 141147 - DNA, 2049 bp, Artificial Sequence
  Description of Artificial Sequence: Synthetic coding sequence
atgccatcgctgcgaacaaggcgcgaggaggcggagatggaactgtccgtccctgggccatctccttggacacccgcagcgcaggctcgcgttagagatgcccctgccgtgacccaccccggaagtgcagcctgtggcaccccgtgctgctccgacaccgagctggaggccatctgccctcactatcagcagcctgactgtgatacccgcacagaggataaggagtttctgcataaggaagatatccacgaggacctcgagtctcaggcagagatttcggagaactatgcaggcgacgtctcccaggtcccggaactgggggacctctgtgacgatgtctctgagagggactggggcgtgcccgaaggacgtcgcctgccacagtccctgtcacaagagggtgactttacaccagctgctatgggcctgctaagaggacccttgggtgagaaggacctcgactgcaacgggttcgactcaagattttctcttagtccaaacctgatggcctgtcaggaaatcccgaccgaggagcgccctcacccgtatgacatgggcggccagtcatttcagcatagtgtggacttaacaggtcatgagggagttcctacggccgagtccccattgatctgtaatgaatgtggaaagacgttccaggggaatcccgatctgattcaacggcaaatcgtccatacaggcgaggcttccttcatgtgcgacgattgtggcaagacttttagccagaacagtgtcctcaagaacaggcacagatcacatatgagcgagaaggcttatcagtgtagcgaatgcggcaaagcatttcgcggccactcagacttttcaagacaccagtcccatcattcaagcgagcggccttacatgtgtaatgagtgtggtaaagccttctcccagaactcttctttaaagaagcatcaaaagtcccatatgtccgagaaaccttacgaatgcaacgagtgtggcaaggctttcaggagatcttctaatctgattcagcaccagaggatacactcaggagaaaagccctatgtgtgcagcgaatgtggaaaagccttcaggcgctcctcaaacctgattaagcatcacaggacccacacaggggaaaagccattcgagtgcggtgagtgtggcaaagccttctcccagtctgcccacctaaggaagcaccagcgcgtgcacacgggagaaaagccctacgaatgcaatgattgcggcaagccgttctctcgggtctccaacctgatcaagcatcatagagttcacacaggggagaagccatataaatgttctgactgtgggaaagcattcagtcagtcatcatcgctgatccaacatcggaggattcacactggagagaaaccacacgtttgtaatgtctgcgggaaggcgttcagctactcttctgtccttcgaaaacaccagatcatccatacaggagagaaaccatatagatgttctgtatgtggaaaagccttttctcacagctcggctctgatccaacatcagggagtgcatactggtgataagccatatgcctgccacgagtgtggcaaaactttcggccgctctagtaatctcatcctccaccagagagtgcatacaggagagaaaccatacgagtgcaccgaatgcgggaaaactttttcacagagctctaccctgattcaacatcagcggatccataacgggttaaagccgcacgaatgcaatcagtgcggcaaagcttttaacaggagctctaacctgatccatcatcagaaggtccacaccggcgaaaagccttatacctgcgtagagtgcgggaaaggcttctcccagtcatcacatctgattcaacatcagattatacatacaggggaacgcccctataaatgcagcgaatgcggtaaagccttttcccagcggagcgttctgatccaacatcagcgcattcatacaggcgtcaagccctacgattgcgcagcctgcgggaaggctttcagccagcgctccaagctgattaagcaccagctgatccatacacgtgaatag

SEQ ID NO: 141148 - DNA, 2049 bp, Artificial Sequence
  Description of Artificial Sequence: Synthetic coding sequence
atgccatctttgagaacaaggcgggaagaggcagagatggaactgtctgtgccaggaccctccccttggacaccggctgcccaggctcgggtacgcgatgctccagctgttacgcatcccgggtctgccgcctgtggcacaccatgttgtagcgatactgagcttgaagccatttgtcctcattaccagcagccggattgtgatacccgcactgaagacaaggagttcctacacaaagaggacatccatgaggatctcgagagccaagccgaaatcagcgagaactacgccggagatgtcagccaggttcccgaactgggcgacctctgcgatgatgttagcgagcgcgactggggtgtcccagaaggaaggaggctgccccagagcctgagccaggaaggggacttcacaccagctgcgatgggccttttacggggtcccctgggagaaaaggatctggactgcaacgggttcgacagcaggttcagccttagcccaaatctcatggcgtgccaggaaattccaacggaggagcggccccacccctatgacatgggagggcagtcctttcaacattcagttgacctgacaggtcacgagggggtgcccactgccgaatccccacttatttgcaacgaatgcggaaaaacattccagggtaatcctgacctgatccagagacagatagtccacaccggggaggccagttttatgtgcgatgattgcggtaagactttcagccagaactcagtactgaagaacaggcatcggtcccatatgagcgagaaagcctatcagtgttctgagtgcggaaaggcctttcgcggacactccgatttcagtcggcaccagagtcaccactccagtgagcggccatacatgtgtaatgaatgtggcaaagccttctcccagaattcaagcctgaaaaaacaccagaagtcccacatgtcagaaaaaccctacgaatgtaacgagtgtgggaaagcctttcggagaagcagtaatttaattcagcatcaacgtattcactcaggcgaaaaaccttacgtctgcagcgagtgtggaaaggcatttcgccgctcatctaatcttatcaagcaccacagaacgcacacaggtgagaaaccattcgagtgtggggaatgtggcaaggccttttctcaatctgcgcacttacgcaagcatcagcgcgtgcatacgggcgagaagccctatgagtgcaacgattgcgggaagcccttctctcgggtgtctaacttgatcaagcaccacagagtgcatacaggagagaaaccgtataagtgtagtgactgtggtaaggcgttcagtcagtcctcaagcttaatccaacatcggaggattcatacgggtgaaaaaccgcacgtgtgcaacgtgtgtggcaaggcattcagctactcttctgtcctccgcaaacatcagatcatccatactggtgagaagccataccgttgttccgtgtgcggcaaggctttcagccatagtagcgcccttattcagcaccaaggcgtccacactggagataaaccgtacgcgtgccacgaatgtggtaagactttcggcagaagctctaacctgattcttcaccagcgggtccacaccggcgagaaaccttatgagtgcactgagtgtggcaagactttcagtcagagctccactttaattcaacaccagcggatacacaacggattaaagcctcacgagtgtaatcagtgcggcaaagcatttaatagatctagtaacttaattcaccaccagaaggtgcacaccggcgaaaaaccttatacttgtgtggagtgtggcaaaggcttcagccagtcctctcatctgattcaacaccagatcatacacactggagaacggccgtataaatgcagtgaatgtggcaaagcattctctcaacggtctgtattgatccagcaccaacgaatccacaccggcgttaaaccatacgattgtgcggcttgtgggaaagccttctctcagagaagcaaactaattaagcaccagctgattcatacccgcgagtag

SEQ ID NO: 141149 - DNA, 444 bp, Artificial Sequence
  Description of Artificial Sequence: Synthetic coding sequence
atggcattgactcaggttcgcctgaccttccgggacgttgctattgaatttagccaggaagagtggaagtgcttggatcccgcgcaacggattctctacagagatgtgatgttggaaaactattggaacctcgttagcctcggcctctgtcactttgacatgaatatcatttccatgctcgaagaggggaaggaaccctggacagtgaaatcctgtgttaaaattgctagaaagcctcggactcctgagtgtgtcaagggcgtggtgacagacctgttgcggcgatggaagcactggctgctgctcctgggcatttgctgccccaaaccacacggacgtgtgtctagcaggctgcgtctgtcccgcagcctggggcacttttttcattcagccttcgcgaccttcatgggggtctgtgataaaagggttggtagtatcttttag

SEQ ID NO: 141150 - DNA, 2457 bp, Artificial Sequence
  Description of Artificial Sequence: Synthetic coding sequence
atggccctgacacaggtcagactgactttcagggacgtcgcaatagaattctcccaggaggagtggaagtgtctcgacccagcgcagcgcattttataccgcgacgtgatgctcgagaactattggaacctggtaagtttagggctctgccacttcgacatgaacatcatttcaatgctggaggagggcaaagaaccttggacagtcaagagctgtgtgaaaattgcacgcaagcctcgaactcctgaatgtgtaaagggggtcgtgactgatatccccccgaagtgcactattaaggacctgctccccaaagagaagtcttcaacagaggctgtgtttcacaccgtggtgctggagcggcacgaatctcctgatattgaggattttagctttaaggaaccccagaaaaacgttcatgacttcgagtgccagtggcgagacgacactgggaattataaaggtgtcttgatggcacaaaaagaaggtaaacgcgatcagcgggatcgacgggacatcgagaacaagttgatgaacaatcaactgggagtttcttttcacagccatctgcctgagctgcagctgtttcagggggaggggaagatgtatgaatgtaaccaggtagaaaaaagcaccaacaatggtagttcggtgtctcctcttcagcagattccaagcagtgtccagacccatcgttccaagaagtatcatgaactcaaccacttttctctgctgactcaacggcggaaggccaactcttgcggcaagccatataagtgcaacgagtgtggcaaggcatttactcagaactctaatctgaccagtcaccgaaggattcatagtggtgagaaaccctataagtgttccgagtgcggcaagacgttcaccgtccgctctaaccttacgatccaccaggtaatccatacaggagagaagccatacaaatgccatgaatgcggtaaggttttcaggcacaatagttacctggctacacacagaaggatccatacaggagaaaagccctacaagtgcaacgagtgcggcaaggctttcaggggacactccaacctgacaacccatcagctaatccacacaggtgagaagccattcaaatgcaatgagtgcggcaagctctttacacagaacagccatcttatttctcactggaggatacacaccggcgaaaaaccctacaaatgcaacgagtgtggcaaggccttttcagtgagaagcagcctcgctatccatcagacaatacataccggagaaaagccatacaagtgcaacgaatgcgggaaggtcttccggtataatagttaccttggcaggcatcggcgcgtgcataccggggagaaaccatacaagtgtaatgagtgtgggaaagcttttagcatgcactctaatctcgcgacgcaccaggtaatacacacaggaacaaaaccattcaagtgtaatgaatgcagcaaagttttcactcagaattcccagctggcaaaccaccggaggatacacacaggcgagaagccctataagtgtaacgaatgtggcaaagccttctctgtgagatcgagcctaactacgcaccaggccattcacagcggcgaaaagccatacaaatgcatagaatgcggcaagagcttcacacagaaatcacacctgcgctctcacagaggaatccactcgggtgagaaaccctacaagtgcaacgagtgcgggaaggtttttgcacagactagccagctggcccgccattggcgagtccatactggcgagaagccatataagtgtaacgattgtggaagggcctttagtgaccggagttccctgactttccatcaggctatacatactggggaaaagccatacaagtgtcacgaatgtggaaaggtgttccgtcacaacagctacctcgcaactcaccgacgcatccacactggggagaaaccttataaatgcaacgaatgcggcaaggcattcagtatgcacagtaacctgaccactcataaggtgatacacaccggcgaaaagccatacaaatgcaaccagtgtggcaaagtgtttacccagaattctcacttagccaaccaccagagaacccacactggcgaaaagccctatcgttgcaatgagtgtggtaaggcattttctgtgcggagctcactgacaacacatcaagctatccacacaggaaaaaagccatataagtgcaacgaatgtggaaaagtcttcacccagaatgcccacttagcaaatcaccggcgcatccacactggggagaagccttacaggtgcactgagtgtgggaaggcattcagggtcagaagtagcctgacaactcatatggcaatccacactggcgagaagagatacaagtgtaacgaatgcggaaaagtcttcagacagtccagcaaccttgcgtcacaccaccgaatgcataccggcgaaaaaccctacaagtag

SEQ ID NO: 141151 - DNA, 2457 bp, Artificial Sequence
  Description of Artificial Sequence: Synthetic coding sequence
atggcccttacacaggtcaggttgacgtttagggacgtcgctattgaattctcccaagaagagtggaaatgccttgaccccgcccagcgcattctgtatagagacgtaatgctggaaaactattggaatctggtgagcctgggactgtgccatttcgatatgaacataatatctatgctggaggaaggtaaggaaccttggaccgtaaagtcttgcgtgaagattgctagaaaacctcgaacacctgaatgtgtgaaaggtgtggttaccgatatcccacccaaatgcactatcaaagacttgctgcctaaggagaagagctccacagaagctgtttttcacaccgtcgttttggagaggcatgaaagccccgatatagaggatttctcatttaaagagcctcagaagaacgttcacgattttgagtgccagtggcgggacgacaccggcaattataaaggagttctgatggctcaaaaggagggtaaaagggaccaacgggatcgacgggatattgagaacaagctgatgaacaaccagctgggcgtcagtttccatagccatctgcccgagctgcagctgttccagggcgagggaaagatgtacgagtgtaaccaggtggaaaaatctacaaataacgggtcgtctgtgtctcctctacagcaaatccccagcagcgtgcagacacaccgcagcaagaagtaccacgagttaaaccattttagcctccttacccagcgtcggaaggctaactcttgcggaaagccttataaatgcaatgagtgtggcaaggcttttacccagaactcaaatctgacctcccaccgacgcattcattctggcgagaagccctacaaatgttcagagtgtgggaagacctttacagtgaggagcaacctgactattcatcaggtgatccatacaggggagaagccatataagtgccacgagtgtgggaaagtgtttcgtcataactcttatctggctacccatcgcagaatccacaccggggaaaagccatacaagtgtaacgagtgtgggaaagcctttcgaggacactctaatttaactacacaccaactcatccacactggggaaaagcccttcaagtgcaacgaatgcggcaagctgttcacccaaaattctcacctcattagtcattggcgtatccacacaggagagaagccttataaatgtaacgagtgtggcaaagccttcagtgtcagaagttctctggccattcaccagacaatacacactggagaaaaaccgtacaaatgcaatgagtgtgggaaagtttttaggtataattcctacctcgggagacaccggcgtgtgcacacaggagagaaaccctataaatgcaatgagtgtgggaaagctttctccatgcatagcaacctagcaacccaccaggtcatccacacagggacgaaacccttcaaatgcaatgaatgtagcaaagtgttcacccagaattcacagctggccaatcaccgccgcatccacacgggtgaaaaaccctacaaatgcaacgaatgcggaaaagccttcagcgtgagatcctcactgactactcaccaagcgatacacagcggagagaagccttacaaatgtattgagtgtggtaaaagttttacccagaagtcgcacctccgcagccatcgcggcatacacagcggagagaaaccttacaaatgcaacgaatgcgggaaagtcttcgcccagacatcccagcttgcccgacactggcgtgtgcataccggggaaaaaccttacaaatgcaatgattgcggcagagctttcagtgatcgctcctctctcacatttcatcaggccatacacaccggggagaaaccatacaagtgtcacgaatgcggcaaagtcttccgtcacaactcatacctcgccacacaccggcgcatccatactggggaaaaaccttacaagtgcaatgagtgcgggaaagcctttagtatgcactcgaaccttaccactcataaggtgatccacactggagagaaaccatacaagtgcaaccagtgtggaaaggttttcacccagaattctcatctggccaaccaccagagaacccacacaggcgagaaaccctaccgctgcaacgagtgtggtaaggccttttccgttagatcaagcctgactactcaccaggctattcatactgggaaaaagccatacaagtgcaacgaatgcggcaaggtgttcacccaaaacgcacaccttgcgaaccatcgcagaatccatactggggagaagccttacagatgtacagagtgcggaaaagcattccgggtcagatctagcctgacgacacacatggctatccacaccggagaaaaacggtataagtgcaatgaatgtggcaaggtctttcgccagtctagtaatctcgccagccatcatcggatgcatacgggagaaaaaccttataagtag

SEQ ID NO: 141152 - DNA, 2457 bp, Artificial Sequence
  Description of Artificial Sequence: Synthetic coding sequence
atggccctcactcaagtacggctgacatttagggacgttgcaattgagtttagccaggaggaatggaaatgtctagaccctgcccaacggatcctgtaccgcgacgtcatgttggaaaactactggaatctagtgtcactgggcctttgccattttgatatgaatataatcagcatgctggaggagggcaaagagccatggactgtgaagagttgtgtgaaaattgctagaaaaccgaggacgcccgagtgtgtaaaaggagtggtgaccgatatcccccccaaatgcactataaaagatttgttgccaaaagagaaaagttccaccgaggctgtttttcatacggttgtcttagagcggcacgagagtcccgatatcgaagatttttcatttaaagagccacagaagaatgtccacgattttgaatgtcaatggcgtgatgacaccggtaattataaaggggtgttgatggctcagaaggagggaaaacgcgaccagcgggatagacgggatattgaaaacaaactgatgaacaatcaattaggggtatcgttccacagccacctccccgaactccaactttttcagggagaggggaaaatgtacgagtgcaaccaggttgaaaaaagcactaataatggatcatcagtgagcccacttcaacagattcccagcagtgtccagacacatcgcagcaagaagtatcacgagttgaaccatttcagcctgttgacccagcgacgaaaggcgaatagctgtggcaagccttacaaatgtaacgagtgtgggaaggctttcacacagaattccaacctcacctcacatcgaaggatacatagtggagagaaaccatacaaatgctctgagtgcggcaagaccttcacggttcggtctaacctaactattcaccaagtgatccataccggtgagaagccatataagtgccatgagtgtggaaaggtctttaggcacaatagttacctggcaacccaccgacggatccataccggagaaaagccatataagtgcaacgagtgtggtaaggcttttcgcgggcacagcaatctgactacccaccagctcatacacacgggagagaagccttttaagtgcaacgagtgtggcaagttgtttacacagaacagccatctcatttcacattggcgcattcatactggcgaaaagccctataagtgcaacgagtgtggtaaggcttttagcgttaggagttccctggcgattcaccagaccatccatacaggtgagaagccctacaaatgtaacgagtgtgggaaagtgttcaggtataacagttacctcggaaggcatagacgagtgcataccggagagaaaccgtataagtgtaacgagtgcgggaaggccttcagtatgcattccaacttggccacccaccaagtcatccatacgggaactaagccttttaagtgtaacgaatgtagtaaggtttttacacagaattcacagctggcgaatcacagacggattcacactggcgagaagccctataaatgcaatgagtgcggcaaagcattcagcgtgagatcatccctcaccacgcaccaagccatccactctggcgagaagccatacaagtgcatcgagtgtgggaaaagtttcacacagaagtcgcacctccgaagccaccgcgggatacactcgggagaaaaaccctataaatgtaacgagtgcggcaaggtcttcgcccaaacctcccagttggcacgccactggagagtgcacaccggggagaagccctacaagtgcaacgactgtggcagagcttttagtgaccggtcctcattaacatttcatcaagcaattcacaccggggagaaaccatacaaatgccatgaatgcggaaaggtgttccggcataattcctatctcgcaactcacaggagaatccacacaggagagaagccctataaatgcaatgagtgtggtaaggcgttcagtatgcattctaatctcactactcataaggtaattcacaccggggaaaagccatataaatgtaaccagtgcggcaaggtttttacccagaattcccacctggctaatcatcagaggacgcacacaggagagaagccttacagatgtaacgagtgcggcaaggccttcagcgtgcgaagttcccttactacacatcaggccatccacactggcaagaagccctacaagtgtaacgaatgcgggaaagtgtttacccagaacgcccacctggctaatcatcgccggatccatacgggagagaagccctaccgctgtactgagtgtggcaaggccttccgggttaggtcttccttgactactcatatggcgatacataccggggagaagaggtataagtgcaacgagtgtggcaaagtcttccgccaatcctccaatctggcaagtcatcacagaatgcataccggcgaaaaaccctacaaatag

SEQ ID NO: 141153 - DNA, 1350 bp, Artificial Sequence
  Description of Artificial Sequence: Synthetic coding sequence
atggagttctttatttcaatgtccgaaaccattaaatacaacgacgatgatcacaagactctcttccttaaaacactgaatgagcagcgcctggagggcgagttctgcgatattgccatcgtcgttgaggatgttaagtttagggcacacaggtgcgtcctggccgcctgttctacctacttcaaaaaactgtttaaaaagctcgaggtcgacagttcctctgtaatcgaaatcgattttctgaggtcagacatctttgaagaagtgctcaattatatgtatactgccaaaatctctgtgaagaaagaagacgttaatttaatgatgagttctggtcagattctggggattcggttcctggacaagctatgctcccagaaaagggacgtgtcaagtcctgatgagaataatgggcagagcaaaagtaagtactgtctcaagataaatcgtccaatcggggacgcagctgacacacaggatgatgatgtggaggagatcggcgaccaggatgactctccgtctgacgacacagttgagggtactcctccatctcaggaggacgggaaatctcccactaccacactgcgggtgcaggaagctatcctgaaagagctgggcagtgaggaagtccggaaggtgaactgctacggtcaggaggtggagagcatggagactccagagagtaaggacctgggatcccagaccccacaggcactcacatttaacgatggaatgagcgaggttaaagacgagcagactccaggctggacgacagccgctagcgacatgaagtttgagtatcttctctatggtcatcatagagaacagatcgcatgccaggcatgtggcaagactttttctgacgaaggcaggctgcgcaaacacgaaaaacttcatacagctgacaggccgttcgtgtgtgaaatgtgtacgaagggctttacaactcaagcccatctgaaggagcatctgaaaatccataccgggtacaaaccttactcctgtgaagtgtgcgggaagtcctttatcagggcaccggacctcaagaagcacgaacgggtgcactcaaacgagcgcccattcgcctgccacatgtgcgacaaagccttcaagcataagtctcacttgaaggatcacgaacgccgacatagaggcgagaaacccttcgtgtgtgggagctgcaccaaggcatttgccaaagccagtgacctgaagagacacgagaataacatgcatagtgagcgaaagcaagtcacacccagtgccattcaatccgagacggaacagctgcaagctgccgctatggcagcagaagctgaacaacagctcgagaccatcgcctgtagctag

SEQ ID NO: 141154 - DNA, 1350 bp, Artificial Sequence
  Description of Artificial Sequence: Synthetic coding sequence
atggaattctttatctctatgagtgagactatcaaatacaatgatgatgaccacaagaccctcttcctgaagacactgaacgagcagcggttggaaggtgagttctgtgacatagccatcgtggtggaagatgtgaaattcagagcccacagatgtgtgttagctgcatgctcaacatacttcaaaaaactgtttaagaagctggaagtggattccagtagcgtgattgagattgatttcctccggagcgatatctttgaagaagtgctgaattatatgtataccgcgaaaatcagtgtgaaaaaagaggatgtgaatctcatgatgtcatctggacaaatcttagggattcgatttctggacaagttatgcagtcagaaaagggatgtttcttctcccgacgagaataacgggcagtccaaatcaaagtattgtctcaaaattaaccggcctatcggtgacgccgctgacacccaggacgatgatgtagaggagattggcgaccaggacgacagcccttctgacgacacggtagagggaactccgccctcgcaggaggacggcaaaagtccaaccacaactttaagggtccaggaggcaatccttaaggagctaggctccgaggaggtgagaaaagtcaactgctacggccaggaggtagaatcgatggaaactccagaaagtaaagatttaggcagccagaccccccaggctcttacattcaatgatggcatgagcgaagtaaaggacgagcaaactccaggatggacaaccgcagccagtgacatgaaattcgagtacctcctgtatggccatcaccgtgaacagattgcttgtcaagcgtgtgggaagaccttctctgacgagggacgattgaggaaacatgagaagctgcacaccgcagaccggcctttcgtgtgcgagatgtgtaccaagggattcacaacgcaagcccatctaaaggagcatttgaagatacatacagggtataagccttatagctgtgaagtgtgtggcaagtccttcattcgtgcacctgaccttaagaaacatgaacgagtgcactccaacgaaaggccatttgcttgtcacatgtgtgataaagcgtttaagcacaagtctcatctgaaagatcacgagaggcgccacaggggcgagaagccgttcgtatgtggctcgtgcactaaggctttcgccaaggcgagtgatctgaaacggcacgagaacaacatgcactctgagagaaaacaagtcaccccctccgctattcaaagcgagaccgagcaactgcaggccgccgccatggcagcagaagccgaacagcagttggaaactatcgcgtgctcttag

SEQ ID NO: 141155 - DNA, 1458 bp, Artificial Sequence
  Description of Artificial Sequence: Synthetic coding sequence
atggctacggagccaaaaaaggctgcagcccagaactcccccgaagacgaaggcctccttattgttaagattgaggaagaggaatttattcacggacaggatacctgcctgcaacgcagcgagctgctgaagcaagaactatgcaggcagttatttagacagttctgctaccaggactccccaggcccccgggaagcccttagccgtctgcgtgagttatgttgccaatggctcaagcccgaaattcacaccaaagaacagattctggagctattggttctggaacagtttctcaccatcctgcccggtgacttgcaggcgtgggttcacgagcattacccggaatccggggaagaggctgtaacaatcctcgaggatctcgagagaggaacagacgaggcagtgttgcaagtgcaggcgcatgagcacggacaggaaatctttcagaagaaggtgtcaccaccaggacccgccctgaacgttaagctgcagcctgtggaaacgaaggcccattttgactcatcggagccgcaattgctgtgggattgtgataacgaatctgagaacagtcgcagtatgcctaaacttgaaatattcgagaaaattgaatcccagcgtatcatctcaggtcgcatcagcggctacatttcagaggcatctggtgagagtcaggacatttgcaagtccgcaggacgagtgaaaagacagtgggaaaaggaatctggggagtctcagagactatcttccgcccaagatgagggattcgggaagatattaacacacaagaataccgtgcggggggagattatctcccatgatggctgcgagcggcgcttgaatttgaacagtaacgaattcacccaccagaaaagctgtaagcacgggacatgcgaccagagtttcaagtggaatagtgattttatcaatcaccaaatcatttatgctggtgagaaaaaccaccaatacgggaaatcctttaaatctccaaaactggcaaaacacgcggcagtgtttagcggagataaaacgcatcagtgtaatgaatgtggcaaagcattcaggcacagcagtaagctagctaggcatcagcgcatccatacaggcgaacgatgttatgagtgtaacgaatgtggtaagtcctttgctgagagtagtgatctgactaggcaccgtcgaattcacaccggtgaacgaccttttggctgcaaggaatgcgggcgagcatttaatcttaattctcatttaatccgtcaccagagaattcacacaagggaaaagccatacgagtgcagtgagtgtggaaagacatttcgcgtgagttctcacttaattaggcacttccgcattcatactggggagaagccatacgagtgctctgagtgcggaagggcatttagtcagtcatctaacctgtcccagcatcagcgaattcatatgagggaaaacctacttatgtag

SEQ ID NO: 141156 - DNA, 1239 bp, Artificial Sequence
  Description of Artificial Sequence: Synthetic coding sequence
atgtcactcggtggctccgataccatgctaaagggggcagacacaagtgagtccggggcagtcatcagaggcaactaccgtttgggcctgagtaaaaagagttctcttttctcccaccagaaacatcacgtatgcccagagtgcgggcggggcttctgccaaagatctgacctgatcaagcaccagcggacccacacaggcgaaaagccttatctatgtcccgagtgcgggagaagattcagccagaaggcaagtttgtcgatccaccagcgtaaacatagcggcgagaagccttacgtttgccgcgagtgcgggcggcactttcgctacacttcttcattaacaaaccacaaacggatccactctggggagcggccttttgtttgccaagagtgcggcagggggttccggcagaagatcgctctcctactccatcagcgaacgcatttagaagaaaagcccttcgtttgccccgaatgtgggcgcggattttgccagaaagcctccctgctgcagcatcagtcaagccacacaggcgagcgaccattcctgtgtctggagtgcggaaggagcttcaggcagcagagcttgttgttgtctcatcaggtgacccattcgggagaaaagccatatgtgtgcgccgaatgcggccactctttcaggcagaaggtgactctcattcggcatcagcgaacccataccggcgagaagccttatctgtgcccccagtgcgggcggggctttagccagaaggtcactttgatcggacatcagagaacacacacaggggaaaaaccatacctctgccctgattgtgggcgaggatttggtcaaaaagtcaccttgattcggcaccaacgcacacacactggcgaaaaaccatacttgtgcccaaagtgtggaagagctttcggattcaaaagcctgctcacccgccaccagaggacccactccgaggaagagctctatgtggaccgcgtgtgcggtcagggcctgggacagaaatcacacctgatatccgatcaaagaactcactctggcgagaagccctgcatttgcgacgaatgcggaagaggctttggtttcaagtcagcattaatccgccatcaacgcacccactccggcgaaaaaccctacgtgtgcagagaatgcggacgcgggttttctcaaaaaagtcaccttcatcgtcacagacgaactaagtccggccatcagttgttgccccaggaggtgttttag

SEQ ID NO: 141157 - DNA, 291 bp, Artificial Sequence
  Description of Artificial Sequence: Synthetic coding sequence
atgagtcccggtctcctgaccacacgaaaagaagcccttatggctttccgtgatgtcgcagttgcgtttacccagaaagaatggaagcttttgagttctgctcagagaacattataccgggaagtgatgctcgagaattactcccacctggtatctttggggatcgctttctccaagcctaaactcattgaacagttagaacagggtgacgaaccttggagggaggagaatgagcatctgctggacctttgtcccggaaggcgtatcacccgctcaggtgtcagggattag

SEQ ID NO: 141158 - DNA, 1812 bp, Artificial Sequence
  Description of Artificial Sequence: Synthetic coding sequence
atgtctcccggactgctcaccacgcggaaagaggcgctgatggccttccgggacgtggcagtggcctttacccaaaaggagtggaagttattgtcatctgcacaacggaccctgtaccgcgaagtgatgctggagaactactctcatctggtttcactaggaattgccttcagtaaaccaaaattaatcgagcagctggaacaaggggacgaaccgtggcgtgaagaaaatgaacatctgctcgacttgtgtcctgagccaaggaccgaatttcagccctcatttccacatctggtcgctttctcaagtagccagctgctgagacagtacgcactgtccggccaccctactcagatattcccctcctcatcagctggaggagacttccagctggaagcccccaggtgtagctcagagaagggcgaatctggtgagactgaaggccccgattcatctttgaggaaaagaccaagcagaatctctcggacattcttctccccgcaccaaggtgaccccgtcgaatgggttgaaggcaacagggaggggggaaccgatcttcggttggcgcagcggatgagccttggaggatctgataccatgcttaagggcgccgatacatccgagagtggggccgtaattcggggtaactataggctgggcttgtctaagaagtcgtcattgtttagtcaccaaaagcaccatgtatgcccggaatgtggccgtggattttgccagcgaagcgacttgattaagcatcagagaacccatacaggcgagaagccctatttatgccccgagtgtggccgccggttttcacagaaggcctccctgtcaattcaccagagaaaacactcaggcgagaaaccctacgtatgcagagagtgtggcaggcactttcggtatacaagctcactgactaatcataagcggatacacagcggagagaggccctttgtctgccaagagtgcggccgaggcttcaggcagaagatcgcattgctactgcatcagaggacacatctggaggagaaaccctttgtctgcccagagtgtgggcgcggcttctgccagaaagcctcccttctgcaacaccagagcagccacaccggggagcgccctttcctgtgcctggagtgcggtaggagctttcgacagcagtcccttcttttgagtcatcaagtcacacactctggcgagaaaccctacgtatgcgccgaatgcggccactctttcaggcagaaagtgacattgattcgccatcaacgaactcacacgggcgaaaagccgtacctctgtccacagtgtggacgaggcttctctcagaaggttacactgatcgggcatcaaagaacccacactggtgagaaaccgtacctgtgtcctgattgtggaagagggtttggtcagaaggtgacactgattcggcaccagaggacacacaccggggagaaaccatacttgtgtccaaaatgtggccgtgccttcgggtttaaaagtctcctcactagacatcagaggacacacagtgaagaggaactgtacgtagatcgcgtgtgtggtcaggggctaggacagaagagccatctcatttccgatcagcgcactcattcaggcgaaaaaccctgcatttgtgacgagtgcggacggggctttggttttaagtctgctttaatccggcatcaacgaacccactcaggcgaaaaaccatacgtgtgccgagaatgcggtaggggtttctctcagaagagccacctacatcggcaccgacgtactaagtctggccatcaactgcttcctcaagaagtgttttag

SEQ ID NO: 141159 - DNA, 1224 bp, Artificial Sequence
  Description of Artificial Sequence: Synthetic coding sequence
atggcggccaaaatggagatcacattgtcatcgaataccgaggcctcgagtaagcaggagcgacatataattgccaaactggaagaaaagcgggggccccctctgcagaaaaattgcccagatcctgaactctgccgacagtcatttcgccgattttgttaccaggaagtatccggaccccaggaggcccttagtcaactgcgtcaactgtgtagacagtggttacaacctgagttgcacactaaagagcaaattctggagctgctcgtgatggaacaattcctgacaattttgccgccagaaatccaggcccgcgttagacaccgatgccccatgtcctctaaggagatcgtaacactcgtggaggatttccatcgggcgagcaaaaagccaaaacagtgggttgcggtctgtatgcagggccagaaagttctattggaaaagacgggctctcagctcggggaacaggagttgcctgatttccagccacaaaccccaaggcgtgatcttagggagagttcccctgccgagcccagtcaagccggggcctacgaccgccttagcccccaccattgggaaaaatcacccttgttgcaggagcccacacccaaactggccgggacagaagcccctagaatgcgctccgataataaggaaaaccctcaacaggaaggcgctaaaggggcgaagccctgcgcggtatccgcaggcaggtctaaaggtaatggactccaaaacccggagccccggggcgccaatatgagcgaaccgcgcctctcaagaagacaggtaagtagtcccaacgcacaaaagcccttcgcccactaccagcgacactgtcgtgtcgaatacattagtagccctctgaagtcgcatcctctgcgggagcttaaaaaatcaaagggcggaaagcgctcactgagtaaccggctgcagcaccttgggcaccagcctacgagatccgcgaagaagccatacaagtgcgatgattgtggcaagagcttcacatggaattctgagctgaagagacacaaacgtgttcacacaggagagcggccatatacttgtggggaatgcggaaattgctttgggcgccagtctacacttaaactccaccaacgcatccatactggggaaaagccctatcagtgcggtcaatgcgggaagagctttcgccagtcctccaacttgcaccagcaccataggttacaccacggagattag

SEQ ID NO: 141160 - DNA, 705 bp, Artificial Sequence
  Description of Artificial Sequence: Synthetic coding sequence
atggcggcaaagatggagatcactttgagttcgaatacagaagccagctcaaaacaggagcgccatatcatcgctaaactcgaggagaagagagggcctccccttcagaaaaattgccccgaccccgaattgtgtcggcaatcctttaggagattctgctaccaggaagtatccggtccgcaggaggctttatctcaactgcgacagctatgtaggcagtggctccagcccgagctgcacacgaaggagcaaatcctggagctcttagtgatggaacagtttctcaccattctccctccagaaatccaggcacgggtccgccatcgctgtcctatgtcctccaaggaaatagttacactggtcgaagattttcaccgcgcatcaaaaaagccaaaacagtgggtcgccgtgtgcatgcaggggcagaaggttctcctggagaagaccggatcccagctaggagagcaggagcttcctgacttccaaccgcagacgccccggcgcgatctccgtgagtcctcgccagccgagccttcgcaggcaggcgcttatgacagattgtctcctcatcattgggagaagtcccctcttctccaagagcccactcctaaattggcgggcacagagctcttaattgaaaagactgaccctaatatggctactgacgaactgccctgtaagctgtggttgagttttattgcgtag

SEQ ID NO: 141161 - DNA, 2136 bp, Artificial Sequence
  Description of Artificial Sequence: Synthetic coding sequence
atgccggccgatgtcaatttgagtcaaaaacctcaagtgctgggccctgaaaaacaagacgggtcttgcgaggcttctgtgtcctttgaggatgtcaccgtagatttttccagagaggaatggcagcagctagaccctgcccagaggtgcctctaccgcgacgtcatgctcgagctctactcacacctcttcgcggtcgggtatcacatacctaatcccgaagtgatctttcggatgcttaaggaaaaagaaccgcgggtggaggaggctgaagtttcccaccagcgatgccaggaaagagagttcggcctggagataccccagaaggaaatctcaaaaaaagcctcctttcagaaagatatggtgggcgagtttacacgggatggctcttggtgtagcatcctggaggagctgaggttggacgcggacagaactaaaaaggacgagcaaaatcagatccagccaatgtcgcattcagctttttttaacaagaagaccctgaacacggaatctaactgtgaatataaggaccctggcaagatgatccgtactcgtccacatctggcctcctcccagaagcagccccaaaagtgctgcttgtttactgagagcctcaaattaaatttagaagtgaatggccagaatgaatctaacgatacagagcaactagatgatgtagtcggctcaggacagctgttctcacatagttccagcgatgcctgttcaaaaaacattcacaccggcgaaacgttctgtaaggggaaccagtgcagaaaggtgtgtggccacaagcagtccctgaagcagcaccagatacacacacagaaaaagcctgacgggtgctctgaatgcggtggctccttcactcagaaaagccacttattcgctcagcagcggattcattccgtgggcaacctacacgaatgtgggaagtgcggaaaggcattcatgccgcaacttaaactgagcgtttacctcactgaccacacaggcgatattccatgcatctgcaaggaatgtggaaaagttttcatccagaggagcgaactgttaacccaccaaaaaacccacaccagaaagaaaccctacaaatgccacgattgtggtaaagccttcttccagatgctatcactctttaggcaccaaaggactcactctcgcgagaagctctacgaatgtagcgagtgcgggaaagggttcagtcagaactctaccctgatcatccaccaaaagattcatacgggtgaacgccagtacgcatgttccgagtgcgggaaggcctttactcagaaatctactctatcacttcatcagaggatacattctggtcaaaaatcatacgtctgcattgagtgcggacaggcttttattcaaaaggcgcatctgattgtccaccaaaggtcccacacgggagaaaaaccttaccagtgccataattgtggcaaatctttcatatcgaaaagccaactggacatccatcacagaatccataccggtgaaaaaccctacgagtgcagcgactgtgggaagacattcacacaaaagtcgcacctgaatatccaccagaagatacatacgggcgaacggcatcacgtctgctccgaatgtggtaaggcattcaaccagaaatccattctgtccatgcaccagaggatccacaccggtgaaaaaccttacaagtgcagcgagtgcggcaaagcattcacctccaaatctcagttcaaagagcaccaaagaatccacacaggggagaaaccctatgtctgcacggagtgcggaaaggccttcaatggccggagcaattttcacaaacaccagatcactcatacaagggagcgccccttcgtctgctacaagtgtggaaaggccttcgtccagaaatcggagctgatcacccaccagaggacccacatgggcgagaagccttatgaatgcttggactgcgggaaatcttttagtaagaaaccccagctcaaggtgcaccagaggatacatacaggcgagaggccttacgtttgcagcgaatgcggcaaagccttcaacaataggagcaattttaacaaacatcagaccacgcacacacgcgataagtcctacaaatgtagttattcagtgaagggctttacgaaacagtag

SEQ ID NO: 141162 - DNA, 966 bp, Artificial Sequence
  Description of Artificial Sequence: Synthetic coding sequence
atggcagcagggtggctgaccacttggtcgcagaatagcgtgactttccaggaggttgccgtcgatttctcccaggaggaatgggcactcctcgatcccgctcagaagaacctctacaaggatgtcatgctggagaactttcgcaatctcgcttccgtggggtaccagttatgcagacacagcttaatctcaaaggttgatcaggagcagttaaaaaccgatgagagaggaattctacagggagactgcgctgattgggagacccagctgaagccgaaggataccattgcgatgcagaacattcctggtggcaagacttccaatggtataaacaccaactgtgtgaggactcatagcggagaaatgccctacgaatgctcagactgcgggaaagcattcatcttccaatcgtcactcaagaaacacatgagatctcatacaggggagaagccttacgagtgtgaccattgtggaaagagcttcagccaaagctcccatctcaacgtccataaacggacccacaccggggagaagccctatgattgtaaagagtgcggaaaagcttttactgtcccgagcagtctccagaaacatgtgagaactcatactggcgaaaaaccttatgagtgctccgattgtggcaaggctttcatagatcagtcttcactgaagaaacatactagatcccatacgggggagaaaccgtacgagtgcaaccagtgtggcaagagctttagcacaggctcatacctgatcgttcataaacgaacacacactggcgagaaaacgtacgagtgcaaagaatgcgggaaagctttcagaaattccagctgcctgcgtgttcacgtgaggacccacacaggtgaaaagccctacaagtgtatacagtgtgagaaagcgttcagtaccagtaccaatctgattatgcataaacggatccacaacgggcagaagctccatgagtag

SEQ ID NO: 141163 - DNA, 1446 bp, Artificial Sequence
  Description of Artificial Sequence: Synthetic coding sequence
atggccgctggctggctgactacatggagtcagaattccgtgacatttcaagaggttgcagtagacttctcacaggaagaatgggcactgctggaccccgcccagaagaacttatacaaggatgtgatgctggaaaatttcaggaaccttgctagtgttggctaccaactctgtagacacagcttgataagtaaggtggaccaggaacagcttaaaactgatgagcggggcatcctgcagggtgactgcgctgactgggaaacccagcttaaaccaaaggacactattgccatgcagaacattcctggcggaaagacttccaacggtattaacacagccgagaatcaaccgggggaacattcattagaatgcaatcactgcggcaaatttagaaagaatacaagattcatctgtactcgttattgtaagggtgagaaatgctacaagtacatcaaatactcaaaggtattcaaccacccctctacgctgaggagtcacgtcagtattcacattggggagaaaacactagagttcacggattgccgtaaggcgttcaatcaagagtcttctctaaggaaacacctgcggaccccaacaggccagaagttccaggagtacgagcagtgcgatatgagcttttctctacatagctcatgctcagtccgggaacaaatccccacgggggagaagggagacgaatgctcagattatggtaagataagtccgctgtctgtacatactaaaaccgggtccgtcgaagaaggtctcgagtgcaacgagcacgaaaagacatttactgaccccctttcgctgcaaaattgtgtccgtactcactcaggggaaatgccctacgagtgcagtgactgcggaaaggcttttatcttccagtccagtctgaagaagcacatgagatcacatactggcgaaaaaccatatgagtgtgaccactgtggcaaatcttttagtcaatcatctcacttaaatgtgcacaaaaggactcacaccggcgaaaaaccttacgattgcaaagaatgtggcaaggcattcactgtgcccagttccctgcaaaagcacgtgcgaactcacactggggagaaaccgtatgagtgctctgactgcggtaaagccttcatcgatcaatcatcactgaaaaagcacacaaggtctcatactggagagaaaccttatgaatgcaaccagtgcgggaaatccttctccaccggatcttatctgatcgtacacaagcggacccacaccggagaaaaaacatatgagtgtaaggagtgcgggaaggcgttccggaattcctcgtgtttgcgcgtccatgttagaacgcatactggagaaaagccttacaagtgcatccagtgcgaaaaggctttttctactagcactaatctgataatgcataagcggattcacaatggccagaaactgcacgaatag

SEQ ID NO: 141164 - DNA, 363 bp, Artificial Sequence
  Description of Artificial Sequence: Synthetic coding sequence
atggccgccgggtggctgacaacctggtcacagaatagcgttacatttcaggaagttgccgtcgattttagccaggaggagtgggcgctgctcgatccagcccagaagaatttgtacaaagacgtgatgctggagaattttaggaacctggcaagtgtcggctaccagctgtgtagacattccctgattagcaaggtggaccaagagcaactgaagactgacgagcggggcatcttacaaggagactgtgccgattgggagacgcaactcaagcccaaagatactatcgctatgcagaacatacctggtggcaagacaagcaacggcatcaacacgaatcctcacggcagagaatttctgtag

SEQ ID NO: 141165 - DNA, 966 bp, Artificial Sequence
  Description of Artificial Sequence: Synthetic coding sequence
atggcagcaggatggctaacaacctggagccagaattcagtaaccttccaagaggtggccgttgacttctctcaggaggagtgggctctgctggaccctgcccaaaagaacctctacaaggacgtcatgctcgagaacttcagaaatctggcttctgttgggtatcagttgtgtcggcacagtctcattagcaaagtggatcaagagcaactgaaaacagatgagcggggaatacttcaaggcgactgcgccgattgggagacccaacttaagcctaaggacacaatcgcaatgcagaacatccccggcggtaaaacctcgaacggcataaataccaattgcgtgaggacacattctggggaaatgccctacgaatgtagcgactgcggaaaagcttttattttccagtcctctctgaaaaaacacatgcgatctcacacgggggagaagccgtatgaatgcgaccactgtggtaaaagctttagtcagtcaagccatcttaacgtacacaaacgaacccacacaggcgagaaaccatacgattgcaaagagtgtggcaaggctttcaccgtacccagctctttacagaaacatgtgagaacacatacaggagaaaagccctatgagtgtagcgactgtggaaaggctttcattgaccagtcaagcttgaagaagcacacgagatcccataccggtgagaaaccctatgaatgtaatcagtgtggtaaaagcttctctacggggtcttatctgatcgtacacaagaggacccacacaggggaaaagacttacgagtgcaaggaatgtggcaaagctttccgcaatagttcctgcctgcgcgtgcacgtccggacccacacgggcgaaaagccttataagtgcatacagtgcgaaaaagctttcagtacaagcacgaacttaatcatgcataaaaggattcataatggccaaaaactgcacgagtag

SEQ ID NO: 141166 - DNA, 1650 bp, Artificial Sequence
  Description of Artificial Sequence: Synthetic coding sequence
atgcctgtggatcttgggcaagcccttggcctgcttccgagtcttgcgaaagctgaggacagccaattctcagagtccgatgccgcactccaggaggaactctcgagtcccgagacagctcgccaactgttcagacagttccgttaccaggtcatgtccggtccccacgaaaccttaaagcagttgcgcaagctatgcttccagtggctgcaacccgaggtgcatacaaaggagcagatcctggaaatccttatgttggagcagtttttgaccatactgccaggggaaattcagatgtgggtgaggaaacagtgtcctggtagtggggaggaggcagtgactttagtggagtcgctgaaaggggacccccagcgcctctggcagtggatcagtattcaggtgctggggcaagacatactgtccgagaaaatggaatcaccttcctgtcaggtaggagaggtcgagccccatctcgaggtcgtcccccaggaactgggattagaaaattcgagcagtggacccggagaactgctcagccatatagtaaaagaagaatccgacacagaggccgagctcgctctcgctgcgtcacagcctgcgagacttgaagagcgcctgattcgcgaccaagatctgggagcttccctgttacccgcggctccacaggagcagtggcgtcagcttgattcgacacagaaggaacagtactgggacctgatgttggaaacttatgggaagatggtgtccggagcgggcataagtcatcctaaaagcgatctaaccaattcgattgaattcggggaagaattggcgggtatatatctgcatgtcaatgagaagataccccggccaacatgcattggagaccgacaggagaacgacaaagaaaacttgaatcttgagaaccatagagatcaggagttgctccatgccagctgtcaggccagtggggaggtccctagtcaggcgagccttcgcggcttcttcaccgaagatgagcctgggtgcttcggagagggcgaaaacttgcccgaagctctgcagaacattcaggatgaaggcacaggagaacagcttagcccgcaagagcgcatatctgaaaaacagcttggacagcatctcccaaatccccactccggagagatgtccactatgtggctcgaagagaaaagagagacttcccagaagggccagcctcgagcccctatggcccagaagctccccacatgccgggaatgtggcaagacattttatcggaactctcagctgatcttccaccagcgaacacatactggcgagacatattttcagtgtactatatgcaaaaaagcgttcttgcgatcgagcgactttgtgaagcatcagcgcacccacactggcgagaagccctgcaaatgcgactattgtggtaaaggtttctccgacttctccggactgaggcatcacgagaagattcatactggagaaaagccctacaaatgtcctatctgtgaaaaatccttcatccagcgatctaatttcaacagacaccagcgcgttcataccggggagaaaccctataagtgcagtcattgtgggaaaagtttttcctggagctcttcactcgataagcatcagcgttctcatctgggtaaaaaaccattccagtag

SEQ ID NO: 141167 - DNA, 1650 bp, Artificial Sequence
  Description of Artificial Sequence: Synthetic coding sequence
atgcctgtggatctcggccaagcgctcggcttactgccctccctcgccaaggctgaggatagccagttcagtgagagcgacgccgctcttcaggaagaactttcctcccccgagactgcgaggcagctgtttcgccagtttaggtaccaagtaatgagcggcccacacgaaacactgaagcagttgaggaagctgtgttttcaatggctccagccagaggttcacaccaaggagcagattctcgagattcttatgttggagcagtttctgactatcttacctggtgagatccagatgtgggtgcggaagcaatgtcctggatcaggagaggaggcagtgacccttgtggagagccttaagggagatccccagcggctgtggcagtggatctcgattcaagtgctcgggcaggatatcctgagtgaaaaaatggagagcccttcatgccaggtgggtgaggtagagccccatctggaagtcgttccacaggaactgggactagagaattccagctccggacctggagaactgctgtcacatatcgtgaaggaggaaagtgataccgaggctgaattagccttggcagcttcgcagccagcccggttggaggagaggcttattagggaccaagacttaggtgccagtctcttgcccgctgctccccaggagcagtggcggcagctcgattcgacccagaaggagcagtactgggaccttatgctggagacatatgggaaaatggtgagcggggcagggatttctcatcccaaaagcgatctcactaatagtattgaatttggagaagaactggctggtatttacctgcacgttaacgaaaagatcccacgccctacctgcatcggtgacagacaggaaaacgataaagagaatctaaatctggagaatcatagagaccaggagctgctgcacgcatcctgccaggccagcggagaggtgccctctcaagcttctctgagagggttcttcaccgaagacgagcccggctgtttcggagagggggagaacctgccggaggccttacagaacatccaggacgagggcactggcgaacagctatccccacaggagcggatcagcgaaaaacagctgggccagcatctgcccaatccacactcaggcgagatgagtactatgtggctggaggagaagcgagagacatcccaaaagggacagccccgggctccaatggcacaaaaactgcccacgtgtcgcgagtgcggaaagaccttctataggaactcccagctcattttccaccagcgcacccatactggtgagacctattttcaatgtacaatttgcaagaaagccttcctccgttcaagcgattttgtcaaacaccagcgcacacatacaggcgagaagccttgtaagtgcgactattgtggcaagggttttagtgacttctccggattgagacaccatgaaaaaattcatactggggaaaagccctacaagtgccccatctgcgagaagtcctttatccagcggagtaatttcaatcgacaccagagggttcacacaggtgagaagccttacaagtgttcccattgcgggaagtctttcagttggagcagttctctggacaagcaccaacggtcccacttagggaagaaacctttccagtag

SEQ ID NO: 141168 - DNA, 1959 bp, Artificial Sequence
  Description of Artificial Sequence: Synthetic coding sequence
atgattaacgcacaggagctgttaacactggaagacgtcactgttgagttcacttgggaggagtggcagctgctggggccttttcagaaagatctgtacagggatgtgatgttggagatctacagcaatctactgtctatgggctaccaggtgagcaagcccgacgccttaagtaaactcgaaagaggggaggaaccctggacaatggaagacgaacgccatagccgcatttgtccagagaacaatgaagttgacgaccatcttcaggatcatctggagaaccaaaggatgctgaaatctgtggagcagtaccacgagcacaacgcatttggtaacaccgcttctcagacaaaatctctctgcctttttagagagaaccacgatacctttgagctctacatcaaaaccctgaagagcaatctcagcctggtgaatcaaaacaagagttgtgaaataaacaactctaccaagttctccggagacggaaagtccttcctccatggaaactacgaggaactctattccgccgctaagttcagcgtctctaccaaggccaactccaccaagagccaagtcagcaaacatcagcggacccatgagattgaaaaaaatcacgtgtgctctgaatgcggtaaagcatttgtgaagaaatcccagttgaccgaccacgaaagagtccacactggcgagaaaccatacggatgcacgttgtgcgccaaagtcttctcccgaaaaagtagactgaacgagcatcaaaggatacataagagagagaagagcttcatttgtagtgaatgcgggaaggtgtttacaatgaagagtagactcatcgaacatcaaaggacacacacgggtgaaaagccctacatatgcaatgagtgcggcaagggcttccccggtaagcggaatctgatcgtacaccagcgaaatcataccggtgagaagtcttacatttgttccgagtgtggtaaaggatttacgggcaagtcaatgttgatcattcatcaacgcactcacaccggcgaaaagccttacatctgctcagagtgtggcaagggctttaccactaagcactatgttatcatccaccagcgaaatcacacgggagagaaaccttatatctgcaacgaatgcggaaagggatttaccatgaaatccagaatgatcgagcaccagaggacccacactggggaaaagccatacatctgttcagagtgcggaaagggattccccagaaaatctaacctcatcgtacatcagcgtaatcatacggtcgagaagtcgtatctatgttctgagtgcggaaaggggtttaccgttaagtcgatgctaatcatccaccagaggacccatacgggggaaaagccttatacttgcagcgaatgtggtaagggctttccgctcaagtcccgacttatcgtacaccagcgcactcatactggtgaaaaaccttatcgctgcagtgagtgcgggaagggcttcatcgtgaactcaggactgatgttacaccaacggacacacacaggcgaaaaaccctacatctgcaatgaatgtggcaagggtttcgcctttaaaagcaacttggtggtgcaccagagaacccacaccggagagaagccattcatgtgcagcgagtgtgggaagggattcacaatgaagcggtatctgattgtgcaccagcagatccacaccgaagaaaaatcgtgcatatgcagcgaatgcggtcggggctttgcaaaagaaacagaacttgcgctccacaagcaggttcacaccggagaaaagccctacgggtgtaatgagtgtgggaaagggtttaccatgaagtcccggttgatagtacaccaaagaactcacacgggcgaaaagccatttgtatgtagcgaatgccgtaaagcttttagttctaagcgaaacctcattgttcatcagaggacccacaacggaaataaaccatag

SEQ ID NO: 141169 - DNA, 2004 bp, Artificial Sequence
  Description of Artificial Sequence: Synthetic coding sequence
atgcgggcatgtgctgggagcacccgcgaggcagggtcgggcgcccaggatctttccactctcttgtgtctggaggagtcaatggaagaacaggatgagaaaccgccagaaccacccaaggcctgtgcccaagaaggcgtcaatttcaagatcgtcaccgtggacttcactcgagaggagcagggaacctggaaccccgcccagcgaacccttgaccgagacgtaattttggagaaccacagagatctggttagttgggatttagccactgccgtgggcaagaaggatagtacttccaaacagcgcatcttcgacgaagagccagctaacggcgtgaaaatcgagagattcacccgcgatgacccctggttgagttcttgcgaggaggtagacgattgtaaggaccaactagagaaacagcaagaaaagcaggagatactgttgcaggaggttgcctttacccagcggaaggctgtaatccacgagagggtttgcaagtcggacgagactggagagaagagcggtctgaacagctctctctttagctcccccgtgattcccattagaaatcacttccataaacatgtgagtcacgccaagaaatggcatttgaatgccgctgtgaacagccatcagaagataaacgaaaatgaaacgctctacgaaaacaacgaatgtgggaagcccccgcaatctattcacctcatacagttcaccaggacccagactaaggataagtgttacggcttctcagataggatccaaagcttctgtcacggaactcccttgcacattcatgagaaaattcatggaggcgggaaaaccttcgactttaaggaatgcggacaggtgctgaaccctaaaatcagtcataatgagcagcagcggattcctttcgaagagagccagtacaagtgtagtgagaccagccattccagtagtctgactcagaatatgcgcaataactctgaggagaaacctttcgagtgcaaccagtgtgggaagtcattttcatggtcttcacacctcgtggctcaccagaggactcatacaggagaaaagccatatgaatgcagcgaatgcggaaagagtttcagtagatcttctcatctggtaagtcaccagagaacacacaccggtgaaaagccctatcggtgcaaccaatgtggaaagagtttctcccagagctatgtgctcgtcgtgcaccagaggactcacacaggcgaaaaaccctatgagtgcaatcaatgtggtaagtccttccgccagagttataaactcattgcccaccagcgaacccacaccggcgagaagccctatgaatgcaaccagtgtggcaaaagcttcatccagtcctataagctcatcgctcaccaaaggattcacactggcgagaagccctacgaatgcaaccaatgcggaaagtccttttcacagtcttacaagctggtggcccatcaaagaactcatacaggggaaaagccattcgaatgcaatcagtgtggcaagtcctttagttggtcttcgcagctggtggcccatcagcgcacccacacgggagaaaaaccttacgaatgttcagagtgtggaaagagcttcaatagaagcagccacctggtgatgcaccagcgtattcacacaggcgagaagccttacgaatgcaatcagtgtggtaaaagcttctctcagtcctacgtccttgtggtgcatcaaagaacccatacaggtgagaaaccatacgagtgctctcagtgtgggaaaagctttcggcagtcctcctgcctaacacaacaccagagaacccacactggagaaaaaccgttcgaatgtaaccagtgcgggaaaactttcagcctttccgcaagattaatcgtacatcagcgcacccacacaggagagaagcctttcacatgtatccagtgcgggaaggccttcataaatagctacaagctgattaggcaccaggcaacacacaccgaagaaaagctgtacgaatgcaactag

SEQ ID NO: 141170 - DNA, 1848 bp, Artificial Sequence
  Description of Artificial Sequence: Synthetic coding sequence
atgccccagctgcaataccccgagggatatctggctcctaacagatgcctcgtgtctaattgtggcgtgaataagatgtccaacgatgagctggtgggccagaaccacggcatggagggggaagcatgtatcggcggcgatgtcacgtttaacgacgtagccatcgatttcacacacgaagagtggggatggctttctagcgcccagcgtgatctctacaaagacgtgatggttcaaaattacgaaaacctcgtgagtgtggcggggctgtccgtgactaagccctacgttatcactctcctggaagacggcaaagagccctggatgatggagaagaaattgtccaaaggaatgatccctgactgggaaagccgatgggagaacaaggaactgagtactaagaaggataactacgatgaggattcaccccagactgttataatagaaaaggtggttaagcagagctatgagttttccaactctaaaaagaacctagagtatattgagaagttggaggggaagcacgggagccaagtggaccattttagacctgccatcctcacctccagagaaagccctacggctgactcagtgtataagtataatattttcaggtctacgttccactcaaagtccacccttagcgagccacagaaaatatctgctgaggggaactctcacaagtatgacatcttgaagaagaatctgcccaagaaaagcgtgatcaagaacgagaaggtgaacggcgggaagaagctactgaattctaataaatccggcgcggcctttagccagggaaaatcgttaactctgccacagacctgcaaccgtgaaaagatctacacctgttccgaatgcggcaaggcttttggtaagcaatcaatcctaaatagacattggcgaatacatactggagaaaaaccatacgagtgtcgcgagtgcgggaagactttctcgcatggcagtagtctgacaagacatctgatctctcattcaggagagaaaccttataagtgtatagagtgtgggaaagccttctcccatgtttcatcattgacgaatcaccagtccacacatacgggtgaaaagccgtacgaatgcatgaattgtgggaagagcttctctcgggtgtcacacctgatcgaacacctgcgaatccacacacaggagaagttatatgagtgtcggatctgcggtaaagccttcatccaccggagttcgcttatccatcatcagaaaatacacactggagaaaagccttacgagtgtagggagtgcggcaaggcgttttgctgtagcagtcacctcaccagacatcagagaattcatacaatggaaaaacagtacgagtgcaacaaatgcctgaaggtcttcagttcattatccttcctggttcagcatcagtcaattcacaccgaagagaagcctttcgagtgtcagaagtgcagaaagagcttcaatcagctagaatctttgaatatgcacttgcgcaatcatatccgactgaaaccatatgagtgttcaatctgtgggaaggcatttagccatcggagctccttgcttcaacaccaccggatccatacgggcgaaaaaccctacgaatgcatcaagtgtgggaagacatttagctgctcgagtaatctcactgtccaccaacgtatccataccggtgagaagccatacaaatgtaatgagtgtgggaaagcgtttagcaagggctctaatcttaccgctcatcagagagtgcataatggagaaaagcccaattcagtggtcagtgtggaaaagcccctggattatatgaaccactacacttgcgagaaaagttatcgcagggagacagtctag

SEQ ID NO: 141171 - DNA, 1404 bp, Artificial Sequence
  Description of Artificial Sequence: Synthetic coding sequence
atgccacaggtaaccttcaacgacgtcgccattgattttacgcacgaggagtggggctggctctcctcggctcagcgtgatctgtataaggacgtaatggtccaaaactacgagaatctggtgtcggtcgggctatctgttactaagccctatgtgattaccctcctggaagatggtaaagaaccctggatgatggagaagaagctgagtaaagggatgattcctgactgggagtctcgctgggaaaacaaggagttgtccaccaagaaggacaattatgatgaagactccccacagacagtcattatcgaaaaagttgttaagcaatcttacgaattctccaactccaaaaaaaatcttgagtacatcgaaaagttagaggggaagcatggtagtcaggtggaccacttccgtccagcgatactcacgagcagggaatctccaacagccgactccgtttataaatataacatcttccgcagcacctttcacagcaagtctacactgtccgagccacagaaaatttctgccgaagggaattcacacaagtacgatatcctgaaaaagaacctacccaaaaagtcagttataaagaacgaaaaagttaacggggggaaaaaactactaaacagcaataagtcaggagctgctttctctcagggcaaatctctaaccctccctcagacctgcaatagagaaaaaatatacacatgtagtgagtgtggaaaggcttttggtaagcagagtattctgaataggcattggaggattcataccggcgaaaaaccatacgaatgtcgggaatgcgggaagacctttagccatgggtcttccctcacaaggcatctaataagccattccggtgagaagccatacaaatgtattgagtgtgggaaagctttttctcacgttagctcactgacaaaccatcagagtacccacacaggggaaaagccgtacgagtgcatgaactgtggcaagtcattctcgagggtgagccacctgattgagcatctgagaatacatacccaagaaaaactctacgagtgccggatctgtggcaaagcctttatccaccggagtagtcttattcaccaccagaaaatccacaccggcgaaaagccctatgagtgtagggaatgcggcaaggctttctgttgcagcagccacctaacaaggcaccaaagaatccacacaatggagaagcaatatgagtgtaataaatgcctgaaggtgttttccagcttgtcatttctcgttcaacatcagtcaatacacaccgaagagaagccattcgagtgccagaaatgccgtaaatcattcaatcaactggaaagcctcaacatgcacctgaggaatcatattgagacacttaggatgcagtacatgtgggagtccctttag

SEQ ID NO: 141172 - DNA, 1713 bp, Artificial Sequence
  Description of Artificial Sequence: Synthetic coding sequence
atgccgcaggtgaccttcaatgacgttgccatcgactttactcacgaagagtgggggtggctctcctctgctcagcgcgatctctacaaagatgtcatggtgcagaactacgaaaatctagtgagtgtgggcctgagtgtgacgaagccttacgtgattacgctgctggaagacggcaaggagccttggatgatggagaagaagctttcaaagggtatgatccccgattgggagtcgaggtgggaaaataaggagctgtccaccaaaaaggataactacgacgaggactctcctcagaccgttatcattgaaaaagttgtaaagcagtcctatgaattctcgaactccaaaaagaacctcgaatacattgaaaagctggaaggaaaacatggttcccaggttgatcatttccgccccgccattttgacctcaagggaatcccctacagctgatagcgtgtacaagtataatatttttagaagtacttttcactctaaaagcacactgtcagagcctcagaagattagcgcagaaggaaattcgcacaagtatgatatcctgaagaagaatcttccgaaaaaaagcgttatcaaaaatgagaaggtgaatggcggtaagaagctgttgaactccaataagtctggagctgctttcagtcaaggcaagagcttgactctgccccagacgtgcaaccgagagaagatatatacatgctcagaatgtgggaaagctttcggaaaacaatccatcctcaacaggcactggaggatccacactggagagaaaccctacgagtgccgggagtgtggaaaaactttcagccacggtagtagcttgaccagacatctgatcagccattccggcgagaagccgtacaagtgcatcgaatgtggcaaagccttctcccatgtgtcctccctgacaaaccatcagagcacacatacgggtgaaaaaccttatgagtgtatgaattgcggcaaatcgttcagcagagtttctcatttgatcgaacacctcagaatccatacgcaggagaaactgtacgagtgccggatctgcggtaaggcgttcatacatcgatcttctcttatccaccaccaaaagatccataccggagagaaaccttatgagtgtcgcgagtgtgggaaggcattttgctgctcttcccatcttactcggcaccagcgcatccacacaatggagaagcaatatgaatgtaataagtgtttgaaggtgttctcttcgctgtcatttctggtccagcaccaatccatccacacagaggagaagccgtttgaatgtcaaaagtgccgcaaatctttcaaccagctcgaatccttaaacatgcatttaagaaaccacattcgtctaaaaccttatgagtgtagcatctgtgggaaggcattctcacaccggagctccctcctgcagcatcatcggattcataccggcgaaaaaccatatgaatgtatcaagtgcggaaagacgttcagctgtagttctaatctcactgttcaccagcgtattcatactggtgagaaaccttacaaatgcaatgagtgcggaaaggcgttctccaaaggatcaaacttaaccgcacatcaaagggtgcacaatggagaaaaacctaacagcgtggtcagcgtcgagaagcctctcgattatatgaatcactacacttgtgagaaatcctaccgccgagaaactgtatag

SEQ ID NO: 141173 - DNA, 1716 bp, Artificial Sequence
  Description of Artificial Sequence: Synthetic coding sequence
atgccgcaggtcacattcaatgacgtggccatcgactttacccacgaagaatggggctggttatcttcagcacagcgggatctgtacaaggatgtgatggtccagaattatgaaaaccttgtgtcagtcgccggcctaagtgtgacaaaaccatacgtgattaccctgttggaggacggtaaggagccgtggatgatggagaagaaattatccaagggtatgattcccgactgggagagccgttgggagaataaagaactgtccaccaagaaagacaattatgatgaagacagtcctcagactgtcataatcgagaaagtagtaaagcagtcgtatgaattctccaatagtaaaaaaaacctggaatatattgagaagctagaaggcaagcacggtagtcaggtggaccacttccggcccgccatcctgacttctcgggagtcccccacagccgattccgtctacaagtacaacattttcaggtcgacattccacagtaagagtacccttagcgaaccacagaaaatttctgccgaaggcaattctcacaaatacgacattctaaagaaaaacttacctaaaaagagcgtcattaagaacgaaaaagttaatggtgggaagaagctgctgaactccaacaagtcgggagcagcatttagccagggaaaaagtcttacccttccgcaaacatgcaatcgggaaaaaatctatacgtgttccgagtgcggaaaggcattcgggaagcagtccatcctgaataggcattggcggatccatacgggggaaaagccctatgagtgtagggaatgtgggaagactttcagccacggttcctcactcacccgccacctaatcagtcatagtggagagaaaccctataagtgcattgagtgcggcaaagccttttctcatgtttcatctcttacaaatcatcagtctacccataccggagagaaaccctatgaatgcatgaactgtggaaaaagcttcagtcgcgtcagccacctgattgagcatttgcgaatccatacccaggagaagctgtatgaatgcagaatttgcggcaaagcctttattcatcgcagtagtttgattcaccaccaaaagatccatacgggcgagaagccatatgaatgccgtgagtgtggcaaagccttttgctgcagctcccatctcacccgccatcagcgcatacatacgatggaaaagcagtacgagtgcaacaaatgcctgaaggtgttttcctccctgagctttctcgtgcagcatcagagtattcacacagaagagaagcctttcgaatgccagaagtgccggaaaagtttcaatcaactcgaatctttaaacatgcatttgagaaatcacattcgcctgaaaccttatgaatgtagtatctgcggcaaggctttcagccatcgctcctctctgctgcagcatcacagaattcacacgggagagaagccttatgaatgcatcaagtgcggcaagactttttcttgctccagcaatcttaccgtccaccagaggatccacacaggggagaaaccctataaatgtaatgagtgcgggaaggcattctcgaagggaagtaacctgacggcccaccagcgggtccataacggagaaaaaccaaacagcgtcgtgtccgtcgaaaaacccttggattacatgaatcactatacatgtgaaaaatcatatagaagagaaactgtgtag

SEQ ID NO: 141174 - DNA, 1920 bp, Artificial Sequence
  Description of Artificial Sequence: Synthetic coding sequence
atgacacctgccagcgctagtggcgaagactccggctctttttatagctggcaaaaagcaaagcgagagcaggggctcgtcacattcgaagatgtcgcggtggacttcacacaggaagagtggcagtatctcaaccctccccagaggactctgtatcgcgatgtgatgctagaaacatactccaacttggtctttgtgggtcaacaggtcactaagcccaaccttatcctgaaacttgaagtcgaagaatgccccgcagaaggaaaaatccccttctggaattttccagaggtgtgtcaggtcgatgagcagattgaacgccagcatcaagacgaccaggataaatgtctgctgatgcaggtgggctttagcgacaagaagaccattataacaaagtctgcacgggactgccacgaatttgggaatatactgcacctctctacaaacctggtcgcaagcatccagcgccctgataaacacgaatcttttggtaacaatatggtcgataacctggatctgttctcccgcagttctgcagagaataagtacgacaacgggtgtgccaagctctttttccacacagaatacgaaaagaccaaccccgggatgaagccctatgggtacaaagagtgcggtaagggcttgcgccggaaaaaaggcttgtcactgcaccagagaattaaaaatggcgagaaacccttcgaatgtactgcttgtcggaagacattttctaagaaaagtcatctcatagtgcactggcgcacccatacaggggagaagccttttgggtgcactgagtgcggaaaggcattttcacaaaagtctcagttgattattcacctgagaactcatactggggaacgcccgtttgagtgcccagagtgtggaaaggccttccgagagaagtctactgtcattatccactaccgcacccacactggagagaagccatatgaatgcaacgaatgcggcaaagctttcacccagaagagcaatctcatcgtccatcagaagacacacaccggtgaaaagacctatgagtgtaccaagtgcggcgagagctttattcagaagttagacctgattattcaccactctactcacactggcaagaaaccacacgagtgcaacgagtgcaagaaaacgttcagtgataagagcaccctcattatacaccagaggacacacactggtgagaaaccgcacaaatgcacagaatgcgggaaaagtttcaatgagaaatccaccctgattgttcaccagagaactcatacaggagaaaaaccgtatgaatgcgatgtgtgcggaaagacttttacacagaaaagcaacctgggggtccaccagcgtacccattctggtgagaagccattcgagtgcaacgaatgcgagaaggcctttagccagaagagctatctaatgctgcatcagcggggccatactggagaaaagccctatgagtgtaacgagtgcgaaaaagccttctcacagaaatcgtatctgataatccaccagaggactcacactgaagagaagccctacaagtgcaacgagtgcggaaaggcgtttcgtgagaagtcgaaactgattattcaccagcgcattcacacaggtgaaaagccttacgaatgtcctgtgtgctggaaagcattctcacaaaagtcccagcttataatccatcaaagaacacatacaggagaaaagccatatgcatgcaccgagtgtggcaaggcctttcgcgaaaaatcaacatttaccgttcaccagagaacccatacgggcgagaaaccctacaagtgtacagaatgtggaaaagcattcacacagaagagtaacttgatcgtgcatcaacggacccacgcaggaaagaaggctcacggacgcggtcatacccgcaagtctaagttcatggctcactag

SEQ ID NO: 141175 - DNA, 1863 bp, Artificial Sequence
  Description of Artificial Sequence: Synthetic coding sequence
atggcgaaaccccaaggactagtcacatttgaggatgtcgctgtagactttacccaagaagagtggcagtacctgaaccctcctcagagaaccctgtatagagacgtaatgctggagacctactcaaacctggttttcgtgggccagcaagtaaccaaaccaaacttaattttaaagttggaagtcgaagagtgccctgctgaggggaagattccattctggaactttcccgaggtgtgccaggtagacgagcaaatagaaagacagcatcaggatgaccaggataagtgtctgctgatgcaggttggcttttccgacaagaaaaccattatcaccaagagcgctcgggattgtcatgaattcggaaatattcttcacttaagtactaacctggtcgcctcaattcaaagacctgacaaacatgagtcctttgggaataatatggtcgacaacctggacctcttcagcaggagcagtgctgagaacaaatatgacaacggttgcgcaaagctgtttttccatactgaatatgagaaaacaaaccccggcatgaagccctacggatataaagaatgtggcaagggtttgcgacgaaagaagggcctcagcctgcaccagaggatcaagaacggggagaaaccttttgaatgcacggcttgccgaaaaaccttcagcaaaaagagccaccttatcgtccactggagaacacatactggagagaaaccatttgggtgcacagagtgcgggaaagcattctcccagaagagccagctaataattcatctgcgcacacacaccggggaacggcccttcgagtgccccgagtgtggtaaagcgtttagggagaaatctactgttatcattcactacaggacccacactggggagaaaccctatgagtgtaacgagtgcggcaaagcttttactcagaaatcaaacctgatcgtacatcagaagacccatacgggtgagaagacttacgaatgcactaagtgtggcgaaagctttattcaaaagctggacctaataattcatcactcaactcacacaggcaagaaacctcacgaatgtaatgagtgtaaaaagacattctccgacaaaagcacccttatcatccaccagaggacacatacgggagagaaaccccataaatgcacagagtgtggcaagagctttaatgaaaagtctaccctgatcgtacaccaacgcacccacactggggagaagccttacgaatgtgatgtgtgtggtaaaacattcacccaaaagtcaaacttaggcgtgcaccagcggacccactccggcgaaaaaccttttgaatgcaatgagtgcgagaaagcctttagccagaaatcttatctgatgcttcaccaacgcggtcatacaggagaaaaaccgtatgaatgtaatgagtgcgagaaggctttctctcagaaaagctatcttataattcaccagcgcactcacacagaagaaaagccatacaagtgtaatgagtgtggcaaagcgttcagagaaaagtccaagttgatcatccaccaacgtatacatacgggagaaaaaccttacgagtgtcccgtgtgttggaaagcattctcgcaaaaatctcagttgatcatccaccagagaacccatacaggcgagaagccttatgcctgcacagagtgcgggaaggcctttcgtgagaagtcaacctttacggtacatcagcgcacgcacacaggggaaaagccctataaatgcacggaatgtgggaaagcctttacacaaaagtccaatctcatcgtccaccaaagaacccacgcaggcaaaaaggctcatggcaggggtcatacacgtaagagcaagtttatggcccattag

SEQ ID NO: 141176 - DNA, 1920 bp, Artificial Sequence
  Description of Artificial Sequence: Synthetic coding sequence
atgactcctgcttcagcaagcggcgaggatagtggatctttctactcttggcagaaggctaagcgtgagcagggcctcgtgactttcgaagacgtcgcagttgacttcactcaggaggagtggcagtacctcaacccaccccaaagaaccctttatagggacgtgatgcttgagacctactctaatctggtgttcgtcggccagcaggtaacaaagcctaacctcatcctgaaattggaggtcgaggagtgccctgcagaaggtaagatccccttttggaatttccccgaggtctgccaagtcgacgagcagatagagcggcagcaccaggatgatcaagacaaatgtttgcttatgcaggtaggatttagtgataagaaaaccatcatcaccaagtctgcccgggactgtcatgaatttgggaatattctgcacttgtctactaacttggtagcgtctatccagaggcctgacaagcacgagtccttcggcaataacatggtggataatttagacctcttctcccgatcatccgccgaaaacaagtacgacaacggctgcgcaaaactcttcttccacactgagtatgaaaagactaacccaggcatgaagccatatgggtacaaggaatgcggaaagggcttacgacggaaaaagggcctgtctttgcaccagagaatcaaaaacggcgagaagccttttgaatgcactgcttgtcgtaaaactttcagcaaaaagtcacatctgatcgtgcattggcgcactcatactggggagaaacccttcggttgtacagaatgtggtaaggctttctctcagaagtctcaactcattatccacctgcgaacccataccggggagcgcccttttgaatgcccggagtgcggaaaggcatttagagagaaatcgacagttataattcactacagaacacacaccggcgagaaaccctacgagtgtaacgagtgtggtaaggccttcacccagaagagcaatttaatcgttcatcaaaaaactcacacaggggaaaagacatacgaatgcactaaatgcggtgaaagtttcatccagaagctggatctcattatccatcattccactcataccggaaagaagccgcacgagtgtaacgagtgcaaaaagacattcagtgacaagtcgactctgataattcatcagcggacgcacaccggggagaaaccacacaaatgcaccgagtgtggtaaaagcttcaatgaaaaatctactctcatcgtgcatcagcgaactcatacaggagagaaaccttacgaatgcgatgtttgcggtaagaccttcacacagaagagcaacctaggcgtgcaccagcggactcattctggcgagaaacccttcgaatgtaatgagtgtgaaaaggctttttcacagaagagttacctcatgctgcatcaacgtggacacaccggggagaaaccctacgaatgtaacgagtgcgaaaaggcattcagccaaaagtcctatttaataattcaccagagaacccacaccgaagagaaaccatacaaatgtaatgagtgcggaaaggctttccgagagaaatctaagttgattattcaccaacgaatccacacaggggaaaaaccctacgagtgtcctgtatgttggaaggccttttcccagaaaagccagctgatcatccaccagcggacgcacacaggtgagaagccctatgcctgtacagaatgcggaaaggcctttagggagaagtccacctttacagtgcatcaacgcacccacacaggggagaagccttacaaatgcacagaatgtggaaaggccttcacgcagaagagcaacctgatagtgcatcaaagaacacacgcagggaagaaagctcacggccgtggccacacccgaaagagcaagttcatggctcattag

SEQ ID NO: 141177 - DNA, 921 bp, Artificial Sequence
  Description of Artificial Sequence: Synthetic coding sequence
atgtccagtgagaagagtggtttgcctgatagtgtcccccatacctcacccccgccctataacgccccgcagcctccggcagaaccaccagccccaccacctcaggcagccccctcctcccaccaccaccaccaccatcattaccatcagtccggcactgccactctacctaggttgggagccggaggcctggcatcttctgcagccacagctcagcggggcccttcctctagtgccactttgccacgaccgccacatcacgccccgcctggccccgccgctggagcacctccacctggctgtgctactctgccccggatgccgccagacccttatctgcaggagacaagatttgaggggccgctgccgcctccccccccagcggcggcagctccccccccccctgcacccgctcagactgctcaggcccccggatttgttgtacccacgcacgcgggcacggtgggtaccctgccactcggaggctacgtcgcccccggctaccctctccagttgcagccttgtaccgcgtacgtgccagtataccccgtgggcacgccatacgcgggcggaacacctggcggaactggcgtcacaagtaccctcccaccaccccctcagggcccgggactggctctattggagcctaggaggccgccccacgactacatgccaatagccgtgctcaccacgatttgctgcttctggcctacaggaattatcgcaatttttaaagcagttcaagttcggacggcacttgccaggggtgatatggtgagtgccgaaatagctagtagagaagcacgaaacttctctttcatttcactggccgtgggcatcgctgcaatggtcctgtgtaccatattgaccgtggtaatcattatcgctgctcagcatcatgagaactactgggatccttag

SEQ ID NO: 141178 - DNA, 2004 bp, Artificial Sequence
  Description of Artificial Sequence: Synthetic coding sequence
atggaggacctgtcaagtcctgacagcactttattgcagggaggccacaacctactatccagcgcatcattccaggaggctgtcaccttcaaggatgtaattgtcgactttacacaggaggagtggaaacaactggacccaggccagcgggatctgtttagagacgtcacgctggagaactacacacacctcgtgtccatcggacttcaggttagcaagcccgacgtgatctcccagctagaacaagggaccgagccctggatcatggagccctccatccctgttggcacctgcgccgattgggaaactagactggagaatagtgtctctgcaccagagccggatatctcagaggaggaactttcccccgaagttatcgtcgaaaaacacaagcgcgacgacagctggtccagcaatctacttgagagctgggagtatgaagggtcacttgagcgtcaacaggccaatcaacagacactgccgaaagagatcaaggtgactgaaaaaacgataccaagttgggagaaagggccagtcaataacgagttcggaaagtctgttaatgtcagctcaaacctcgtcactcaagagccaagtccggaggagaccagtacaaagcgctctattaagcagaacagcaatcccgtcaaaaaagagaaatcatgcaagtgtaatgagtgcggaaaagcatttagctactgtagcgcattgattcgacatcaacgcacccacactggggaaaagccttacaagtgcaacgaatgtgaaaaagctttttcccggtctgaaaatctgattaatcatcagcggattcacactggggataagccttataaatgcgaccaatgcgggaagggctttatagagggaccatccctgacccagcaccagcggatccacactggagagaaaccttataagtgtgacgagtgcgggaaggctttctctcagaggacgcacctcgttcagcaccagcgaatccataccggagagaagccttacacttgcaacgaatgtggaaaggccttcagccagagaggtcatttcatggagcatcaaaaaatccacacgggagaaaaacccttcaaatgcgatgaatgcgacaaaaccttcacacgcagcacccacctgacacaacaccagaaaattcacactggggagaagacatacaagtgcaacgaatgcggaaaagcatttaatggcccatcaacctttatcagacatcacatgattcataccggagagaaaccgtacgaatgtaacgagtgcggtaaagcattcagccagcacagcaatctaacacagcatcagaaaactcacactcaagagaaagcttatgagtgcaaggagtgcgggaaggcttttataagatcttccagcttggccaaacatgagcgcatccacacaggagaaaaaccctaccaatgccatgaatgcgggaagaccttttcttacggctcttcgttgatccaacatagaaaaatccacactggggaaagaccttataaatgcaacgaatgcggacgggcgttcaaccagaacatccacctgacacagcataaacggatccatactggcgctaaaccatatgagtgcgccgaatgtggtaaggcttttagacactgctcgagcctggctcagcaccaaaagactcatacagaggagaagccgtaccagtgcaataaatgtgaaaaaaccttctctcagagctcccatttaacgcaacatcagagaattcatactggcgagaagccttataaatgcaatgaatgcgataaagccttttccagatccacccacttaacagagcaccaaaacacccatactggcgagaagccatataactgcaacgagtgtaggaagaccttcagtcagtctacatacctgatccaacaccagcggattcactccggtgaaaaacccttcggctgcaatgactgtgggaaatctttccgctatcggtctgccctgaacaagcaccagagactgcatcctggcatctag

SEQ ID NO: 141179 - DNA, 2256 bp, Artificial Sequence
  Description of Artificial Sequence: Synthetic coding sequence
atggaggatttatctagcccagatagcaccctccttcaggggggtcacaatttgttgtcctctgcaagcttccaggaagctgtgacattcaaggacgttatagttgacttcacccaagaagaatggaagcagctcgacccaggccagagggacctcttcagagatgtcaccctggagaactatacacatctggtcagtatcggacttcaagtgtcaaagcccgacgtgatttcccagttagagcaaggcaccgagccttggatcatggagccaagcattcccgttgggacttgtgctgattgggaaactcgactcgagaactcagtgtctgcccctgaacccgacataagtgaggaggagctatcgcccgaggtgattgtggagaaacacaagagagacgacagctggtcctccaatctcctggagtcatgggaatatgaagggagtctggaacgccaacaagcgaatcagcagacactgccgaaagagatcaaggtgaccgaaaagacaatcccaagttgggagaagggtccggtaaataacgagtttggcaagtctgtgaacgtatcctctaatctggtcactcaagagccgagtccagaagaaacttccacaaagaggagcatcaagcagaactcaaaccctgtgaagaaggagaagtcctgtaagtgcaacgagtgtggtaaagccttttcctactgcagtgccctaatcaggcaccaacgtacccatacaggggaaaagccctacaaatgtaatgagtgtgagaaggcattttctaggtccgaaaatttgatcaaccaccaacggatccacacgggcgacaaaccgtacaaatgcgatcagtgcggcaaggggtttattgaaggcccttctcttacccagcaccagagaatacatacaggcgaaaagccatacaaatgtgacgaatgcggcaaggctttctcacaaaggactcatctcgttcagcatcagaggatacacactggtgagaaaccctacacctgcaacgaatgtggaaaagcattcagtcagaggggacatttcatggagcaccaaaagattcacaccggagagaaaccatttaagtgcgacgaatgtgacaaaacatttacaagatccactcacctcactcaacatcaaaaaattcataccggcgagaagacctataagtgcaatgaatgtggaaaagccttcaacgggccttctacattcattcgccaccatatgatccacacgggcgaaaaaccctatgaatgcaatgaatgtggcaaggcctttagtcagcactctaacctgacccagcaccagaagacacacactggcgagaaaccttatgactgtgcagagtgtggcaaaagttttagttattggagttcgctggctcagcatcttaagatccatacaggtgaaaaaccgtataaatgcaatgagtgtgggaaggccttctcttattgttcaagcttgacccaacacagaagaattcatacaagggaaaaacctttcgagtgtagtgagtgtggcaaagcctttagttacctcagcaacctaaaccaacaccagaagacgcatacccaggagaaggcatatgagtgcaaagagtgtgggaaggctttcatccgttcgagctccctggcgaagcatgagcggatccataccggcgaaaagccgtaccagtgccatgaatgtggaaagacctttagttatggatccagcttaatacaacatcggaagatccacacgggggagcgcccttataagtgcaatgagtgtggccgtgccttcaatcagaatattcatcttacccagcacaaacgtatccatacaggtgcgaagccttacgagtgcgccgagtgcggaaaggccttcaggcactgttcatccctggcccaacaccaaaagacgcacaccgaggagaagccctaccagtgtaataagtgcgaaaaaacattttcacaatctagtcacctcacccagcaccagagaattcacacaggggagaagccatacaaatgtaatgagtgcgacaaggccttctccagatccacccaccttaccgagcaccagaacacccacaccggagagaaaccttacaattgcaatgagtgcaggaagacattctcccagtctacgtacctcatccagcatcaacgcatccactctggtgaaaaaccatttggctgcaacgactgcggtaagtcctttagatataggtctgcccttaacaaacaccaacggctgcatcctgggatctag

SEQ ID NO: 141180 - DNA, 234 bp, Artificial Sequence
  Description of Artificial Sequence: Synthetic coding sequence
aaggcattctcacagcgcacccacctggttcagcatcagcggattcatactggggagaagccttatacctgcaatgagtgcggtaaggcattttctcaaaggggccactttatggaacaccaaaagatacataccggcgagaaaccatttaagtgcgatgagtgcgacaagacatttaccaggtctacacatcttaccacctcgaagaattcgtattggaggaagaacttgtag

SEQ ID NO: 141181 - DNA, 1755 bp, Artificial Sequence
  Description of Artificial Sequence: Synthetic coding sequence
atgatggaaaactatggcaacctggtaagcctcgacgttctgaatcgtgacaaggacgaggagccaaccgttaagcaagaaatcgaggagatcgaggaggaagtggagccacagggagtgatcgtgacgagaatcaaatctgagattgaccaggaccctatgggacgggagacttttgaactcgtgggtaggcttgataagcagcggggtattttcctgtgggagatccctcgagagtccctaacacaggagcaaaggatgttcagagaaaacactaacattatacggaaaaggcccaactccgaagaaaagtgtcacaaatgcgaagaatgtgggaaaggattcgtgaggaaagcccatttcattcagcaccaacgtgtgcataccggggagaagccattccagtgtaacgagtgtggtaaaagttttagccgcagctcttttgtgattgagcaccagcggattcacactggggagcggccttatgaatgcaactactgcggaaagacattcagcgtgagttcgactttaattagacaccagagaatccataccggcgaaagaccttatcagtgcaaccaatgcaagcaaagcttttcccagcggcgttccttagtcaagcaccaaagaatccataccggtgaaaaaccgcataaatgctccgattgcggaaaggcctttagctggaaatctcaccttattgaacaccagaggactcacaccggggaaaagccctaccactgtacaaagtgtaaaaaaagcttttctcggaatagcttgctggtggagcaccagcgcatccacacgggagagaggcctcacaagtgcggagaatgtgggaaggcattccggctgtcaacctacctgattcaacaccaaaaaattcacaccggtgaaaagccatttctgtgtattgaatgcgggaaaagcttctcccgctcatcttttttaattgaacatcaaaggattcataccggggagcggccttatcaatgcaaagagtgtggaaaatccttcagccaactgtgtaaccttaccaggcatcagcgaatacataccggcgataaacctcataagtgcgaggagtgcgggaaagcttttagtcgatcctcaggattgattcagcatcagcgcatccacacccgtgagaagacatatccatacaacgaaaccaaggaatccttcgatcctaattgttcactagtgatccagcaagaagtgtatcctaaggaaaaatcatacaaatgcgatgagtgtgggaaaacattttccgtctctgcccatttggttcagcaccagcgtatacacacgggcgagaaaccgtacctttgcactgtgtgcggaaagtccttcagccggtccagtttcctgatcgagcaccagagaatacataccggagaaagaccctacctctgccggcaatgcgggaagagctttagccagctgtgtaacctgattagacaccagggagtgcacactggcaacaagcctcataaatgtgacgagtgtggcaaagccttcagtaggaattctggcctcattcagcaccagagaattcacactggagaaaagccctacaagtgtgagaaatgtgataagtctttcagccaacagagatcactcgttaatcaccagaagatccatgcagaggtgaagacgcaggagactcacgaatgcgatgcctgtggtgaggcatttaattgtcgaatctccctgatccagcatcaaaagctacacacagcctggatgcagtag

SEQ ID NO: 141182 - DNA, 1881 bp, Artificial Sequence
  Description of Artificial Sequence: Synthetic coding sequence
atggccagtccttcccccccccctgaaagcaagggcttactgactttcgaagacgtggcagtgttttttactcaagaagaatgggactatcttgaccccgcacagcggtccttgtataaggacgtgatgatggagaactacggaaatctcgtgagtctggacgtcctaaatcgcgacaaggacgaggagcctacagtcaagcaggaaatcgaggagattgaagaggaggtagaaccccaaggagtcattgtcacaagaatcaagtccgagatagaccaggaccctatgggtcgggagactttcgagttggttgggaggctggacaaacagcggggcatttttctgtgggagatccccagggagtcgcttacccaggagcagagaatgttcagggagaacacaaatataatacggaaacgccctaatagtgaagaaaaatgccacaaatgtgaggagtgcggtaaaggcttcgtgagaaaagcacacttcattcagcatcagcgcgttcatacgggcgagaaacctttccaatgtaacgagtgcggtaagtcattctcccgttcttccttcgtcatcgaacaccaacgaatccacaccggtgaacgtccctatgagtgtaactactgcgggaagaccttctccgtgtcgagcacactcatcaggcaccaacggatccacaccggagagaggccataccaatgcaatcagtgtaagcagtccttttcccagcgtcggtcactcgtaaaacaccagcgaatacacacaggtgagaagcctcataagtgctccgactgtggcaaggcgttttcatggaagagccacctgattgaacaccaacggacccatacgggagagaaaccgtaccattgcaccaaatgcaagaagagctttagcaggaattccttactggttgaacaccagcgcatccacactggggagcgaccccataagtgtggggagtgtggaaaggccttccggttatctacatacctgatccagcatcagaaaatccacaccggcgaaaaacccttcctatgtatcgaatgcgggaagagcttcagcaggtccagttttctgatagagcatcagaggatccacactggtgaaaggccctaccagtgcaaagagtgcggaaaatccttctcccaattgtgcaacctcacacgccaccaaaggatccatactggggacaagccccacaagtgcgaagagtgcgggaaagcctttagccgcagcagcgggctgattcagcatcaaagaatccatacaagagagaaaacgtatccttataatgaaactaaagaaagctttgacccaaattgttctctcgtgatccagcaggaggtgtaccctaaggagaagagttataagtgcgacgaatgcgggaagacctttagcgttagtgcccacctcgttcaacatcagaggatacataccggcgagaagccctacctgtgtactgtctgtggcaagtctttttctagatcctctttcctcatagagcaccagcgaatacatactggcgagcgcccatacctttgcaggcagtgcggcaaatccttttcccagttatgcaacctcataaggcatcaaggtgtgcacaccggcaacaagccacacaagtgcgatgagtgcgggaaagctttctcacggaacagtggactgatacagcaccagagaatccatacaggcgaaaagccctataaatgcgaaaaatgcgataaatccttcagccagcagagaagtttggtcaaccatcagaagatccatgccgaggtcaagacacaagagacacacgagtgtgatgcgtgtggggaagccttcaattgtaggatctccttgattcagcatcagaagcttcacactgcgtggatgcaatag

SEQ ID NO: 141183 - DNA, 1839 bp, Artificial Sequence
  Description of Artificial Sequence: Synthetic coding sequence
atggcctccccttcccccccgcctgaaagcaaggaggagtgggactaccttgatcctgcccaacgttctctttataaggacgtgatgatggaaaactatggaaacctggtgtcgctggatgtgttgaaccgggataaagatgaggagccaactgtcaaacaagaaatcgaagaaatagaggaagaagtcgagcctcagggggtgatcgtgaccaggattaagtctgagatcgatcaagatcctatgggccgtgaaacattcgaattagttgggagactagataaacagcggggcatcttcctctgggaaatccctcgggagagtttaacacaggaacaacgaatgttcagggaaaataccaacattatcagaaagcgtccgaacagcgaggaaaagtgtcataagtgcgaagagtgcggcaagggttttgttcgcaaagcccattttatccaacaccaacgcgtccacactggcgaaaagcccttccagtgtaatgagtgcgggaaaagcttcagtaggagctcattcgttatcgaacatcaacggattcatacaggggaaaggccgtatgaatgtaactattgtggcaaaaccttcagcgtatcttcaaccctcataagacatcagcgcatccacactggggaaaggccttaccaatgtaaccagtgtaagcagagcttctcacaaagacggtctctggtcaagcatcagcgcattcacacgggagagaaaccccataagtgcagtgattgcggaaaggccttcagctggaagtcccatctcatagagcatcagcgcactcacacaggggagaagccctaccactgtaccaagtgcaagaagagttttagcaggaattcccttcttgttgagcaccaacggattcatacaggggagcgcccccataagtgtggcgagtgcgggaaagcctttcgactctccacgtatcttattcagcatcagaagatacataccggtgagaaaccatttttgtgcattgagtgcgggaagtcgttttcgagatcatcttttctcattgaacatcaaagaatccacaccggagaacgcccctatcagtgcaaagagtgcggcaagtctttttctcagttgtgcaaccttacccggcaccagcgcatccacacaggggacaaacctcacaaatgtgaggagtgtgggaaagcgtttagcaggtcttcaggcctgattcagcatcaaagaattcacactcgcgagaaaacatacccttacaatgaaactaaggagtcttttgacccaaactgcagcctggtaattcagcaagaggtatatccaaaagaaaagtcatacaagtgcgatgaatgtggcaagacattcagcgtgtctgcgcatttagtacagcaccagcggatccacactggcgagaagccgtatctgtgcactgtttgtgggaaatcgttcagtcgctcctctttcctaattgaacaccagcggatccacactggggagcggccatatctttgcagacagtgcggcaagtctttctcccagttgtgcaatctaatcagacaccagggggttcacactggaaacaagcctcacaagtgtgatgagtgcggtaaggcattttctcgaaactctggccttattcaacatcagcgcatacataccggggagaaaccctacaagtgcgagaaatgtgataaaagcttttcgcaacagcggtcactagtcaaccaccagaagattcatgcggaagtaaaaacacaggagactcatgaatgtgacgcctgtggcgaagccttcaattgtagaatttccttgatccagcatcagaaactgcacaccgcctggatgcagtag

SEQ ID NO: 141184 - DNA, 1377 bp, Artificial Sequence
  Description of Artificial Sequence: Synthetic coding sequence
atggctgccatgcctctcaaggcccagtaccaggaaatggtgacctttgaggacgttgctgtccacttcactaagacagagtggaccggactgagccccgctcagcgagccttatatcggtcagtcatgctggagaattttggtaatctgactgccctggggtaccccgtaccaaagcccgctctgattagtcttctggagcgcggagatatggcctggggcctcgaagcccaggatgatccgccagccgagaggacaaaaaacgtttgcaaagacgtcgagactaacatagattctgagagcacactgatccagggtatttctgaggagcgggatgggatgatgtcccacggccagttgaagtcagtgccccagagaaccgactttccagaaacaagaaacgtggagaaacaccaggatatccctacagtaaaaaatattcaaggcaaagtccctcgaataccctgcgccaggaagccctttatttgtgaggagtgtggaaaatctttcagctatttcagctattatgccagacaccagcgcatccatacgggcgagaaaccatttgaatgcagtgaatgcggaaaggctttcaacgggaacagtagcctgatcagacatcagcgaatccatactggggaacgcccttatcagtgcgaggagtgtgggagggcctttaacgataacgccaaccttatccgccatcaacgtatccactcaggtgaccgtccctactactgtacagagtgtggaaattctttcactagctcaagcgagtttgtgatacatcagcgaatacacacgggggaaaagccctacgaatgtaacgagtgtggaaaggctttcgtgggcaatagccccctgctcaggcaccaaaaaattcatactggcgaaaaaccatacgagtgtaacgaatgcggaaagtctttcgggcggactagccatctcagccaacatcagcggatccacaccggagagaaaccatacagttgtaaggtgtgcggacaggccttcaattttcacactaaactgacccggcaccaaagaatccattctgaggagaagccttttgattgcgtggattgcggcaaggcgttcagtgcacaggaacagctgaaacgccatctacggatccatacacaggagtcctcctacgtgtgtgatgaatgtggaaaagcgctgacaagcaaacgaaacctgcaccagcatcagaggatccacacaggcgagaagccatatgagtgtagcaaatatgagaaagctttcgggacttcttctcagttgggccacctggagcacgtttactctggggagaaacctgtcttggatatctgtaggttcggcttgcccgagttctttactccattctactggtag

SEQ ID NO: 141185 - DNA, 1737 bp, Artificial Sequence
  Description of Artificial Sequence: Synthetic coding sequence
atggccgaagagtcccgtaaaccatccgctcccagcccacccgaccaaacccccgaagaggatctggtgattgttaaggtggaagaagaccatggctgggaccaggagtcaagcttgcacgaatcaaacccacttggtcaggaggtgtttcgcctgaggttccggcagctgaggtaccaagaaaccctggggcctagagaagcgttaatccagcttcgtgcgctgtgtcaccaatggctgcggcccgaccttaacaccaaggaacagatcttagagttgctggtgctcgagcagtttctaaccatcctgcctgaggagttacagacccttgtgaaagagcatcaactggaaaacggcgaggaagttgtcactcttctggaggatttggagcgccaaattgatatcctgggccgtccagtgtctgcacgggtacacgggcacagggtgctgtgggaggaggtcgtacacagcgcctcagcccccgaacctccaaacacacagctacagtctgaggctactcaacataaaagcccagtgccccaagagagccaggaaagagcaatgtcaactagccagagccccacacgcagtcagaaagggtcttctggcgaccaggagatgactgccacactgctgacagcaggattccaaacactggagaaaattgaagatatggccgtttctctgattagggaagaatggctcctggacccttcccaaaaagatctttgccgcgataatcgccctgagaactttagaaatatgttcagccttggcggcgagacccggtccgagaatcgggaactcgctagtaaacaggtgatctccaccgggatccaaccccacggggagaccgctgcaaaatgcaatggagatgttatccggggcctggaacacgaggaagcgcgcgatttgctgggtcgcctggaacggcagagggggaacccgacacaggaacggagacacaagtgcgacgagtgtggtaaatccttcgcccagtcatcaggattagtgagacactggcgaattcataccggcgagaaaccctatcagtgtaacgtgtgcggaaaggcattcagctacagatctgcgctgttgtcacatcaagatattcacaataaggtcaaacggtatcattgtaaggaatgcggcaaagccttttcacagaataccggccttatcctgcaccaacggatccacacaggggagaagccttatcagtgtaaccagtgcggaaaagcattcagtcagtccgccggacttatcctccatcagcgaatccactccggtgagaggccatacgaatgcaatgagtgtggtaaggccttcagccatagctcacatctgatcggtcatcagcggatccacacaggcgaaaagccatacgagtgcgatgagtgcggcaagacattccgccggagcagtcatctgattgggcatcaaaggtcccacacaggggagaagccttacaagtgcaatgagtgtggccgcgcctttagccagaaaagtggtcttattgaacatcagcgcatccatacaggcgagcggccttataagtgcaaggagtgcggcaaagccttcaatggaaacaccggtctaattcaacacctcagaatccacaccggagagaagccctaccagtgcaatgagtgtggcaaggccttcattcagcgctctagtctgataaggcaccaacggatacattcgggagagaagagtgaatccatatcagtctag

SEQ ID NO: 141186 - DNA, 1737 bp, Artificial Sequence
  Description of Artificial Sequence: Synthetic coding sequence
atggcggaggaatcgaggaagccgtccgcccctagtccacccgaccagacccccgaggaagacctcgttattgtaaaggtggaggaggatcatggatgggaccaggagtcctccctgcacgagtcaaaccccctagggcaagaagtctttaggttaaggtttaggcaactgcgttaccaagaaacgctgggccctagagaggctctcattcagttgcgggccctgtgccaccaatggctcaggcccgacctcaatactaaggaacagatcctggaactgctcgttctggagcagtttttgaccattctcccggaagagctgcaaactctggtcaaggaacaccagttagaaaacggggaggaagtggtcacactgcttgaggacctggaaagacagatcgatatcctggggagacctgtatctgcacgagtccatgggcatcgggtactgtgggaagaggtggtccattctgcctccgcgccggagccacctaacacccagctgcagagtgaagctacccaacacaaatctcccgttccacaggaatcccaggaacgcgccatgtccacaagtcagagccccactcgctcacagaagggatcctcgggtgaccaggaaatgactgcaacgctgctaactgcaggcttccagacactcgagaaaattgaagacatggcagtgagcctgattcgggaggagtggttactcgacccgagccagaaagacctgtgccgggataacaggccggagaacttcaggaatatgttttctctgggaggagaaacaagatccgaaaaccgtgagctagcgtcaaagcaggtgatctctactggcatccagcctcatggagagaccgccgccaagtgcaatggagatgtcatccggggcctggaacacgaggaggctcgagatttgctgggcaggctagagaggcagcgcggcaaccctacacaggagcgcagacacaaatgcgacgaatgcggcaagagctttgcccagagctcaggactggtgcgacattggcggattcacacaggggaaaagccttaccagtgtaatgtgtgtgggaaggccttcagttatcggtccgcgctgcttagccaccaggacatccacaacaaggtcaaaagataccattgcaaggaatgcggaaaggctttttcacagaataccgggctcatcctgcatcagcgaatacacacaggcgagaaaccatatcagtgcaaccagtgtggaaaggcgtttagtcagagcgctggcctgattttacatcagcgaattcatagcggagaacgtccgtatgagtgtaacgagtgcggcaaggcatttagccactcctcacatctgattgggcaccagcgtattcacacaggcgagaaaccctatgagtgcgatgagtgtggcaagactttccgccgctcttcccatcttatcggccatcaaagaagccacaccggggagaagccttacaaatgcaacgagtgtgggagagcctttagccagaagtcaggccttatcgaacatcagcggattcataccggagagcggccctataagtgcaaggagtgtggaaaagcctttaatggaaatactggtttgatccagcatctccggatccacacaggtgagaagccctaccaatgtaatgaatgtgggaaagcatttatacaacgctcctccttaattcgtcaccagaggattcatagtggtgaaaagtccgaaagcatttcggtgtag

SEQ ID NO: 141187 - DNA, 477 bp, Artificial Sequence
  Description of Artificial Sequence: Synthetic coding sequence
atggcagaggaatctagaaagcctagcgcaccatcccctcccgaccagacgccagaggaggatctggtgattgtgaaggttgaggaagaccacgggtgggatcaagagtcttctctgcacgaatcaaatcctctgggacaagaggtcttccgtctgaggtttcggcagctgaggtaccaggaaacgctcggaccacgtgaggccttgattcagctacgggccctgtgccatcagtggctgcgacccgacctcaacacaaaggagcagatccttgagctgctggtactggaacaatttttgaccattttgccggaggaattacagacactggtaaaagagcaccagctcgagaatggcgaagaagtggtgaccctgcttgaggacctggagcgccagattgacattctcgggaggccggtgtctcggcgaagatcgcagctggcttatatggacatcggttactcgggtcggcggtag

SEQ ID NO: 141188 - DNA, 1185 bp, Artificial Sequence
  Description of Artificial Sequence: Synthetic coding sequence
atgaatactaactcaaaggaggttctgtctctcggtgtgcaagtgcctgaagcctgggaagagctgctgactatgaaagtggaggccaaatcgcatcttcagtggcaagagtcgagacttaagcggtcgaacccactggcacgtgagatatttcgccgccactttcggcagctctgttaccaggaaacccccggccccagggaggccttgaccagactccaggagctctgctaccagtggttgagaccccacgtgagtactaaggaacagatcttggacctcctggtcctggaacagttcctgtccatcctcccaaaggaattgcagggctgggtgagagagcactgtcccgagtctggcgaagaggctgtgattctcctcgaagacctggagcgtgagctggacgagccccagcacgagatggtcgctcaccgacataggcaggaggtcctatgtaaagaaatggtgcctttggctgagcagacccctctgaccctgcagtcacagcctaaagagccgcaattgacttgcgattctgcccagaagtgccacagcattggcgagaccgatgaggtaactaaaactgaagacagggaactcgtcctgaggaaggattgccccaaaattgtagagccacatgggaagatgttcaatgaacagacttgggaagtgagccagcaagacccatctcatggtgaagtgggcgagcataaggatcggatcgaacggcagtggggcaatctactgggagaaggccagcacaagtgtgacgagtgcggaaagagcttcacccaaagctcaggactgatcagacatcagcgtatccatacaggagagagaccctacgaatgcaatgaatgtggcaaagccttttctagatcatctggcttgtttaaccacagaggaatccacaacattcagaagagataccattgcaaagagtgtggcaaggtgttttctcagtcagccgggctgatccagcatcagaggatccataagggtgagaagccttatcaatgttctcagtgtagcaagagttactcccggcgtagctttctgattgaacatcaacggtctcatactggagagcgccctcatcagtgcattgaatgcggtaaatcattcaatcgccactgtaacctgattagacatcagaaaattcatactgtagcagaactcgtttag

SEQ ID NO: 141189 - DNA, 126 bp, Artificial Sequence
  Description of Artificial Sequence: Synthetic coding sequence
atgaacaccaattcgaaggaggtactgagcctgggtgtgcaggtcccagaggcgtgggaagaactgctgacaatgaaggtcgaggctaagtcacacctgcaatggcaggaatcaagactcaaatag

SEQ ID NO: 141190 - DNA, 1185 bp, Artificial Sequence
  Description of Artificial Sequence: Synthetic coding sequence
atgaatacaaattcgaaggaggtactgagtttaggagtgcaggtccctgaggcctgggaagagctgctgactatgaaagtggaagcgaagagccatttacagtggcaggaatcaaggctgaaaaggagcaaccctctggctcgggaaatcttccggcgacactttagacagctgtgttaccaagaaactccaggacccagggaagctttaactcgactgcaggaactgtgctaccaatggcttaggccccatgtcagcactaaggaacagatcctagacttactggtgttagagcagtttctgtctattctgcccaaagagctgcagggttgggtacgcgaacattgccccgaaagcggggaggaggccgtcattctccttgaagatctggaacgcgagctagatgagccccagcacgaaatggtggcacaccgccaccgtcaagaggtgctgtgcaaagagatggtgcctctggccgagcagacaccgttaacgctacagtcccagcccaaagaaccgcagctcacctgtgacagcgctcaaaaatgccacagtatcggagaaacggatgaagttaccaagaccgaagatagggagctggtacttcgcaaagactgtcccaagattgtggagccccacggaaagatgttcaatgaacaaacttgggaggtgtcgcaacaggatccctcccatggagaggtaggggagcacaaggatcgaatcgaaaggcagtggggcaatctccttggcgaaggccagcacaagtgtgacgagtgtggtaaaagcttcacccagtcctccggcttgatacgccaccagaggatccacaccggcgagcgtccctacgagtgcaacgaatgtggaaaagccttctcacgctccagcgggctctttaatcaccggggaattcacaacatacaaaagcggtaccattgtaaggagtgtgggaaggtgttttctcagagcgcgggtctaatccagcaccaaaggatacacaagggtgagaagccctatcaatgctctcagtgcagtaagtcttactctcgccgatctttcctcatcgaacaccagaggtcccacaccggagagagaccacatcagtgtattgagtgtgggaagtccttcaaccggcactgtaacttgatccggcatcagaagattcacactgtcgccgagctagtctag

SEQ ID NO: 141191 - DNA, 1338 bp, Artificial Sequence
  Description of Artificial Sequence: Synthetic coding sequence
atgaatactaattcgaaagaagtgctgtcgctgggagttcaagtccccgaagcttgggaagagctgctcaccatgaaagtcgaagccaaaagtcatctgcagtggcaggaatcaaggttgaagcgctctaatcctttggctagggagatcttcaggcgtcactttagacagttatgttaccaggaaacacctggtccacgcgaagccttgacaagactgcaagagctgtgttaccagtggttgagaccccatgtctcaactaaggaacagatcctggatctgttggttctggagcagttcctgtcaattctgcctaaggaattacaaggctgggtcagagagcattgcccagagagtggcgaggaggcggtcatacttctggaagatctagaacgcgagttggacgaaccccagcacgagatggtcgcccataggcacaggcaggaggtgctgtgcaaggaaatggtgccactagcggagcaaacccctcttacattgcagagtcagccaaaggagcctcagcttacctgtgactctgctcagaagtgccactcaattggagaaacagacctgattaggagcttgaggaggagggccgtgctgattccccttggggctcatctgttttcgacagacactttcctgtttagtaaaccggtagtgatcccacagctaaaaggcgggggcgagacatggccaaataacagaggggtgctccgggacgaagtcactaagaccgaagacagagaactcgtgcttaggaaggattgcccaaaaatcgttgaaccgcacggcaagatgtttaacgagcaaacctgggaagtgtcacagcaggacccaagccacggcgaggttggtgaacacaaggacaggattgagcggcaatgggggaacctgctgggcgaaggccagcataaatgtgatgagtgtgggaagtcattcacccagtcttcaggactgatccggcatcagagaattcatactggcgaacggccctatgaatgcaacgaatgtggcaaagcctttagccgtagttctggcctatttaaccaccgcggtatccataatatccagaagcggtaccactgcaaggagtgcggcaaggtgtttagtcaaagcgctggactgatccagcaccagagaattcacaaaggagagaagccttaccaatgttcccagtgctccaagagctactccaggcgttcattcttaattgaacaccagagatcccatactggcgaacgcccgcatcagtgcatagagtgtggcaaaagtttcaacaggcactgcaacctgattagacaccagaagattcacaccgtggcggagctcgtgtag

SEQ ID NO: 141192 - DNA, 1821 bp, Artificial Sequence
  Description of Artificial Sequence: Synthetic coding sequence
atgacacttctcaccttccgcgacgtagccattgagttctctctggaggagtggaaatgcctcgacttggcccaacaaaatctgtatcgggatgttatgctggaaaattacagaaacctcttctccgtcgggctgaccgtgtgtaagccaggcctgataacttgcctagaacaaagaaaggaaccttggaacgtaaagaggcaggaagctgccgatggccaccccgagatgggatttcaccatgcaactcaagcgtgtctggagttgctcggaagcagcgacctgcctgcctcagcttcacagagtgctggaatcacaggggttaatcatcgtgcccagccagggctcaatgtgagtgtggataagttcacggcaatgtcctcacactttactcaggacctgctcccggagcagggcatacaggacgcctttcccaagagaatcctgcgagggtacggcaattgtggcctggacaacctctaccttaggaaggactgggagtcgttagacgaatgtaaacttcagaaagattacaatggtctgaaccagtgttcctcgaccacacactctaagatcttccagtacaacaaatatgtgaagatattcgataatttcagcaatctccataggcggaatatttctaacacaggtgagaaaccctttaaatgccaagagtgcggcaagtcattccagatgttatcctttcttactgaacaccagaagattcataccggcaaaaagtttcagaagtgcggagaatgcggcaaaacgtttatccagtgctcacacttcaccgaaccagaaaacatcgatacaggtgagaaaccctataagtgtcaggaatgtaacaacgtgattaagacgtgttccgtcttaacaaagaaccggatttacgcaggcggcgaacactaccgttgcgaggaattcggtaaagtgtttaaccagtgctcacacctgactgaacatgaacatggaacggaggaaaagccatgtaagtacgaagaatgttcctcagtctttatcagttgcagctcactgtcaaatcaacagatgatcttggcaggtgaaaagctcagtaaatgtgaaacctggtataagggcttcaatcacagccccaatcccagtaagcatcagcgaaacgagatcgggggcaagccattcaaatgtgaagaatgcgattccatttttaagtggttttcagacctgactaagcataagcggatacacacgggtgaaaagccctacaaatgtgacgagtgcggaaaagcctacacacagtctagccatttgagtgagcaccggcgtatacacaccggagagaaaccctaccagtgcgaggaatgcggcaaggtctttcgaacgtgtagcagccttagcaatcataaaagaactcacagcgaagagaaaccttatacatgtgaggagtgtgggaatatctttaagcagctgtcggacttgacaaaacataagaagacacatacaggtgagaaaccttacaaatgtgacgaatgcggcaagaatttcactcagtcctctaatctgatcgtgcataaacgtattcacactggtgagaagccgtacaagtgtgaggagtgcgggagagtgtttatgtggttttcagacatcacgaagcacaaaaaaacacataccggtgagaagccatacaaatgcgatgaatgtggcaagaacttcacacaatcctctaacctcatcgtgcataaacgaattcacactggtgaaaagccatacaaatgcgagaagtgcggcaaggccttcactcagttctctcacctcacagtgcacgagtcaatccacacttag

SEQ ID NO: 141193 - DNA, 1686 bp, Artificial Sequence
  Description of Artificial Sequence: Synthetic coding sequence
atggcgggagcccagacactgcttacctttagagatgtagccatcgagttcagtctggaagagtggaagtgtttagatttggcccagcagaacctgtaccgtgacgtgatgctggaaaactaccggaacctgttctctgtggggctaacagtatgcaagcctgggctgatcacatgcctggaacaaagaaaagagccttggaatgtaaaacgacaggaggccgccgacggccacccagcaatgagctcacatttcacgcaagaccttttgccggaacaggggatccaggatgcttttcctaagcggatcctgagaggctatggtaattgtggtctggacaacctctatttaagaaaggactgggaaagccttgatgagtgcaaacttcaaaaagattataatggactaaaccagtgcagtagtacaacacattctaagatcttccagtacaacaagtatgtaaaaatctttgataactttagtaatctgcaccgaagaaacatatccaacacaggcgagaagccctttaagtgccaggagtgcggaaaaagtttccaaatgttgagctttcttactgaacatcagaaaatccatacaggcaagaaatttcagaagtgcggggagtgcggcaaaactttcatccaatgcagccattttaccgaacctgaaaacattgacaccggagaaaaaccctacaagtgccaggaatgcaacaacgtgattaagacttgctctgtcctgaccaaaaataggatctatgcagggggggaacactaccgctgcgaggaattcgggaaggtgtttaaccaatgcagccatctgactgagcacgagcacggcactgaggagaagccatgtaaatacgaggagtgctcttctgtcttcatctcatgctcatctctcagcaatcagcagatgatcctcgccggagaaaagctgtctaaatgcgaaacctggtataaagggttcaatcacagtccaaatcccagcaaacaccagcgaaatgagatagggggcaaaccctttaagtgtgaagaatgcgattctatcttcaagtggttcagcgacttgactaagcacaagagaatacacacgggtgagaaaccgtataagtgtgatgagtgtgggaaagcatacactcagtcttcccatctcagtgagcacaggcggatccatacgggcgagaagccttatcaatgcgaggaatgtggcaaagtttttcggacgtgctcctccttgagtaaccacaagagaacacattcggaagaaaaaccgtacacttgcgaggaatgcgggaacatttttaaacaactgagtgacctgaccaaacacaagaaaactcatactggcgagaaaccttataagtgcgatgagtgtggtaaaaactttactcagagttccaacctcatcgttcataaacgaatccacaccggcgagaagccatataaatgtgaagagtgcggccgggtctttatgtggttttccgacattaccaagcacaaaaagacgcataccggcgagaaaccatacaagtgtgacgagtgtgggaaaaacttcacacaatcatcaaatctgattgtgcacaaaaggattcatacaggggaaaaaccttacaagtgtgaaaagtgcggcaaggccttcacgcagttttcccacctgacggtacatgaatctatccacacgtag

SEQ ID NO: 141194 - DNA, 1674 bp, Artificial Sequence
  Description of Artificial Sequence: Synthetic coding sequence
atgaccctcctcacctttagggacgttgcgatcgaatttagcttggaagaatggaagtgtctcgatctggcccagcagaatctgtatcgagatgtgatgttagaaaattacagaaatctgttcagcgtgggcctgacagtgtgtaaacccggccttattacatgtctggagcaacggaaagaaccctggaacgtgaagcgtcaggaagccgcagacgggcaccctgccatgtctagtcatttcactcaggatcttctgccagagcaaggtatacaagacgccttcccaaagcggatactgcgaggctatggcaactgcggtctggataacctgtacctgcgaaaagactgggagtctctcgatgagtgcaagctccaaaaggattataacggactcaaccagtgctcttcaacaacccatagcaagatttttcagtataacaagtacgtcaagattttcgataacttttccaacttgcacagaagaaacatatccaatacaggtgagaagccgtttaagtgtcaggaatgtggaaagtctttccagatgttatctttcttaaccgaacatcagaagatccacactggcaagaagttccagaagtgtggggagtgtggcaagaccttcatccagtgctcacactttactgaacctgagaacatcgacactggggaaaaaccatataagtgccaggagtgcaataatgtgattaagacttgttctgtgctgacaaaaaatcgcatttacgcaggtggcgagcactacagatgtgaagaatttggcaaggtgtttaaccaatgctcacacctcactgaacatgaacacggtactgaggagaaaccgtgcaagtatgaagaatgcagtagtgtgtttatctcttgtagtagcctctctaatcaacagatgattcttgcaggcgaaaaattaagcaagtgcgagacatggtacaaggggttcaaccactctccaaacccatccaagcatcagcgtaatgaaattggtggcaaaccattcaagtgcgaagagtgcgacagtatatttaagtggttctccgatctgactaagcacaagagaatccacaccggggagaagccctataagtgcgatgaatgtggtaaggcctatacgcagagttcccacctgagcgaacacaggcgaatacacacaggggaaaagccatatcagtgcgaggagtgcggaaaagtgttccggacctgttcgtcactttcaaaccataaacggacacatagcgaagagaaaccctacacttgtgaggaatgcggcaatatttttaagcagctttccgacctgactaaacataaaaagacccacacaggagagaaaccgtataaatgcgatgagtgcggtaagaactttacacagtcaagcaacttgattgtacataagaggatccataccggggagaagccctataaatgtgaggagtgcggccgtgtgtttatgtggttctccgacattacaaaacacaagaagacacacactggagagaaaccgtataagtgcgatgaatgtggcaagaacttcacccagtctagcaatctgatcgtacacaagaggatccacacaggggagaagccctacaagtgtgaaaaatgtggcaaggctttcacccaatttagccacctcaccgttcacgagtctatccacacctag

SEQ ID NO: 141195 - DNA, 1890 bp, Artificial Sequence
  Description of Artificial Sequence: Synthetic coding sequence
atgactctcctcacattcagagatgtggcaatcgaattcagtctggaagagtggaaatgccttgatctggcacagcagaatctctatcgggatgtgatgctggagaactaccggaatctgttctccgtcggactgaccgtttgtaaacctggcctaatcacatgtctcgaacagcggaaagagccgtggaacgtgaaaagacaggaagccgccgacggccacccagaaatggggttccatcacgcaacacaggcctgtctggaactgctgggcagcagcgacttgcccgcgtcagcaagccagagcgccgggattaccggggtgaatcacagagcccagcctggccttaatgtatctgtggataagttcaccgccctgtgctctccaggggtgctgcagaccgtcaaatggttcctggaattccgctgcatcttcagcctggctatgagtagtcatttcactcaggatctccttcccgaacagggcatccaagacgccttcccgaagagaatcctgaggggctatggtaattgcggattggataacctttacctgaggaaagattgggaatcgctcgatgagtgcaagttgcagaaggactacaatggtctcaaccaatgttcctccacaactcactcaaagatctttcagtacaataagtatgtcaagatttttgataacttttcaaacctgcacaggaggaatatcagcaacacaggagagaagccctttaaatgtcaggaatgcggaaagtcattccagatgctttcttttcttacggagcatcaaaagatccacaccggtaagaaatttcagaaatgcggagagtgcggcaagacatttatccagtgttcccattttacggagccagaaaacattgacaccggagagaaaccttacaagtgtcaggaatgcaataacgtgatcaaaacatgttctgtgttaacaaagaaccgtatatacgctgggggtgaacattacaggtgtgaggagttcggcaaagtgtttaatcagtgcagccatcttacagaacatgagcatgggactgaagagaagccttgcaaatatgaggagtgttcttcagtcttcatctcttgctctagtctctctaatcagcagatgattctggccggcgagaaactgtcgaagtgtgaaacctggtacaaggggttcaatcattcccctaacccatctaagcatcagcggaatgaaatcggagggaaacctttcaaatgcgaggaatgtgatagtatttttaagtggtttagtgacttgactaagcataagcggatccatacaggagagaaaccttacaagtgcgatgagtgcggcaaggcttacacacagtcttcccacctctctgaacacaggcggattcacaccggagagaagccctaccagtgtgaggaatgcggcaaagtcttccgcacgtgctcctccctttcgaaccataagcgcacgcatagtgaggagaagccgtacacatgcgaggaatgcggcaacatttttaaacagctctcagacctgactaaacataaaaagacacacaccggggagaagccttataagtgcgatgagtgcggcaaaaacttcacacagtctagtaacctcattgtgcacaagcgtatccacactggtgaaaaaccctataaatgcgaggaatgcggccgggtttttatgtggttttctgacattactaaacacaaaaaaactcacactggggaaaagccatacaaatgtgatgaatgtggtaagaacttcactcagagttcaaatctgatcgtccataagaggattcacaccggcgagaagccatacaaatgtgaaaaatgtggcaaggctttcacacaattcagccacctaaccgtgcatgagtctattcacacatag

SEQ ID NO: 141196 - DNA, 1686 bp, Artificial Sequence
  Description of Artificial Sequence: Synthetic coding sequence
atggcaggggctcagactttacttacattcagagatgtggcaatcgaattctcattggaggagtggaagtgtctagacctagcccagcagaacctgtatagagacgtgatgcttgagaactataggaacctgttttcggtgggcctcactgtctgcaagcccggtctgatcacgtgtttagagcaaaggaaagagccatggaatgttaaaagacaggaggcagccgatggacaccccgcaatgagctcccattttactcaggatctgctccccgaacagggcattcaagacgcattccctaagcgtatccttcgaggctacggcaactgcgggcttgataatctttaccttagaaaggattgggagtctctggacgagtgtaaactgcaaaaggactacaacggcctcaatcaatgttcttcaaccactcactccaagatcttccagtacaacaagtatgtaaagatctttgacaatttcagcaatctccaccgccgaaatatcagcaatactggggagaaaccctttaagtgccaggaatgtggtaaaagtttccaaatgctgagcttcctcacagagcatcaaaaaattcacaccgggaagaagtttcagaagtgtggagagtgtgggaagacttttatccagtgcagtcacttcacagaacccgagaacattgataccggcgagaagccctacaaatgtcaggaatgtaataatgttattaagacctgttctgtgttaacaaaaaatcggatctacgctggtggagagcattatcgatgtgaagagttcggcaaagtctttaatcagtgctcccaccttactgagcatgagcatggcaccgaggagaaaccctgcaaatatgaagagtgtagtagcgtattcatatcctgctcctctctgtcgaatcagcagatgatcctggccggagaaaaactaagtaaatgtgagacctggtacaaaggctttaaccatagcccaaatccatcgaaacatcaaagaaacgaaatcggcggcaagccattcaagtgtgaggagtgtgactccattttcaagtggttcagcgatttaaccaaacataagcgcatccacaccggggaaaaaccttacaaatgcgacgagtgtggaaaggcctatacccaatcttcccatttgtcagagcacaggaggatccataccggggagaaaccataccagtgcgaggagtgcgggaaggtattcaggacatgcagtagtctgtccaatcataagcgcacacattctgaagagaagccatatacctgcgaagagtgcggcaacatatttaaacagttaagtgacctgacaaaacacaagaaaactcataccggagagaagccttacaagtgtgatgaatgtggcaagaactttacacaatctagcaacctaatcgtgcacaaacgtattcatacgggtgagaagccgtataaatgtgaggaatgcgggagagtcttcatgtggttctcagacattacaaaacataagaaaacccacactggagagaaaccatataaatgcgatgagtgcggaaaaaacttcacccagtcttccaacctgatcgtccataagcgaatccatacaggagaaaaaccgtataaatgtgaaaaatgtggaaaagcatttacgcaatttagtcaccttactgttcatgagtccattcacacttag

SEQ ID NO: 141197 - DNA, 1833 bp, Artificial Sequence
  Description of Artificial Sequence: Synthetic coding sequence
atggccggtgctcaaactctgctgaccttcagggacgttgcgattgagtttagcctggaggagtggaaatgcctggaccttgcccagcaaaatctgtatcgggacgtgatgctggaaaactacaggaatctgttctctgttggcttgaccgtgtgcaagcccggcctgattacttgcctggaacagaggaaggagccttggaacgttaagcggcaggaggccgctgacggtcatccagagatgggatttcaccacgctacacaagcgtgtctggaactactgggcagcagcgatctgcccgcaagtgcgtctcagagcgcggggattaccggagtgaaccaccgcgcccagcccgggttgaatgtcagtgttgataaatttacagccatgtcatcccacttcactcaggacctgctccccgaacagggtattcaggacgctttccctaaaaggatcctgcgagggtacggcaactgcggccttgacaacctatatctgcgcaaggactgggagtctttagatgagtgtaaattgcagaaggattacaacggtctgaatcagtgctcttcgactacccacagcaaaatctttcagtataataagtatgtcaagatcttcgataatttcagcaacctgcacagaaggaatatcagcaacacaggcgaaaaaccattcaagtgccaagaatgtggcaaatcattccaaatgctaagctttctgacggagcaccagaagatccatacagggaagaagttccagaagtgcggggaatgcgggaaaaccttcatacagtgtagtcactttacggagcccgagaacatagatacaggagaaaagccatacaaatgtcaggaatgcaacaacgtgataaaaacatgttcagtactgactaagaaccgcatctatgcggggggagaacattaccgatgtgaggagttcgggaaagtgtttaaccagtgctcccacctgaccgagcatgagcatggcacagaggagaagccgtgtaagtatgaggagtgtagttccgttttcatctcctgcagcagtctgagcaaccaacagatgattttagccggtgaaaagttatctaagtgcgaaacgtggtacaagggctttaatcatagtcccaaccctagcaaacaccagcgtaatgagataggcgggaaacctttcaaatgtgaagagtgtgatagcattttcaagtggttcagcgatttgacaaaacataaaagaattcacactggcgagaagccctataaatgcgacgagtgcggcaaagcctacacacagtcttctcacctgagcgagcatcggcggatccataccggagagaagccatatcaatgtgaagaatgcggaaaagtttttcgcacttgcagcagccttagcaatcacaagaggacgcacagcgaagaaaaaccatacacatgtgaagagtgcgggaacatctttaagcagttatcagacctcaccaaacataagaagacccacaccggagagaaaccttataaatgcgacgagtgcgggaagaattttacacagtcctctaatcttatagtgcacaagaggatacacacaggcgagaagccatacaaatgcgaggagtgcgggcgggtgttcatgtggtttagtgacatcacaaagcataaaaagacgcataccggggagaagccctataagtgcgatgaatgtggcaaaaactttactcagtcatcaaatctgatcgtacacaagagaatccacaccggcgagaagccatataagtgcgagaagtgcggcaaagccttcacacagttttcgcacctcacagtccacgagagcatccatacctag

SEQ ID NO: 141198 - DNA, 396 bp, Artificial Sequence
  Description of Artificial Sequence: Synthetic coding sequence
atggccggagctcagacactcctcacctttcgggatgtggcgattgaatttagtcttgaggaatggaagtgcttagacctcgcacaacagaatctttacagggacgtaatgctcgagaactataggaatctattttccgtcggtcttacggtgtgtaagccgggactaatcacttgtctcgaacagaggaaggaaccatggaatgtgaagagacaggaagccgccgatggtcaccccgctatgtctagccattttactcaggatctgctaccagaacagggcattcaagacgcgtttccaaagcgcatccttagaggttacggtaactgcggactggacaacttgtatttgcggaaggactgggaaagtctcgatgagtgcaagctgcagaaatag

SEQ ID NO: 141199 - DNA, 348 bp, Artificial Sequence
  Description of Artificial Sequence: Synthetic coding sequence
atggcaggtgcacagacactgctgaccttccgggatgtagcaattgaattttcactggaggaatggaagtgcctagatttggctcagcagaacctgtatagggatgtgatgctggagaattatagaaatctgttcagtgttggtttaactgtgtgcaaaccaggactaataacctgcctggaacagcgaaaggaaccatggaacgtcaaaaggcaagaggccgcagatgggcatcccgagatgggtttccaccacgcgacccaagcatgtttggagctgctcggctccagcgatttgccagctagcgctagtcagtccgccgggatcaccggcgtaaatcacagatag

SEQ ID NO: 141200 - DNA, 1281 bp, Artificial Sequence
  Description of Artificial Sequence: Synthetic coding sequence
atggcagcggtgagcccaactacgcgttgccaggaatctgttacattcgaggacgtggctgttgtgtttaccgatgaagaatggtcccgcctcgtgcccattcaaagagatttatataaggaagtcatgcttgagaactacaactccattgtgtcactgggcctcccagtccctcagccagacgtgatctttcagcttaaaaggggggataagccctggatggtggacttgcatggcagcgaggaaagggagtggcccgagagtgtgtcccttgattgggagacaaaaccggaaatccatgacgcatccgataaaaagagcgagggctcactccgggaatgtctaggcaggcagtccccactatgcccaaaattcgaagtccacactcctaatggccggatgggcaccgaaaaacagtctccttcaggagagacacgcaaaaaatcattgtcccgagataagggcctacgccgcaggagatccgccttgtctagagagatactgactaaggagcgtcatcaggaatgttccgattgcggtaagactttcttcgaccactcttccttgacacgacaccaacgcactcataccggcgaaaaaccctatgattgcagagaatgcggcaaagccttcagccatcgatcctccctctcgcgccatctgatgagccacacaggggaaagtccctacgagtgctccgtttgttccaaggcgttcttcgatcgatcttctctcacagtccaccagcggatccacaccggggagaagccatttcagtgcaatgagtgcggaaaggccttctttgacagaagcagcctgactcgccaccagagaatacatacgggcgaatctccttatgaatgccaccagtgcgggaaagcttttagtcagaagtcaatcctgacccgacaccagctcatacatacgggcagaaaaccatatgagtgtaacgaatgcggcaaggcattctatggtgtgtcaagtctgaatcggcatcaaaaggcccatgctggggatcctcgctatcagtgcaatgaatgcggaaaggccttcttcgaccgctcttctctcacccagcatcagaaaattcataccggcgacaagccatatgagtgctcagaatgtggcaaagctttctcacagagatgtcgactgaccagacatcaaagggtccatacgggagaaaagccttttgagtgcactgtgtgcggtaaggtcttttcttcaaagtccagtgtcatacagcaccaacgccgctacgccaaacagggcatagactag

SEQ ID NO: 141201 - DNA, 1155 bp, Artificial Sequence
  Description of Artificial Sequence: Synthetic coding sequence
atgcttgagaactacaactccatcgtgagcctgggcctgccggtgccccaaccagacgtcatattccagcttaaaagaggagacaagccatggatggttgacctgcatggcagcgaggagcgagaatggcccgagagcgtgagcttagattgggaaaccaaacccgagatacatgacgcatctgacaagaagagtgagggcagtttgagagagtgcttgggccggcagtcccctctctgtcctaagttcgaggtgcacacaccaaatggccgcatgggcacagaaaaacagagcccatctggagagacaaggaagaagtccctgtctcgggataaagggctgaggcgacgtcgctccgctctctcccgcgagatcttgaccaaggaacgacatcaggagtgttccgactgcggcaagaccttctttgaccactcatctctgacccggcaccagaggacccacacaggcgaaaagccatacgactgccgcgaatgcggaaaagccttttctcaccggagtagtttaagtcggcacttaatgtcacacaccggagagtccccctatgagtgcagcgtatgctccaaagcgtttttcgatcgctcgagtttgacagttcatcagagaattcataccggagagaaacctttccagtgtaacgagtgcggaaaggcgttcttcgatcgctcgagtcttaccaggcaccagcgaatccacaccggcgaaagcccatacgagtgtcaccagtgcggcaaagccttctcccaaaaaagtatcctgacccgtcaccaattgattcacactggaagaaaaccatatgaatgcaacgaatgcggtaaggctttctacggagtgagttcattaaataggcaccagaaggcccatgcaggcgatcctcgctatcagtgcaacgaatgtggtaaagcctttttcgaccgctcctctctgactcagcaccagaagatacataccggcgataagccgtacgagtgcagtgagtgcggcaaagctttttcacagcggtgccgattgactcgtcatcagcgcgttcataccggtgagaagcccttcgaatgcacggtgtgtggcaaagtctttagtagcaagtcgagcgtaatccagcatcagagacggtatgccaagcagggaatcgattag

SEQ ID NO: 141202 - DNA, 1041 bp, Artificial Sequence
  Description of Artificial Sequence: Synthetic coding sequence
atgctcgagaactataatagcatagtgagcctcgactgggagaccaagcccgagatccatgatgcctccgataagaagtctgaagggagtctgagagagtgccttggcaggcagtctccgttatgtcctaaattcgaggtgcatactccgaatggccgcatgggcacggagaagcaatcgccgtctggcgagacgcgtaaaaagtctctgtctcgtgataagggactccgaaggcggcgatccgcactgagccgggagattcttacaaaagagcgtcaccaggaatgtagcgactgtggaaaaacttttttcgaccattcgtctctcactcgccaccagaggactcacactggagaaaagccctacgactgccgagaatgtgggaaggccttttcacacaggtcttcgctatctcgtcacctcatgagccacactggagagtctccgtatgaatgttccgtgtgctctaaggcattcttcgacaggagctctttgacagtacaccagcgcattcataccggtgaaaagccgtttcagtgtaatgagtgcggcaaggccttctttgataggagctctctgacccgtcaccagcggatccatacgggggagagtccttacgagtgtcatcagtgtggaaaagcttttagccagaagagcatactgacacgccaccagctgatccatacaggccgcaaaccatatgagtgtaatgaatgtggtaaagcattctatggggtctcttctctgaataggcaccagaaagctcatgccggcgacccaaggtatcagtgtaatgagtgtggtaaggctttcttcgaccggtcatcattaactcagcaccaaaagatacacaccggagacaaaccctacgaatgttccgaatgtgggaaagctttctcccagcggtgccgcctgacacgccatcagcgggtccacacaggagagaaacccttcgaatgcaccgtctgtggaaaggtgttttcgagtaagtcctcagtcatacagcaccagcggaggtacgctaagcagggcattgattag

SEQ ID NO: 141203 - DNA, 1320 bp, Artificial Sequence
  Description of Artificial Sequence: Synthetic coding sequence
atggccgcagtctcccctacaactcggtgccaagaatccgttacgttcgaggacgtcgcagtcgtctttaccgacgaagaatggtcccgtttggtccctattcagcgggatttgtataaagaagtgatgttggagaattataattccattgtgagcctgggcctcccagtgccacagccggacgtgatcttccagttgaaaagaggcgataaaccctggatggttgacctgcatggatctgaggagagagaatggccagaatctgtcagcctggcccaagagaaaaattgtatctgttttttgtttgtacctgactgggagacaaaacccgagatccacgacgcgtcggacaaaaagagtgaggggagcctgagagagtgcctggggcggcagagtcctctgtgtcctaaattcgaagtacacacccccaatggacgtatgggcaccgaaaaacagagcccctccggcgaaacaaggaagaagtccctctctagggacaaggggcttagaagacggagatcagcattaagccgggagatcctgaccaaagagcgacaccaggaatgttccgattgcggaaagacatttttcgatcacagtagcctgaccagacaccagagaacccacacaggggaaaaaccttatgattgccgcgaatgtgggaaggccttctctcaccgctcgagcctgagccgacacctcatgtctcacaccggcgaaagcccatacgagtgcagcgtgtgttcaaaagccttcttcgacagatccagcttaactgtgcatcagaggattcatacgggtgaaaaaccctttcagtgtaatgagtgcggtaaagctttctttgatcgtagctcgttgacaaggcaccagcgcatccacactggtgagtctccatacgagtgccaccagtgtgggaaggccttttcacagaaatccattctgactcgtcaccagcttattcataccggaaggaaaccatacgagtgcaacgagtgtggcaaagctttctatggggtgagcagcttaaatcgccatcaaaaagcacacgctggggacccacgctatcaatgcaatgagtgcggaaaggccttcttcgacagatcgtctctgactcagcatcagaagattcacacaggggacaaaccctacgagtgttcggagtgcggcaaagccttcagccagagatgtcgactgactaggcaccagagggtgcacactggtgaaaagcccttcgaatgcacggtgtgtggaaaggttttctcctcaaagtcaagcgtgattcaacaccagaggagatatgctaaacagggcatagactag

SEQ ID NO: 141204 - DNA, 1611 bp, Artificial Sequence
  Description of Artificial Sequence: Synthetic coding sequence
atgatgtttcaagattccgtcgcttttgaggatgtggccgtgagcttcacgcaggaggagtgggcgctcctcgacccatcccaaaaaaacctgtaccgggacgtgatgcaggagaccttcaaaaatttaactagcgtgggaaagacctggaaggttcaaaatatagaagacgagtataagaatcctaggcggaaccttagcctgatgcgggaaaaactgtgtgagagcaaggaatctcatcactgtggcgagtctttcaaccagatcgcagatgatatgctcaatcgcaagacacttcctggcataactccatgcgagtcctcagtatgtggcgaggttggtaccggccactccagtctcaatacccatattagggctgacactggccataaatcctcagagtatcaggaatacggagaaaacccatacagaaataaggagtgcaagaaagccttctcttacctggatagttttcaatcccatgataaagcttgtacaaaagaaaagccttatgacggcaaggaatgcaccgaaacatttatttctcactcttgtattcagcggcatcgggtcatgcacagcggcgacggaccctacaagtgcaagttttgcggtaaagctttctatttcctcaatttgtgccttattcacgaaagaatccacaccggcgtgaagccttacaaatgtaagcagtgtgggaaggcattcacccggagcaccacgctcccggttcatgaacgtacacacactggtgttaacgcagacgagtgcaaggaatgcggaaacgcattctccttcccctccgaaatcagacgacataaacgctctcacaccggggagaagccatacgaatgtaagcagtgcggcaaagtattcatttccttttcctctattcagtaccataagatgacacacacaggggaaaaaccatacgaatgtaagcagtgcggcaaggccttcagatgcgggagccacttacagaagcatgggcgaactcacacaggagagaaaccctacgaatgccgccaatgcggcaaggcctttcgatgtacatccgatcttcaacgtcatgagaagacccacactgaagacaagccgtacggttgcaagcagtgcgggaagggcttcagatgcgcgagccagctgcaaatccacgagagaactcacagtggcgaaaagcctcatgagtgcaaggaatgcggcaaggtgttcaaatacttttcatctttgcgcattcatgaacgtactcacaccggcgagaagccccatgagtgcaaacaatgtgggaaagcgttcagatacttcagctccctgcatatacatgaacgcactcacactggagataaaccatatgaatgcaaagtttgcggaaaagcctttacttgctccagcagcatacgctatcacgagcgcacacacaccggggagaaaccatacgaatgcaagcactgtggcaaggccttcattagcaactatatacgctatcacgaacgcacacacacaggtgaaaaaccatatcagtgtaagcagtgcggcaaggcgttcatcgtgcccgtgcatgtcgagaacatgaaagagttgattcctttaatcgatgaaaagtccttctag

SEQ ID NO: 141205 - DNA, 1599 bp, Artificial Sequence
  Description of Artificial Sequence: Synthetic coding sequence
atgatgttccaggactctgtggccttcgaggacgtagccgtgagcttcactcaggaggaatgggccctgctggacccgtcccagaagaatctgtatcgggatgtcatgcaagagacattcaagaacctgacctctgtcgggaagacgtggaaggtgcaaaatatagaagacgaatacaaaaatcctcgaagaaatctgtcgcttatgcgcgagaagttgtgcgaatctaaggagtctcaccattgcggagagtctttcaatcaaatcgcagacgatatgctaaatagaaaaactttaccaggaatcacaccgtgcgaatcctctgtgtgcggagaggtaggaacaggacactccagtttgaacacccacattcgggctgacaccgggcataagtcttccgagtatcaagaatacggcgagaacccataccgcaataaggaatgcaagaaggccttctcatatcttgattccttccagtcacacgataaagcctgtactaaggagaagccctatgacggcaaggaatgtacggagacctttatttcgcacagctgtatccagcggcatagagtgatgcactctggtgatggtccatataagtgtaagttttgtgggaaggctttctattttttaaatctgtgcctcatacacgagcggatccatacaggcgtgaagccttacaaatgtaaacaatgcggcaaggccttcacacggtctacaacgttacctgtgcacgagcgcactcacacaggcgttaatgctgatgaatgcaaggagtgcggaaatgcgttttcctttccaagtgagataaggaggcataaacgaagccacacgggtgaaaaaccatatgaatgcaaacagtgtggtaaagtttttatcagtttttcctccatccagtatcacaaaatgacacacacaggcgagaagccttacgagtgcaagcagtgcgggaaggcctttagatgtgggtctcacctgcagaaacatggacgtacccataccggtgagaagccctatgagtgtcggcagtgcggtaaggcgttccggtgtactagcgacctgcagaggcacgaaaagacacatacagaggataagccttacggttgtaaacagtgcgggaagggctttcgatgcgcctctcaattacagatacacgagaggacccactcgggcgagaagccacatgagtgcaaggaatgcggcaaagtcttcaaatactttagttcgctgcgtattcacgagcgaactcacacaggcgaaaagccgcacgagtgcaagcaatgcggaaaagccttccggtatttctcttcgctgcacatccacgagcgaactcataccggagataagccatatgaatgcaaggtgtgcggcaaggcctttacatgttccagctctatcaggtaccacgaacggacacataccggagagaagccctacgaatgtaaacactgtggaaaagcattcatcagcaactatattagataccacgaaagaacacataccggcgaaaaaccctaccagtgcaagcagtgcggtaaagcctttataagagcctccagctgtagggagcacgagcgaacacataccatcaaccgttag

SEQ ID NO: 141206 - DNA, 1185 bp, Artificial Sequence
  Description of Artificial Sequence: Synthetic coding sequence
atgatggccgccaaagtagttcctatgcccccaaagcctaagcaatcattcattctgcgggtgcccccggatagcaagttagggcaggacctgctgagagacgcaactaacgggccgaaaacgatacatcagctggtgttggaacactttctgacttttctgcccaaaccctccctggttcagccgagccagaaagttaaagagacacttgttatcatgaaagatgtgtcatccagcctccaaaatagagtgcatccgcggcctctggtgaaactgctgcccaaaggggtgcaaaaggagcaggagaccgtgtctctgtacttgaaggctaatcccgagttagtggtctttgaggacctgaacgtgtttcactgtcaggaggaatgcgtctctcttgaccctacacaacagcttacctcggagaaagaagacgacagctccgttggagagatgatgctgctcgcagtgaacggtagtaaccccgaaggtgaggatccagaacgcgaacccgtcgagaacgaagactatcgcgaaaagagctctgacgatgatgaaatggactcaagtttggtgtctcagcagcccccagacaaccaggaaaaggagagattgaatacttccatccctcaaaagagaaagatgagaaacttattggtgaccatcgagaatgacacacccctggaggaactgtcaaagtacgtagatatcagtatcatcgcgctgacaagaaacagacgcactcgccgatggtacacctgcccactttgtggtaaacaattcaacgaatcgtcatatcttatttcccatcagagaactcacacaggcgagaagccttatgactgcaatcactgcggaaaatccttcaaccataagacaaaccttaacaaacacgagcgtatccatacaggagaaaagccttattcttgctctcaatgcggcaagaatttcagacaaaatagccatagatccagacacgaaggtatccatatccgggaaaaaatcttcaaatgcccagaatgcggaaaaacattccccaaaaatgaggagtttgtgttacacctgcagtcccacgaggcagagcggccgtacggatgcaagaagtgcggacggcggttcggacgccttagtaattgtactcgacatgaaaagactcactctgcttgcaagactcggaaacaaaagtag

SEQ ID NO: 141207 - DNA, 1188 bp, Artificial Sequence
  Description of Artificial Sequence: Synthetic coding sequence
atgatggcagcaaaagttgtgccaatgcctcctaaacctaagcagtctttcatccttcgtgtgccaccggactctaagctggggcaagacttactgagagatgcaaccaatgggccaaaaactattcatcagctcgtcctggagcatttcctcacatttcttccaaaaccctcactggtgcagccaagccagaaagtcaaagagacccttgtgattatgaaggatgtctcctcctcattacagaaccgcgtgcacccaagaccactagtgaaacttttgcccaaaggtgtccagaaagaacaggagacagtgagcctgtatcttaaagccaatcctgaagagctggtggtgtttgaggacctcaatgtgtttcactgccaggaggagtgcgtgtctctggaccccactcagcagctgacaagtgaaaaggaagatgatagtagcgttggcgagatgatgctactagccgtgaatggatcgaatccagagggagaggatccagagcgtgaaccagtggaaaatgaggactaccgggaaaagtcctccgatgacgacgagatggactccagtctggtgtcacaacagcctcctgacaaccaggagaaggaaaggctcaatactagcatccctcagaaaaggaaaatgcgcaatctcctggtgacaatagaaaacgacactcctctcgaggaactgagcaagtatgtggacatctctattatcgcgctaacaaggaacagacgcacgcggcgctggtacacatgccccctttgcggcaagcagtttaacgagagctcatacctcatcagccaccagcgaacccacacaggagagaaaccctatgattgtaaccattgtggaaaatctttcaatcacaagactaatttgaataaacatgagaggattcacactggggagaagccgtacagctgttctcagtgcggaaaaaactttcgccagaacagtcaccggtctagacacgaaggaattcatattagggagaagatattcaaatgtcccgagtgcggtaagacattccctaagaacgaagagtttgtactccatctgcagagccacgaggccgagcgcccgtatggatgcaaaaaatgtggccgaagatttgggcgactatcgaactgtacacgccacgaaaagacgcactctgcgtgtaagacccggaagcagaaatag

SEQ ID NO: 141208 - DNA, 1185 bp, Artificial Sequence
  Description of Artificial Sequence: Synthetic coding sequence
atgatggctgccaaggtggtgcctatgccaccaaaacctaaacaatcttttatactgcgtgttcctccagacagtaaactggggcaagacttgcttcgcgatgcaacgaatggccccaaaactatccaccagctggtactagagcactttcttacattccttcccaagcccagcctagttcagccaagccaaaaggtgaaagagactctggttatcatgaaggatgtctctagtagtctgcagaatcgggtacaccctagaccgctcgttaaactgctgcctaaaggagttcaaaaagagcaagagacagtctccctatacctgaaggccaacccagaagaactggtcgtctttgaagaccttaacgtgttccactgccaggaggagtgtgtgagtctcgatccgacacagcagttgactagcgaaaaggaagatgactccagcgttggcgagatgatgcttctcgttaatggctcaaatccagagggtgaagatccagaaagggaacctgttgaaaacgaagactatagagaaaagtcctctgatgatgacgagatggactcttcccttgtatctcaacaaccacccgataatcaggaaaaggaacggctgaacactagcattcctcagaaaaggaaaatgaggaatttactggttacaatcgagaatgacacccccctcgaggagttgtctaaatacgtggacatttccattattgctttaacgcgaaatcgaagaacccggagatggtacacctgtccactttgcggaaaacagtttaatgagtcttcttatctgatctctcaccaacgcacgcacaccggcgagaagccttatgattgcaaccattgcggcaagtcttttaatcacaagacaaatttgaacaagcatgaacggattcacactggagaaaaaccctattcctgcagtcagtgcggaaagaatttcagacaaaacagccaccggtcacgtcacgagggcatccacataagggagaaaatctttaaatgtccagagtgcgggaaaacctttcctaagaacgaagagttcgtactgcacctgcagtcccatgaagccgagcgaccgtatggatgcaaaaaatgcggacggagattcggaaggctgtccaattgcacaaggcatgagaaaacccactctgcctgcaaaaccaggaagcaaaaatag

SEQ ID NO: 141209 - DNA, 1185 bp, Artificial Sequence
  Description of Artificial Sequence: Synthetic coding sequence
atgatggctgcaaaagtggtccccatgccacccaaacctaaacaatctttcatcctcagagtacccccagactctaagcttggccaagacctcctgcgtgatgcgacgaacggacccaagacaatccatcagctggtgctggagcactttcttacttttctcccaaagccatctctggttcagccctcacagaaagtcaaagagaccctggtgatcatgaaagatgttagttctagccttcagaatcgggttcacccaaggcctctggttaaactgctacccaaaggagtccagaaagagcaggaaaccgtctcactttacctgaaggccaatccagaggaactggtggttttcgaagatctgaacgtgtttcattgccaagaggagtgcgtgtcgctcgaccccactcagcagctaacttccgaaaaagaggatgacagtagtgtgggcgagatgatgctgctcgtaaatggtagcaacccagagggcgaagatcccgaaagggagcccgtggagaatgaggactatagagagaagagtagcgacgacgacgagatggactccagtcttgtgtcacagcaacctcccgacaaccaggagaaggaacggctgaatacttctatccctcagaagcggaagatgcggaacttgttggtcaccatagagaatgacactcccctggaggagctgtccaaatatgtggacatctcaatcatagctcttactagaaataggcggactagaagatggtacacatgcccgctgtgcggtaaacagttcaacgagagcagttacctgatcagtcaccagcggactcacacaggggaaaagccctacgattgcaaccactgtggaaaatcgttcaatcacaagaccaatctcaataaacatgaacggatccacactggcgagaagccttattcatgtagccagtgtggcaagaatttcagacagaactcgcacagatctagacatgaagggatccatattagggagaagatctttaagtgcccggagtgcggcaaaacctttccaaagaacgaggaatttgtcctgcaccttcagtcacacgaggcagagcggccatacgggtgcaagaaatgtggcagaaggttcggacgtctgagtaactgtaccagacacgagaagacacacagcgcatgtaagacgagaaagcagaagtag

SEQ ID NO: 141210 - DNA, 1188 bp, Artificial Sequence
  Description of Artificial Sequence: Synthetic coding sequence
atgatggcagccaaagttgtgccgatgccccccaagcccaaacagagtttcatcctgagagttccacctgactccaagctaggacaggacctgttgcgtgacgcaacaaatggccccaagacaattcatcagttggtcctggagcacttcttgacatttttgcccaaaccctcattggttcagccctctcagaaggtaaaagaaaccctggtcattatgaaagacgtgagtagttcactccagaaccgtgtgcatccccgtccgttagtgaaacttcttccaaagggggtccagaaggaacaagaaacagtaagtctgtacctgaaagccaaccccgaggagcttgttgtgttcgaggacctgaacgtttttcattgtcaagaggagtgtgtgtcattagatccgacccagcagctaacaagtgaaaaagaagacgacagcagtgtcggtgaaatgatgttactggccgtcaacggcagcaatcccgaaggagaggatcccgagagagaaccggttgagaatgaggactaccgagagaagtcaagcgatgatgatgaaatggattcgtccctcgtctcacagcaaccccccgataaccaagagaaagaacgtctcaacacaagcattcctcagaagagaaagatgcggaacttactcgtgacaattgaaaacgacacccctcttgaagaactctctaagtacgtagacattagcatcatagccttgacacgaaatcgtagaacccgcagatggtacacctgtccgttatgcggcaagcagttcaatgaaagtagctacctgatttctcaccagagaacccatactggcgagaagccatacgattgtaaccattgcggcaagtcctttaatcacaaaaccaatctgaacaagcacgaacggattcacacgggagaaaagccctatagttgttcccaatgtggaaaaaattttcgtcagaatagtcaccgctcacgccacgagggaatccatatccgcgaaaaaatttttaaatgtcctgaatgtggtaaaacgtttccaaagaatgaggagttcgtcctgcatctgcagtcccatgaagccgagagaccatacggctgtaagaagtgcggaaggaggttcggacgactgagtaactgcactcgccacgaaaagacccattcagcatgcaaaacacggaagcaaaagtag

SEQ ID NO: 141211 - DNA, 1947 bp, Artificial Sequence
  Description of Artificial Sequence: Synthetic coding sequence
atggcaacagccgtcgagcctgaggatcaggatctgtgggaagaagagggaattctgatggtgaagctggaagatgacttcacttgcaggcccgaatcagtcctccagcgggacgatcctgtactggagacctcacatcagaattttcgcagatttaggtatcaagaggcggcttccccacgggaggccctgattcggctcagggagctctgccatcagtggctgaggcctgagaggagaacaaaagagcaaatcctcgagctgctagttcttgaacagttcctgactgtactccccggagagctccagagctgggtgagaggccagcggcccgaatccggagaggaggctgtcaccctcgtagagggactgcaaaaacagccccgcagacctcgccggtgggtgacggttcacgtacacggtcaggaggtgcttagcgaggaaaccgtgcacctgggtgtggagcccgaatcacccaatgagttgcaggaccccgttcaaagttcaacacccgaacagtcaccagaagaaacaacgcagtctcccgaccttggcgcgccagccgagcagcggcctcaccaggaagaagagctgcagactttgcaagaatctgaggtgccagtccctgaggatcccgacctgcccgctgagagatctagcggcgatagcgagatggtggcactgctgactgctctgagtcaggggttagtgaccttcaaggacgttgccgtgtgtttcagccaagaccaatggagcgacctggaccctactcagaaggaattctacggtgagtatgttctcgaggaagactgcgggattgtcgtgagccttagttttcctatccctcgacccgacgagatcagccaggtacgggaagaggaaccttgggtacccgacatccaggagccacaagaaacccaggagccagaaatcctaagtttcacttatacaggagacaggagtaaggatgaggaggagtgcctggaacaggaggatttgagcctggaagatatccacagacccgtcctcggagagcccgagatccaccagacgcccgactgggagattgtgttcgaagacaaccctggtcgtctgaatgaacggaggtttgggacaaatatctcgcaggtcaattcattcgtgaacctgagagagactacgcccgtgcatccactgttgggccggcatcatgattgcagcgtgtgcggaaaaagctttacctgcaactctcatctcgtgagacacttacggactcatacgggggagaaaccttacaagtgcatggagtgtgggaagtcctatacgaggagtagccacctggctagacatcagaaggtacacaaaatgaacgccccgtacaaataccctctgaaccggaagaatttagaggagacaagtccagtgacccaggcagagagaacgccatctgttgaaaagccctataggtgtgacgactgcggcaagcacttcagatggaccagtgacctggtccggcaccagcgcacccatacgggtgaaaagccatttttttgtaccatctgtggcaagagcttctcacagaaatccgttctcactacacatcagagaatccaccttggcggtaaaccttacctgtgtggagagtgcggtgaggatttcagcgagcacagacgatacctggctcatagaaaaacacatgccgccgaggagctgtacttatgcagcgagtgcggtagatgtttcacccactccgccgcctttgccaagcaccttagaggccatgcttctgtgcgcccttgcagatgtaacgaatgtgggaagagcttttcccggcgggaccatctcgtgcgtcaccagagaacccataccggagaaaagccctttacgtgccccacgtgtggcaagagcttctccagaggctaccacctaatccggcatcaacggactcatagcgagaagacctcttag

SEQ ID NO: 141212 - DNA, 1947 bp, Artificial Sequence
  Description of Artificial Sequence: Synthetic coding sequence
atggccactgccgtggagcctgaagaccaggacctgtgggaagaggaggggatcctcatggttaagttagaggacgacttcacatgccgtcccgagagcgtgctgcaacgagatgaccctgtgctggagactagtcaccagaattttcgcagattccggtatcaagaggcggccagcccccgtgaagcattaattcggcttcgcgagctgtgccatcagtggttgcgccccgagagaaggacgaaagagcagatcctagaattactcgtactcgaacaattcctcaccgtgctgcctggagagctacagagctgggtccgtgggcagagacccgaaagcggcgaggaggcagtgaccttggtcgaggggcttcagaaacagcccaggcggccgcgaagatgggtaactgtgcacgtgcacggccaagaggtgctgtccgaggagaccgtccacctcggcgtagagccggagtcacctaacgaactgcaagatcccgttcagagctctacccccgagcagtccccagaagagacaacgcagagcccggaccttggtgctccggccgaacagaggcctcaccaggaggaggaactgcagactttacaggaaagtgaagtgcccgtgcccgaggatcccgacctgcctgctgaacgcagctcaggagactcagagatggtggccctgctcactgccctgtcccagggactggtcacattcaaagatgttgcagtgtgtttctctcaggaccagtggtcagacctcgaccctacacaaaaagaattctacggggaatatgtgctcgaggaggattgtggaatcgtggtgagtctttctttccctattcctaggccagatgaaatatcgcaggtgagagaggaggaaccctgggtgcctgatattcaggagccacaggaaacccaggagcccgaaattctctccttcacatatacaggagaccggtcaaaggacgaggaggaatgcctggagcaggaagatctgagtcttgaagatattcaccgaccggtactaggggaacctgaaattcatcagactcccgactgggaaatcgtgttcgaggataatcctggtcgactgaatgagagacgttttggcaccaatatatctcaggtgaacagttttgttaatctccgggaaactacacctgttcatcctcttttgggccgtcatcacgattgctctgtctgcggaaaatccttcacatgtaactctcatctggtgagacatctccggacacatacaggcgagaaaccgtacaagtgtatggaatgcggaaaaagttacactcgctcttcacacctggcccgccatcagaaggtgcataagatgaacgcgccatataaataccctcttaatcgcaagaacctggaggaaacttcgccagtcacccaggcagaacgtacgccttccgtggaaaagccgtacagatgcgatgattgcggcaaacacttccgctggactagcgacctggtacggcatcagcgcacgcacaccggtgagaaacccttcttttgcaccatctgcggaaaatctttttcccagaagtccgtactaacaacccatcaaaggattcacttaggcgggaagccatacctgtgtggcgaatgcggggaggacttctctgagcatcggcgctatctggctcatcggaaaacacatgctgcggaagaattgtacctctgcagtgaatgcggcagatgcttcactcatagcgcagcatttgccaaacacttgagggggcacgcatccgtgaggccctgtcggtgtaacgagtgtggcaagtccttttccagacgagaccatctggtccgacaccagcgcacacatactggtgagaagccgttcacatgccccacctgtggcaagtcattttctaggggttatcatctcataaggcaccagaggactcactcagaaaagacctcttag

SEQ ID NO: 141213 - DNA, 1947 bp, Artificial Sequence
  Description of Artificial Sequence: Synthetic coding sequence
atggccactgctgttgaacccgaggaccaggacctgtgggaagaagagggaatactcatggttaaattggaagacgattttacatgcaggcccgagagtgtgctccagcgcgatgatcccgtgctggaaactagtcaccagaatttccgtcgttttagataccaagaagcagcttccccccgcgaagcactgatacgcctgagagagctgtgtcatcagtggttacgccctgagaggcgaaccaaggagcagatccttgaactcctcgtgttagaacagttccttacagtactgcccggcgagctgcagagttgggtgcgcgggcagagaccagaatccggagaggaggccgtcacacttgttgaggggctccaaaaacagccaaggcgcccccgcaggtgggtcaccgtgcatgtccacggtcaggaggtgctgtctgaagagacagttcacctgggggttgagcctgagtctcctaacgaacttcaggatccagtccaaagctccactcccgagcagtctcctgaggagaccacccagagcccggatctgggagcgcctgcagaacagcgcccacatcaagaggaggagctgcagaccctgcaggaaagtgaagtacccgtgcctgaggaccctgacttgcccgccgaacgttcgtccggtgactcagaaatggttgctcttctcaccgctttgtcgcagggcttagtgacctttaaggacgtcgctgtttgcttttcacaggaccagtggagcgatctagaccccacccaaaaggagttttatggagagtatgtgttggaagaggattgcggcattgtcgtgtccctgagtttccctatccctagacccgacgaaatatctcaagttcgcgaggaggaaccttgggttcctgacatccaggagccgcaggagacccaggaacctgagattttgtcatttacatataccggagatagatctaaagacgaagaggagtgtctcgagcaggaagatctgtcactggaggacatccatcgtccagttctgggagagcctgagattcaccaaacacccgattgggaaattgtctttgaagacaatcccgggagactgaacgagcgacggttcggaaccaatatcagccaggtgaactcctttgtgaatctgagagaaacaactcccgtgcacccattgctcggtcggcaccacgactgctccgtatgcggcaaatcgttcacgtgcaatagtcacctggtaagacatttgaggacccacacaggtgagaagccctacaagtgcatggagtgcggcaaatcctatacccgatcttcgcatctggcaaggcaccaaaaagtccacaagatgaatgctccttacaagtacccacttaataggaagaacctagaggaaacctccccggtgactcaggctgaacggaccccaagtgttgaaaagccttacagatgcgatgattgtggaaagcactttcggtggaccagtgacctcgtaagacatcaaagaacccatacaggcgagaagccatttttttgtacaatttgtggaaagagcttctcacagaaaagcgtgctgaccactcaccagcggatccatctgggcgggaagccctacctgtgcggggaatgtggagaggatttctccgagcaccggcggtatttggcgcacagaaagactcacgccgccgaggagctgtatctgtgttctgagtgtggcagatgctttacccatagtgccgcgttcgcaaagcatctgcgcggacacgccagcgtcaggccctgccgctgtaacgagtgtgggaaaagtttcagcagacgggatcacctggtcaggcatcaacgtactcacaccggcgaaaagccttttacctgtcctacgtgcggaaagtccttcagtagaggttatcacttgatcagacatcagagaacccattccgagaaaacttcttag

SEQ ID NO: 141214 - DNA, 399 bp, Artificial Sequence
  Description of Artificial Sequence: Synthetic coding sequence
atgaccgccgcggcatcactgttggccagcctgttgccggcgctccccccgctgaatcttcaggatgcgaagtttgtggaggagcgaagaaagcagctgcagaactatttaaggagtgttatgaacaaggtaatccagatggttccagagttcgctgcgagtcctaagaaggagacgctgattcagctcatgcccttttttgtaatgggactgcaggtggggatgtacgggctttttcacttcggtgtgatgatggatcaaccccagccttctctgaccagagccgatgagagcccctgtgaccgggtcctgtcaccatgtgcagcccataggaagcaaagagattgctgcctgtcctggaaggcagaacccgaaaggtttctggtgaagaagaaatag

SEQ ID NO: 141215 - DNA, 1665 bp, Artificial Sequence
  Description of Artificial Sequence: Synthetic coding sequence
atgagtgccgatggaggtggtattcaggatacacaggataaggaaacacctcctgaggttcccgaccgtggacatccacatcaggaaatgccgagtaagttgggagaggctgttccatccggcgacactcaggaatccctgcatatcaagatggagccagaagagccccactccgaaggagctagtcaggaggacggcgcccagggcgcttggggatgggcaccgctgtctcatggatcgaaagaaaaggctctattcctgccaggtggggcacttccatctccccgcattcctgtactctctagggaaggccgcacccgcgacaggcagatggctgccgctctgctgacagcctggtctcagatgcctgtcacctttgaagacgtcgcattgtacctgtcccgggaggaatgggggcgacttgaccacacacagcagaacttctaccgagacgtgctgcagaaaaagaatggattgagcctgggatttcccttcagccgccccttttgggccccacaggcccacggcaagggggaagccagcggctcaagcagacaagcaggcgacgagaaagagtggcgtggcgcctgcaccggggccgtcgaggtcggccagcgtgtccagacctcatctgtagccgcgttaggtaacgtaaagccttttcggacacgagcaggcagagttcagtggggtgtgccccaatgcgctcaggaggctgcgtgtggtcgtagtagcgggccagctaaagattcgggacagccagccgagccagacagaaccccagacgccgcaccgccagacccttccccaaccgagccccaagagtatagagtgccagagaaacctaatgaagaggagaaaggtgccccagaatctggggaggagggactcgccccggactccgaggttgggaggaagtcctaccggtgtgaacagtgcggtaagggcttttcatggcacagtcatttagtgactcacaggcgcacacatacaggcgaaaagccttatgcatgtaccgattgtggaaaacgatttggtagatctagtcacctcattcagcatcaaatcatccataccggcgaaaagccctacacatgtcctgcttgcagaaagagcttcagtcaccattccaccttgatccagcaccagcgcatccataccggagaaaaaccttacgtttgtgaccgatgcgctaaaagattcacacgcagatctgacctggtcacccaccaggggactcacaccggtgctaaaccacataaatgcccgatttgcgcgaaatgctttacccaatctagcgctttggttactcatcagcgaactcacactggtgtcaagccctacccatgccccgagtgcgggaagtgttttagccagcggtctaatttaattgcccacaacaggacgcatacaggggaaaagccataccactgtttggactgtggtaagtctttcagccactcgtctcatctgactgcccaccagaggacacacaggggggttcgaccatacgcctgtccactctgtggaaagtcattttccagacgtagcaacctccacagacacgagaaaatccatacaacggggccgaaggcactcgccatgttaatgctcggcgcggcggccgccggagccctagccactcctcctcccgccccaacctag

SEQ ID NO: 141216 - DNA, 840 bp, Artificial Sequence
  Description of Artificial Sequence: Synthetic coding sequence
atgagtgcagatggcggcggcatccaggacacacaggacaaggaaaccccgcccgaggtccccgacagggggcatccgcatcaggagatgccctccaaactgggtgaggccgtgcctagcggcgacacccaggagtctctacatatcaaaatggagcctgaagagcctcatagcgagggcgccagtcaggaggacggcgctcagggcgcatggggttgggccccgctttcccacggatctaaagaaaaggctttattcctgccaggaggagcacttccttcccccaggatccctgtgctcagccgagaggggcgcacaagggaccggcagatggctgccgccctcctgactgcttggagccagatgcctgtgacatttgaggacgtggccctgtatttgtcccgtgaggagtggggccgactggaccacacccagcaaaacttttacagagacgttctgcaaaagaaaaatgggctcagcctgggtttccctttttcaaggccattctgggccccgcaggcgcacggcaagggggaagcctcagggtctagccgtcaggcgggcgatgaaaaggagtggcggggcgcctgtacaggcgcggtagaagtagggcagcgcgtgcagaccagctctgtcgccgccctgggtaacgtgaaaccatttaggaccagggcaggccgtgtccagtggggggttccacaatgtgcacaagaggctgcctgcggccgctcatcagggcccgccaaggattcaggccaacccgccgaacccgatcgtacccccgacgccgctccccccgatcccagcccaaccgaaccccaggaatatcgtgtgccatag

SEQ ID NO: 141217 - DNA, 357 bp, Artificial Sequence
  Description of Artificial Sequence: Synthetic coding sequence
atgtctgccgacggaggaggcatccaggatactcaggataaagaaacgccccctgaagtgccagatcgcgggcacccacaccaggagatgccttctaagttgggggaagctgtacctagtggcgacacacaggagagtctccacattaagatggagcccgaagagccacatagcgagggggctagtcaagaggacggagcccagggtgcctgggggtgggcacctttatcacatggatctaaggaaaaggccctgtttctgcccggcggggccctcccttctcctaggatccccgttctgagcagagaaggtcgtacccgcgaccgacagatggccgccgctcttctaactgcctag

SEQ ID NO: 141218 - DNA, 1392 bp, Artificial Sequence
  Description of Artificial Sequence: Synthetic coding sequence
atgggccgaaaaaagaaaaagcaattgaagccatggtgttggtattgcaatcgggatttcgatgacgagaagatcttgatccaacaccagaaagctaaacacttcaagtgccacatctgccacaaaaagctgtacactgggcctggcttggccatccactgtatgcaagtgcacaaggaaacgattgatgccgttcctaacgctataccagggaggaccgacattgaactggagatctacggcatggaagggattcccgaaaaagatatggatgagaggcgacgactcctcgaacaaaagacccaggagtcacagaagaagaaacagcaggacgactctgacgaatatgatgatgatgattcagccgccagtacatcctttcagccccagcccgtgcagccacagcagggatatatcccaccgatggctcagcccggattaccccctgtccccggagccccagggatgccacctggcattcctcccctcatgccaggggtcccccccctgatgcctggaatgccacccgtgatgcccggcatgcctccgggcctgcatcatcaacgcaagtacacccagtctttctgcggtgagaatatcatgatgccgatgggggggatgatgcctccaggccccggtatcccgccacttatgcctgggatgccacctggaatgccaccacccgtacccagacccggtataccaccaatgacgcaggctcaggcggtttccgctccagggatcctcaaccgcccgcccgcgccaaccgctacagtgcccgctccccagccccccgtgactaaaccgctgtttcccagtgccggtcaagcgcaagctgccgtgcagggcccagtcggaaccgatttcaagcccctgaactctactcccgcaacaaccacagaacccccaaaacctactttcccagcatacacgcagtccaccgctagtaccacgagcaccactaacagtactgctgcaaaaccagcggcgtcgatcacttctaagccagccactcttactacaaccagtgctactagtaaactgatccatccggatgaggatatcagcctggaggagagaagggcacagctgccgaagtatcagaggaatctgcccagacctggtcaagccccaatcgggaatcctcccgtcggacccatcggcggcatgatgcccccacagccaggcatccctcagcagcaggggatgaggcccccaatgcccccacatggccagtacggaggacaccatcaagggatgccagggtacctgcccggcgcaatgccaccttacggacaaggcccccccatggtgccaccctatcagggcgggccgcccagaccccctatggggatgcggccacctgtaatgtcccagggaggacgatactag

SEQ ID NO: 141219 - DNA, 1188 bp, Artificial Sequence
  Description of Artificial Sequence: Synthetic coding sequence
atgggccgcaaaaagaaaaaacagctgaagccctggtgctggtactgcaatcgtgactttgacgatgaaaagattctaatccaacatcaaaaagcaaagcactttaaatgccacatttgtcataagaagctctataccggcttgccccctgtgcccggcgccccagggatgccaccagggatccctcctctgatgccgggagtgccaccattaatgccaggcatgcctccagtaatgccaggaatgcctccaggtctgcaccaccagagaaagtacacgcagtctttttgcggcgaaaacatcatgatgcctatgggggggatgatgccccctggtcccggaatccctcccttgatgcccggcatgcctccgggcatgcccccacccgttcccaggcccggcattccacctatgacacaggcccaggcagtgagcgcaccaggaatcttgaacagaccacctgcacccacggcgacagtgcctgcccctcagccaccagtgacaaagcctcttttccccagtgcaggccagatgggtacccccgtgacatccagtagtacggccagctccaatagcgaatctcttagtgcctctagcaaagcattgttccccagtaccgcccaagcacaggcagcagtgcagggtccagtcgggacggatttcaaacctttgaactcaacccccgccactaccaccgagccgccgaagccaacatttcctgcctacacacagtctactgccagcactacctccacgaccaactccacagccgccaagcctgccgcttctatcacttcaaaacctgctactctgacaaccacaagcgcaacctccaagctcattcatccggacgaagacatatcactcgaagagcgcagagcacagcttcctaaatatcagcgcaacctgcctagaccaggacaggctcccatcggaaaccctcctgtcgggccgatcggaggcatgatgccaccccagcccggcatccctcagcaacagggaatgagacctcctatgccaccacacggacagtacgggggccatcatcaggggatgcctggatacctgcctggtgccatgcctccatatggccaggggccacccatggtccctccctaccaggggggaccaccgagaccaccgatgggtatgcggcccccggtcatgagccagggaggtagatattag

SEQ ID NO: 141220 - DNA, 1437 bp, Artificial Sequence
  Description of Artificial Sequence: Synthetic coding sequence
atgggtcgcaaaaaaaagaaacagctgaaaccttggtgttggtattgtaatagagactttgacgatgaaaaaattctcatccagcaccaaaaagcgaagcatttcaaatgtcatatctgccacaaaaagctgtacactggccccgggctcgccattcattgtatgcaggtgcataaagagaccatcgatgctgtaccaaatgccattcctggccggaccgacatagaacttgagatctacggaatggaaggcataccagagaaggatatggatgaaagaaggcggctgctggaacagaaaactcaggagagtcagaagaaaaagcagcaggacgacagcgatgaatacgatgatgacgattccgctgcaagcacgagttttcaaccacagcccgttcaaccacaacagggttacattcctcccatggcccagcccggtctgccgcccgttcccggagcccccggaatgccgccaggcatccccccattaatgccaggtgtgcctcctttgatgcctggcatgccacccgttatgccagggatgccaccaggaatgatgcctatgggtggcatgatgccacctggaccaggcattccacccttgatgcccggcatgcccccaggcatgcctccgcccgtgccccggccgggaatccctccgatgacccaggcacaagctgtgtctgcgccgggaattctgaacaggcctcctgccccaactgccaccgtgcctgccccccagccaccggttactaaaccattgttcccctcagcaggacagatgggcacccctgtcacctcttcctccactgcttcaagtaactccgagtccctttcggcatcaagcaaggccctatttccttccactgcccaggcacaagccgcagtacagggccccgtcggcacagacttcaaacccctaaattccacccccgcaacaacaacagagccccccaagcctacatttccagcgtatactcaatctaccgcctctactacctccacgacgaatagcacagcagcaaagccagccgcttccatcactagcaaaccggctactctaaccaccacgtccgcgacatcgaagctcattcaccccgatgaggacatttccctggaggaacgacgagcccagttgccgaagtatcagcgaaatttgccacggcccggccaggcacccattggtaacccaccagtcgggccaatcggcgggatgatgcctccccagccaggaatcccccagcagcagggaatgcgtccccccatgccccctcatgggcaatacggcgggcaccaccagggaatgcccggatacctacctggtgctatgcctccgtacgggcaagggccccctatggtgcccccgtatcaaggcggcccaccgcggccccctatgggaatgagaccacccgttatgagccaagggggaaggtattag

SEQ ID NO: 141221 - DNA, 1485 bp, Artificial Sequence
  Description of Artificial Sequence: Synthetic coding sequence
atggggcggaaaaagaaaaagcaattgaaaccttggtgctggtattgtaaccgagatttcgatgacgagaagatactgattcagcatcagaaggcgaagcactttaagtgccacatatgccacaagaagctgtacaccggtcctggtctggccatacactgtatgcaagtgcacaaagaaaccattgacgccgtgcctaacgccatcccaggccgcacagatattgagcttgagatatacgggatggaaggtattccagaaaaagacatggacgaaaggaggaggcttttagaacagaagacccaagagtcccaaaagaagaagcagcaggacgacagtgacgagtacgacgatgatgacagcgcggcctccacctccttccaaccacaacccgtgcagccacagcagggctacatccccccaatggcccagcctggcttacctcctgtgcctggggcaccgggcatgcccccaggaataccacctcttatgcctggtgtcccaccccttatgcctgggatgccacctgttatgcctggaatgccccccggccttcaccaccaacgaaaatacactcagtccttctgcggggagaacatcatgatgccaatgggcggcatgatgccgccaggccctggaatccccccgctgatgcctgggatgccccccggtatgccccctccggtaccccgcccaggcatcccacctatgacccaagcccaggcagtgagtgcaccagggattctgaaccgcccccctgctccaactgcaaccgtcccagccccacaaccgcccgtgactaagcccctgttccctagcgccggtcagatgggtacccctgtaacatccagtagcaccgctagctctaattctgaatctctcagcgcttcatcgaaagcgctgtttccttccacggctcaggcgcaagcagccgtccaaggcccggtgggaaccgacttcaagccgctaaatagcaccccagcaacaactacagagcctcctaaacctacatttcccgcctacacacagtccaccgcctcaactacgagcaccaccaactctaccgccgccaaacctgctgctagtatcactagtaagcccgctacactgacaacaaccagtgccacttctaaattgattcatcctgatgaagatatctctctcgaagagagacgggcccagctcccaaaataccagaggaacctgcctcgcccgggacaagcaccaatcggtaatccacccgtaggaccgatcgggggcatgatgccaccacagcctgggatcccacagcagcagggaatgcgaccgccaatgccgccacacggacaatatggcggacaccatcaggggatgcccggctatctgcctggagcaatgcctccttatggccagggacccccaatggtgcccccttaccagggcggacctccacgcccccctatgggcatgcgccctcccgtaatgtctcagggcggtcgctattag

SEQ ID NO: 141222 - DNA, 1344 bp, Artificial Sequence
  Description of Artificial Sequence: Synthetic coding sequence
atgggccgcaagaaaaagaagcaattaaaaccttggtgttggtactgtaaccgcgactttgacgacgaaaaaattctgattcagcaccagaaggctaagcacttcaagtgccatatttgtcataaaaagctttatacaggacctggtcttgccattcactgcatgcaggtccataaagaaacaatcgatgcagtgcccaacgctattcctgggcggaccgatattgaactggaaatttatgggatggaaggaattcccgaaaaggatatggacgaacggcgccgtctgcttgagcagaaaactcaagagtcccagaagaagaagcagcaagacgatagtgatgaatacgatgatgacgattcagctgctagcacatctttccaaccacagcccgtgcagcctcagcaaggttacattccaccaatggcgcagcccgggctgcctcctgtgcccggcgcacccggcatgcctcctggcatccctcctctcatgcccggggtgcccccactgatgccagggatgcccccggtgatgccaggcatgcctccaggaatgatgcccatgggaggcatgatgcccccaggccctggcatcccccccctgatgccgggcatgccacccggaatgccaccaccagtgccaaggcctggcatcccccccatgacccaggcacaagctgtgagcgcaccaggaatcttgaataggcctccagccccaaccgctaccgtccctgcacctcaacccccggtcaccaagccactgtttccttccgcgggacaggcccaagcggctgtgcaaggcccggtcggcacggacttcaagcccctcaatagcactccagcaactacaacagagcctccaaagcccacctttcccgcctacactcaatcaaccgcatctactacgtccactactaacagcactgctgccaagcccgcagcaagtataaccagtaaacctgcaacattgaccactacaagtgccacctccaaattgatacaccctgacgaagatatctctctggaagaacggcgggcccagttgcccaagtaccagagaaatctgccccgtccgggacaggccccaataggaaacccacccgtcggaccaatcggtggcatgatgcctccccaacccggcatcccacaacagcaggggatgagacctcctatgccaccacatggccagtacggaggtcatcaccagggtatgcccggatacctgcctggagcaatgccaccctacggccagggcccccctatggtgccaccctatcaggggggccccccgcggccccccatggggatgcggccccccgtgatgtcacaaggagggagatattag

SEQ ID NO: 141223 - DNA, 1491 bp, Artificial Sequence
  Description of Artificial Sequence: Synthetic coding sequence
aacacagtaatgggtaggaagaaaaaaaagcagctgaagccgtggtgctggtattgtaatagggactttgacgacgaaaaaatcctgattcagcaccagaaggccaagcatttcaaatgtcacatttgtcataaaaagctgtataccggccctggactggctattcattgcatgcaggtgcataaggaaacaatcgacgccgtgccgaatgctatcccaggccgaacagatatagagctcgagatttatgggatggaaggaattcctgaaaaagatatggatgaacgtaggcgtcttctggagcaaaaaacacaggaatctcaaaagaagaaacaacaggacgactcagatgaatacgatgatgacgactcagcagcctccactagcttccagccacagccagtccagcctcagcaggggtatatccctcccatggctcaacctggactgcctcccgtgccaggcgccccaggcatgcccccagggattccaccactgatgccaggcgtccctcctctgatgccggggatgcccccagtgatgccagggatgccaccagggctgcatcatcagagaaaatacacccagagcttctgcggggaaaatatcatgatgcctatgggcggaatgatgccgccaggacccgggatcccaccgcttatgcctgggatgccacctggaatgcctcctcccgtgcccagaccaggaatccccccaatgactcaagctcaggccgtgagcgctcccgggattctgaatcgtcctcctgcccctacagcaaccgtgcccgcacctcagccgcccgtgacgaagccactttttccttcagccggccagatggggacccccgtcacttcaagtagtacagcttcaagcaattcagaatcactttctgcctcctctaaagccttattcccatcgacagcgcaggcccaggccgccgttcaggggccagtaggcactgacttcaaacctcttaattctacgcccgctacgacgaccgagccacccaagcctacttttccagcgtatacccagagtactgcctccaccacctctaccaccaacagcacagccgcgaaacctgccgctagtatcacgagtaagcccgccactctgacaaccaccagcgccacttctaagttaattcatcccgacgaggatatttccctggaagagcgtcgggcacagttgccaaagtaccagcggaacctcccccgacctgggcaggctccgattggcaacccccctgtcggcccaatcggaggcatgatgccgcctcagcccggtatcccccagcagcagggtatgcgaccgcctatgcctccccacgggcagtatggaggtcatcatcagggtatgcccggctatttacctggagctatgcccccatacggccagggcccacccatggttccaccctatcagggaggaccccccagaccaccaatgggtatgagacctccggtcatgtctcaagggctgccttag

SEQ ID NO: 141224 - DNA, 3843 bp, Artificial Sequence
  Description of Artificial Sequence: Synthetic coding sequence
atgggctctctcacgttcagggatgtggccatagaattctccctcgaagaatggcagtgcctagatactgctcagcaaaacctctataggaacgtaatgctagagaactatcgtaatctggtgtttctgggcattgccgccttcaaaccggacctgattattttccttgaggaaggaaaggaatcgtggaatatgaagcgacacgagatggttgaagaaagtccggtcatttgcagtcacttcgcccaggatctttggccggagcagggaatcgaagattctttccagaaagttattctgcggagatatgaaaagtgtggccatgaaaacctgcacctgaaaataggttacactaacgtggatgagtgcaaagttcataaggaagggtacaataaacttaatcagtccctcactacaacccaaagcaaggttttccaaagaggtaaatacgccaatgtcttccataagtgcagcaatagcaaccggcataagatcagacatactggcaagaagcacttacaatgcaaagagtacgtgaggtcattttgcatgctctcccatctttctcagcacaagcggatctacacacgggaaaacagctataagtgcgaagagggtggcaaggctttcaactggtcatccaccctgacatactacaaaagcgcacacaccggcgaaaaaccctatcgctgcaaagaatgtggaaaagcattttccaaatttagtatcctcactaaacacaaagtaatccacaccggtgaaaagtcatacaagtgcgaagagtgtgggaaagcattcaaccagagtgccatcctcacaaagcacaaaatcatacatactggtgagaaaccaaataagtgcgaggagtgtggcaaggctttttccaaggtgtctaccctcactacccacaaggccatccacgcaggagaaaagccctataaatgcaaggagtgcggcaaggccttctcgaaggtgagcaccttgatcacccacaaggcgattcacgccggggagaaaccctacaagtgcaaggagtgtggcaaggcattctctaagtttagtatcttaaccaaacataaagtgattcacacaggagaaaagccttacaaatgcgaggagtgtggaaaagcatataagtggcctagcaccctctcttatcataagaagatccacacgggggaaaaaccttacaagtgcgaggaatgcggcaaagggttttctatgtttagcatacttacaaagcatgaggtcatccatacgggcgagaaaccttataagtgtgaggagtgcggaaaggctttcaattggtctagtaacttgatggaacacaaaaagatccatacgggggaaaccccgtacaaatgtgaggaatgtggaaaggggttttcaatgtttagtattctgacaaaacataaagtgattcacaatggcgagaagccttataagtgcgaggaatgcgacaaagcaacgcatgccggggagaagccttataaatgtgaagagtgtggcaaggcctttaattggtcatcgaatctgatggagcacaaaaggatccacactggcgagaagccgtacaaatgcgaggaatgtggcaagtctttcagcactttttcaatactgactaagcacaaggtcatccatactggggaaaagccctataagtgcgaggagtgcggaaaagcctacaagtggagttcaaccctgtcttatcacaagaaaatccacacggtcgaaaaaccgtacaagtgtgaggagtgtggcaaggcgtttaaccagtccgccatcttgataaagcacaagaggatccatactggtgaaaagccttacaagtgtgaggaatgcggcaagactttttctaaggtctcgacgctgaccactcacaaggctatccacgctggtgagaaaccttataaatgtaaggagtgtggcaagacttttattaaagtttctacgttgacaacacataaggcaattcacgccggtgaaaagccctataagtgcaaggagtgtggaaaggccttctccaaatttagcatccttaccaaacacaaggtgatacataccggggagaagccatataagtgtgaagagtgtggcaaggcattcaactggtcctctaacctgatggagcacaaacgaattcacaccggagaaaagccttataagtgcgaagaatgtggcaagagctttagtacattcagtgttttgactaagcacaaagttatccataccggtgagaagccttataagtgtgaggaatgcggtaaggcttacaaatggagctcgacactctcttaccataaaaaaatccataccgtggagaaaccatataagtgtgaggagtgcgggaaggccttcaatcgttcagccattctgatcaaacacaagaggattcacactgacgagaagccttataagtgcgaagagtgcggtaagacattttctaaggtgtcaactttgacaactcacaaggccatacatgccggggagaaaccctacaagtgcaaggaatgtgggaaagcattcagtaagttctcaatcttgactaagcacaaggtcattcacaccggagaaaagccatacaaatgcgaggaatgcggcaaggcctacaagtggccctccactttgtcatatcacaagaagatccacaccggcgagaaaccctacaagtgtgaggagtgtggaaagggtttttctatgttttctatcctcaccaaacacgaggttatacacaccggagagaagccttataaatgtgaggaatgtggcaaggcttttagctggctctcagtcttttccaaacacaaaaaaacccacgccggagaaaagttttataagtgtgaggcttgcggaaaagcctacaagagctcgtccactctgtcatatcacaaaaaaatccacactgaggagaaaccatacaaatacgaggaatgtggcaaaggcttttctacttttagcatattgactaaacacaaagtgatccacactggcgaaaagccatataagtgtgaggaatgcggtaaggcctttaattggtcgtccaatcttatggaacataagaagattcacacaggggagactccttacaagtgtgaggaatgtgacaaggcattctcctggccttcatccttaactgaacacaaggccacgcacgctggggagaagccgtacaaatgcgaagaatgcggaaaggcctttagctggcctagccgcctcactgagcataaggccacgcacgcaggagaggaaccttataagtgcgaagagtgcggcaaggccttcaattggtcttcaaacctgatggagcacaagcggatacacacaggagagaagccctacaagtgtgaagagtgcgggaaaagtttcagtacattctccatccttacaaagcacaaggtcatacatacaggagagaaaccttacaagtgcgaggaatgtggaaaagcctacaaatggtcctctacattgtcctatcataaaaagattcacacagtcgaaaagccctataagtgtgaagaatgtggaaagggatttgtgatgttcagtatcttagcgaaacataaagttatccacaccggagaaaaattatacaaatgtgaggagtgtggaaaggcttataagtggccctccactctcagataccataagaagatccacacgggggagaagccctataaatgtgaagagtgcgggaaggccttcagtacttttagtatcttgacaaaacacaaggtgatccacaccggcgagaagccttataaatgtgaggagtgtggaaaggcgttttcatggttgtccgtgttttctaaacataagaagatccacacaggagagaagctttag

SEQ ID NO: 141225 - DNA, 123 bp, Artificial Sequence
  Description of Artificial Sequence: Synthetic coding sequence
ggaaaaggtttttctatgttctccattctcacgaagcataaggcgactcatgccggagagaagccctataaatgtgaggagtgcggcaaggccttcaattggtcatcgaacttaatggaatag

SEQ ID NO: 141226 - DNA, 3504 bp, Artificial Sequence
  Description of Artificial Sequence: Synthetic coding sequence
atgggcagcctgacttttcgcgacgttgccattgagtttagcttggaagaatggcagtgcctggatactgcacaacagaatctgtacagaaatgtcatgctcgagaattaccgcaatttggtgtttctgggaatcgctgcgtttaaacctgacttgatcatttttctcgaagaagggaaggaatcatggaatatgaagcgccacgaaatggttgaggagagtccagtcatctgcagtcactttgcacaggatctgtggccagaacaggggatcgaagattcctttcagaaagtcattctgagacgctacgaaaaatgtggccatgagaatttgcatttgaaaatcggctatactaatgttgatgaatgcaaggtccataaagagggctacaataagctcaaccagtcattgaccacgactcagagcaaagtcttccaacgtggaaagtatgccaacgtgttccacaagtgctcaaattcaaacaggcacaaaatacgccacactggcaagaaacacctgcagtgtaaagagtacgttcgctcgttttgtatgctttcgcatctgtcccagcacaaacgcatctacacgagggagaactcatacaagtgcgaggagggagggaaagcttttaattggtctagcacacttacttactacaaatctgctcatacaggcgagaagccctaccgctgcaaggagtgcggaaaggccttctccaagttttcaatactgactaaacataaggtcatccatacaggggaaaaaagctataagtgtgaagaatgcggcaaggcatttaaccaaagcgctattcttacaaagcataaaattattcacactggcgaaaagcctaataagtgcgaggagtgtgggaaggcattcagcaaagtgagcaccctcacaacgcataaagctattcatgctggcgagaaaccttataagtgtaaagaatgcggcaaagcctttagtaaggtgtccactcttatcacccataaggccatacatgccggggaaaagccttacaaatgtaaggagtgtggcaaggctttctcaaagttttcgattctcaccaagcataaggtcatccacaccggcgaaaaaccttacaaatgcgaagaatgcggtaaagcgtataaatggccttcgactttaagttatcacaagaaaatccataccggtgaaaagccttataagtgcgaagagtgcgggaagggattctcaatgtttagtatcctgactaagcatgaggtgatccacaccggtgaaaagccctacaaatgcgaagaatgcggtaaggccttcaattggtcctccaatttgatggagcataagaaaatccatacgggtgaaaccccctataagtgtgaggagtgcggcaagggatttaaatggtcctctacactgagctatcataagaaaattcacaccgtagagaagccctacaagtgcgaagaatgcgggaaggcctttaaccaaagcgcgattctcatcaaacataagcggattcatactggtgagaaaccctataagtgtgaggagtgtggaaagaccttctcaaaggtcagcacattgaccacacataaagctatacatgccggagaaaagccgtacaagtgtaaagagtgtgggaaaacgttcataaaggtttccaccctaacaactcacaaagccattcatgccggagagaaaccctacaagtgtaaggaatgcggaaaggccttttccaagttcagtatacttactaaacacaaggttattcacacaggggagaaaccatataagtgtgaggaatgtggaaaagcctttaattggtcatccaaccttatggaacataagaggatacacactggagagaagccttacaagtgtgaagagtgtgggaagtccttctcaacattttcggtcttgaccaagcacaaggtcatccataccggggagaagccttataagtgcgaggagtgcggtaaggcgtataagtggtcttccactctgtcttaccataagaagattcacacagtcgagaaaccttacaagtgcgaggaatgcggtaaggcctttaatcggagcgcaattctcattaaacataagcgcatccataccgacgagaaaccctacaagtgcgaggaatgtggcaagacattctcaaaagttagcactctgactacgcacaaagctatccacgcgggagagaagccatacaaatgcaaggagtgtggtaaggctttctctaagttcagcatactgaccaaacataaggttattcacactggagagaagccatataagtgtgaagagtgcgggaaggcgtacaagtggccgtccactctgagttaccataagaagatccatactggcgagaagccatataagtgcgaagagtgtggtaagggcttcagtatgttctccattcttacgaagcatgaggtgatccacaccggcgagaagccttacaagtgcgaggagtgcggcaaggctttcagttggctctccgtcttttcaaagcacaaaaaaactcacgctggggagaaattctacaagtgtgaggcctgtggaaaagcctataatacattttcaattctaaccaaacacaaggttatacacaccggcgagaaaccctacaagtgcgaggaatgtggtaaggctttcaactggtcatctaacctcatggagcacaaaaagatacatactggcgaaacaccatataaatgtgaagagtgtgataaagccttcagctggccatcaagtctaactgagcataaggccacccacgctggggaaaagccttacaaatgcgaggagtgcggaaaagcgttttcatggccttcccggctgactgagcataaggcgacccatgcaggcgaagagccctataaatgcgaggagtgtggcaaggccttcaactggagttccaatctgatggaacataaaaggatacataccggtgaaaaaccttataaatgtgaggagtgtggaaaaagcttcagcacatttagcatcctcactaagcacaaagtgatccatacaggagagaagccatacaaatgcgaagagtgtggcaaagcctacaagtggtcctccaccctctcctaccataaaaagatacacactgtcgagaagccatacaagtgtgaagagtgtggaaagggattcgtcatgttctcgatccttgccaaacacaaggttatccacaccggcgaaaagctgtacaaatgtgaagagtgcggaaaggcctataagtggccctctaccctcaggtatcataagaagatacataccggtgaaaagccctacaagtgcgaagaatgcggaaaggccttttccacctttagcatcctgactaagcacaaggtgatacatacaggagagaaaccatacaagtgcgaagaatgtggaaaggccttttcctggctgtctgtgttttcaaagcacaaaaaaatccatacaggcgtcccaaaccctcccactcataagaagattcacgccggggaaaagttgtataagtag

SEQ ID NO: 141227 - DNA, 1488 bp, Artificial Sequence
  Description of Artificial Sequence: Synthetic coding sequence
atggctgaatcggcacccgcacggcatcggagaaaaagaaggtccacacccttaactagttccaccctcccctcccaggccactgagaaatcttcatatttccagactacagagatctcactctggactgttgtggcagctatccaggcagtcgagaaaaagatggagtcacaggccgcccggctccagtctctcgaggggagaacagggaccgcagagaagaaactcgccgactgtgagaaaatggcagttgagttcggaaaccaactcgagggtaaatgggcggttctggggaccttattgcaggaatatggtctgctacagagaagactcgagaacgtcgagaacctgcttcggaacaggaatttctggatattacggctaccccctgggtccaaaggagaggcaccaaaagtttctcggtccctggagaatgacggcgtgtgcttcactgagcaggagtgggagaacttagaggactggcagaaagagctctataggaacgtaatggaaagcaattatgagaccctggtctcactgaaggtgttgggtcagactgagggcgaagctgagctggggacagagatgctgggtgatttagaggaagaaggacctgggggcgcacatcccgccggcggcgtgatgataaaacaagaactgcagtacacccaggaagggcctgctgatctgcctggcgaattcagctgcatcgccgaggagcaggcctttctatcaccagaacagactgaactttggggcggtcaagggtcatctgtgctccttgagacaggacccggtgattccacgctggaagagccagttgggtcacgtgtccccagttccagcagaaccgtggggtgccctaagcaaaaatcacacagacaggtgcaactggaccaggagtgcggacagggcctgaaactgaagaaagatacttctcgcccctacgagtgctccgagtgcgaaattactttccggtacaagcagcagctcgccactcatctgagaagccactctggatgggggtcgtgtactcctgaagagcctgaagagtctttgcgtcctagacccagactgaaacctcagactaaaaaggcaaagctccaccaatgtgatgtctgcctgaggtcctttagttgcaaggttagcctcgtgacccaccagcggtgccacctgcaggagggtccttctgcgggtcagcacgtgcaggaaaggtttagccccaattccctcgtggcactgccaggccatatcccttggagaaagtctcgcagctccctcatttgcgggtattgcggcaaatccttctcgcacccatctgatctcgttcgtcaccagcggattcacactggtgaacggccatacagctgcaccgagtgtgaaaagtctttcgtgcaaaaacaacatcttcttcagcatcagaagatccatcagagggaaaggggcggcttggccctcgagccagggcggccaaacggtttgttgtag

SEQ ID NO: 141228 - DNA, 1380 bp, Artificial Sequence
  Description of Artificial Sequence: Synthetic coding sequence
atggctgcacctctcgaagcccaggaccaagctcctggtgaaggcgagggcttactgatcgtgaaggtggaggatagttcctgggagcaggagtccgcacagcacgaggatggtcgggactcagaagcctgtcgacagagatttcggcagttctgttatggagacgtgcatggccctcatgaagcgttttcacagctgtgggagctttgttgtcggtggttgcgccccgagcttagaactaaagagcagatcctggaactgctggttcttgaacaatttctcactgttcttccaggagagatccagggctgggtccgcgagcaacacccaggatcaggggaggaggctgttgccctggtggaggatctgcagaaacagcctgtgaaggcttggcgccaggacgtcccctcagaagaggcagagcctgaggccgccggacgtggctcccaagctactggccccccccctaccgttggagcacgccggcggccctcggtgcctcaggagcagcattcccatagcgcgcagccaccggccctcctaaaagaaggtaggccaggagagacgactgatacatgttttgtgtccggggtccacggacccgtggcccttggtgacattccattctatttctctagagaagagtggggcactttggacccggcccagagggatctcttttgggacataaagagagaaaattccagaaatacgactttggggttcggtctgaagggacagagcgaaaagtcactgttacaggaaatggtgccagtcgttccaggtcagactggtagcgacgtaacagtctcttggtcaccagaagaagccgaggcttgggaatctgagaataggccacgtgccgccctcggccctgtcgtgggagctagaaggggccggccaccgacccggcgaagacagttcagagatctggctgcagagaagccacactcttgcggccaatgcgggaaacgctttaggtggggtagcgatctggctagacatcagcgaacccatacaggcgagaagccgcataaatgtccggaatgtgataaatctttccgaagctcctcggacctggtcagacatcagggtgtacacacaggcgagaagcccttcagctgcagcgagtgcgggaagagtttctccaggtcggcctaccttgctgatcatcagagaatccacacaggggaaaagccttttggttgctctgactgcggaaaatccttctctcttagatcgtatcttcttgaccaccggcgggttcacaccggagaaaggccattcggctgcggcgaatgcgataagtcctttaagcaaagagcccacctgatcgctcatcagtctttacacgccaagatggcccagccagtcggctag

SEQ ID NO: 141229 - DNA, 906 bp, Artificial Sequence
  Description of Artificial Sequence: Synthetic coding sequence
atgtgccctcgtcggcgcaggaacccaagactccaagcaggggaccctagaccacgcgggctcccaaggcggtggggccacggtggtgggcgactgttccccagatcaagcacagcaatcgcaggccctgttgccctgggtgacatcccattttacttttccagggaagaatggggtactctcgacccagctcagcgggaccttttttgggacatcaagagggaaaatagccgcaacaccacattaggatttggacttaaaggccaaagcgagaagtctctactgcaggaaatggttcccgtggtaccgggacaaaccggcagtgacgtgacagtgtcttggtcccctgaagaggctgaggcatgggagtccgaaaatcggccaagagccgcgcttggtcccgtagtcggggcaagacggggtaggccgcccactcgcaggagacagtttcgagatctagctgccgaaaaaccccattcttgtgggcaatgtgggaaacggtttcgctggggatccgaccttgcccgccaccagcggacacacacaggggagaaacctcacaaatgtcccgaatgtgacaagagcttcaggtcaagctccgacctcgtcaggcaccagggcgtgcatacgggcgaaaagcctttttcatgtagcgagtgcggcaaatcatttagccggtccgcatatctagccgaccatcagcggatccacaccggggagaagcctttcggctgttccgactgcggtaaatctttctccttaagatcctacctgcttgatcatcgtcgcgttcataccggggaaagaccatttgggtgcggggaatgtgataagtcgtttaaacagagggcgcatctgattgctcatcagagcctccatgccaagatggcccagcctgtgggctag

SEQ ID NO: 141230 - DNA, 1821 bp, Artificial Sequence
  Description of Artificial Sequence: Synthetic coding sequence
atggcagtgacttttgaggacgtaacaatcatttttacgtgggaggaatggaaattcttggattcttcccagaaacggttgtaccgagaagtgatgtgggagaattacacaaacgtaatgtccgtcgaaaattggaacgagagctataaatcccaggaagagaagtttagatacttagaatacgaaaacttcagctattggcaggggtggtggaacgccggggctcagatgtatgagaaccaaaactacggggagaccgtgcaaggaacagatagcaaagaccttactcagcaagaccgatcacaatgccaggagtggctgatcctttctacacaggtgccaggatacggcaactacgagctgacgtttgagtctaaatcgctgcgcaacttgaagtataagaactttatgccttggcaatccctggaaaccaaaactacccaggattacggcagggagatctacatgtccggctctcacgggtttcagggcggacggtaccggttgggcatctccagaaagaatctctctatggaaaaggagcagaaactgatagtacaacactcctacataccagtggaagaggcccttccccaatatgtaggcgtgatctgtcaagaggatctattgagggacagcatggaggaaaagtactgcggatgtaataaatgtaaaggcatctattactggaatagtcgttgcgtattccataaacgcaatcagcctggtgagaacttgtgccagtgttccatctgcaaggcgtgtttttcacaacgctcggacctttataggcacccacggaaccacatcgggaaaaaactgtacggctgtgatgaagtggatggtaatttccaccagtcaagtggggttcacttccaccagcgtgttcacataggcgaagtgccctactcctgcaatgcatgcggcaaatcattttcacagatttcaagtctccataaccaccagagggtacacacagaagagaagttctataagattgaatgcgataaagatctctcacggaactcccttctccacattcatcagagactccacatcggcgaaaagccattcaagtgcaaccagtgtggcaaaagcttcaaccgtagctccgttctgcatgtccatcagagggtgcacactggagagaagccatataaatgtgatgaatgcggcaaaggcttctctcaatcatccaacttgagaatccatcaactggtacacacaggcgaaaaatcatataaatgtgaagactgtgggaagggcttcacgcagaggagcaatttacagatccaccagcgagtccataccggcgaaaaaccgtacaaatgtgacgattgcggcaaggacttcagccattcatctgacctgcgcatacaccagagagtgcacaccggagaaaagccttacacgtgtccggaatgtgggaagggattcagcaagtcaagcaaacttcatacccaccagcgggtccatacaggggagaagccttataagtgcgaagagtgcgggaaaggtttctcccagcgttcgcatctcctgatacaccagcgagtgcacacaggggaaaaaccctataaatgccatgactgcggtaagggcttctcgcactcctcaaacctgcacattcatcagagggtccacacgggcgagaaaccttatcagtgtgctaagtgcggcaagggattcagccacagcagtgctctgcgcattcaccaaagagtgcacgccggcgaaaagccttacaaatgccgagagtattataaggggttcgaccacaatagtcacctacataacaaccacaggcgcggcaatctttag

SEQ ID NO: 141231 - DNA, 1821 bp, Artificial Sequence
  Description of Artificial Sequence: Synthetic coding sequence
atggccgtgacttttgaggacgtaacaatcatattcacatgggaagaatggaaatttttggatagttcccagaaacggctgtatcgggaggttatgtgggagaactatactaacgttatgtcagtcgagaattggaacgagtcatacaagtcccaggaggaaaaattcaggtacctggagtacgaaaatttttcttactggcagggatggtggaacgccggagctcagatgtatgaaaaccaaaactacggagagacggtgcaaggcacagacagcaaagaccttactcagcaggacagatcccaatgccaggagtggctcatcctgagtacacaggtgcccgggtacggcaactacgaattgacctttgagtctaaatcgctgcggaacctcaaatacaagaacttcatgccttggcaaagcctggagaccaagactacgcaagattatggtcgtgagatctatatgtccggctcacatggctttcaaggtgggaggtacaggctgggaatttctagaaaaaacctgagcatggagaaagaacagaagctgattgtgcagcattcctacattccagtagaagaggccctgccacagtatgtgggagtgatctgtcaggaggaccttctgcgtgacagtatggaggaaaagtattgcggatgcaacaagtgcaaaggaatttactattggaattctagatgtgtgtttcacaagaggaaccagcccggcgagaacctctgtcagtgcagcatttgcaaggcatgtttcagtcaacggagcgacttgtacagacaccctcggaatcacataggcaaaaaattgtatggttgtgatgaagtggacggaaacttccatcagtcaagcggagtccacttccaccagagggtgcacatcggtgaggtgccgtacagctgcaacgcttgtggaaagtccttttctcagatctcatcccttcacaaccatcagcgagtccatactgaggaaaaattctacaaaatcgagtgcgacaaagatctaagccgcaattcacttctgcacattcaccagaggctacacatcggagagaaaccttttaaatgcaatcagtgcggcaagtcgttcaataggagctctgtgttgcacgtacatcagagggttcacacgggcgagaagccatacaaatgcgatgagtgtggtaaaggattctcccaaagctcaaacctgaggatccatcaactggtccacacaggtgaaaagtcatacaagtgcgaagactgcggcaagggcttcacccagcgatctaacctgcaaatccaccagagggtgcacacaggcgaaaaaccgtataagtgtgacgactgcgggaaagacttctctcactcctcagacctgcggatccaccagcgcgtccacaccggggagaagccgtatacctgtcccgagtgtgggaagggatttagcaagtcaagtaaacttcatacacaccagcgcgtgcataccggcgagaagccctataagtgtgaggagtgtggaaagggattttcacagcgttcacacctgctgatccatcagcgagtccatacgggagagaaaccatacaagtgccatgactgcggcaaagggttctcacatagctcaaatttgcatattcaccagagagtgcacacaggtgaaaagccatatcagtgcgctaaatgtggcaagggcttctctcactctagcgccctgagaatccaccaaagggtgcacgctggagagaaaccatacaaatgccgcgagtattacaagggcttcgaccacaactctcacctccataacaaccaccgccgcggcaatttgtag

SEQ ID NO: 141232 - DNA, 1554 bp, Artificial Sequence
  Description of Artificial Sequence: Synthetic coding sequence
atgcagccactaagtaagcttatggccatttcaaagcccaggaacctcagtttgagagagcagcgcgaagtgctgcgcgcagatatgtcctggcagcaggaaacaaacccagttgttgaaacgcacgacagtgaggcctcacgacaaaagttcagacacttccagtatctgaaggtttccggacctcacgaggcgttatcccaactgtgggaactctgcctgcagtggcttcgtccagagatccacaccaagaaacagataatcgagctcctagtgctagaacagtttctggctatccttcccgaagaggtcaggacgtgggtaaatctccagcatcctaacaactctaaggacatggtgaccttgattgaagacgtcatagaaatgctggaggacgaggacatgccctgcaaggatagtgccctccaaatgggcagcataaaagagaaaatgaaagcaggatctagaaccggtaagccccaggagccagtgaccttcaaggacgttgtggtcgagttttctaaggaggagtggggccagttggattctgccgtgaagaacctgtaccggaacgtgatgctggaaaacttccgaaatctgaactcgctgagaaaggcacatttactctccaagcctttcgagagcttgaagctcgagtctaaaaaaaaacgatggattatggaaaaagaaatcccacgaaagactatattcgatatgaaatccatttctggcgaggagtctagtcatggcgtcattatgaccaggctaaccgagtctggccaccctagcagtgatgcttggaaaggcgaaaactggctatatcggaatcagaaaaaatgggacatcaatctacctcaagaagcgtttatacccgagaccatatacacggaggaggaagattttgagtgtagcgaaaacaagaaatcattcgacatcaacagtgtctccagtatatgtgcgatccaagtgggaatccctagccggaaagggtctcccaagtgtgacaaatttaaaacctatttcaagtttaacctggactcggttggtaaacaacactccgaatacgaatatggcaacgacctgtccctatctactgacatcaggcaccagaaaagccatactaccatgaactcctatgagtgttatcaatgcggcaaagcattttgcagatcatcctcactcatccgacaccagataattcacaccggagagaagccatataaatgtagcgagtgcggaagattctttaatcgtagaactaacttaaccaaacaccaaaagctgcacgcagaagctaaagcttgtacctcgaacaaatgcggaaaagcgttctctaaaagcgaggactctaacaaccccacattacacttcggaaataatttttaccagtgtgttaactgcggcaagtcttttaaccggagctccagcctgatccggcatcagatgatccataccggagagaagcccttcaaatgcaaagagtgcagcaaggcctttaaccgcagttcgaatctggttaaacaccagaaattgcacaccagggacaaatcatag

SEQ ID NO: 141233 - DNA, 1554 bp, Artificial Sequence
  Description of Artificial Sequence: Synthetic coding sequence
atgcagcctctgagtaagctgatggcgatcagcaaaccacgaaatttgagtctgagagaacaacgtgaggtgctccgggccgacatgtcatggcagcaggagacaaaccccgtggtggagacccacgatagtgaggcctctcgccagaaatttcggcacttccagtacctaaaagtcagcgggccgcacgaggccctgtcacaactgtgggagctgtgtttgcagtggctaaggccggaaatacacacgaaaaagcagataatcgagctgcttgtgctggagcaattcctggccatcctgcctgaagaggtgcgtacatgggtaaacttacaacatccaaacaatagtaaggacatggtcacattaatagaggacgtcatcgaaatgctggaagatgaggatatgccgtgcaaagatagtgccctgcagatgggcagcattaaggagaaaatgaaggccgggagcagaacggggaaacctcaggagcccgtgacttttaaagatgtggtggtcgagttttcaaaggaggagtgggggcagctggacagcgccgtaaaaaacctgtatcgcaacgtgatgcttgagaacttccgtaacctcaactccctgagaaaagcccatctgctgtcgaagccattcgaatctttgaagctcgaaagtaagaaaaagcgctggataatggagaaagaaatccctaggaagaccatatttgacatgaagtctatctctggcgaagaatccagccacggggtgattatgaccagactcacagaatctgggcatcctagctcagacgcatggaaaggggagaattggttatacagaaatcagaaaaagtgggatattaatttgccccaggaggccttcatccccgagacgatttacaccgaagaagaggatttcgagtgctcagaaaataaaaagagctttgacatcaactcggttagcagcatctgtgccatccaggtgggcatccccagccggaagggatcccccaaatgtgacaagttcaagacgtactttaaatttaacctcgattccgtgggaaagcagcactccgaatatgaatacgggaatgatctatctctttccactgacattagacaccagaagagtcacaccacgatgaattcttacgagtgttatcagtgtggcaaggctttctgccgctcttcgagcctgatacggcaccagatcattcacacaggcgagaagccttacaagtgctccgagtgcgggaggttcttcaataggagaacaaacctgaccaaacaccagaaactgcatgcagaagccaaagcatgtacgagtaataaatgcggtaaagcatttagtaagagcgaagatagtaataatcctaccctgcatttcggaaataacttttatcagtgtgtgaactgtggaaagagcttcaaccggagtagcagtctgatacgccaccaaatgattcatacaggggaaaagcccttcaagtgcaaagagtgtagtaaagccttcaacagatccagcaacctggtcaagcaccagaagctccacactagagacaagagttag

SEQ ID NO: 141234 - DNA, 915 bp, Artificial Sequence
  Description of Artificial Sequence: Synthetic coding sequence
atgcagccactctcgaaactcatggccatttctaaacccaggaatctcagtctccgggagcagcgagaggtgctgcgggccgatatgtcatggcagcaggaaactaatccagtggtggaaacacatgactccgaggcctcccggcagaaatttcgccacttccagtacctcaaggtctctggtcctcatgaggccctctctcagctctgggagttatgtttgcagtggctacgtcctgaaattcataccaaaaaacaaattatagaactgctggtgctcgagcagtttctggcaattcttcctgaagaagtacggacctgggtcaatcttcaacatcctaacaattctaaagatatggtgacgctcatagaagatgtcattgagatgctggaggatgaggacatgccttgtaaggactcagcgctgcaaatggggtcaatcaaggagaagatgaaggctggcagtcggaccggtaaacctcaagagcccgtgacctttaaggacgtcgtagtcgagttcagcaaagaagaatgggggcaactggactcagcagttaaaaacctgtatcgaaatgttatgttagaaaatttccggaatcttaacagcctgaggaaagcccacttattaagcaagcccttcgagagcctcaaactggaaagcaaaaaaaaacgctggatcatggagaaggagattccaaggaagacaattttcgacatgaagtccatctccggggaggaaagtagccacggggtgattatgaccagactcactgaatctgggcatccaagttccgacgcctggaaagacggggtttctctcctgctgcctcgcctggagtataacgatgctgtctccgcacattgcaatctgcatctgtgggtgcaggtcattctactgccgcaaccaccggaatag

SEQ ID NO: 141235 - DNA, 3147 bp, Artificial Sequence
  Description of Artificial Sequence: Synthetic coding sequence
atgcagtctaaggttacaggcaacatgcccacccagtccctccttatgtatatggacggcccagaagtgattggctcctccctggggtcgcctatggagatggaggacgccctgtccatgaagggtactgcagttgtgccatttagagctacccaggagaaaaacgtgatccaaatcgaggggtatatgcctctagattgcatgttctgttctcaaacattcacacactcagaggatctgaacaagcacgtgctaatgcagcaccggcccactctttgcgaaccagcagttctgagggtggaagcggaatatttatctccgctggataaatcccaggttcggacagaacctcctaaggaaaagaattgtaaggagaacgagttcagttgcgaggtatgcggacagacatttcgggtcgcctttgacgtggagatccacatgagaacccataaagactcctttacatacggctgcaacatgtgcggccgtaggtttaaagagccctggttcctgaaaaatcacatgcgtactcataacggtaagtcaggcgcacggtctaagctgcagcaaggcctcgaatctagccccgccaccattaacgaggtggtgcaggttcacgcggcagagagcatcagcagtccttataaaatatgcatggtgtgcggctttctgttcccaaacaaagaaagtttaatcgaacaccgaaaggtgcacaccaagaaaacagcctttggaacaagtagtgcacagactgactccccgcagggaggaatgccaagcagcagagaggatttcctgcagttatttaacttgcggccgaaatcacaccccgaaaccggcaagaagcccgttagatgcatcccccagctggaccccttcaccacattccaggcctggcagctcgccactaagggcaaagtggccatatgccaggaagtgaaagagtcaggccaggaagggtctaccgataacgacgactcctccagcgagaaggaacttggagaaaccaataaggggagctgcgcggggcttagccaagagaaagaaaaatgtaaacactctcatggggaagctccttccgtagacgcagacccaaaactgccatcgtctaaagaaaaaccaacacattgcagcgagtgtggaaaggcattcaggacttaccaccaactggtcctgcatagccgcgtccacaaaaaagaccgtcgggcaggtgctgagtcgcctactatgtcagtggacggaaggcagcccgggacatgttcacctgaccttgctgcgccacttgacgagaatggcgccgtggaccgaggcgagggcggctcagaggatgggagtgaagacggccttcctgagggcatccatttagataagaacgacgacgggggcaaaatcaaacacctcacctcttcccgcgaatgtagctactgcggcaaattcttcagatccaactactatcttaatatccatctgcgtacacacactggagaaaagccctataaatgcgagttttgcgagtatgcagctgcccaaaagacctctttgcgctaccacttggagcggcaccataaggagaaacagaccgacgtcgccgcagaagtaaagaacgatggaaagaatcaggacacggaagacgccctcttaacagcagactcagcgcagaccaaaaacctgaagaggtttttcgatggggccaaggatgtgactggctctccccctgcaaaacaactaaaggagatgccatctgtgtttcagaacgtactggggtcagcagtgctgtcccccgcccacaaggatacccaggactttcataaaaatgctgcagacgactctgcggataaggtaaataaaaacccaacacccgcctatctcgacctacttaaaaaaagaagcgctgtagaaactcaagcaaacaacctcatatgtcggacaaaagccgacgtgacgcctccccctgatggatcaaccactcacaatttggaggtgagcccaaaggaaaagcaaactgaaactgccgcagactgcaggtaccggccatccgtggactgccatgaaaagcctctgaacctttctgtgggcgctctacacaattgtcctgccatatccctttccaaatccctgattccaagcataacctgtccattttgcactttcaagactttctatccggaagtgctcatgatgcatcagcggcttgaacacaaatataacccggatgtccataagaactgccggaacaagagtctcctccggtctcgtcgcacaggttgcccacctgccttgctgggaaaagacgttccgccactttcaagcttctgcaaacctaaacccaaaagcgctttcccagcacaatcaaaatctctgccatcggccaagggcaagcaatcacctccaggcccaggtaaggcacccctgaccagcgggattgattcctccactcttgcaccctccaatcttaagagtcacagacctcagcagaatgttggtgttcagggcgccgcaaccaggcaacagcaaagtgagatgttccctaaaacctccgtttccccggcacccgacaaaaccaagcgccccgagacaaaactgaagcctttgcccgtcgccccctctcaacctaccctaggaagttcgaatattaacggctcgatagattaccctgctaagaatgacagcccatgggcccctccagggcgcgactacttctgtaacaggtccgccagtaatactgccgctgagttcggggagcccctcccaaaaagactaaagagttcagtcgtcgcactggatgtagaccaaccaggcgcaaactacaggagagggtacgatctcccgaagtaccatatggtgcgcggcattacctctcttctgccccaggattgcgtgtacccttcccaggccctgccccccaaacctcgcttcctatcctctagcgaagtggacagcccaaacgtcctcacagtgcagaaaccatacggcggaagtggcccattgtacacttgcgtgcctgccggctcgcccgccagctcgtcaacattagaaggaaagcgtccagtttcctatcagcacctctctaatagcatggcccaaaaaaggaactatgaaaattttatcggcaacgctcactaccgacccaacgacaaaaagacttag

SEQ ID NO: 141236 - DNA, 3147 bp, Artificial Sequence
  Description of Artificial Sequence: Synthetic coding sequence
atgcagagcaaagtgaccggcaacatgccaacacagtctttactcatgtatatggatgggcccgaagtaatcggatccagcctcggttcaccaatggagatggaggacgctctgagtatgaagggcactgccgttgtgcctttcagagccacgcaagaaaagaacgtgattcagatagaaggctatatgcctctggattgtatgttctgctcacaaacttttacccattcggaggatctgaataagcatgtgttgatgcaacacaggcccaccttgtgtgaacctgccgttcttagagtggaagctgaatatctctcccccctagacaaaagccaggttaggactgaacctccaaaggagaaaaactgtaaagagaatgagttttcttgcgaggtgtgtggacagacgttccgcgtcgcttttgatgtggagatccacatgcgaacccataaggacagtttcacttatggttgcaacatgtgcggtagacggtttaaagaaccctggtttctcaaaaatcatatgaggacacacaacggaaaatccggcgctaggtccaaacttcaacaggggctggaaagttctccggccaccatcaacgaagtagtgcaggtgcacgcagccgagtcaatcagcagcccatacaagatctgtatggtatgtggatttctgttcccaaataaggagtcacttattgaacaccgcaaagttcacactaaaaagaccgctttcggcacttccagtgctcagactgactcacctcagggaggaatgccctcttcaagagaggatttcctgcagttgttcaatttgaggcctaagtcccacccggagacgggaaagaaacccgtccgctgcatccctcagttagatcctttcactacattccaagcttggcagctggcaaccaaaggaaaagtggccatatgccaagaggtgaaagaatctggacaagaaggctcaacagataacgacgacagcagtagcgagaaggagctgggagagaccaacaaaggaagctgtgctgggctcagccaggagaaggaaaagtgtaaacactcccacggcgaggccccatcagtagatgctgacccaaaactgcccagctcgaaagagaagcccactcactgtagcgaatgcgggaaagctttcagaacatatcatcagcttgtgctgcattcacgagtacataagaaagatagacgggccggcgctgagagccccacgatgtccgttgacggtagacagcccggcacctgttctcctgatctggcggccccgctggatgaaaatggtgctgttgaccggggtgaagggggcagcgaggatggctcggaggatggcctgccagaggggatacaccttgataaaaacgacgatggcgggaagatcaaacatctcacttctagccgtgaatgctcatattgcggaaaattcttcagatctaattattatctcaacattcaccttaggacccatactggcgaaaaaccctataaatgtgagttttgtgaatatgcagccgctcagaagacatcgctgcgataccatttggagcgccatcataaagaaaaacagactgacgtggccgcagaggtcaaaaacgatggtaaaaaccaagataccgaggacgccctgctcactgctgactcagcgcaaaccaagaaccttaaacggttcttcgatggcgccaaggacgtgactggaagcccacccgcgaagcaacttaaagagatgccatccgtctttcagaatgttctcgggagcgctgttctttccccagcccacaaagatactcaagacttccacaaaaacgctgctgacgactctgctgacaaggttaacaaaaatcccacaccagcctacctggacctgctgaagaagaggagcgcagtggagacccaggcgaacaatctgatctgccgcactaaagctgatgtcacccctcccccagatgggtccacaacacataatctagaagtgagccctaaggaaaaacagaccgaaaccgctgctgattgtagatatagaccttctgtggattgccacgagaagcccctgaacctgtccgtaggagctctgcacaattgcccagctataagcttgtcaaagtccctgattcctagcattacctgtcctttctgtacattcaagaccttctatcccgaggtgctgatgatgcatcagaggctcgaacataaatataatcccgacgtgcataaaaattgcagaaataagtctctactgaggtcccgccggaccggatgcccccctgcgctcctgggtaaggacgtgccccccctgtctagcttttgcaagcctaaaccgaagagcgcttttccagctcagagtaagagcttaccttccgccaagggaaaacagagtcctcctggaccaggcaaagcaccactcacgtcaggtattgattcttcaaccctcgcgcccagcaacttaaaatctcacaggcctcagcagaacgtgggtgtgcagggtgcagccacacgtcagcagcagagcgagatgtttcccaagacttccgtgtcacctgcgcccgacaagacaaagcggcccgagacaaagctgaagcccctgccggtcgccccgagccagcctacccttgggtctagtaatataaacggaagcattgattatcctgcaaaaaatgattcgccatgggctcctcctgggcgcgattacttctgtaaccgttccgctagtaacaccgctgcagaattcggtgagcctctgccaaaacgcctgaagagcagcgtggttgcccttgacgttgaccagccaggggccaactacaggcgcggatacgatctgccgaaatatcatatggtaagagggatcacaagtctcctgccccaggattgcgtgtatccttcccaggcccttccacccaagcctcgctttctttcatcaagcgaggtggatagtcctaatgtgctcacagtccagaaaccatacggtggtagtgggccgctctatacttgtgtaccagcaggttcccctgccagcagctctaccctggaagggaaaagaccagtgtcgtaccagcatctttctaattccatggcccagaagcggaactacgaaaatttcatcggtaacgctcactacaggccaaatgacaaaaagacctag

SEQ ID NO: 141237 - DNA, 666 bp, Artificial Sequence
  Description of Artificial Sequence: Synthetic coding sequence
atgttcccaaagaccagtgtgtcgccagccccagacaagacgaagcggcctgagaccaaacttaagcctctgcctgtcgctccgagccagccgacgctaggatcttccaacataaacgggagcattgattaccctgctaaaaacgatagcccatgggcgccgcccgggagggactatttctgtaatcggtccgcatcgaacaccgccgccgagttcggtgagcctctgccaaagaggctaaaaagctccgtagtcgctctggacgtggatcagcccggcgctaattaccgacgcggctatgatctgccgaagtaccacatggtccgaggaataaccagtctgctccctcaggactgtgtgtatccgagccaggctctcccacccaagccaaggtttctctctagttccgaggttgacagccctaatgtcctgaccgttcaaaaaccctacggtggctctgggccattgtacacctgcgtgcctgccgggtcaccagcatctagtagcacactcgagggcctaggaggatgccagtgtttactgcccatgaaacttaactttaccagctcctttgaaaagaggatggtaaaagccactgagatttcatgcgactgtacagtgcacaagacgtatgaggagtcggctcgcaataccaccgtggtttag

SEQ ID NO: 141238 - DNA, 288 bp, Artificial Sequence
  Description of Artificial Sequence: Synthetic coding sequence
atgcaaagtaaggtgactgggaacatgccaacccagtccttgttgatgtacatggacggacccgaggtgattggcagctcactgggaagtcctatggaaatggaggatgccctttcaatgaagggcaccgctgttgtcccattcagagcgactcaggaaaaaaacgtcatacagattgaggggtatatgcctctggattgtatgttttgcagccagacctttactcacagtgaggacttaaacaaacatgtcctgatgcagcatagacctaccctgtgtgaaccttag

SEQ ID NO: 141239 - DNA, 2169 bp, Artificial Sequence
  Description of Artificial Sequence: Synthetic coding sequence
atggagggcagcaggccacgagcaccatctggccacttggcaccttcacctcctgctttcgacggagagctcgatctgcagagatacagtaacggacccgctgtgagcgccggcagccttggcatgggggctgtgtcctggagcgagagtcgggctggagagaggcgcttcccttgccctgtatgtggaaagcgcttccggtttaacagcatcctcgcgctgcacctccgagctcatccgggagcgcaggcctttcaatgcccacactgtgggcaccgcgccgcccagagagcactgctcagatctcacttgcggactcaccaacccgaacgacctagatccccggcggcccggctgctcttggaattggaagagcgagctctgctacgtgaagcgagattagggcgagcccgatcttctggtggcatgcaagctacccctgcaactgaagggctcgcaaggccacaggcaccatccagttctgctttccgctgtccatactgcaaggggaagtttcgaacttccgccgaacgggagcgacacctccatatccttcatcggccctggaagtgtgggttatgcagctttggcagttcccaggaggaagagcttctacatcatagtttgacagcccacggggctccggaacgaccattggctgcaaccagtgcggctccccctccacagccacagccccaacctccaccacaaccggagccccgctcggtcccacaacctgaaccagaacctgaacccgagcgagaagcgacccctaccccggctccagcggctccggaggagcctccagctccaccagagttccggtgtcaagtgtgcggccaatcttttacacagtcttggttcctgaaaggccacatgcgaaagcacaaagcatccttcgaccacgcctgtccagtatgtggccgatgctttaaagagccgtggttcctgaaaaatcacatgaaagtgcacgcctccaaattaggccccctcagggctccgggacccgccagtgggccagcccgcgcgccccagcccccagatctcgggcttctcgcctatgagcctctgggacctgcccttttgttggcgccggcccccactcccgcagaaagacgggagccccctagtctgttgggctacttgagccttcgtgctggcgaggggagacctaatggagaaggggctgaacccggtcctggaaggagctttggcggattcagacccctctccagtgcactgcccgcacgggcgcgtcgtcatagggctgaggagccagaggaagaggaagaagttgttgaagctgaggaagagacatgggccagaggacgtagcttggggagtctcgcaagtttacatcccagacctggcgaagggcccgggcactccgcatcggccgccggagcacaagccaggtcaaccgcaactcaggaggaaaacggcctgctggtcggaggaactaggccggagggcggtcgtggcgccaccggtaaagactgccccttttgcggaaagtccttccgcagcgcccaccatctcaaagtacacctgagagtccatacaggtgagaggccctacaaatgcccacattgcgactacgctgggactcagtcaggttccctgaagtaccatctccagcggcaccatcgtgagcaacgttccggcgcagggcccggaccccccccagagccaccccccccgtcccagcgcggtagtgcccctcaatctggagcaaagccttcaccccagcccgcaacctgggtggaaggggcatccagtccacggccccctagttccggtgcaggccccgggtcccgcaggaagcctgccagtcccggccgcaccctgaggaatggcagggggggcgaagctgagccactagacctgtcattacgggccggccccgggggagaggcagggccaggtggtgctcttcacagatgtctcttttgcccgttcgccaccggcgcgccagaactcatggctcttcacctccaggttcaccatagtcgtcgggctcgagggcggagaccaccgcaagcagatgctagcccaccgtacgccagagtgccatccggagagactccgccctctccctctcaggagggagaagaggggagcgggttgagccggcctggcgaggctgggctaggaggccaagagagatag

SEQ ID NO: 141240 - DNA, 2169 bp, Artificial Sequence
  Description of Artificial Sequence: Synthetic coding sequence
atggaaggctctaggccaagggccccctcaggccacttggctccaagccctcccgccttcgacggagaattagatttgcagcgctacagcaacggtcctgccgtgtcagctggttccctcggaatgggagcagtgagctggtccgaaagtcgggctggcgaacgcaggtttccatgtccagtgtgcgggaaaaggtttaggtttaattcgatacttgccctgcacctgagggcccatcctggggcccaagcattccaatgcccgcactgtggtcaccgggctgcccagcgagccctgttgagatcacacctgcgaacgcatcaacccgaacggccaaggagcccagcagcacggcttctactggaacttgaagagagggcactgttgagggaggcaagactaggccgggctcgatcttccggcgggatgcaggctacacccgcaacagaagggctggctcgcccacaggcaccaagcagtagcgcttttcgatgtccctattgcaaaggtaagtttcgcacctcggctgagagggagcgacacctgcatattctgcaccgaccatggaagtgcgggctatgcagctttggcagctctcaggaggaagaacttcttcaccacagtctgactgctcatggggctcccgaaagacccctggcggctacaagcgcagccccaccccctcaaccccaaccccagcctcctcctcagccagagcctcgtagcgtgccacagcccgagccagagccggaacccgaacgagaggcgactccaacacctgccccagcagccccagaggaacctcccgcaccaccagagtttcggtgccaagtctgcggccagtccttcacacagtcctggttcctgaagggtcacatgcgtaagcacaaggcgagcttcgatcatgcttgccccgtgtgcggaagatgctttaaggagccatggtttcttaagaaccatatgaaagtccatgcctcaaagttgggtccccttcgcgcccccggccccgctagtggccccgcgcgagccccgcaaccgccagacctggggttgcttgcctatgagccgcttgggccagcgctcctcctggcacccgcccctaccccagccgaaaggagggagcctccttccctgctagggtatttaagcctaagagctggagaagggcggccgaatggtgagggggccgagccgggtcctggcagatctttcggcggcttccggcctctctccagtgccctgcctgccagagctcggaggcatcgtgcagaggaaccggaggaggaggaggaggtcgtggaggctgaggaagagacatgggcccggggcagatctctagggtccctggcctccctccacccgcggcccggcgagggtcctggacattctgctagtgccgccggagcacaggctaggagtacggcgacacaggaagaaaatggtcttctggtgggtggtaccagacccgaggggggtcgcggcgcaacagggaaggactgtcccttctgtggcaaatcctttcggagcgcccatcatctgaaagtgcatctgagagtgcacaccggggagcgtccctacaaatgcccacattgcgattacgccggaacccaatccggatcattgaagtaccacctccaacgtcaccatcgcgagcaaaggtccggcgctggccccggccccccacctgagccacccccgccttcacagaggggttcagccccccagagtggtgcaaagccctcccctcagcccgcgacatgggttgagggtgccagttcgccccgccctccaagctcaggggctggcccagggtcgagacgaaagcctgcatcccccgggagaactctgcgcaatggtcgggggggggaagccgaacctttggatctgtccttacgagcggggcccggtggggaggcgggaccagggggggccctgcaccgctgcctcttctgtcccttcgctactggggcccctgaactgatggcgctacatttgcaagtacatcattcccggagggcccgggggcgacggcccccacaggcagacgctagccctccatatgcccgcgtgcctagcggcgagacccctcctagcccatctcaggaaggagaggagggcagtggcctgtcgaggccaggggaggctggcctgggggggcaggaacgctag

SEQ ID NO: 141241 - DNA, 2169 bp, Artificial Sequence
  Description of Artificial Sequence: Synthetic coding sequence
atggagggctcacggcccagagctccctccggacaccttgcgccgtccccccccgccttcgatggcgaattggacttgcagcgatattctaatgggcccgccgtgtctgctgggagtttgggaatgggagcagtgtcctggagcgaaagccgcgcaggcgagagaaggttcccttgcccagtgtgcggcaagcgattccggtttaattcaattctggccctccatctccgcgcccatcccggcgcccaggcattccaatgtccacactgcggtcacagggcagcacagagggccttgcttcgctctcatctgaggacacatcaaccagaaaggcccagatcaccagcagcgagactgttgctggagcttgaggaacgcgccttactgcgggaggcacgcttaggacgggcacggagtagcggcgggatgcaggcgactccggcgactgaagggttggccaggccacaggccccgtcaagcagtgcttttcgctgcccctattgcaaggggaagttccgcacctctgctgagcgggagaggcacctgcatattctgcatcggccctggaaatgtggcctgtgttcgttcggttcctcgcaggaagaggagctcctgcaccactctttgacagcacatggggctccagaacgtcctctggccgccacaagcgccgctcccccaccccaaccacaaccccagccgcctcctcagcctgagccgcgatccgtaccgcaacccgaacccgagcccgagccagagcgcgaagcgactccaaccccggcgcctgccgctccggaggagccaccggcacctcccgagtttcgctgccaggtgtgcgggcagagtttcacccaatcatggtttctaaaaggccatatgcggaagcacaaggcttcatttgaccatgcttgtccagtctgtggacggtgctttaaagagccttggttcctgaagaatcacatgaaggtgcacgccagtaaactgggaccccttcgcgctcctggtccagccagtggacccgcgcgtgccccccagccaccagacttgggactcctggcctatgagcctctgggtcctgcccttctcctggccccagcacccaccccagcagaacgccgagagccacccagcctgctcggctatctgagtttgagagccggtgaagggagacccaacggggagggggcggagccaggtccaggtaggagcttcggaggcttcagaccactgtcctccgcacttcctgccagagcgagacgtcaccgagccgaggagcccgaggaggaggaggaggtggtggaggctgaggaggagacttgggctagaggtcggtctttgggttctctagccagcctccatcctaggcctggcgagggccctggtcactctgcatcagcagctggggctcaggcgagaagcacagcgacccaggaagagaacgggctcctcgtcggtggcacccgccccgagggtgggcggggtgccacaggaaaagactgcccattctgtggcaaatccttcaggagtgcccaccatctcaaggtgcacctgcgcgtacacaccggcgaaaggccctataagtgtccgcactgcgattacgcaggaacacaaagcggctctctgaagtatcatctgcagaggcatcatcgcgagcagcgttccggcgcaggcccgggccctcctcctgaaccacctccgcctagccagaggggctccgcgccccagagtggggctaagcccagccctcaacccgctacatgggtcgagggggcttctagcccccgcccacccagctcaggagccggtcccggcagcagaagaaaacccgcatcccctggccgtaccttgcgcaatggaaggggcggggaagccgagcccctcgatctctccctcagagccgggccaggtggcgaagcaggacccggaggcgccctgcatcgatgcctgttctgtccctttgcgaccggggccccagagctgatggcgctgcatctgcaggtccatcattccagaagagctagggggagacgccccccacaggccgacgccagcccgccatatgccagggtgcctagcggcgagacccctcccagcccgtcccaggaaggtgaagaggggtcaggactgagtcgccctggagaagctggcctggggggccaggagcgctag

SEQ ID NO: 141242 - DNA, 324 bp, Artificial Sequence
  Description of Artificial Sequence: Synthetic coding sequence
atggagggcagcagaccacgggctcccagtggacatctggcacccagcccgccggccttcgacggagagttagacctgcagcggtattccaacggtcccgctgtgtctgccggcagcctcggaatgggagcggtttcctggtccgagtctcgagccggggaaagacgctttccatgtccagtatgcggtaaacggtttcgattcaactccatcctcgcactccacttgcgagcacatccaggggctcaagccttccagtgtccgcactgtggtcatcgggcagcccagcgtgccttgctgcgaagccacctgcggactcattag

SEQ ID NO: 141243 - DNA, 636 bp, Artificial Sequence
  Description of Artificial Sequence: Synthetic coding sequence
atggagggctctaggcctcgcgcccccagtggtcacttggctcccagtcctcctgcctttgacggggagttggatctgcagaggtattcaaacgggcccgctgtgtccgcaggctcgctcggcatgggagctgtttcttggagcgagtcccgggcaggagaacgaagatttccttgtcccgtgtgcgggaagcgatttcgattcaattcaatcttagccttgcacctgcgcgcccaccccggagctcaggccttccaatgcccacattgcgggcaccgcgccgcccagagggcgctgctccggtcccaccttcgaacacaccagcccgaaagaccccggagccccgccgctaggctgctgctggaactagaagaacgggccctactgcgcgaggctcgcctgggccgagcaagatcctccggcgggatgcaagctacccccgccacagaggggttagctagaccacaggccccatcctctagcgctttcagatgtccatactgcaaaggcaagttccgaaccagtgccgaaagggagcgccatctgcatatcctgcacaggccttggaaatgtggtttgtgtagctttgggtccagccaagaggaagagctgctgcatcactcccttaccgcctag

SEQ ID NO: 141244 - DNA, 96 bp, Artificial Sequence
  Description of Artificial Sequence: Synthetic coding sequence
atggagggaagccgcccgcgggctccttctgggcaccttgcaccatctccacccgcctttgatggcgagctggatctgcagcggtactcaaactag

SEQ ID NO: 141245 - DNA, 336 bp, Artificial Sequence
  Description of Artificial Sequence: Synthetic coding sequence
atggagggctcgaggcccagggctccatccggacatctggctccgtcccctccagcatttgacggggagctcgatctccagcgttacagtaatggtccagctgtgagcgccggatctctgggcatgggtgccgtgagttggtctgagtcacgcgcgggcgagagacggttcccgtgtcccgtttgtggcaagcgcttccggtttaattcaatcctggccctccatctgcgagcacaccctggagcacaggccttccagtgtccccactgtgggcaccgagccgcacagcgtgctttactgcggtctcatctacgaacacaccagccagagaggtag

SEQ ID NO: 141246 - DNA, 675 bp, Artificial Sequence
  Description of Artificial Sequence: Synthetic coding sequence
atgcgcctggccaaacctaaggcaggcatctcgcggagcagctcacaggggaaagcatatgaaaacaaaagaaagacagggcgccagagacagaagtggggcatgacaattaggttcgattcatctttctcaaggctgcgaaggagcttagacgacaagccctataagtgtaccgagtgcgagaagtccttctcacagagttctactctgtttcagcatcagaaaattcatacagggaagaaatctcacaagtgcgccgactgcggaaagtcttttttccagagctctaatctcatccagcatcgccgaatccataccggggagaagccctataaatgcgacgaatgtggggagagctttaagcaaagctccaatctcattcagcatcaacggatccacaccggggaaaagccttaccagtgtgacgagtgcggccgctgtttttcccagtcctcccacctcatacagcaccaaagaacacacacgggagaaaagccgtaccagtgctccgaatgcggcaagtgcttcagccagtcatcccacctcagacagcatatgaaagtgcacaaggaagagaaacctagaaaaacccgaggtaagaacatccgagtcaaaacacatctcccgagctggaaggctggaactggacggaaaagtgtggccggcttgaggtag

SEQ ID NO: 141247 - DNA, 237 bp, Artificial Sequence
  Description of Artificial Sequence: Synthetic coding sequence
atgaccacattcaaggaagcaatgacgtttaaggatgtcgcagttgtctttactgaggaggaattagggctgttagacctggctcaacgaaagctgtaccgcgacgtgatgctagaaaacttcaggaatctgctgtctgtgggtcaccaagcttttcacagagacacattccactttctgagagaggaaaagatctggatgatgaaaaccgcaatacagcgtgaaggcaacagctag

SEQ ID NO: 141248 - DNA, 2124 bp, Artificial Sequence
  Description of Artificial Sequence: Synthetic coding sequence
atgacaactttcaaagaggccatgaccttcaaagacgtggccgtggtgtttaccgaagaggaactcggcttgctggatctcgcgcagcggaagctctatcgggacgtcatgctcgaaaacttccgtaatctgctgtcagtcggtcaccaggcctttcacagggacaccttccatttcctaagggaggagaagatctggatgatgaaaaccgcaatccagagagagggtaacagcggcgacaagattcagacagaaatggagacagtttctgaggcaggcacgcaccaggagtggtcctttcagcagatctgggaaaagatcgcatccgacctaaccaggtcccaggaccttatgatcaatagcagtcagttctcaaaagaaggggacttcccttgccagactgaagccggcctgtctgtcatccacacaagacaaaagtcatctcaaggtaacggctataagccctcatttagcgacgtgtctcatttcgactttcaccaacagctgcattcaggggaaaagtctcacacctgtgatgagtgtggaaagaatttctgttatattagcgcattaagaattcatcaaagagtacacatgggcgaaaaatgttataaatgtgacgtttgtgggaaggaattttcccaatcatcccacctgcagacccaccagagagtccatacaggggaaaaaccgtttaaatgtgtggaatgtggtaaaggtttctctcggcggagcgctctgaatgttcatcataaattacacacaggagaaaagccgtataattgcgaggaatgcggcaaagccttcatacatgatagtcagctgcaagagcaccagagaatacacacaggagaaaaaccgtttaagtgcgatatttgcggaaagagcttctgtgggcggtcccgacttaaccgtcacagtatggtgcatacagccgaaaagcctttccggtgcgatacgtgcgataagagttttaggcagcgttctgcattgaatagtcatcggatgatacacaccggcgagaagccttacaaatgtgaggagtgcggcaagggtttcatctgtcggagggacctgtatacacatcatatggtgcataccggagaaaagccttacaattgtaaagagtgcggtaaatcatttcgttgggccagctgcctgttgaagcatcaacgagtacatagcggcgagaagcccttcaagtgcgaggaatgcggtaaaggattttatacaaatagccaatgctatagccatcagcgaagccacagtggagaaaagccgtataaatgcgtggaatgtggaaagggctataaacggaggcttgacctggattttcatcagagagtccacaccggagagaagttgtacaattgcaaagaatgcggcaagagtttctcccgcgccccttgcttactgaagcacgaaagactccactccggggaaaagccctttcagtgtgaggagtgtggtaagaggtttacccagaactcccacctgcattcccaccagagagtgcacacaggggagaagccctacaaatgcgaaaaatgcggtaaaggatataatagcaagttcaacctcgacatgcaccagaaggtgcacactggcgagaggccatacaattgtaaagagtgtgggaaaagcttcggatgggctagctgtttgcttaagcaccagcggttacacagtggggagaagccctttaagtgtgaggaatgtggaaagcgctttacacagaactctcagctgcattctcaccagcgggtgcacacaggcgagaaaccatataaatgtgatgagtgtggaaagggcttttcatggagtagcacgagactgacgcatcaacggaggcactcacgagagactccgctcaagtgcgagcagcatggcaaaaacattgttcagaactcttttagcaaagtgcaggagaaggtgcattctgtagaaaaaccctacaagtgcgaagactgtggcaaagggtacaatcgtcgcctcaacctggatatgcaccaacgcgtccatatgggggagaagacatggaagtgccgagagtgcgatatgtgtttcagccaggcatctagtctgaggttacaccagaacgtccacgtcggtgaaaagccgtag

SEQ ID NO: 141249 - DNA, 1932 bp, Artificial Sequence
  Description of Artificial Sequence: Synthetic coding sequence
atgctggagaactacgggaatgtggcctcacttgggtttcctctgttaaagcccgcggtgatatcccaactggagggcggtagcgagctcggaggttcctccccgctggccgccggtacgggccttcagggtttacagaccgacatccaaactgacaatgacctcaccaaagaaatgtatgagggtaaggaaaacgtgagctttgagttacagagagacttctcccaagagactgatttctcagaagctagtctgctggagaagcaacaggaagttcactccgctgggaatattaaaaaagaaaagtctaacacaatagatggcactgtgaaagatgaaacatctcctgtggaagaatgttttttttcacagtctagcaactcgtatcagtgccacaccataacgggggagcaaccgagcggctgtaccggcctaggaaaatccatatccttcgacaccaagctggtgaaacacgaaattataaacagtgaggaacggccctttaaatgcgaggaactggttgagccctttagatgtgacagtcaactcattcaacaccaggagaacaatacagaggagaagccctatcagtgttcagagtgtggcaaggccttcagcattaatgaaaagctgatttggcatcagaggctccactccggggagaaacccttcaagtgtgtggagtgcggcaagtcattttcctactcgagccactacattactcatcagactattcattctggggaaaaaccctaccagtgcaagatgtgcggaaaggcatttagcgtgaatggaagcctgtccaggcaccagcgcatccacacgggcgagaaaccttatcagtgtaaagagtgtggcaacggcttcagctgctctagcgcctacatcactcatcaacgcgtacatacaggcgaaaaaccctatgaatgcaatgattgcggcaaggcatttaacgttaatgctaaactcatccagcaccagaggattcacaccggagaaaaaccttatgagtgcaacgaatgtggcaagggtttcaggtgctcctctcagctacgtcagcaccagagtattcacactggagaaaagccataccagtgtaaggaatgtgggaagggcttcaataacaatacgaaactgatccagcaccagcggatacacactggtgagaaaccttacgagtgcactgaatgtgggaaggcattttcagtgaaggggaagctgatccaacaccaaagaatccacacgggcgagaagccgtacgagtgtaatgaatgcgggaaagcttttcgctgtaatagtcagttccgccagcatttacgcattcacacaggagagaagccttatgagtgcaacgaatgcgggaaggccttcagcgtaaatggaaagcttatgcggcatcagagaatccacacaggagagaaacccttcgagtgcaatgagtgtgggcgctgttttacctctaagagaaatctgctggaccatcaccgtattcatacgggcgagaagccttatcagtgtaaagagtgcggcaaagcattcagcatcaatgcaaagcttacccggcaccagcgtatacatacaggagagaagccgttcaaatgtatggagtgtgaaaaagcattttcctgctcttcgaactacatcgtgcaccaacgtattcataccggggagaaaccctttcagtgcaaagagtgcgggaaggcttttcatgtgaacgctcacctcattagacaccagcgctcccatacaggcgaaaagccctttcgctgcgtcgaatgcgggaagggtttttcctttagcagcgactatattattcaccaaacggtgcatacatggaagaagccctacatgtgttccgtgtgcggcaaagcatttcgattctcgttccagttgtctcagcaccagtctgtgcattcagaaggcaaaagctag

SEQ ID NO: 141250 - DNA, 1248 bp, Artificial Sequence
  Description of Artificial Sequence: Synthetic coding sequence
tgcgggaaggctttctctattaacgaaaagcttatttggcaccagcggctacattctggagaaaagccatttaagtgtgtagaatgtggtaaatctttcagctacagttcccattacatcacgcaccagacaatacactctggagagaagccctatcagtgcaaaatgtgcgggaaggccttcagcgttaacgggtcgttaagccgccaccagcggatccacaccggtgaaaaaccctatcagtgtaaagaatgtgggaatggcttttcatgttcttccgcctacattacacatcagcgcgtccacacaggcgaaaagccttatgaatgcaatgattgcggcaaagcctttaacgtaaacgctaaattaattcagcaccagaggatccacactggggaaaagccatatgagtgtaacgagtgtggcaaggggtttcgttgctccagtcagctgaggcagcaccagagcatccatacaggggagaagccatatcagtgcaaagagtgtggaaaagggttcaataacaacacaaaactgatccagcatcagcggattcatactggcgaaaagccttatgaatgtaacgagtgcggcaaagcttttcgctgtaacagccagttcagacagcacttaaggattcatacgggagagaaaccttacgagtgcaatgagtgtgggaaagccttctcggtcaacggtaaacttatgcggcaccagcgcatccacacaggggagaagccctttgaatgtaacgaatgcggtcgctgctttacatcaaaaagaaacctgctggaccaccaccgaatccataccggagagaagccctaccagtgtaaggagtgtgggaaagccttttctatcaacgcaaaactcacacgccaccagcgtatccatactggagagaaaccctttaaatgcatggaatgcgaaaaagcttttagctgttccagcaactatatagtgcaccaacgtattcacaccggcgagaaaccattccagtgtaaggaatgcggaaaagcatttcacgtaaacgcccacctgattcgacatcagaggagtcatactggcgaaaaaccgttccggtgtgtagagtgtggcaaaggcttcagttttagctcagattatataatccaccaaaccgtgcacacttggaaaaagccgtacatgtgctcagtgtgtgggaaagcatttcggttttcttttcagctgagccagcaccaatcggtgcacagtgaggggaagtcttag

SEQ ID NO: 141251 - DNA, 1932 bp, Artificial Sequence
  Description of Artificial Sequence: Synthetic coding sequence
atgctagaaaactacggcaatgtcgcctcattgggtttccccctcctcaaacctgcagtcatctcccaactcgaaggagggtctgagctgggtggaagctctcctctagctgcaggaacaggcctgcaaggtctgcagactgacatccagaccgataatgatctaaccaaagagatgtacgaaggtaaagagaacgtatcctttgaattgcagagggacttttctcaagagactgactttagcgaagcttcattgctcgaaaagcagcaagaagttcactctgctggaaacatcaaaaaggagaagtctaacaccatcgacggaaccgtcaaggatgagacaagtcctgtggaggagtgcttcttctctcagtcaagcaattcttatcagtgccataccataaccggggaacagcccagtggatgtactggcctgggcaagtcaatctcttttgatacaaaacttgtgaagcacgaaatcattaactcggaagagaggcccttcaaatgtgaagagctcgttgagcctttccgatgtgattcccaactgatccagcaccaagaaaataatactgaagaaaagccatatcagtgtagtgagtgtggcaaagcattttcgatcaacgaaaaattgatctggcaccagagactccactctggtgagaagcctttcaaatgtgtagagtgtggcaagagcttctcgtacagcagtcactacattacccatcagacaatccacagtggagagaaaccataccagtgtaagatgtgcggcaaagcctttagcgtcaacggctcactgagccggcatcagcgaattcacaccggagagaagccttaccagtgtaaagagtgcgggaatggtttctcctgctcaagtgcttacatcacgcatcagcgcgtgcatacaggcgagaagccctacgagtgcaatgattgcggcaaagctttcaacgtgaacgccaaactgatccagcatcaacgcatccatactggtgaaaaaccatacgagtgtaatgagtgtggaaaggggttcaggtgttcctcccaactgcggcagcatcagtctatccacactggagagaagccctaccagtgtaaagaatgtggcaagggtttcaacaataacacaaagctaatacagcatcagcgaattcataccggagagaaaccctatgagtgtactgaatgtgggaaagccttctccgtgaagggaaagcttattcagcatcagagaattcacacaggggagaaaccctacgaatgcaatgagtgcgggaaggcttttcgttgcaactctcagtttaggcagcaccttcggatccatacaggtgagaagccctatgagtgtaatgaatgcgggaaggcttttagtgtaaacggtaagctgatgaggcaccagagaattcacaccggcgagaagccgtttgagtgcaacgaatgtggtagatgttttacaagcaaacgcaacctcctggatcaccaccggatccatactggggaaaaaccttatcagtgcaaagagtgcggaaaggctttttcaatcaacgctaagctgactcgacaccagcggattcatacaggggaaaagcctttcaaatgtatggagtgtgaaaaggccttctcttgttcatctaactacatagttcatcagaggattcatactggggaaaagccatttcagtgcaaagagtgcggaaaggcgtttcatgtgaacgcccatctgattcgtcaccaaagatcccatacgggagaaaaaccctttcggtgcgtggagtgcgggaagggattctcgttcagctcagactacatcatccatcagaccgtacacacatggaagaaaccttacatgtgtagtgtttgtggtaaggcattccgcttctcttttcagctgagccagcaccagagtgtccacagcgaagggaagtcctag

SEQ ID NO: 141252 - DNA, 1932 bp, Artificial Sequence
  Description of Artificial Sequence: Synthetic coding sequence
atgctggagaattacgggaatgtggcatcccttggtttcccattgctgaagccggctgttatttctcaactggaaggcggatccgaattaggcggtagttctcctttggcggcaggcactggcctgcaggggctccagactgacatacagacagataacgatctgacgaaggaaatgtatgagggaaaagagaacgtttcattcgagctgcagcgggatttcagccaggaaacagactttagcgaagcctctttgctagagaagcagcaggaggttcactccgctggaaatatcaagaaggagaagtccaacactattgatggcacagttaaggatgagacctctcctgttgaggaatgtttctttagtcaatcttccaattcttaccagtgccacactatcacgggagaacagccaagcgggtgtacaggtttgggcaaatctatcagcttcgacaccaaactcgtgaagcacgagattatcaattctgaggaaagaccatttaagtgcgaagagttggtggagccatttagatgcgactcacagttgattcaacaccaggagaacaacacagaggagaaaccatatcagtgctccgaatgcggcaaagccttctcaatcaatgagaaattgatctggcatcaaagactccactctggagaaaaaccctttaagtgcgtcgagtgcggaaagtcattctcgtattcctctcactatattacacaccaaacaatccactccggcgagaaaccgtaccagtgcaagatgtgcgggaaggcctttagcgtgaacgggtccctttctcgtcaccaacgtatccacactggcgaaaaaccctaccaatgcaaagagtgcgggaatggatttagttgtagcagcgcttatattacgcatcagagagtccacacaggcgaaaaaccttacgagtgcaatgattgtggcaaagcatttaatgtaaatgctaaactgatccagcaccagagaatacacacaggcgaaaaaccttatgaatgcaacgaatgtgggaaagggtttcgatgcagctcgcagctgcgacagcaccaatccattcacacaggagagaagccatatcagtgtaaggaatgcggaaagggctttaataacaataccaagctaatacaacaccagcggatccacacaggggaaaagccttacgagtgcaccgaatgcggtaaagccttctctgtgaaagggaaactgatccaacaccagcggatccacaccggtgaaaagccttatgaatgcaacgaatgtggcaaagcttttaggtgcaactctcagttccgtcagcatttaaggattcataccggtgaaaaaccatatgaatgcaatgaatgcggtaaggcatttagtgtgaacggtaagctgatgcgacaccagcgaatccatacgggcgaaaaaccgttcgagtgtaacgaatgtggtcgctgcttcacctcaaaacgcaacctgctcgaccaccacaggatccatacaggcgagaaaccctaccaatgtaaggagtgtggaaaagcgtttagcattaatgccaagctgacccgccaccaaaggattcacactggcgaaaaaccattcaagtgtatggagtgcgaaaaggctttctcctgttctagtaattacatcgttcaccaacgtatccacacgggcgagaaaccctttcagtgcaaagagtgtggcaaggcatttcacgtgaacgcacatctgattcgacatcaaagaagccatactggcgagaaaccttttcgctgtgtcgagtgtggtaagggcttctcattctcgtcagactatattattcaccagacggtgcatacatggaagaagccgtacatgtgctcggtgtgtggaaaagcattcaggttcagtttccagctgtcacagcaccagtccgttcactccgaggggaagtcctag

SEQ ID NO: 141253 - DNA, 1758 bp, Artificial Sequence
  Description of Artificial Sequence: Synthetic coding sequence
atgtacgagggcaaagaaaacgtgagcttcgaacttcaacgcgattttagtcaagaaacagattttagtgaggcctccctactagagaagcagcaagaagttcacagtgcaggcaacatcaaaaaggaaaagtctaataccatcgacggaacagtgaaggacgagacaagccctgtggaggagtgctttttcagccaatcttctaacagttaccagtgtcacactatcaccggagaacaacccagcggctgcactgggcttggcaaatcaatcagttttgacaccaagctcgtgaaacatgagattatcaacagtgaggagcggccattcaaatgcgaggagctggtggagcctttccgttgcgactcccagctcatccaacatcaggagaacaacaccgaggaaaaaccctaccagtgctccgagtgcggcaaggcgttcagcattaatgaaaagctgatttggcatcagaggttacacagtggggaaaaaccatttaagtgcgtggaatgtggcaagtcgttttcctattccagccactacatcactcatcagaccatccactccggtgagaaaccctaccaatgcaagatgtgcggcaaagcttttagtgtgaacggctctctgagccggcaccagcgaatccacaccggtgagaagccgtaccaatgtaaggaatgtgggaacggattctcttgctcctccgcatacattactcaccaaagagtgcacaccggtgagaagccctacgaatgcaatgattgcggcaaggcctttaacgtgaacgctaaactcattcagcatcaaaggatccacacaggggagaaaccatatgaatgtaatgagtgtggaaaggggttccggtgctcttcgcagctgagacagcatcaaagcattcatacaggtgaaaagccctaccagtgcaaggagtgcggcaagggttttaacaacaacacgaagctaatacaacaccagcgtattcacaccggtgagaagccatacgagtgcacggagtgtggcaaggcgttcagtgtaaagggcaaacttattcaacatcagagaatccataccggcgaaaagccatatgaatgtaatgagtgtgggaaggcattcagatgtaattcacaatttaggcaacatctgagaatccacaccggcgagaagccctacgaatgcaatgaatgcggcaaggctttttcagtaaacggaaagttgatgcgccatcaacgtattcacaccggggagaaaccgttcgagtgcaacgagtgcggccggtgttttaccagcaagcgtaacctgctcgaccaccacaggatccataccggggaaaagccctaccagtgcaaggagtgcgggaaggccttcagtataaatgcaaagctcacccgacatcagcgaatccatacaggagagaagccgtttaaatgtatggagtgtgagaaagcgttctcatgttcatctaactatattgtgcatcagcgtatacacacaggggagaagccctttcagtgcaaggagtgtgggaaggcattccatgtgaatgcccaccttatcagacaccaacgctcacataccggagaaaagccttttcgatgtgtggagtgcggcaaagggttttcattttctagtgattacatcatacatcagaccgttcatacctggaagaagccatatatgtgcagcgtgtgcggaaaggcattcagattttctttccagctctcacaacaccagagcgttcacagcgaagggaagtcctag

SEQ ID NO: 141254 - DNA, 1758 bp, Artificial Sequence
  Description of Artificial Sequence: Synthetic coding sequence
atgtatgaaggcaaagagaacgtctcatttgagcttcagagggacttctcgcaagaaactgatttctcggaggcctctctgctggagaaacagcaggaggtgcatagtgccggtaatatcaaaaaagagaagtctaatacgattgatggaacagtgaaggacgagacaagtcccgtagaagagtgttttttttcacaatcctctaattcatatcagtgtcatactattactggagagcagccctcaggatgtacagggctgggaaagtcaatctcctttgatacgaagttggtgaagcatgagatcattaactccgaggagcgacccttcaaatgcgaagaactggttgaaccgttccggtgtgattcacagctcatccagcatcaagagaacaacacagaggagaagccctaccagtgttccgaatgcgggaaagcatttagtattaacgaaaagctgatttggcaccagcggttgcattcaggcgagaagcctttcaaatgcgttgaatgcggaaagagttttagctactcatctcactacatcactcatcagacgattcactctggagaaaaaccttaccagtgcaagatgtgcgggaaggcattttccgtcaacggatctttgtcccggcaccagcgcatccatacaggggagaaaccatatcaatgcaaggagtgcggtaatggtttttcttgttcatccgcctatatcacacatcagcgcgtccacactggcgagaagccatacgagtgtaacgactgtgggaaagcgtttaacgtcaatgctaagctcatccaacatcagcgaattcacaccggcgagaaaccttacgagtgcaatgagtgcggaaaggggtttaggtgttcttcccagctgaggcaacaccagagcatacacactggggagaagccatatcagtgtaaagaatgtggaaaaggatttaacaacaacacaaaactcatacagcaccaaagaatacatacaggcgagaaaccgtacgagtgcactgagtgtgggaaggccttctccgtgaagggaaaactgattcagcaccagcggatccatacaggcgagaagccctatgaatgtaacgagtgtggcaaagcgttccggtgcaactctcaattcagacagcatttgcgcatccacactggtgagaaaccatacgagtgtaatgagtgcggcaaggctttcagcgtgaacgggaaactcatgagacaccagcgtattcacacaggcgaaaaaccatttgagtgcaacgaatgcggaagatgctttacgagcaagagaaacctgctagatcatcaccggattcatacaggggaaaaaccttatcaatgcaaagagtgtggcaaggcgttctcgatcaacgctaagctgacccgtcatcagcgtatccacacaggtgaaaaacccttcaagtgtatggagtgtgagaaagccttctcctgctcttccaactacatcgtgcaccagaggatacacaccggcgagaagccctttcagtgcaaggaatgcggaaaggcctttcacgtgaatgctcacctgattaggcaccagaggtcccacactggcgaaaagccattccggtgtgtggagtgcggaaagggcttcagcttttctagcgactacatcattcaccagacagttcacacatggaagaaaccttacatgtgttctgtgtgcggtaaggctttccgcttcagctttcagctctctcagcaccagtcagttcatagcgagggaaagtcttag

SEQ ID NO: 141255 - DNA, 5538 bp, Artificial Sequence
  Description of Artificial Sequence: Synthetic coding sequence
atggggctctgtggattgctggagcgctgctggctgcaccacgatcctgacggagtgctgacactgaacgccgagaatacgaattatgcatatcaggtaccaaattttcacaagtgcgaaatctgtctactgtccttccctaaggaatcacagttccagcggcatatgagagatcacgagcggaacgacaagccacataggtgcgaccagtgtcctcagacatttaatgtggagttcaatctgacacttcataaatgcactcatagtggagaggaccccacatgccctgtctgtaataagaaatttagcagggtggctagcctgaaagctcacatcatgctgcatgagaaagaggagaatcttatttgttctgagtgcggggacgagttcactctacagagccaattggccgtacatatggaggaacaccgccaggaacttgcaggaacaagacagcatgcatgtaaggcctgcaaaaaagagtttgagacttcctcagagctcaaggagcacatgaagactcattacaaaatcagagtgtcttcaacccggagctacaatcgcaacattgatcgatcagggtttacatactcctgcccacattgcggaaagacattccaaaagccctcacagctgaccaggcacataaggattcataccggggagagaccctttaagtgctccgagtgcggcaaagcgtttaatcagaaaggggctctccagacccacatgataaaacacactggggagaagccccatgcctgcgcgttctgccctgccgcattctcccagaaaggtaacctgcagtcacatgtacagagggtgcattctgaagtaaaaaatggacctacatacaactgcactgagtgttcatgcgtgttcaagtctctcggcagccttaatactcatatctctaagatgcacatggggggtcctcagaattcaaccagttcaacggaaacagctcacgtgctgacggctacattattccagacgctgccattacagcaaacagaggcccaggccaccagcgccagcagtcagccatccagccaagccgtgagcgacgtaattcagcagctgttagaattgtccgaaccggcacctgtcgagtctggccagtctccgcagccaggccaacagctttcaattacagtggggattaatcaggatatcctgcagcaggccctcgagaatagtgggctcagttccattcctgccgccgcacaccctaacgatagctgtcatgccaaaactagtgcgccacacgcccagaacccagacgtgtcatctgtgtcaaatgagcaaactgaccctacggatgccgaacaggaaaaggaacaggaaagccccgagaaactggacaaaaaagaaaaaaaaatgattaagaagaagagccccttcctgcctgggtctattcgcgaagagaacggtgtgcggtggcatgtctgcccctactgtgctaaggaattcagaaagccctccgacttagttcgccatatccgaattcatactcatgaaaaaccatttaagtgtccacaatgcttcagggctttcgcagtgaagtccactttgactgctcatatcaagacacacacaggaattaaggccttcaagtgccaatactgcatgaaatcctttagtacctctggctccctaaaagtacatattaggctccacactggtgtcaggccattcgcatgtccgcattgtgataagaagtttagaaccagcgggcatagaaaaacacacatcgccagccactttaaacatactgagctcagaaaaatgcgacaccagcgaaagccagcaaaggttcgcgtcgggaagactaacatacctgtccccgacatcccgttgcaagagcccatacttataacagatcttggcctgattcagcccatccccaagaatcaattcttccagtcatattttaacaacaacttcgtgaatgaagcagatagaccctataagtgcttctactgtcatcgtgcctacaaaaagagctgccaccttaaacagcacatccgctcccatacaggcgaaaagcctttcaaatgcagccagtgtggtcggggatttgtgtcagctggggtgctgaaggcgcatataaggacccacaccgggctaaagtccttcaaatgtcttatttgtaacggagcattcactaccgggggaagcctgcggcgccacatgggcatccataatgatctgcggccatatatgtgcccctattgtcaaaagactttcaaaacatcactgaattgcaaaaagcacatgaagacccaccggtacgagctagcccaacaattgcagcagcaccagcaggccgcatccattgatgactccaccgtggatcagcaaagcatgcaggcttcaacccaaatgcaggtggaaatcgaatccgacgaactgccgcagaccgccgaagtggtggcagcaaaccccgaggccatgctcgatctggaaccacagcatgtagtgggaacggaggaggccggcttgggccagcaactagccgatcaacccttggaggctgatgaggatggtttcgtggccccacaggatcccctgcgaggacatgtggaccagttcgaggagcaaagtcctgcccagcagagtttcgagcccgcaggtctgcctcagggcttcacagtgactgatacatatcaccagcaaccacagttcccccccgtccaacagctgcaggatagtagtacattggagtcacaagcactatccacctcttttcaccagcagtctctactccaggcaccctccagcgatggcatgaatgtcacaacacgcttgatacaggagtcgtcacaggaagagttagatctgcaagcacagggaagccagttcctggaggacaacgaagaccagagtcgtcgctcgtatcgttgtgattactgcaacaaaggctttaagaagtcttcacatttgaagcagcatgtgagatctcatactggcgagaaaccttataagtgcaagctgtgtgggcggggattcgtgtctagtggcgtattgaagtcccacgagaaaactcacactggtgtaaaggcttttagctgcagcgtttgcaatgcttcattcacaactaatggcagtctgacacgacacatggccacccatatgtcgatgaaaccatataaatgtccattctgtgaggaggggttccggactactgtgcattgtaagaagcacatgaagagacatcagaccgttcctagtgcagtgtccgcgacaggcgagaccgagggcggcgatatttgcatggaagaggaagaggagcattccgacaggaacgcctcccggaagtctcgccccgaagtgatcacgttcacagaggaggagacagctcagctggccaaaattcgcccccaggaatctgcaaccgtcagcgaaaaggtgttggtgcagagtgcggccgagaaagaccgtatcagcgaattgagagataaacaggcagagcttcaggatgagcccaagcatgcaaattgctgtacctattgccccaagtcattcaaaaagccctcagacctggtgagacacgtaagaatccacaccggcgagaaaccatacaaatgcgatgaatgtggcaaatctttcactgtgaagtccaccttggactgccacgttaaaacacacacaggccagaagttgttttcctgccacgtctgttccaacgccttctccactaaggggtccctcaaggtccatatgcgtttgcacactggcgccaaaccttttaaatgtccccactgtgagctgaggttcaggacatcgggcaggcgtaaaactcatatgcagtttcattacaagccagaccccaaaaaggcccgcaaaccaatgacaagatcctcttcagaaggcctgcagccggtgaacctgcttaacagctcttcaactgaccctaatgtgtttatcatgaacaactccgtcctgacgggccagttcgatcaaaacctcctccagccaggcctggtgggccaggccatactgcccgcctcagtgagcgccgggggtgatctaacagttagtttaactgatggatcccttgcgaccctggaaggcattcaactgcaattggccgcaaatctcgtgggacctaatgtgcagatcagcggaatagacgccgctagcatcaacaacatcactttgcaaatcgatccctcaattttacagcagactttacagcaaggaaacctgctcgcccaacagctgacaggagagcctggactggcaccccagaatagttcactgcagaccagcgatagtacagtaccggctagcgtcgtcattcaacccattagtggtctatcgctgcagcctactgttacaagcgcgaacctgaccattggtcccctgtcagagcaggatagcgtcctgacgaccaactcgagcggcacccaggatctgactcaagtaatgactagtcaagggctagtctcccccagtggaggaccccacgaaatcacccttacgataaacaatagctccctgtctcaagtgcttgcccaggccgcaggacccacagccacgtcctcctccgggtcaccccaggagatcacactcactattagcgaattgaacactacaagcgggtccctgccttctacaacgccgatgtcgccgtcggccattagtactcaaaatctggttatgtcttcatcaggcgtaggcggcgacgccagcgtgactctgaccttggctgacacacaggggatgttgtcgggagggctggacacggtgacgcttaacatcacttcccaggggcaacagtttccagcccttctaactgatcccagcctcagtggacagggtggagccgggagcccccaggtgattctagtgagccatacaccacagtccgcgtcagccgcttgcgaggagattgcctaccaggttgctggcgtctccgggaaccttgcacctggtaatcagccggaaaaagaaggcagagctcaccagtgcttggagtgcgaccgggcgttctcctccgccgccgtgcttatgcaccattccaaggaggtgcacgggcgtgagcgcatacacggctgtcctgtgtgcagaaaagctttcaaacgggccacccacttgaaagagcacatgcagacgcatcaggccgggcccagcctgagcagtcagaagccacgggtgtttaagtgtgacacgtgcgaaaaggcctttgctaagccatcccagctcgaaaggcacagtagaattcatactggcgaacgccctttccattgtaccctttgcgagaaggcatttaaccagaagagtgccctgcaggtgcatatgaagaaacacacgggcgaaaggccttacaagtgtgcctattgcgttatgggttttacccagaagtctaacatgaaacttcatatgaagagggctcacagctacgctggcgcactgcaagagagcgccgggcacccagagcaggatggggaggagctgagtaggactttgcacctggaggaggtcgttcaggaggcagccggagagtggcaggcactaacccatgttttttag

SEQ ID NO: 141256 - DNA, 4677 bp, Artificial Sequence
  Description of Artificial Sequence: Synthetic coding sequence
atggggctctgtggcttgcttgagaggtgctggctgcatcatgatcctgatggcgttctaacgctaaacgcagaaaacactaattacgcttaccaggtgcctaacttccacaaatgcgaaatctgcctgctctccttccctaaagagagccaatttcagaggcatatgcgggaccacgaaagaaacgacaaaccacatcgctgtgatcaatgccctcagactttcaatgtggagttcaacctcactcttcacaagtgcacgcactcaggcgaagatccaacatgcccagtttgcaataagaagttctctcgggtggcatcgcttaaagcgcacataatgcttcatgagaaagaggagaacctgatctgttcagagtgcggcgatgagttcacgctacagagccagctagccgtccatatggaagagcaccgacaggagctggcaggcacgagacagcatgcgtgcaaagcatgtaagaaggagttcgaaacttcttccgagttaaaagagcacatgaaaacccactacaagattcgagtgagctctactcgctcctacaaccgtaatatcgatagatcaggattcacctactcttgtcctcactgcggtaagacgtttcagaagccttcacagttgactaggcatattcgcatccacactggggagcgtcctttcaagtgctcagagtgcgggaaagccttcaaccagaagggcgctctccagacccatatgataaaacataccggagagaagccccatgcctgcgccttttgcccggccgccttcagtcagaaaggcaacctgcagagccatgtccagcgtgtgcactccgaggtgaagaacggacctacatataattgcacagagtgctcctgtgtctttaaatctctgggctctttaaatactcatatctctaagatgcacatggggggccctcagaatagtacatcatcaacggaaaccgcgcatgtgcttaccgcaacattattccagactctgcctctgcagcagactgaagcacaagccaccagcgccagctctcaaccctcctcccaggccgtcagcgacgttatacagcaactcttagaactgagtgagccagccccagtagagagtggccagagccctcagcctggccagcaactgagcatcaccgtgggaatcaatcaggacatcctgcagcaggcgctggaaaacagcgggttatcatctatcccggccgccgcacacccgaacgattcttgccacgcgaaaacctctgcaccacatgctcagaacccagacgtcagctcagtttccaacgaacagactgatcctactgatgcagagcaggaaaaagagcaagagtcccctgagaagctcgacaagaaggagaaaaagatgattaagaagaaaagcccattcctgcccgggtccatccgtgaggagaatggcgtgaggtggcatgtctgcccttactgcgctaaagagtttcgcaagccaagcgacctggtacgacatatccggattcatacacacgaaaaaccatttaaatgccctcagtgttttagagcattcgcagtgaagtccacactaacagctcacatcaagacacatactgggatcaaagcattcaaatgtcaatactgcatgaagagcttcagcacttcgggctccttaaaggtccacatacgactgcacacaggcgttaggcccttcgcctgcccccattgtgacaaaaagtttcgtacaagcgggcatcgtaagacccatatcgcgagccacttcaaacacacggagctgcggaaaatgcgacaccaacgcaagccagccaaggttagggtgggcaagactaatatcccagtccccgatatacccctgcaggagccaatactgatcactgatttgggtctgatacagcccatacctaaaaatcagttcttccaaagctactttaataacaatttcgtgaacgaggctgatagaccatataagtgcttctactgtcaccgggcgtacaaaaagtcttgccacctaaagcagcacatacgtagccacacgggggaaaagccctttaaatgttctcagtgcggccgcggatttgtatccgctggcgttctcaaggctcatatacggacacacaccggcctgaaatcctttaagtgcttaatttgcaatggcgccttcacaacagggggatcgctgcgcagacacatgggaatccacaacgacctaagaccgtatatgtgcccttactgccagaagaccttcaaaacttcccttaactgcaaaaagcatatgaagacccaccgttatgaactggcacaacaattgcagcagcaccagcaagcagcctctattgacgatagtaccgtcgaccagcaatccatgcaggcctctacacagatgcaagttgagattgagagtgatgaacttccacagactgccgaggtggtagctgcgaatccagaggcaatgctggacctggaaccgcaacatgtggtcggtaccgaggaggccggactaggccagcagttggctgatcagccactggaagcggatgaagacgggttcgtggctccccaggaccctctgaggggacatgttgatcagtttgaagagcagagtcctgcccagcaatctttcgaacctgcgggtctgccacagggttttacagtcaccgacacctaccatcagcaaccacagttccctcccgtgcagcagctgcaagactctagtacacttgagtctcaagccctttcaacctctttccatcagcagtctttgctgcaggcacctagtagcgacgggatgaatgtgacaactagactgatacaggaatcttcccaggaggaactggatctccaggcacaggggagtcagttcctggaggacaatgaagaccaatctcgccggagctatcggtgcgactattgcaacaaaggctttaagaaatcgtcacacctgaagcagcacgttagaagtcatacaggcgagaagccatacaaatgcaaactttgtgggcgcggatttgtctcaagcggcgtcctgaagtcgcatgaaaaaacccacaccggggtcaaggccttctcatgtagcgtgtgtaacgcctcatttactacaaatgggtcactcacacggcacatggcaacgcacatgtctatgaagccttataagtgtcccttctgcgaagaagggttccgcacaactgtgcattgtaaaaagcatatgaaaagacatcagaccgtgccatccgctgtttcagcaaccggtgaaaccgagggaggggacatctgcatggaggaggaggaggagcactcggatcgcaatgcaagcaggaaaagtaggcctgaggtgataaccttcacagaggaggagactgcccagctcgccaagatcagaccacaggagtccgccaccgtctccgaaaaggtcctggttcagtcggccgcagaaaaggataggatctctgagctgcgagacaaacaagccgaactccaagacgagccgaagcacgcaaactgttgtacctactgcccaaaatctttcaagaagccctctgatctggtccgtcatgtgagaatccacacgggagagaagccttataagtgtgatgagtgtgggaagagtttcaccgttaagtccaccttggattgccacgtcaaaacgcacaccggtcagaaactcttctcttgccacgtgtgctctaacgctttctccaccaagggatctctgaaggtacacatgcggctgcacaccggcgccaagcccttcaagtgtccacactgtgagctgagatttcgcacgagtggcagacggaagacccacatgcagtttcattacaagcccgatccgaaaaaggccagaaaacccatgacacgctcctcctctgagggactacagcctgtgaatctgcttaatagctcttccaccgaccctaatgttttcattatgaataatagtgtcctcactggccagtttgatcagaacctgctccagccgggtctcgtgggtcaggccatcttacctgcatctgtgagcgccgggggggatctgactgttagcctaaccgacggttcactggcgactctcgaaggaattcagctgcaactggctgcaaacttggtggggcccaatgttcagatcagcggcatcgatgccgccagcattaacaatatcaccctacagatcgacccctccatactccagcagactttacagcaaggaaatctgctggcacagcagctgacaggagaacccgggcttgccccccaaaactcttctctccagacatccgactccacggtacctgcaagcgttgtgatccagcctatatctggactgtccttgcagcctacagttacttccgcgaacctcacaattggccctctgtccgagcaggacagcgtgctcacaacaaactcctccggaacccaagatctgacccaagttatgacatcacaggggctggtctccccctcaggcggccctcacgagataaccctgaccatcaacaattcttccctgagccaagtactggcgcaagcagctggcccaactgccacctcttcatccgggtcccctcaggaaatcactctcaccattagcggatcacgatctgtacagcactctgtgggacctcaggagtgtggtagtgtggaagcactatatctggagaattccagcgataagacttag

SEQ ID NO: 141257 - DNA, 4677 bp, Artificial Sequence
  Description of Artificial Sequence: Synthetic coding sequence
atgggcctctgcggactgctggagagatgctggctccaccatgacccagatggggtgctgaccctgaacgcggaaaacactaactacgcctaccaggtgccaaacttccacaagtgtgaaatctgcctgttatcatttcctaaagagtcacagttccaacgccacatgcgggaccacgagcggaacgataagccacatcgttgtgaccagtgcccccagacgttcaatgtggagtttaacctaacgcttcataagtgtactcattcgggagaggacccaacctgccccgtgtgtaacaagaagtttagccgcgtggcttcgttaaaggcacacataatgttgcacgagaaggaggagaatttgatttgttcagaatgcggcgacgagttcactctccaatcgcagctcgcggtccatatggaggaacataggcaagagctggcaggcacccgccagcacgcatgtaaagcatgcaagaaggaatttgagacaagttccgagttaaaagagcacatgaaaacccattacaagattagagtatcttccacccgatcttacaatcggaacatcgatcgtagtggcttcacctactcgtgtccccattgcggcaagacattccagaaacccagccaactgacaagacacataagaatccacaccggcgagagaccctttaaatgcagtgagtgcggcaaagcattcaatcagaaaggagccttacagacgcatatgattaagcacaccggggaaaagcctcacgcctgcgccttctgcccggcagccttttcacagaaggggaacctccagtcacatgtccaacgagtccacagcgaggtcaagaacggcccaacatacaattgtacagaatgttcctgtgtattcaagtcgctggggagtttaaatacgcatatcagcaagatgcatatgggggggccacagaactctacctcctccaccgagacagctcacgtcttgaccgcaacattatttcagactttaccactgcagcagacagaggcccaggcaaccagcgccagcagccaaccgtcttcacaggccgtgtccgacgtgattcagcaactattagaattatctgaaccagcccctgtggagtctgggcagtccccgcagcccggccagcagcttagcatcacggtcggcattaatcaggatatcctgcagcaggcccttgagaattctggtctcagcagcatccctgccgccgcccacccaaatgattcctgccacgccaagacgtccgctccccatgcacaaaatccagatgtgtctagcgtatctaacgaacagacggaccccaccgatgcagagcaggaaaaggaacaggagtcccccgagaaactggataaaaaggagaagaagatgatcaagaagaaaagccccttcctacctggcagcatacgtgaggagaatggcgtgcggtggcatgtgtgcccgtactgtgccaaagagttcagaaaaccctcagacctggtacgacacattcgcatccatacccatgaaaagcccttcaaatgtcctcagtgttttcgcgcctttgcagtgaaaagtacactaaccgcgcatattaaaacccacacagggatcaaagcgtttaaatgtcaatactgcatgaagtcctttagcacttcaggctccttgaaagttcatatcaggctacacaccggggtccgcccatttgcatgcccacactgtgacaaaaaattcagaactagcggacatcgcaaaactcacatagctagtcattttaagcatacagagctcagaaagatgaggcatcagcgaaagcctgcgaaggtgagagtcgggaaaactaacatccccgtgccagatattccgctgcaggagcctatcttaatcacagacttgggacttatacaacccattcctaaaaatcagttttttcaatcttacttcaacaataactttgtcaatgaagcagatcgtccatacaaatgtttctattgccaccgggcttataaaaaaagctgtcacctgaaacagcatatccggtcccatactggagagaagccattcaagtgctctcagtgcggacgggggtttgtcagcgcaggcgtcctgaaggcacatatcaggacgcacacaggccttaagtcattcaaatgtctgatctgcaacggggcattcacgaccgggggctcgttgcgtcgtcacatgggtattcacaacgacctgcggccatacatgtgtccgtactgtcaaaagacatttaagacctccctgaactgcaaaaaacacatgaaaacgcacaggtacgaactggctcagcagctccaacagcatcagcaagctgccagtatagatgactctaccgtggatcagcagtccatgcaagcctccacacagatgcaggtggagatcgagtccgacgaactgcctcagacagccgaagtggtcgctgccaacccagaggccatgctggacttggaaccacagcatgtcgttggtacagaagaagccggcctgggacagcaactggccgaccagccccttgaggcagacgaagatgggtttgtggccccccaggatcccttgagaggccacgttgatcaatttgaagaacaatcccctgcacagcagtccttcgagcctgccgggctgccccagggcttcacggtgactgacacataccatcagcagcctcaattccctccagtgcaacaactccaagactcatctactctcgagagccaagcccttagcacttcttttcatcagcagagcctcttacaggcaccctcaagcgacgggatgaacgtcacgactcgccttatccaggaatcttctcaggaggagctcgatctgcaggctcaaggaagtcagttcctggaggataatgaagaccaaagcagacgcagctacaggtgtgattactgcaataagggcttcaaaaagagttcccatcttaaacagcacgtgcgatcgcacactggcgagaagccgtataagtgcaaattatgtgggcggggatttgtcagtagtggggtgctgaagagccatgaaaagacccatactggcgtgaaggctttctcctgtagtgtttgcaatgctagcttcacaacgaatggtagcctgacacggcatatggctactcatatgtccatgaaaccctataagtgccccttctgtgaagaagggtttcgcactacagtccactgtaagaaacatatgaaacgccatcagactgttccatcagctgtctcagccacaggggagaccgaagggggcgacatttgcatggaggaggaagaagaacactccgaccgaaatgcaagtcggaagagccggccagaggtcattacattcactgaagaggagacagcacagctggctaaaatcaggccacaggagtctgcaaccgtgtcggaaaaagtcctggtccagagtgctgccgagaaggataggattagcgagctgagagataaacaggctgagctacaggatgaacctaaacacgcgaactgctgcacttattgccctaagtcctttaaaaaaccctccgatctggttcgccacgtaaggatccatactggagagaagccctacaagtgtgatgagtgcggtaagtcgtttaccgtcaagtctaccctggactgtcatgtgaagactcacaccggtcaaaaactgtttagctgccacgtgtgctcgaatgccttctctaccaagggttcgcttaaggtgcacatgcgcctgcataccggagcaaaacccttcaagtgcccccactgtgaactaaggttccgtacatcaggaagacgtaagactcacatgcagtttcattacaaacccgatcccaagaaagcaaggaagcccatgacccggagctccagcgagggactgcagcctgttaatctgctgaattcttcgtcaactgatcccaatgtgttcatcatgaataacagcgttctgactggacagtttgaccagaacttgctgcagcctgggctcgtcggtcaggcgatactgcctgcctctgtgagcgccggcggtgacctgacagtgagtctgaccgatggatccctggctacattagaagggattcaacttcaactggcggctaacctagtgggacctaacgtgcagatctccggcatcgatgccgcctctatcaataacatcactctgcagatcgatccctcgattttgcaacagaccctgcagcaaggaaacctcctcgcccagcagttgaccggcgagccaggtctcgcaccacagaactcctccctgcaaacatcagacagcaccgtgcctgcgagtgttgtgattcagcccatctcaggcctttccttacagcctaccgtaacatccgcaaatttaaccattggaccactgagcgagcaggacagcgtacttactaccaactcctcgggaactcaggacttaacccaggtgatgacatcacaggggctggtgtcaccttccggcggccctcatgaaatcacgctcacaataaataactcctcactgtcacaagtattagcccaggccgccggtccaaccgccaccagttcaagcgggagtcctcaagagatcacattgaccattagcggttctcggagtgtgcaacacagcgtgggacctcaggaatgtgggtccgtagaagccctgtatctggagaattcgagcgataaaacttag

SEQ ID NO: 141258 - DNA, 1596 bp, Artificial Sequence
  Description of Artificial Sequence: Synthetic coding sequence
atgtgtcccaaggggtacgaggatagtatggaattcccagatcacagcagacacctattgcagtgcctctctgaacagagacaccagggattcctgtgcgactgtacagtgctggtcggagatgcccagtttcgggcacaccgtgccgtgctcgctagctgctccatgtatttccacctgttctacaaagaccagcttgataaaagggacattgtccatctcaacagtgatattgtgaccgccccggcctttgcacttctgcttgaattcatgtacgagggtaagctgcagttcaaggatctgccaatcgaagacgtattggctgcggcatcatacctgcacatgtacgatatcgtaaaggtgtgtaaaaagaaactcaaggaaaaggctacgactgaagccgatagcacgaagaaggaagaggatgccagcagctgctccgacaaagttgaatctctgtctgatgggtcaagccatattgccggcgaccttcctagtgacgaagatgagggcgaggatgagaagttaaacatcctccctagcaagcgcgacttagcagccgaaccggggaatatgtggatgcgacttccatctgattcagctggaattcctcaagcgggaggagaagccgaacctcacgccacggccgccggtaagacagtggcctcaccctgtagttcaaccgagtcccttagtcagagatctgtgacttcggttcgggacagcgccgatgtggactgcgtacttgacctgtccgtcaagtctagccttagcggcgtcgaaaaccttaactcttcgtactttagttcacaggatgtgctcaggagcaatctagtgcaggtcaaggtagagaaagaggcctcatgtgacgaaagcgacgtggggacaaacgactacgacatggagcattcaactgtgaaagaaagcgtttccactaacaacagggttcagtatgagcctgcacacttggcccccctgagagaagatagcgtgctccgggaactggacagagaagataaagcctctgacgacgaaatgatgacccccgaatccgagcgcgtccaggtggagggagggatggaatcttctttgttaccgtatgtgagcaacattctgagtccagcagggcagatcttcatgtgtccgctttgcaataaagtgttccctagccctcatatcctccaaatacacttaagcacacatttcagagagcaggatggtataagatctaagcctgccgctgacgtgaatgtccctacctgcagcctgtgcgggaagacgttcagctgtatgtatactttaaagagacacgagcgaactcactcaggcgaaaagccctacacctgtactcagtgcgggaaatcgttccaatactcccataacctttcgagacatgcggtggtgcacacacgggagaagcctcacgcgtgcaaatggtgtgagagaagattcacacagtcaggggatctatatcggcatattcgcaagtttcattgcgagctggtgaactccctaagtgtcaagtcagaggccctttctctgccaaccgtgcgggattggacgcttgaagattcatcacaggaactctggaagtag

SEQ ID NO: 141259 - DNA, 1464 bp, Artificial Sequence
  Description of Artificial Sequence: Synthetic coding sequence
atgtgcccaaaaggttacgaggattctatggaattccctgaccactcacgtcacctgctgcagtgtcttagcgaacaacggcaccaggggttcctgtgtgactgcactgtgctcgttggcgacgcacaatttagggctcacagagccgtcttagccagctgctcaatgtatttccatttgttttataaagatcaattagataaaagggacatcgtgcacctgaattctgacatagtaactgctcctgctttcgcattactcctggaattcatgtacgagggtaagctccagtttaaagatctgcctatcgaggatgtcctggctgccgcttcctacctgcacatgtacgacatcgtgaaggtgtgtaaaaaaaaattaaaggaaaaggctaccaccgaagccgattctacaaaaaaggaggaagacgcttcttcttgctcagacaaggtcgaatccctttcagatgggtcttcccacatcgccggagatctccccagcgatgaggacgagggcgaggacgagaagctcaacatactgccctctaagagggatctggcagcggaacctgggaacatgtggatgcggctccccagcgatagcgccggtatcccacaggccggtggagaggcggagccgcacgcaaccgccgccgggaaaacagtggcctcaccctgctctagtacagaatcgctatctcagcgctctgttacatctgtcagggattctgctgatgtagattgtgtgttggatttatctgtgaagtcatctctcagcggggtggagaatttgaacagcagttacttctcttcgcaagacgttctgaggagtaatcttgtgcaggttaaggttgagaaagaagcctcttgtgacgaatctgatgtcggaactaacgactatgacatggagcactcaacagtgaaagaatcggttagcaccaacaaccgcgtccagtacgaacccgcccacttagcccctctgagagaagactccgtactgagggagctcgaccgggaggataaagcctctgatgacgagatgatgacacccgaaagcgagcgcgtgcaggtggaaggcggcatggagagctccctgttgccgtacgtgagtaacatcctgtcaccagcgggccagatctttatgtgccccctgtgtaacaaggttttcccatccccacacatactgcaaattcatctgtcgacccacttcagggagcaagatggaattagaagtaagcccgccgccgacgtgaacgtgccaacctgttccctttgtggaaaaactttctcttgcatgtatacgctcaaacgacacgagcgcacccattccggggagaaaccttacacttgtactcaatgtgggaaatcctttcagtacagccataacctatcccgtctccaggtggtcagggctcaagtgcacgctgttcgtgggccagtccaaacgcactcccaggtgcccctttag

SEQ ID NO: 141260 - DNA, 1377 bp, Artificial Sequence
  Description of Artificial Sequence: Synthetic coding sequence
atggctagcacgatcacgggaagccaggactgtatcgtcaatcataggggggaggttgatggagagccagagcttgacatctcaccatgtcagcagtggggcgaggcctcctctccaatttcccgaaaccgagacagtgttatgacactgcagagcggatgtttcgagaatatcgaaagcgagacctacctccctcttaaggtatcatcacagatcgatacacaggattcctccgtgaaattctgtaaaaacgaacctcaggaccaccaggagtctcgccgtctgtttgtgatggaggagtctacagagcgtaaagttatcaagggggagtcgtgtagcgagaacctgcaggtgaaactcgtcagtgatggtcaggagctggcatcgccactgctcaacggcgaagccacatgtcagaatggacagctgaaggaatccctggaccccatagactgtaattgcaaggacatacacggatggaagagtcaggtagtgtcttgctctcaacagcgcgctcatactgaagagaaaccttgcgatcacaacaactgtggcaagatccttaacactagcccggatggacacccgtatgaaaaaattcataccgccgaaaaacagtacgagtgcagccagtgtgggaagaattttagtcagtcctctgagctcctgctgcaccagcgggatcataccgaggaaaaaccctacaagtgcgaacagtgtggaaagggcttcacaagatcgtcaagtctcttaatacatcaggccgtgcacaccgatgagaaaccatacaaatgtgataaatgtgggaagggatttacacggtcctccagcctacttattcaccacgctgttcatactggggagaagccatacaagtgcgataaatgtggcaaaggcttctcccagtcctccaagttgcatatccatcaacgggtgcatactggagagaagccttatgaatgcgaggaatgtgggatgtctttcagccagcgatctaaccttcacattcaccagagagtgcacaccggggagaggccatacaagtgtggggagtgcggcaaagggttctcccaaagttctaacttgcatatacataggtgtattcacaccggcgagaaaccatatcaatgctatgaatgtggcaaaggatttagtcagtcttctgacttgcgcatccacctgagagtacacaccggtgagaagccttaccattgtggtaagtgcgggaaggggttttcccagtcctcgaaactactgattcaccagcgcgtgcatacaggagagaaaccatacgaatgttccaagtgcggcaagggtttttcccaatccagcaatctgcacatccaccagagagtgcataagaaagacccccgctag

SEQ ID NO: 141261 - DNA, 1377 bp, Artificial Sequence
  Description of Artificial Sequence: Synthetic coding sequence
atggcctccacaatcaccgggtctcaagactgcattgtcaatcaccggggcgaagtggacggcgagcccgaattggacatttcgccgtgccaacagtggggtgaggcaagttctcccatctccaggaaccgcgacagcgtgatgactctacaatctggatgctttgagaacatcgaatcagaaacctacctgcccttaaaggtttcgtcccagattgacacccaagactcatcggtcaagttctgcaagaatgaaccccaggaccatcaggaaagtagacggctgttcgtgatggaagagtctacagagcggaaggtgattaaaggcgaatcatgttctgaaaatctgcaggtgaaattagtgtctgatggacaggagctggcttctcctctcctgaacggggaagcaacatgccagaatggacagctcaaggagagtctggacccgatcgactgtaactgtaaggacatccacgggtggaagtcccaagtggtgtcttgctcccagcaacgggcacacactgaggaaaaaccatgtgatcacaataattgcggtaagatcttaaacacttcccccgatggtcatccatatgagaaaatccatactgccgagaagcaatatgagtgttctcagtgtggaaaaaatttcagtcagagctctgaactgcttcttcaccaacgagatcacacagaggagaagccatataaatgcgagcagtgtggtaaaggatttacacggtcttcctcactcctgatccatcaggccgtgcatacggatgaaaagccctacaaatgtgataaatgcggcaagggcttcacccgctcatcatctctgctcatccatcatgccgtacacaccggggaaaaaccatacaagtgtgataagtgcgggaagggattcagtcagtcctctaagctgcatattcaccaacgagtgcataccggggagaagccctatgagtgcgaagaatgtggcatgtctttttcacagagatcaaacctacatatccaccagcgcgtccatacaggcgagagaccatataagtgcggggaatgcggaaagggcttttctcagtcctcgaacctgcacatccaccgctgcatccatacaggagagaagccataccaatgttacgagtgtggaaaagggtttagccaaagtagcgatttgagaattcatttacgcgtgcacactggggagaagccatatcattgcgggaaatgcgggaagggattctctcaaagctccaagcttctcatccatcagcgtgtgcacacaggggaaaagccgtacgagtgctcaaagtgcggcaaaggttttagtcagtcctccaacctccacatccatcagcgagtccacaagaaagatccccggtag

SEQ ID NO: 141262 - DNA, 1377 bp, Artificial Sequence
  Description of Artificial Sequence: Synthetic coding sequence
atggcctcaacgattacaggttcacaagactgcattgtaaatcaccgcggcgaggttgacggagagcccgagctggatataagtccatgtcagcagtggggcgaggcctcgagccccatctctcgaaacagggacagtgtcatgacactccaatcgggctgttttgaaaacatcgagtccgagacttacttgcccctgaaggtgagtagccagatcgacacccaggacagcagcgtgaagttctgtaaaaacgaaccacaggatcatcaggagtccagacggctgttcgttatggaggaaagtacagagagaaaggttataaagggagagtcctgctcagagaatttgcaggtcaagcttgtgtcggacggacaggagctggcctctcctcttttgaacggcgaagcgacatgccagaacggtcagcttaaggagtccctcgatcctatcgactgcaactgcaaagatatccacggatggaagagccaagtggtgtcctgttctcagcaacgggcgcatacagaggagaagccctgtgatcataataactgcgggaagattctgaatacatctcctgatgggcacccatacgagaaaattcacacagccgaaaaacaatatgagtgttcacaatgtgggaaaaacttttctcaatcctcggaactgctgttacaccagcgggaccatacagaggagaaaccttataagtgtgaacagtgcggcaaaggctttacaagatcctctagtctgctgattcatcaagccgtccataccgacgagaaaccctacaagtgtgataagtgcgggaagggcttcactcgatcatcttctctgctgatccaccacgcagtgcataccggggaaaagccctataagtgtgataaatgcgggaaaggtttttctcaatcgtccaagctgcacatacatcagcgcgtgcacacaggagagaaaccatatgagtgcgaggagtgtggcatgtctttttctcagagatctaacttgcatatacatcagagagtacataccggggaaaggccgtataagtgcggcgaatgcggcaagggcttctcacagtcctcaaacctgcacattcatcgctgcattcacacaggcgagaaaccgtatcagtgctatgagtgcgggaagggcttcagccagagctcagacttgcggatccatttgcgagtgcatacaggtgagaaaccttaccattgcgggaagtgtggaaagggatttagccagtcctccaaactactcatccaccagagagtccacacgggcgagaaaccgtacgaatgctctaaatgcggaaagggattcagccaatcatctaacctgcatattcatcagcgtgtccataagaaagatcccagatag

SEQ ID NO: 141263 - DNA, 1377 bp, Artificial Sequence
  Description of Artificial Sequence: Synthetic coding sequence
atggcaagcacaatcactggtagtcaggactgcattgtgaaccaccgcggagaagtggacggagagcctgaactcgacatatctccctgccagcagtggggagaggcctcttctcccataagtcggaaccgggactctgtgatgacccttcaaagcggatgctttgagaacatagaatccgagacatatctgcctttgaaggtcagttctcagatcgatacacaggatagttccgtgaaattctgtaaaaatgaacctcaggaccatcaagagtcaaggcgcttatttgtgatggaggagtcaacagaaagaaaggtgatcaaaggtgagagctgctccgagaacctgcaagtgaagctggtgagtgacggacaggaactcgctagtcctcttctgaacggcgaagcaacctgccaaaatggccagctcaaagaaagtctagaccctatcgactgtaactgcaaggacatccacggatggaaaagccaggtggtgagttgctctcagcagagggcccatacagaggagaagccttgcgatcataataattgcggaaaaatattaaatactagccctgacggacacccatatgagaaaattcatacagccgaaaagcaatatgaatgtagccaatgtggcaaaaacttcagccagagctctgagttgctgctccaccagcgcgaccacaccgaggaaaaaccctacaagtgcgaacagtgtggtaaaggttttacacgatcgagctccctcctcatccatcaggcggtccatacagacgagaagccctacaaatgcgataaatgtggaaagggttttacccgcagttccagccttttaattcaccacgctgtccacaccggagaaaaaccctataagtgcgataagtgtggcaagggtttttcacagagttctaagctccacatacaccagagagtgcacaccggagagaaaccatatgaatgcgaggagtgcgggatgagtttttcacaacggtctaacctgcacatccaccagagggtacacactggagagagaccctacaagtgcggggagtgtgggaaaggattttcacaatcaagtaatctccatatacacagatgcatccacaccggagagaaaccgtaccagtgctacgagtgcggcaaggggttctcacagtcaagcgacttacgtattcacctgcgggtgcataccggagagaagccttaccactgtggcaagtgtggtaagggattttcccagtcaagcaaactgttaatccatcagcgagtacacaccggagaaaaaccttacgagtgcagcaaatgcggaaaaggcttcagccagtcatccaatctacatatccatcagcgcgtgcacaagaaggacccaagatag

SEQ ID NO: 141264 - DNA, 1377 bp, Artificial Sequence
  Description of Artificial Sequence: Synthetic coding sequence
atggcttcgactatcaccgggtctcaggactgcatcgtgaatcataggggcgaagtcgatggagagccagaattggatataagcccttgccaacagtggggggaggccagcagtcccatctcccgaaatagggacagtgttatgaccttgcagtcggggtgtttcgagaacattgaaagcgaaacctatctccccctcaaggtcagcagccagattgatacccaggactcaagtgtgaaattctgcaaaaacgagcctcaagaccaccaggaatcccgacgactgttcgttatggaagaatcgaccgagagaaaggtgatcaagggagaatcctgcagcgaaaacctccaggtcaagctggtatcggacggacaagagctcgcctcccctcttctgaacggggaggctacatgtcaaaacggccagctgaaggagtcactggacccaatcgactgtaactgcaaggacattcacggctggaaatcccaagtcgtgagctgctctcagcaaagagcccacactgaggaaaagccgtgcgatcacaataactgcggtaagattctcaacacatcacccgacggccatccttacgaaaagatccacaccgctgagaagcagtacgaatgttcacagtgtggtaaaaatttcagccagtccagcgagttattactccatcagcgcgatcatactgaagagaaaccttataagtgtgaacagtgtggcaaggggttcacaagatcttcttcacttctcatccatcaggccgtgcatacagacgagaagccctacaagtgtgacaagtgcggcaaaggcttcacgcggagctccagcttgctgatccaccacgctgtgcataccggcgaaaagccatacaaatgtgacaagtgcggaaagggctttagccagtccagcaagctgcatatccaccaaagagtgcacaccggcgagaagccttatgagtgtgaggaatgcggcatgagcttctctcaacgcagtaatctgcacattcaccaaagggtgcacactggggagcgtccctataagtgcggcgagtgcggcaagggtttcagccaaagctccaaccttcatatccatcggtgtattcacactggcgaaaagccctaccaatgctatgagtgcgggaaaggattctctcagtcaagtgatctccgcatccatctcagagtccacactggggagaaaccttatcactgcgggaaatgcggcaaaggcttctcccagtctagcaaattgcttatacaccaaagggtccacaccggagagaagccgtacgagtgtagtaaatgcggtaagggatttagccaatccagcaacctgcacatccatcaaagagtccataagaaggatcccagatag

SEQ ID NO: 141265 - DNA, 1107 bp, Artificial Sequence
  Description of Artificial Sequence: Synthetic coding sequence
atgtctgcccaaagcgttgaggaagacagcatcttaatcatccctacccctgatgaagaagagaaaattctaagggttaagttagaagaggatccggacggcgaggaaggatcctccatcccctggaaccacctgcctgaccccgaaattttcagacaacgattcaggcagtttgggtaccaagactcccctggccccagagaagctgtatcacagctgcgcgagctgtgtagactttggcttagaccagagactcacactaaggagcagattctcgagctggtagtgctagaacagtttgtggccatcctgccaaaggagctgcagacctgggtgcgggatcatcatcccgagaatggagaagaggccgtaaccgtgctggaagatctggaatccgagctggacgacccgggccagcctgttagcctcagacgaagaaagagggaggtgctcgtggaagatatggtgagccaagaggaggctcagggtcttccatcttctgagctagacgctgttgaaaaccagttgaaatgggcctcctgggaactgcatagcctgagacactgcgacgatgacgggcgcaccgagaatggcgccctcgctcctaagcaggaactaccaagcgccctggaaagccatgaggtaccggggactctgaacatgggtgttccccaaatatttaagtacggagaaacatgctttcctaaaggtcgctttgagcggaaacgcaacccctcaagaaagaaacagcacatatgcgacgagtgtggtaaacacttctcccagggctccgctctcattctgcatcagaggattcacagcggtgaaaaaccttatggctgcgtggaatgtggtaaggcattctccagatcgagtatcttggttcagcaccagcgagtacacacaggcgaaaagccttacaagtgcctagagtgtggaaaggcattctcccagaactctgggctgattaatcaccagcggatccatacaggggaaaaaccgtacgagtgcgtgcagtgtgggaaatcctattctcaatcttccaatctgttccgccatcaaagacggcacaatgccgagaaactgctcaacgtggtaaaggtttag

SEQ ID NO: 141266 - DNA, 1107 bp, Artificial Sequence
  Description of Artificial Sequence: Synthetic coding sequence
atgtccgcgcagagcgtggaggaggatagcattctgatcataccaactcctgacgaagaggagaaaatcctgcgcgttaaactggaggaggaccccgacggtgaggagggatcctccatcccgtggaaccacctacccgaccccgagatctttcgccaacgtttcaggcagtttggttaccaggacagccccgggcctagagaggctgtgtctcagctgagggaactgtgtagactgtggctgcggccagagacccatactaaagaacagatcctggagctcgtggtactggaacagtttgttgccatcctcccgaaagagctgcagacatgggttagggaccaccaccctgaaaacggagaggaggcagtgacagtgttagaggacctggagagtgagcttgacgatcccggacagcccgtaagccttcggcggcgaaagcgcgaagtcttggttgaggacatggtgtcacaggaggaggcccaaggactgccaagctcagagctcgatgccgttgagaaccagctgaaatgggcttcttgggagctgcattcattacggcactgtgacgatgacggacgaaccgaaaatggtgctcttgcccctaaacaggagctcccgagcgcactggaaagccatgaggtgccaggcactctcaatatgggggtgccacagatattcaagtacggggagacctgctttcctaaaggcagattcgagcgcaaaagaaacccttctagaaagaagcaacacatctgcgacgagtgcggcaaacattttagccagggtagcgccttgatcctacatcagagaatacactccggggagaaaccatacggttgcgttgaatgtgggaaagccttctctcgcagcagcattttggtacagcatcagagggttcacactggagagaaaccttacaagtgtctggagtgtggcaaagccttttcacagaattcaggcctgatcaaccaccagagaatccacaccggggagaaaccctacgaatgtgtccagtgtggcaaaagttacagtcagtccagtaacctttttagacatcaacgtcgccacaatgccgaaaaactgctgaatgttgtgaaggtgtag

SEQ ID NO: 141267 - DNA, 1371 bp, Artificial Sequence
  Description of Artificial Sequence: Synthetic coding sequence
atgaataagtttcaaggtcccgttacacttaaggacgtcattgtggaatttacaaaagaagagtggaagctgttgacccccgcccagcggacactctacaaggatgtgatgctggaaaactattctcatcttgtttccgttggatatcatgtgaataagcctaacgcggtgttcaagctgaaacagggcaaggaaccgtggatcttagaggtggaattcccacatcgaggttttcctgaggatctttggagcattcacgacctagaggctagatatcaggaatctcaggccggaaattcacgcaacggggaactaaccaagcaccagaaaacacacacaaccgaaaaggcctgtgaatgcaaggaatgcggaaagtttttctgccagaagagtgcattaatagtgcaccagcatacccatagtaagggcaaatcctatgattgcgataaatgcgggaagtccttttcaaaaaacgaggatctgatccgtcaccagaagatccacaccagagacaaaacatatgaatgcaaagagtgtaaaaagattttctaccatctgagtagtttgtcacgacatttacggactcatgccggcgagaagccgtacgagtgcaaccagtgtgagaaaagcttctatcagaagccccatctgacggaacaccaaaagacgcataccggagaaaaaccttttgagtgcaccgaatgtggaaaattcttttacgtcaaggcctatctgatggtgcaccagaaaacccacaccggggagaaaccttacgagtgtaaggagtgcggcaaagctttttctcagaaatcacacctgaccgtccaccagcgcatgcatactggcgagaagccttataaatgcaaagaatgtggcaaattcttcagtaggaactcccatctgaagacccatcagcgatcgcatacaggcgaaaaaccctatgagtgcaaagaatgccgaaagtgcttctaccagaaatctgctcttacggtccaccaaagaacccatacaggcgagaagcctttcgaatgtaataaatgcggaaaaaccttttactacaagagcgacctgaccaaacaccaaaggaaacacacaggggagaagccctacgagtgtaccgagtgcggcaaaagctttgcggttaacagcgtgctacgcctccaccagagaactcacaccggcgaaaaaccatatgcctgcaaagagtgcgggaaatcgttcagccagaagtcgcacttcataatccaccagcgaaagcataccggggagaagccatacgagtgccaggaatgcggcgagacatttatccagaaatcccagcttacagctcaccagaaaacccacaccaaaaaaaggaacgccgagaagtag

SEQ ID NO: 141268 - DNA, 1263 bp, Artificial Sequence
  Description of Artificial Sequence: Synthetic coding sequence
atgctggagaattatagccatttagtttccgtgggctatcatgttaataagccaaacgcagtgttcaagctcaaacagggaaaggagccatggatcctggaagtcgagttccctcaccgaggatttcccgaagatctgtggtccatccatgacttggaggcacgctaccaggaatcacaggctgggaatagccgcaacggtgaactgacaaaacaccagaaaacacacaccaccgaaaaggcctgcgaatgtaaggagtgcggcaaattcttttgtcaaaaatcagctttaatagtgcaccagcacacgcattctaagggcaaaagttatgactgtgacaagtgcggaaaaagctttagtaagaatgaagatctaattaggcaccagaagatccacacccgggacaagacttacgagtgcaaagagtgtaagaaaatattttaccatctgagcagcctttcgcgtcatttgcggactcatgcgggggagaaaccgtatgagtgtaaccagtgtgagaagagtttttatcagaagccacacctcacagaacaccagaaaacgcatacgggggaaaaacccttcgaatgtacagagtgtggcaagtttttttatgtcaaggcctatctaatggtgcatcagaagactcacacaggcgaaaaaccatatgaatgcaaggagtgcggtaaggctttctcacagaagtcccatctgacagttcaccagagaatgcacaccggcgagaagccctacaagtgcaaggagtgcggtaagttcttctctcgcaatagtcacctaaagacacaccagagatctcacaccggggagaaaccatatgagtgcaaggagtgtaggaaatgtttctaccagaagtctgccttgactgtgcaccaaagaacccatacgggagagaaacccttcgaatgtaacaaatgtggaaaaacattctattataaaagcgatctgactaagcaccagcgcaaacacacaggtgagaagccttatgaatgtactgaatgcggcaagtcattcgccgttaattcagtgcttcggctgcaccaacggacacacacaggcgaaaaaccctatgcatgcaaggaatgcgggaaatcattcagccaaaagagtcactttatcatccaccagagaaagcacaccggcgaaaaaccatacgaatgtcaggagtgcggagaaacctttattcaaaagtctcaactgacagcccaccaaaagacccataccaaaaagcgtaacgcagagaaatag

SEQ ID NO: 141269 - DNA, 1500 bp, Artificial Sequence
  Description of Artificial Sequence: Synthetic coding sequence
atggggcctcttcaattcagagacgtcgctattgaattctcactggaagagtggcattgtctggacactgcacagcgcaacctgtaccgcgacgtgatgctggagaactatagaaacctggtcttccttggaatcgttgtaagcaaacccgatctggtgacatgtttggagcaggggaagaaacccctcaccatggagcgtcacgagatgatcgccaagccaccggtcatgtccagccacttcgcccaagatttgtggccggaaaacatacagaacagctttcagattggcatgctgcggcggtatgaggagtgccgccatgataaccttcagctgaagaagggctgtaagtctgtaggagagcacaaagtgcacaagggaggttacaatggtcttaaccaatgcttgactaccacccagaaagagatcttccaatgcgacaagtacggcaaggtgtttcacaagtttagcaattcaaacacctataagacaaggcatacaggtattaacttgtttaaatgcatcatatgtggaaaggcgttcaagagaagttccaccttgactacccataaaaagatccacaccggcgagaagccctacaggtgcgaggaatgtggaaaagccttcaaccagtccgctaatctgactactcacaagcgaattcacactggagaaaagccgtatagatgtgaggagtgtgggaaggccttcaaacaaagttctaacctgactacgcacaagaagatccacactggagagaaaccctacaaatgtgaggaatgtggaaaagctttcaatagatcaaccgacctcacaacacataaaatagtgcacaccggcgaaaaaccttataagtgtgaggagtgcggcaaggctttcaagcatccaagtcacgtgaccacccacaaaaaaatccacacaagggggaagccttacaattgtgaagaatgcggtaaatccttcaaacactgctcaaaccttaccatccataaacgaatccacacgggagaaaaaccttacaagtgcgaggaatgcgggaaagccttccatctgtcctcacatctgaccactcataaaatcctccacacaggggaaaaaccctatcgctgcagggaatgtgggaaggccttcaatcatagcaccactctgttctcccacgaaaaaatccacacaggcgagaagccgtataagtgcgacgagtgtggcaagacttttacatggccaagtattctgagcaagcataaaagaactcatacaggcgaaaaaccctacaagtgtgaagagtgcggaaagtcttttaccgccagtagcacactaacgacacacaagcgcatacacactggagagaagccttataaatgtgaagagtgcggaaaagcattcaattggtcctcagacctaaataaacataaaaagattcacatcgagcggaagccttacattgtaaaaaacgttacagacctactgaatgtcccaccactgcttatctcaatccgctag

SEQ ID NO: 141270 - DNA, 1500 bp, Artificial Sequence
  Description of Artificial Sequence: Synthetic coding sequence
atgggtccgttgcagttccgggacgtagccatagagttttctctggaagaatggcattgtctggacacggctcagaggaacctgtacagagacgtgatgctggaaaattaccgaaatctcgtcttcctcggaatcgtggtcagcaagcctgatttagttacttgcctagaacaaggcaagaagcctctaaccatggagaggcacgagatgattgccaaaccacctgttatgtcaagccacttcgcacaggatctctggcctgaaaacattcagaacagcttccagatcgggatgttgagacggtacgaggagtgtcgtcacgacaacctgcagctcaagaagggatgtaagtccgtcggtgagcacaaggtgcacaagggcgggtacaatggcctcaatcagtgtctgaccaccacccagaaggaaattttccagtgtgacaagtacggcaaggtgtttcacaaattctcaaatagtaatacctataagacaagacacacagggataaacctgttcaagtgcattatatgtggtaaggcctttaaaagatcaagtaccctgacaacgcacaaaaagattcatacaggagagaaaccctaccggtgtgaggaatgtggcaaagccttcaaccagtccgccaacctcacaacccacaaaaggattcatactggagagaagccatataggtgtgaggagtgcggcaaggccttcaaacagagctccaacctgactacccacaagaagattcatactggtgagaaaccgtacaaatgcgaggaatgcggtaaggccttcaacaggtccactgacctgacaacccacaagatcgtgcacacgggggagaagccatacaaatgcgaagaatgtggcaaggccttcaagcatccttcccatgttactacccacaaaaaaatccatactagggggaagccctataactgcgaggagtgcgggaagagctttaaacattgtagcaacctcactatccataaacggatccataccggcgagaagccatacaagtgcgaggagtgcgggaaggcctttcatctctcgtctcatctgaccactcataagatattgcataccggggagaagccttatagatgtcgggaatgcggtaaggccttcaaccattcgaccaccctgttttctcacgagaagatacacacgggagaaaagccatataagtgcgatgagtgcggtaagacctttacgtggccaagtatcctgtccaaacacaagaggacacacacaggcgagaaaccgtataagtgtgaggagtgtggaaaatccttcactgctagctctaccctcaccacacacaagcgaatccacactggagagaagccttataagtgtgaagaatgtgggaaggcctttaattggtcctccgacttaaataagcataaaaaaatccacattgaacgcaaaccatacattgtgaagaacgtcacagatctactgaatgtgcctcctctactgatctcaattcgctag

SEQ ID NO: 141271 - DNA, 276 bp, Artificial Sequence
  Description of Artificial Sequence: Synthetic coding sequence
atgccaggaccccctcgctccctcgagatggggctgctcacctttcgagatgttgcgatcgaatttagtttggaagagtggcagcacctcgacattgcccaacagaatctttatagaaacgtcatgctggaaaactatagaaatttagctttccttggcatcgccgtgtccaagccggatctgattacctgtttggaacagggtaaggagccttggaatatgaaaagacacgaaatggtggatgaacccccagggctggacttttcattgctgtag

SEQ ID NO: 141272 - DNA, 1725 bp, Artificial Sequence
  Description of Artificial Sequence: Synthetic coding sequence
atgtgccctcatttcgcccaggacctgtggcccgagcagggcatggaagacagctttcagaaagccatcttacgtaggtacggtaaatacggtcacgagaacctacagctgcgcaagggatgtaaatcagtggacgaatataaggtcaataaggaaggctataacggactcaaccaatgcttcaccacagctcagtcaaaggtgttccagtgtgacaagtaccttaaagttttttacaagttcctgaacagcaaccggccaaaaatccggcacactgagaagaagagcttcaagtgcaaaaaaagggtgaagctgttttgtatgctaagtcataagacacagcacaagtctatctaccacagagaaaaatcttacaaatgtaaggaatgtggcaagacattcaactggtcatccaccttgacaaatcaccgtaaaatttacaccgaggagaagccatataagtgcgaggaatacaataaatctccaaaacaattgagcaccctgaccacccatgaaatcattcacgctggcgagaagctatacaaatgcgaggaatgcggggaagcgttcaacaggtccagtaacctgacgactcacaagatcatccacactggtgagaaaccctataagtgtgaggagtgcggtaaggcattcatctggtcctctaccttaactgaacacaagaagattcacacacgcaagaaaccatacaagtgtgaagagtgtggaaaggcatttatttggtcatccaccctaacgaggcacaaaaggatgcatactggtgagaagccttacaagtgtgaggagtgtggtaaggccttttctcagagctcgactttgacgacccacaagattattcatacgggcgagaaaaggtataagtgtctcgagtgtgggaaagcttttaaacagctcagtacacttactactcataaaatcattcacgtgggggagaagctgtataagtgcgaggaatgcgggaaagggttcaaccgcagtagcaatctcacaacccataaaatcattcatactggagagaaaccttacaagtgcgaggaatgcggcaaggcattcatctggtcctccacacttaccaaacacaagaggattcacacaagggagaagccttacaaatgtgaagaatgcgggaaggcttttatctggagctctacgctgactcgtcacaagcgcatgcacactggtgagaagccctacaaatgtgaagaatgtggcaagtcatttagccaaagcagcacattgaccacccataagataatccacacaggcgagaaaccttacaaatgcgaagagtgcggcaaagctttcaattggagcagcaccctgactaagcacaagattattcacactgaagagaagccctataagtgcgaaaagtgcgggaaggccttcaagcagagctccatcctgacgaaccacaagcgcatccataccggggagaaaccgtataaatgcgaggagtgtggcaaaagttttaatcggtcctctacctttactaagcacaaagtcatccacactggcgtgaaaccatataagtgcgaggaatgtggcaaagccttcttttggagtagtacccttaccaaacacaaacgtatccataccggtgagcaaccatataaatgggaaaagtttgggaaggcgtttaatagatctagccatcttacaacggataaaatcacccactggcgtgaaattttgcaggtgtag

SEQ ID NO: 141273 - DNA, 1980 bp, Artificial Sequence
  Description of Artificial Sequence: Synthetic coding sequence
atgccaggtcctcctagatccctggagatgggcctgttaacatttcgggacgtggcgatcgaattctctctggaggagtggcagcatctcgatatcgcacagcagaatttatacagaaatgtcatgctcgaaaattatagaaatctggcttttttgggtatagctgtctccaaacccgacttgatcacatgccttgaacaaggcaaggagccctggaacatgaagcggcatgagatggtagacgaacctcccggaatgtgtccacacttcgcacaggacctgtggcctgagcaggggatggaggattccttccagaaagcaatcttgcgccggtacggcaagtacggacacgagaaccttcagttacgtaagggatgtaagagcgtggacgaatacaaggtgaataaggagggctacaacggcttaaatcagtgctttacaactgcccaatctaaagtgtttcaatgtgataagtatcttaaagtgttctacaagtttcttaattccaaccgtccaaagatccggcataccgagaaaaagagtttcaagtgcaaaaaacgggtgaagcttttctgcatgctgagccacaagacacaacacaaatctatctatcacagagaaaaaagttataaatgcaaggaatgcgggaaaacctttaactggagctctaccctgaccaatcacagaaagatctacactgaggaaaaaccttataaatgtgaggaatacaataagtctcccaaacagctctcgacgcttacaacacatgaaatcattcacgccggtgaaaagctctataaatgcgaagagtgtggcgaggccttcaatagatcgtcgaacctgacaacccacaagataattcatactggcgaaaagccctacaagtgcgaggagtgcgggaaagccttcatctggtcctccaccctgactgaacataagaagatccataccagaaaaaagccctacaaatgtgaggagtgcggcaaggctttcatctggtcatcgactctgacccggcataaacgcatgcataccggggagaagccttataaatgcgaggaatgtggtaaggccttcagccagtcttccaccttgacaacacacaagatcattcacacaggtgagaagcgttacaaatgtctggagtgcggcaaagctttcaaacaactgagcactctgacaactcacaagatcatacacgtcggcgaaaagctgtataagtgcgaagagtgtggaaaagggttcaacagatcctctaatctaacaactcataagatcattcacactggagagaagccgtataagtgtgaagaatgtggaaaagctttcatctggtctagtaccctgacaaaacataaacgaattcatacacgagagaagccatataagtgcgaagaatgcggcaaggcctttatttggtcatctaccctaactcggcataaacgcatgcacacgggcgaaaaaccctacaagtgtgaggagtgtggaaagagtttcagccagagcagcaccctcactactcacaagattatccacacaggcgaaaagccctataagtgtgaagagtgtggcaaggcttttaactggagctctacactgacaaaacataagattatccataccgaggagaagccttataaatgcgagaaatgtggtaaggccttcaagcaatcttcaattctgactaaccacaaacgaattcacacaggggaaaagccgtataagtgcgaggaatgtggtaagtcattcaaccggtcatccaccttcactaagcacaaggtgatccatacaggcgtgaagccctataaatgtgaagagtgcggaaaagccttcttctggtcgtccaccctcactaaacataagagaatccacacgggtgagcagccatataaatgggaaaagttcggaaaggctttcaatcggtccagccacctaacgacagataaaatcacacactggcgtgagattctgcaggtgtag

SEQ ID NO: 141274 - DNA, 1056 bp, Artificial Sequence
  Description of Artificial Sequence: Synthetic coding sequence
atgcccgggccaccgcggtctctcgaaatggggctgttaacgtttagagatgtcgccatagaattcagcctcgaagagtggcagcacctggatattgctcaacaaaatctctatcgtaacgtcatgctggagaactataggaacttggccttcctcggcattgccgtgagtaagcccgacttaattacctgccttgagcagggaaaggaaccctggaatatgaagcggcatgaaatggtggacgagccacccgggatgtgtccacatttcgcacaagacctctggcctgaacaggggatggaggattcatttcagaaggccattttaagaagatatggcaagtatgggcatgagaatctgcagttaaggaaaggttgcaaaagcgtggacgagtacaaagtgaacaaggaggggtataacggactcaatcagtgttttactaccgcgcagagtaaggtatttcaatgtgacaagtatctaaaggtgttctataaattcctgaatagcaatagaccaaagatacggcacaccgagaagaagtcttttaagtgcaagaagcgcgtcaagttgttttgcatgctgtcacacaaaacccaacataagagcatctaccatcgtgaaaagtcttataaatgcaaggagtgcggtaaaacatttaattggtcctctactctgaccaaccacagaaaaatctacaccgaggagaaaccatataaatgtgaagagtacaataaaagtcccaaacagctgtccacactcacaacccacgaaataatccacgccggtgagaaactctacaaatgtgaggagtgcggtgaagccttcaataggtcctctaccttcactaagcacaaggtgatccacactggcgtcaagccatacaaatgcgaagaatgcggcaaggcttttttttggagttcaactctcaccaaacataagaggatccacactggagaacagccctataagtgggagaagtttggcaaggccttcaatagatcatcacacctgacaacggataagattacacattggcgagaaatcttgcaggtttag

SEQ ID NO: 141275 - DNA, 1884 bp, Artificial Sequence
  Description of Artificial Sequence: Synthetic coding sequence
atggccgccgccgagctaaccgcacccgcccagggtatcgtgactttcgaggatgtcgctgtttatttctcctggaaagagtggggcttgctggatgaggcccagaagtgcctgtaccacgatgtgatgctggaaaacctgacgctgactacttccctcggtggctctggtgccggcgatgaggaggccccctaccaacagtctacaagccctcaaagagtgtcacaggtacggatccctaaagccttgccaagcccgcagaaaacgaatccttgtgaaatctgtggccccgtgttgagacagatccttcaccttgtggagcaccaaggcacgcatcacgggcaaaaattatacaccgatggcgcttgtaggaagcagctgcagtttaccgcatacctccaccagcaccaaaaacagcatgttggacagaaacactttagatctaacggggggagggatatgttcctcagctcttgtacattcgaggttagcggtaagccattcacatgtaaggaggtaggtaaggatttccttgtgaggtcacgctttctgcagcagcaagcagcacacaccaggaaaaagtcaaataggacgaagtcggctgtggccttccactccgttaagaaccactataactggggtgaatgtgtgaaagcgttttcatataagcatgtgcgggtgcagcatcagggggacctcatcagggagaggtcttacatgtgctccgagtgcggaaaatctttttcaacctcgtgctctctgagcgaccatctgagggtgcacacatctgaaaagccctacacatgtggggagtgtggaaagtcttatagacagagcagctcgctgattacacatcgcaggattcacaccggggtaagacctcatcagtgtgacgagtgtggaaagctgtttaacaggaaatatgacctgctaatccatcagcgcgtccatacaggggagcgtccctataaatgtagcgaatgcgggaaaagctttagccactcttctagccttattactcaccagagaatacataccggcatgagaccttatgaatgctcggagtgcggtaaaagctttattcactcgtcttccttgattacacaccagcgggtccatactggcacccgtccatatatgtgttctgagtgtggtaagtcattctcgcagtcttgccatctgattaagcaccgcagactccacataggtgagggaccttatgagtgtagcgaatgtggcaagctatttacgtatagatcacgattctttcaacatcaacgggtccatacaggcgtcaggagtcacgagtgtcatgaatgcggaaaactgttctctagaaagttcgatttaatcgtccatgaaagagtccacaccggggagcggccgtacgaatgttctgaatgtggcaaatcgtttacctgcaagtcatatctcatctcccactggaaagtacacaccggggcccgtccctacgagtgtggcgagtgtggcaagtccttcactcactcttccacgctcttacaacaccagcgggtccacactggcgaacggccatacgagtgtaacgagtgtggaaagtttttttcccaatccagtagcctgatccggcatcgacgcagccataccggagagaggccgtatgaatgtagtgagtgttggaagtccttcagcaatcactctagcctggtgaaacacaggagagtccacaccggtgaacggccatacgaatgtagcgagtgcggcaaatcctttagccagtcaagtaatctgactaatcaccagcggatccacagcggtgagcgcccttacgaatgtagcgattgcggtaagtttttcacattcaatagcaacctcctgaagcaccagaatgtgcacaagggctag

SEQ ID NO: 141276 - DNA, 1608 bp, Artificial Sequence
  Description of Artificial Sequence: Synthetic coding sequence
atgggccccctcaccattcgcgatgtcactgtggagttttctttagaagagtggcattgtctggatactgcgcaacagaatttatacagagatgtgatgttagagaactaccgaaatttggtgtttctcgggatcgccgtatccaaacctgatttaattacctgcttggagcaggggaaagaaccctgtaatatgaaacgtcacgagatggtggccaagcctccagtgatgtgttcacacatcgcagaagatttgtgtcctgagcgggacattaaatacttttttcagaaagtcatcctgcggcgctatgataaatgcgagcatgaaaacttgcagctgagaaagggctgtaagtccgtggacgaatgcaaagtctgcaagggaggatataatgggctgaatcagtgccttattacaacacagtccaaaatgtaccagtgcgataaatacgttaaagtcttctacaaattcagcaacagtgacaggcataaaataagacataccgaaaaaaagacctgcaagtgcaaggagtgcggaaaggctttcaaccagtctagcgcgctgactcgccacaagatgacgcatacgggcgagaaaccttataaatgcgaagaatgtgggaaagcattcaataggtcatcccacctaactcagcacaaggtgatccacacacgagaaaagccctataagtgtgaggagtgcgggaaagccttcaaccgcagttcacatataactcagcacaagagaatacacaatcgggagaaacccttcaagtatgatgagtgctgcaaagcattcaaatggtccagtgctcttactacactgactcaacataagcggattcacacgggagaaaagccatataaatgtgaggaatgcggcaaggctttcaaccaaagcagcgcccttaccaggcataagatgattcacacaggagagaaaccattccagtgtgaagagtgtgggaaggcctttaatagatcatctcatttaacccagcacaagatcatacacactaaggagaagccgtacaaatgcgaagagtgtggaaaagcctttaacaggtcctcccacctaactaagcacaaacggatccacacacgtgagaaggcatacaagtgtgacgagtattgcaaagcatttaattggagtagcgccctgaccaccctgacccaacacaagataatccatacgggggaaaaaccctacaaatgtgaagaatgtggtaaagccttcaaccgtagctcctaccttattaggcacaaaattatccatacaggggagaagccgtataaatgcgaagaatgcgggaaggcctttaaccagtcctctcatttgacgcagcacaaaataattcacacaggcgagaagccttacaaatgcgaggagtgcgggaaggcgtttaacaggagcagccatctcagccagcacaagattatccacaccggcgaaaaaccttataagtgtgaagagtgtggaaagccattcaaccggttctcttatctcactgtacacaagcgcattcacgcaggcgaaaaccccaataaatatgaggagtgtggaaaggcatgtaatcactcatctaacctgacgaaacacaattcatag

SEQ ID NO: 141277 - DNA, 1692 bp, Artificial Sequence
  Description of Artificial Sequence: Synthetic coding sequence
atgggtccactcactatcagggatgttacagttgaattctctctcgaggaatggcactgcctagataccgctcagcagaacctgtatcgggatgtcatgctggagaattaccgcaacctcgtctttctcgggattgccgttagcaaacctgacctgatcacatgtttagaacagggcaaggagccttgcaatatgaaaaggcatgagatggtggctaaaccccctgttatgtgttcccatattgcagaggacttgtgccccgaacgcgacattaagtactttttccaaaaggtgattttgaggagatacgacaaatgtgagcacgagaacctgcagttaagaaaggggtgtaagtcggtggacgaatgcaaagtgtgtaaggggggctacaatggtctgaaccagtgccttatcactacgcagtctaagatgtaccagtgcgataaatatgtgaaggtgttctacaaattcagcaatagtgatcgccacaaaatacggcacaccgaaaagaagacttgcaaatgcaaggagtgcggcaaatcattctgtatgttgagtcagcttacacgccataagaggatccatatcagggagaacagtcacaagtgtgaggagtgtggcaaggcctttaaccaaagttctgccctcacgcggcacaaaatgacccacaccggagaaaaaccatacaagtgtgaagaatgtggaaaggccttcaaccggtcttcgcacctgacccagcacaaggtcatccatacaagggaaaaaccttacaaatgtgaagagtgtggaaaggcctttaaccgttcaagccatataacgcaacacaaacggatccacaacagagagaaaccctttaaatacgatgaatgctgcaaagcctttaagtggtcctcagccctcaccaccctgacccagcataagagaattcatacaggagagaagccttacaaatgtgaagagtgcggaaaggcgtttaatcaatcctctgccttgaccaggcataaaatgatccataccggtgagaaaccattccagtgtgaggagtgtgggaaagccttcaacaggagcagtcatctcacgcagcataagattatccatactaaggaaaagccttacaagtgtgaagagtgtggcaaggcctttaataggtcttctcacctgactaaacataagaggatccacacaagggaaaaagcttataaatgtgacgagtactgcaaggcttttaattggtctagcgccctaacaacgttaactcaacacaagataatccacacaggggagaagccctataagtgcgaggaatgcggcaaggctttcaataggagttcctacttaatccgtcacaaaattattcacacaggtgagaagccttataagtgtgaggagtgtggtaaagcttttaatcaaagctcccatttaacccagcacaaaattatccacacaggggagaagccttacaaatgtgaggagtgtggcaaagcattcaatcggtcctcccacctgagccagcacaagattatccatactggagagaagccttacaaatgtgaggagtgtggaaagccttttaaccgattttcttacctgaccgttcacaagcgcatacacgcgggagaaaaccctaataaatatgaagagtgcggcaaagcatgcaatcacagcagtaacctcactaaacacaacagctag
